United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 221

SEQ ID NO: 9156222 - DNA, 22 bp, Homo sapiens
ctgccccagcctggggccttct

SEQ ID NO: 9156223 - DNA, 22 bp, Homo sapiens
ctgcccctcgaccaagcgcgtc

SEQ ID NO: 9156224 - DNA, 22 bp, Homo sapiens
ctgcccctcgaccaagcgcgtc

SEQ ID NO: 9156225 - DNA, 22 bp, Homo sapiens
ctgccccctgctttgtccttga

SEQ ID NO: 9156226 - DNA, 22 bp, Homo sapiens
ctgcccctgccaggcagctgtc

SEQ ID NO: 9156227 - DNA, 22 bp, Homo sapiens
ctgccccagtgccaggcaggtg

SEQ ID NO: 9156228 - DNA, 22 bp, Homo sapiens
ctgcccattcaaccagctacag

SEQ ID NO: 9156229 - DNA, 22 bp, Homo sapiens
ctgcccatctggccacacacag

SEQ ID NO: 9156230 - DNA, 22 bp, Homo sapiens
ctgcccagtttgggagcctttc

SEQ ID NO: 9156231 - DNA, 22 bp, Homo sapiens
ctgcccagtttgggagcctttc

SEQ ID NO: 9156232 - DNA, 22 bp, Homo sapiens
ctgcccaggggagtgctgtcgg

SEQ ID NO: 9156233 - DNA, 22 bp, Homo sapiens
ctgcccaggaaggagaggatgg

SEQ ID NO: 9156234 - DNA, 22 bp, Homo sapiens
ctgcccaggctgaaggaacatc

SEQ ID NO: 9156235 - DNA, 22 bp, Homo sapiens
ctgagccaaaaagcagagcttg

SEQ ID NO: 9156236 - DNA, 22 bp, Homo sapiens
ctgagccaaaaagcagagcttg

SEQ ID NO: 9156237 - DNA, 22 bp, Homo sapiens
ctgaggccgtctgggtctgcag

SEQ ID NO: 9156238 - DNA, 22 bp, Homo sapiens
ctgagcatttgccggagcgtca

SEQ ID NO: 9156239 - DNA, 22 bp, Homo sapiens
ctgaggccgttggtgggcctta

SEQ ID NO: 9156240 - DNA, 22 bp, Homo sapiens
ctgagcatgctacatgcagcac

SEQ ID NO: 9156241 - DNA, 22 bp, Homo sapiens
ctgagcatggccggtccatggt

SEQ ID NO: 9156242 - DNA, 22 bp, Homo sapiens
ctgagccaaaaagcagagcttg

SEQ ID NO: 9156243 - DNA, 22 bp, Homo sapiens
ctgaggcctggtgaggtggtga

SEQ ID NO: 9156244 - DNA, 22 bp, Homo sapiens
ctgaggctaacctcgagagaca

SEQ ID NO: 9156245 - DNA, 22 bp, Homo sapiens
ctgaggctggagtgcagtggtg

SEQ ID NO: 9156246 - DNA, 22 bp, Homo sapiens
ctgaggctgcccagggccaggt

SEQ ID NO: 9156247 - DNA, 22 bp, Homo sapiens
ctgaggctctgggtgtcactgt

SEQ ID NO: 9156248 - DNA, 22 bp, Homo sapiens
ctgaggggaaaagtcaggatga

SEQ ID NO: 9156249 - DNA, 22 bp, Homo sapiens
ctgaggggaaaagtcaggatga

SEQ ID NO: 9156250 - DNA, 18 bp, Homo sapiens
ctgaggctggcaggagcc

SEQ ID NO: 9156251 - DNA, 17 bp, Homo sapiens
ctgaggggagtgctgtg

SEQ ID NO: 9156252 - DNA, 17 bp, Homo sapiens
ctgaggggagtgctgtg

SEQ ID NO: 9156253 - DNA, 22 bp, Homo sapiens
ctgagcagggaccaaaagcatt

SEQ ID NO: 9156254 - DNA, 22 bp, Homo sapiens
ctgagcagtctagccaggtgtt

SEQ ID NO: 9156255 - DNA, 22 bp, Homo sapiens
ctgagcagtggttcttgagcgc

SEQ ID NO: 9156256 - DNA, 22 bp, Homo sapiens
ctgagcagcgtggggagctggc

SEQ ID NO: 9156257 - DNA, 22 bp, Homo sapiens
ctgagcaggatattcacagcag

SEQ ID NO: 9156258 - DNA, 19 bp, Homo sapiens
ctgagcagcggcagcactt

SEQ ID NO: 9156259 - DNA, 19 bp, Homo sapiens
ctgagcagcggcagcactt

SEQ ID NO: 9156260 - DNA, 22 bp, Homo sapiens
ctcttctctgcagcctttgaag

SEQ ID NO: 9156261 - DNA, 22 bp, Homo sapiens
ctcttctgtacctcggcctcca

SEQ ID NO: 9156262 - DNA, 22 bp, Homo sapiens
ctcttcttatggccgtggctga

SEQ ID NO: 9156263 - DNA, 22 bp, Homo sapiens
ctgagcactgggcacatagctg

SEQ ID NO: 9156264 - DNA, 22 bp, Homo sapiens
ctcttcttgaaagaggaattca

SEQ ID NO: 9156265 - DNA, 22 bp, Homo sapiens
ctcttctgtacctcggcctcca

SEQ ID NO: 9156266 - DNA, 22 bp, Homo sapiens
ttttgcttatctgagtgcagcc

SEQ ID NO: 9156267 - DNA, 22 bp, Homo sapiens
ttttggaacacagacattagaa

SEQ ID NO: 9156268 - DNA, 22 bp, Homo sapiens
ttggataaaaatgtttaagtgt

SEQ ID NO: 9156269 - DNA, 22 bp, Homo sapiens
ttggataaagaggaagattatc

SEQ ID NO: 9156270 - DNA, 20 bp, Homo sapiens
ttggagtctaaagactgggg

SEQ ID NO: 9156271 - DNA, 22 bp, Homo sapiens
ttggagtcattggcctgggtga

SEQ ID NO: 9156272 - DNA, 22 bp, Homo sapiens
ttggaggtttcccaactgtggg

SEQ ID NO: 9156273 - DNA, 20 bp, Homo sapiens
ttggaggtgcagtgcatgca

SEQ ID NO: 9156274 - DNA, 22 bp, Homo sapiens
ttggaggttattaacactggcc

SEQ ID NO: 9156275 - DNA, 22 bp, Homo sapiens
ctccactcaacaagcccagtgt

SEQ ID NO: 9156276 - DNA, 22 bp, Homo sapiens
ttggatccatctcaggcatagg

SEQ ID NO: 9156277 - DNA, 22 bp, Homo sapiens
ttggatccatctcaggcatagg

SEQ ID NO: 9156278 - DNA, 22 bp, Homo sapiens
ttggaggggccactgcagagct

SEQ ID NO: 9156279 - DNA, 20 bp, Homo sapiens
ttggaaggtggagaagagga

SEQ ID NO: 9156280 - DNA, 23 bp, Homo sapiens
ttggaagggaagagcatttgaga

SEQ ID NO: 9156281 - DNA, 22 bp, Homo sapiens
ttggaagggaacaccatttgac

SEQ ID NO: 9156282 - DNA, 22 bp, Homo sapiens
ttggaaaagtgaaactagatgc

SEQ ID NO: 9156283 - DNA, 22 bp, Homo sapiens
ttggaagcagtgtacactgtac

SEQ ID NO: 9156284 - DNA, 22 bp, Homo sapiens
ttggaaggaattaaggtcatga

SEQ ID NO: 9156285 - DNA, 22 bp, Homo sapiens
ttggaaggagcctaaaagagac

SEQ ID NO: 9156286 - DNA, 22 bp, Homo sapiens
ttggaaggcagcatttgtccat

SEQ ID NO: 9156287 - DNA, 22 bp, Homo sapiens
ctccagagtcatcgagcattcc

SEQ ID NO: 9156288 - DNA, 22 bp, Homo sapiens
ctccagagtcacactgcctggg

SEQ ID NO: 9156289 - DNA, 22 bp, Homo sapiens
ctccagagtcacactgcctggg

SEQ ID NO: 9156290 - DNA, 22 bp, Homo sapiens
ctccagaggttctcatctggga

SEQ ID NO: 9156291 - DNA, 22 bp, Homo sapiens
ctccagaggttctcatctggga

SEQ ID NO: 9156292 - DNA, 22 bp, Homo sapiens
ctccagaggttctcatctggga

SEQ ID NO: 9156293 - DNA, 22 bp, Homo sapiens
ctccagaggttctcatctggga

SEQ ID NO: 9156294 - DNA, 22 bp, Homo sapiens
ctccagaggttctcatctggga

SEQ ID NO: 9156295 - DNA, 22 bp, Homo sapiens
ttggctctgatggggatcagga

SEQ ID NO: 9156296 - DNA, 20 bp, Homo sapiens
ttggctctgatcagtggagc

SEQ ID NO: 9156297 - DNA, 22 bp, Homo sapiens
ctccagaggtccccgcggcact

SEQ ID NO: 9156298 - DNA, 22 bp, Homo sapiens
ctccagagggtcagactctgag

SEQ ID NO: 9156299 - DNA, 22 bp, Homo sapiens
ctccagaggcgacttgcatcac

SEQ ID NO: 9156300 - DNA, 22 bp, Homo sapiens
ctccagaggatgcaggtgaggg

SEQ ID NO: 9156301 - DNA, 22 bp, Homo sapiens
ctccagaggatgcaggtgaggg

SEQ ID NO: 9156302 - DNA, 22 bp, Homo sapiens
ctccagaggaaagcacatagtg

SEQ ID NO: 9156303 - DNA, 18 bp, Homo sapiens
ctccagagctgtgagaca

SEQ ID NO: 9156304 - DNA, 22 bp, Homo sapiens
ctccagaggaaagcacatagtg

SEQ ID NO: 9156305 - DNA, 22 bp, Homo sapiens
ctccaggacatgactttcttgc

SEQ ID NO: 9156306 - DNA, 22 bp, Homo sapiens
ctccaggaccagggctcctgga

SEQ ID NO: 9156307 - DNA, 22 bp, Homo sapiens
ctccaggaccagggctcctgga

SEQ ID NO: 9156308 - DNA, 22 bp, Homo sapiens
ctccaggaccagggctcctgga

SEQ ID NO: 9156309 - DNA, 22 bp, Homo sapiens
ctccaggacactaacccaggct

SEQ ID NO: 9156310 - DNA, 22 bp, Homo sapiens
ctccaggacactaacccaggct

SEQ ID NO: 9156311 - DNA, 22 bp, Homo sapiens
ctccaggacagattcagggcca

SEQ ID NO: 9156312 - DNA, 22 bp, Homo sapiens
ctccaggacagattcagggcca

SEQ ID NO: 9156313 - DNA, 22 bp, Homo sapiens
ctccaggacccagtggctccag

SEQ ID NO: 9156314 - DNA, 22 bp, Homo sapiens
ctccaggaccagggctcctgga

SEQ ID NO: 9156315 - DNA, 22 bp, Homo sapiens
ctccaggacccagtggctccag

SEQ ID NO: 9156316 - DNA, 22 bp, Homo sapiens
ctccaggactgaggacagagct

SEQ ID NO: 9156317 - DNA, 22 bp, Homo sapiens
ctccaggactcaggcccctggg

SEQ ID NO: 9156318 - DNA, 22 bp, Homo sapiens
ctccaggactcaggcccctggg

SEQ ID NO: 9156319 - DNA, 22 bp, Homo sapiens
ctccaggactcaggcccctggg

SEQ ID NO: 9156320 - DNA, 22 bp, Homo sapiens
ttggctgccttcacccctggcc

SEQ ID NO: 9156321 - DNA, 22 bp, Homo sapiens
ttggctgctaatggctgacagc

SEQ ID NO: 9156322 - DNA, 22 bp, Homo sapiens
ttggctgcaatcacagggactc

SEQ ID NO: 9156323 - DNA, 22 bp, Homo sapiens
ttggctgatgcaagagcttcct

SEQ ID NO: 9156324 - DNA, 22 bp, Homo sapiens
ttggctgagagctgctctgcag

SEQ ID NO: 9156325 - DNA, 22 bp, Homo sapiens
ttggctgagccatgtgaaacca

SEQ ID NO: 9156326 - DNA, 22 bp, Homo sapiens
ttggctgccgagcgcatcccgg

SEQ ID NO: 9156327 - DNA, 22 bp, Homo sapiens
ttggctgccgagcgcatcccgg

SEQ ID NO: 9156328 - DNA, 22 bp, Homo sapiens
ttggctgaccagaacctgcccc

SEQ ID NO: 9156329 - DNA, 22 bp, Homo sapiens
ttggctgacaaatggaatctct

SEQ ID NO: 9156330 - DNA, 22 bp, Homo sapiens
ttggctgagagaggaaaagggc

SEQ ID NO: 9156331 - DNA, 22 bp, Homo sapiens
ttggctgaaggaataaatggat

SEQ ID NO: 9156332 - DNA, 22 bp, Homo sapiens
ttggctgaaggaataaatggat

SEQ ID NO: 9156333 - DNA, 22 bp, Homo sapiens
ttggctgaaggttaagtgctgg

SEQ ID NO: 9156334 - DNA, 22 bp, Homo sapiens
ttggctgaatgaggtcaccttt

SEQ ID NO: 9156335 - DNA, 22 bp, Homo sapiens
ttggctgaaagccatgagaccg

SEQ ID NO: 9156336 - DNA, 22 bp, Homo sapiens
ttggctgaagactagatgttta

SEQ ID NO: 9156337 - DNA, 22 bp, Homo sapiens
ttggctgaactgagctccatcg

SEQ ID NO: 9156338 - DNA, 19 bp, Homo sapiens
ctcagctgtagctcatgtg

SEQ ID NO: 9156339 - DNA, 22 bp, Homo sapiens
ctcagaggcaagcaaggagctg

SEQ ID NO: 9156340 - DNA, 22 bp, Homo sapiens
ctcaggaaaggccatgcaaggg

SEQ ID NO: 9156341 - DNA, 22 bp, Homo sapiens
ctcaggaaaggccatgcaaggg

SEQ ID NO: 9156342 - DNA, 22 bp, Homo sapiens
ctcaggaaaatattgaagaagt

SEQ ID NO: 9156343 - DNA, 22 bp, Homo sapiens
ctcagcttcatttgttccatga

SEQ ID NO: 9156344 - DNA, 19 bp, Homo sapiens
ctcagctgtagctcatgtg

SEQ ID NO: 9156345 - DNA, 22 bp, Homo sapiens
ctcaggagacagtgtccacatg

SEQ ID NO: 9156346 - DNA, 22 bp, Homo sapiens
ctcaggagagtcttatatctcc

SEQ ID NO: 9156347 - DNA, 22 bp, Homo sapiens
ctcaggagatgacagaaggtat

SEQ ID NO: 9156348 - DNA, 22 bp, Homo sapiens
ctcaggaaccgcggcagcagcc

SEQ ID NO: 9156349 - DNA, 22 bp, Homo sapiens
ctcaggaaccgcggcagcagcc

SEQ ID NO: 9156350 - DNA, 22 bp, Homo sapiens
ctcaggaagcacaggccctaca

SEQ ID NO: 9156351 - DNA, 22 bp, Homo sapiens
ctcaggaaggaagcagggagcc

SEQ ID NO: 9156352 - DNA, 22 bp, Homo sapiens
ctcaggaagcctgtaatgtggg

SEQ ID NO: 9156353 - DNA, 22 bp, Homo sapiens
ttgcagttgctttctatattga

SEQ ID NO: 9156354 - DNA, 19 bp, Homo sapiens
ttgcagttgggtggggagt

SEQ ID NO: 9156355 - DNA, 22 bp, Homo sapiens
ttgcagttgtttagaatatgtg

SEQ ID NO: 9156356 - DNA, 23 bp, Homo sapiens
ttgcatagacatcctcatagatt

SEQ ID NO: 9156357 - DNA, 22 bp, Homo sapiens
ttgcataaatgcttaaaatttg

SEQ ID NO: 9156358 - DNA, 22 bp, Homo sapiens
ttgcagtttctggatgccttct

SEQ ID NO: 9156359 - DNA, 22 bp, Homo sapiens
ttgcataaaagagtatatctta

SEQ ID NO: 9156360 - DNA, 22 bp, Homo sapiens
ttgcataaagattttattgcat

SEQ ID NO: 9156361 - DNA, 22 bp, Homo sapiens
ctcaggagatgacagaaggtat

SEQ ID NO: 9156362 - DNA, 22 bp, Homo sapiens
ctcaggagcttcctcagcccat

SEQ ID NO: 9156363 - DNA, 22 bp, Homo sapiens
ctcaggaggaggaagttcattg

SEQ ID NO: 9156364 - DNA, 22 bp, Homo sapiens
ctcaggaggccattctcaaggt

SEQ ID NO: 9156365 - DNA, 22 bp, Homo sapiens
ctcaggaggccattctcaaggt

SEQ ID NO: 9156366 - DNA, 22 bp, Homo sapiens
ctcaggaggatgactgccttgg

SEQ ID NO: 9156367 - DNA, 22 bp, Homo sapiens
ctcaggaggatgactgccttgg

SEQ ID NO: 9156368 - DNA, 22 bp, Homo sapiens
ctcaggaggtggtagaggccct

SEQ ID NO: 9156369 - DNA, 22 bp, Homo sapiens
ctcaggaggtttcctgtctagg

SEQ ID NO: 9156370 - DNA, 22 bp, Homo sapiens
ctcaggtcttagttctgtcatc

SEQ ID NO: 9156371 - DNA, 22 bp, Homo sapiens
ctcagggtgagaaattgatcca

SEQ ID NO: 9156372 - DNA, 22 bp, Homo sapiens
ctcagggaagctatggtgaggg

SEQ ID NO: 9156373 - DNA, 22 bp, Homo sapiens
ctcagggaattatttctgtcct

SEQ ID NO: 9156374 - DNA, 22 bp, Homo sapiens
ctcagggagtagcacatgtgga

SEQ ID NO: 9156375 - DNA, 23 bp, Homo sapiens
ctcagggatagaaaggaagacag

SEQ ID NO: 9156376 - DNA, 22 bp, Homo sapiens
ctcagggatggtgaagcaccca

SEQ ID NO: 9156377 - DNA, 22 bp, Homo sapiens
ctcagggcagtatggctgagag

SEQ ID NO: 9156378 - DNA, 22 bp, Homo sapiens
ttgcatcaggtagacaactata

SEQ ID NO: 9156379 - DNA, 22 bp, Homo sapiens
ttgcccaggctggagtgcagta

SEQ ID NO: 9156380 - DNA, 22 bp, Homo sapiens
ttgcccagagtccacagcgtac

SEQ ID NO: 9156381 - DNA, 22 bp, Homo sapiens
ttgcccagagtcacccagctca

SEQ ID NO: 9156382 - DNA, 22 bp, Homo sapiens
ttgcatcagaaaatatgggaag

SEQ ID NO: 9156383 - DNA, 22 bp, Homo sapiens
ttgcatatgaagctgacttaaa

SEQ ID NO: 9156384 - DNA, 22 bp, Homo sapiens
ttgcatagtgctgaggttcggg

SEQ ID NO: 9156385 - DNA, 22 bp, Homo sapiens
ttgcatatatttctaaggaggt

SEQ ID NO: 9156386 - DNA, 22 bp, Homo sapiens
ttgcccaggctggagtgcagtg

SEQ ID NO: 9156387 - DNA, 21 bp, Homo sapiens
ttgcccctgagtttttctgag

SEQ ID NO: 9156388 - DNA, 22 bp, Homo sapiens
ttgcccctcttggattttccgg

SEQ ID NO: 9156389 - DNA, 22 bp, Homo sapiens
ttgcccctcttggattttccgg

SEQ ID NO: 9156390 - DNA, 18 bp, Homo sapiens
ttgcccctgggtgaggat

SEQ ID NO: 9156391 - DNA, 21 bp, Homo sapiens
ttgcccctgagtttttctgag

SEQ ID NO: 9156392 - DNA, 18 bp, Homo sapiens
ttgcccctgggtgaggat

SEQ ID NO: 9156393 - DNA, 22 bp, Homo sapiens
ttgccccttggccgttaaaaca

SEQ ID NO: 9156394 - DNA, 22 bp, Homo sapiens
ttgcccctggtcagaggaggct

SEQ ID NO: 9156395 - DNA, 22 bp, Homo sapiens
ttgccccttggccgttaaaaca

SEQ ID NO: 9156396 - DNA, 22 bp, Homo sapiens
ttgcccctggtcagaggaggct

SEQ ID NO: 9156397 - DNA, 22 bp, Homo sapiens
cgtttactgtgtaccaggcact

SEQ ID NO: 9156398 - DNA, 22 bp, Homo sapiens
cgtttaaccagcacgcttggcc

SEQ ID NO: 9156399 - DNA, 22 bp, Homo sapiens
cgtttattttgaagattccact

SEQ ID NO: 9156400 - DNA, 22 bp, Homo sapiens
cgttggtctgtcccctggcacc

SEQ ID NO: 9156401 - DNA, 22 bp, Homo sapiens
cgtttttcagtggtcttaggtc

SEQ ID NO: 9156402 - DNA, 22 bp, Homo sapiens
cgtttgaaagcctttgtacact

SEQ ID NO: 9156403 - DNA, 22 bp, Homo sapiens
cgtttattttgaagattccact

SEQ ID NO: 9156404 - DNA, 22 bp, Homo sapiens
cgtttttcagtggtcttaggtc

SEQ ID NO: 9156405 - DNA, 21 bp, Homo sapiens
ctagaaagaatgttgtcgtct

SEQ ID NO: 9156406 - DNA, 22 bp, Homo sapiens
ctagaaagatacttaaatcaag

SEQ ID NO: 9156407 - DNA, 22 bp, Homo sapiens
ctaaaaatccacactaggtgaa

SEQ ID NO: 9156408 - DNA, 22 bp, Homo sapiens
ctagagggatgttaggatagca

SEQ ID NO: 9156409 - DNA, 22 bp, Homo sapiens
ctagagctgttctgtgcactca

SEQ ID NO: 9156410 - DNA, 22 bp, Homo sapiens
ctagagcagattgcagagtagg

SEQ ID NO: 9156411 - DNA, 22 bp, Homo sapiens
ttctgcagcccaacagtagttt

SEQ ID NO: 9156412 - DNA, 22 bp, Homo sapiens
ttctgcagcccaacagtagttt

SEQ ID NO: 9156413 - DNA, 22 bp, Homo sapiens
ttctgcagctgtctcgcaggca

SEQ ID NO: 9156414 - DNA, 21 bp, Homo sapiens
ttctgcagccatgttggtttt

SEQ ID NO: 9156415 - DNA, 22 bp, Homo sapiens
ttctgcaggagccctagtgtat

SEQ ID NO: 9156416 - DNA, 22 bp, Homo sapiens
ttctgcagtgtgcagggcctgt

SEQ ID NO: 9156417 - DNA, 22 bp, Homo sapiens
ttctgcagtgaatgactcaata

SEQ ID NO: 9156418 - DNA, 22 bp, Homo sapiens
ttctattgaatgataatctata

SEQ ID NO: 9156419 - DNA, 22 bp, Homo sapiens
ttctatttccagtccttcagag

SEQ ID NO: 9156420 - DNA, 22 bp, Homo sapiens
ttctattgcacacaaataatta

SEQ ID NO: 9156421 - DNA, 22 bp, Homo sapiens
ttctattgggaagtgtgagagt

SEQ ID NO: 9156422 - DNA, 22 bp, Homo sapiens
ttctatgttagtatgggtctcc

SEQ ID NO: 9156423 - DNA, 22 bp, Homo sapiens
ttctggaagctgcaggtggccg

SEQ ID NO: 9156424 - DNA, 23 bp, Homo sapiens
ttctggatgttctagtctgagag

SEQ ID NO: 9156425 - DNA, 22 bp, Homo sapiens
ttctggaacatagcaagaagtt

SEQ ID NO: 9156426 - DNA, 22 bp, Homo sapiens
ttctttctgaatacagttgagt

SEQ ID NO: 9156427 - DNA, 22 bp, Homo sapiens
ttctttctgaatacagttgagt

SEQ ID NO: 9156428 - DNA, 21 bp, Homo sapiens
ttctttctgaatctgaagtat

SEQ ID NO: 9156429 - DNA, 21 bp, Homo sapiens
ttctttctgaatctgaagtat

SEQ ID NO: 9156430 - DNA, 21 bp, Homo sapiens
ttctttctgaatctgaagtat

SEQ ID NO: 9156431 - DNA, 22 bp, Homo sapiens
ttctttctgggaagagttcaga

SEQ ID NO: 9156432 - DNA, 22 bp, Homo sapiens
ttctttctgggaagagttcaga

SEQ ID NO: 9156433 - DNA, 22 bp, Homo sapiens
ttctttctgggaagagttcaga

SEQ ID NO: 9156434 - DNA, 21 bp, Homo sapiens
ttctttctgaatctgaagtat

SEQ ID NO: 9156435 - DNA, 21 bp, Homo sapiens
ttctttctgaatctgaagtat

SEQ ID NO: 9156436 - DNA, 22 bp, Homo sapiens
ttctttctctgtaaaaggaaaa

SEQ ID NO: 9156437 - DNA, 22 bp, Homo sapiens
ttctttctgaatacagttgagt

SEQ ID NO: 9156438 - DNA, 22 bp, Homo sapiens
ttctttctctccacaaggcttg

SEQ ID NO: 9156439 - DNA, 22 bp, Homo sapiens
ttctttctctccacaaggcttg

SEQ ID NO: 9156440 - DNA, 22 bp, Homo sapiens
ttctttctgtccataatgagac

SEQ ID NO: 9156441 - DNA, 22 bp, Homo sapiens
ctcagaaaggtgccatttatgt

SEQ ID NO: 9156442 - DNA, 22 bp, Homo sapiens
ttctttctgtcatggtgtactg

SEQ ID NO: 9156443 - DNA, 22 bp, Homo sapiens
ttctttctggggtccttcggct

SEQ ID NO: 9156444 - DNA, 22 bp, Homo sapiens
ttctttctggggtccttcggct

SEQ ID NO: 9156445 - DNA, 22 bp, Homo sapiens
ctcagagaaaaggagcaagggt

SEQ ID NO: 9156446 - DNA, 22 bp, Homo sapiens
ctcagagaggttgaacaacttg

SEQ ID NO: 9156447 - DNA, 19 bp, Homo sapiens
ctcagagaggggcagtgcc

SEQ ID NO: 9156448 - DNA, 22 bp, Homo sapiens
ctcagagaggcagtggaagtca

SEQ ID NO: 9156449 - DNA, 21 bp, Homo sapiens
ctcagagcagttcagagggat

SEQ ID NO: 9156450 - DNA, 22 bp, Homo sapiens
ctcacccagaggctttccccct

SEQ ID NO: 9156451 - DNA, 22 bp, Homo sapiens
ctcacaggttctgcagctcaca

SEQ ID NO: 9156452 - DNA, 18 bp, Homo sapiens
ctcaccattctgcccaat

SEQ ID NO: 9156453 - DNA, 22 bp, Homo sapiens
ctcacaggttctgcagctcaca

SEQ ID NO: 9156454 - DNA, 22 bp, Homo sapiens
ctatacagcagcttactagtta

SEQ ID NO: 9156455 - DNA, 22 bp, Homo sapiens
ctcactgacgaggaagctgaga

SEQ ID NO: 9156456 - DNA, 22 bp, Homo sapiens
ctcactataatgtgttcagtgt

SEQ ID NO: 9156457 - DNA, 22 bp, Homo sapiens
ctcacctgtaagatggaagaga

SEQ ID NO: 9156458 - DNA, 22 bp, Homo sapiens
ctcacctgtaagatggaagaga

SEQ ID NO: 9156459 - DNA, 22 bp, Homo sapiens
ctcacccatatctccatgactc

SEQ ID NO: 9156460 - DNA, 22 bp, Homo sapiens
ctcacccatatctccatgactc

SEQ ID NO: 9156461 - DNA, 22 bp, Homo sapiens
ttctggcatctgggggaggcct

SEQ ID NO: 9156462 - DNA, 22 bp, Homo sapiens
ttctggcatgagagatgggggt

SEQ ID NO: 9156463 - DNA, 22 bp, Homo sapiens
ttctggatgttgtagtctgaga

SEQ ID NO: 9156464 - DNA, 22 bp, Homo sapiens
ttctggattttccaactcactg

SEQ ID NO: 9156465 - DNA, 22 bp, Homo sapiens
ttctggcttagttgttgtatat

SEQ ID NO: 9156466 - DNA, 22 bp, Homo sapiens
ttatcaagggagaaacaggagg

SEQ ID NO: 9156467 - DNA, 22 bp, Homo sapiens
ttatcatagtgcagttttctga

SEQ ID NO: 9156468 - DNA, 22 bp, Homo sapiens
ttatcattgtcgcagtctaatt

SEQ ID NO: 9156469 - DNA, 22 bp, Homo sapiens
ttatccaaactggtgaatcatt

SEQ ID NO: 9156470 - DNA, 22 bp, Homo sapiens
ttatcagttgtgtgtatacacg

SEQ ID NO: 9156471 - DNA, 22 bp, Homo sapiens
ttatcagttgtgtgtatacacg

SEQ ID NO: 9156472 - DNA, 22 bp, Homo sapiens
ttatcacttatgagctttttgc

SEQ ID NO: 9156473 - DNA, 22 bp, Homo sapiens
ttataaaggtttgtgcatattt

SEQ ID NO: 9156474 - DNA, 22 bp, Homo sapiens
ttataacaacagtttactttaa

SEQ ID NO: 9156475 - DNA, 23 bp, Homo sapiens
ttataaatattttcaggtgtgtt

SEQ ID NO: 9156476 - DNA, 22 bp, Homo sapiens
ttataacattataaagtggaga

SEQ ID NO: 9156477 - DNA, 22 bp, Homo sapiens
ccttgcccgctgcctctgagtt

SEQ ID NO: 9156478 - DNA, 22 bp, Homo sapiens
ttaggcttttttaaagcacaga

SEQ ID NO: 9156479 - DNA, 22 bp, Homo sapiens
ttagtttccaccacacatgttc

SEQ ID NO: 9156480 - DNA, 22 bp, Homo sapiens
ttagtttataattcatttctgt

SEQ ID NO: 9156481 - DNA, 22 bp, Homo sapiens
ttagggaaataaaattatcagt

SEQ ID NO: 9156482 - DNA, 22 bp, Homo sapiens
ttagttttctcatctatctcac

SEQ ID NO: 9156483 - DNA, 22 bp, Homo sapiens
ttataaagattgttatgtatct

SEQ ID NO: 9156484 - DNA, 22 bp, Homo sapiens
ttataaaggtttgtgcatattt

SEQ ID NO: 9156485 - DNA, 22 bp, Homo sapiens
ttataaacttgccaagaaggag

SEQ ID NO: 9156486 - DNA, 22 bp, Homo sapiens
ttataaacttgccaagaaggag

SEQ ID NO: 9156487 - DNA, 22 bp, Homo sapiens
ccttgcagacatcagtagtggc

SEQ ID NO: 9156488 - DNA, 22 bp, Homo sapiens
ccttgcagacatcagtagtggc

SEQ ID NO: 9156489 - DNA, 22 bp, Homo sapiens
ccttgcagagcataggagccct

SEQ ID NO: 9156490 - DNA, 22 bp, Homo sapiens
ccttgcagcatatagagtccct

SEQ ID NO: 9156491 - DNA, 22 bp, Homo sapiens
ccttgcaggggaacaggcagtg

SEQ ID NO: 9156492 - DNA, 22 bp, Homo sapiens
ccttgcagttgttactgtagcc

SEQ ID NO: 9156493 - DNA, 22 bp, Homo sapiens
ccttgcatctcatttcattctt

SEQ ID NO: 9156494 - DNA, 22 bp, Homo sapiens
ccttgcatatattatatctttg

SEQ ID NO: 9156495 - DNA, 22 bp, Homo sapiens
ccttgcatatattatatctttg

SEQ ID NO: 9156496 - DNA, 22 bp, Homo sapiens
ccttgaatctctgctctagaac

SEQ ID NO: 9156497 - DNA, 22 bp, Homo sapiens
ttagcaaatatcttgaaacagg

SEQ ID NO: 9156498 - DNA, 22 bp, Homo sapiens
ttagcaaatatcttgaaacagg

SEQ ID NO: 9156499 - DNA, 22 bp, Homo sapiens
ttagcaaatttccaggtgatgc

SEQ ID NO: 9156500 - DNA, 22 bp, Homo sapiens
ttagcaatatgaatgcatttgc

SEQ ID NO: 9156501 - DNA, 22 bp, Homo sapiens
ttagcaagataacagtaatttt

SEQ ID NO: 9156502 - DNA, 22 bp, Homo sapiens
ttagcaatgtatgattaaaata

SEQ ID NO: 9156503 - DNA, 22 bp, Homo sapiens
ttagcaatgtatgattaaaata

SEQ ID NO: 9156504 - DNA, 22 bp, Homo sapiens
ccttgaaagtatatgctcaatt

SEQ ID NO: 9156505 - DNA, 22 bp, Homo sapiens
ttagcacaattatttcagttgt

SEQ ID NO: 9156506 - DNA, 22 bp, Homo sapiens
ttagcaccacacactttagagg

SEQ ID NO: 9156507 - DNA, 22 bp, Homo sapiens
ttagcaccagctatggatgtgc

SEQ ID NO: 9156508 - DNA, 22 bp, Homo sapiens
ttagcacccgggccagcggctg

SEQ ID NO: 9156509 - DNA, 22 bp, Homo sapiens
ttagcaccttgaacagaccctg

SEQ ID NO: 9156510 - DNA, 22 bp, Homo sapiens
ttagcaccttaactgtggagat

SEQ ID NO: 9156511 - DNA, 18 bp, Homo sapiens
ttagcacctatgtgggta

SEQ ID NO: 9156512 - DNA, 22 bp, Homo sapiens
ttagcacctcattcccaccttc

SEQ ID NO: 9156513 - DNA, 22 bp, Homo sapiens
ttagcaccctgatactagaatg

SEQ ID NO: 9156514 - DNA, 18 bp, Homo sapiens
ccttcagctctgccagta

SEQ ID NO: 9156515 - DNA, 22 bp, Homo sapiens
ttagacagagctccttgagggc

SEQ ID NO: 9156516 - DNA, 18 bp, Homo sapiens
ccttcagctctgccagta

SEQ ID NO: 9156517 - DNA, 22 bp, Homo sapiens
ttagacagagctccttgagggc

SEQ ID NO: 9156518 - DNA, 22 bp, Homo sapiens
ttagacaggatgtatgaaagct

SEQ ID NO: 9156519 - DNA, 22 bp, Homo sapiens
ttagcaaagtttgccatctagt

SEQ ID NO: 9156520 - DNA, 22 bp, Homo sapiens
ttagcaaaggcccctacaccca

SEQ ID NO: 9156521 - DNA, 22 bp, Homo sapiens
ttagcaaatatcttgaaacagg

SEQ ID NO: 9156522 - DNA, 22 bp, Homo sapiens
ttagcaaactctgttagattct

SEQ ID NO: 9156523 - DNA, 22 bp, Homo sapiens
ttagcaaagaagatgtgagttt

SEQ ID NO: 9156524 - DNA, 22 bp, Homo sapiens
ccttcaaactttcattaaccag

SEQ ID NO: 9156525 - DNA, 22 bp, Homo sapiens
ccttcaaaacactagtttttga

SEQ ID NO: 9156526 - DNA, 22 bp, Homo sapiens
ttacatacctcatagactcagg

SEQ ID NO: 9156527 - DNA, 22 bp, Homo sapiens
ccttcagccttcatccttcctt

SEQ ID NO: 9156528 - DNA, 20 bp, Homo sapiens
ccttcagaacttacatagta

SEQ ID NO: 9156529 - DNA, 22 bp, Homo sapiens
ccttcaagttcctggtccctgg

SEQ ID NO: 9156530 - DNA, 22 bp, Homo sapiens
ccttcaaggcaaggagggctgg

SEQ ID NO: 9156531 - DNA, 22 bp, Homo sapiens
ccttcaaattctcttagctgaa

SEQ ID NO: 9156532 - DNA, 21 bp, Homo sapiens
tgtcagagcttgtaggacatt

SEQ ID NO: 9156533 - DNA, 22 bp, Homo sapiens
tgtcagagcaatgaggttcagc

SEQ ID NO: 9156534 - DNA, 22 bp, Homo sapiens
tgtcagacacagccagagactg

SEQ ID NO: 9156535 - DNA, 21 bp, Homo sapiens
tgtcagcaacaatactttctc

SEQ ID NO: 9156536 - DNA, 21 bp, Homo sapiens
tgtcagagcttgtaggacatt

SEQ ID NO: 9156537 - DNA, 21 bp, Homo sapiens
tgtcagagcttgtaggacatt

SEQ ID NO: 9156538 - DNA, 22 bp, Homo sapiens
tgtcagcaattctggcttactc

SEQ ID NO: 9156539 - DNA, 22 bp, Homo sapiens
tgtcagcagctggtttgctgtt

SEQ ID NO: 9156540 - DNA, 22 bp, Homo sapiens
tgtcagctcccagtcagagaga

SEQ ID NO: 9156541 - DNA, 22 bp, Homo sapiens
ttaaatagtaggtctattttgg

SEQ ID NO: 9156542 - DNA, 22 bp, Homo sapiens
ttaaattagtcaagcttctctg

SEQ ID NO: 9156543 - DNA, 22 bp, Homo sapiens
ttaaatttctacgtgatccagg

SEQ ID NO: 9156544 - DNA, 22 bp, Homo sapiens
ttaaattagtcaagcttctctg

SEQ ID NO: 9156545 - DNA, 22 bp, Homo sapiens
ttaaattattgagggattgtca

SEQ ID NO: 9156546 - DNA, 22 bp, Homo sapiens
ttaaattccagcctcataatag

SEQ ID NO: 9156547 - DNA, 22 bp, Homo sapiens
ttaaattcattccaacttttga

SEQ ID NO: 9156548 - DNA, 22 bp, Homo sapiens
ttaaattatttctagtgaggtg

SEQ ID NO: 9156549 - DNA, 22 bp, Homo sapiens
ttaagatagaacccagtagtct

SEQ ID NO: 9156550 - DNA, 22 bp, Homo sapiens
ttaagagttatttgcacataat

SEQ ID NO: 9156551 - DNA, 22 bp, Homo sapiens
ttaagatttgtagagaaaaagc

SEQ ID NO: 9156552 - DNA, 22 bp, Homo sapiens
ttaaattttagaaacagactct

SEQ ID NO: 9156553 - DNA, 17 bp, Homo sapiens
ccttagggcagtgtggt

SEQ ID NO: 9156554 - DNA, 22 bp, Homo sapiens
ccttagtgaaacagaggcaatt

SEQ ID NO: 9156555 - DNA, 22 bp, Homo sapiens
ccttagtgtgcctgaggcagat

SEQ ID NO: 9156556 - DNA, 22 bp, Homo sapiens
ttacaaagagtgccagagtgtg

SEQ ID NO: 9156557 - DNA, 22 bp, Homo sapiens
ccttacctgattgctggcatcc

SEQ ID NO: 9156558 - DNA, 22 bp, Homo sapiens
ccttaaaagaactatctcttct

SEQ ID NO: 9156559 - DNA, 22 bp, Homo sapiens
ccttaagtacctgactagcatg

SEQ ID NO: 9156560 - DNA, 22 bp, Homo sapiens
ccttaaattctccatttgaaag

SEQ ID NO: 9156561 - DNA, 17 bp, Homo sapiens
ttaagcatgtaatctgc

SEQ ID NO: 9156562 - DNA, 22 bp, Homo sapiens
ttaagcagcatgcattcagtgg

SEQ ID NO: 9156563 - DNA, 22 bp, Homo sapiens
ttaagcaacacacattaattat

SEQ ID NO: 9156564 - DNA, 22 bp, Homo sapiens
ttaagcagaaaatttgagcact

SEQ ID NO: 9156565 - DNA, 22 bp, Homo sapiens
ttacagttggtattagaccaaa

SEQ ID NO: 9156566 - DNA, 22 bp, Homo sapiens
ttacagttgttctatcagcatg

SEQ ID NO: 9156567 - DNA, 22 bp, Homo sapiens
ttacagttaatgtgactaacca

SEQ ID NO: 9156568 - DNA, 21 bp, Homo sapiens
ttacagaatccatgggaagtc

SEQ ID NO: 9156569 - DNA, 22 bp, Homo sapiens
ttacaaagcaggtcagctgaaa

SEQ ID NO: 9156570 - DNA, 22 bp, Homo sapiens
ttacaaagcgttgagacaagta

SEQ ID NO: 9156571 - DNA, 22 bp, Homo sapiens
ttacaaagcgttgagacaagta

SEQ ID NO: 9156572 - DNA, 22 bp, Homo sapiens
ccttttgctctcccatccagaa

SEQ ID NO: 9156573 - DNA, 22 bp, Homo sapiens
ccttttggccaggtcagtgcag

SEQ ID NO: 9156574 - DNA, 22 bp, Homo sapiens
cctttttctgagttgtagcttc

SEQ ID NO: 9156575 - DNA, 22 bp, Homo sapiens
ccttttctgtttcctgtcactg

SEQ ID NO: 9156576 - DNA, 22 bp, Homo sapiens
ccttttcttgccactgactcgg

SEQ ID NO: 9156577 - DNA, 22 bp, Homo sapiens
ccttttcttgccactgactcgg

SEQ ID NO: 9156578 - DNA, 22 bp, Homo sapiens
ccttttctgaaccacttaaata

SEQ ID NO: 9156579 - DNA, 22 bp, Homo sapiens
ccttttctgtgtgggtaattta

SEQ ID NO: 9156580 - DNA, 22 bp, Homo sapiens
ccttttctggccaccaagcgct

SEQ ID NO: 9156581 - DNA, 22 bp, Homo sapiens
ccttttctatccttctaggttc

SEQ ID NO: 9156582 - DNA, 22 bp, Homo sapiens
ccttttctaggatgctttatag

SEQ ID NO: 9156583 - DNA, 22 bp, Homo sapiens
ccttttctatgtaccagcagtg

SEQ ID NO: 9156584 - DNA, 22 bp, Homo sapiens
ccttttctatccttctaggttc

SEQ ID NO: 9156585 - DNA, 22 bp, Homo sapiens
ccttttctacaagcaaatgtgc

SEQ ID NO: 9156586 - DNA, 22 bp, Homo sapiens
ccttttctagaaagggaggcaa

SEQ ID NO: 9156587 - DNA, 22 bp, Homo sapiens
ccttttctaggatgctttatag

SEQ ID NO: 9156588 - DNA, 22 bp, Homo sapiens
cctttggtaacattccaacctt

SEQ ID NO: 9156589 - DNA, 22 bp, Homo sapiens
cctttggtaattctgtgtagag

SEQ ID NO: 9156590 - DNA, 22 bp, Homo sapiens
cgagagttagctaggagtcaca

SEQ ID NO: 9156591 - DNA, 22 bp, Homo sapiens
cgagcagaagcctggtggtctg

SEQ ID NO: 9156592 - DNA, 22 bp, Homo sapiens
ttattcagcatttagaggaagg

SEQ ID NO: 9156593 - DNA, 22 bp, Homo sapiens
ttattgcaactcctaaatagag

SEQ ID NO: 9156594 - DNA, 22 bp, Homo sapiens
ttattgcaactcctaaatagag

SEQ ID NO: 9156595 - DNA, 22 bp, Homo sapiens
ttattgcaaaggaagagcttga

SEQ ID NO: 9156596 - DNA, 22 bp, Homo sapiens
cgaagtttggggagaggagtct

SEQ ID NO: 9156597 - DNA, 21 bp, Homo sapiens
cgaagtttgggcagaggggtc

SEQ ID NO: 9156598 - DNA, 22 bp, Homo sapiens
cgactgtcatacacaagacatg

SEQ ID NO: 9156599 - DNA, 21 bp, Homo sapiens
cgacaggagaggcagccagcc

SEQ ID NO: 9156600 - DNA, 22 bp, Homo sapiens
cgagagatgggttggcaggggc

SEQ ID NO: 9156601 - DNA, 19 bp, Homo sapiens
ccttttttaacttcagcaa

SEQ ID NO: 9156602 - DNA, 22 bp, Homo sapiens
cgaaaatagatctgtttcccag

SEQ ID NO: 9156603 - DNA, 22 bp, Homo sapiens
cgaaacaggatcttagcccttg

SEQ ID NO: 9156604 - DNA, 22 bp, Homo sapiens
cgaaacaggatcttagcccttg

SEQ ID NO: 9156605 - DNA, 22 bp, Homo sapiens
cgctgcagtttatgtgttcctg

SEQ ID NO: 9156606 - DNA, 22 bp, Homo sapiens
cgctgccaggtcaccaggggta

SEQ ID NO: 9156607 - DNA, 22 bp, Homo sapiens
cgctgcctccaggtgcagcagg

SEQ ID NO: 9156608 - DNA, 22 bp, Homo sapiens
ttcaaagtaccgtacttaatgg

SEQ ID NO: 9156609 - DNA, 22 bp, Homo sapiens
cgctgctcggaaggtgtcacgt

SEQ ID NO: 9156610 - DNA, 22 bp, Homo sapiens
ttatttcatataatgttatcaa

SEQ ID NO: 9156611 - DNA, 22 bp, Homo sapiens
cgccgtcccctaggaaagagct

SEQ ID NO: 9156612 - DNA, 22 bp, Homo sapiens
cgccggcttgaggcaggcggca

SEQ ID NO: 9156613 - DNA, 22 bp, Homo sapiens
ttatttcatgtaaaatttatgt

SEQ ID NO: 9156614 - DNA, 22 bp, Homo sapiens
cgctccttgagcgtgtcggcct

SEQ ID NO: 9156615 - DNA, 22 bp, Homo sapiens
cgctgataaacgtcacgttccc

SEQ ID NO: 9156616 - DNA, 22 bp, Homo sapiens
cgctctggcaggcacaggaggg

SEQ ID NO: 9156617 - DNA, 22 bp, Homo sapiens
ttatttattgtgtacctactgt

SEQ ID NO: 9156618 - DNA, 22 bp, Homo sapiens
ttatttattgtgtacctactgt

SEQ ID NO: 9156619 - DNA, 22 bp, Homo sapiens
ttatttattcattctgtctgtc

SEQ ID NO: 9156620 - DNA, 22 bp, Homo sapiens
ttatttcatataatgttatcaa

SEQ ID NO: 9156621 - DNA, 20 bp, Homo sapiens
ttatttcagttgctagattg

SEQ ID NO: 9156622 - DNA, 22 bp, Homo sapiens
ttattgcatagattatgccata

SEQ ID NO: 9156623 - DNA, 22 bp, Homo sapiens
ttattgcatagattatgccata

SEQ ID NO: 9156624 - DNA, 22 bp, Homo sapiens
ttattgctaaggtactaggtgg

SEQ ID NO: 9156625 - DNA, 17 bp, Homo sapiens
ttattgctataagctga

SEQ ID NO: 9156626 - DNA, 22 bp, Homo sapiens
ttattgcatagattatgccata

SEQ ID NO: 9156627 - DNA, 22 bp, Homo sapiens
ttattgcactattgattttcta

SEQ ID NO: 9156628 - DNA, 22 bp, Homo sapiens
ttattgcaccttcctcactaac

SEQ ID NO: 9156629 - DNA, 22 bp, Homo sapiens
ttattgcaccttcctcactaac

SEQ ID NO: 9156630 - DNA, 22 bp, Homo sapiens
ttattgcaactttagggataga

SEQ ID NO: 9156631 - DNA, 23 bp, Homo sapiens
ttattgcaaggtaaaattgctga

SEQ ID NO: 9156632 - DNA, 23 bp, Homo sapiens
ttattgcaaggtaaaattgctga

SEQ ID NO: 9156633 - DNA, 22 bp, Homo sapiens
cggagtggggactggggtaatc

SEQ ID NO: 9156634 - DNA, 22 bp, Homo sapiens
cggatcctcagtcgtgcgggag

SEQ ID NO: 9156635 - DNA, 22 bp, Homo sapiens
cggcaaagaacgctttttcaga

SEQ ID NO: 9156636 - DNA, 22 bp, Homo sapiens
cggcacagccgggcaaggctgg

SEQ ID NO: 9156637 - DNA, 22 bp, Homo sapiens
cggcacagccgggcaaggctgg

SEQ ID NO: 9156638 - DNA, 23 bp, Homo sapiens
cggatttgactgaggtcctgcca

SEQ ID NO: 9156639 - DNA, 22 bp, Homo sapiens
cggcacagccgggcaaggctgg

SEQ ID NO: 9156640 - DNA, 22 bp, Homo sapiens
cggcagagacggcgctttgaac

SEQ ID NO: 9156641 - DNA, 22 bp, Homo sapiens
cggcacagggtaaacgttaccc

SEQ ID NO: 9156642 - DNA, 22 bp, Homo sapiens
cggcagagccctgagtcagcct

SEQ ID NO: 9156643 - DNA, 22 bp, Homo sapiens
cggcagagccctgagtcagcct

SEQ ID NO: 9156644 - DNA, 22 bp, Homo sapiens
cggcagagacggcgctttgaac

SEQ ID NO: 9156645 - DNA, 22 bp, Homo sapiens
cggcagagcggcgagcccctcc

SEQ ID NO: 9156646 - DNA, 22 bp, Homo sapiens
cggcagagcggcgagcccctcc

SEQ ID NO: 9156647 - DNA, 22 bp, Homo sapiens
cggcagctgattgcagagcacc

SEQ ID NO: 9156648 - DNA, 22 bp, Homo sapiens
cggcagggctccatgcatttct

SEQ ID NO: 9156649 - DNA, 22 bp, Homo sapiens
cggcagggttggttttctctga

SEQ ID NO: 9156650 - DNA, 22 bp, Homo sapiens
cggcagcaaaggaagccaggtc

SEQ ID NO: 9156651 - DNA, 22 bp, Homo sapiens
cggcagcaaaggaagccaggtc

SEQ ID NO: 9156652 - DNA, 22 bp, Homo sapiens
cggcagagtgtgtgcgtgcatg

SEQ ID NO: 9156653 - DNA, 22 bp, Homo sapiens
cggcagagtgtgtgcgtgcatg

SEQ ID NO: 9156654 - DNA, 22 bp, Homo sapiens
cggcagagcttcctgctcagcg

SEQ ID NO: 9156655 - DNA, 22 bp, Homo sapiens
cggcagagcttcctgctcagcg

SEQ ID NO: 9156656 - DNA, 18 bp, Homo sapiens
cggcagagtgcttctagc

SEQ ID NO: 9156657 - DNA, 18 bp, Homo sapiens
cggcagagtgcttctagc

SEQ ID NO: 9156658 - DNA, 21 bp, Homo sapiens
ttcaaagtttgcctaaagatt

SEQ ID NO: 9156659 - DNA, 22 bp, Homo sapiens
ttcaaattaccacatttgctta

SEQ ID NO: 9156660 - DNA, 22 bp, Homo sapiens
ttcaaatggttagactgttagc

SEQ ID NO: 9156661 - DNA, 22 bp, Homo sapiens
ttcaaatgcaagttactacttt

SEQ ID NO: 9156662 - DNA, 22 bp, Homo sapiens
ttcaaatgcaagttactacttt

SEQ ID NO: 9156663 - DNA, 22 bp, Homo sapiens
cggagaggacctgcaactcgct

SEQ ID NO: 9156664 - DNA, 22 bp, Homo sapiens
cggaggttgaggctgcagtgag

SEQ ID NO: 9156665 - DNA, 22 bp, Homo sapiens
cggggccctggggctgaaggtc

SEQ ID NO: 9156666 - DNA, 22 bp, Homo sapiens
cggggccctggggctgaaggtc

SEQ ID NO: 9156667 - DNA, 22 bp, Homo sapiens
cggggcaggagtccctgtagag

SEQ ID NO: 9156668 - DNA, 22 bp, Homo sapiens
cggggcagagggtcttctccag

SEQ ID NO: 9156669 - DNA, 22 bp, Homo sapiens
cggggcagaaagttgtcttttg

SEQ ID NO: 9156670 - DNA, 22 bp, Homo sapiens
cggggaggcttcggattaaagc

SEQ ID NO: 9156671 - DNA, 22 bp, Homo sapiens
cggggacacactggcagctcct

SEQ ID NO: 9156672 - DNA, 22 bp, Homo sapiens
cggggaggcttcggattaaagc

SEQ ID NO: 9156673 - DNA, 22 bp, Homo sapiens
cggggagggcagaggctccctc

SEQ ID NO: 9156674 - DNA, 22 bp, Homo sapiens
cggggagggcagaggctccctc

SEQ ID NO: 9156675 - DNA, 22 bp, Homo sapiens
cgggctggctgcagctgctgga

SEQ ID NO: 9156676 - DNA, 22 bp, Homo sapiens
cgggctggctgcagctgctgga

SEQ ID NO: 9156677 - DNA, 22 bp, Homo sapiens
cgggctggctgcagctgctgga

SEQ ID NO: 9156678 - DNA, 22 bp, Homo sapiens
cgggcaaggcgagactaggccc

SEQ ID NO: 9156679 - DNA, 21 bp, Homo sapiens
cgggctggccgggccctcacc

SEQ ID NO: 9156680 - DNA, 21 bp, Homo sapiens
cgggctggccgggccctcacc

SEQ ID NO: 9156681 - DNA, 22 bp, Homo sapiens
cggggctggcacaggtgaccac

SEQ ID NO: 9156682 - DNA, 22 bp, Homo sapiens
cggggctggcacaggtgaccac

SEQ ID NO: 9156683 - DNA, 22 bp, Homo sapiens
cgtggctggtggacctgagggc

SEQ ID NO: 9156684 - DNA, 22 bp, Homo sapiens
cgtggctggtggacctgagggc

SEQ ID NO: 9156685 - DNA, 22 bp, Homo sapiens
cgtgggctgcgcccagttcttc

SEQ ID NO: 9156686 - DNA, 22 bp, Homo sapiens
cgtgggccccagccactccctc

SEQ ID NO: 9156687 - DNA, 22 bp, Homo sapiens
cggggctgcgctcttcctgccg

SEQ ID NO: 9156688 - DNA, 22 bp, Homo sapiens
cggggctgaggcaacgcggaga

SEQ ID NO: 9156689 - DNA, 22 bp, Homo sapiens
cggggcctgtgccagcctgtgg

SEQ ID NO: 9156690 - DNA, 22 bp, Homo sapiens
cggggctgacagcaggtgtgct

SEQ ID NO: 9156691 - DNA, 22 bp, Homo sapiens
cggggcgagcagacggcggcaa

SEQ ID NO: 9156692 - DNA, 22 bp, Homo sapiens
cggggccctggggctgaaggtc

SEQ ID NO: 9156693 - DNA, 22 bp, Homo sapiens
cggggccctggggctgaaggtc

SEQ ID NO: 9156694 - DNA, 22 bp, Homo sapiens
cggggccctggggctgaaggtc

SEQ ID NO: 9156695 - DNA, 22 bp, Homo sapiens
cggggcctaccgctgcgtggcc

SEQ ID NO: 9156696 - DNA, 22 bp, Homo sapiens
tgattacagtctgacagatgtt

SEQ ID NO: 9156697 - DNA, 22 bp, Homo sapiens
cccaaccagaaattgacagaga

SEQ ID NO: 9156698 - DNA, 22 bp, Homo sapiens
cccaaccagaaattgacagaca

SEQ ID NO: 9156699 - DNA, 22 bp, Homo sapiens
cccaacactcacctccggatta

SEQ ID NO: 9156700 - DNA, 22 bp, Homo sapiens
cccaaagggcttcctgttctca

SEQ ID NO: 9156701 - DNA, 22 bp, Homo sapiens
cccaagagcttctaggacgctg

SEQ ID NO: 9156702 - DNA, 22 bp, Homo sapiens
cccaagagcttctaggacgctg

SEQ ID NO: 9156703 - DNA, 22 bp, Homo sapiens
cccaagcagggtgcagaggcat

SEQ ID NO: 9156704 - DNA, 22 bp, Homo sapiens
cccaagcagggtgcagaggcat

SEQ ID NO: 9156705 - DNA, 22 bp, Homo sapiens
ccatggagcgggtgagtgagtg

SEQ ID NO: 9156706 - DNA, 22 bp, Homo sapiens
ccatggccaattgcaccttgct

SEQ ID NO: 9156707 - DNA, 22 bp, Homo sapiens
ccatggccaggaaagccaaggt

SEQ ID NO: 9156708 - DNA, 22 bp, Homo sapiens
ccatggcagcctggcctggctt

SEQ ID NO: 9156709 - DNA, 22 bp, Homo sapiens
cccaaacatccaggtgctggac

SEQ ID NO: 9156710 - DNA, 22 bp, Homo sapiens
cccaaacatccaggtgctggac

SEQ ID NO: 9156711 - DNA, 20 bp, Homo sapiens
cccaaagcttcatatgagcc

SEQ ID NO: 9156712 - DNA, 22 bp, Homo sapiens
cccaaagcagggtcattgggcc

SEQ ID NO: 9156713 - DNA, 22 bp, Homo sapiens
ccatggccgccgctgctcagga

SEQ ID NO: 9156714 - DNA, 22 bp, Homo sapiens
ccattgtaaattctgtggaagt

SEQ ID NO: 9156715 - DNA, 22 bp, Homo sapiens
ccattgtagtatctgttttagt

SEQ ID NO: 9156716 - DNA, 22 bp, Homo sapiens
ccatttttaaagagcttaagta

SEQ ID NO: 9156717 - DNA, 22 bp, Homo sapiens
ccatttttcacaagactcactt

SEQ ID NO: 9156718 - DNA, 22 bp, Homo sapiens
ccatttttcacaagactcactt

SEQ ID NO: 9156719 - DNA, 23 bp, Homo sapiens
ccattttgtgttttggagaaaca

SEQ ID NO: 9156720 - DNA, 22 bp, Homo sapiens
tgaggcaggtaagcaagttttg

SEQ ID NO: 9156721 - DNA, 22 bp, Homo sapiens
tgaggcaggtggattacaaggt

SEQ ID NO: 9156722 - DNA, 22 bp, Homo sapiens
tgaggcagtattttagtgactt

SEQ ID NO: 9156723 - DNA, 22 bp, Homo sapiens
tgaggcagtattttagtgactt

SEQ ID NO: 9156724 - DNA, 22 bp, Homo sapiens
ccagtgtgttccctgcctcact

SEQ ID NO: 9156725 - DNA, 22 bp, Homo sapiens
ccagtgtgtttttctctgactc

SEQ ID NO: 9156726 - DNA, 22 bp, Homo sapiens
ccagtgtggtaggtccacaggt

SEQ ID NO: 9156727 - DNA, 22 bp, Homo sapiens
ccagtgtgggctggtggaggac

SEQ ID NO: 9156728 - DNA, 23 bp, Homo sapiens
ccagtgtggctctgtccgctctc

SEQ ID NO: 9156729 - DNA, 18 bp, Homo sapiens
tgaggcagtcagtgatgg

SEQ ID NO: 9156730 - DNA, 18 bp, Homo sapiens
tgaggcagtcagtgatgg

SEQ ID NO: 9156731 - DNA, 22 bp, Homo sapiens
tgaggcagtgatgtttaagcac

SEQ ID NO: 9156732 - DNA, 21 bp, Homo sapiens
tgatacaggaatggttctatg

SEQ ID NO: 9156733 - DNA, 22 bp, Homo sapiens
tgatgaccgccaacgtttaggt

SEQ ID NO: 9156734 - DNA, 20 bp, Homo sapiens
cccaaggtcacagctagcag

SEQ ID NO: 9156735 - DNA, 22 bp, Homo sapiens
cccacactctgagaaatgctga

SEQ ID NO: 9156736 - DNA, 22 bp, Homo sapiens
cccacaggacgggctaaagagt

SEQ ID NO: 9156737 - DNA, 19 bp, Homo sapiens
cccacaggaggacatatgg

SEQ ID NO: 9156738 - DNA, 22 bp, Homo sapiens
cccacaggcaggggcagagaca

SEQ ID NO: 9156739 - DNA, 22 bp, Homo sapiens
cccacaggcaggggcagagaca

SEQ ID NO: 9156740 - DNA, 22 bp, Homo sapiens
cccacaggccctgctgccttga

SEQ ID NO: 9156741 - DNA, 22 bp, Homo sapiens
cccacaggcaggtgcatgggct

SEQ ID NO: 9156742 - DNA, 22 bp, Homo sapiens
cccacaggccctgctgccttga

SEQ ID NO: 9156743 - DNA, 22 bp, Homo sapiens
cccacaggcaggtgcatgggct

SEQ ID NO: 9156744 - DNA, 22 bp, Homo sapiens
cccacaggtgtgagcttgctgg

SEQ ID NO: 9156745 - DNA, 22 bp, Homo sapiens
cccacaggtgtgagcttgctgg

SEQ ID NO: 9156746 - DNA, 22 bp, Homo sapiens
cccacaggtccccatgaactcg

SEQ ID NO: 9156747 - DNA, 22 bp, Homo sapiens
cccacaggtggaagcctcggaa

SEQ ID NO: 9156748 - DNA, 22 bp, Homo sapiens
cccacaggtggaagcctcggaa

SEQ ID NO: 9156749 - DNA, 22 bp, Homo sapiens
cccacaggccctgctgccttga

SEQ ID NO: 9156750 - DNA, 22 bp, Homo sapiens
cccacaggctaggggtagggca

SEQ ID NO: 9156751 - DNA, 22 bp, Homo sapiens
cccacaggctaggggtagggca

SEQ ID NO: 9156752 - DNA, 22 bp, Homo sapiens
cccacagggctgctgatggcag

SEQ ID NO: 9156753 - DNA, 22 bp, Homo sapiens
cccacagggctgctgatggcag

SEQ ID NO: 9156754 - DNA, 22 bp, Homo sapiens
cccaccagtacagatggtagat

SEQ ID NO: 9156755 - DNA, 22 bp, Homo sapiens
cccacccagcctggctgagggg

SEQ ID NO: 9156756 - DNA, 22 bp, Homo sapiens
cccaccagccatctgagagtgt

SEQ ID NO: 9156757 - DNA, 22 bp, Homo sapiens
cccaccagccatctgagagtgt

SEQ ID NO: 9156758 - DNA, 22 bp, Homo sapiens
cccaccacgtgctttgctggag

SEQ ID NO: 9156759 - DNA, 22 bp, Homo sapiens
tgcagagagttagggcccgtat

SEQ ID NO: 9156760 - DNA, 22 bp, Homo sapiens
tgcagaggtgttgctgagataa

SEQ ID NO: 9156761 - DNA, 22 bp, Homo sapiens
tgcagaggtttccaggcaagtt

SEQ ID NO: 9156762 - DNA, 22 bp, Homo sapiens
tgcagaggtgaaagactagcaa

SEQ ID NO: 9156763 - DNA, 22 bp, Homo sapiens
tgcagaggtgtgcattcttaag

SEQ ID NO: 9156764 - DNA, 22 bp, Homo sapiens
tgcagagatagaactactttct

SEQ ID NO: 9156765 - DNA, 21 bp, Homo sapiens
tgcagagatatctgaagcaga

SEQ ID NO: 9156766 - DNA, 22 bp, Homo sapiens
cccagagaaccttctgtgccac

SEQ ID NO: 9156767 - DNA, 22 bp, Homo sapiens
cccagagaatctttcagaaagg

SEQ ID NO: 9156768 - DNA, 22 bp, Homo sapiens
cccagagaagtgaagtgacttg

SEQ ID NO: 9156769 - DNA, 22 bp, Homo sapiens
tgcagaggtttgtggtgttgct

SEQ ID NO: 9156770 - DNA, 22 bp, Homo sapiens
tgcagaggtttccaggcaagtt

SEQ ID NO: 9156771 - DNA, 22 bp, Homo sapiens
tgcagaggtttgtggtgttgct

SEQ ID NO: 9156772 - DNA, 17 bp, Homo sapiens
cccagagatgctgcctt

SEQ ID NO: 9156773 - DNA, 22 bp, Homo sapiens
cccagagggtggaggttgcagt

SEQ ID NO: 9156774 - DNA, 22 bp, Homo sapiens
cccagagatcttgtcctttcca

SEQ ID NO: 9156775 - DNA, 22 bp, Homo sapiens
cccagagatctactgagcccag

SEQ ID NO: 9156776 - DNA, 22 bp, Homo sapiens
cccagcactcagcaggctcata

SEQ ID NO: 9156777 - DNA, 22 bp, Homo sapiens
cccagagggtggaggttgcagt

SEQ ID NO: 9156778 - DNA, 22 bp, Homo sapiens
cccagagaggtaaaacagcctt

SEQ ID NO: 9156779 - DNA, 22 bp, Homo sapiens
cccagcagaatctgatgagggc

SEQ ID NO: 9156780 - DNA, 22 bp, Homo sapiens
cccagcagaatctgatgagggc

SEQ ID NO: 9156781 - DNA, 22 bp, Homo sapiens
cccagcactttgaatatgtcac

SEQ ID NO: 9156782 - DNA, 22 bp, Homo sapiens
cccagcagaccgctgtgatggc

SEQ ID NO: 9156783 - DNA, 22 bp, Homo sapiens
cccagcagatggctatgtgcta

SEQ ID NO: 9156784 - DNA, 23 bp, Homo sapiens
cccagcagagatgaggaggggtc

SEQ ID NO: 9156785 - DNA, 23 bp, Homo sapiens
cccagcagattgtaaagtgtcca

SEQ ID NO: 9156786 - DNA, 22 bp, Homo sapiens
cccagcagccagaatgaggagc

SEQ ID NO: 9156787 - DNA, 22 bp, Homo sapiens
cccagcagccagaatgaggagc

SEQ ID NO: 9156788 - DNA, 22 bp, Homo sapiens
tgcagcaggtgacaacgagtgg

SEQ ID NO: 9156789 - DNA, 22 bp, Homo sapiens
tgcagcaggtatggcaagctcc

SEQ ID NO: 9156790 - DNA, 22 bp, Homo sapiens
tgcagcaggtatggcaagctcc

SEQ ID NO: 9156791 - DNA, 22 bp, Homo sapiens
tgcagcagtcagtcaggcctgg

SEQ ID NO: 9156792 - DNA, 22 bp, Homo sapiens
tgcagcagtcagtcaggcctgg

SEQ ID NO: 9156793 - DNA, 22 bp, Homo sapiens
cccagcccagcgttcgaggggt

SEQ ID NO: 9156794 - DNA, 22 bp, Homo sapiens
cccagcccagcgttcgaggggt

SEQ ID NO: 9156795 - DNA, 22 bp, Homo sapiens
cccagcccagcgttcgaggggt

SEQ ID NO: 9156796 - DNA, 22 bp, Homo sapiens
cccagcccacggtcctgggtgg

SEQ ID NO: 9156797 - DNA, 22 bp, Homo sapiens
cccagcccacggtcctgggtgg

SEQ ID NO: 9156798 - DNA, 22 bp, Homo sapiens
cccagcccacggtcctgggtgg

SEQ ID NO: 9156799 - DNA, 18 bp, Homo sapiens
cccagcccaccatttctc

SEQ ID NO: 9156800 - DNA, 18 bp, Homo sapiens
cccagcccaccatttctc

SEQ ID NO: 9156801 - DNA, 19 bp, Homo sapiens
cccagccaggtcttgcatc

SEQ ID NO: 9156802 - DNA, 19 bp, Homo sapiens
cccagccaggtcttgcatc

SEQ ID NO: 9156803 - DNA, 20 bp, Homo sapiens
cccagcccctacctgttgcc

SEQ ID NO: 9156804 - DNA, 20 bp, Homo sapiens
cccagcccctacctgttgcc

SEQ ID NO: 9156805 - DNA, 20 bp, Homo sapiens
cccagcccgggccgcgctcg

SEQ ID NO: 9156806 - DNA, 22 bp, Homo sapiens
cccagccctgacctattggaaa

SEQ ID NO: 9156807 - DNA, 20 bp, Homo sapiens
cccagcccgggccgcgctcg

SEQ ID NO: 9156808 - DNA, 22 bp, Homo sapiens
cccagcccccgagtgtctggaa

SEQ ID NO: 9156809 - DNA, 22 bp, Homo sapiens
cccagcccccgagtgtctggaa

SEQ ID NO: 9156810 - DNA, 22 bp, Homo sapiens
cccagcccccgagtgtctggaa

SEQ ID NO: 9156811 - DNA, 22 bp, Homo sapiens
cccagcccccgagtgtctggaa

SEQ ID NO: 9156812 - DNA, 22 bp, Homo sapiens
cccagcccccgagtgtctggaa

SEQ ID NO: 9156813 - DNA, 22 bp, Homo sapiens
cccagcccatctcaaaggtcta

SEQ ID NO: 9156814 - DNA, 22 bp, Homo sapiens
cccagcccatctcaaaggtcta

SEQ ID NO: 9156815 - DNA, 22 bp, Homo sapiens
cccagccaagtgatctgaccgc

SEQ ID NO: 9156816 - DNA, 22 bp, Homo sapiens
cccagccaaggtgctggtgttg

SEQ ID NO: 9156817 - DNA, 22 bp, Homo sapiens
cccagcaggtgccatcactctg

SEQ ID NO: 9156818 - DNA, 22 bp, Homo sapiens
cccagcaggtgccatcactctg

SEQ ID NO: 9156819 - DNA, 22 bp, Homo sapiens
cccagcaggtgccatcactctg

SEQ ID NO: 9156820 - DNA, 22 bp, Homo sapiens
cccagcatggagtgaggactca

SEQ ID NO: 9156821 - DNA, 22 bp, Homo sapiens
cccagcatgcacgctgacactc

SEQ ID NO: 9156822 - DNA, 22 bp, Homo sapiens
cccagcatgcacgctgacactc

SEQ ID NO: 9156823 - DNA, 22 bp, Homo sapiens
tgcagcattagtacaagtctca

SEQ ID NO: 9156824 - DNA, 22 bp, Homo sapiens
tgcagcattatgtagctgtttt

SEQ ID NO: 9156825 - DNA, 22 bp, Homo sapiens
tgcagcattagtacaagtctca

SEQ ID NO: 9156826 - DNA, 22 bp, Homo sapiens
tgcagcattagtacaagtctca

SEQ ID NO: 9156827 - DNA, 18 bp, Homo sapiens
tgcagcatgttcccataa

SEQ ID NO: 9156828 - DNA, 22 bp, Homo sapiens
tgcagcattctggtaaaaggca

SEQ ID NO: 9156829 - DNA, 22 bp, Homo sapiens
tgcagcattctggtaaaaggca

SEQ ID NO: 9156830 - DNA, 22 bp, Homo sapiens
tgcagcattcttggccactact

SEQ ID NO: 9156831 - DNA, 22 bp, Homo sapiens
tgcagcattttataccatcatt

SEQ ID NO: 9156832 - DNA, 22 bp, Homo sapiens
tgcagcattgcaaagcagtctt

SEQ ID NO: 9156833 - DNA, 22 bp, Homo sapiens
tgcagcattgaaatagctaggc

SEQ ID NO: 9156834 - DNA, 22 bp, Homo sapiens
tgcagcattgaaatagctaggc

SEQ ID NO: 9156835 - DNA, 22 bp, Homo sapiens
tgcagcagtttaatgcagggtt

SEQ ID NO: 9156836 - DNA, 22 bp, Homo sapiens
tgcagcagtgttccttggcttg

SEQ ID NO: 9156837 - DNA, 17 bp, Homo sapiens
tgcagcagttcccatct

SEQ ID NO: 9156838 - DNA, 22 bp, Homo sapiens
tgcagcatgcaggagaggctct

SEQ ID NO: 9156839 - DNA, 22 bp, Homo sapiens
tgcagcatgcaggagaggctct

SEQ ID NO: 9156840 - DNA, 22 bp, Homo sapiens
tgcagcatctccttgtgccatg

SEQ ID NO: 9156841 - DNA, 22 bp, Homo sapiens
tgcagcatctccttgtgccatg

SEQ ID NO: 9156842 - DNA, 22 bp, Homo sapiens
tgcagcatctccttaaatcttg

SEQ ID NO: 9156843 - DNA, 22 bp, Homo sapiens
tgcagcagtttaatgcagggtt

SEQ ID NO: 9156844 - DNA, 22 bp, Homo sapiens
tgcagcatccatatattattag

SEQ ID NO: 9156845 - DNA, 22 bp, Homo sapiens
cccagctccaagggacagcgaa

SEQ ID NO: 9156846 - DNA, 22 bp, Homo sapiens
tgcagtggaggccgtgagacag

SEQ ID NO: 9156847 - DNA, 22 bp, Homo sapiens
tgcagtggaagaggtggagatc

SEQ ID NO: 9156848 - DNA, 22 bp, Homo sapiens
tgcagtggaatctggagagcag

SEQ ID NO: 9156849 - DNA, 22 bp, Homo sapiens
cccagccctgacctattggaaa

SEQ ID NO: 9156850 - DNA, 22 bp, Homo sapiens
tgcaggtggacacgggagacgg

SEQ ID NO: 9156851 - DNA, 22 bp, Homo sapiens
tgcagtgaaagtatcttaattt

SEQ ID NO: 9156852 - DNA, 22 bp, Homo sapiens
tgcagtgagaagcagttatgat

SEQ ID NO: 9156853 - DNA, 22 bp, Homo sapiens
tgcagtgaggcagttgggttgg

SEQ ID NO: 9156854 - DNA, 21 bp, Homo sapiens
tgcagtgaggggagctgtcag

SEQ ID NO: 9156855 - DNA, 22 bp, Homo sapiens
tgcagtgatgcttctggctcag

SEQ ID NO: 9156856 - DNA, 22 bp, Homo sapiens
tgcagtgattaaagtgttaaat

SEQ ID NO: 9156857 - DNA, 22 bp, Homo sapiens
tgcagtgatttgtacaattaga

SEQ ID NO: 9156858 - DNA, 22 bp, Homo sapiens
tgcagtgcctcggcagtgcagc

SEQ ID NO: 9156859 - DNA, 22 bp, Homo sapiens
tgcagtggaagaggtggagatc

SEQ ID NO: 9156860 - DNA, 22 bp, Homo sapiens
tgcagtggaaagactcagactt

SEQ ID NO: 9156861 - DNA, 22 bp, Homo sapiens
cccaggaattcagggctcaagg

SEQ ID NO: 9156862 - DNA, 22 bp, Homo sapiens
cccaggaaatagccaggaggtg

SEQ ID NO: 9156863 - DNA, 22 bp, Homo sapiens
cccaggaaatagccaggaggtg

SEQ ID NO: 9156864 - DNA, 22 bp, Homo sapiens
cccaggaaagtggaggcggctg

SEQ ID NO: 9156865 - DNA, 22 bp, Homo sapiens
cccagctccagagccagaaaca

SEQ ID NO: 9156866 - DNA, 22 bp, Homo sapiens
cccaggaccatccttctgtgcc

SEQ ID NO: 9156867 - DNA, 22 bp, Homo sapiens
cccaggaattggaggctgcagt

SEQ ID NO: 9156868 - DNA, 22 bp, Homo sapiens
cccaggaattggaggctgcagt

SEQ ID NO: 9156869 - DNA, 22 bp, Homo sapiens
cccaggaattggaggctgcagt

SEQ ID NO: 9156870 - DNA, 22 bp, Homo sapiens
cccaggactcggcactctcctt

SEQ ID NO: 9156871 - DNA, 22 bp, Homo sapiens
cccaggactaatgagctctacg

SEQ ID NO: 9156872 - DNA, 22 bp, Homo sapiens
cccaggaccgcgcggctgagcg

SEQ ID NO: 9156873 - DNA, 22 bp, Homo sapiens
cccaggactcttcactgcagcc

SEQ ID NO: 9156874 - DNA, 22 bp, Homo sapiens
cccaggactcttcactgcagcc

SEQ ID NO: 9156875 - DNA, 21 bp, Homo sapiens
cccaggagaagaaaagatgca

SEQ ID NO: 9156876 - DNA, 22 bp, Homo sapiens
cccaggactctgacacccccaa

SEQ ID NO: 9156877 - DNA, 21 bp, Homo sapiens
cccaggagaagaaaagatgca

SEQ ID NO: 9156878 - DNA, 22 bp, Homo sapiens
cccaggagatctggatctcgtc

SEQ ID NO: 9156879 - DNA, 22 bp, Homo sapiens
tgcatattttctgattcagaag

SEQ ID NO: 9156880 - DNA, 21 bp, Homo sapiens
cccaggaggagctccggctcc

SEQ ID NO: 9156881 - DNA, 22 bp, Homo sapiens
tgcatattgtgaaaatgtagat

SEQ ID NO: 9156882 - DNA, 22 bp, Homo sapiens
tgcatattgtccttgatattat

SEQ ID NO: 9156883 - DNA, 22 bp, Homo sapiens
tgcatattgtccttgatattat

SEQ ID NO: 9156884 - DNA, 21 bp, Homo sapiens
tgcatattcttctggtggctg

SEQ ID NO: 9156885 - DNA, 22 bp, Homo sapiens
tgcatattttataaagatggaa

SEQ ID NO: 9156886 - DNA, 22 bp, Homo sapiens
tgcatatttgtatgatgtttag

SEQ ID NO: 9156887 - DNA, 22 bp, Homo sapiens
tgcatattgtgaaaatgtagat

SEQ ID NO: 9156888 - DNA, 22 bp, Homo sapiens
cccaggagacagaaacagaggt

SEQ ID NO: 9156889 - DNA, 22 bp, Homo sapiens
cccaggagacagaaacagaggt

SEQ ID NO: 9156890 - DNA, 22 bp, Homo sapiens
tgcatatcttcaatgctgttgc

SEQ ID NO: 9156891 - DNA, 22 bp, Homo sapiens
tgcatattatgtgtatctgtct

SEQ ID NO: 9156892 - DNA, 22 bp, Homo sapiens
tgcatatccacaccttatctct

SEQ ID NO: 9156893 - DNA, 22 bp, Homo sapiens
tgcatatctggggatagggatg

SEQ ID NO: 9156894 - DNA, 22 bp, Homo sapiens
tgcatatcagaattcaagagtg

SEQ ID NO: 9156895 - DNA, 22 bp, Homo sapiens
tgcatatcactttgaatgggga

SEQ ID NO: 9156896 - DNA, 23 bp, Homo sapiens
tgcatatcagaaatttcatatgg

SEQ ID NO: 9156897 - DNA, 22 bp, Homo sapiens
cccaggaggcctgcctggccgg

SEQ ID NO: 9156898 - DNA, 22 bp, Homo sapiens
cccaggaggccaaggttgcagt

SEQ ID NO: 9156899 - DNA, 22 bp, Homo sapiens
cccaggaggcagaggttgcagt

SEQ ID NO: 9156900 - DNA, 22 bp, Homo sapiens
cccaggaggcagagcttgcagt

SEQ ID NO: 9156901 - DNA, 22 bp, Homo sapiens
cccaggaggcagagatagcagt

SEQ ID NO: 9156902 - DNA, 22 bp, Homo sapiens
cccaggaggcagagatagcagt

SEQ ID NO: 9156903 - DNA, 22 bp, Homo sapiens
cccaggaggaggaaaaagctcg

SEQ ID NO: 9156904 - DNA, 22 bp, Homo sapiens
cccaggaggaggaaaaagctcg

SEQ ID NO: 9156905 - DNA, 22 bp, Homo sapiens
cccaggaggcagaagttgcagt

SEQ ID NO: 9156906 - DNA, 22 bp, Homo sapiens
cccaggaggcagaagttgcagt

SEQ ID NO: 9156907 - DNA, 22 bp, Homo sapiens
tgccctccctgtactgtcagga

SEQ ID NO: 9156908 - DNA, 22 bp, Homo sapiens
tgccctccctgtactgtcagga

SEQ ID NO: 9156909 - DNA, 22 bp, Homo sapiens
tgccctcaggagtccctgacca

SEQ ID NO: 9156910 - DNA, 22 bp, Homo sapiens
tgccctctgcctcctctgcaga

SEQ ID NO: 9156911 - DNA, 22 bp, Homo sapiens
tgccctcttaggtctgcgcagc

SEQ ID NO: 9156912 - DNA, 22 bp, Homo sapiens
tgccctctaggctacagttcca

SEQ ID NO: 9156913 - DNA, 22 bp, Homo sapiens
tgccctctcaagttgagtcaga

SEQ ID NO: 9156914 - DNA, 22 bp, Homo sapiens
cccaggaggcggaggttgcagt

SEQ ID NO: 9156915 - DNA, 21 bp, Homo sapiens
cccaggaggctgagaagagca

SEQ ID NO: 9156916 - DNA, 21 bp, Homo sapiens
cccaggaggctgagaagagca

SEQ ID NO: 9156917 - DNA, 21 bp, Homo sapiens
cccaggaggctgagaagagca

SEQ ID NO: 9156918 - DNA, 22 bp, Homo sapiens
tgccctcagcagcagctcctgc

SEQ ID NO: 9156919 - DNA, 22 bp, Homo sapiens
tgccctcagccacctccaagtt

SEQ ID NO: 9156920 - DNA, 22 bp, Homo sapiens
tgccctcagcagcagctcctgc

SEQ ID NO: 9156921 - DNA, 20 bp, Homo sapiens
cccaggagtgagcagcttta

SEQ ID NO: 9156922 - DNA, 20 bp, Homo sapiens
cccaggagtgagcagcttta

SEQ ID NO: 9156923 - DNA, 22 bp, Homo sapiens
tgcctcagtctaaagtctctca

SEQ ID NO: 9156924 - DNA, 22 bp, Homo sapiens
tgccctggttacactggagtcc

SEQ ID NO: 9156925 - DNA, 23 bp, Homo sapiens
tgcctcagtggaatgtgagggtg

SEQ ID NO: 9156926 - DNA, 22 bp, Homo sapiens
cccaggaggttgaggctgcagt

SEQ ID NO: 9156927 - DNA, 19 bp, Homo sapiens
tgccctgcacgctgtcctg

SEQ ID NO: 9156928 - DNA, 22 bp, Homo sapiens
tgccctctttctgtacagctcc

SEQ ID NO: 9156929 - DNA, 22 bp, Homo sapiens
tgccctctttctgtacagctcc

SEQ ID NO: 9156930 - DNA, 22 bp, Homo sapiens
cccaggaggttgaggctgcagt

SEQ ID NO: 9156931 - DNA, 22 bp, Homo sapiens
cccaggaggttggggctacagt

SEQ ID NO: 9156932 - DNA, 19 bp, Homo sapiens
cccaggagtctggctggtt

SEQ ID NO: 9156933 - DNA, 22 bp, Homo sapiens
ccaggctcacagcatcccagga

SEQ ID NO: 9156934 - DNA, 22 bp, Homo sapiens
ccaggctcacctggagcccctg

SEQ ID NO: 9156935 - DNA, 17 bp, Homo sapiens
ccaggctccatcactgt

SEQ ID NO: 9156936 - DNA, 22 bp, Homo sapiens
ccaggctccccaggaggccctt

SEQ ID NO: 9156937 - DNA, 22 bp, Homo sapiens
ccaggctcaggcctgctcgttg

SEQ ID NO: 9156938 - DNA, 22 bp, Homo sapiens
tctttaagagttcatttgcatg

SEQ ID NO: 9156939 - DNA, 22 bp, Homo sapiens
tctttatttaagtctgttgtaa

SEQ ID NO: 9156940 - DNA, 22 bp, Homo sapiens
tctttatttaagtctgttgtaa

SEQ ID NO: 9156941 - DNA, 22 bp, Homo sapiens
tctttatttaagtctgttgtaa

SEQ ID NO: 9156942 - DNA, 22 bp, Homo sapiens
tctttatttaagtctgttgtaa

SEQ ID NO: 9156943 - DNA, 22 bp, Homo sapiens
tctttatttaagtctgttgtaa

SEQ ID NO: 9156944 - DNA, 22 bp, Homo sapiens
tctttatttctgaatcccccat

SEQ ID NO: 9156945 - DNA, 22 bp, Homo sapiens
tctttatttctgaatcccccat

SEQ ID NO: 9156946 - DNA, 22 bp, Homo sapiens
tctttatttctgaatcccccat

SEQ ID NO: 9156947 - DNA, 22 bp, Homo sapiens
tctttatttctgaatcccccat

SEQ ID NO: 9156948 - DNA, 22 bp, Homo sapiens
tctttatttctgaatcccccat

SEQ ID NO: 9156949 - DNA, 19 bp, Homo sapiens
ccaggcctggcgtctccgc

SEQ ID NO: 9156950 - DNA, 22 bp, Homo sapiens
ccaggcgtggcttcagcagccc

SEQ ID NO: 9156951 - DNA, 19 bp, Homo sapiens
ccaggcctggcgtctccgc

SEQ ID NO: 9156952 - DNA, 22 bp, Homo sapiens
ccaggctagaaactgaggcaca

SEQ ID NO: 9156953 - DNA, 22 bp, Homo sapiens
tctttattttatgcttgtgcaa

SEQ ID NO: 9156954 - DNA, 22 bp, Homo sapiens
tctttattttatgcttgtgcaa

SEQ ID NO: 9156955 - DNA, 22 bp, Homo sapiens
tctttattttatgcttgtgcaa

SEQ ID NO: 9156956 - DNA, 22 bp, Homo sapiens
tctttattttatgcttgtgcaa

SEQ ID NO: 9156957 - DNA, 22 bp, Homo sapiens
tctttattttatgcttgtgcaa

SEQ ID NO: 9156958 - DNA, 22 bp, Homo sapiens
tctttattttatgcttgtgcaa

SEQ ID NO: 9156959 - DNA, 22 bp, Homo sapiens
ccagcccttgagatggaaggga

SEQ ID NO: 9156960 - DNA, 22 bp, Homo sapiens
tctgcagaggtaatttacagat

SEQ ID NO: 9156961 - DNA, 20 bp, Homo sapiens
tctgcagataagggaaagac

SEQ ID NO: 9156962 - DNA, 22 bp, Homo sapiens
ccagcccttgaggtctgtccat

SEQ ID NO: 9156963 - DNA, 22 bp, Homo sapiens
tctgcagagggagtgctgggtc

SEQ ID NO: 9156964 - DNA, 22 bp, Homo sapiens
tctgcagagcattatagcaaaa

SEQ ID NO: 9156965 - DNA, 22 bp, Homo sapiens
tctgcagagattctgggctgag

SEQ ID NO: 9156966 - DNA, 22 bp, Homo sapiens
tctgcagagacaaagtgttatt

SEQ ID NO: 9156967 - DNA, 22 bp, Homo sapiens
tctgcagacttgcctaagtgtg

SEQ ID NO: 9156968 - DNA, 22 bp, Homo sapiens
tctgcagacttgataaccactg

SEQ ID NO: 9156969 - DNA, 22 bp, Homo sapiens
tctgcagacaggaagctgaggc

SEQ ID NO: 9156970 - DNA, 23 bp, Homo sapiens
tctgcagacgctgttctattgtc

SEQ ID NO: 9156971 - DNA, 22 bp, Homo sapiens
tctgcagacactggggtctgga

SEQ ID NO: 9156972 - DNA, 22 bp, Homo sapiens
tctgcagaattcgaggaagaaa

SEQ ID NO: 9156973 - DNA, 22 bp, Homo sapiens
tctgcagaattgtctcaagcta

SEQ ID NO: 9156974 - DNA, 22 bp, Homo sapiens
tcttgttttgaactcatcagga

SEQ ID NO: 9156975 - DNA, 22 bp, Homo sapiens
tcttgtttcttctaagcagcag

SEQ ID NO: 9156976 - DNA, 22 bp, Homo sapiens
tcttgtttctgtatataatgac

SEQ ID NO: 9156977 - DNA, 22 bp, Homo sapiens
tctttaagagtaattattttgg

SEQ ID NO: 9156978 - DNA, 22 bp, Homo sapiens
tctttaaagttggagcttgcaa

SEQ ID NO: 9156979 - DNA, 23 bp, Homo sapiens
tcttgtttcctttgcgctatcca

SEQ ID NO: 9156980 - DNA, 22 bp, Homo sapiens
tcttgtcctaagagctggattc

SEQ ID NO: 9156981 - DNA, 21 bp, Homo sapiens
tcttgtccttgctctcccact

SEQ ID NO: 9156982 - DNA, 22 bp, Homo sapiens
tcttgtctgcagatactttgaa

SEQ ID NO: 9156983 - DNA, 21 bp, Homo sapiens
ccagcctcagatcagggagct

SEQ ID NO: 9156984 - DNA, 22 bp, Homo sapiens
ccagcctcactggcatcaccta

SEQ ID NO: 9156985 - DNA, 22 bp, Homo sapiens
tcttgggggactttggcatgga

SEQ ID NO: 9156986 - DNA, 22 bp, Homo sapiens
tcttgggggactttggcatgga

SEQ ID NO: 9156987 - DNA, 21 bp, Homo sapiens
tcttggggaggagggctgcac

SEQ ID NO: 9156988 - DNA, 22 bp, Homo sapiens
tcttgccttatgccatgaagca

SEQ ID NO: 9156989 - DNA, 22 bp, Homo sapiens
tgaaaggggttgagttacagct

SEQ ID NO: 9156990 - DNA, 22 bp, Homo sapiens
tgaaagggaacctgctggactg

SEQ ID NO: 9156991 - DNA, 22 bp, Homo sapiens
ccaggctgagcatgattggagc

SEQ ID NO: 9156992 - DNA, 22 bp, Homo sapiens
ccaggctgcagtcaaggggcat

SEQ ID NO: 9156993 - DNA, 22 bp, Homo sapiens
tgaacacataaggctttcctgt

SEQ ID NO: 9156994 - DNA, 22 bp, Homo sapiens
ccaggctgctcacaagctgccc

SEQ ID NO: 9156995 - DNA, 22 bp, Homo sapiens
tgaaatgattatatggtgtttg

SEQ ID NO: 9156996 - DNA, 22 bp, Homo sapiens
tgaacacacacctatgtacaaa

SEQ ID NO: 9156997 - DNA, 21 bp, Homo sapiens
tgaacacagatttgtctgatt

SEQ ID NO: 9156998 - DNA, 22 bp, Homo sapiens
ccaggctgctcacaagctgccc

SEQ ID NO: 9156999 - DNA, 22 bp, Homo sapiens
tgaaatgatgtacaagaaggca

SEQ ID NO: 9157000 - DNA, 22 bp, Homo sapiens
tgaaagcagcaccaataccatt

SEQ ID NO: 9157001 - DNA, 22 bp, Homo sapiens
tgaaacagctatcagtagactg

SEQ ID NO: 9157002 - DNA, 22 bp, Homo sapiens
tgaaacagattgatggtttcta

SEQ ID NO: 9157003 - DNA, 22 bp, Homo sapiens
tgaaacagctatcagtagactg

SEQ ID NO: 9157004 - DNA, 21 bp, Homo sapiens
tgaaacagatggaagtatttg

SEQ ID NO: 9157005 - DNA, 22 bp, Homo sapiens
ccaggctccgcatagaccccac

SEQ ID NO: 9157006 - DNA, 22 bp, Homo sapiens
ccaggctccgcatagaccccac

SEQ ID NO: 9157007 - DNA, 22 bp, Homo sapiens
ccaggctccccaggaggccctt

SEQ ID NO: 9157008 - DNA, 21 bp, Homo sapiens
tgaaacagatggaagtatttg

SEQ ID NO: 9157009 - DNA, 22 bp, Homo sapiens
tgaaagcagtgccatgattatg

SEQ ID NO: 9157010 - DNA, 17 bp, Homo sapiens
tgaagatgcatggcagc

SEQ ID NO: 9157011 - DNA, 22 bp, Homo sapiens
tgaagatcagttttgtgtctga

SEQ ID NO: 9157012 - DNA, 22 bp, Homo sapiens
tgaagattgccctgtctcctgt

SEQ ID NO: 9157013 - DNA, 17 bp, Homo sapiens
tgaagatgcatggcagc

SEQ ID NO: 9157014 - DNA, 22 bp, Homo sapiens
tgaagatattttaaaatactga

SEQ ID NO: 9157015 - DNA, 22 bp, Homo sapiens
tgaagataaattgtactgaaga

SEQ ID NO: 9157016 - DNA, 22 bp, Homo sapiens
tgaagataacagtaaggtattg

SEQ ID NO: 9157017 - DNA, 22 bp, Homo sapiens
tgaagatttagacctctttgcc

SEQ ID NO: 9157018 - DNA, 22 bp, Homo sapiens
tgaagctttaggatgggttcat

SEQ ID NO: 9157019 - DNA, 22 bp, Homo sapiens
tgaaggaaagagggaacatccc

SEQ ID NO: 9157020 - DNA, 22 bp, Homo sapiens
tgaaggaaatgacggcagaaga

SEQ ID NO: 9157021 - DNA, 22 bp, Homo sapiens
tgaagctttcctgtggtcagga

SEQ ID NO: 9157022 - DNA, 17 bp, Homo sapiens
tgaaggaaggatgatgt

SEQ ID NO: 9157023 - DNA, 22 bp, Homo sapiens
tgaaggaagaataggcagtgtt

SEQ ID NO: 9157024 - DNA, 22 bp, Homo sapiens
tgaaggaagaataggcagtgtt

SEQ ID NO: 9157025 - DNA, 22 bp, Homo sapiens
tgaaggaagaataggcagtgtt

SEQ ID NO: 9157026 - DNA, 22 bp, Homo sapiens
tgaaggaaatgacggcagaaga

SEQ ID NO: 9157027 - DNA, 22 bp, Homo sapiens
tgaaggaaatgacggcagaaga

SEQ ID NO: 9157028 - DNA, 22 bp, Homo sapiens
tgaaggacagcagtggctccaa

SEQ ID NO: 9157029 - DNA, 22 bp, Homo sapiens
tgaaggaatggaggatcagagc

SEQ ID NO: 9157030 - DNA, 17 bp, Homo sapiens
tgaaggaaggatgatgt

SEQ ID NO: 9157031 - DNA, 22 bp, Homo sapiens
tgaaggaatgagggagtgggtc

SEQ ID NO: 9157032 - DNA, 22 bp, Homo sapiens
tgaaggaatgagtatactgttt

SEQ ID NO: 9157033 - DNA, 22 bp, Homo sapiens
tgaagagatagaagtacatgct

SEQ ID NO: 9157034 - DNA, 22 bp, Homo sapiens
tgaagagatagaagtacatgct

SEQ ID NO: 9157035 - DNA, 22 bp, Homo sapiens
tgaagagaagaaaattatcttt

SEQ ID NO: 9157036 - DNA, 22 bp, Homo sapiens
tgaagagaagaaaattatcttt

SEQ ID NO: 9157037 - DNA, 22 bp, Homo sapiens
tgaacaggtcttagtaggttct

SEQ ID NO: 9157038 - DNA, 19 bp, Homo sapiens
tgaagagctgtcaaaagtg

SEQ ID NO: 9157039 - DNA, 20 bp, Homo sapiens
tgaagaggaagaggacggcc

SEQ ID NO: 9157040 - DNA, 20 bp, Homo sapiens
tgaagaggaagaggacggcc

SEQ ID NO: 9157041 - DNA, 22 bp, Homo sapiens
tgaagagattaagttggttttg

SEQ ID NO: 9157042 - DNA, 22 bp, Homo sapiens
tgaagagattaagttggttttg

SEQ ID NO: 9157043 - DNA, 20 bp, Homo sapiens
tgaagagtgcgcacattgcc

SEQ ID NO: 9157044 - DNA, 22 bp, Homo sapiens
tgaacagactgacctctgacct

SEQ ID NO: 9157045 - DNA, 22 bp, Homo sapiens
tgaacactgtccagagccatta

SEQ ID NO: 9157046 - DNA, 22 bp, Homo sapiens
tgaacactgtatattcttcttg

SEQ ID NO: 9157047 - DNA, 20 bp, Homo sapiens
tgaacactggggtgtttcag

SEQ ID NO: 9157048 - DNA, 21 bp, Homo sapiens
tgaacactctacccatttttt

SEQ ID NO: 9157049 - DNA, 22 bp, Homo sapiens
tgaacactctggggtgggaggt

SEQ ID NO: 9157050 - DNA, 22 bp, Homo sapiens
tgaacactgccatatttaagaa

SEQ ID NO: 9157051 - DNA, 22 bp, Homo sapiens
tgaacacatttgggaaaatctt

SEQ ID NO: 9157052 - DNA, 22 bp, Homo sapiens
tgaacagagctgattcagctca

SEQ ID NO: 9157053 - DNA, 22 bp, Homo sapiens
tgaacagatggcccagcagagg

SEQ ID NO: 9157054 - DNA, 20 bp, Homo sapiens
tgaacactggggtgtttcag

SEQ ID NO: 9157055 - DNA, 22 bp, Homo sapiens
tgaacagatgtggaggtacctt

SEQ ID NO: 9157056 - DNA, 22 bp, Homo sapiens
tgaacagctatcttgtcagtgt

SEQ ID NO: 9157057 - DNA, 18 bp, Homo sapiens
tgaacagctgagactatc

SEQ ID NO: 9157058 - DNA, 22 bp, Homo sapiens
tgaggaagttgtttctcttcta

SEQ ID NO: 9157059 - DNA, 22 bp, Homo sapiens
tgaggaagttgtttctcttcta

SEQ ID NO: 9157060 - DNA, 23 bp, Homo sapiens
tgagctggtattgtccatctcca

SEQ ID NO: 9157061 - DNA, 22 bp, Homo sapiens
tgaggaatgtgacaaaaccaag

SEQ ID NO: 9157062 - DNA, 22 bp, Homo sapiens
tgaggaatgctgagcagaggaa

SEQ ID NO: 9157063 - DNA, 22 bp, Homo sapiens
tgagctgggctgggctgagctg

SEQ ID NO: 9157064 - DNA, 22 bp, Homo sapiens
tgagctggggtcagctcccctg

SEQ ID NO: 9157065 - DNA, 22 bp, Homo sapiens
tgagctggggtcagctcccctg

SEQ ID NO: 9157066 - DNA, 22 bp, Homo sapiens
tgagctggggtcagctcccctg

SEQ ID NO: 9157067 - DNA, 23 bp, Homo sapiens
tgagctggtattgtccatctcca

SEQ ID NO: 9157068 - DNA, 23 bp, Homo sapiens
tgagctgggcctgcaggggtctc

SEQ ID NO: 9157069 - DNA, 22 bp, Homo sapiens
tgagcagactctgcagagccac

SEQ ID NO: 9157070 - DNA, 22 bp, Homo sapiens
tgagcagaaaagaatgctgagc

SEQ ID NO: 9157071 - DNA, 22 bp, Homo sapiens
tgagctgggaagagcagccaga

SEQ ID NO: 9157072 - DNA, 21 bp, Homo sapiens
tgagctgggagttctgaaaag

SEQ ID NO: 9157073 - DNA, 22 bp, Homo sapiens
tgagctggcttgtcaaccaggg

SEQ ID NO: 9157074 - DNA, 22 bp, Homo sapiens
tgagctgggaagagcagccaga

SEQ ID NO: 9157075 - DNA, 19 bp, Homo sapiens
tgagctggctgagcctctc

SEQ ID NO: 9157076 - DNA, 19 bp, Homo sapiens
tgagctggctgagcctctc

SEQ ID NO: 9157077 - DNA, 22 bp, Homo sapiens
tgagctggcaggggctcaggga

SEQ ID NO: 9157078 - DNA, 22 bp, Homo sapiens
tgagctggcaggggctcaggga

SEQ ID NO: 9157079 - DNA, 22 bp, Homo sapiens
tgagctggcaggggctcaggga

SEQ ID NO: 9157080 - DNA, 22 bp, Homo sapiens
tgagcccaggagttggaggctg

SEQ ID NO: 9157081 - DNA, 22 bp, Homo sapiens
ccaggtaggagagtcaacatgt

SEQ ID NO: 9157082 - DNA, 22 bp, Homo sapiens
ccaggtcaagctcccctgtggt

SEQ ID NO: 9157083 - DNA, 22 bp, Homo sapiens
ccagggttggtattcacctgga

SEQ ID NO: 9157084 - DNA, 22 bp, Homo sapiens
ccagggttggatgagtcactta

SEQ ID NO: 9157085 - DNA, 22 bp, Homo sapiens
ccagggtggcgtagatgctggg

SEQ ID NO: 9157086 - DNA, 22 bp, Homo sapiens
ccagggtggcgtagatgctggg

SEQ ID NO: 9157087 - DNA, 22 bp, Homo sapiens
ccagggtggggtccaggaacca

SEQ ID NO: 9157088 - DNA, 22 bp, Homo sapiens
tgagataacaaaattatcttca

SEQ ID NO: 9157089 - DNA, 21 bp, Homo sapiens
tgagataaatttccttactac

SEQ ID NO: 9157090 - DNA, 22 bp, Homo sapiens
tgagagttttgacgcttgtaac

SEQ ID NO: 9157091 - DNA, 22 bp, Homo sapiens
tgagataaggaagtaattagga

SEQ ID NO: 9157092 - DNA, 22 bp, Homo sapiens
tgagataactctgatttatgtt

SEQ ID NO: 9157093 - DNA, 22 bp, Homo sapiens
tgagataacaaaattatcttca

SEQ ID NO: 9157094 - DNA, 22 bp, Homo sapiens
tgagataacaaaattatcttca

SEQ ID NO: 9157095 - DNA, 22 bp, Homo sapiens
tgagataaggatgttatactcg

SEQ ID NO: 9157096 - DNA, 22 bp, Homo sapiens
tgagataaggatgttatactcg

SEQ ID NO: 9157097 - DNA, 22 bp, Homo sapiens
tgagcaccgccgcatttccaag

SEQ ID NO: 9157098 - DNA, 22 bp, Homo sapiens
tgagcacctactgtattccagg

SEQ ID NO: 9157099 - DNA, 19 bp, Homo sapiens
tgagactgggtgcagtact

SEQ ID NO: 9157100 - DNA, 22 bp, Homo sapiens
ccaggtctatcaagttgggctc

SEQ ID NO: 9157101 - DNA, 22 bp, Homo sapiens
tgagagttattctgaatttagc

SEQ ID NO: 9157102 - DNA, 22 bp, Homo sapiens
tgagagtgaaatgtcacatgtc

SEQ ID NO: 9157103 - DNA, 22 bp, Homo sapiens
tgagagtctgttcctcttgcag

SEQ ID NO: 9157104 - DNA, 22 bp, Homo sapiens
tgagagtctcagacctcctggt

SEQ ID NO: 9157105 - DNA, 22 bp, Homo sapiens
tgagagtagagtcttcatctgt

SEQ ID NO: 9157106 - DNA, 22 bp, Homo sapiens
tgactttaagctatctgattct

SEQ ID NO: 9157107 - DNA, 19 bp, Homo sapiens
tgaccccacgctccagagc

SEQ ID NO: 9157108 - DNA, 22 bp, Homo sapiens
tgacccatttgcttttcctgta

SEQ ID NO: 9157109 - DNA, 22 bp, Homo sapiens
tgacccatggtctgatcatagg

SEQ ID NO: 9157110 - DNA, 22 bp, Homo sapiens
tgaccccactgtgctcagaggt

SEQ ID NO: 9157111 - DNA, 22 bp, Homo sapiens
tgacccctatatcctgtttctt

SEQ ID NO: 9157112 - DNA, 22 bp, Homo sapiens
tgactttagaattttatccaga

SEQ ID NO: 9157113 - DNA, 22 bp, Homo sapiens
tgactttaataggattttgcat

SEQ ID NO: 9157114 - DNA, 22 bp, Homo sapiens
tgactttacagatatgtttcct

SEQ ID NO: 9157115 - DNA, 17 bp, Homo sapiens
tgactttatttgcttgg

SEQ ID NO: 9157116 - DNA, 22 bp, Homo sapiens
tgactttggactagtgatttaa

SEQ ID NO: 9157117 - DNA, 17 bp, Homo sapiens
tgactttatttgcttgg

SEQ ID NO: 9157118 - DNA, 22 bp, Homo sapiens
ccagggtctctgctgcctgaga

SEQ ID NO: 9157119 - DNA, 22 bp, Homo sapiens
ccagggtctctgctgcctgaga

SEQ ID NO: 9157120 - DNA, 22 bp, Homo sapiens
tgagaaaactcaaagacagatc

SEQ ID NO: 9157121 - DNA, 22 bp, Homo sapiens
tgagaaaacagtttgtaataat

SEQ ID NO: 9157122 - DNA, 22 bp, Homo sapiens
tgactttgtccctttcaaatcc

SEQ ID NO: 9157123 - DNA, 22 bp, Homo sapiens
tgactttggataagaaaatgag

SEQ ID NO: 9157124 - DNA, 22 bp, Homo sapiens
tgactttgtccctttcaaatcc

SEQ ID NO: 9157125 - DNA, 22 bp, Homo sapiens
tgactttgtgccatttttataa

SEQ ID NO: 9157126 - DNA, 22 bp, Homo sapiens
tgagaaaacagtttgtaataat

SEQ ID NO: 9157127 - DNA, 22 bp, Homo sapiens
tgacttttggacctcactgtcc

SEQ ID NO: 9157128 - DNA, 22 bp, Homo sapiens
tgaccaaaggtggtttatttgg

SEQ ID NO: 9157129 - DNA, 22 bp, Homo sapiens
tgaccactgaatatgactgcct

SEQ ID NO: 9157130 - DNA, 22 bp, Homo sapiens
tgaccactgaaaacatggctag

SEQ ID NO: 9157131 - DNA, 22 bp, Homo sapiens
tgaccaggatactgcagggatg

SEQ ID NO: 9157132 - DNA, 22 bp, Homo sapiens
tgaccaggctggagtgcagtgg

SEQ ID NO: 9157133 - DNA, 22 bp, Homo sapiens
tgaccatttgatctacattcca

SEQ ID NO: 9157134 - DNA, 23 bp, Homo sapiens
ccagggcccctacaccactgtcc

SEQ ID NO: 9157135 - DNA, 22 bp, Homo sapiens
ccagggcccacggccagaatag

SEQ ID NO: 9157136 - DNA, 22 bp, Homo sapiens
ccagggcccacggccagaatag

SEQ ID NO: 9157137 - DNA, 22 bp, Homo sapiens
ccagggccagtaagattggcat

SEQ ID NO: 9157138 - DNA, 23 bp, Homo sapiens
ccagggcccctacaccactgtcc

SEQ ID NO: 9157139 - DNA, 22 bp, Homo sapiens
tgacatttttataagagtcaaa

SEQ ID NO: 9157140 - DNA, 22 bp, Homo sapiens
tgacagagtccagaagtagtgt

SEQ ID NO: 9157141 - DNA, 22 bp, Homo sapiens
ccagggcatgggaagaactgaa

SEQ ID NO: 9157142 - DNA, 22 bp, Homo sapiens
ccagggcatgtccaagacttag

SEQ ID NO: 9157143 - DNA, 22 bp, Homo sapiens
ccagggcatgtaactaatggtg

SEQ ID NO: 9157144 - DNA, 22 bp, Homo sapiens
tgacagagcatgtagtgacagc

SEQ ID NO: 9157145 - DNA, 22 bp, Homo sapiens
tgacagagcatgtagtgacagc

SEQ ID NO: 9157146 - DNA, 22 bp, Homo sapiens
tgacagagcatgtagtgacagc

SEQ ID NO: 9157147 - DNA, 22 bp, Homo sapiens
tgacagagccaagatcagtact

SEQ ID NO: 9157148 - DNA, 22 bp, Homo sapiens
tgacagagaggtaagttatgaa

SEQ ID NO: 9157149 - DNA, 22 bp, Homo sapiens
tgacagagagcttttgactgtc

SEQ ID NO: 9157150 - DNA, 22 bp, Homo sapiens
tgaaggaatgagtatactgttt

SEQ ID NO: 9157151 - DNA, 22 bp, Homo sapiens
tgaaggagaattaataggcatt

SEQ ID NO: 9157152 - DNA, 21 bp, Homo sapiens
tgaaggagaggaccgagtgct

SEQ ID NO: 9157153 - DNA, 22 bp, Homo sapiens
ccaggcttttagctgcatggca

SEQ ID NO: 9157154 - DNA, 22 bp, Homo sapiens
ccaggctttgtaccaggctttc

SEQ ID NO: 9157155 - DNA, 22 bp, Homo sapiens
ccaggctttcccagcctctcca

SEQ ID NO: 9157156 - DNA, 22 bp, Homo sapiens
ccagggaaacagcccagtgtga

SEQ ID NO: 9157157 - DNA, 22 bp, Homo sapiens
ccagggaaacagcccagtgtga

SEQ ID NO: 9157158 - DNA, 22 bp, Homo sapiens
ccagggaaaatcaacttctact

SEQ ID NO: 9157159 - DNA, 22 bp, Homo sapiens
ccagggaaattaatgagttaat

SEQ ID NO: 9157160 - DNA, 22 bp, Homo sapiens
ccagggaagaaagatgaagtgc

SEQ ID NO: 9157161 - DNA, 22 bp, Homo sapiens
ccagggaagaaagatgaagtgc

SEQ ID NO: 9157162 - DNA, 22 bp, Homo sapiens
ccagggaaaggaggttgacttg

SEQ ID NO: 9157163 - DNA, 22 bp, Homo sapiens
ccagggaaaggaggttgacttg

SEQ ID NO: 9157164 - DNA, 22 bp, Homo sapiens
ccagggaaactttggagtggag

SEQ ID NO: 9157165 - DNA, 22 bp, Homo sapiens
ccagggaaactttggagtggag

SEQ ID NO: 9157166 - DNA, 22 bp, Homo sapiens
ccagggaaactttggagtggag

SEQ ID NO: 9157167 - DNA, 21 bp, Homo sapiens
ccagggaagaaatgagggcag

SEQ ID NO: 9157168 - DNA, 21 bp, Homo sapiens
ccagggaagaaatgagggcag

SEQ ID NO: 9157169 - DNA, 21 bp, Homo sapiens
ccagggaagaaatgagggcag

SEQ ID NO: 9157170 - DNA, 21 bp, Homo sapiens
ccagggaagaaatgagggcag

SEQ ID NO: 9157171 - DNA, 22 bp, Homo sapiens
ccagggaagaataggtgtggtt

SEQ ID NO: 9157172 - DNA, 22 bp, Homo sapiens
ccagggaagaataggtgtggtt

SEQ ID NO: 9157173 - DNA, 22 bp, Homo sapiens
ccagggaagaccacttcctgga

SEQ ID NO: 9157174 - DNA, 22 bp, Homo sapiens
tgacaattgtgggcagtttgtg

SEQ ID NO: 9157175 - DNA, 22 bp, Homo sapiens
tgacaattcattatatctacag

SEQ ID NO: 9157176 - DNA, 22 bp, Homo sapiens
tgacaattgcagacacagaagt

SEQ ID NO: 9157177 - DNA, 22 bp, Homo sapiens
tgacagagacttcagagccaaa

SEQ ID NO: 9157178 - DNA, 22 bp, Homo sapiens
tgacagagagatgggaaagggc

SEQ ID NO: 9157179 - DNA, 22 bp, Homo sapiens
tgacagagacttcagagccaaa

SEQ ID NO: 9157180 - DNA, 22 bp, Homo sapiens
tgtcaagttgttaagttctggg

SEQ ID NO: 9157181 - DNA, 22 bp, Homo sapiens
tgtcaacatttatcaagttatt

SEQ ID NO: 9157182 - DNA, 22 bp, Homo sapiens
tgtcaacagatctcaaagctgg

SEQ ID NO: 9157183 - DNA, 22 bp, Homo sapiens
tgtcaacagatctcaaagctgg

SEQ ID NO: 9157184 - DNA, 22 bp, Homo sapiens
tgtcaacattggctgacagttg

SEQ ID NO: 9157185 - DNA, 22 bp, Homo sapiens
tgtcaacacacctatctcaatt

SEQ ID NO: 9157186 - DNA, 22 bp, Homo sapiens
tgtcaacagatactagagagct

SEQ ID NO: 9157187 - DNA, 22 bp, Homo sapiens
tgtattccaaaatgctgaggat

SEQ ID NO: 9157188 - DNA, 22 bp, Homo sapiens
tgtcaaatttttattgcagtat

SEQ ID NO: 9157189 - DNA, 22 bp, Homo sapiens
cctggagggcgccgcacagtcc

SEQ ID NO: 9157190 - DNA, 22 bp, Homo sapiens
cctggaggggaccaggaccagg

SEQ ID NO: 9157191 - DNA, 18 bp, Homo sapiens
cctggaggtcttcggggt

SEQ ID NO: 9157192 - DNA, 22 bp, Homo sapiens
cctggaggagcgctgaccagct

SEQ ID NO: 9157193 - DNA, 22 bp, Homo sapiens
cctggagcttttccatcctgga

SEQ ID NO: 9157194 - DNA, 22 bp, Homo sapiens
cctggaggagcgctgaccagct

SEQ ID NO: 9157195 - DNA, 22 bp, Homo sapiens
cctggaggagcgctgaccagct

SEQ ID NO: 9157196 - DNA, 22 bp, Homo sapiens
cctggagcttttccatcctgga

SEQ ID NO: 9157197 - DNA, 22 bp, Homo sapiens
cctggagcttttccatcctgga

SEQ ID NO: 9157198 - DNA, 22 bp, Homo sapiens
cctggagcttttccagttgaca

SEQ ID NO: 9157199 - DNA, 22 bp, Homo sapiens
cctggagcttggtcacgctgcg

SEQ ID NO: 9157200 - DNA, 18 bp, Homo sapiens
cctggagctccacagcaa

SEQ ID NO: 9157201 - DNA, 22 bp, Homo sapiens
cctggagcttggtcacgctgcg

SEQ ID NO: 9157202 - DNA, 18 bp, Homo sapiens
cctggagctccacagcaa

SEQ ID NO: 9157203 - DNA, 18 bp, Homo sapiens
cctggagctccacagcaa

SEQ ID NO: 9157204 - DNA, 18 bp, Homo sapiens
cctggagctccacagcaa

SEQ ID NO: 9157205 - DNA, 22 bp, Homo sapiens
cctggagggaccctggccctgt

SEQ ID NO: 9157206 - DNA, 22 bp, Homo sapiens
cctggagggcgccgcacagtcc

SEQ ID NO: 9157207 - DNA, 22 bp, Homo sapiens
cctggagggcgccgcacagtcc

SEQ ID NO: 9157208 - DNA, 22 bp, Homo sapiens
cctggagggcagcccattctgg

SEQ ID NO: 9157209 - DNA, 22 bp, Homo sapiens
cctggagggcagcccattctgg

SEQ ID NO: 9157210 - DNA, 22 bp, Homo sapiens
cctggaggcggaggttgcagtg

SEQ ID NO: 9157211 - DNA, 22 bp, Homo sapiens
cctggaggcagaaataggactt

SEQ ID NO: 9157212 - DNA, 22 bp, Homo sapiens
cctggaggcggaggttgcagtg

SEQ ID NO: 9157213 - DNA, 22 bp, Homo sapiens
cctggaggcggaggttgcagtg

SEQ ID NO: 9157214 - DNA, 22 bp, Homo sapiens
tgtaattgcttgtttacctgct

SEQ ID NO: 9157215 - DNA, 22 bp, Homo sapiens
tgtaattaacgttcttgttaga

SEQ ID NO: 9157216 - DNA, 22 bp, Homo sapiens
tgtaattaaactgaagacagaa

SEQ ID NO: 9157217 - DNA, 22 bp, Homo sapiens
tgtacatacatagatatacaca

SEQ ID NO: 9157218 - DNA, 22 bp, Homo sapiens
cctggagcactctccctggctg

SEQ ID NO: 9157219 - DNA, 22 bp, Homo sapiens
cctggagcactctccctggctg

SEQ ID NO: 9157220 - DNA, 22 bp, Homo sapiens
tgtacattgtcactcatcaagt

SEQ ID NO: 9157221 - DNA, 22 bp, Homo sapiens
tgtacattgtcactcatcaagt

SEQ ID NO: 9157222 - DNA, 22 bp, Homo sapiens
tgtacattttctcagagtttat

SEQ ID NO: 9157223 - DNA, 22 bp, Homo sapiens
tgtacatttagagctcaataga

SEQ ID NO: 9157224 - DNA, 22 bp, Homo sapiens
tgtacatagaaaggatacagct

SEQ ID NO: 9157225 - DNA, 19 bp, Homo sapiens
tgtacatatagagctcagt

SEQ ID NO: 9157226 - DNA, 19 bp, Homo sapiens
tgtacatatagagctcagt

SEQ ID NO: 9157227 - DNA, 22 bp, Homo sapiens
tgtacatacatagatatacaca

SEQ ID NO: 9157228 - DNA, 22 bp, Homo sapiens
cctgcttaacattgccatgaca

SEQ ID NO: 9157229 - DNA, 22 bp, Homo sapiens
cctgctgttctgtttagtgaac

SEQ ID NO: 9157230 - DNA, 22 bp, Homo sapiens
cctgctgttttcttcacttcag

SEQ ID NO: 9157231 - DNA, 20 bp, Homo sapiens
cctgctgtgctttccatgga

SEQ ID NO: 9157232 - DNA, 21 bp, Homo sapiens
cctgctgtgatcttagtgagt

SEQ ID NO: 9157233 - DNA, 22 bp, Homo sapiens
cctgctgtgtccctggctttct

SEQ ID NO: 9157234 - DNA, 22 bp, Homo sapiens
cctgctgttagatttcagtcac

SEQ ID NO: 9157235 - DNA, 22 bp, Homo sapiens
cctgctgttctgtttagtgaac

SEQ ID NO: 9157236 - DNA, 22 bp, Homo sapiens
cctgcttccttcaagtttatct

SEQ ID NO: 9157237 - DNA, 22 bp, Homo sapiens
cctgcttaacattgccatgaca

SEQ ID NO: 9157238 - DNA, 22 bp, Homo sapiens
tgtaagtctggcttatagcttt

SEQ ID NO: 9157239 - DNA, 22 bp, Homo sapiens
tgtaagtagtaatggaaggaca

SEQ ID NO: 9157240 - DNA, 22 bp, Homo sapiens
tgtaagtagtaatggaaggaca

SEQ ID NO: 9157241 - DNA, 21 bp, Homo sapiens
tgtaagtttcatctgaattgg

SEQ ID NO: 9157242 - DNA, 22 bp, Homo sapiens
tgtaatcattacagtacatgga

SEQ ID NO: 9157243 - DNA, 21 bp, Homo sapiens
tgtaagtttcatctgaattgg

SEQ ID NO: 9157244 - DNA, 22 bp, Homo sapiens
cctgctggccactgctccacct

SEQ ID NO: 9157245 - DNA, 22 bp, Homo sapiens
cctgctggccactgctccacct

SEQ ID NO: 9157246 - DNA, 22 bp, Homo sapiens
cctgctggcggggacccagtga

SEQ ID NO: 9157247 - DNA, 22 bp, Homo sapiens
cctgctgggacgtgtggttgcc

SEQ ID NO: 9157248 - DNA, 22 bp, Homo sapiens
cctgctgggcctgagcaatgag

SEQ ID NO: 9157249 - DNA, 22 bp, Homo sapiens
cctgctggcgtggctggcgccc

SEQ ID NO: 9157250 - DNA, 22 bp, Homo sapiens
cctgctggcgtggctggcgccc

SEQ ID NO: 9157251 - DNA, 22 bp, Homo sapiens
cctgctggctggtagagttccg

SEQ ID NO: 9157252 - DNA, 22 bp, Homo sapiens
cctgctgtgaaactggcatatg

SEQ ID NO: 9157253 - DNA, 22 bp, Homo sapiens
cctgctgtccctctgggctcca

SEQ ID NO: 9157254 - DNA, 22 bp, Homo sapiens
cctgctgtctctgggcaggcag

SEQ ID NO: 9157255 - DNA, 22 bp, Homo sapiens
cctgctgtgaagccaggcctgt

SEQ ID NO: 9157256 - DNA, 22 bp, Homo sapiens
cctgctgtgaagccaggcctgt

SEQ ID NO: 9157257 - DNA, 22 bp, Homo sapiens
cctgctgtgaccggggagcagg

SEQ ID NO: 9157258 - DNA, 21 bp, Homo sapiens
cctgctgtgatcttagtgagt

SEQ ID NO: 9157259 - DNA, 22 bp, Homo sapiens
cctgctgtcagcatcctcgcga

SEQ ID NO: 9157260 - DNA, 22 bp, Homo sapiens
cctgctgtcagcatcctcgcga

SEQ ID NO: 9157261 - DNA, 22 bp, Homo sapiens
cctgctgtaatgtgtctttatt

SEQ ID NO: 9157262 - DNA, 22 bp, Homo sapiens
cctgctgtaatgtgtctttatt

SEQ ID NO: 9157263 - DNA, 22 bp, Homo sapiens
tggtctcttcttccaagatggc

SEQ ID NO: 9157264 - DNA, 21 bp, Homo sapiens
tggtctgaaagtatttgtggc

SEQ ID NO: 9157265 - DNA, 22 bp, Homo sapiens
tggtctgaactaagacagtagt

SEQ ID NO: 9157266 - DNA, 22 bp, Homo sapiens
tggtctcttttcagcctgggga

SEQ ID NO: 9157267 - DNA, 22 bp, Homo sapiens
tggtctctgtgctcgggcatgg

SEQ ID NO: 9157268 - DNA, 23 bp, Homo sapiens
cctgcctgttctaactccatttc

SEQ ID NO: 9157269 - DNA, 22 bp, Homo sapiens
cctgccttcagccctgaagtct

SEQ ID NO: 9157270 - DNA, 22 bp, Homo sapiens
tggtctgataccggattccagt

SEQ ID NO: 9157271 - DNA, 22 bp, Homo sapiens
tggtctgagcaactgccctatc

SEQ ID NO: 9157272 - DNA, 23 bp, Homo sapiens
tggtctgacttgtagctgtgaga

SEQ ID NO: 9157273 - DNA, 22 bp, Homo sapiens
tggtctgagcggggccattcag

SEQ ID NO: 9157274 - DNA, 22 bp, Homo sapiens
tggtctgaggaacaccagcact

SEQ ID NO: 9157275 - DNA, 22 bp, Homo sapiens
tggtctgaaggacttctgaggg

SEQ ID NO: 9157276 - DNA, 22 bp, Homo sapiens
tggtctgaatgacttgttagtt

SEQ ID NO: 9157277 - DNA, 22 bp, Homo sapiens
tggtctgacttgctttggacag

SEQ ID NO: 9157278 - DNA, 22 bp, Homo sapiens
tggtctgactacaataggaaga

SEQ ID NO: 9157279 - DNA, 22 bp, Homo sapiens
tggtctgaaggtggatttgaga

SEQ ID NO: 9157280 - DNA, 22 bp, Homo sapiens
tggtctgaaggacttctgaggg

SEQ ID NO: 9157281 - DNA, 23 bp, Homo sapiens
tggtctgaagcctcaggttcctc

SEQ ID NO: 9157282 - DNA, 22 bp, Homo sapiens
tggtctgaacacattttaggta

SEQ ID NO: 9157283 - DNA, 22 bp, Homo sapiens
tggtctgatttctttctggagt

SEQ ID NO: 9157284 - DNA, 22 bp, Homo sapiens
tggtctgattccacctaactga

SEQ ID NO: 9157285 - DNA, 22 bp, Homo sapiens
tggtctgatattttttcttacc

SEQ ID NO: 9157286 - DNA, 22 bp, Homo sapiens
tggtctgatagtctgaaaatga

SEQ ID NO: 9157287 - DNA, 22 bp, Homo sapiens
tggtctgatggtcccaccaccg

SEQ ID NO: 9157288 - DNA, 22 bp, Homo sapiens
tggtctgcatttattcaagact

SEQ ID NO: 9157289 - DNA, 22 bp, Homo sapiens
tggtctgattcttgctccccaa

SEQ ID NO: 9157290 - DNA, 22 bp, Homo sapiens
tggtctgatttttcatctgttg

SEQ ID NO: 9157291 - DNA, 17 bp, Homo sapiens
tggtctggaagaactga

SEQ ID NO: 9157292 - DNA, 20 bp, Homo sapiens
tggtctggagccagtgagga

SEQ ID NO: 9157293 - DNA, 22 bp, Homo sapiens
tggtctgggcaaatccttctga

SEQ ID NO: 9157294 - DNA, 22 bp, Homo sapiens
tggtctggggaccgagggttac

SEQ ID NO: 9157295 - DNA, 22 bp, Homo sapiens
cctgctgctatgaaggtgacag

SEQ ID NO: 9157296 - DNA, 22 bp, Homo sapiens
cctgccagggccagaggccagc

SEQ ID NO: 9157297 - DNA, 22 bp, Homo sapiens
cctgccagtcactatgtcacct

SEQ ID NO: 9157298 - DNA, 22 bp, Homo sapiens
cctgccagggccttggaagaaa

SEQ ID NO: 9157299 - DNA, 18 bp, Homo sapiens
cctgccagtctggagcag

SEQ ID NO: 9157300 - DNA, 22 bp, Homo sapiens
cctgccaggctttgggcttctg

SEQ ID NO: 9157301 - DNA, 22 bp, Homo sapiens
cctgccaggcgagtctaggcca

SEQ ID NO: 9157302 - DNA, 22 bp, Homo sapiens
cctgccaggctttcaggtttgg

SEQ ID NO: 9157303 - DNA, 22 bp, Homo sapiens
cctgccaggcgagtctaggcca

SEQ ID NO: 9157304 - DNA, 22 bp, Homo sapiens
cctgccaggcgagtctaggcca

SEQ ID NO: 9157305 - DNA, 22 bp, Homo sapiens
cctgccaggccagtgagcttcc

SEQ ID NO: 9157306 - DNA, 22 bp, Homo sapiens
tgggtcagacagccagtgggcc

SEQ ID NO: 9157307 - DNA, 22 bp, Homo sapiens
tgggtcagacagccagtgggcc

SEQ ID NO: 9157308 - DNA, 22 bp, Homo sapiens
tgggtcagaatcagagagttgc

SEQ ID NO: 9157309 - DNA, 22 bp, Homo sapiens
tgggtcagaatcagagagttgc

SEQ ID NO: 9157310 - DNA, 22 bp, Homo sapiens
tgggtcagagctgtgctgccca

SEQ ID NO: 9157311 - DNA, 22 bp, Homo sapiens
tgggtcagagctgtgctgccca

SEQ ID NO: 9157312 - DNA, 22 bp, Homo sapiens
tgggtaggtgctggggattcag

SEQ ID NO: 9157313 - DNA, 22 bp, Homo sapiens
tgggtaggtgctggggattcag

SEQ ID NO: 9157314 - DNA, 22 bp, Homo sapiens
tgggtcagaggacctcgtggcc

SEQ ID NO: 9157315 - DNA, 22 bp, Homo sapiens
tgggtcaggctgggagtcctga

SEQ ID NO: 9157316 - DNA, 22 bp, Homo sapiens
tgggtcagtttgggggccagcc

SEQ ID NO: 9157317 - DNA, 20 bp, Homo sapiens
cctgcctgcctcggctcatt

SEQ ID NO: 9157318 - DNA, 22 bp, Homo sapiens
cctgcctgggctcacttgccag

SEQ ID NO: 9157319 - DNA, 22 bp, Homo sapiens
cctgcctggcttccagaagaga

SEQ ID NO: 9157320 - DNA, 22 bp, Homo sapiens
cctgcctgtcatcgcctgcgcc

SEQ ID NO: 9157321 - DNA, 22 bp, Homo sapiens
cctgcctgtcatcgcctgcgcc

SEQ ID NO: 9157322 - DNA, 22 bp, Homo sapiens
cctgcctggtgtaagtctaagg

SEQ ID NO: 9157323 - DNA, 22 bp, Homo sapiens
cctgcctgtaagatgggtacaa

SEQ ID NO: 9157324 - DNA, 20 bp, Homo sapiens
cctgcctgtgtttgtgatga

SEQ ID NO: 9157325 - DNA, 20 bp, Homo sapiens
cctgcctgtgtttgtgatga

SEQ ID NO: 9157326 - DNA, 23 bp, Homo sapiens
cctgcctgttctaactccatttc

SEQ ID NO: 9157327 - DNA, 22 bp, Homo sapiens
cctgcctgtccctcagtccaca

SEQ ID NO: 9157328 - DNA, 22 bp, Homo sapiens
cctgcctgtccctcagtccaca

SEQ ID NO: 9157329 - DNA, 23 bp, Homo sapiens
tggctctctcagtgctgcagagg

SEQ ID NO: 9157330 - DNA, 22 bp, Homo sapiens
tggctctcagctcccagcagcc

SEQ ID NO: 9157331 - DNA, 22 bp, Homo sapiens
cctccctgccggctggactagt

SEQ ID NO: 9157332 - DNA, 22 bp, Homo sapiens
cctccctgcgctcctgcggcgg

SEQ ID NO: 9157333 - DNA, 22 bp, Homo sapiens
cctccctgctcctcaactggca

SEQ ID NO: 9157334 - DNA, 21 bp, Homo sapiens
tgggagagcgttgctgtcctc

SEQ ID NO: 9157335 - DNA, 21 bp, Homo sapiens
tgggagagcgttgctgtcctc

SEQ ID NO: 9157336 - DNA, 21 bp, Homo sapiens
tgggagagcgttgctgtcctc

SEQ ID NO: 9157337 - DNA, 22 bp, Homo sapiens
tgggagcaggtgtgctagggaa

SEQ ID NO: 9157338 - DNA, 21 bp, Homo sapiens
tggctctgaaagagtgctgca

SEQ ID NO: 9157339 - DNA, 22 bp, Homo sapiens
tggctctgaccaggtagaggag

SEQ ID NO: 9157340 - DNA, 20 bp, Homo sapiens
tggctctctctagtaagtgg

SEQ ID NO: 9157341 - DNA, 21 bp, Homo sapiens
tggctctgaaagagtgctgca

SEQ ID NO: 9157342 - DNA, 22 bp, Homo sapiens
cctctggagtcagaccagcttg

SEQ ID NO: 9157343 - DNA, 22 bp, Homo sapiens
cctctggagtcagaccagcttg

SEQ ID NO: 9157344 - DNA, 22 bp, Homo sapiens
cctctggatctttctccacact

SEQ ID NO: 9157345 - DNA, 22 bp, Homo sapiens
cctctggcaacttcacagccca

SEQ ID NO: 9157346 - DNA, 22 bp, Homo sapiens
tgggagctcagaaagggaggtc

SEQ ID NO: 9157347 - DNA, 22 bp, Homo sapiens
cctctggcagccagccagttgt

SEQ ID NO: 9157348 - DNA, 22 bp, Homo sapiens
cctctggcatagcaagtggcct

SEQ ID NO: 9157349 - DNA, 22 bp, Homo sapiens
cctctggcatagcaagtggcct

SEQ ID NO: 9157350 - DNA, 16 bp, Homo sapiens
cctctggcaattagat

SEQ ID NO: 9157351 - DNA, 22 bp, Homo sapiens
cctctggcaagtgatttatcat

SEQ ID NO: 9157352 - DNA, 22 bp, Homo sapiens
tgggagcaggtgtgctagggaa

SEQ ID NO: 9157353 - DNA, 22 bp, Homo sapiens
tgggagcaggctgatgataggt

SEQ ID NO: 9157354 - DNA, 22 bp, Homo sapiens
tgggagcaggtgtgctagggaa

SEQ ID NO: 9157355 - DNA, 22 bp, Homo sapiens
tgggagcagttgtgaagctcag

SEQ ID NO: 9157356 - DNA, 22 bp, Homo sapiens
cctctttgttcaggctgctggc

SEQ ID NO: 9157357 - DNA, 22 bp, Homo sapiens
cctctttgtgcctgcaggctgc

SEQ ID NO: 9157358 - DNA, 22 bp, Homo sapiens
cctctttgactctcaggtcttt

SEQ ID NO: 9157359 - DNA, 22 bp, Homo sapiens
cctctttaatcccatccatgtg

SEQ ID NO: 9157360 - DNA, 22 bp, Homo sapiens
cctgaaaatatcctctcctttg

SEQ ID NO: 9157361 - DNA, 22 bp, Homo sapiens
cctgaaaatcaaggtagtttgg

SEQ ID NO: 9157362 - DNA, 22 bp, Homo sapiens
cctgaagcaagggtaggcaggt

SEQ ID NO: 9157363 - DNA, 22 bp, Homo sapiens
cctgaagcacaaaagcacagct

SEQ ID NO: 9157364 - DNA, 22 bp, Homo sapiens
cctgaagggactccagagagca

SEQ ID NO: 9157365 - DNA, 22 bp, Homo sapiens
cctgaaggaaactggaaataca

SEQ ID NO: 9157366 - DNA, 17 bp, Homo sapiens
cctgaaggcacttccag

SEQ ID NO: 9157367 - DNA, 23 bp, Homo sapiens
cctgaagggtcagggtcctcagc

SEQ ID NO: 9157368 - DNA, 22 bp, Homo sapiens
cctgaatgcctgacatttcact

SEQ ID NO: 9157369 - DNA, 22 bp, Homo sapiens
cctcttgaatgccaggaaggac

SEQ ID NO: 9157370 - DNA, 22 bp, Homo sapiens
cctcttgaagagaagagttact

SEQ ID NO: 9157371 - DNA, 22 bp, Homo sapiens
cctcttgaacctaggcaagact

SEQ ID NO: 9157372 - DNA, 22 bp, Homo sapiens
cctcttctgcttcaggagcact

SEQ ID NO: 9157373 - DNA, 22 bp, Homo sapiens
cctcttgagaggcactcaggtt

SEQ ID NO: 9157374 - DNA, 22 bp, Homo sapiens
cctcttgaggccgggccggatc

SEQ ID NO: 9157375 - DNA, 22 bp, Homo sapiens
cctcttgacagcctctgtttcc

SEQ ID NO: 9157376 - DNA, 22 bp, Homo sapiens
cctcttgactctaaatcccgcg

SEQ ID NO: 9157377 - DNA, 22 bp, Homo sapiens
cctctttaagtggtaaccctta

SEQ ID NO: 9157378 - DNA, 22 bp, Homo sapiens
cctctttaatcccatccatgtg

SEQ ID NO: 9157379 - DNA, 22 bp, Homo sapiens
cctcttgccaatcagctacaga

SEQ ID NO: 9157380 - DNA, 22 bp, Homo sapiens
cctctttaagtggtaaccctta

SEQ ID NO: 9157381 - DNA, 21 bp, Homo sapiens
cctcttgatttttagctctgg

SEQ ID NO: 9157382 - DNA, 22 bp, Homo sapiens
cctcttgattggttggaagcgg

SEQ ID NO: 9157383 - DNA, 22 bp, Homo sapiens
cctcttgatttggctgtgaagt

SEQ ID NO: 9157384 - DNA, 22 bp, Homo sapiens
cctcttgagtgtctgttttcca

SEQ ID NO: 9157385 - DNA, 22 bp, Homo sapiens
cctcttgagttctttaaaagct

SEQ ID NO: 9157386 - DNA, 22 bp, Homo sapiens
tgggccacgtgacccttaccct

SEQ ID NO: 9157387 - DNA, 23 bp, Homo sapiens
tgggccactatagaaatctctca

SEQ ID NO: 9157388 - DNA, 22 bp, Homo sapiens
tgggccactgctgcggaaggcg

SEQ ID NO: 9157389 - DNA, 22 bp, Homo sapiens
tgggccactgctccaagtagct

SEQ ID NO: 9157390 - DNA, 22 bp, Homo sapiens
cctctggcctaggccgggagag

SEQ ID NO: 9157391 - DNA, 22 bp, Homo sapiens
cctctggccattctttgatgga

SEQ ID NO: 9157392 - DNA, 22 bp, Homo sapiens
cctctggccattctttgatgga

SEQ ID NO: 9157393 - DNA, 22 bp, Homo sapiens
cctctggccacatgggacatag

SEQ ID NO: 9157394 - DNA, 22 bp, Homo sapiens
cctctggccagagaaaggccag

SEQ ID NO: 9157395 - DNA, 22 bp, Homo sapiens
cctctggccatcccccattaag

SEQ ID NO: 9157396 - DNA, 21 bp, Homo sapiens
tgggccagatctgagtttcta

SEQ ID NO: 9157397 - DNA, 22 bp, Homo sapiens
tgggccagatccatggcaataa

SEQ ID NO: 9157398 - DNA, 22 bp, Homo sapiens
tgggccagaggcatggagctat

SEQ ID NO: 9157399 - DNA, 22 bp, Homo sapiens
tgggccagaggcatggagctat

SEQ ID NO: 9157400 - DNA, 22 bp, Homo sapiens
tgggccagaggcatggagctat

SEQ ID NO: 9157401 - DNA, 22 bp, Homo sapiens
tgggccagagagtaagaaaggt

SEQ ID NO: 9157402 - DNA, 22 bp, Homo sapiens
tgggccagaagtatgcatgttt

SEQ ID NO: 9157403 - DNA, 22 bp, Homo sapiens
cctgaggggctgcaggccagct

SEQ ID NO: 9157404 - DNA, 22 bp, Homo sapiens
cctgaggggctgcaggccagct

SEQ ID NO: 9157405 - DNA, 22 bp, Homo sapiens
cctgaggggaagcttcccaaga

SEQ ID NO: 9157406 - DNA, 22 bp, Homo sapiens
cctgaggggctgcaggccagct

SEQ ID NO: 9157407 - DNA, 22 bp, Homo sapiens
cctgagggcgccgagctcccag

SEQ ID NO: 9157408 - DNA, 22 bp, Homo sapiens
cctgagggctcagcccccagcc

SEQ ID NO: 9157409 - DNA, 22 bp, Homo sapiens
cctgagggaaggatgctaccca

SEQ ID NO: 9157410 - DNA, 22 bp, Homo sapiens
cctgagggagggtataggctgt

SEQ ID NO: 9157411 - DNA, 22 bp, Homo sapiens
cctgaggctggcccttccatcc

SEQ ID NO: 9157412 - DNA, 22 bp, Homo sapiens
cctgagctggcagtgacctgga

SEQ ID NO: 9157413 - DNA, 22 bp, Homo sapiens
cctgagcttgatccttctgtct

SEQ ID NO: 9157414 - DNA, 22 bp, Homo sapiens
cctgagaaacctggtgcaatta

SEQ ID NO: 9157415 - DNA, 22 bp, Homo sapiens
cctgactctggccaggccagct

SEQ ID NO: 9157416 - DNA, 22 bp, Homo sapiens
cctgactcctgggcaaaaccaa

SEQ ID NO: 9157417 - DNA, 22 bp, Homo sapiens
cctgacctccaagtggctctgg

SEQ ID NO: 9157418 - DNA, 22 bp, Homo sapiens
cctgacctatttttctcagctg

SEQ ID NO: 9157419 - DNA, 22 bp, Homo sapiens
cctgacctccaagtggctctgg

SEQ ID NO: 9157420 - DNA, 22 bp, Homo sapiens
cctgacgaaaggcgtgctggag

SEQ ID NO: 9157421 - DNA, 22 bp, Homo sapiens
cctgagaagactgtttctttga

SEQ ID NO: 9157422 - DNA, 22 bp, Homo sapiens
cctgacttaagtctcctgttgg

SEQ ID NO: 9157423 - DNA, 22 bp, Homo sapiens
cctgacagtggtagccttggca

SEQ ID NO: 9157424 - DNA, 22 bp, Homo sapiens
cctgacagttaattgtcctgta

SEQ ID NO: 9157425 - DNA, 22 bp, Homo sapiens
cctgacagtggtagccttggca

SEQ ID NO: 9157426 - DNA, 22 bp, Homo sapiens
cctgacagttaattgtcctgta

SEQ ID NO: 9157427 - DNA, 22 bp, Homo sapiens
cctgacaggagaagcgcagcat

SEQ ID NO: 9157428 - DNA, 22 bp, Homo sapiens
cctgacaggagaagcgcagcat

SEQ ID NO: 9157429 - DNA, 22 bp, Homo sapiens
cctgacagcgtgtccctggccc

SEQ ID NO: 9157430 - DNA, 22 bp, Homo sapiens
cctgaatggtctccaaatagat

SEQ ID NO: 9157431 - DNA, 22 bp, Homo sapiens
cctgacaaggctaacaaaaggc

SEQ ID NO: 9157432 - DNA, 22 bp, Homo sapiens
cctgacagcgtgtccctggccc

SEQ ID NO: 9157433 - DNA, 21 bp, Homo sapiens
cctgacctaatttgccatcag

SEQ ID NO: 9157434 - DNA, 23 bp, Homo sapiens
cctgaccctgtctccctcacatg

SEQ ID NO: 9157435 - DNA, 23 bp, Homo sapiens
cctgaccctgtctccctcacatg

SEQ ID NO: 9157436 - DNA, 22 bp, Homo sapiens
cctgaccccagcacttgtccct

SEQ ID NO: 9157437 - DNA, 22 bp, Homo sapiens
cctgaccccagcacttgtccct

SEQ ID NO: 9157438 - DNA, 22 bp, Homo sapiens
cctgaccctccttagagtccag

SEQ ID NO: 9157439 - DNA, 22 bp, Homo sapiens
cctgaccctccttagagtccag

SEQ ID NO: 9157440 - DNA, 19 bp, Homo sapiens
cctgaccacacaggccttg

SEQ ID NO: 9157441 - DNA, 22 bp, Homo sapiens
cctgccagagcagcttgtcctc

SEQ ID NO: 9157442 - DNA, 22 bp, Homo sapiens
cctgccagacgcaccagggggc

SEQ ID NO: 9157443 - DNA, 22 bp, Homo sapiens
cctgccaggagctggtgctgca

SEQ ID NO: 9157444 - DNA, 22 bp, Homo sapiens
cctgccaggagctggtgctgca

SEQ ID NO: 9157445 - DNA, 22 bp, Homo sapiens
tggggtcgagggttctctggca

SEQ ID NO: 9157446 - DNA, 17 bp, Homo sapiens
tggggtccccgatggtg

SEQ ID NO: 9157447 - DNA, 22 bp, Homo sapiens
cctgcacatgtgtgcgcctgta

SEQ ID NO: 9157448 - DNA, 22 bp, Homo sapiens
cctgcaccacactcactgctca

SEQ ID NO: 9157449 - DNA, 21 bp, Homo sapiens
cctgagggtggttgtgaagat

SEQ ID NO: 9157450 - DNA, 22 bp, Homo sapiens
tgggggtgtcctggtgcacaca

SEQ ID NO: 9157451 - DNA, 22 bp, Homo sapiens
tgggggtggttcttgcctccag

SEQ ID NO: 9157452 - DNA, 22 bp, Homo sapiens
tggggtcagcaggcctggcctg

SEQ ID NO: 9157453 - DNA, 22 bp, Homo sapiens
tgggggtgtgccagggacctcc

SEQ ID NO: 9157454 - DNA, 22 bp, Homo sapiens
tgggggtgtgccagggacctcc

SEQ ID NO: 9157455 - DNA, 22 bp, Homo sapiens
ccgggagcaggcgccaccgcca

SEQ ID NO: 9157456 - DNA, 22 bp, Homo sapiens
ccggctactcgggaggctgacg

SEQ ID NO: 9157457 - DNA, 22 bp, Homo sapiens
ccggctactcgggaggctgacg

SEQ ID NO: 9157458 - DNA, 22 bp, Homo sapiens
ccgggcctcgggacaccgggta

SEQ ID NO: 9157459 - DNA, 22 bp, Homo sapiens
ccgggcctcgggacaccgggta

SEQ ID NO: 9157460 - DNA, 22 bp, Homo sapiens
ccgggcctcgggacaccgggta

SEQ ID NO: 9157461 - DNA, 22 bp, Homo sapiens
ccgggcgggggctctcgtcacc

SEQ ID NO: 9157462 - DNA, 22 bp, Homo sapiens
ccgggcgggggctctcgtcacc

SEQ ID NO: 9157463 - DNA, 22 bp, Homo sapiens
ccgggagcaggcgccaccgcca

SEQ ID NO: 9157464 - DNA, 22 bp, Homo sapiens
ccgtccccagccacctgctgat

SEQ ID NO: 9157465 - DNA, 22 bp, Homo sapiens
ccgtggagttgtgctgagtatg

SEQ ID NO: 9157466 - DNA, 22 bp, Homo sapiens
ccgtggctggactggcattcag

SEQ ID NO: 9157467 - DNA, 18 bp, Homo sapiens
ccgggctttggtgacaca

SEQ ID NO: 9157468 - DNA, 22 bp, Homo sapiens
ccggtcccaggtgccccggtga

SEQ ID NO: 9157469 - DNA, 22 bp, Homo sapiens
cctcacccagtcacctaggtgg

SEQ ID NO: 9157470 - DNA, 22 bp, Homo sapiens
cctcacccactacactcaaggg

SEQ ID NO: 9157471 - DNA, 22 bp, Homo sapiens
cctcacagtttggctaactgtg

SEQ ID NO: 9157472 - DNA, 22 bp, Homo sapiens
cctcacagcctcatgcccagcc

SEQ ID NO: 9157473 - DNA, 22 bp, Homo sapiens
cctcacagcttttcaaagtgga

SEQ ID NO: 9157474 - DNA, 22 bp, Homo sapiens
cctcacagccctcctctagcac

SEQ ID NO: 9157475 - DNA, 22 bp, Homo sapiens
cctcacagccctcctctagcac

SEQ ID NO: 9157476 - DNA, 22 bp, Homo sapiens
cctcacagaggggcagccatct

SEQ ID NO: 9157477 - DNA, 22 bp, Homo sapiens
ccgttaatcccataatatggat

SEQ ID NO: 9157478 - DNA, 22 bp, Homo sapiens
cctcacagagcccagatgtcta

SEQ ID NO: 9157479 - DNA, 22 bp, Homo sapiens
ccctgtggatttcagtttgtgt

SEQ ID NO: 9157480 - DNA, 22 bp, Homo sapiens
ccctgtggcaggaggaggagca

SEQ ID NO: 9157481 - DNA, 22 bp, Homo sapiens
ccctgtggcaggaggaggagca

SEQ ID NO: 9157482 - DNA, 22 bp, Homo sapiens
ccctgtgggaactcctgagttg

SEQ ID NO: 9157483 - DNA, 22 bp, Homo sapiens
ccctgtggcaggaggaggagca

SEQ ID NO: 9157484 - DNA, 22 bp, Homo sapiens
ccctttccatggctctcctagg

SEQ ID NO: 9157485 - DNA, 22 bp, Homo sapiens
ccggcgaccgctgtcggaggcg

SEQ ID NO: 9157486 - DNA, 22 bp, Homo sapiens
ccggagtgtctggcctgctggg

SEQ ID NO: 9157487 - DNA, 22 bp, Homo sapiens
ccggaaggcggaacgtgcagtg

SEQ ID NO: 9157488 - DNA, 22 bp, Homo sapiens
ccctgtgccagagaggcaggag

SEQ ID NO: 9157489 - DNA, 22 bp, Homo sapiens
ccctgtgcctagttggcctaaa

SEQ ID NO: 9157490 - DNA, 22 bp, Homo sapiens
ccctgtggaggaggagagcagt

SEQ ID NO: 9157491 - DNA, 22 bp, Homo sapiens
ccctgtggaggcagcatcctgc

SEQ ID NO: 9157492 - DNA, 22 bp, Homo sapiens
ccctgtggaggaggagagcagt

SEQ ID NO: 9157493 - DNA, 22 bp, Homo sapiens
ccctgtgcatattgccagatac

SEQ ID NO: 9157494 - DNA, 22 bp, Homo sapiens
ccctgtcctgctaggccctggt

SEQ ID NO: 9157495 - DNA, 22 bp, Homo sapiens
ccctgtcctgctaggccctggt

SEQ ID NO: 9157496 - DNA, 22 bp, Homo sapiens
ccctgtcctggatgggagcact

SEQ ID NO: 9157497 - DNA, 22 bp, Homo sapiens
ccctgtccttggctgtgaggct

SEQ ID NO: 9157498 - DNA, 22 bp, Homo sapiens
ccctggtggtacggcactggca

SEQ ID NO: 9157499 - DNA, 22 bp, Homo sapiens
ccctggtgtggatgtgattggc

SEQ ID NO: 9157500 - DNA, 22 bp, Homo sapiens
ccctggtgtccactggaggaag

SEQ ID NO: 9157501 - DNA, 22 bp, Homo sapiens
ccctggagctgcttgcatgttg

SEQ ID NO: 9157502 - DNA, 22 bp, Homo sapiens
ccctggaggaaaatctgaggct

SEQ ID NO: 9157503 - DNA, 22 bp, Homo sapiens
ccctggaggaaaatctgaggct

SEQ ID NO: 9157504 - DNA, 22 bp, Homo sapiens
ccctggaggaagaaacaatggc

SEQ ID NO: 9157505 - DNA, 22 bp, Homo sapiens
ccctggtcagggaaggcgcctg

SEQ ID NO: 9157506 - DNA, 22 bp, Homo sapiens
ccctggtggggccagacttgct

SEQ ID NO: 9157507 - DNA, 22 bp, Homo sapiens
ccctggtgccctgggtcagcct

SEQ ID NO: 9157508 - DNA, 22 bp, Homo sapiens
ccctggtcagggaaggcgcctg

SEQ ID NO: 9157509 - DNA, 22 bp, Homo sapiens
tggctcagcctggccctttcat

SEQ ID NO: 9157510 - DNA, 22 bp, Homo sapiens
tggctaagcatgctccagctgc

SEQ ID NO: 9157511 - DNA, 22 bp, Homo sapiens
tggctaagaattggcagctgct

SEQ ID NO: 9157512 - DNA, 22 bp, Homo sapiens
tggctaaggtcgatagaggctt

SEQ ID NO: 9157513 - DNA, 22 bp, Homo sapiens
tggctaacaaggtgaaaccccg

SEQ ID NO: 9157514 - DNA, 22 bp, Homo sapiens
tggctacagacattcctaggga

SEQ ID NO: 9157515 - DNA, 22 bp, Homo sapiens
tggctacagaattggccctgtt

SEQ ID NO: 9157516 - DNA, 22 bp, Homo sapiens
tggctacagaattggccctgtt

SEQ ID NO: 9157517 - DNA, 22 bp, Homo sapiens
tggctacagaatgaatgctgcc

SEQ ID NO: 9157518 - DNA, 19 bp, Homo sapiens
tggctaattttatagaggc

SEQ ID NO: 9157519 - DNA, 22 bp, Homo sapiens
tggctacaagtgtgtttagttt

SEQ ID NO: 9157520 - DNA, 22 bp, Homo sapiens
tggctaaggtcgatagaggctt

SEQ ID NO: 9157521 - DNA, 22 bp, Homo sapiens
tggctacatttatactctcatt

SEQ ID NO: 9157522 - DNA, 22 bp, Homo sapiens
tggctacatcacagagaattcc

SEQ ID NO: 9157523 - DNA, 22 bp, Homo sapiens
tggctacagcaagaggaaagaa

SEQ ID NO: 9157524 - DNA, 22 bp, Homo sapiens
tggctacagatttgctgacaat

SEQ ID NO: 9157525 - DNA, 22 bp, Homo sapiens
tggctacagcttggccacagag

SEQ ID NO: 9157526 - DNA, 23 bp, Homo sapiens
tggctcagctagttttccatttc

SEQ ID NO: 9157527 - DNA, 22 bp, Homo sapiens
cctcccctcagacagagactgg

SEQ ID NO: 9157528 - DNA, 22 bp, Homo sapiens
cctcccctgctcagaactctgg

SEQ ID NO: 9157529 - DNA, 22 bp, Homo sapiens
cctccccatgacccggtgctgg

SEQ ID NO: 9157530 - DNA, 22 bp, Homo sapiens
cctcccaggcattgccattttc

SEQ ID NO: 9157531 - DNA, 22 bp, Homo sapiens
cctccctccattgccatcgtct

SEQ ID NO: 9157532 - DNA, 22 bp, Homo sapiens
cctccctccctgcagaagccac

SEQ ID NO: 9157533 - DNA, 22 bp, Homo sapiens
cctccctctgttagagctgtct

SEQ ID NO: 9157534 - DNA, 22 bp, Homo sapiens
cctccctctgttagagctgtct

SEQ ID NO: 9157535 - DNA, 23 bp, Homo sapiens
cctccccttcccacagctgggtg

SEQ ID NO: 9157536 - DNA, 19 bp, Homo sapiens
cctccccttggaccagcaa

SEQ ID NO: 9157537 - DNA, 22 bp, Homo sapiens
tggcctcaagtctgagggcctt

SEQ ID NO: 9157538 - DNA, 22 bp, Homo sapiens
tggcctcaatctgtcctccagc

SEQ ID NO: 9157539 - DNA, 22 bp, Homo sapiens
tggcctcccctaacagcctctt

SEQ ID NO: 9157540 - DNA, 22 bp, Homo sapiens
tggcctcccctaacagcctctt

SEQ ID NO: 9157541 - DNA, 21 bp, Homo sapiens
tggcctcccacacttccatgg

SEQ ID NO: 9157542 - DNA, 22 bp, Homo sapiens
tggcctcagattattgcacagt

SEQ ID NO: 9157543 - DNA, 22 bp, Homo sapiens
tggcctcaccactagctgggtg

SEQ ID NO: 9157544 - DNA, 22 bp, Homo sapiens
cctcactctgcaccctgcagca

SEQ ID NO: 9157545 - DNA, 22 bp, Homo sapiens
cctcactcttgtcctggcaggt

SEQ ID NO: 9157546 - DNA, 22 bp, Homo sapiens
cctcactcttgtcctggcaggt

SEQ ID NO: 9157547 - DNA, 22 bp, Homo sapiens
cctcactcttgtcctggcaggt

SEQ ID NO: 9157548 - DNA, 19 bp, Homo sapiens
cctcaccctgcagaggagg

SEQ ID NO: 9157549 - DNA, 19 bp, Homo sapiens
cctcaccctgcagaggagg

SEQ ID NO: 9157550 - DNA, 22 bp, Homo sapiens
cctcagaagactttagggaaga

SEQ ID NO: 9157551 - DNA, 22 bp, Homo sapiens
tggcctctcctggctgagtttc

SEQ ID NO: 9157552 - DNA, 22 bp, Homo sapiens
tggcctctctaccaggcagcct

SEQ ID NO: 9157553 - DNA, 22 bp, Homo sapiens
cctcagcatcctggtgaagtag

SEQ ID NO: 9157554 - DNA, 23 bp, Homo sapiens
cctcagcatggcaggagcccagc

SEQ ID NO: 9157555 - DNA, 22 bp, Homo sapiens
cctcagcccctgaatggagaga

SEQ ID NO: 9157556 - DNA, 22 bp, Homo sapiens
cctcagccttggccccaggcag

SEQ ID NO: 9157557 - DNA, 22 bp, Homo sapiens
cctcagccttggccccaggcag

SEQ ID NO: 9157558 - DNA, 23 bp, Homo sapiens
tggcctctccccacctggcagaa

SEQ ID NO: 9157559 - DNA, 22 bp, Homo sapiens
tggcctctcctggcagcatcca

SEQ ID NO: 9157560 - DNA, 22 bp, Homo sapiens
tggcctctcctggcagcatcca

SEQ ID NO: 9157561 - DNA, 22 bp, Homo sapiens
cctcagctgctgcacagctttt

SEQ ID NO: 9157562 - DNA, 22 bp, Homo sapiens
cctcagccttggccccaggcag

SEQ ID NO: 9157563 - DNA, 22 bp, Homo sapiens
tggcctggggacctgtgagacc

SEQ ID NO: 9157564 - DNA, 22 bp, Homo sapiens
cctcagctgcttccctggagcc

SEQ ID NO: 9157565 - DNA, 22 bp, Homo sapiens
tgctttcaatgaattgtatact

SEQ ID NO: 9157566 - DNA, 22 bp, Homo sapiens
tgctttcacaccatgcctataa

SEQ ID NO: 9157567 - DNA, 22 bp, Homo sapiens
tgctttcactgatgtatcattt

SEQ ID NO: 9157568 - DNA, 22 bp, Homo sapiens
tgctttcatgaagtctatagag

SEQ ID NO: 9157569 - DNA, 22 bp, Homo sapiens
tgcctgctagatatccaggtga

SEQ ID NO: 9157570 - DNA, 22 bp, Homo sapiens
tgcctgctaggccctgctgggt

SEQ ID NO: 9157571 - DNA, 22 bp, Homo sapiens
tgcctgctaggcactttcaaac

SEQ ID NO: 9157572 - DNA, 22 bp, Homo sapiens
tgcctgctaggccctgctgggt

SEQ ID NO: 9157573 - DNA, 22 bp, Homo sapiens
tgcctgctatttgcctaaagtg

SEQ ID NO: 9157574 - DNA, 22 bp, Homo sapiens
tgcctgctccagtcctgtccac

SEQ ID NO: 9157575 - DNA, 22 bp, Homo sapiens
tgcctgctatttgcctaaagtg

SEQ ID NO: 9157576 - DNA, 19 bp, Homo sapiens
tgcctgctcctggcttcca

SEQ ID NO: 9157577 - DNA, 22 bp, Homo sapiens
tgcctgctccagtcctgtccac

SEQ ID NO: 9157578 - DNA, 22 bp, Homo sapiens
tgctttatttataaaatagcaa

SEQ ID NO: 9157579 - DNA, 22 bp, Homo sapiens
tgcctcagtttcatctgcagaa

SEQ ID NO: 9157580 - DNA, 22 bp, Homo sapiens
tgcctcattaactgtccttaat

SEQ ID NO: 9157581 - DNA, 22 bp, Homo sapiens
tgcctgctagatatccaggtga

SEQ ID NO: 9157582 - DNA, 19 bp, Homo sapiens
ccctagagtaagactgcat

SEQ ID NO: 9157583 - DNA, 19 bp, Homo sapiens
ccctagagtaagactgcat

SEQ ID NO: 9157584 - DNA, 20 bp, Homo sapiens
ccctaggaacgcagcaggag

SEQ ID NO: 9157585 - DNA, 19 bp, Homo sapiens
ccctagagtaagactgcat

SEQ ID NO: 9157586 - DNA, 22 bp, Homo sapiens
tggaagaatatgggggtacaga

SEQ ID NO: 9157587 - DNA, 22 bp, Homo sapiens
tggaagaataggatagaagaac

SEQ ID NO: 9157588 - DNA, 22 bp, Homo sapiens
tggaagaataggatagaagaac

SEQ ID NO: 9157589 - DNA, 22 bp, Homo sapiens
tggaagaaggcagagaggcatt

SEQ ID NO: 9157590 - DNA, 22 bp, Homo sapiens
tggaagaagctacaagcggtga

SEQ ID NO: 9157591 - DNA, 22 bp, Homo sapiens
tggaagaaggcagagaggcatt

SEQ ID NO: 9157592 - DNA, 22 bp, Homo sapiens
cccgtcccttttgcccgctggt

SEQ ID NO: 9157593 - DNA, 21 bp, Homo sapiens
cccgtgccttcagcagtcctg

SEQ ID NO: 9157594 - DNA, 22 bp, Homo sapiens
cccgtttaattactcgagctgt

SEQ ID NO: 9157595 - DNA, 22 bp, Homo sapiens
cccgtgtggacagcgtgccagt

SEQ ID NO: 9157596 - DNA, 22 bp, Homo sapiens
ccctactctgccactttttctg

SEQ ID NO: 9157597 - DNA, 22 bp, Homo sapiens
tggaagggaaagtttggggtcc

SEQ ID NO: 9157598 - DNA, 22 bp, Homo sapiens
tggaagggaacaggtgggtgtt

SEQ ID NO: 9157599 - DNA, 22 bp, Homo sapiens
tggaagggaacaggtgggtgtt

SEQ ID NO: 9157600 - DNA, 22 bp, Homo sapiens
tggaagggaaagtttggggtcc

SEQ ID NO: 9157601 - DNA, 22 bp, Homo sapiens
tggaagggaaagtttggggtcc

SEQ ID NO: 9157602 - DNA, 22 bp, Homo sapiens
tggaaggctgagagtcctgggg

SEQ ID NO: 9157603 - DNA, 22 bp, Homo sapiens
tggaaggctgagagtcctgggg

SEQ ID NO: 9157604 - DNA, 19 bp, Homo sapiens
tggaaggctaagacacttg

SEQ ID NO: 9157605 - DNA, 22 bp, Homo sapiens
tggaagaatttggggataaatt

SEQ ID NO: 9157606 - DNA, 22 bp, Homo sapiens
ccctgccttcttggcctttaaa

SEQ ID NO: 9157607 - DNA, 22 bp, Homo sapiens
ccctgccttgttggagcctatg

SEQ ID NO: 9157608 - DNA, 22 bp, Homo sapiens
ccctgccttgtctgggctaggt

SEQ ID NO: 9157609 - DNA, 22 bp, Homo sapiens
tggaggccaggaaggcagcgag

SEQ ID NO: 9157610 - DNA, 22 bp, Homo sapiens
ccctgctgaatcccatggagtc

SEQ ID NO: 9157611 - DNA, 22 bp, Homo sapiens
tggaggccagaggtactgggac

SEQ ID NO: 9157612 - DNA, 19 bp, Homo sapiens
tggaggccaggacacaggt

SEQ ID NO: 9157613 - DNA, 22 bp, Homo sapiens
tggaggggcaatggagcgcgga

SEQ ID NO: 9157614 - DNA, 22 bp, Homo sapiens
tggaggggcaatggagcgcgga

SEQ ID NO: 9157615 - DNA, 22 bp, Homo sapiens
tggaggggcaatggagcgcgga

SEQ ID NO: 9157616 - DNA, 22 bp, Homo sapiens
ccctgctcttagtgcctgtgtg

SEQ ID NO: 9157617 - DNA, 22 bp, Homo sapiens
ccctgctcttagtgcctgtgtg

SEQ ID NO: 9157618 - DNA, 22 bp, Homo sapiens
ccctgctgaatcccatggagtc

SEQ ID NO: 9157619 - DNA, 22 bp, Homo sapiens
ccctgctgaagaacgttcatac

SEQ ID NO: 9157620 - DNA, 22 bp, Homo sapiens
ccctgctagttgtctcagtgat

SEQ ID NO: 9157621 - DNA, 22 bp, Homo sapiens
tggaggtgacggggcctcgttg

SEQ ID NO: 9157622 - DNA, 23 bp, Homo sapiens
ccctggagctagtctgagcgggg

SEQ ID NO: 9157623 - DNA, 22 bp, Homo sapiens
ccctggagctgcttgcatgttg

SEQ ID NO: 9157624 - DNA, 23 bp, Homo sapiens
ccctggagctagtctgagcgggg

SEQ ID NO: 9157625 - DNA, 22 bp, Homo sapiens
ccctggagctagtctgagcaga

SEQ ID NO: 9157626 - DNA, 23 bp, Homo sapiens
ccctggagctagtctgagcagag

SEQ ID NO: 9157627 - DNA, 23 bp, Homo sapiens
ccctggagctagtctgagcagag

SEQ ID NO: 9157628 - DNA, 23 bp, Homo sapiens
ccctggagctagtctgagcagag

SEQ ID NO: 9157629 - DNA, 22 bp, Homo sapiens
tggaggtcctgcaggatggcac

SEQ ID NO: 9157630 - DNA, 22 bp, Homo sapiens
tggaggtacataatgagagggt

SEQ ID NO: 9157631 - DNA, 19 bp, Homo sapiens
tggaggtccaggagtaggg

SEQ ID NO: 9157632 - DNA, 22 bp, Homo sapiens
tggaggtcctgcaggatggcac

SEQ ID NO: 9157633 - DNA, 22 bp, Homo sapiens
tggaggtcgcgcgggtgctgca

SEQ ID NO: 9157634 - DNA, 22 bp, Homo sapiens
tggaggtctgcaaggcgctgga

SEQ ID NO: 9157635 - DNA, 22 bp, Homo sapiens
tggaggtcttacccagggctat

SEQ ID NO: 9157636 - DNA, 22 bp, Homo sapiens
tggaggtcttacccagggctat

SEQ ID NO: 9157637 - DNA, 22 bp, Homo sapiens
tggaggtctgcaaggcgctgga

SEQ ID NO: 9157638 - DNA, 22 bp, Homo sapiens
tggaggtctgcaaggcgctgga

SEQ ID NO: 9157639 - DNA, 22 bp, Homo sapiens
tggaggtctctgtctgggcagg

SEQ ID NO: 9157640 - DNA, 22 bp, Homo sapiens
tggaggtcgctagcgagcgggc

SEQ ID NO: 9157641 - DNA, 22 bp, Homo sapiens
tggaggtacataatgagagggt

SEQ ID NO: 9157642 - DNA, 22 bp, Homo sapiens
tggagggtcaccccttgctgag

SEQ ID NO: 9157643 - DNA, 19 bp, Homo sapiens
tggaggggtttgaatgtgg

SEQ ID NO: 9157644 - DNA, 19 bp, Homo sapiens
tggaggggtttgaatgtgg

SEQ ID NO: 9157645 - DNA, 22 bp, Homo sapiens
tggaggggcaatggagcgcgga

SEQ ID NO: 9157646 - DNA, 22 bp, Homo sapiens
ccctgcagaccaatgccataga

SEQ ID NO: 9157647 - DNA, 22 bp, Homo sapiens
ccctgcagacgtcttgatgcct

SEQ ID NO: 9157648 - DNA, 23 bp, Homo sapiens
ccctgcactaagaggagaaggtg

SEQ ID NO: 9157649 - DNA, 17 bp, Homo sapiens
ccctgcaccctactctc

SEQ ID NO: 9157650 - DNA, 21 bp, Homo sapiens
tggaagggaagtcttggttgt

SEQ ID NO: 9157651 - DNA, 22 bp, Homo sapiens
tggaagggaacaggtgggtgtt

SEQ ID NO: 9157652 - DNA, 22 bp, Homo sapiens
ccctgcagagagtgcttttgtg

SEQ ID NO: 9157653 - DNA, 22 bp, Homo sapiens
ccctgcagagccagccctgacc

SEQ ID NO: 9157654 - DNA, 22 bp, Homo sapiens
ccctgcagagggatgggggcag

SEQ ID NO: 9157655 - DNA, 22 bp, Homo sapiens
ccctgcagatcagtgagaactt

SEQ ID NO: 9157656 - DNA, 22 bp, Homo sapiens
ccctgcagatctagggtccttc

SEQ ID NO: 9157657 - DNA, 20 bp, Homo sapiens
ccctgcagccatgggagtgg

SEQ ID NO: 9157658 - DNA, 20 bp, Homo sapiens
ccctgcagccatgggagtgg

SEQ ID NO: 9157659 - DNA, 22 bp, Homo sapiens
tggacaggtgcacacagcagcc

SEQ ID NO: 9157660 - DNA, 22 bp, Homo sapiens
tggacaggtgcacacagcagcc

SEQ ID NO: 9157661 - DNA, 19 bp, Homo sapiens
ccctgccctggtgactggg

SEQ ID NO: 9157662 - DNA, 22 bp, Homo sapiens
ccctgcagtcctttcttggctc

SEQ ID NO: 9157663 - DNA, 22 bp, Homo sapiens
ccctgcctacagggttttcttt

SEQ ID NO: 9157664 - DNA, 22 bp, Homo sapiens
ccctgcctctgaagctgctcag

SEQ ID NO: 9157665 - DNA, 22 bp, Homo sapiens
ccctgcctgtgggcatcaacat

SEQ ID NO: 9157666 - DNA, 22 bp, Homo sapiens
ccctgcctctgaagctgctcag

SEQ ID NO: 9157667 - DNA, 22 bp, Homo sapiens
tggacaggttgagtaggaggag

SEQ ID NO: 9157668 - DNA, 22 bp, Homo sapiens
tggacaggtgcacacagcagcc

SEQ ID NO: 9157669 - DNA, 22 bp, Homo sapiens
tggacaggtttgggtgcctgtt

SEQ ID NO: 9157670 - DNA, 22 bp, Homo sapiens
tggacaggttgagtaggaggag

SEQ ID NO: 9157671 - DNA, 22 bp, Homo sapiens
tggacaggtttgggtgcctgtt

SEQ ID NO: 9157672 - DNA, 23 bp, Homo sapiens
ccctgcagtcagggtgagatggt

SEQ ID NO: 9157673 - DNA, 22 bp, Homo sapiens
tggacatcttagtcatgtcaat

SEQ ID NO: 9157674 - DNA, 22 bp, Homo sapiens
tcacagttactccttcagatga

SEQ ID NO: 9157675 - DNA, 22 bp, Homo sapiens
tcacagttaattgttggaatgt

SEQ ID NO: 9157676 - DNA, 20 bp, Homo sapiens
tcacaggagggaaggcaggt

SEQ ID NO: 9157677 - DNA, 20 bp, Homo sapiens
tcacaggagggaaggcaggt

SEQ ID NO: 9157678 - DNA, 22 bp, Homo sapiens
tcacaggaggactgaaagatat

SEQ ID NO: 9157679 - DNA, 22 bp, Homo sapiens
tcacaggagtcaaggaatagta

SEQ ID NO: 9157680 - DNA, 22 bp, Homo sapiens
tcacaggagtcaaggaatagta

SEQ ID NO: 9157681 - DNA, 23 bp, Homo sapiens
tcacagttacttttgcatcaacc

SEQ ID NO: 9157682 - DNA, 22 bp, Homo sapiens
cagtgccaaggagaaggacagc

SEQ ID NO: 9157683 - DNA, 22 bp, Homo sapiens
tcacaggaccctgagggtggcg

SEQ ID NO: 9157684 - DNA, 22 bp, Homo sapiens
tcacaggagagctgatgctggt

SEQ ID NO: 9157685 - DNA, 22 bp, Homo sapiens
tcacaggaggaacctggcctgg

SEQ ID NO: 9157686 - DNA, 22 bp, Homo sapiens
tcacaggagattatgtgtgcta

SEQ ID NO: 9157687 - DNA, 22 bp, Homo sapiens
tcacaggagcccaggggagctg

SEQ ID NO: 9157688 - DNA, 22 bp, Homo sapiens
tcacagctttgagcagagacca

SEQ ID NO: 9157689 - DNA, 22 bp, Homo sapiens
tcacaggaaccatcagagaaat

SEQ ID NO: 9157690 - DNA, 22 bp, Homo sapiens
tcacaggaagaggtgtctatct

SEQ ID NO: 9157691 - DNA, 22 bp, Homo sapiens
tcacaggaagggtaaatattta

SEQ ID NO: 9157692 - DNA, 22 bp, Homo sapiens
tcacaggaccctgagggtggcg

SEQ ID NO: 9157693 - DNA, 22 bp, Homo sapiens
tcacagctgttttgtccattaa

SEQ ID NO: 9157694 - DNA, 20 bp, Homo sapiens
tcacagctggctatgacagg

SEQ ID NO: 9157695 - DNA, 22 bp, Homo sapiens
tcacagctggggttttggcagc

SEQ ID NO: 9157696 - DNA, 22 bp, Homo sapiens
tcacagctttcagattgttccc

SEQ ID NO: 9157697 - DNA, 22 bp, Homo sapiens
tcacagctttcagattgttccc

SEQ ID NO: 9157698 - DNA, 22 bp, Homo sapiens
tcacagcttcttgcgggtctga

SEQ ID NO: 9157699 - DNA, 22 bp, Homo sapiens
tatttcttttcgtgacttattg

SEQ ID NO: 9157700 - DNA, 22 bp, Homo sapiens
tatttgaaagtgtacaaaaact

SEQ ID NO: 9157701 - DNA, 22 bp, Homo sapiens
tcacaacaggaaggaccagctg

SEQ ID NO: 9157702 - DNA, 22 bp, Homo sapiens
tcacaagaatttgtagatgaaa

SEQ ID NO: 9157703 - DNA, 22 bp, Homo sapiens
cagtgaggaagctgtctggacc

SEQ ID NO: 9157704 - DNA, 22 bp, Homo sapiens
cagtgaggaagctgtctggacc

SEQ ID NO: 9157705 - DNA, 22 bp, Homo sapiens
tcacaagacagaaaacatttag

SEQ ID NO: 9157706 - DNA, 22 bp, Homo sapiens
tcacaagactgagcttgcttga

SEQ ID NO: 9157707 - DNA, 17 bp, Homo sapiens
cagtgaagagacattaa

SEQ ID NO: 9157708 - DNA, 22 bp, Homo sapiens
cagtgaagtttaaagtgtagat

SEQ ID NO: 9157709 - DNA, 22 bp, Homo sapiens
cagtgacgtaaactgcatgtgc

SEQ ID NO: 9157710 - DNA, 22 bp, Homo sapiens
cagtgacgtaaactgcatgtgc

SEQ ID NO: 9157711 - DNA, 22 bp, Homo sapiens
tatttataacagtgagaacggg

SEQ ID NO: 9157712 - DNA, 22 bp, Homo sapiens
tatttcaggtatggtgtgaaat

SEQ ID NO: 9157713 - DNA, 22 bp, Homo sapiens
tatttataacagtgagaacggg

SEQ ID NO: 9157714 - DNA, 22 bp, Homo sapiens
tatttcagggggtacaagaaga

SEQ ID NO: 9157715 - DNA, 22 bp, Homo sapiens
tatttataacagtgagaacggg

SEQ ID NO: 9157716 - DNA, 22 bp, Homo sapiens
caggtttctagttctaagaata

SEQ ID NO: 9157717 - DNA, 22 bp, Homo sapiens
tatttataacagtgagaacggg

SEQ ID NO: 9157718 - DNA, 22 bp, Homo sapiens
tatttcatgtgcaccataattc

SEQ ID NO: 9157719 - DNA, 22 bp, Homo sapiens
tatttcatgtgcaccataattc

SEQ ID NO: 9157720 - DNA, 22 bp, Homo sapiens
tatttcatctggaacaaggtaa

SEQ ID NO: 9157721 - DNA, 22 bp, Homo sapiens
tatttcagtcacttcttctctg

SEQ ID NO: 9157722 - DNA, 22 bp, Homo sapiens
tatttccaaaaaggccatattc

SEQ ID NO: 9157723 - DNA, 22 bp, Homo sapiens
caggttctggagatgcagagat

SEQ ID NO: 9157724 - DNA, 22 bp, Homo sapiens
caggttctgaggatggtgcctg

SEQ ID NO: 9157725 - DNA, 22 bp, Homo sapiens
caggttctgccatttacttgta

SEQ ID NO: 9157726 - DNA, 22 bp, Homo sapiens
caggttctcagaaggcagtcac

SEQ ID NO: 9157727 - DNA, 22 bp, Homo sapiens
caggttctcagaaggcagtcac

SEQ ID NO: 9157728 - DNA, 22 bp, Homo sapiens
caggttctatactgaataattt

SEQ ID NO: 9157729 - DNA, 22 bp, Homo sapiens
caggttctgggtcctgggtcct

SEQ ID NO: 9157730 - DNA, 22 bp, Homo sapiens
caggttctggagatgcagagat

SEQ ID NO: 9157731 - DNA, 22 bp, Homo sapiens
caggttctggggctccactgtg

SEQ ID NO: 9157732 - DNA, 22 bp, Homo sapiens
caggttctggggctccactgtg

SEQ ID NO: 9157733 - DNA, 22 bp, Homo sapiens
caggttcttaagtaacagcaca

SEQ ID NO: 9157734 - DNA, 22 bp, Homo sapiens
caggttcttaacttgttcttcc

SEQ ID NO: 9157735 - DNA, 22 bp, Homo sapiens
caggttcttgaagccttctggc

SEQ ID NO: 9157736 - DNA, 22 bp, Homo sapiens
caggttggtcggcaagtacaca

SEQ ID NO: 9157737 - DNA, 22 bp, Homo sapiens
caggttggtattcatctccaca

SEQ ID NO: 9157738 - DNA, 22 bp, Homo sapiens
caggttgggctgcgaggaggag

SEQ ID NO: 9157739 - DNA, 22 bp, Homo sapiens
caggttgggatcggttgcaatg

SEQ ID NO: 9157740 - DNA, 22 bp, Homo sapiens
caggttgggatcggttgcaatg

SEQ ID NO: 9157741 - DNA, 22 bp, Homo sapiens
caggttgggatcggttgcaatg

SEQ ID NO: 9157742 - DNA, 22 bp, Homo sapiens
caggttcttgtttcaaacagac

SEQ ID NO: 9157743 - DNA, 22 bp, Homo sapiens
caggttatcaaggtccctgtca

SEQ ID NO: 9157744 - DNA, 22 bp, Homo sapiens
cagggtgggcacccagcctcca

SEQ ID NO: 9157745 - DNA, 22 bp, Homo sapiens
caggtgtgccgggagcagtttg

SEQ ID NO: 9157746 - DNA, 22 bp, Homo sapiens
caggtgtgccgggagcagtttg

SEQ ID NO: 9157747 - DNA, 22 bp, Homo sapiens
cagtataagagtgaggaagggc

SEQ ID NO: 9157748 - DNA, 22 bp, Homo sapiens
cagtagttattagttgccactg

SEQ ID NO: 9157749 - DNA, 22 bp, Homo sapiens
cagtagtggaagggagagaaaa

SEQ ID NO: 9157750 - DNA, 21 bp, Homo sapiens
cagtagtgcgtcgcagaggac

SEQ ID NO: 9157751 - DNA, 22 bp, Homo sapiens
cagtagcccactagtatgcagt

SEQ ID NO: 9157752 - DNA, 22 bp, Homo sapiens
cagtagccttatttggatcatt

SEQ ID NO: 9157753 - DNA, 22 bp, Homo sapiens
cagtaggaaggatgcagaaaaa

SEQ ID NO: 9157754 - DNA, 22 bp, Homo sapiens
cagtaggcaggttgtcttctta

SEQ ID NO: 9157755 - DNA, 22 bp, Homo sapiens
tatttccaagctgaatccaatg

SEQ ID NO: 9157756 - DNA, 22 bp, Homo sapiens
tatttccaaaagcctattatga

SEQ ID NO: 9157757 - DNA, 22 bp, Homo sapiens
tatttccacctattattttctg

SEQ ID NO: 9157758 - DNA, 20 bp, Homo sapiens
cagtcccaatccagggccag

SEQ ID NO: 9157759 - DNA, 22 bp, Homo sapiens
cagtcccaccaggatcgctctt

SEQ ID NO: 9157760 - DNA, 22 bp, Homo sapiens
cagtcccactagtgccaatacc

SEQ ID NO: 9157761 - DNA, 22 bp, Homo sapiens
cagtcccacaagatctccacaa

SEQ ID NO: 9157762 - DNA, 22 bp, Homo sapiens
cagtcccaaggaggaagcagtc

SEQ ID NO: 9157763 - DNA, 19 bp, Homo sapiens
cagtcccaaattcttgtca

SEQ ID NO: 9157764 - DNA, 18 bp, Homo sapiens
cagtcccaaaccttagga

SEQ ID NO: 9157765 - DNA, 22 bp, Homo sapiens
cagtatatgctctttcatcaaa

SEQ ID NO: 9157766 - DNA, 20 bp, Homo sapiens
cagtccaatcagaggccacc

SEQ ID NO: 9157767 - DNA, 20 bp, Homo sapiens
cagtccactggagttcctac

SEQ ID NO: 9157768 - DNA, 22 bp, Homo sapiens
tatttctttcaggtatgtgttg

SEQ ID NO: 9157769 - DNA, 21 bp, Homo sapiens
tatttctttgactctctccct

SEQ ID NO: 9157770 - DNA, 22 bp, Homo sapiens
cagtcccagacatagtaaggga

SEQ ID NO: 9157771 - DNA, 22 bp, Homo sapiens
cagtcccagaagagcctgggag

SEQ ID NO: 9157772 - DNA, 22 bp, Homo sapiens
tatttcttgttccctccaagtt

SEQ ID NO: 9157773 - DNA, 20 bp, Homo sapiens
cagtttacaacataaattgt

SEQ ID NO: 9157774 - DNA, 21 bp, Homo sapiens
cagtttaataacaaagaagga

SEQ ID NO: 9157775 - DNA, 22 bp, Homo sapiens
cagtttaagtgtgttgaaggta

SEQ ID NO: 9157776 - DNA, 22 bp, Homo sapiens
cagtttaaggcaggacatggga

SEQ ID NO: 9157777 - DNA, 22 bp, Homo sapiens
cagtttaagtagaactgagaat

SEQ ID NO: 9157778 - DNA, 22 bp, Homo sapiens
cagtttaagtagaactgagaat

SEQ ID NO: 9157779 - DNA, 22 bp, Homo sapiens
cagtttagtcctgccaccatgg

SEQ ID NO: 9157780 - DNA, 22 bp, Homo sapiens
cagtttacctatatgtaaattt

SEQ ID NO: 9157781 - DNA, 22 bp, Homo sapiens
cagtttatatataagcacattg

SEQ ID NO: 9157782 - DNA, 22 bp, Homo sapiens
cagtttatagctctagcagctt

SEQ ID NO: 9157783 - DNA, 22 bp, Homo sapiens
cagtttatagttgttatgtgtg

SEQ ID NO: 9157784 - DNA, 22 bp, Homo sapiens
cagtttatagctctagcagctt

SEQ ID NO: 9157785 - DNA, 22 bp, Homo sapiens
cataaactcttgagattcttgt

SEQ ID NO: 9157786 - DNA, 22 bp, Homo sapiens
cataaactctctgtaccaatat

SEQ ID NO: 9157787 - DNA, 22 bp, Homo sapiens
cataaactctctgtaccaatat

SEQ ID NO: 9157788 - DNA, 21 bp, Homo sapiens
tcaggaaacacctcttaagga

SEQ ID NO: 9157789 - DNA, 22 bp, Homo sapiens
tcaggaaaatactgcttatcca

SEQ ID NO: 9157790 - DNA, 22 bp, Homo sapiens
cataaagtaaagatgtcttcca

SEQ ID NO: 9157791 - DNA, 22 bp, Homo sapiens
cataaagtctcataattcactt

SEQ ID NO: 9157792 - DNA, 22 bp, Homo sapiens
tcagcagaagtatagaggccat

SEQ ID NO: 9157793 - DNA, 22 bp, Homo sapiens
tcagcagaagtatagaggccat

SEQ ID NO: 9157794 - DNA, 22 bp, Homo sapiens
tcagcagaatcttcctacacct

SEQ ID NO: 9157795 - DNA, 21 bp, Homo sapiens
tcagcagaatatgaactgcac

SEQ ID NO: 9157796 - DNA, 21 bp, Homo sapiens
tcagcagaatatgaactgcac

SEQ ID NO: 9157797 - DNA, 21 bp, Homo sapiens
tcagcagaatatgaactgcac

SEQ ID NO: 9157798 - DNA, 22 bp, Homo sapiens
cagttactcaataattcttgcg

SEQ ID NO: 9157799 - DNA, 22 bp, Homo sapiens
cagttaactgattttataaagt

SEQ ID NO: 9157800 - DNA, 21 bp, Homo sapiens
tcagcagcatctgcctagagt

SEQ ID NO: 9157801 - DNA, 19 bp, Homo sapiens
tcagcagattttgcaaaca

SEQ ID NO: 9157802 - DNA, 19 bp, Homo sapiens
tcagcagattttgcaaaca

SEQ ID NO: 9157803 - DNA, 19 bp, Homo sapiens
tcagcagattttgcaaaca

SEQ ID NO: 9157804 - DNA, 20 bp, Homo sapiens
cagtttaactttgagcagtt

SEQ ID NO: 9157805 - DNA, 22 bp, Homo sapiens
tcagcagaatcttcctacacct

SEQ ID NO: 9157806 - DNA, 22 bp, Homo sapiens
tcagcagaatgtggcatgtcac

SEQ ID NO: 9157807 - DNA, 22 bp, Homo sapiens
tcagcagaatgtggcatgtcac

SEQ ID NO: 9157808 - DNA, 22 bp, Homo sapiens
tcagcagaatgtggcatgtcac

SEQ ID NO: 9157809 - DNA, 22 bp, Homo sapiens
tcagcagacagttagctatatt

SEQ ID NO: 9157810 - DNA, 22 bp, Homo sapiens
tcagcagaatgtggcatgtcac

SEQ ID NO: 9157811 - DNA, 22 bp, Homo sapiens
tcagcagacagttagctatatt

SEQ ID NO: 9157812 - DNA, 22 bp, Homo sapiens
tcagcagacagttagctatatt

SEQ ID NO: 9157813 - DNA, 22 bp, Homo sapiens
tcagcagacagttagctatatt

SEQ ID NO: 9157814 - DNA, 22 bp, Homo sapiens
tcagcagacattattttctggc

SEQ ID NO: 9157815 - DNA, 22 bp, Homo sapiens
tcagcagacattattttctggc

SEQ ID NO: 9157816 - DNA, 22 bp, Homo sapiens
tcagcagacctgttatttggat

SEQ ID NO: 9157817 - DNA, 22 bp, Homo sapiens
tcagcagacctgttatttggat

SEQ ID NO: 9157818 - DNA, 22 bp, Homo sapiens
tcagcagacctgttatttggat

SEQ ID NO: 9157819 - DNA, 22 bp, Homo sapiens
tcagcagagctcaggctccagc

SEQ ID NO: 9157820 - DNA, 22 bp, Homo sapiens
tcagcagagctcaggctccagc

SEQ ID NO: 9157821 - DNA, 22 bp, Homo sapiens
tcagcagagctcaggctccagc

SEQ ID NO: 9157822 - DNA, 22 bp, Homo sapiens
tcagcagagcgagaccaagtca

SEQ ID NO: 9157823 - DNA, 22 bp, Homo sapiens
tcagcagagcgagaccaagtca

SEQ ID NO: 9157824 - DNA, 22 bp, Homo sapiens
tcagcagactaggcagattact

SEQ ID NO: 9157825 - DNA, 22 bp, Homo sapiens
tcagcagactaggcagattact

SEQ ID NO: 9157826 - DNA, 22 bp, Homo sapiens
tcagcagactaggcagattact

SEQ ID NO: 9157827 - DNA, 22 bp, Homo sapiens
tcagcagaggggaaggcatctg

SEQ ID NO: 9157828 - DNA, 22 bp, Homo sapiens
tcagcagaggggaaggcatctg

SEQ ID NO: 9157829 - DNA, 22 bp, Homo sapiens
tcagcagaggggaaggcatctg

SEQ ID NO: 9157830 - DNA, 22 bp, Homo sapiens
tcagcagaggcagactctcctt

SEQ ID NO: 9157831 - DNA, 22 bp, Homo sapiens
tcagcagagtggaacattgtca

SEQ ID NO: 9157832 - DNA, 22 bp, Homo sapiens
tcagcagagtggaacattgtca

SEQ ID NO: 9157833 - DNA, 22 bp, Homo sapiens
tcagcagaggcagactctcctt

SEQ ID NO: 9157834 - DNA, 22 bp, Homo sapiens
tcagcagaggcagactctcctt

SEQ ID NO: 9157835 - DNA, 22 bp, Homo sapiens
tcagcagaggagtgtcttgccc

SEQ ID NO: 9157836 - DNA, 22 bp, Homo sapiens
tcagcagaggagtgtcttgccc

SEQ ID NO: 9157837 - DNA, 22 bp, Homo sapiens
tcagcagaggagtgtcttgccc

SEQ ID NO: 9157838 - DNA, 22 bp, Homo sapiens
tcagcagagtttcatcttggga

SEQ ID NO: 9157839 - DNA, 22 bp, Homo sapiens
tcagcagatgatttccatacaa

SEQ ID NO: 9157840 - DNA, 22 bp, Homo sapiens
tcagcagatgatttccatacaa

SEQ ID NO: 9157841 - DNA, 22 bp, Homo sapiens
tcagcagagtttcatcttggga

SEQ ID NO: 9157842 - DNA, 22 bp, Homo sapiens
tcagcagagtttcatcttggga

SEQ ID NO: 9157843 - DNA, 22 bp, Homo sapiens
tcagcagagtttcatcttggga

SEQ ID NO: 9157844 - DNA, 22 bp, Homo sapiens
tcagcagatgggttgtgttggc

SEQ ID NO: 9157845 - DNA, 22 bp, Homo sapiens
tcagcagatgggttgtgttggc

SEQ ID NO: 9157846 - DNA, 22 bp, Homo sapiens
tcagcagatgggttgtgttggc

SEQ ID NO: 9157847 - DNA, 22 bp, Homo sapiens
tcagcagatgatttccatacaa

SEQ ID NO: 9157848 - DNA, 22 bp, Homo sapiens
tcagcagatgtggtgaaaagtc

SEQ ID NO: 9157849 - DNA, 22 bp, Homo sapiens
tcagcagatgtggtgaaaagtc

SEQ ID NO: 9157850 - DNA, 22 bp, Homo sapiens
tcagcagatgtggtgaaaagtc

SEQ ID NO: 9157851 - DNA, 22 bp, Homo sapiens
tcagactgtgtcataagtaggt

SEQ ID NO: 9157852 - DNA, 22 bp, Homo sapiens
tcagactggcatctaagggctg

SEQ ID NO: 9157853 - DNA, 22 bp, Homo sapiens
tcagactgcttagctcccagta

SEQ ID NO: 9157854 - DNA, 22 bp, Homo sapiens
tcagactgactagtcaatgaaa

SEQ ID NO: 9157855 - DNA, 22 bp, Homo sapiens
tcagactgaccgaagcatctgg

SEQ ID NO: 9157856 - DNA, 22 bp, Homo sapiens
cagtgtctccagatgctccaat

SEQ ID NO: 9157857 - DNA, 22 bp, Homo sapiens
tcagagaaatgctgagctcatg

SEQ ID NO: 9157858 - DNA, 23 bp, Homo sapiens
cagtgtgacgaggtgaggcaggc

SEQ ID NO: 9157859 - DNA, 23 bp, Homo sapiens
cagtgtgacgaggtgaggcaggc

SEQ ID NO: 9157860 - DNA, 22 bp, Homo sapiens
cagtgtgaggaattagtgtcca

SEQ ID NO: 9157861 - DNA, 22 bp, Homo sapiens
cagtgtttagcacagtgcttgg

SEQ ID NO: 9157862 - DNA, 22 bp, Homo sapiens
cagttaaaaggtatgctaccaa

SEQ ID NO: 9157863 - DNA, 22 bp, Homo sapiens
cagtgttttgttacttgggcac

SEQ ID NO: 9157864 - DNA, 22 bp, Homo sapiens
cagtgcccaagatgtgccatgc

SEQ ID NO: 9157865 - DNA, 22 bp, Homo sapiens
cagtggctgtgaccagggacct

SEQ ID NO: 9157866 - DNA, 22 bp, Homo sapiens
cagtggctggttagggacagga

SEQ ID NO: 9157867 - DNA, 20 bp, Homo sapiens
cagtggctgataacaaatta

SEQ ID NO: 9157868 - DNA, 22 bp, Homo sapiens
cagtggctggttagggacagga

SEQ ID NO: 9157869 - DNA, 22 bp, Homo sapiens
cagtggcttctcatgtcattca

SEQ ID NO: 9157870 - DNA, 22 bp, Homo sapiens
cagtggcttcttcctagagcca

SEQ ID NO: 9157871 - DNA, 22 bp, Homo sapiens
cagtggcttcttcctagagcca

SEQ ID NO: 9157872 - DNA, 22 bp, Homo sapiens
cagtggcttaaataagattagg

SEQ ID NO: 9157873 - DNA, 22 bp, Homo sapiens
cagtggcttacaatgaactaga

SEQ ID NO: 9157874 - DNA, 22 bp, Homo sapiens
cagtggctgtgaccagggacct

SEQ ID NO: 9157875 - DNA, 22 bp, Homo sapiens
cagtggctgtttctggaaggca

SEQ ID NO: 9157876 - DNA, 22 bp, Homo sapiens
cagtggggaggccaggatagaa

SEQ ID NO: 9157877 - DNA, 22 bp, Homo sapiens
cagtggggaggccaggatagaa

SEQ ID NO: 9157878 - DNA, 23 bp, Homo sapiens
cagtgggcttctaactgctcctg

SEQ ID NO: 9157879 - DNA, 22 bp, Homo sapiens
cagtggggggactgaggcctga

SEQ ID NO: 9157880 - DNA, 22 bp, Homo sapiens
cagtgggggggccatgctgcag

SEQ ID NO: 9157881 - DNA, 22 bp, Homo sapiens
cagtgggggggccatgctgcag

SEQ ID NO: 9157882 - DNA, 22 bp, Homo sapiens
cagtggggtttctgtgggtgct

SEQ ID NO: 9157883 - DNA, 22 bp, Homo sapiens
cagtgggggtgaggccgaggta

SEQ ID NO: 9157884 - DNA, 22 bp, Homo sapiens
cagtgggggtgaggccgaggta

SEQ ID NO: 9157885 - DNA, 22 bp, Homo sapiens
cagtgggggtgaggccgaggta

SEQ ID NO: 9157886 - DNA, 22 bp, Homo sapiens
cagtgggtaggaaaggctcttc

SEQ ID NO: 9157887 - DNA, 21 bp, Homo sapiens
cagtgggctgctgcgctccag

SEQ ID NO: 9157888 - DNA, 23 bp, Homo sapiens
cagtgggcttctaactgctcctg

SEQ ID NO: 9157889 - DNA, 22 bp, Homo sapiens
cagtgggatatgggggcagcat

SEQ ID NO: 9157890 - DNA, 22 bp, Homo sapiens
cagtgggaagggcagaggcttt

SEQ ID NO: 9157891 - DNA, 22 bp, Homo sapiens
cagtgggaaagtgaagagcatt

SEQ ID NO: 9157892 - DNA, 22 bp, Homo sapiens
cagtgggacatgggcactgggc

SEQ ID NO: 9157893 - DNA, 22 bp, Homo sapiens
cagtgggaagggcagaggcttt

SEQ ID NO: 9157894 - DNA, 22 bp, Homo sapiens
cagtgggaatgaagtggaggcc

SEQ ID NO: 9157895 - DNA, 22 bp, Homo sapiens
tactcagagtcattgcccttct

SEQ ID NO: 9157896 - DNA, 22 bp, Homo sapiens
tactattttgacatgaaattga

SEQ ID NO: 9157897 - DNA, 22 bp, Homo sapiens
tactgtattgttggctcttttg

SEQ ID NO: 9157898 - DNA, 21 bp, Homo sapiens
tactgtagccttgcactgtag

SEQ ID NO: 9157899 - DNA, 22 bp, Homo sapiens
tactgtctaataagattgatgg

SEQ ID NO: 9157900 - DNA, 22 bp, Homo sapiens
tactgtcattagcattaacttt

SEQ ID NO: 9157901 - DNA, 22 bp, Homo sapiens
tactgtccatggtgctggacgg

SEQ ID NO: 9157902 - DNA, 22 bp, Homo sapiens
tactgtccatggtgctggacgg

SEQ ID NO: 9157903 - DNA, 22 bp, Homo sapiens
tactgtctaataagattgatgg

SEQ ID NO: 9157904 - DNA, 22 bp, Homo sapiens
tactgtctctgccctggccagg

SEQ ID NO: 9157905 - DNA, 22 bp, Homo sapiens
tactgtctatacacttgattac

SEQ ID NO: 9157906 - DNA, 22 bp, Homo sapiens
tactgtctatacacttgattac

SEQ ID NO: 9157907 - DNA, 22 bp, Homo sapiens
tactgtctgcttcttatagctt

SEQ ID NO: 9157908 - DNA, 22 bp, Homo sapiens
tactgtctggagttgccaaagg

SEQ ID NO: 9157909 - DNA, 22 bp, Homo sapiens
tactgtctggcaattaagaatc

SEQ ID NO: 9157910 - DNA, 22 bp, Homo sapiens
gtgaggggtggctgagcagttt

SEQ ID NO: 9157911 - DNA, 22 bp, Homo sapiens
gtgaggggtggctgagcagttt

SEQ ID NO: 9157912 - DNA, 22 bp, Homo sapiens
gtgaggggccaagagtagggca

SEQ ID NO: 9157913 - DNA, 22 bp, Homo sapiens
gtgaggggccaagagtagggca

SEQ ID NO: 9157914 - DNA, 22 bp, Homo sapiens
gtgaggggagtaaagccatgtt

SEQ ID NO: 9157915 - DNA, 22 bp, Homo sapiens
gtgagggcagcttggtcagtgt

SEQ ID NO: 9157916 - DNA, 20 bp, Homo sapiens
cagccctgtgacctggccct

SEQ ID NO: 9157917 - DNA, 22 bp, Homo sapiens
tagaataagttgatgatatatg

SEQ ID NO: 9157918 - DNA, 22 bp, Homo sapiens
tagaatatgattaattttctta

SEQ ID NO: 9157919 - DNA, 22 bp, Homo sapiens
tagaatatacactacagcttaa

SEQ ID NO: 9157920 - DNA, 19 bp, Homo sapiens
tagaatagttacacagatt

SEQ ID NO: 9157921 - DNA, 22 bp, Homo sapiens
tagaatactagtgaagtcatcg

SEQ ID NO: 9157922 - DNA, 22 bp, Homo sapiens
tagaatagtggctggcatattt

SEQ ID NO: 9157923 - DNA, 22 bp, Homo sapiens
caggctggagtgcagtggggcg

SEQ ID NO: 9157924 - DNA, 22 bp, Homo sapiens
caggctggagtgcagtggggcg

SEQ ID NO: 9157925 - DNA, 22 bp, Homo sapiens
caggctggagtgcagtggggcg

SEQ ID NO: 9157926 - DNA, 22 bp, Homo sapiens
caggctggagtgcagtggcgct

SEQ ID NO: 9157927 - DNA, 22 bp, Homo sapiens
caggctggagtgcagtggcgct

SEQ ID NO: 9157928 - DNA, 22 bp, Homo sapiens
caggctggagtgcagtggcgct

SEQ ID NO: 9157929 - DNA, 22 bp, Homo sapiens
caggctggagtgcagtggcgct

SEQ ID NO: 9157930 - DNA, 22 bp, Homo sapiens
caggctggagtgcagtggcgcc

SEQ ID NO: 9157931 - DNA, 22 bp, Homo sapiens
caggctggagtgcagtggcgcc

SEQ ID NO: 9157932 - DNA, 22 bp, Homo sapiens
caggctggagtgcagtggcgcc

SEQ ID NO: 9157933 - DNA, 22 bp, Homo sapiens
caggctggagtgcaatggcaca

SEQ ID NO: 9157934 - DNA, 22 bp, Homo sapiens
caggctggagtgcaatgacgcc

SEQ ID NO: 9157935 - DNA, 22 bp, Homo sapiens
caggctggagtgcaatgacgcc

SEQ ID NO: 9157936 - DNA, 22 bp, Homo sapiens
caggctggagtgagtgtagtgg

SEQ ID NO: 9157937 - DNA, 22 bp, Homo sapiens
caggctggagtgagtgtagtgg

SEQ ID NO: 9157938 - DNA, 22 bp, Homo sapiens
caggctggagtgcaatggtgct

SEQ ID NO: 9157939 - DNA, 22 bp, Homo sapiens
caggctggagtgcagtggcgcc

SEQ ID NO: 9157940 - DNA, 22 bp, Homo sapiens
caggctggagtgagtgtagtgg

SEQ ID NO: 9157941 - DNA, 22 bp, Homo sapiens
caggctggagtacaattgtgtg

SEQ ID NO: 9157942 - DNA, 22 bp, Homo sapiens
caggctgcctggaagaggactg

SEQ ID NO: 9157943 - DNA, 22 bp, Homo sapiens
caggctgcctggaagaggactg

SEQ ID NO: 9157944 - DNA, 22 bp, Homo sapiens
tactgtgccctgggtcagaact

SEQ ID NO: 9157945 - DNA, 23 bp, Homo sapiens
tactgtgctgaatatttgagagg

SEQ ID NO: 9157946 - DNA, 23 bp, Homo sapiens
tactgtgctgaatatttgagagg

SEQ ID NO: 9157947 - DNA, 22 bp, Homo sapiens
tactgtctttccatccttgcct

SEQ ID NO: 9157948 - DNA, 22 bp, Homo sapiens
tactgtcttttcctaaatgggt

SEQ ID NO: 9157949 - DNA, 22 bp, Homo sapiens
tactgtctttaggggtagaaat

SEQ ID NO: 9157950 - DNA, 23 bp, Homo sapiens
tactgtcttctattaagtaagga

SEQ ID NO: 9157951 - DNA, 22 bp, Homo sapiens
tactgtctggcaattaagaatc

SEQ ID NO: 9157952 - DNA, 22 bp, Homo sapiens
tactgtctgggttcccaagcaa

SEQ ID NO: 9157953 - DNA, 17 bp, Homo sapiens
tagagctggttcaggag

SEQ ID NO: 9157954 - DNA, 22 bp, Homo sapiens
tagagctgtatcaaagagcctt

SEQ ID NO: 9157955 - DNA, 22 bp, Homo sapiens
tagagctgggcagtgctctgag

SEQ ID NO: 9157956 - DNA, 22 bp, Homo sapiens
tagagctggaatttgcagcaag

SEQ ID NO: 9157957 - DNA, 22 bp, Homo sapiens
tagagctggaatttgcagcaag

SEQ ID NO: 9157958 - DNA, 22 bp, Homo sapiens
tagagctggccgggacagctgg

SEQ ID NO: 9157959 - DNA, 22 bp, Homo sapiens
tagagctggccgggacagctgg

SEQ ID NO: 9157960 - DNA, 22 bp, Homo sapiens
tagagctggaaaactgcaggta

SEQ ID NO: 9157961 - DNA, 22 bp, Homo sapiens
tagagctggaaaactgcaggta

SEQ ID NO: 9157962 - DNA, 22 bp, Homo sapiens
tagagctggaaaactgcaggta

SEQ ID NO: 9157963 - DNA, 22 bp, Homo sapiens
tagagctggaaaactgcaggta

SEQ ID NO: 9157964 - DNA, 19 bp, Homo sapiens
tagagctgcttcctggcag

SEQ ID NO: 9157965 - DNA, 19 bp, Homo sapiens
tagagctgcttcctggcag

SEQ ID NO: 9157966 - DNA, 19 bp, Homo sapiens
tagagctgcttcctggcag

SEQ ID NO: 9157967 - DNA, 22 bp, Homo sapiens
tagagctgctggactgtaacag

SEQ ID NO: 9157968 - DNA, 22 bp, Homo sapiens
tagagctgctggactgtaacag

SEQ ID NO: 9157969 - DNA, 22 bp, Homo sapiens
tagaggagaacacaaattatag

SEQ ID NO: 9157970 - DNA, 19 bp, Homo sapiens
tagaggagaagggaagtgg

SEQ ID NO: 9157971 - DNA, 19 bp, Homo sapiens
tagaggagaagggaagtgg

SEQ ID NO: 9157972 - DNA, 19 bp, Homo sapiens
tagaggagaagggaagtgg

SEQ ID NO: 9157973 - DNA, 22 bp, Homo sapiens
tagataaaagggcaaagggcat

SEQ ID NO: 9157974 - DNA, 22 bp, Homo sapiens
tagagtgtcataacagtgccca

SEQ ID NO: 9157975 - DNA, 22 bp, Homo sapiens
tagaatcaagcagtagagcaga

SEQ ID NO: 9157976 - DNA, 18 bp, Homo sapiens
tagaatcaaatattttac

SEQ ID NO: 9157977 - DNA, 22 bp, Homo sapiens
tagaatatgtggtaggatctgg

SEQ ID NO: 9157978 - DNA, 22 bp, Homo sapiens
tagaatatgtggtgtatacttt

SEQ ID NO: 9157979 - DNA, 22 bp, Homo sapiens
tagaatatgtggtaggatctgg

SEQ ID NO: 9157980 - DNA, 22 bp, Homo sapiens
tagaatatgtggtgtatacttt

SEQ ID NO: 9157981 - DNA, 22 bp, Homo sapiens
caggctgggcagcctccccggc

SEQ ID NO: 9157982 - DNA, 22 bp, Homo sapiens
caggctgggcagcctccccggc

SEQ ID NO: 9157983 - DNA, 22 bp, Homo sapiens
caggctgggctccggagataaa

SEQ ID NO: 9157984 - DNA, 22 bp, Homo sapiens
caggctgggctccggagataaa

SEQ ID NO: 9157985 - DNA, 22 bp, Homo sapiens
caggctgggctggtgttagagt

SEQ ID NO: 9157986 - DNA, 22 bp, Homo sapiens
caggctgggctggtgttagagt

SEQ ID NO: 9157987 - DNA, 22 bp, Homo sapiens
caggctgggctggtgttagagt

SEQ ID NO: 9157988 - DNA, 22 bp, Homo sapiens
caggctgggctggtgttagagt

SEQ ID NO: 9157989 - DNA, 22 bp, Homo sapiens
caggctggtcccagagcattgc

SEQ ID NO: 9157990 - DNA, 22 bp, Homo sapiens
caggctggtcccagagcattgc

SEQ ID NO: 9157991 - DNA, 22 bp, Homo sapiens
tagacattttaagacatatacc

SEQ ID NO: 9157992 - DNA, 22 bp, Homo sapiens
tagacattttctcaacatctct

SEQ ID NO: 9157993 - DNA, 22 bp, Homo sapiens
tagacattttctcaacatctct

SEQ ID NO: 9157994 - DNA, 22 bp, Homo sapiens
tagacattttctcaacatctct

SEQ ID NO: 9157995 - DNA, 22 bp, Homo sapiens
cagggcacagttatggaggtgg

SEQ ID NO: 9157996 - DNA, 20 bp, Homo sapiens
cagggcacactgcagcctcg

SEQ ID NO: 9157997 - DNA, 22 bp, Homo sapiens
cagggcacttaaattgcctcgt

SEQ ID NO: 9157998 - DNA, 22 bp, Homo sapiens
cagggcagaacatatagatagt

SEQ ID NO: 9157999 - DNA, 22 bp, Homo sapiens
cagggcagaaggcactctactc

SEQ ID NO: 9158000 - DNA, 22 bp, Homo sapiens
tagataaattagaaagtttact

SEQ ID NO: 9158001 - DNA, 22 bp, Homo sapiens
tagataacttgcacctacagga

SEQ ID NO: 9158002 - DNA, 21 bp, Homo sapiens
cagggcaaccaagtccagaga

SEQ ID NO: 9158003 - DNA, 22 bp, Homo sapiens
cagggcaaagagagcacatgct

SEQ ID NO: 9158004 - DNA, 22 bp, Homo sapiens
tagctaagcattatgtaaacta

SEQ ID NO: 9158005 - DNA, 22 bp, Homo sapiens
tagctaaaccagtatgtgaagg

SEQ ID NO: 9158006 - DNA, 22 bp, Homo sapiens
tagctaaatttttcatgtaata

SEQ ID NO: 9158007 - DNA, 22 bp, Homo sapiens
tagcaatagaaacatataaagt

SEQ ID NO: 9158008 - DNA, 22 bp, Homo sapiens
tagcaatatgctaccttaaatg

SEQ ID NO: 9158009 - DNA, 22 bp, Homo sapiens
tagcaatccgttgatcccttgc

SEQ ID NO: 9158010 - DNA, 22 bp, Homo sapiens
tagcattatctgtcttatcatt

SEQ ID NO: 9158011 - DNA, 22 bp, Homo sapiens
tagcaagatgtcactccaagtt

SEQ ID NO: 9158012 - DNA, 22 bp, Homo sapiens
tagcaagatgatgaattattca

SEQ ID NO: 9158013 - DNA, 22 bp, Homo sapiens
tagcaagatccttccctggcgt

SEQ ID NO: 9158014 - DNA, 22 bp, Homo sapiens
tagcaagatcgtgtctctaaaa

SEQ ID NO: 9158015 - DNA, 22 bp, Homo sapiens
cagggcagaaggcactctactc

SEQ ID NO: 9158016 - DNA, 22 bp, Homo sapiens
cagggcagaaggcactctactc

SEQ ID NO: 9158017 - DNA, 22 bp, Homo sapiens
cagggcagaaggcactctactc

SEQ ID NO: 9158018 - DNA, 22 bp, Homo sapiens
tagcaagaggtgaaggtttcat

SEQ ID NO: 9158019 - DNA, 22 bp, Homo sapiens
tagcaagagtgggctttgtggg

SEQ ID NO: 9158020 - DNA, 22 bp, Homo sapiens
caggggagttttatgcaacaga

SEQ ID NO: 9158021 - DNA, 22 bp, Homo sapiens
tagtctttcatttggagcattt

SEQ ID NO: 9158022 - DNA, 22 bp, Homo sapiens
tagtctttttaataaataatgc

SEQ ID NO: 9158023 - DNA, 22 bp, Homo sapiens
tagtgaaacagttatcaatctg

SEQ ID NO: 9158024 - DNA, 22 bp, Homo sapiens
tagtgaaacctgacagatcatg

SEQ ID NO: 9158025 - DNA, 22 bp, Homo sapiens
tagtcttttgagaagtatatct

SEQ ID NO: 9158026 - DNA, 19 bp, Homo sapiens
tagtctttattcttaattt

SEQ ID NO: 9158027 - DNA, 22 bp, Homo sapiens
tagtgaaatgataacagagcag

SEQ ID NO: 9158028 - DNA, 22 bp, Homo sapiens
tagtgaaagtattaaacagctg

SEQ ID NO: 9158029 - DNA, 22 bp, Homo sapiens
tagtgaaagtcaaagacagcta

SEQ ID NO: 9158030 - DNA, 22 bp, Homo sapiens
tagtgaaatatgtgctgatagc

SEQ ID NO: 9158031 - DNA, 22 bp, Homo sapiens
tagtgaaatttatgcacagcta

SEQ ID NO: 9158032 - DNA, 22 bp, Homo sapiens
tagtgaaatgagaatgtatgac

SEQ ID NO: 9158033 - DNA, 22 bp, Homo sapiens
tatcataagttaattaaacagt

SEQ ID NO: 9158034 - DNA, 22 bp, Homo sapiens
tatcagtttaaaatctgtgaat

SEQ ID NO: 9158035 - DNA, 22 bp, Homo sapiens
tatcagtgctcccagcttagca

SEQ ID NO: 9158036 - DNA, 22 bp, Homo sapiens
tatcagtggtcacaagatacat

SEQ ID NO: 9158037 - DNA, 22 bp, Homo sapiens
tatcatgttgaatttctgagaa

SEQ ID NO: 9158038 - DNA, 22 bp, Homo sapiens
tatcatttaacagaatcattgc

SEQ ID NO: 9158039 - DNA, 22 bp, Homo sapiens
tagggtcctgcctacagagaca

SEQ ID NO: 9158040 - DNA, 22 bp, Homo sapiens
tagggtcccagataggagccag

SEQ ID NO: 9158041 - DNA, 22 bp, Homo sapiens
taggtagggaccaccttgggga

SEQ ID NO: 9158042 - DNA, 22 bp, Homo sapiens
taggtagctttggcgtttcttg

SEQ ID NO: 9158043 - DNA, 22 bp, Homo sapiens
taggtaccaaggagtcactgga

SEQ ID NO: 9158044 - DNA, 22 bp, Homo sapiens
cagggctttcctgagaagtgat

SEQ ID NO: 9158045 - DNA, 22 bp, Homo sapiens
cagggctttgaacaggcatcaa

SEQ ID NO: 9158046 - DNA, 22 bp, Homo sapiens
cagggctttttattagctgcct

SEQ ID NO: 9158047 - DNA, 22 bp, Homo sapiens
cagggctttgtgtgcctgggga

SEQ ID NO: 9158048 - DNA, 22 bp, Homo sapiens
cagggctttgtgtgcctgggga

SEQ ID NO: 9158049 - DNA, 22 bp, Homo sapiens
cagggcttggatctgtggtcag

SEQ ID NO: 9158050 - DNA, 18 bp, Homo sapiens
cagggctgtggggtcact

SEQ ID NO: 9158051 - DNA, 22 bp, Homo sapiens
cagggctgtggctttgtgctgt

SEQ ID NO: 9158052 - DNA, 22 bp, Homo sapiens
cagggcttggttggaaccaccc

SEQ ID NO: 9158053 - DNA, 22 bp, Homo sapiens
cagggcttggatctgtggtcag

SEQ ID NO: 9158054 - DNA, 22 bp, Homo sapiens
caggggaaggagccttgaaact

SEQ ID NO: 9158055 - DNA, 22 bp, Homo sapiens
caggggaagatgccaagggaga

SEQ ID NO: 9158056 - DNA, 22 bp, Homo sapiens
cagggctttttattagctgcct

SEQ ID NO: 9158057 - DNA, 22 bp, Homo sapiens
tagggccagataggcttcttga

SEQ ID NO: 9158058 - DNA, 18 bp, Homo sapiens
tagggccaaaatggaaaa

SEQ ID NO: 9158059 - DNA, 22 bp, Homo sapiens
tagggctcactgagatgaatat

SEQ ID NO: 9158060 - DNA, 22 bp, Homo sapiens
tagggctcagagaagtggggcc

SEQ ID NO: 9158061 - DNA, 22 bp, Homo sapiens
tagggcagttataacattagtg

SEQ ID NO: 9158062 - DNA, 22 bp, Homo sapiens
tagggcagtttcatgttatctt

SEQ ID NO: 9158063 - DNA, 22 bp, Homo sapiens
tagggcagtttcatgttatctt

SEQ ID NO: 9158064 - DNA, 22 bp, Homo sapiens
tagggtccatatggatgaatgg

SEQ ID NO: 9158065 - DNA, 22 bp, Homo sapiens
tagggtcccagataggagccag

SEQ ID NO: 9158066 - DNA, 22 bp, Homo sapiens
tagggtcctgcctacagagaca

SEQ ID NO: 9158067 - DNA, 22 bp, Homo sapiens
tagggtcctcatctgtaaatga

SEQ ID NO: 9158068 - DNA, 22 bp, Homo sapiens
tagggtccaagccttataatta

SEQ ID NO: 9158069 - DNA, 22 bp, Homo sapiens
tagggctcgggcacaggacagg

SEQ ID NO: 9158070 - DNA, 20 bp, Homo sapiens
tagggctcattatgatctcc

SEQ ID NO: 9158071 - DNA, 22 bp, Homo sapiens
tagggctccactcccagagatt

SEQ ID NO: 9158072 - DNA, 22 bp, Homo sapiens
tagggctcagagtccagtttct

SEQ ID NO: 9158073 - DNA, 22 bp, Homo sapiens
tagggctcagctctagctcctg

SEQ ID NO: 9158074 - DNA, 22 bp, Homo sapiens
tagggacaaagagctgaggcct

SEQ ID NO: 9158075 - DNA, 21 bp, Homo sapiens
tagggcaggcattggaagaga

SEQ ID NO: 9158076 - DNA, 22 bp, Homo sapiens
tagggaagtgtataggggtcat

SEQ ID NO: 9158077 - DNA, 22 bp, Homo sapiens
tagggaaggagaccaagccaca

SEQ ID NO: 9158078 - DNA, 22 bp, Homo sapiens
tagggcaggggaggaatctgaa

SEQ ID NO: 9158079 - DNA, 21 bp, Homo sapiens
tagggcaggcattggaagaga

SEQ ID NO: 9158080 - DNA, 21 bp, Homo sapiens
tagggcaggcattggaagaga

SEQ ID NO: 9158081 - DNA, 22 bp, Homo sapiens
tagggcaggggaggaatctgaa

SEQ ID NO: 9158082 - DNA, 22 bp, Homo sapiens
tagggcaggtgaagaaaagcta

SEQ ID NO: 9158083 - DNA, 22 bp, Homo sapiens
tagggcaggtgaagaaaagcta

SEQ ID NO: 9158084 - DNA, 22 bp, Homo sapiens
tagggcaggtgaagaaaagcta

SEQ ID NO: 9158085 - DNA, 19 bp, Homo sapiens
taggaccctggtggccccc

SEQ ID NO: 9158086 - DNA, 19 bp, Homo sapiens
taggaccctggtggccccc

SEQ ID NO: 9158087 - DNA, 19 bp, Homo sapiens
taggaccctggtggccccc

SEQ ID NO: 9158088 - DNA, 22 bp, Homo sapiens
taggacatgtgttttatatatg

SEQ ID NO: 9158089 - DNA, 22 bp, Homo sapiens
taggacatttataaagctgaaa

SEQ ID NO: 9158090 - DNA, 22 bp, Homo sapiens
taggagaggtgaatggcacact

SEQ ID NO: 9158091 - DNA, 22 bp, Homo sapiens
taggagaagagtcagggcctaa

SEQ ID NO: 9158092 - DNA, 22 bp, Homo sapiens
taggaggaactttttgtttgga

SEQ ID NO: 9158093 - DNA, 22 bp, Homo sapiens
taggagcctgctctgcagggac

SEQ ID NO: 9158094 - DNA, 22 bp, Homo sapiens
taggagcctgctctgcagggac

SEQ ID NO: 9158095 - DNA, 22 bp, Homo sapiens
cagggcctgcttccttcttgtt

SEQ ID NO: 9158096 - DNA, 22 bp, Homo sapiens
cagggcctgcctggttcctgga

SEQ ID NO: 9158097 - DNA, 22 bp, Homo sapiens
cagggcctgtcacgacgctcat

SEQ ID NO: 9158098 - DNA, 22 bp, Homo sapiens
cagggctcaggaaatcagacgt

SEQ ID NO: 9158099 - DNA, 22 bp, Homo sapiens
cagggctcagggactgcagaaa

SEQ ID NO: 9158100 - DNA, 22 bp, Homo sapiens
cagggctcagggactgcagaaa

SEQ ID NO: 9158101 - DNA, 22 bp, Homo sapiens
cagggctcagaagacagacctc

SEQ ID NO: 9158102 - DNA, 22 bp, Homo sapiens
cagggctcagaagacagacctc

SEQ ID NO: 9158103 - DNA, 22 bp, Homo sapiens
cagggcaggaatttgacattgc

SEQ ID NO: 9158104 - DNA, 22 bp, Homo sapiens
cagggcaggaatttgacattgc

SEQ ID NO: 9158105 - DNA, 22 bp, Homo sapiens
taggaaattagaacttggaaac

SEQ ID NO: 9158106 - DNA, 22 bp, Homo sapiens
taggaaattgccaatatatgac

SEQ ID NO: 9158107 - DNA, 22 bp, Homo sapiens
taggaaatttgaaatatgtggg

SEQ ID NO: 9158108 - DNA, 22 bp, Homo sapiens
taggaacaagtttccttgctgt

SEQ ID NO: 9158109 - DNA, 22 bp, Homo sapiens
taggaacacagggacttgatga

SEQ ID NO: 9158110 - DNA, 22 bp, Homo sapiens
taggaacatatgcagtgctttt

SEQ ID NO: 9158111 - DNA, 22 bp, Homo sapiens
taggacatgctacataaatagg

SEQ ID NO: 9158112 - DNA, 22 bp, Homo sapiens
cagggcagccaggccccgtggg

SEQ ID NO: 9158113 - DNA, 22 bp, Homo sapiens
cagggcagcttcctttgttagg

SEQ ID NO: 9158114 - DNA, 22 bp, Homo sapiens
cagggcagccaggccccgtggg

SEQ ID NO: 9158115 - DNA, 22 bp, Homo sapiens
cagggcagagggaaactccttt

SEQ ID NO: 9158116 - DNA, 22 bp, Homo sapiens
cagggcagagggaaactccttt

SEQ ID NO: 9158117 - DNA, 22 bp, Homo sapiens
cagggcagagggaaactccttt

SEQ ID NO: 9158118 - DNA, 22 bp, Homo sapiens
cagggcagagccaggatttcaa

SEQ ID NO: 9158119 - DNA, 22 bp, Homo sapiens
cagggcagagccaggatttcaa

SEQ ID NO: 9158120 - DNA, 22 bp, Homo sapiens
tagctcctggctgcagggcctc

SEQ ID NO: 9158121 - DNA, 22 bp, Homo sapiens
tagctcacttgagctctgctag

SEQ ID NO: 9158122 - DNA, 22 bp, Homo sapiens
tagctcaaaggttaagtgtgga

SEQ ID NO: 9158123 - DNA, 22 bp, Homo sapiens
tagctcactatttcaggctttt

SEQ ID NO: 9158124 - DNA, 23 bp, Homo sapiens
tctctgcatgtcctgagcacatc

SEQ ID NO: 9158125 - DNA, 22 bp, Homo sapiens
tctctgagttttaaggatgatg

SEQ ID NO: 9158126 - DNA, 22 bp, Homo sapiens
tctctgagttttaaggatgatg

SEQ ID NO: 9158127 - DNA, 23 bp, Homo sapiens
tctctgagttgtactttcccttg

SEQ ID NO: 9158128 - DNA, 22 bp, Homo sapiens
tctctgagttctcctccagccc

SEQ ID NO: 9158129 - DNA, 23 bp, Homo sapiens
tctcctggctgcactgtggccac

SEQ ID NO: 9158130 - DNA, 23 bp, Homo sapiens
tctcctggctgcactgtggccac

SEQ ID NO: 9158131 - DNA, 17 bp, Homo sapiens
tctcctggctctatcag

SEQ ID NO: 9158132 - DNA, 22 bp, Homo sapiens
tctcctggctctaaaaggctgt

SEQ ID NO: 9158133 - DNA, 22 bp, Homo sapiens
tctcctggctcaccaggctgga

SEQ ID NO: 9158134 - DNA, 22 bp, Homo sapiens
tctcctggccgggctgtcccct

SEQ ID NO: 9158135 - DNA, 21 bp, Homo sapiens
tctctgggaggacttgtgaga

SEQ ID NO: 9158136 - DNA, 21 bp, Homo sapiens
tctctgggaggacttgtgaga

SEQ ID NO: 9158137 - DNA, 22 bp, Homo sapiens
tctctgggagttgagcagcagc

SEQ ID NO: 9158138 - DNA, 22 bp, Homo sapiens
tctctgggagttgagcagcagc

SEQ ID NO: 9158139 - DNA, 22 bp, Homo sapiens
tctctgggagttgagcagcagc

SEQ ID NO: 9158140 - DNA, 22 bp, Homo sapiens
tctctgggaattttttggacat

SEQ ID NO: 9158141 - DNA, 22 bp, Homo sapiens
tctctgggacactgggtcagtt

SEQ ID NO: 9158142 - DNA, 22 bp, Homo sapiens
tctctgggacactgggtcagtt

SEQ ID NO: 9158143 - DNA, 22 bp, Homo sapiens
tctctgggagcaattgtttgct

SEQ ID NO: 9158144 - DNA, 22 bp, Homo sapiens
tctctgggagccaggatgacac

SEQ ID NO: 9158145 - DNA, 22 bp, Homo sapiens
tctctgccaccatgagatgggc

SEQ ID NO: 9158146 - DNA, 22 bp, Homo sapiens
tctctgcccaagtttctcaagt

SEQ ID NO: 9158147 - DNA, 22 bp, Homo sapiens
tctctgggaattcacaagccct

SEQ ID NO: 9158148 - DNA, 22 bp, Homo sapiens
tctctgggaattcacaagccct

SEQ ID NO: 9158149 - DNA, 22 bp, Homo sapiens
tctctgggaattcacaagccct

SEQ ID NO: 9158150 - DNA, 22 bp, Homo sapiens
tctctgggaatgggcctgggta

SEQ ID NO: 9158151 - DNA, 22 bp, Homo sapiens
tctctgggaatgggcctgggta

SEQ ID NO: 9158152 - DNA, 22 bp, Homo sapiens
tctctgggaatgggcctgggta

SEQ ID NO: 9158153 - DNA, 22 bp, Homo sapiens
tctctgggaaatggagaatttt

SEQ ID NO: 9158154 - DNA, 22 bp, Homo sapiens
tctctgcccatcctcagtccac

SEQ ID NO: 9158155 - DNA, 22 bp, Homo sapiens
ccagcagaggggcggagtgcag

SEQ ID NO: 9158156 - DNA, 22 bp, Homo sapiens
ccagcagaggggcggagtgcag

SEQ ID NO: 9158157 - DNA, 22 bp, Homo sapiens
ccagcagaggggcggagtgcag

SEQ ID NO: 9158158 - DNA, 22 bp, Homo sapiens
ccagcagagtatcaatgtattt

SEQ ID NO: 9158159 - DNA, 22 bp, Homo sapiens
ccagcagagtatcaatgtattt

SEQ ID NO: 9158160 - DNA, 22 bp, Homo sapiens
ccagcagagggtcttggccatt

SEQ ID NO: 9158161 - DNA, 22 bp, Homo sapiens
ccagcagagggtcttggccatt

SEQ ID NO: 9158162 - DNA, 22 bp, Homo sapiens
ccagcagagtctaggaaggagg

SEQ ID NO: 9158163 - DNA, 22 bp, Homo sapiens
ccagcagagttggtttctggta

SEQ ID NO: 9158164 - DNA, 22 bp, Homo sapiens
ccagcagagttggtttctggta

SEQ ID NO: 9158165 - DNA, 22 bp, Homo sapiens
ccagcagagtggggtttagagt

SEQ ID NO: 9158166 - DNA, 22 bp, Homo sapiens
ccagcagagtggggtttagagt

SEQ ID NO: 9158167 - DNA, 22 bp, Homo sapiens
ccagcagagtggggtttagagt

SEQ ID NO: 9158168 - DNA, 22 bp, Homo sapiens
ccagcagagtctaggaaggagg

SEQ ID NO: 9158169 - DNA, 22 bp, Homo sapiens
ccagcagagtctaggaaggagg

SEQ ID NO: 9158170 - DNA, 22 bp, Homo sapiens
ccagcagcagcgtccaaggaga

SEQ ID NO: 9158171 - DNA, 22 bp, Homo sapiens
ccagcagagttggtttctggta

SEQ ID NO: 9158172 - DNA, 22 bp, Homo sapiens
ccagcagcagcgtccaaggaga

SEQ ID NO: 9158173 - DNA, 22 bp, Homo sapiens
ccagcagccagagaaggacctc

SEQ ID NO: 9158174 - DNA, 22 bp, Homo sapiens
ccagcagccctcttccaagact

SEQ ID NO: 9158175 - DNA, 22 bp, Homo sapiens
ccagcagcccctcaatgatctg

SEQ ID NO: 9158176 - DNA, 22 bp, Homo sapiens
ccagcagggcagtgccctggac

SEQ ID NO: 9158177 - DNA, 22 bp, Homo sapiens
ccagcagggcagtgccctggac

SEQ ID NO: 9158178 - DNA, 22 bp, Homo sapiens
ccagcagggaaaaacccaccaa

SEQ ID NO: 9158179 - DNA, 22 bp, Homo sapiens
ccagcagctccctcagggtccg

SEQ ID NO: 9158180 - DNA, 21 bp, Homo sapiens
ccagcagctcaaggatctctt

SEQ ID NO: 9158181 - DNA, 22 bp, Homo sapiens
ccagcagctccctcagggtccg

SEQ ID NO: 9158182 - DNA, 22 bp, Homo sapiens
ccagcatccatgctccctcggg

SEQ ID NO: 9158183 - DNA, 22 bp, Homo sapiens
ccagcatccctggggttggcca

SEQ ID NO: 9158184 - DNA, 22 bp, Homo sapiens
ccagcatctaacgctcctggga

SEQ ID NO: 9158185 - DNA, 22 bp, Homo sapiens
ccagcatctaacgctcctggga

SEQ ID NO: 9158186 - DNA, 22 bp, Homo sapiens
ccagcatcctcagctcacttct

SEQ ID NO: 9158187 - DNA, 22 bp, Homo sapiens
tctgaaggtttgattggagcta

SEQ ID NO: 9158188 - DNA, 19 bp, Homo sapiens
tctgaagtccagggcatac

SEQ ID NO: 9158189 - DNA, 22 bp, Homo sapiens
tctgaatagttctattttaaag

SEQ ID NO: 9158190 - DNA, 22 bp, Homo sapiens
tctgaatatgtttatcatctct

SEQ ID NO: 9158191 - DNA, 22 bp, Homo sapiens
tctcttaaaagattttaatgac

SEQ ID NO: 9158192 - DNA, 22 bp, Homo sapiens
tctgaaatgacctttccccact

SEQ ID NO: 9158193 - DNA, 22 bp, Homo sapiens
tctgaaatgaactcttgaactt

SEQ ID NO: 9158194 - DNA, 22 bp, Homo sapiens
tctcttaactccaccagtgcag

SEQ ID NO: 9158195 - DNA, 22 bp, Homo sapiens
tctcttaaaggtcttcagctga

SEQ ID NO: 9158196 - DNA, 22 bp, Homo sapiens
tctcttaactggttcagcaatt

SEQ ID NO: 9158197 - DNA, 22 bp, Homo sapiens
tctcttaaatacttcacatctc

SEQ ID NO: 9158198 - DNA, 22 bp, Homo sapiens
ccagcatcagcacccaaggagc

SEQ ID NO: 9158199 - DNA, 22 bp, Homo sapiens
ccagcatcagcacccaaggagc

SEQ ID NO: 9158200 - DNA, 19 bp, Homo sapiens
ccagcaggttcatttcagg

SEQ ID NO: 9158201 - DNA, 19 bp, Homo sapiens
ccagcaggttcatttcagg

SEQ ID NO: 9158202 - DNA, 19 bp, Homo sapiens
ccagcaggttcatttcagg

SEQ ID NO: 9158203 - DNA, 22 bp, Homo sapiens
ccagcagggttggtttcttctg

SEQ ID NO: 9158204 - DNA, 22 bp, Homo sapiens
ccagcagggttggtttcttctg

SEQ ID NO: 9158205 - DNA, 22 bp, Homo sapiens
ccagcaggggaatatttttagg

SEQ ID NO: 9158206 - DNA, 22 bp, Homo sapiens
ccagcagggttggtttcttctg

SEQ ID NO: 9158207 - DNA, 22 bp, Homo sapiens
ccagcaggtgtagggctcatgg

SEQ ID NO: 9158208 - DNA, 22 bp, Homo sapiens
ccagcaggtgtagggctcatgg

SEQ ID NO: 9158209 - DNA, 22 bp, Homo sapiens
ccagcaggtgtagggctcatgg

SEQ ID NO: 9158210 - DNA, 22 bp, Homo sapiens
tctgagagatacaaggaggcaa

SEQ ID NO: 9158211 - DNA, 22 bp, Homo sapiens
tctgagagatacaaggaggcaa

SEQ ID NO: 9158212 - DNA, 22 bp, Homo sapiens
tctgagagcaaggcattagcag

SEQ ID NO: 9158213 - DNA, 22 bp, Homo sapiens
tctgagagcaggaggagctgct

SEQ ID NO: 9158214 - DNA, 22 bp, Homo sapiens
tctgagaggattcctgtcccga

SEQ ID NO: 9158215 - DNA, 22 bp, Homo sapiens
tctgagaggcagaccttcctaa

SEQ ID NO: 9158216 - DNA, 22 bp, Homo sapiens
tctgagagtccatctccaagcc

SEQ ID NO: 9158217 - DNA, 22 bp, Homo sapiens
tctgagagtacgggctgcgcgc

SEQ ID NO: 9158218 - DNA, 22 bp, Homo sapiens
tctgagagtagagctgcctctt

SEQ ID NO: 9158219 - DNA, 22 bp, Homo sapiens
tctgagagtacgggctgcgcgc

SEQ ID NO: 9158220 - DNA, 22 bp, Homo sapiens
tctgagagtctctgaggcagat

SEQ ID NO: 9158221 - DNA, 22 bp, Homo sapiens
tctgcagaattcgaggaagaaa

SEQ ID NO: 9158222 - DNA, 19 bp, Homo sapiens
tctgcagaaggcatacatg

SEQ ID NO: 9158223 - DNA, 19 bp, Homo sapiens
tctgcagaaggcatacatg

SEQ ID NO: 9158224 - DNA, 22 bp, Homo sapiens
tctgcagaaggaatcagctgag

SEQ ID NO: 9158225 - DNA, 22 bp, Homo sapiens
ccagccctgcctctcagggccc

SEQ ID NO: 9158226 - DNA, 22 bp, Homo sapiens
ccagccaccgcttgtttgcact

SEQ ID NO: 9158227 - DNA, 22 bp, Homo sapiens
ccagccctcactgaggcctctc

SEQ ID NO: 9158228 - DNA, 22 bp, Homo sapiens
ccagccctcactgaggcctctc

SEQ ID NO: 9158229 - DNA, 22 bp, Homo sapiens
ccagccacagcttccagctcct

SEQ ID NO: 9158230 - DNA, 22 bp, Homo sapiens
ccagcatttgcttctggtgggg

SEQ ID NO: 9158231 - DNA, 22 bp, Homo sapiens
ccagcatttgcttctggtgggg

SEQ ID NO: 9158232 - DNA, 22 bp, Homo sapiens
ccagcattcacactggttcctt

SEQ ID NO: 9158233 - DNA, 22 bp, Homo sapiens
ccagccctgtaaggatgaggca

SEQ ID NO: 9158234 - DNA, 22 bp, Homo sapiens
ccagccctgtttatgtgtcact

SEQ ID NO: 9158235 - DNA, 22 bp, Homo sapiens
ccagccctgtttatgtgtcact

SEQ ID NO: 9158236 - DNA, 22 bp, Homo sapiens
tcgcttgaacccaggaagtgga

SEQ ID NO: 9158237 - DNA, 22 bp, Homo sapiens
tcggaaccgacctgggagctgg

SEQ ID NO: 9158238 - DNA, 22 bp, Homo sapiens
tcgctgtggtttctgtacatgg

SEQ ID NO: 9158239 - DNA, 22 bp, Homo sapiens
tcggagctgtagatgaaaccct

SEQ ID NO: 9158240 - DNA, 22 bp, Homo sapiens
tcggagctgtagatgaaaccct

SEQ ID NO: 9158241 - DNA, 22 bp, Homo sapiens
tcggagagttcatgaagacccg

SEQ ID NO: 9158242 - DNA, 22 bp, Homo sapiens
tcggagcgtcactggctggagg

SEQ ID NO: 9158243 - DNA, 20 bp, Homo sapiens
tcggctggacactgtgcact

SEQ ID NO: 9158244 - DNA, 22 bp, Homo sapiens
tcggcgctggaacgcagtagct

SEQ ID NO: 9158245 - DNA, 23 bp, Homo sapiens
tcggtgggcgtggaggccgaggc

SEQ ID NO: 9158246 - DNA, 23 bp, Homo sapiens
tcggtgggcgtggaggccgaggc

SEQ ID NO: 9158247 - DNA, 22 bp, Homo sapiens
ccaccctgggttctgatgtgga

SEQ ID NO: 9158248 - DNA, 22 bp, Homo sapiens
ccacctccacctattgccagcc

SEQ ID NO: 9158249 - DNA, 22 bp, Homo sapiens
ccacccttgggttcggaggccg

SEQ ID NO: 9158250 - DNA, 22 bp, Homo sapiens
ccaccagcttcagcagccgcgg

SEQ ID NO: 9158251 - DNA, 22 bp, Homo sapiens
ccaccagcttcagcagccgcgg

SEQ ID NO: 9158252 - DNA, 22 bp, Homo sapiens
ccaccagatttactttactatt

SEQ ID NO: 9158253 - DNA, 22 bp, Homo sapiens
ccaccagagcttcgtggcttaa

SEQ ID NO: 9158254 - DNA, 22 bp, Homo sapiens
ccaccagagggcagactgtgat

SEQ ID NO: 9158255 - DNA, 22 bp, Homo sapiens
ccaccagagggcagactgtgat

SEQ ID NO: 9158256 - DNA, 22 bp, Homo sapiens
ccaccactgaggcacaggagcc

SEQ ID NO: 9158257 - DNA, 22 bp, Homo sapiens
ccaccagaccaccaagagcaac

SEQ ID NO: 9158258 - DNA, 22 bp, Homo sapiens
ccaccacttctggcttctggtg

SEQ ID NO: 9158259 - DNA, 22 bp, Homo sapiens
ccaccagaaagactctgtgtga

SEQ ID NO: 9158260 - DNA, 22 bp, Homo sapiens
ccaccagaagctgggagaagct

SEQ ID NO: 9158261 - DNA, 22 bp, Homo sapiens
ccaccagaagctgggagaagct

SEQ ID NO: 9158262 - DNA, 22 bp, Homo sapiens
ccaccaggacagccctgagggg

SEQ ID NO: 9158263 - DNA, 22 bp, Homo sapiens
ccaccaggacagccctgagggg

SEQ ID NO: 9158264 - DNA, 22 bp, Homo sapiens
tcgcctcatcatcctaattaca

SEQ ID NO: 9158265 - DNA, 22 bp, Homo sapiens
tcctctctgcactggccctgcc

SEQ ID NO: 9158266 - DNA, 22 bp, Homo sapiens
tcctctctgcactggccctgcc

SEQ ID NO: 9158267 - DNA, 22 bp, Homo sapiens
tcctctgaatgctgttgaagaa

SEQ ID NO: 9158268 - DNA, 22 bp, Homo sapiens
tcctctgacttctggttgagtt

SEQ ID NO: 9158269 - DNA, 22 bp, Homo sapiens
tcctgaagtcacaggctctgag

SEQ ID NO: 9158270 - DNA, 22 bp, Homo sapiens
tcctgaagtcacaggctctgag

SEQ ID NO: 9158271 - DNA, 22 bp, Homo sapiens
tcctgaattgccttagtttctg

SEQ ID NO: 9158272 - DNA, 21 bp, Homo sapiens
tcctctgcagtgaggtggcct

SEQ ID NO: 9158273 - DNA, 22 bp, Homo sapiens
tcctgaagtatgggtatggagt

SEQ ID NO: 9158274 - DNA, 22 bp, Homo sapiens
tcctgaagtattgtttgagtaa

SEQ ID NO: 9158275 - DNA, 22 bp, Homo sapiens
tcctgaaggcctgagttccacc

SEQ ID NO: 9158276 - DNA, 22 bp, Homo sapiens
ccacatctcggtcccctctttg

SEQ ID NO: 9158277 - DNA, 22 bp, Homo sapiens
ccacatgaatcttggaagcagg

SEQ ID NO: 9158278 - DNA, 22 bp, Homo sapiens
ccacagtgatccctgcctgcga

SEQ ID NO: 9158279 - DNA, 22 bp, Homo sapiens
tcctgacctcttgctctgacct

SEQ ID NO: 9158280 - DNA, 22 bp, Homo sapiens
tcctgaccattccttgtctcca

SEQ ID NO: 9158281 - DNA, 22 bp, Homo sapiens
tcctgaccacactgccttctgc

SEQ ID NO: 9158282 - DNA, 22 bp, Homo sapiens
tcctgaccacactgccttctgc

SEQ ID NO: 9158283 - DNA, 22 bp, Homo sapiens
tcctgaccactaggaccaggct

SEQ ID NO: 9158284 - DNA, 22 bp, Homo sapiens
ccacattcagtccaggcttgga

SEQ ID NO: 9158285 - DNA, 22 bp, Homo sapiens
ccacatggtcctcatttactct

SEQ ID NO: 9158286 - DNA, 20 bp, Homo sapiens
ccacatggaagtttgagacc

SEQ ID NO: 9158287 - DNA, 21 bp, Homo sapiens
ccagagagagggaagtgggtt

SEQ ID NO: 9158288 - DNA, 22 bp, Homo sapiens
ccagagagattgcttctaaaga

SEQ ID NO: 9158289 - DNA, 19 bp, Homo sapiens
ccagagagctaggtacaga

SEQ ID NO: 9158290 - DNA, 19 bp, Homo sapiens
ccagagagctaggtacaga

SEQ ID NO: 9158291 - DNA, 19 bp, Homo sapiens
ccagagagctaggtacaga

SEQ ID NO: 9158292 - DNA, 19 bp, Homo sapiens
ccagagagctaggtacaga

SEQ ID NO: 9158293 - DNA, 22 bp, Homo sapiens
ccagagagctacaaggcataaa

SEQ ID NO: 9158294 - DNA, 21 bp, Homo sapiens
tctccagagtgggaggaaatc

SEQ ID NO: 9158295 - DNA, 21 bp, Homo sapiens
tctccagagtgggaggaaatc

SEQ ID NO: 9158296 - DNA, 20 bp, Homo sapiens
tctccagatgcagatgacat

SEQ ID NO: 9158297 - DNA, 22 bp, Homo sapiens
tctccagaggtcccttgtctct

SEQ ID NO: 9158298 - DNA, 22 bp, Homo sapiens
tctccagaaatggggctgggga

SEQ ID NO: 9158299 - DNA, 22 bp, Homo sapiens
tctccactctgagtgcctttca

SEQ ID NO: 9158300 - DNA, 22 bp, Homo sapiens
tctccactctgagtgcctttca

SEQ ID NO: 9158301 - DNA, 22 bp, Homo sapiens
tctccaggaaagacactggact

SEQ ID NO: 9158302 - DNA, 22 bp, Homo sapiens
tctccaggaaagacactggact

SEQ ID NO: 9158303 - DNA, 22 bp, Homo sapiens
tctccaggaaccatcatggtaa

SEQ ID NO: 9158304 - DNA, 22 bp, Homo sapiens
tctccaggaaccatcatggtaa

SEQ ID NO: 9158305 - DNA, 22 bp, Homo sapiens
ccagagaggcaaaactccttcc

SEQ ID NO: 9158306 - DNA, 22 bp, Homo sapiens
ccagagaggcaaaactccttcc

SEQ ID NO: 9158307 - DNA, 22 bp, Homo sapiens
ccagagaggccttggcaagaca

SEQ ID NO: 9158308 - DNA, 22 bp, Homo sapiens
tctcccacagtctcccatggct

SEQ ID NO: 9158309 - DNA, 22 bp, Homo sapiens
tctcccacagtctcccatggct

SEQ ID NO: 9158310 - DNA, 22 bp, Homo sapiens
tctccctcattcctgcttccat

SEQ ID NO: 9158311 - DNA, 20 bp, Homo sapiens
tctccctgcccatctcagat

SEQ ID NO: 9158312 - DNA, 20 bp, Homo sapiens
tctccctgcccatctcagat

SEQ ID NO: 9158313 - DNA, 20 bp, Homo sapiens
tctccctgcccatctcagat

SEQ ID NO: 9158314 - DNA, 20 bp, Homo sapiens
tctccctgcccatctcagat

SEQ ID NO: 9158315 - DNA, 20 bp, Homo sapiens
tctccctgcccatctcagat

SEQ ID NO: 9158316 - DNA, 22 bp, Homo sapiens
tctccctggagccctgaagcat

SEQ ID NO: 9158317 - DNA, 22 bp, Homo sapiens
tctccctgtggaggacccctta

SEQ ID NO: 9158318 - DNA, 22 bp, Homo sapiens
tctccgtgccgtgggaggctcc

SEQ ID NO: 9158319 - DNA, 22 bp, Homo sapiens
tctccgatcacaggttttcaat

SEQ ID NO: 9158320 - DNA, 22 bp, Homo sapiens
tctccacactttctctcccagg

SEQ ID NO: 9158321 - DNA, 22 bp, Homo sapiens
tctccactattttctagctctt

SEQ ID NO: 9158322 - DNA, 22 bp, Homo sapiens
tctccacactttctctcccagg

SEQ ID NO: 9158323 - DNA, 22 bp, Homo sapiens
ccagaaaaatcctcccttgtcc

SEQ ID NO: 9158324 - DNA, 22 bp, Homo sapiens
tctccacaagctttctcctttt

SEQ ID NO: 9158325 - DNA, 22 bp, Homo sapiens
tctccacaagtgttgagagtac

SEQ ID NO: 9158326 - DNA, 19 bp, Homo sapiens
ccactttgcagatagtgag

SEQ ID NO: 9158327 - DNA, 22 bp, Homo sapiens
ccactttctgagggaacagcag

SEQ ID NO: 9158328 - DNA, 22 bp, Homo sapiens
ccacttgtgaaataatcaaata

SEQ ID NO: 9158329 - DNA, 22 bp, Homo sapiens
ccacttgacaataaactgagct

SEQ ID NO: 9158330 - DNA, 22 bp, Homo sapiens
ccacttttttctccatctctga

SEQ ID NO: 9158331 - DNA, 22 bp, Homo sapiens
ccacctcctaggcctggagaag

SEQ ID NO: 9158332 - DNA, 22 bp, Homo sapiens
tctatattccagatacagatta

SEQ ID NO: 9158333 - DNA, 23 bp, Homo sapiens
tctcaagaggaagcagggctcat

SEQ ID NO: 9158334 - DNA, 22 bp, Homo sapiens
tctcaacagtgcaagctgctcc

SEQ ID NO: 9158335 - DNA, 22 bp, Homo sapiens
tctcaagctactaccttggatc

SEQ ID NO: 9158336 - DNA, 22 bp, Homo sapiens
cattatattacagcactgttaa

SEQ ID NO: 9158337 - DNA, 22 bp, Homo sapiens
catgtttctgagaaaagtagga

SEQ ID NO: 9158338 - DNA, 22 bp, Homo sapiens
catgtttctgatgcagctttta

SEQ ID NO: 9158339 - DNA, 22 bp, Homo sapiens
cattatattttactgcatggga

SEQ ID NO: 9158340 - DNA, 22 bp, Homo sapiens
catgttgggcatgcatatgtgt

SEQ ID NO: 9158341 - DNA, 22 bp, Homo sapiens
catgttgtattctttggctggt

SEQ ID NO: 9158342 - DNA, 22 bp, Homo sapiens
catgttgtgaaggaaaatgggc

SEQ ID NO: 9158343 - DNA, 22 bp, Homo sapiens
catgttgtagtatcataatggt

SEQ ID NO: 9158344 - DNA, 22 bp, Homo sapiens
catgttaatgaatttttgcagt

SEQ ID NO: 9158345 - DNA, 22 bp, Homo sapiens
catgttcatcagatcaattgta

SEQ ID NO: 9158346 - DNA, 22 bp, Homo sapiens
catgttcagtgacagttattga

SEQ ID NO: 9158347 - DNA, 22 bp, Homo sapiens
cattcacaatggattgcttcaa

SEQ ID NO: 9158348 - DNA, 22 bp, Homo sapiens
cattcagagctttcttatcata

SEQ ID NO: 9158349 - DNA, 22 bp, Homo sapiens
cattcataggaggagatgatta

SEQ ID NO: 9158350 - DNA, 22 bp, Homo sapiens
cattcacagagggggaagcatc

SEQ ID NO: 9158351 - DNA, 22 bp, Homo sapiens
cattcacaaaaccacatgccat

SEQ ID NO: 9158352 - DNA, 22 bp, Homo sapiens
tcccagaggaaatggcagctga

SEQ ID NO: 9158353 - DNA, 22 bp, Homo sapiens
tcccagaggaaatggcagctga

SEQ ID NO: 9158354 - DNA, 22 bp, Homo sapiens
tcccagccacaggtgtagccct

SEQ ID NO: 9158355 - DNA, 22 bp, Homo sapiens
tcccagagctgataagccttta

SEQ ID NO: 9158356 - DNA, 22 bp, Homo sapiens
tcccagagctgataagccttta

SEQ ID NO: 9158357 - DNA, 22 bp, Homo sapiens
tcccagaggaaatggcagctga

SEQ ID NO: 9158358 - DNA, 22 bp, Homo sapiens
tcccagaggaaatggcagctga

SEQ ID NO: 9158359 - DNA, 22 bp, Homo sapiens
tcccagagctctgacaccagct

SEQ ID NO: 9158360 - DNA, 22 bp, Homo sapiens
tcccagagcctctgccactctg

SEQ ID NO: 9158361 - DNA, 22 bp, Homo sapiens
tcccagagctctgacaccagct

SEQ ID NO: 9158362 - DNA, 22 bp, Homo sapiens
tcccagagctctggaggttgga

SEQ ID NO: 9158363 - DNA, 22 bp, Homo sapiens
tcccagagctctggaggttgga

SEQ ID NO: 9158364 - DNA, 22 bp, Homo sapiens
tcccagagctctggaggttgga

SEQ ID NO: 9158365 - DNA, 22 bp, Homo sapiens
tcccagagcctctgccactctg

SEQ ID NO: 9158366 - DNA, 22 bp, Homo sapiens
tcccagagcccaagttggagag

SEQ ID NO: 9158367 - DNA, 22 bp, Homo sapiens
tcccagagcccaagttggagag

SEQ ID NO: 9158368 - DNA, 22 bp, Homo sapiens
tcccagagcccaagttggagag

SEQ ID NO: 9158369 - DNA, 22 bp, Homo sapiens
tcccagagcccaagttggagag

SEQ ID NO: 9158370 - DNA, 22 bp, Homo sapiens
tcccaggacaggccacatggaa

SEQ ID NO: 9158371 - DNA, 22 bp, Homo sapiens
tcccaggacatgggctctgctc

SEQ ID NO: 9158372 - DNA, 22 bp, Homo sapiens
tcccaggaatccgtcctctaga

SEQ ID NO: 9158373 - DNA, 22 bp, Homo sapiens
tcccagccattcctttaggtgt

SEQ ID NO: 9158374 - DNA, 22 bp, Homo sapiens
tcccagcccagacttctccagt

SEQ ID NO: 9158375 - DNA, 22 bp, Homo sapiens
tcccagcccagatttgtgtgac

SEQ ID NO: 9158376 - DNA, 22 bp, Homo sapiens
tcccagccacagtttccacctg

SEQ ID NO: 9158377 - DNA, 22 bp, Homo sapiens
tcccagccaggctctaccactt

SEQ ID NO: 9158378 - DNA, 22 bp, Homo sapiens
tccccagctctgtgcttccact

SEQ ID NO: 9158379 - DNA, 22 bp, Homo sapiens
tccccagccgtgaaggagagga

SEQ ID NO: 9158380 - DNA, 22 bp, Homo sapiens
tccccagccgtgaaggagagga

SEQ ID NO: 9158381 - DNA, 22 bp, Homo sapiens
tccccagcttgctacttctgct

SEQ ID NO: 9158382 - DNA, 19 bp, Homo sapiens
tccccagcacctctgagtc

SEQ ID NO: 9158383 - DNA, 22 bp, Homo sapiens
tccccagcattgagggtctctc

SEQ ID NO: 9158384 - DNA, 22 bp, Homo sapiens
tccctactgttagggactcagc

SEQ ID NO: 9158385 - DNA, 22 bp, Homo sapiens
tccctaggaccccaccttccgc

SEQ ID NO: 9158386 - DNA, 22 bp, Homo sapiens
tccctagcttatttgtgctcta

SEQ ID NO: 9158387 - DNA, 22 bp, Homo sapiens
tcccggcgctgggaggtgggtc

SEQ ID NO: 9158388 - DNA, 22 bp, Homo sapiens
tccccaggaaattctgattctt

SEQ ID NO: 9158389 - DNA, 22 bp, Homo sapiens
tcccggagcctgcactcctaac

SEQ ID NO: 9158390 - DNA, 19 bp, Homo sapiens
tccccagcacctctgagtc

SEQ ID NO: 9158391 - DNA, 22 bp, Homo sapiens
tccccagattcatgtctgctgt

SEQ ID NO: 9158392 - DNA, 22 bp, Homo sapiens
tccccagattcatgtctgctgt

SEQ ID NO: 9158393 - DNA, 22 bp, Homo sapiens
tccccagattcatgtctgctgt

SEQ ID NO: 9158394 - DNA, 22 bp, Homo sapiens
tccccagatggccagctacatg

SEQ ID NO: 9158395 - DNA, 22 bp, Homo sapiens
tccccagaggtgaggcagcttt

SEQ ID NO: 9158396 - DNA, 22 bp, Homo sapiens
tccccagaggtgaggcagcttt

SEQ ID NO: 9158397 - DNA, 22 bp, Homo sapiens
tccccagaggtgaggcagcttt

SEQ ID NO: 9158398 - DNA, 22 bp, Homo sapiens
tccccagacagcgggaggcctg

SEQ ID NO: 9158399 - DNA, 22 bp, Homo sapiens
tccccactgggcctcctctttc

SEQ ID NO: 9158400 - DNA, 22 bp, Homo sapiens
tcccaggaggtgcttcctagga

SEQ ID NO: 9158401 - DNA, 22 bp, Homo sapiens
cattgaaaaacgttgactgagt

SEQ ID NO: 9158402 - DNA, 22 bp, Homo sapiens
cattgaaaaacgttgactgagt

SEQ ID NO: 9158403 - DNA, 22 bp, Homo sapiens
cattgaaaatgttgcaggctgt

SEQ ID NO: 9158404 - DNA, 22 bp, Homo sapiens
cattgaaacctaacataggctg

SEQ ID NO: 9158405 - DNA, 22 bp, Homo sapiens
cattgaaacagatgtacccatg

SEQ ID NO: 9158406 - DNA, 22 bp, Homo sapiens
cattgaaaatgttgcaggctgt

SEQ ID NO: 9158407 - DNA, 22 bp, Homo sapiens
cattgaaaaacgttgactgagt

SEQ ID NO: 9158408 - DNA, 22 bp, Homo sapiens
cattgaaacagatgtacccatg

SEQ ID NO: 9158409 - DNA, 22 bp, Homo sapiens
cattgaaacctaacataggctg

SEQ ID NO: 9158410 - DNA, 22 bp, Homo sapiens
cattgaaagagataaagccttt

SEQ ID NO: 9158411 - DNA, 22 bp, Homo sapiens
cattgaaagagataaagccttt

SEQ ID NO: 9158412 - DNA, 22 bp, Homo sapiens
cattgaaatatggaaactgatg

SEQ ID NO: 9158413 - DNA, 22 bp, Homo sapiens
cattgaaatatggaaactgatg

SEQ ID NO: 9158414 - DNA, 22 bp, Homo sapiens
cattgagcgaccctgcatgact

SEQ ID NO: 9158415 - DNA, 22 bp, Homo sapiens
tcccagggtcctcttctggaat

SEQ ID NO: 9158416 - DNA, 22 bp, Homo sapiens
tcctagaaggatcattctagtg

SEQ ID NO: 9158417 - DNA, 22 bp, Homo sapiens
tcctcagcattagcacagacat

SEQ ID NO: 9158418 - DNA, 22 bp, Homo sapiens
tccctcactggttctgcatccc

SEQ ID NO: 9158419 - DNA, 22 bp, Homo sapiens
tccctagtagacccagatcatt

SEQ ID NO: 9158420 - DNA, 22 bp, Homo sapiens
tccctataattgcacatccatt

SEQ ID NO: 9158421 - DNA, 22 bp, Homo sapiens
tccctcacctagtctttgactc

SEQ ID NO: 9158422 - DNA, 22 bp, Homo sapiens
tcctcagcttttatttcacttg

SEQ ID NO: 9158423 - DNA, 18 bp, Homo sapiens
tcctcagcctcacctagc

SEQ ID NO: 9158424 - DNA, 22 bp, Homo sapiens
catttgtatgttcctccttagg

SEQ ID NO: 9158425 - DNA, 22 bp, Homo sapiens
tcctctccatattttctgattt

SEQ ID NO: 9158426 - DNA, 22 bp, Homo sapiens
catttgtatcatatgtatctta

SEQ ID NO: 9158427 - DNA, 22 bp, Homo sapiens
catttgtatagtgcttagacca

SEQ ID NO: 9158428 - DNA, 22 bp, Homo sapiens
catttgtagttaaaaatgtctc

SEQ ID NO: 9158429 - DNA, 22 bp, Homo sapiens
catttgtagttaaaaatgtctc

SEQ ID NO: 9158430 - DNA, 22 bp, Homo sapiens
catttgtaggatgcttcttgtt

SEQ ID NO: 9158431 - DNA, 22 bp, Homo sapiens
catttgtagagtaggaaagagt

SEQ ID NO: 9158432 - DNA, 22 bp, Homo sapiens
catttgtactgttcaatgtcat

SEQ ID NO: 9158433 - DNA, 22 bp, Homo sapiens
catttggtgttaggcatgttaa

SEQ ID NO: 9158434 - DNA, 22 bp, Homo sapiens
catttgtacagaacagctttat

SEQ ID NO: 9158435 - DNA, 22 bp, Homo sapiens
tcctcagggaagatgagcctca

SEQ ID NO: 9158436 - DNA, 22 bp, Homo sapiens
tcatttatttataccattgcct

SEQ ID NO: 9158437 - DNA, 22 bp, Homo sapiens
tcatttatttgactttggagtg

SEQ ID NO: 9158438 - DNA, 22 bp, Homo sapiens
tcatttatttgactttggagtg

SEQ ID NO: 9158439 - DNA, 22 bp, Homo sapiens
tccacaggtatttctccttgct

SEQ ID NO: 9158440 - DNA, 22 bp, Homo sapiens
tccacaggtatttctccttgct

SEQ ID NO: 9158441 - DNA, 22 bp, Homo sapiens
tccacaggtatgaggccccacc

SEQ ID NO: 9158442 - DNA, 22 bp, Homo sapiens
tccacagggcctttctggtgtg

SEQ ID NO: 9158443 - DNA, 22 bp, Homo sapiens
tccacaggtcctctttgcaaag

SEQ ID NO: 9158444 - DNA, 22 bp, Homo sapiens
tccacaggtcctctttgcaaag

SEQ ID NO: 9158445 - DNA, 22 bp, Homo sapiens
tccacaggtccggcatgaacag

SEQ ID NO: 9158446 - DNA, 22 bp, Homo sapiens
tccacaggtcagggagataggc

SEQ ID NO: 9158447 - DNA, 19 bp, Homo sapiens
tccacagtggttgaactag

SEQ ID NO: 9158448 - DNA, 22 bp, Homo sapiens
tccacatctctcgccaaccaat

SEQ ID NO: 9158449 - DNA, 22 bp, Homo sapiens
tccacatccattgcttgacttt

SEQ ID NO: 9158450 - DNA, 22 bp, Homo sapiens
tccacatcaagggcagagaggt

SEQ ID NO: 9158451 - DNA, 22 bp, Homo sapiens
tccagacattttatagcagtct

SEQ ID NO: 9158452 - DNA, 22 bp, Homo sapiens
tccagacattttatagcagtct

SEQ ID NO: 9158453 - DNA, 22 bp, Homo sapiens
tccacatgacttctaataactg

SEQ ID NO: 9158454 - DNA, 20 bp, Homo sapiens
tccacatcttttgagatgtg

SEQ ID NO: 9158455 - DNA, 21 bp, Homo sapiens
tcatttattgagaaatgactg

SEQ ID NO: 9158456 - DNA, 22 bp, Homo sapiens
tcatttatgtctttgccatcca

SEQ ID NO: 9158457 - DNA, 22 bp, Homo sapiens
tcatttatgcaggaatggcata

SEQ ID NO: 9158458 - DNA, 22 bp, Homo sapiens
tcatttatgcaggaatggcata

SEQ ID NO: 9158459 - DNA, 22 bp, Homo sapiens
tcatttatcatttgtgctgtag

SEQ ID NO: 9158460 - DNA, 22 bp, Homo sapiens
tcatttatcgctgccttttaaa

SEQ ID NO: 9158461 - DNA, 22 bp, Homo sapiens
tcattcttgatcactagttagt

SEQ ID NO: 9158462 - DNA, 22 bp, Homo sapiens
tcattctctgggatgcagtttg

SEQ ID NO: 9158463 - DNA, 22 bp, Homo sapiens
tcattctcctctggaaaaggca

SEQ ID NO: 9158464 - DNA, 22 bp, Homo sapiens
tcattctcacactcgtcaatgt

SEQ ID NO: 9158465 - DNA, 22 bp, Homo sapiens
tcattctcagactcttggcctc

SEQ ID NO: 9158466 - DNA, 22 bp, Homo sapiens
tcattcccccataatggtattt

SEQ ID NO: 9158467 - DNA, 22 bp, Homo sapiens
tcattccctcattgttcactgg

SEQ ID NO: 9158468 - DNA, 22 bp, Homo sapiens
tcatcatccttttttgaagagt

SEQ ID NO: 9158469 - DNA, 22 bp, Homo sapiens
tcatgaacatctcaaataacca

SEQ ID NO: 9158470 - DNA, 22 bp, Homo sapiens
tcatcagtttagaaaaaatatg

SEQ ID NO: 9158471 - DNA, 19 bp, Homo sapiens
tcatgacaaaacaggcgct

SEQ ID NO: 9158472 - DNA, 22 bp, Homo sapiens
tcatgacaactatattattcca

SEQ ID NO: 9158473 - DNA, 21 bp, Homo sapiens
tcatgaagcatcacttctgcc

SEQ ID NO: 9158474 - DNA, 22 bp, Homo sapiens
tcatgacagaagtggtcatatt

SEQ ID NO: 9158475 - DNA, 22 bp, Homo sapiens
tcatgacagccagagctctgac

SEQ ID NO: 9158476 - DNA, 22 bp, Homo sapiens
tcatgacagaggagctggaatg

SEQ ID NO: 9158477 - DNA, 22 bp, Homo sapiens
tcatgacactgggacaggagag

SEQ ID NO: 9158478 - DNA, 22 bp, Homo sapiens
tcatgacaatggtagcctgtta

SEQ ID NO: 9158479 - DNA, 22 bp, Homo sapiens
tcatgacaacttgcacagtttt

SEQ ID NO: 9158480 - DNA, 22 bp, Homo sapiens
tcatgacatggacatgattgta

SEQ ID NO: 9158481 - DNA, 22 bp, Homo sapiens
tcatgacatctgtttatctcaa

SEQ ID NO: 9158482 - DNA, 22 bp, Homo sapiens
tcatgacaggtgagtttttagg

SEQ ID NO: 9158483 - DNA, 22 bp, Homo sapiens
tcatgacataaacctgtggggt

SEQ ID NO: 9158484 - DNA, 22 bp, Homo sapiens
tcatgacatctgttaggtttat

SEQ ID NO: 9158485 - DNA, 22 bp, Homo sapiens
tcatgacattcaggtgctacat

SEQ ID NO: 9158486 - DNA, 18 bp, Homo sapiens
tcatgaggtagaggctgg

SEQ ID NO: 9158487 - DNA, 22 bp, Homo sapiens
tcatgacatgtgaattgaatat

SEQ ID NO: 9158488 - DNA, 22 bp, Homo sapiens
tcatgcaaactctagtccttta

SEQ ID NO: 9158489 - DNA, 22 bp, Homo sapiens
tcatgcaaagccaattccagct

SEQ ID NO: 9158490 - DNA, 22 bp, Homo sapiens
tcatgcaaagccaattccagct

SEQ ID NO: 9158491 - DNA, 22 bp, Homo sapiens
tcatgcaagcaggcactgggaa

SEQ ID NO: 9158492 - DNA, 22 bp, Homo sapiens
tcatgtcttctgtgatgtccaa

SEQ ID NO: 9158493 - DNA, 22 bp, Homo sapiens
tcatgtctgggagcagactcca

SEQ ID NO: 9158494 - DNA, 22 bp, Homo sapiens
catgaaaaatttactgttaaca

SEQ ID NO: 9158495 - DNA, 22 bp, Homo sapiens
catgaaaaatttactgttaaca

SEQ ID NO: 9158496 - DNA, 23 bp, Homo sapiens
tcattccacaaatacttatctag

SEQ ID NO: 9158497 - DNA, 19 bp, Homo sapiens
catctttggtcacctagtc

SEQ ID NO: 9158498 - DNA, 19 bp, Homo sapiens
catctttggtcacctagtc

SEQ ID NO: 9158499 - DNA, 22 bp, Homo sapiens
tcatgcaatgagtcaggaggca

SEQ ID NO: 9158500 - DNA, 22 bp, Homo sapiens
tcatgcaatgagtcaggaggca

SEQ ID NO: 9158501 - DNA, 22 bp, Homo sapiens
catctttggttttctatatgcc

SEQ ID NO: 9158502 - DNA, 22 bp, Homo sapiens
catctttgtaacttccacataa

SEQ ID NO: 9158503 - DNA, 22 bp, Homo sapiens
catcttttcagaagccattctg

SEQ ID NO: 9158504 - DNA, 22 bp, Homo sapiens
catcttttggcctattctgagg

SEQ ID NO: 9158505 - DNA, 22 bp, Homo sapiens
catctttgttttggatataatc

SEQ ID NO: 9158506 - DNA, 19 bp, Homo sapiens
tccagccctgttccctttt

SEQ ID NO: 9158507 - DNA, 22 bp, Homo sapiens
tccagccctgtgtctgggagag

SEQ ID NO: 9158508 - DNA, 19 bp, Homo sapiens
tccagccctgttccctttt

SEQ ID NO: 9158509 - DNA, 22 bp, Homo sapiens
tccagccctgtggcttccaccc

SEQ ID NO: 9158510 - DNA, 22 bp, Homo sapiens
tccagccctgtggcttccaccc

SEQ ID NO: 9158511 - DNA, 22 bp, Homo sapiens
tccagcccagctgtccccttca

SEQ ID NO: 9158512 - DNA, 22 bp, Homo sapiens
tccagcccagctcctctcagaa

SEQ ID NO: 9158513 - DNA, 22 bp, Homo sapiens
tccagcccagctgtccccttca

SEQ ID NO: 9158514 - DNA, 22 bp, Homo sapiens
tccagagaggcatatttacaag

SEQ ID NO: 9158515 - DNA, 22 bp, Homo sapiens
tccagagagaaaaacaagcttt

SEQ ID NO: 9158516 - DNA, 22 bp, Homo sapiens
tccagagacttgcatgtgcttg

SEQ ID NO: 9158517 - DNA, 22 bp, Homo sapiens
tccagagacttgcatgtgcttg

SEQ ID NO: 9158518 - DNA, 22 bp, Homo sapiens
tccagagaattctacgcagtgc

SEQ ID NO: 9158519 - DNA, 22 bp, Homo sapiens
tccagagacttgcatgtgcttg

SEQ ID NO: 9158520 - DNA, 22 bp, Homo sapiens
tccagagaacgatgaaagctgg

SEQ ID NO: 9158521 - DNA, 22 bp, Homo sapiens
tccagagaacgatgaaagctgg

SEQ ID NO: 9158522 - DNA, 19 bp, Homo sapiens
tccagactgtccaggctat

SEQ ID NO: 9158523 - DNA, 22 bp, Homo sapiens
tccagactctgtcacttcctag

SEQ ID NO: 9158524 - DNA, 22 bp, Homo sapiens
tccagctgccaaccgggccccg

SEQ ID NO: 9158525 - DNA, 22 bp, Homo sapiens
tccagctgcaaggggcacagct

SEQ ID NO: 9158526 - DNA, 21 bp, Homo sapiens
tccagctgcacaagcatgggg

SEQ ID NO: 9158527 - DNA, 21 bp, Homo sapiens
tccagctgcacaagcatgggg

SEQ ID NO: 9158528 - DNA, 21 bp, Homo sapiens
tccagctgcacaagcatgggg

SEQ ID NO: 9158529 - DNA, 22 bp, Homo sapiens
tccagctgaggtggcctctgtg

SEQ ID NO: 9158530 - DNA, 22 bp, Homo sapiens
tccagctgaggtggcctctgtg

SEQ ID NO: 9158531 - DNA, 22 bp, Homo sapiens
tccagctgacatctcctgaggg

SEQ ID NO: 9158532 - DNA, 22 bp, Homo sapiens
tccagctcttgttgcccactgc

SEQ ID NO: 9158533 - DNA, 22 bp, Homo sapiens
tccagctgacacttaaggggag

SEQ ID NO: 9158534 - DNA, 17 bp, Homo sapiens
tccagcctcctctgctg

SEQ ID NO: 9158535 - DNA, 22 bp, Homo sapiens
tccagctggcctaacttcaggg

SEQ ID NO: 9158536 - DNA, 22 bp, Homo sapiens
tccagctggcctaacttcaggg

SEQ ID NO: 9158537 - DNA, 22 bp, Homo sapiens
tccagctggcttcggaagtgga

SEQ ID NO: 9158538 - DNA, 20 bp, Homo sapiens
tccaggcagctcagagtgtc

SEQ ID NO: 9158539 - DNA, 20 bp, Homo sapiens
tccaggcagctcagagtgtc

SEQ ID NO: 9158540 - DNA, 22 bp, Homo sapiens
tccaggcccatggagcagagct

SEQ ID NO: 9158541 - DNA, 22 bp, Homo sapiens
tccaggccccactgaagcccct

SEQ ID NO: 9158542 - DNA, 22 bp, Homo sapiens
tccaggcccatagacacttctc

SEQ ID NO: 9158543 - DNA, 22 bp, Homo sapiens
tccaggccccagaccgtactgc

SEQ ID NO: 9158544 - DNA, 22 bp, Homo sapiens
tccaggccccactgaagcccct

SEQ ID NO: 9158545 - DNA, 22 bp, Homo sapiens
tccaggccccagcaccttggga

SEQ ID NO: 9158546 - DNA, 22 bp, Homo sapiens
tccaggcccctgcctgggcctg

SEQ ID NO: 9158547 - DNA, 22 bp, Homo sapiens
tccaggcccctgcctgggcctg

SEQ ID NO: 9158548 - DNA, 22 bp, Homo sapiens
tccaggcccgagatgggctgga

SEQ ID NO: 9158549 - DNA, 22 bp, Homo sapiens
tccaggctcagtcaagcacttc

SEQ ID NO: 9158550 - DNA, 22 bp, Homo sapiens
tccaggctccctcaggatgcac

SEQ ID NO: 9158551 - DNA, 20 bp, Homo sapiens
tccaggctcctccacttagt

SEQ ID NO: 9158552 - DNA, 22 bp, Homo sapiens
tccaggctcccctgcgtgctcc

SEQ ID NO: 9158553 - DNA, 22 bp, Homo sapiens
tccaggctcccctgcgtgctcc

SEQ ID NO: 9158554 - DNA, 19 bp, Homo sapiens
tccaggctccattggcaga

SEQ ID NO: 9158555 - DNA, 22 bp, Homo sapiens
tccaggctcccctgcgtgctcc

SEQ ID NO: 9158556 - DNA, 22 bp, Homo sapiens
tccaggctcccctgcgtgctcc

SEQ ID NO: 9158557 - DNA, 18 bp, Homo sapiens
tccaggctccaggctaac

SEQ ID NO: 9158558 - DNA, 22 bp, Homo sapiens
catgtgttgtctcatttaatcc

SEQ ID NO: 9158559 - DNA, 23 bp, Homo sapiens
catgtgtgtgtgaagaaggcgac

SEQ ID NO: 9158560 - DNA, 22 bp, Homo sapiens
catgttaaattgagtttgcaat

SEQ ID NO: 9158561 - DNA, 22 bp, Homo sapiens
catgttaaaatatacattctga

SEQ ID NO: 9158562 - DNA, 22 bp, Homo sapiens
catgttaaaatatacattctga

SEQ ID NO: 9158563 - DNA, 22 bp, Homo sapiens
catgtgtgtggacgagcgtggc

SEQ ID NO: 9158564 - DNA, 22 bp, Homo sapiens
catgtgtgtccatgtgactaag

SEQ ID NO: 9158565 - DNA, 22 bp, Homo sapiens
ttggaaatgcatttgttattat

SEQ ID NO: 9158566 - DNA, 22 bp, Homo sapiens
ttggaaatgtagaaaagcagat

SEQ ID NO: 9158567 - DNA, 22 bp, Homo sapiens
ttggaaatacagcagttacttt

SEQ ID NO: 9158568 - DNA, 22 bp, Homo sapiens
ttggaaatacgagtagtatcat

SEQ ID NO: 9158569 - DNA, 22 bp, Homo sapiens
ttggaaatgcaaatatattgaa

SEQ ID NO: 9158570 - DNA, 22 bp, Homo sapiens
ttggaatttgcttcagctaata

SEQ ID NO: 9158571 - DNA, 22 bp, Homo sapiens
ttggaattgaggatttacatag

SEQ ID NO: 9158572 - DNA, 22 bp, Homo sapiens
ttggaacacagcagctgatttt

SEQ ID NO: 9158573 - DNA, 22 bp, Homo sapiens
ttggaacacaatgtttctttca

SEQ ID NO: 9158574 - DNA, 22 bp, Homo sapiens
ttggaattggacatgttgaagg

SEQ ID NO: 9158575 - DNA, 22 bp, Homo sapiens
ttggaattgctattgataacaa

SEQ ID NO: 9158576 - DNA, 22 bp, Homo sapiens
ttggaattgctcataagagaga

SEQ ID NO: 9158577 - DNA, 22 bp, Homo sapiens
ttggaatttcatgtaagtgact

SEQ ID NO: 9158578 - DNA, 22 bp, Homo sapiens
ttggaaacgtcaccttttcctt

SEQ ID NO: 9158579 - DNA, 22 bp, Homo sapiens
ttggaaactttcaagcataatg

SEQ ID NO: 9158580 - DNA, 22 bp, Homo sapiens
ttgctttattgggtttactgcc

SEQ ID NO: 9158581 - DNA, 22 bp, Homo sapiens
ttgctttatttggcatgccact

SEQ ID NO: 9158582 - DNA, 23 bp, Homo sapiens
ttgctttcatcatgagatgctcc

SEQ ID NO: 9158583 - DNA, 22 bp, Homo sapiens
ttgcttcactgagttatgcctg

SEQ ID NO: 9158584 - DNA, 22 bp, Homo sapiens
ttgcttcagaagttctgcttgt

SEQ ID NO: 9158585 - DNA, 22 bp, Homo sapiens
ttgcttcaccccaccttgttgc

SEQ ID NO: 9158586 - DNA, 23 bp, Homo sapiens
ttggaaacctgttttagctgttt

SEQ ID NO: 9158587 - DNA, 22 bp, Homo sapiens
ttggaaaatgtatttctagaag

SEQ ID NO: 9158588 - DNA, 22 bp, Homo sapiens
ttgcttatagagagtttcatac

SEQ ID NO: 9158589 - DNA, 21 bp, Homo sapiens
ttgcttatggcactgctttgc

SEQ ID NO: 9158590 - DNA, 21 bp, Homo sapiens
ttgcttatggcactgctttgc

SEQ ID NO: 9158591 - DNA, 22 bp, Homo sapiens
ttgcttatgcctcttgacaaag

SEQ ID NO: 9158592 - DNA, 22 bp, Homo sapiens
ttgcttatagagagtttcatac

SEQ ID NO: 9158593 - DNA, 22 bp, Homo sapiens
ttgctgtttctctgtgtctggt

SEQ ID NO: 9158594 - DNA, 22 bp, Homo sapiens
ttgctgtttaatgatgtcttat

SEQ ID NO: 9158595 - DNA, 22 bp, Homo sapiens
ttgctgtttaatgatgtcttat

SEQ ID NO: 9158596 - DNA, 22 bp, Homo sapiens
ttgctgaattgaatcctttggt

SEQ ID NO: 9158597 - DNA, 22 bp, Homo sapiens
ttgctgaattgaatcctttggt

SEQ ID NO: 9158598 - DNA, 22 bp, Homo sapiens
ttgctgtgaaaccatgggaagt

SEQ ID NO: 9158599 - DNA, 22 bp, Homo sapiens
ttgctgtgtaactcctggcctg

SEQ ID NO: 9158600 - DNA, 22 bp, Homo sapiens
ttgctgtgtcatttgtttaatc

SEQ ID NO: 9158601 - DNA, 22 bp, Homo sapiens
ttgctgtgtctgatggctgaga

SEQ ID NO: 9158602 - DNA, 20 bp, Homo sapiens
ttgctgttgccaagattttg

SEQ ID NO: 9158603 - DNA, 22 bp, Homo sapiens
ttgctgttacaattatttaccc

SEQ ID NO: 9158604 - DNA, 22 bp, Homo sapiens
ttgctgaagtatgaaaaagaca

SEQ ID NO: 9158605 - DNA, 22 bp, Homo sapiens
ttgctgaagtattgtgaatcct

SEQ ID NO: 9158606 - DNA, 22 bp, Homo sapiens
ttgctgaagtattgtgaatcct

SEQ ID NO: 9158607 - DNA, 19 bp, Homo sapiens
ttgctgaaggaagcctctg

SEQ ID NO: 9158608 - DNA, 22 bp, Homo sapiens
ttgctgaaggcctcttggggtt

SEQ ID NO: 9158609 - DNA, 22 bp, Homo sapiens
ttgctgaagtatgaaaaagaca

SEQ ID NO: 9158610 - DNA, 22 bp, Homo sapiens
ttgctgaaccctgccctctaat

SEQ ID NO: 9158611 - DNA, 22 bp, Homo sapiens
ttgctgaagaaaaaatatgtta

SEQ ID NO: 9158612 - DNA, 22 bp, Homo sapiens
ttgctgaagctgccaaaccagt

SEQ ID NO: 9158613 - DNA, 22 bp, Homo sapiens
ttgctgaagctgccaaaccagt

SEQ ID NO: 9158614 - DNA, 19 bp, Homo sapiens
ttgctgaaggaagcctctg

SEQ ID NO: 9158615 - DNA, 22 bp, Homo sapiens
ttgctgaaggcctcttggggtt

SEQ ID NO: 9158616 - DNA, 22 bp, Homo sapiens
ttgctgaagttgctcagctcca

SEQ ID NO: 9158617 - DNA, 22 bp, Homo sapiens
ttgctgaagttgctcagctcca

SEQ ID NO: 9158618 - DNA, 22 bp, Homo sapiens
ttgctgaatgcaagttggatag

SEQ ID NO: 9158619 - DNA, 22 bp, Homo sapiens
ttgctgaatgcaagttggatag

SEQ ID NO: 9158620 - DNA, 22 bp, Homo sapiens
ttgctgaagtgaaggtatgttt

SEQ ID NO: 9158621 - DNA, 22 bp, Homo sapiens
ttgctgaagttaatgcttgcaa

SEQ ID NO: 9158622 - DNA, 22 bp, Homo sapiens
ttgctgaagttaatgcttgcaa

SEQ ID NO: 9158623 - DNA, 22 bp, Homo sapiens
ttgctgaagtgaaggtatgttt

SEQ ID NO: 9158624 - DNA, 22 bp, Homo sapiens
ttgctgaaaggtagctgtgtgg

SEQ ID NO: 9158625 - DNA, 22 bp, Homo sapiens
ttgctgaaaggtagctgtgtgg

SEQ ID NO: 9158626 - DNA, 22 bp, Homo sapiens
ttgctgaaagtggcaagaagta

SEQ ID NO: 9158627 - DNA, 22 bp, Homo sapiens
ttgctgaaagtggcaagaagta

SEQ ID NO: 9158628 - DNA, 22 bp, Homo sapiens
ttgctgaagaaaaaatatgtta

SEQ ID NO: 9158629 - DNA, 22 bp, Homo sapiens
ttgctgaaccctgccctctaat

SEQ ID NO: 9158630 - DNA, 22 bp, Homo sapiens
ttgctgaaatctatgacatcct

SEQ ID NO: 9158631 - DNA, 22 bp, Homo sapiens
ttgctgaaatctatgacatcct

SEQ ID NO: 9158632 - DNA, 22 bp, Homo sapiens
ttgctgaaaacagtgggtattg

SEQ ID NO: 9158633 - DNA, 22 bp, Homo sapiens
ttgctgaaaacagtgggtattg

SEQ ID NO: 9158634 - DNA, 22 bp, Homo sapiens
ttgctgaaaagctggcctttgt

SEQ ID NO: 9158635 - DNA, 22 bp, Homo sapiens
ttgctgaaaagctggcctttgt

SEQ ID NO: 9158636 - DNA, 22 bp, Homo sapiens
ttgctgaaaacaggtcatcagg

SEQ ID NO: 9158637 - DNA, 22 bp, Homo sapiens
ttgctgaaaacaggtcatcagg

SEQ ID NO: 9158638 - DNA, 22 bp, Homo sapiens
ttgctcttgaaaattgatgctg

SEQ ID NO: 9158639 - DNA, 22 bp, Homo sapiens
ttgcatttaagtagatgttaca

SEQ ID NO: 9158640 - DNA, 22 bp, Homo sapiens
ttgcattgaatgcacattttta

SEQ ID NO: 9158641 - DNA, 23 bp, Homo sapiens
ttgcattaatgtggaggcacagg

SEQ ID NO: 9158642 - DNA, 22 bp, Homo sapiens
ttgctcatatttgcatgtgttt

SEQ ID NO: 9158643 - DNA, 22 bp, Homo sapiens
ttgctctcagaggaggaggccg

SEQ ID NO: 9158644 - DNA, 22 bp, Homo sapiens
ttgctctccagaggctcacagc

SEQ ID NO: 9158645 - DNA, 18 bp, Homo sapiens
ttgctcttctatgtcaat

SEQ ID NO: 9158646 - DNA, 22 bp, Homo sapiens
ttgctctgtccagccagcaggt

SEQ ID NO: 9158647 - DNA, 22 bp, Homo sapiens
ttgctctgaacccagggcacca

SEQ ID NO: 9158648 - DNA, 22 bp, Homo sapiens
ttgctctgattaggtggaaaca

SEQ ID NO: 9158649 - DNA, 22 bp, Homo sapiens
ttgacaaagatatattcatgct

SEQ ID NO: 9158650 - DNA, 22 bp, Homo sapiens
ttgacaaaggctgagaggaaaa

SEQ ID NO: 9158651 - DNA, 22 bp, Homo sapiens
ttgacaaaggctgagaggaaaa

SEQ ID NO: 9158652 - DNA, 22 bp, Homo sapiens
ttgacaaaggctgagaggaaaa

SEQ ID NO: 9158653 - DNA, 22 bp, Homo sapiens
ttgacaaaaataacacagcata

SEQ ID NO: 9158654 - DNA, 22 bp, Homo sapiens
ttgacaaaaacctcatttcacc

SEQ ID NO: 9158655 - DNA, 22 bp, Homo sapiens
ttgacaatgcactgtgctaagt

SEQ ID NO: 9158656 - DNA, 22 bp, Homo sapiens
ttgacacaatgtatattttcaa

SEQ ID NO: 9158657 - DNA, 22 bp, Homo sapiens
ttgacacaaacagtgatgtagt

SEQ ID NO: 9158658 - DNA, 22 bp, Homo sapiens
ttgacacaatcatggcagacat

SEQ ID NO: 9158659 - DNA, 22 bp, Homo sapiens
ttgacacagatcaatattcaac

SEQ ID NO: 9158660 - DNA, 22 bp, Homo sapiens
ttgcaattgctatggagagcgt

SEQ ID NO: 9158661 - DNA, 22 bp, Homo sapiens
ttgcaattgctatggagagcgt

SEQ ID NO: 9158662 - DNA, 22 bp, Homo sapiens
ttgcaattgctatggagagcgt

SEQ ID NO: 9158663 - DNA, 22 bp, Homo sapiens
ttgacacagtcaacttgatttt

SEQ ID NO: 9158664 - DNA, 22 bp, Homo sapiens
ttgacacagttttctcattaag

SEQ ID NO: 9158665 - DNA, 22 bp, Homo sapiens
ttgacacattagagcttgtaaa

SEQ ID NO: 9158666 - DNA, 22 bp, Homo sapiens
ttgcagagaggttaggaactca

SEQ ID NO: 9158667 - DNA, 22 bp, Homo sapiens
ttgcagagtggttgtgaggatt

SEQ ID NO: 9158668 - DNA, 22 bp, Homo sapiens
ttgcagagtggttgtgaggatt

SEQ ID NO: 9158669 - DNA, 22 bp, Homo sapiens
ttgcagagtggttgtgaggatt

SEQ ID NO: 9158670 - DNA, 22 bp, Homo sapiens
ttgcagagccatgaggctggct

SEQ ID NO: 9158671 - DNA, 22 bp, Homo sapiens
ttgcagaggcaaaaatgaactc

SEQ ID NO: 9158672 - DNA, 22 bp, Homo sapiens
ttgcagaggcaaaaatgaactc

SEQ ID NO: 9158673 - DNA, 22 bp, Homo sapiens
ttgcagagaggttaggaactca

SEQ ID NO: 9158674 - DNA, 22 bp, Homo sapiens
ttgcagagaggttaggaactca

SEQ ID NO: 9158675 - DNA, 22 bp, Homo sapiens
ttgcagagatcagcaggtttga

SEQ ID NO: 9158676 - DNA, 22 bp, Homo sapiens
ttgcagagcagtaggaatatag

SEQ ID NO: 9158677 - DNA, 22 bp, Homo sapiens
ttgcagagcagtaggaatatag

SEQ ID NO: 9158678 - DNA, 22 bp, Homo sapiens
ttgcagagccatgaggctggct

SEQ ID NO: 9158679 - DNA, 22 bp, Homo sapiens
ttgcagcttcaagcaggttgac

SEQ ID NO: 9158680 - DNA, 22 bp, Homo sapiens
ttgcagctgttgcaaagtctct

SEQ ID NO: 9158681 - DNA, 22 bp, Homo sapiens
ttgcagcttagtgatgttatct

SEQ ID NO: 9158682 - DNA, 22 bp, Homo sapiens
ttgcagctgcagtaaatgttca

SEQ ID NO: 9158683 - DNA, 22 bp, Homo sapiens
ttgcagctgtgagctttacacg

SEQ ID NO: 9158684 - DNA, 22 bp, Homo sapiens
ttgcagctgaggaaattgaagc

SEQ ID NO: 9158685 - DNA, 22 bp, Homo sapiens
ttgcagggaaatcagtgaggat

SEQ ID NO: 9158686 - DNA, 22 bp, Homo sapiens
ttgcagggataaaacaagtgaa

SEQ ID NO: 9158687 - DNA, 22 bp, Homo sapiens
ttgcagcttctaccactgtttc

SEQ ID NO: 9158688 - DNA, 22 bp, Homo sapiens
ttgcagcttcttgcatcagaaa

SEQ ID NO: 9158689 - DNA, 22 bp, Homo sapiens
ttgcaggaaactgagtgtgagc

SEQ ID NO: 9158690 - DNA, 22 bp, Homo sapiens
ttgcaggaaactgagtgtgagc

SEQ ID NO: 9158691 - DNA, 22 bp, Homo sapiens
ttgcagggaaatagaaataaac

SEQ ID NO: 9158692 - DNA, 22 bp, Homo sapiens
ttgcaggaagcacaagtctgag

SEQ ID NO: 9158693 - DNA, 22 bp, Homo sapiens
ttgcaggaagcacaagtctgag

SEQ ID NO: 9158694 - DNA, 22 bp, Homo sapiens
ttgcaggacaatgatggtccct

SEQ ID NO: 9158695 - DNA, 22 bp, Homo sapiens
ttgcaggacaatgatggtccct

SEQ ID NO: 9158696 - DNA, 22 bp, Homo sapiens
ttgcaggattttagagatgaca

SEQ ID NO: 9158697 - DNA, 22 bp, Homo sapiens
ttgcaggattttagagatgaca

SEQ ID NO: 9158698 - DNA, 22 bp, Homo sapiens
ttgcaggggaaggagcagagct

SEQ ID NO: 9158699 - DNA, 22 bp, Homo sapiens
ttgcaggggaaggagcagagct

SEQ ID NO: 9158700 - DNA, 22 bp, Homo sapiens
ttgcagggtcccagaggcctgg

SEQ ID NO: 9158701 - DNA, 22 bp, Homo sapiens
ttgcagggctggaacatggaat

SEQ ID NO: 9158702 - DNA, 22 bp, Homo sapiens
ttgcatgtacgtacagagagag

SEQ ID NO: 9158703 - DNA, 22 bp, Homo sapiens
ttgcagggttgaccaataggct

SEQ ID NO: 9158704 - DNA, 22 bp, Homo sapiens
ttggccagtggaaagaggagga

SEQ ID NO: 9158705 - DNA, 22 bp, Homo sapiens
ttggccagtggaaagaggagga

SEQ ID NO: 9158706 - DNA, 22 bp, Homo sapiens
ttggccagcagctctggcttag

SEQ ID NO: 9158707 - DNA, 22 bp, Homo sapiens
ttggcataccttagtggtggag

SEQ ID NO: 9158708 - DNA, 22 bp, Homo sapiens
ttggcataccttagtggtggag

SEQ ID NO: 9158709 - DNA, 22 bp, Homo sapiens
ttggcataccttagtggtggag

SEQ ID NO: 9158710 - DNA, 22 bp, Homo sapiens
ttgggacagcactgctacccct

SEQ ID NO: 9158711 - DNA, 22 bp, Homo sapiens
ttgggacagcaaccatctgcta

SEQ ID NO: 9158712 - DNA, 22 bp, Homo sapiens
ttgggacagcaacggttctgtt

SEQ ID NO: 9158713 - DNA, 22 bp, Homo sapiens
ttgggacagagctggggctgga

SEQ ID NO: 9158714 - DNA, 22 bp, Homo sapiens
ttgggacagaaaaggagaagat

SEQ ID NO: 9158715 - DNA, 20 bp, Homo sapiens
ttgggacacttgctttgcta

SEQ ID NO: 9158716 - DNA, 22 bp, Homo sapiens
ttgggacaagagatagctctga

SEQ ID NO: 9158717 - DNA, 22 bp, Homo sapiens
ttgggacaaagactccttgaat

SEQ ID NO: 9158718 - DNA, 22 bp, Homo sapiens
ttgggacagaaaaggagaagat

SEQ ID NO: 9158719 - DNA, 22 bp, Homo sapiens
ttgggaagtaatatggtggtct

SEQ ID NO: 9158720 - DNA, 22 bp, Homo sapiens
ttgggaagtttaatgacagact

SEQ ID NO: 9158721 - DNA, 22 bp, Homo sapiens
ttgggaaggcgtggaagcagaa

SEQ ID NO: 9158722 - DNA, 22 bp, Homo sapiens
ttgggaagaggcccctggattc

SEQ ID NO: 9158723 - DNA, 22 bp, Homo sapiens
ttgggaagaatggaggtggtta

SEQ ID NO: 9158724 - DNA, 22 bp, Homo sapiens
ttgggacatgtaagctggaagt

SEQ ID NO: 9158725 - DNA, 22 bp, Homo sapiens
ttgggacatgtaagctggaagt

SEQ ID NO: 9158726 - DNA, 22 bp, Homo sapiens
ttgggacattatcagtctgcag

SEQ ID NO: 9158727 - DNA, 22 bp, Homo sapiens
ttgggacatctggcatacagtt

SEQ ID NO: 9158728 - DNA, 22 bp, Homo sapiens
ttgggacagctgtggtagtgag

SEQ ID NO: 9158729 - DNA, 22 bp, Homo sapiens
ttgggagaaatagttgatccgc

SEQ ID NO: 9158730 - DNA, 22 bp, Homo sapiens
ttgggagaaggctgggacttta

SEQ ID NO: 9158731 - DNA, 22 bp, Homo sapiens
ttgggagacaaaggctctgtct

SEQ ID NO: 9158732 - DNA, 22 bp, Homo sapiens
ttgggagattcattgagccaag

SEQ ID NO: 9158733 - DNA, 22 bp, Homo sapiens
ttgggagatattgttctttaca

SEQ ID NO: 9158734 - DNA, 22 bp, Homo sapiens
ttgggagatattgttctttaca

SEQ ID NO: 9158735 - DNA, 22 bp, Homo sapiens
ttgggagagtttacatcctttt

SEQ ID NO: 9158736 - DNA, 22 bp, Homo sapiens
ttgggagatagggtaatttagc

SEQ ID NO: 9158737 - DNA, 22 bp, Homo sapiens
ttgggccaaggcagatctccaa

SEQ ID NO: 9158738 - DNA, 22 bp, Homo sapiens
ttgggccaaatagctatttact

SEQ ID NO: 9158739 - DNA, 22 bp, Homo sapiens
ttgggccaaagatgtccttgtt

SEQ ID NO: 9158740 - DNA, 22 bp, Homo sapiens
ttgggccaaagatgtccttgtt

SEQ ID NO: 9158741 - DNA, 22 bp, Homo sapiens
ttgggccactttagtttcctta

SEQ ID NO: 9158742 - DNA, 22 bp, Homo sapiens
ttgggccactttagtttcctta

SEQ ID NO: 9158743 - DNA, 22 bp, Homo sapiens
ttgggccaaggcagatctccaa

SEQ ID NO: 9158744 - DNA, 20 bp, Homo sapiens
ttgggccacactgattcagc

SEQ ID NO: 9158745 - DNA, 22 bp, Homo sapiens
ttgggcagtctggctgcagagt

SEQ ID NO: 9158746 - DNA, 22 bp, Homo sapiens
ttggaccaaggtctgctctttc

SEQ ID NO: 9158747 - DNA, 18 bp, Homo sapiens
ttggacctgtgtcagggc

SEQ ID NO: 9158748 - DNA, 22 bp, Homo sapiens
ttggacggtggaggcaacttgg

SEQ ID NO: 9158749 - DNA, 22 bp, Homo sapiens
ttggaccattgacctgatctac

SEQ ID NO: 9158750 - DNA, 22 bp, Homo sapiens
ttggaccatggtagggaacttg

SEQ ID NO: 9158751 - DNA, 21 bp, Homo sapiens
ttggaccatacaagttatgca

SEQ ID NO: 9158752 - DNA, 22 bp, Homo sapiens
ttggagagaggctgctcaggct

SEQ ID NO: 9158753 - DNA, 22 bp, Homo sapiens
ttggagagttaattgacagtta

SEQ ID NO: 9158754 - DNA, 23 bp, Homo sapiens
ttggagagggtgagtagtgtcag

SEQ ID NO: 9158755 - DNA, 22 bp, Homo sapiens
ttggcagggcatcagacacgtg

SEQ ID NO: 9158756 - DNA, 22 bp, Homo sapiens
ttggcaggatgatagctttgtg

SEQ ID NO: 9158757 - DNA, 22 bp, Homo sapiens
ttggcaggaggcttcagttcct

SEQ ID NO: 9158758 - DNA, 22 bp, Homo sapiens
ttggcaggaatattgcagaggt

SEQ ID NO: 9158759 - DNA, 22 bp, Homo sapiens
ttggcagggctgcttgtctagg

SEQ ID NO: 9158760 - DNA, 22 bp, Homo sapiens
ttggcagtaaaagaaaatgctt

SEQ ID NO: 9158761 - DNA, 22 bp, Homo sapiens
ttggcagggcatcagacacgtg

SEQ ID NO: 9158762 - DNA, 22 bp, Homo sapiens
ttggcagtgtctgcaaaatgga

SEQ ID NO: 9158763 - DNA, 22 bp, Homo sapiens
ttggcagtgatgcagcttgttc

SEQ ID NO: 9158764 - DNA, 22 bp, Homo sapiens
ttggcagcattccagccaagca

SEQ ID NO: 9158765 - DNA, 22 bp, Homo sapiens
ttggcagctacttccccagtgc

SEQ ID NO: 9158766 - DNA, 22 bp, Homo sapiens
ttggcagctgcacagactccat

SEQ ID NO: 9158767 - DNA, 22 bp, Homo sapiens
ttgtgtctgggggagtgacatc

SEQ ID NO: 9158768 - DNA, 22 bp, Homo sapiens
ttgtgtcctgatttgacacaat

SEQ ID NO: 9158769 - DNA, 21 bp, Homo sapiens
ttgtgtccttctaaagggcca

SEQ ID NO: 9158770 - DNA, 22 bp, Homo sapiens
ttgtgtcctctaatctcaccac

SEQ ID NO: 9158771 - DNA, 22 bp, Homo sapiens
ttgtgtcctatatgcatgttct

SEQ ID NO: 9158772 - DNA, 22 bp, Homo sapiens
ttgtgtcctaagcaccagatgg

SEQ ID NO: 9158773 - DNA, 22 bp, Homo sapiens
ttgtgtccctgcggctgaggag

SEQ ID NO: 9158774 - DNA, 22 bp, Homo sapiens
ttgtgtccctggagcttctgtg

SEQ ID NO: 9158775 - DNA, 22 bp, Homo sapiens
ttgtgtccctgtaagacaaagc

SEQ ID NO: 9158776 - DNA, 22 bp, Homo sapiens
ttgtgtcctaacatctagttaa

SEQ ID NO: 9158777 - DNA, 22 bp, Homo sapiens
ttgtgtcccctgttctacctgt

SEQ ID NO: 9158778 - DNA, 22 bp, Homo sapiens
ttgtgtccccctttgagagcca

SEQ ID NO: 9158779 - DNA, 22 bp, Homo sapiens
ttgtggcagaccatgagtctaa

SEQ ID NO: 9158780 - DNA, 22 bp, Homo sapiens
ttgtggctcatcttcagctccc

SEQ ID NO: 9158781 - DNA, 22 bp, Homo sapiens
ttgtggctcgtgagatgttagg

SEQ ID NO: 9158782 - DNA, 22 bp, Homo sapiens
ttgtggctgtgcaccgctgcct

SEQ ID NO: 9158783 - DNA, 22 bp, Homo sapiens
ttgtggctgtcgagaattgagg

SEQ ID NO: 9158784 - DNA, 22 bp, Homo sapiens
ttgtggctcttgaggctctcgt

SEQ ID NO: 9158785 - DNA, 22 bp, Homo sapiens
ttgtgtccaaggctatggtgat

SEQ ID NO: 9158786 - DNA, 22 bp, Homo sapiens
ttgtgtccatttgagtcatgtg

SEQ ID NO: 9158787 - DNA, 22 bp, Homo sapiens
ttgtgtattttttgatactaac

SEQ ID NO: 9158788 - DNA, 22 bp, Homo sapiens
ttgtggcttctacgcccacagg

SEQ ID NO: 9158789 - DNA, 22 bp, Homo sapiens
ttgtcaccctaaccaaacaccc

SEQ ID NO: 9158790 - DNA, 22 bp, Homo sapiens
ttgtcaagtaaggctgacattt

SEQ ID NO: 9158791 - DNA, 22 bp, Homo sapiens
ttgtcaaggcttttaatattct

SEQ ID NO: 9158792 - DNA, 22 bp, Homo sapiens
ttgtcaagtaaggctgacattt

SEQ ID NO: 9158793 - DNA, 22 bp, Homo sapiens
ttgtcaagattgagagatgact

SEQ ID NO: 9158794 - DNA, 22 bp, Homo sapiens
ttgtcaagaaaaatggatgaag

SEQ ID NO: 9158795 - DNA, 22 bp, Homo sapiens
ttgtattttttcctggcggtgg

SEQ ID NO: 9158796 - DNA, 22 bp, Homo sapiens
ttgtccagaaaaaagccaaggg

SEQ ID NO: 9158797 - DNA, 22 bp, Homo sapiens
ttgtcctggaggttaatagagt

SEQ ID NO: 9158798 - DNA, 22 bp, Homo sapiens
ttgtcctggcccaaatgtcaac

SEQ ID NO: 9158799 - DNA, 22 bp, Homo sapiens
ttgtcctgcaacctcacatggc

SEQ ID NO: 9158800 - DNA, 22 bp, Homo sapiens
ttgtccagagccaggctgtcgg

SEQ ID NO: 9158801 - DNA, 19 bp, Homo sapiens
ttgtccagaaaggcattgc

SEQ ID NO: 9158802 - DNA, 22 bp, Homo sapiens
ttgtccagaacatcggggttgc

SEQ ID NO: 9158803 - DNA, 22 bp, Homo sapiens
ttgtccagcgaccaggctctgt

SEQ ID NO: 9158804 - DNA, 22 bp, Homo sapiens
ttgtccagcagctcagtctacg

SEQ ID NO: 9158805 - DNA, 23 bp, Homo sapiens
ttgtccagctggtttgggccaca

SEQ ID NO: 9158806 - DNA, 23 bp, Homo sapiens
ttgtccagctggtttgggccaca

SEQ ID NO: 9158807 - DNA, 22 bp, Homo sapiens
ttgtccagtttctagaggcctc

SEQ ID NO: 9158808 - DNA, 22 bp, Homo sapiens
ttgtaacatcaccatcaaaatc

SEQ ID NO: 9158809 - DNA, 22 bp, Homo sapiens
ttgtaagaatatgaatacaaat

SEQ ID NO: 9158810 - DNA, 22 bp, Homo sapiens
ttgtaagactgtagaatgcaaa

SEQ ID NO: 9158811 - DNA, 22 bp, Homo sapiens
ttgtaacaggtactaaataact

SEQ ID NO: 9158812 - DNA, 22 bp, Homo sapiens
ttgtaacaggtactaaataact

SEQ ID NO: 9158813 - DNA, 22 bp, Homo sapiens
ttgtaacagctgcttaatagag

SEQ ID NO: 9158814 - DNA, 22 bp, Homo sapiens
ttgtaacaatctgtcataaatg

SEQ ID NO: 9158815 - DNA, 22 bp, Homo sapiens
ttgtaaagctgattagaaagcc

SEQ ID NO: 9158816 - DNA, 21 bp, Homo sapiens
ttgtaaaggtttagaagaatg

SEQ ID NO: 9158817 - DNA, 22 bp, Homo sapiens
ttgtaaatagtagtaagatgcc

SEQ ID NO: 9158818 - DNA, 22 bp, Homo sapiens
ttgtaaactgctgcaggagtgc

SEQ ID NO: 9158819 - DNA, 22 bp, Homo sapiens
ttgggcctctcaaagtgctggg

SEQ ID NO: 9158820 - DNA, 22 bp, Homo sapiens
ttgggcctgatcggaataagga

SEQ ID NO: 9158821 - DNA, 22 bp, Homo sapiens
ttgggccctgctctgagttgct

SEQ ID NO: 9158822 - DNA, 22 bp, Homo sapiens
ttgtacaagttttgagcttaag

SEQ ID NO: 9158823 - DNA, 22 bp, Homo sapiens
ttgtaagtcacaccagggcagg

SEQ ID NO: 9158824 - DNA, 22 bp, Homo sapiens
ttgtacaagtattatgtgaaca

SEQ ID NO: 9158825 - DNA, 22 bp, Homo sapiens
ttgtaagatggataggaacagc

SEQ ID NO: 9158826 - DNA, 22 bp, Homo sapiens
ttgtaaggaatgcagaatctca

SEQ ID NO: 9158827 - DNA, 22 bp, Homo sapiens
ttgtacaatggatgccagatga

SEQ ID NO: 9158828 - DNA, 22 bp, Homo sapiens
ttgtacacaattcttaacatac

SEQ ID NO: 9158829 - DNA, 22 bp, Homo sapiens
ttgtacacaattcttaacatac

SEQ ID NO: 9158830 - DNA, 21 bp, Homo sapiens
ttgtacacccacagatcagcc

SEQ ID NO: 9158831 - DNA, 22 bp, Homo sapiens
ttgtactatcaccatgtcatgt

SEQ ID NO: 9158832 - DNA, 22 bp, Homo sapiens
ttgtacattctgaatctgtcct

SEQ ID NO: 9158833 - DNA, 22 bp, Homo sapiens
ttgtacattctgaatctgtcct

SEQ ID NO: 9158834 - DNA, 22 bp, Homo sapiens
ttgtatttcgatgcacgtgtag

SEQ ID NO: 9158835 - DNA, 22 bp, Homo sapiens
ttgtatttcgatgcacgtgtag

SEQ ID NO: 9158836 - DNA, 22 bp, Homo sapiens
ttgtatttcctataacctttct

SEQ ID NO: 9158837 - DNA, 22 bp, Homo sapiens
ttgtatttcgatgcacgtgtag

SEQ ID NO: 9158838 - DNA, 23 bp, Homo sapiens
ttgtatttttagtagagacaggg

SEQ ID NO: 9158839 - DNA, 23 bp, Homo sapiens
ttgtatttttagtagagacaggg

SEQ ID NO: 9158840 - DNA, 22 bp, Homo sapiens
ttgtattttttcctggcggtgg

SEQ ID NO: 9158841 - DNA, 22 bp, Homo sapiens
tttagataatgctcaagcaatt

SEQ ID NO: 9158842 - DNA, 22 bp, Homo sapiens
tttagcaaaaaagctctgcgta

SEQ ID NO: 9158843 - DNA, 22 bp, Homo sapiens
tttagcaaggagaaataatcct

SEQ ID NO: 9158844 - DNA, 22 bp, Homo sapiens
tttagcaaggtaggtccatgga

SEQ ID NO: 9158845 - DNA, 21 bp, Homo sapiens
tttagcaagagtatagtgcat

SEQ ID NO: 9158846 - DNA, 22 bp, Homo sapiens
tttagcaagattgagccgtctt

SEQ ID NO: 9158847 - DNA, 22 bp, Homo sapiens
tttagcaaaggtagggttcaga

SEQ ID NO: 9158848 - DNA, 22 bp, Homo sapiens
tttagattgtgacctcccccca

SEQ ID NO: 9158849 - DNA, 22 bp, Homo sapiens
tttagcaaattagcacctctaa

SEQ ID NO: 9158850 - DNA, 22 bp, Homo sapiens
tttagcaaatatttctgttgat

SEQ ID NO: 9158851 - DNA, 22 bp, Homo sapiens
tttagcaaaggtgtcttgggca

SEQ ID NO: 9158852 - DNA, 22 bp, Homo sapiens
tttagagagaaataaatgagat

SEQ ID NO: 9158853 - DNA, 22 bp, Homo sapiens
tttagagaggctctgtaaaatg

SEQ ID NO: 9158854 - DNA, 22 bp, Homo sapiens
tttagagagcactgtagacact

SEQ ID NO: 9158855 - DNA, 17 bp, Homo sapiens
tttagaatacaatgttt

SEQ ID NO: 9158856 - DNA, 21 bp, Homo sapiens
tttagagaatactcactattt

SEQ ID NO: 9158857 - DNA, 22 bp, Homo sapiens
tttagagaattagaacagtact

SEQ ID NO: 9158858 - DNA, 22 bp, Homo sapiens
tttagagacacactggcatttg

SEQ ID NO: 9158859 - DNA, 22 bp, Homo sapiens
tttagagctgtgctgccacatg

SEQ ID NO: 9158860 - DNA, 22 bp, Homo sapiens
tttagagcccatgtgagtgtga

SEQ ID NO: 9158861 - DNA, 22 bp, Homo sapiens
tttagagcagggtgtggcacat

SEQ ID NO: 9158862 - DNA, 22 bp, Homo sapiens
tttagagagtgtaaaaatatat

SEQ ID NO: 9158863 - DNA, 20 bp, Homo sapiens
tttacattttgaaacagtga

SEQ ID NO: 9158864 - DNA, 20 bp, Homo sapiens
tttacattttgaaacagtga

SEQ ID NO: 9158865 - DNA, 20 bp, Homo sapiens
tttacattttgaaacagtga

SEQ ID NO: 9158866 - DNA, 20 bp, Homo sapiens
tttacattttgaaacagtga

SEQ ID NO: 9158867 - DNA, 22 bp, Homo sapiens
tttacagtgagagcttagtgag

SEQ ID NO: 9158868 - DNA, 22 bp, Homo sapiens
tttacatttccctctgtcagtt

SEQ ID NO: 9158869 - DNA, 22 bp, Homo sapiens
tttacatttccctctgtcagtt

SEQ ID NO: 9158870 - DNA, 22 bp, Homo sapiens
tttacagtctgtctagcaatgt

SEQ ID NO: 9158871 - DNA, 22 bp, Homo sapiens
tttaccaagctttaattacata

SEQ ID NO: 9158872 - DNA, 22 bp, Homo sapiens
tttagaagttcacacatttaaa

SEQ ID NO: 9158873 - DNA, 22 bp, Homo sapiens
tttagaagggctggtcagaaat

SEQ ID NO: 9158874 - DNA, 22 bp, Homo sapiens
tttagaagacagatgcacagcc

SEQ ID NO: 9158875 - DNA, 22 bp, Homo sapiens
tttaccactgcttgcaggaagt

SEQ ID NO: 9158876 - DNA, 22 bp, Homo sapiens
tttagcaagtatttactgacta

SEQ ID NO: 9158877 - DNA, 22 bp, Homo sapiens
tttagcaatatcataaggaaga

SEQ ID NO: 9158878 - DNA, 22 bp, Homo sapiens
tttagcaatttctaaaagtgtt

SEQ ID NO: 9158879 - DNA, 22 bp, Homo sapiens
tttagcacagaactccactcac

SEQ ID NO: 9158880 - DNA, 22 bp, Homo sapiens
tttagcactgaaagtccaggaa

SEQ ID NO: 9158881 - DNA, 16 bp, Homo sapiens
tttagcactggcatac

SEQ ID NO: 9158882 - DNA, 20 bp, Homo sapiens
tttagcacattgtacaaaac

SEQ ID NO: 9158883 - DNA, 22 bp, Homo sapiens
tttagcaccttcactttctctg

SEQ ID NO: 9158884 - DNA, 22 bp, Homo sapiens
tttagcacggtaacacataaag

SEQ ID NO: 9158885 - DNA, 23 bp, Homo sapiens
tttagcacgtcgcccagggaggc

SEQ ID NO: 9158886 - DNA, 22 bp, Homo sapiens
tttagcactaatcagctgtggc

SEQ ID NO: 9158887 - DNA, 22 bp, Homo sapiens
tttatattgggagtcgttttga

SEQ ID NO: 9158888 - DNA, 22 bp, Homo sapiens
tttatattgggagtcgttttga

SEQ ID NO: 9158889 - DNA, 22 bp, Homo sapiens
tttatattgggagtcgttttga

SEQ ID NO: 9158890 - DNA, 22 bp, Homo sapiens
tttatattgggagtcgttttga

SEQ ID NO: 9158891 - DNA, 22 bp, Homo sapiens
tttatattgtaaaaatggttct

SEQ ID NO: 9158892 - DNA, 22 bp, Homo sapiens
tttatattgtaaaaatggttct

SEQ ID NO: 9158893 - DNA, 22 bp, Homo sapiens
tttatatttcccaggattggcc

SEQ ID NO: 9158894 - DNA, 22 bp, Homo sapiens
tttatccatcatctgctgaagg

SEQ ID NO: 9158895 - DNA, 22 bp, Homo sapiens
tttattattctgttctctctac

SEQ ID NO: 9158896 - DNA, 21 bp, Homo sapiens
tttatcatcacgagcttgagc

SEQ ID NO: 9158897 - DNA, 22 bp, Homo sapiens
tttatcatcttgtttttaaagc

SEQ ID NO: 9158898 - DNA, 22 bp, Homo sapiens
tttatcagaagttagagaaaga

SEQ ID NO: 9158899 - DNA, 22 bp, Homo sapiens
tttatcacagaataagaagtca

SEQ ID NO: 9158900 - DNA, 22 bp, Homo sapiens
tttaaagaaattcctcatcttt

SEQ ID NO: 9158901 - DNA, 22 bp, Homo sapiens
tttaaagaaattcctcatcttt

SEQ ID NO: 9158902 - DNA, 22 bp, Homo sapiens
tttaaacctcctgattcagcta

SEQ ID NO: 9158903 - DNA, 22 bp, Homo sapiens
tttaaacctatctaagaaatag

SEQ ID NO: 9158904 - DNA, 17 bp, Homo sapiens
tttaaactactacaagg

SEQ ID NO: 9158905 - DNA, 22 bp, Homo sapiens
tttaaacatcttgttgccttaa

SEQ ID NO: 9158906 - DNA, 22 bp, Homo sapiens
tttaaatggcattttcccagat

SEQ ID NO: 9158907 - DNA, 22 bp, Homo sapiens
tttaaatggcattttcccagat

SEQ ID NO: 9158908 - DNA, 22 bp, Homo sapiens
tttaaatgtgttcttagtagct

SEQ ID NO: 9158909 - DNA, 22 bp, Homo sapiens
tttaaatgtttatagagagtac

SEQ ID NO: 9158910 - DNA, 22 bp, Homo sapiens
tttaaatgtttatagagagtac

SEQ ID NO: 9158911 - DNA, 22 bp, Homo sapiens
tttaaatgttcatgatactgaa

SEQ ID NO: 9158912 - DNA, 22 bp, Homo sapiens
tttaaatgtttaaaactcgtga

SEQ ID NO: 9158913 - DNA, 22 bp, Homo sapiens
tttaaatgtttaaaactcgtga

SEQ ID NO: 9158914 - DNA, 22 bp, Homo sapiens
tttaaatgtttaaaactcgtga

SEQ ID NO: 9158915 - DNA, 22 bp, Homo sapiens
tttaaagtttttgcacattctg

SEQ ID NO: 9158916 - DNA, 22 bp, Homo sapiens
tttaaagtggtccatttcagaa

SEQ ID NO: 9158917 - DNA, 22 bp, Homo sapiens
tttaaagtggtccatttcagaa

SEQ ID NO: 9158918 - DNA, 22 bp, Homo sapiens
tttaaagtgctgctcctatcct

SEQ ID NO: 9158919 - DNA, 19 bp, Homo sapiens
tttaaagtgactggtattt

SEQ ID NO: 9158920 - DNA, 22 bp, Homo sapiens
tttaaatgcagacgttgattca

SEQ ID NO: 9158921 - DNA, 22 bp, Homo sapiens
tttaaatgctttaagcaagggt

SEQ ID NO: 9158922 - DNA, 22 bp, Homo sapiens
tttaaatgcagacgttgattca

SEQ ID NO: 9158923 - DNA, 22 bp, Homo sapiens
tttaaataggactcctgggggt

SEQ ID NO: 9158924 - DNA, 22 bp, Homo sapiens
tttaaataggactcctgggggt

SEQ ID NO: 9158925 - DNA, 22 bp, Homo sapiens
tttaaggcttcactggagtggg

SEQ ID NO: 9158926 - DNA, 22 bp, Homo sapiens
tttaaggcaatatagaattcat

SEQ ID NO: 9158927 - DNA, 22 bp, Homo sapiens
tttaaggcagtgaaactattct

SEQ ID NO: 9158928 - DNA, 22 bp, Homo sapiens
tttaatcttcaaaatagtctta

SEQ ID NO: 9158929 - DNA, 22 bp, Homo sapiens
tttaatcttcaaaatagtctta

SEQ ID NO: 9158930 - DNA, 22 bp, Homo sapiens
tttaatctattccctaaacacc

SEQ ID NO: 9158931 - DNA, 22 bp, Homo sapiens
tttaagcacagggataaagtta

SEQ ID NO: 9158932 - DNA, 22 bp, Homo sapiens
tttaagattcagtaaggcaaac

SEQ ID NO: 9158933 - DNA, 22 bp, Homo sapiens
tttaagatggtattttataaag

SEQ ID NO: 9158934 - DNA, 22 bp, Homo sapiens
tttacagtctgtctagcaatgt

SEQ ID NO: 9158935 - DNA, 22 bp, Homo sapiens
tttacagtctctatagtcaaaa

SEQ ID NO: 9158936 - DNA, 22 bp, Homo sapiens
tttacagtctctatagtcaaaa

SEQ ID NO: 9158937 - DNA, 22 bp, Homo sapiens
tttacagtctctatagtcaaaa

SEQ ID NO: 9158938 - DNA, 22 bp, Homo sapiens
tttacagtctctatagtcaaaa

SEQ ID NO: 9158939 - DNA, 22 bp, Homo sapiens
tttacagtcaccaaactttgct

SEQ ID NO: 9158940 - DNA, 22 bp, Homo sapiens
tttaatgtgagtccctttcaag

SEQ ID NO: 9158941 - DNA, 22 bp, Homo sapiens
tttaatgtgacatcttttagag

SEQ ID NO: 9158942 - DNA, 23 bp, Homo sapiens
tttaatgaccaatagaaggaaca

SEQ ID NO: 9158943 - DNA, 22 bp, Homo sapiens
tttaatgggatccatctggtta

SEQ ID NO: 9158944 - DNA, 22 bp, Homo sapiens
tttaatgtagcgtgaaatgatt

SEQ ID NO: 9158945 - DNA, 22 bp, Homo sapiens
tttccccaggtagatagataat

SEQ ID NO: 9158946 - DNA, 22 bp, Homo sapiens
tttcccatggcagaagccctgt

SEQ ID NO: 9158947 - DNA, 22 bp, Homo sapiens
tttcccagttccctgctctata

SEQ ID NO: 9158948 - DNA, 22 bp, Homo sapiens
tttcccatccatagccctgcaa

SEQ ID NO: 9158949 - DNA, 19 bp, Homo sapiens
tttcccagtcccaggagtg

SEQ ID NO: 9158950 - DNA, 22 bp, Homo sapiens
tttcccagttagtgaagacatg

SEQ ID NO: 9158951 - DNA, 22 bp, Homo sapiens
tttcccaggccctcagggctgc

SEQ ID NO: 9158952 - DNA, 22 bp, Homo sapiens
tttcccaggctggaatgcagtg

SEQ ID NO: 9158953 - DNA, 19 bp, Homo sapiens
tttcccagcccttgctgtg

SEQ ID NO: 9158954 - DNA, 21 bp, Homo sapiens
tttcccagcagagatagctgg

SEQ ID NO: 9158955 - DNA, 22 bp, Homo sapiens
tttcattgagaatataagattt

SEQ ID NO: 9158956 - DNA, 22 bp, Homo sapiens
tttcattgacagttgggggaaa

SEQ ID NO: 9158957 - DNA, 22 bp, Homo sapiens
tttcattgaactaaagaatctg

SEQ ID NO: 9158958 - DNA, 21 bp, Homo sapiens
tttcattgaatgagataaggt

SEQ ID NO: 9158959 - DNA, 22 bp, Homo sapiens
tttcattgaactaaagaatctg

SEQ ID NO: 9158960 - DNA, 22 bp, Homo sapiens
tttcattattcatgctagttat

SEQ ID NO: 9158961 - DNA, 22 bp, Homo sapiens
tttcattcagcaccctgaggtg

SEQ ID NO: 9158962 - DNA, 22 bp, Homo sapiens
tttcattatacagcttcataaa

SEQ ID NO: 9158963 - DNA, 22 bp, Homo sapiens
tttcatgtgcaattagcaatat

SEQ ID NO: 9158964 - DNA, 22 bp, Homo sapiens
tttcatgtgttgaatgtgtaca

SEQ ID NO: 9158965 - DNA, 22 bp, Homo sapiens
tttcatgttacagtgtaaaagt

SEQ ID NO: 9158966 - DNA, 22 bp, Homo sapiens
tttcatgtctgaattctttagt

SEQ ID NO: 9158967 - DNA, 22 bp, Homo sapiens
tttcatgtctgaattctttagt

SEQ ID NO: 9158968 - DNA, 22 bp, Homo sapiens
tttcatgtacttttttgataga

SEQ ID NO: 9158969 - DNA, 22 bp, Homo sapiens
tttcatgtacttttttgataga

SEQ ID NO: 9158970 - DNA, 22 bp, Homo sapiens
tttcatgtatttcccaaagctt

SEQ ID NO: 9158971 - DNA, 22 bp, Homo sapiens
tttcatcttccttggcataggt

SEQ ID NO: 9158972 - DNA, 22 bp, Homo sapiens
tttcagagctctaggctctcag

SEQ ID NO: 9158973 - DNA, 22 bp, Homo sapiens
tttcatcttgattctatatggc

SEQ ID NO: 9158974 - DNA, 22 bp, Homo sapiens
tttcatgtaatcatttaggtgg

SEQ ID NO: 9158975 - DNA, 22 bp, Homo sapiens
tttcatgcctggaattgccctt

SEQ ID NO: 9158976 - DNA, 22 bp, Homo sapiens
tttcatgcctgtggtgcagtgt

SEQ ID NO: 9158977 - DNA, 22 bp, Homo sapiens
tttcactggaattttaacattt

SEQ ID NO: 9158978 - DNA, 20 bp, Homo sapiens
tttcactggcttgataaggt

SEQ ID NO: 9158979 - DNA, 20 bp, Homo sapiens
tttcactggcttgataaggt

SEQ ID NO: 9158980 - DNA, 22 bp, Homo sapiens
tttcactgggcttgcagaaatc

SEQ ID NO: 9158981 - DNA, 22 bp, Homo sapiens
tttcacattttatacttaagcc

SEQ ID NO: 9158982 - DNA, 22 bp, Homo sapiens
tttcacatttgttttaagaagt

SEQ ID NO: 9158983 - DNA, 22 bp, Homo sapiens
tttcacatttgttttaagaagt

SEQ ID NO: 9158984 - DNA, 22 bp, Homo sapiens
tttcacagcttccacttaagga

SEQ ID NO: 9158985 - DNA, 18 bp, Homo sapiens
tttcacagattcatgact

SEQ ID NO: 9158986 - DNA, 22 bp, Homo sapiens
tttcacagcagaatttctgagg

SEQ ID NO: 9158987 - DNA, 22 bp, Homo sapiens
tttcacagctgatacctcttcc

SEQ ID NO: 9158988 - DNA, 22 bp, Homo sapiens
tttcacagctgggtggcagagt

SEQ ID NO: 9158989 - DNA, 22 bp, Homo sapiens
tttcagaaatcaaaaccagggt

SEQ ID NO: 9158990 - DNA, 22 bp, Homo sapiens
tttcagaaatggcactgaaatc

SEQ ID NO: 9158991 - DNA, 22 bp, Homo sapiens
tttcagaaatggcactgaaatc

SEQ ID NO: 9158992 - DNA, 22 bp, Homo sapiens
tttcagaaacgattatgaacac

SEQ ID NO: 9158993 - DNA, 22 bp, Homo sapiens
tttcagaaaacttatcatcagt

SEQ ID NO: 9158994 - DNA, 22 bp, Homo sapiens
tttcagaaagctgaacatatga

SEQ ID NO: 9158995 - DNA, 22 bp, Homo sapiens
tttcagagaggcttcaaatctt

SEQ ID NO: 9158996 - DNA, 22 bp, Homo sapiens
tttcagagatgcagaattcagg

SEQ ID NO: 9158997 - DNA, 22 bp, Homo sapiens
tttcagagaattagaagctgat

SEQ ID NO: 9158998 - DNA, 22 bp, Homo sapiens
tttcagagatgcagaattcagg

SEQ ID NO: 9158999 - DNA, 22 bp, Homo sapiens
tttcagagcctttatctctcta

SEQ ID NO: 9159000 - DNA, 19 bp, Homo sapiens
tttcagactcatctccagc

SEQ ID NO: 9159001 - DNA, 22 bp, Homo sapiens
tttcagagaactgagtccttgc

SEQ ID NO: 9159002 - DNA, 22 bp, Homo sapiens
tttcagacaggacttcatatgt

SEQ ID NO: 9159003 - DNA, 22 bp, Homo sapiens
tttcaagactcattgagtattg

SEQ ID NO: 9159004 - DNA, 22 bp, Homo sapiens
tttcaagagggaactgaacaca

SEQ ID NO: 9159005 - DNA, 22 bp, Homo sapiens
tttcaacttgtttgcttccata

SEQ ID NO: 9159006 - DNA, 22 bp, Homo sapiens
tttcaagaacaacattcattca

SEQ ID NO: 9159007 - DNA, 22 bp, Homo sapiens
tttcaagaacaacattcattca

SEQ ID NO: 9159008 - DNA, 22 bp, Homo sapiens
tttcaagaacagcagcattcca

SEQ ID NO: 9159009 - DNA, 22 bp, Homo sapiens
tttcaagaagcaaattaaagtc

SEQ ID NO: 9159010 - DNA, 17 bp, Homo sapiens
tttcaacatcactcagc

SEQ ID NO: 9159011 - DNA, 22 bp, Homo sapiens
tttcaacatcacctagcagttc

SEQ ID NO: 9159012 - DNA, 22 bp, Homo sapiens
tttcaacatataccataatgcc

SEQ ID NO: 9159013 - DNA, 22 bp, Homo sapiens
tttcaacatataccataatgcc

SEQ ID NO: 9159014 - DNA, 22 bp, Homo sapiens
tttcaacatataccataatgcc

SEQ ID NO: 9159015 - DNA, 22 bp, Homo sapiens
tttcaacatacctcagtgtatg

SEQ ID NO: 9159016 - DNA, 22 bp, Homo sapiens
tttcaacagggcacaggtgcca

SEQ ID NO: 9159017 - DNA, 22 bp, Homo sapiens
tttcaacaggatgataataggc

SEQ ID NO: 9159018 - DNA, 22 bp, Homo sapiens
tttcaacaggatgataataggc

SEQ ID NO: 9159019 - DNA, 22 bp, Homo sapiens
tttcaacaggatgataataggc

SEQ ID NO: 9159020 - DNA, 22 bp, Homo sapiens
tttcaacaggatgataataggc

SEQ ID NO: 9159021 - DNA, 22 bp, Homo sapiens
tttcaacagctctcaaatgatc

SEQ ID NO: 9159022 - DNA, 22 bp, Homo sapiens
tttcaacagctctcaaatgatc

SEQ ID NO: 9159023 - DNA, 23 bp, Homo sapiens
tttcacaatgagcattacagaat

SEQ ID NO: 9159024 - DNA, 23 bp, Homo sapiens
tttcacaatgagcattacagaat

SEQ ID NO: 9159025 - DNA, 22 bp, Homo sapiens
tttcacacgcatctgtctgccc

SEQ ID NO: 9159026 - DNA, 22 bp, Homo sapiens
tttcacactagtcagaatacca

SEQ ID NO: 9159027 - DNA, 22 bp, Homo sapiens
tttcacacgcatctgtctgccc

SEQ ID NO: 9159028 - DNA, 22 bp, Homo sapiens
tttcacacccactaggactgtt

SEQ ID NO: 9159029 - DNA, 22 bp, Homo sapiens
tttcacacccactaggactgtt

SEQ ID NO: 9159030 - DNA, 22 bp, Homo sapiens
tttcacactagtcagaatacca

SEQ ID NO: 9159031 - DNA, 22 bp, Homo sapiens
tttcacactgcagcatcagaga

SEQ ID NO: 9159032 - DNA, 22 bp, Homo sapiens
tttcacaattttaaggagcaaa

SEQ ID NO: 9159033 - DNA, 22 bp, Homo sapiens
tttcacagagaaatataacagg

SEQ ID NO: 9159034 - DNA, 22 bp, Homo sapiens
tttcacagatcctacagcttgt

SEQ ID NO: 9159035 - DNA, 22 bp, Homo sapiens
tttcacagaaaggataacatta

SEQ ID NO: 9159036 - DNA, 22 bp, Homo sapiens
tttcacacttgatttgcagtta

SEQ ID NO: 9159037 - DNA, 22 bp, Homo sapiens
tttcacactgcagcatcagaga

SEQ ID NO: 9159038 - DNA, 22 bp, Homo sapiens
tttcacagaaagacaacagata

SEQ ID NO: 9159039 - DNA, 20 bp, Homo sapiens
tttcaacaatttcccttcca

SEQ ID NO: 9159040 - DNA, 22 bp, Homo sapiens
tttcaacaccagagaccatgcg

SEQ ID NO: 9159041 - DNA, 22 bp, Homo sapiens
tttcaacagaatatgatcagag

SEQ ID NO: 9159042 - DNA, 22 bp, Homo sapiens
tttcaacagaatatgatcagag

SEQ ID NO: 9159043 - DNA, 22 bp, Homo sapiens
tttcaacagatctgtcttcagg

SEQ ID NO: 9159044 - DNA, 22 bp, Homo sapiens
tttcaacagctctcaaatgatc

SEQ ID NO: 9159045 - DNA, 23 bp, Homo sapiens
tttcaacaatgcttagagaaaac

SEQ ID NO: 9159046 - DNA, 23 bp, Homo sapiens
tttcaacaatgcttagagaaaac

SEQ ID NO: 9159047 - DNA, 23 bp, Homo sapiens
tttcaacaatgcttagagaaaac

SEQ ID NO: 9159048 - DNA, 23 bp, Homo sapiens
tttcaacaatgcttagagaaaac

SEQ ID NO: 9159049 - DNA, 22 bp, Homo sapiens
tttcaaagggaagttatgaagt

SEQ ID NO: 9159050 - DNA, 22 bp, Homo sapiens
tttattgagtatctactatgtg

SEQ ID NO: 9159051 - DNA, 22 bp, Homo sapiens
tttattgacccaaagcgagagt

SEQ ID NO: 9159052 - DNA, 22 bp, Homo sapiens
tttattgacccaaagcgagagt

SEQ ID NO: 9159053 - DNA, 22 bp, Homo sapiens
tttattgaattgtaaccctatt

SEQ ID NO: 9159054 - DNA, 22 bp, Homo sapiens
tttattcaagatgaggttcatg

SEQ ID NO: 9159055 - DNA, 20 bp, Homo sapiens
tttattcacagagaagagtt

SEQ ID NO: 9159056 - DNA, 20 bp, Homo sapiens
tttattcacagagaagagtt

SEQ ID NO: 9159057 - DNA, 20 bp, Homo sapiens
tttattcacagagaagagtt

SEQ ID NO: 9159058 - DNA, 22 bp, Homo sapiens
tttattctagctcagaatagtt

SEQ ID NO: 9159059 - DNA, 22 bp, Homo sapiens
tttattctagctcagaatagtt

SEQ ID NO: 9159060 - DNA, 22 bp, Homo sapiens
tttattctataggcattaagca

SEQ ID NO: 9159061 - DNA, 22 bp, Homo sapiens
tttattctagctcagaatagtt

SEQ ID NO: 9159062 - DNA, 22 bp, Homo sapiens
tttattctataggcattaagca

SEQ ID NO: 9159063 - DNA, 21 bp, Homo sapiens
tttattctcagatacagggag

SEQ ID NO: 9159064 - DNA, 22 bp, Homo sapiens
tttattctataggcattaagca

SEQ ID NO: 9159065 - DNA, 22 bp, Homo sapiens
tttattgaattgtaaccctatt

SEQ ID NO: 9159066 - DNA, 22 bp, Homo sapiens
tttattcttgagagtgagaaga

SEQ ID NO: 9159067 - DNA, 22 bp, Homo sapiens
tttattctgtgctacatgaaga

SEQ ID NO: 9159068 - DNA, 22 bp, Homo sapiens
tttattctgtgctacatgaaga

SEQ ID NO: 9159069 - DNA, 22 bp, Homo sapiens
tttattctctagttggtcagat

SEQ ID NO: 9159070 - DNA, 23 bp, Homo sapiens
tttattctcagatacataggtct

SEQ ID NO: 9159071 - DNA, 22 bp, Homo sapiens
ttcatttattcagcaggtattt

SEQ ID NO: 9159072 - DNA, 22 bp, Homo sapiens
ttcatttattcagcaggtattt

SEQ ID NO: 9159073 - DNA, 22 bp, Homo sapiens
ttcatttgcactggattactgg

SEQ ID NO: 9159074 - DNA, 22 bp, Homo sapiens
ttcatttgagtttatagttgct

SEQ ID NO: 9159075 - DNA, 22 bp, Homo sapiens
ttcatttaatcagaatctctaa

SEQ ID NO: 9159076 - DNA, 22 bp, Homo sapiens
ttcatttaatttgtgtattaac

SEQ ID NO: 9159077 - DNA, 23 bp, Homo sapiens
ttcatttaggagttcataagagc

SEQ ID NO: 9159078 - DNA, 22 bp, Homo sapiens
ttcattgtgaacacattctgcc

SEQ ID NO: 9159079 - DNA, 22 bp, Homo sapiens
ttcattgtcttggaaaacccat

SEQ ID NO: 9159080 - DNA, 22 bp, Homo sapiens
ttcattgtgattcttggctagc

SEQ ID NO: 9159081 - DNA, 22 bp, Homo sapiens
ttcatttaatcagaatctctaa

SEQ ID NO: 9159082 - DNA, 22 bp, Homo sapiens
ttcattgttggctagctacctc

SEQ ID NO: 9159083 - DNA, 22 bp, Homo sapiens
ttcattgtgtctatttttatct

SEQ ID NO: 9159084 - DNA, 22 bp, Homo sapiens
ttcattgtactttaagagatgc

SEQ ID NO: 9159085 - DNA, 22 bp, Homo sapiens
ttcattgtagcttgactaatta

SEQ ID NO: 9159086 - DNA, 22 bp, Homo sapiens
ttcattgtagcttgactaatta

SEQ ID NO: 9159087 - DNA, 22 bp, Homo sapiens
ttcataagtttgtcactgatgt

SEQ ID NO: 9159088 - DNA, 22 bp, Homo sapiens
ttcagtgtttgtagagataact

SEQ ID NO: 9159089 - DNA, 21 bp, Homo sapiens
ttcataaaccattctcatgca

SEQ ID NO: 9159090 - DNA, 22 bp, Homo sapiens
ttcagttttgcttttaatcatg

SEQ ID NO: 9159091 - DNA, 22 bp, Homo sapiens
ttcagttttctttagaatgtag

SEQ ID NO: 9159092 - DNA, 22 bp, Homo sapiens
ttcagttttattgtactgctat

SEQ ID NO: 9159093 - DNA, 22 bp, Homo sapiens
ttcagttttattgtactgctat

SEQ ID NO: 9159094 - DNA, 22 bp, Homo sapiens
ttcagttttccctcctgcaggt

SEQ ID NO: 9159095 - DNA, 22 bp, Homo sapiens
ttcagtttgtttgactgttaga

SEQ ID NO: 9159096 - DNA, 22 bp, Homo sapiens
ttcagtttgctacaagcaacat

SEQ ID NO: 9159097 - DNA, 22 bp, Homo sapiens
ttcagtttatacctgttgatta

SEQ ID NO: 9159098 - DNA, 22 bp, Homo sapiens
ttccaggaacactctgtgtccc

SEQ ID NO: 9159099 - DNA, 22 bp, Homo sapiens
ttccaggaagtgactatgtcat

SEQ ID NO: 9159100 - DNA, 21 bp, Homo sapiens
ttcatttgttatagacaaagt

SEQ ID NO: 9159101 - DNA, 22 bp, Homo sapiens
ttcatttggatgcgtgtttaag

SEQ ID NO: 9159102 - DNA, 22 bp, Homo sapiens
ttcatttgtctgctatagatcc

SEQ ID NO: 9159103 - DNA, 22 bp, Homo sapiens
ttcatttgtccaaatactatgt

SEQ ID NO: 9159104 - DNA, 19 bp, Homo sapiens
ttccaggtgctgtggggag

SEQ ID NO: 9159105 - DNA, 19 bp, Homo sapiens
ttccaggtgctgtggggag

SEQ ID NO: 9159106 - DNA, 22 bp, Homo sapiens
ttccaggggcagcagtgatggt

SEQ ID NO: 9159107 - DNA, 22 bp, Homo sapiens
ttccagggaagagcaaggcagt

SEQ ID NO: 9159108 - DNA, 22 bp, Homo sapiens
ttccagggaagagcaaggcagt

SEQ ID NO: 9159109 - DNA, 22 bp, Homo sapiens
ttccaggctcttccaggctgtc

SEQ ID NO: 9159110 - DNA, 22 bp, Homo sapiens
ttccaggtgttgctgtcttcct

SEQ ID NO: 9159111 - DNA, 22 bp, Homo sapiens
ttccagtcagggcaaactgcca

SEQ ID NO: 9159112 - DNA, 22 bp, Homo sapiens
ttccagtgatgggcaatttggt

SEQ ID NO: 9159113 - DNA, 23 bp, Homo sapiens
ttccagtgagactgagaggtctt

SEQ ID NO: 9159114 - DNA, 22 bp, Homo sapiens
ttcagagacagcaaccaggaca

SEQ ID NO: 9159115 - DNA, 22 bp, Homo sapiens
ttcagagaagtgcacaaaatca

SEQ ID NO: 9159116 - DNA, 22 bp, Homo sapiens
ttcagagatggaaggcagaatg

SEQ ID NO: 9159117 - DNA, 22 bp, Homo sapiens
ttcagagaacttcatggaagag

SEQ ID NO: 9159118 - DNA, 22 bp, Homo sapiens
ttcagagaaaggaaagccggat

SEQ ID NO: 9159119 - DNA, 22 bp, Homo sapiens
ttcagagaagcaaaggcagatt

SEQ ID NO: 9159120 - DNA, 22 bp, Homo sapiens
ttcagactgctggtgcttccct

SEQ ID NO: 9159121 - DNA, 22 bp, Homo sapiens
ttcagactagacacatttcaag

SEQ ID NO: 9159122 - DNA, 22 bp, Homo sapiens
ttcacaggatatatgtgcaggg

SEQ ID NO: 9159123 - DNA, 22 bp, Homo sapiens
ttcacaggatatatgtgcaggg

SEQ ID NO: 9159124 - DNA, 22 bp, Homo sapiens
ttcacaggaatgtaggggtctt

SEQ ID NO: 9159125 - DNA, 18 bp, Homo sapiens
ttcagcagcagacacact

SEQ ID NO: 9159126 - DNA, 18 bp, Homo sapiens
ttcagcagcagacacact

SEQ ID NO: 9159127 - DNA, 21 bp, Homo sapiens
ttcacagatgggaaaactgag

SEQ ID NO: 9159128 - DNA, 21 bp, Homo sapiens
ttcacagatgggaaaactgag

SEQ ID NO: 9159129 - DNA, 23 bp, Homo sapiens
ttcacagattaaatatttcttct

SEQ ID NO: 9159130 - DNA, 22 bp, Homo sapiens
ttcacagatttccctgcacatg

SEQ ID NO: 9159131 - DNA, 18 bp, Homo sapiens
ttcacaggaaatgtcttt

SEQ ID NO: 9159132 - DNA, 19 bp, Homo sapiens
ttcacagctctgtgtcagt

SEQ ID NO: 9159133 - DNA, 22 bp, Homo sapiens
ttcaaagataattaccaaacat

SEQ ID NO: 9159134 - DNA, 22 bp, Homo sapiens
ttcaaagattagcatacgcaat

SEQ ID NO: 9159135 - DNA, 22 bp, Homo sapiens
ttcaaagattttcccaaagctc

SEQ ID NO: 9159136 - DNA, 22 bp, Homo sapiens
ttcaaagaattttgagacctga

SEQ ID NO: 9159137 - DNA, 22 bp, Homo sapiens
ttcaaagaccttacttggcaaa

SEQ ID NO: 9159138 - DNA, 21 bp, Homo sapiens
ttcaaagacttgatgctgacc

SEQ ID NO: 9159139 - DNA, 21 bp, Homo sapiens
ttcaaagagtgggcattgtca

SEQ ID NO: 9159140 - DNA, 21 bp, Homo sapiens
ttcaaagagtgggcattgtca

SEQ ID NO: 9159141 - DNA, 22 bp, Homo sapiens
ttcaaagataatgtagcatttt

SEQ ID NO: 9159142 - DNA, 22 bp, Homo sapiens
ttcaaagataatgtagcatttt

SEQ ID NO: 9159143 - DNA, 22 bp, Homo sapiens
ttcaaagagttgggtgtctggg

SEQ ID NO: 9159144 - DNA, 22 bp, Homo sapiens
ttcaaagataatgtagcatttt

SEQ ID NO: 9159145 - DNA, 22 bp, Homo sapiens
ttcaaagataattaccaaacat

SEQ ID NO: 9159146 - DNA, 22 bp, Homo sapiens
ttattatggtatttctttgcag

SEQ ID NO: 9159147 - DNA, 22 bp, Homo sapiens
ttattatgtgctagagaatgta

SEQ ID NO: 9159148 - DNA, 22 bp, Homo sapiens
ttattatagattatgcaagatt

SEQ ID NO: 9159149 - DNA, 22 bp, Homo sapiens
ttattagtgttgatattaggat

SEQ ID NO: 9159150 - DNA, 22 bp, Homo sapiens
ttattctttaaacatatatgtt

SEQ ID NO: 9159151 - DNA, 22 bp, Homo sapiens
ttattagagtgctttgagaaag

SEQ ID NO: 9159152 - DNA, 22 bp, Homo sapiens
ttattataatgagggataaaaa

SEQ ID NO: 9159153 - DNA, 22 bp, Homo sapiens
ttattataatgagggataaaaa

SEQ ID NO: 9159154 - DNA, 22 bp, Homo sapiens
ttattagagatatttggttagg

SEQ ID NO: 9159155 - DNA, 22 bp, Homo sapiens
ttattactgtattaatccagag

SEQ ID NO: 9159156 - DNA, 22 bp, Homo sapiens
ttattacagtcccagggagtag

SEQ ID NO: 9159157 - DNA, 22 bp, Homo sapiens
ttattacaatgcagaaaataga

SEQ ID NO: 9159158 - DNA, 22 bp, Homo sapiens
ttattacactgaaagaattgcg

SEQ ID NO: 9159159 - DNA, 22 bp, Homo sapiens
ttattacactgaaagaattgcg

SEQ ID NO: 9159160 - DNA, 22 bp, Homo sapiens
ttattaaaatgcggatttggct

SEQ ID NO: 9159161 - DNA, 20 bp, Homo sapiens
ttatatcataatgtgccaat

SEQ ID NO: 9159162 - DNA, 22 bp, Homo sapiens
ttatatatcttgatttgttcca

SEQ ID NO: 9159163 - DNA, 19 bp, Homo sapiens
ttatatacttggtttctct

SEQ ID NO: 9159164 - DNA, 22 bp, Homo sapiens
ttattacaatgcagaaaataga

SEQ ID NO: 9159165 - DNA, 22 bp, Homo sapiens
ttattacaatgcagaaaataga

SEQ ID NO: 9159166 - DNA, 22 bp, Homo sapiens
ttattacaatgcagaaaataga

SEQ ID NO: 9159167 - DNA, 22 bp, Homo sapiens
ttattaataaagtggcatagcc

SEQ ID NO: 9159168 - DNA, 22 bp, Homo sapiens
ttattaagtgcctacaataaag

SEQ ID NO: 9159169 - DNA, 22 bp, Homo sapiens
ttattcttttctccagaatccc

SEQ ID NO: 9159170 - DNA, 22 bp, Homo sapiens
ttattgaaggaactgaaataaa

SEQ ID NO: 9159171 - DNA, 21 bp, Homo sapiens
ttattgaatgtttaccgtgtg

SEQ ID NO: 9159172 - DNA, 22 bp, Homo sapiens
ttattgactgatcagagaggga

SEQ ID NO: 9159173 - DNA, 22 bp, Homo sapiens
ttattgcttatgattaggtgtt

SEQ ID NO: 9159174 - DNA, 22 bp, Homo sapiens
ttattgctgatagtgtttataa

SEQ ID NO: 9159175 - DNA, 22 bp, Homo sapiens
ttattgtaggcctattgtagaa

SEQ ID NO: 9159176 - DNA, 22 bp, Homo sapiens
ttattgtagcactttggcagtg

SEQ ID NO: 9159177 - DNA, 22 bp, Homo sapiens
ttattgtaggcctattgtagaa

SEQ ID NO: 9159178 - DNA, 22 bp, Homo sapiens
ttattgtcctacttattgtctt

SEQ ID NO: 9159179 - DNA, 22 bp, Homo sapiens
ttattgtcttaaatttggtctt

SEQ ID NO: 9159180 - DNA, 22 bp, Homo sapiens
ttattgtcctacttattgtctt

SEQ ID NO: 9159181 - DNA, 22 bp, Homo sapiens
ttcaaacattcaaataaaccgg

SEQ ID NO: 9159182 - DNA, 22 bp, Homo sapiens
ttcaaacattcaaataaaccgg

SEQ ID NO: 9159183 - DNA, 22 bp, Homo sapiens
ttcaaactatgacttcagctac

SEQ ID NO: 9159184 - DNA, 22 bp, Homo sapiens
ttcaaacagtgtagaatatatg

SEQ ID NO: 9159185 - DNA, 22 bp, Homo sapiens
ttcaaacagtgtagaatatatg

SEQ ID NO: 9159186 - DNA, 22 bp, Homo sapiens
ttcaaacagtgtagaatatatg

SEQ ID NO: 9159187 - DNA, 22 bp, Homo sapiens
ttcaaacagttgcacaacttat

SEQ ID NO: 9159188 - DNA, 22 bp, Homo sapiens
ttcaaacattcaaataaaccgg

SEQ ID NO: 9159189 - DNA, 22 bp, Homo sapiens
ttcaaacagttgcacaacttat

SEQ ID NO: 9159190 - DNA, 22 bp, Homo sapiens
ttcaaacagttgcacaacttat

SEQ ID NO: 9159191 - DNA, 22 bp, Homo sapiens
ttcaaacagttgcacaacttat

SEQ ID NO: 9159192 - DNA, 22 bp, Homo sapiens
ttattgtcttaaatttggtctt

SEQ ID NO: 9159193 - DNA, 22 bp, Homo sapiens
ttattgtgtgcgttagcctatg

SEQ ID NO: 9159194 - DNA, 22 bp, Homo sapiens
ttcaaacacagacagcagcatg

SEQ ID NO: 9159195 - DNA, 22 bp, Homo sapiens
ttcaaacacagacagcagcatg

SEQ ID NO: 9159196 - DNA, 22 bp, Homo sapiens
ttcaaacactggcttagccaat

SEQ ID NO: 9159197 - DNA, 22 bp, Homo sapiens
ttagctgctgattaaatatgtt

SEQ ID NO: 9159198 - DNA, 22 bp, Homo sapiens
ttagctgagattaagtgaactt

SEQ ID NO: 9159199 - DNA, 22 bp, Homo sapiens
ttagcgcacatcacagggggaa

SEQ ID NO: 9159200 - DNA, 22 bp, Homo sapiens
ttagctcagaaaatttaaactt

SEQ ID NO: 9159201 - DNA, 22 bp, Homo sapiens
tcctgctggaatggaaaatgaa

SEQ ID NO: 9159202 - DNA, 22 bp, Homo sapiens
tcctgctggactctgagtacaa

SEQ ID NO: 9159203 - DNA, 22 bp, Homo sapiens
tcctgctggaagtagggaatga

SEQ ID NO: 9159204 - DNA, 22 bp, Homo sapiens
tcctgctggaagtagggaatga

SEQ ID NO: 9159205 - DNA, 22 bp, Homo sapiens
tcctgctggaagtagggaatga

SEQ ID NO: 9159206 - DNA, 21 bp, Homo sapiens
tcctgctgctcctgtcgtgtt

SEQ ID NO: 9159207 - DNA, 21 bp, Homo sapiens
tcctgctgctcctgtcgtgtt

SEQ ID NO: 9159208 - DNA, 22 bp, Homo sapiens
tcctgctgctcttgggaaacct

SEQ ID NO: 9159209 - DNA, 22 bp, Homo sapiens
tcctgctggaaacttcctcttg

SEQ ID NO: 9159210 - DNA, 22 bp, Homo sapiens
ttagccatatagaaaaagagct

SEQ ID NO: 9159211 - DNA, 22 bp, Homo sapiens
ttagccatgccctagaagagga

SEQ ID NO: 9159212 - DNA, 23 bp, Homo sapiens
tcctgctgaaagctccagctggc

SEQ ID NO: 9159213 - DNA, 23 bp, Homo sapiens
tcctgctgaaagctccagctggc

SEQ ID NO: 9159214 - DNA, 23 bp, Homo sapiens
tcctgctgaaagctccagctggc

SEQ ID NO: 9159215 - DNA, 22 bp, Homo sapiens
tcctgctgacaaggaaagcatg

SEQ ID NO: 9159216 - DNA, 22 bp, Homo sapiens
tcctgctgacaaggaaagcatg

SEQ ID NO: 9159217 - DNA, 22 bp, Homo sapiens
tcctgctgaccagtaaatgaat

SEQ ID NO: 9159218 - DNA, 20 bp, Homo sapiens
tcctgctgaccttcacaagc

SEQ ID NO: 9159219 - DNA, 20 bp, Homo sapiens
tcctgctgaccttcacaagc

SEQ ID NO: 9159220 - DNA, 20 bp, Homo sapiens
tcctgctgaccttcacaagc

SEQ ID NO: 9159221 - DNA, 21 bp, Homo sapiens
tcctgctgagaaacagatggt

SEQ ID NO: 9159222 - DNA, 22 bp, Homo sapiens
tcctgctgccatttcaagtgct

SEQ ID NO: 9159223 - DNA, 22 bp, Homo sapiens
tcctgctgccatttcaagtgct

SEQ ID NO: 9159224 - DNA, 22 bp, Homo sapiens
tcctgctgctcacctttttgtc

SEQ ID NO: 9159225 - DNA, 22 bp, Homo sapiens
tcctgctgctacctggcccacg

SEQ ID NO: 9159226 - DNA, 22 bp, Homo sapiens
tcctgctgctacctggcccacg

SEQ ID NO: 9159227 - DNA, 22 bp, Homo sapiens
tcctgctgagcgtctgtcattt

SEQ ID NO: 9159228 - DNA, 22 bp, Homo sapiens
tcctgctgagcatgttctgccc

SEQ ID NO: 9159229 - DNA, 22 bp, Homo sapiens
tcctgctgagcatgttctgccc

SEQ ID NO: 9159230 - DNA, 20 bp, Homo sapiens
tcctgctgccacctcttctt

SEQ ID NO: 9159231 - DNA, 22 bp, Homo sapiens
tcctgctgagcgtctgtcattt

SEQ ID NO: 9159232 - DNA, 22 bp, Homo sapiens
tcctgctgagcgtctgtcattt

SEQ ID NO: 9159233 - DNA, 22 bp, Homo sapiens
tcctgcctgcaatcccagcact

SEQ ID NO: 9159234 - DNA, 21 bp, Homo sapiens
ttagctttctagaatctttgt

SEQ ID NO: 9159235 - DNA, 22 bp, Homo sapiens
ttaggaaaatggagtcctttta

SEQ ID NO: 9159236 - DNA, 22 bp, Homo sapiens
ttaggaaaatcatgagagatga

SEQ ID NO: 9159237 - DNA, 22 bp, Homo sapiens
ttaggaaaatgaaattacctgt

SEQ ID NO: 9159238 - DNA, 22 bp, Homo sapiens
ttaggaaacagtagcctttgct

SEQ ID NO: 9159239 - DNA, 22 bp, Homo sapiens
ttatacatgtttataaggttga

SEQ ID NO: 9159240 - DNA, 22 bp, Homo sapiens
ttatacatgtttataaggttga

SEQ ID NO: 9159241 - DNA, 22 bp, Homo sapiens
ttatacatgtttataaggttga

SEQ ID NO: 9159242 - DNA, 22 bp, Homo sapiens
ttatacatgtgttttgagatga

SEQ ID NO: 9159243 - DNA, 22 bp, Homo sapiens
ttatacatgtgttttgagatga

SEQ ID NO: 9159244 - DNA, 22 bp, Homo sapiens
ttatacatgtgttttgagatga

SEQ ID NO: 9159245 - DNA, 22 bp, Homo sapiens
ttatacagtttatacttagaat

SEQ ID NO: 9159246 - DNA, 22 bp, Homo sapiens
ttaggaaagcattgtgtaaaag

SEQ ID NO: 9159247 - DNA, 22 bp, Homo sapiens
ttaggaaagcattgtgtaaaag

SEQ ID NO: 9159248 - DNA, 22 bp, Homo sapiens
ttaggaaagcattgtgtaaaag

SEQ ID NO: 9159249 - DNA, 22 bp, Homo sapiens
ttaggaaaggaacattgaaacg

SEQ ID NO: 9159250 - DNA, 22 bp, Homo sapiens
ttaggaaagaagcagctaggag

SEQ ID NO: 9159251 - DNA, 22 bp, Homo sapiens
ttaggaaacgctgctattgact

SEQ ID NO: 9159252 - DNA, 22 bp, Homo sapiens
ttaggaaaggaacattgaaacg

SEQ ID NO: 9159253 - DNA, 22 bp, Homo sapiens
ttaggaaagtctcttggctggg

SEQ ID NO: 9159254 - DNA, 22 bp, Homo sapiens
ttaggaaagtctcttggctggg

SEQ ID NO: 9159255 - DNA, 22 bp, Homo sapiens
ttatagcagcatgatttacaat

SEQ ID NO: 9159256 - DNA, 22 bp, Homo sapiens
ttatagcagcatgatttataat

SEQ ID NO: 9159257 - DNA, 22 bp, Homo sapiens
ttatagcagcatgatttatagt

SEQ ID NO: 9159258 - DNA, 22 bp, Homo sapiens
ttatactttatactacatcatt

SEQ ID NO: 9159259 - DNA, 22 bp, Homo sapiens
ttatactgtagtctgaaagttg

SEQ ID NO: 9159260 - DNA, 22 bp, Homo sapiens
ttatatactgtggtagtactgt

SEQ ID NO: 9159261 - DNA, 22 bp, Homo sapiens
ttatataactcaggtgggctca

SEQ ID NO: 9159262 - DNA, 22 bp, Homo sapiens
ttatagtattaggtactcaaca

SEQ ID NO: 9159263 - DNA, 22 bp, Homo sapiens
ttataggaaaagttctagaaaa

SEQ ID NO: 9159264 - DNA, 22 bp, Homo sapiens
ttgaacattggcaatttcatat

SEQ ID NO: 9159265 - DNA, 22 bp, Homo sapiens
ttgaacattggcaatttcatat

SEQ ID NO: 9159266 - DNA, 22 bp, Homo sapiens
ttgaacattttctatgttatag

SEQ ID NO: 9159267 - DNA, 22 bp, Homo sapiens
ttgaaccaggaacaattagctc

SEQ ID NO: 9159268 - DNA, 22 bp, Homo sapiens
ttgaacattagaataagtaatt

SEQ ID NO: 9159269 - DNA, 22 bp, Homo sapiens
ttgaactagaagctttggaact

SEQ ID NO: 9159270 - DNA, 22 bp, Homo sapiens
ttgaactaataggtatcttgta

SEQ ID NO: 9159271 - DNA, 22 bp, Homo sapiens
ttgaattgaaacataccctggt

SEQ ID NO: 9159272 - DNA, 21 bp, Homo sapiens
ttgaattgtatgattaaactg

SEQ ID NO: 9159273 - DNA, 22 bp, Homo sapiens
ttgaattggcaaaactgcagct

SEQ ID NO: 9159274 - DNA, 19 bp, Homo sapiens
ttgaattgttttgagtagg

SEQ ID NO: 9159275 - DNA, 23 bp, Homo sapiens
ttgaatttctcttgcaatattta

SEQ ID NO: 9159276 - DNA, 19 bp, Homo sapiens
ttgaaattgtttgatatgg

SEQ ID NO: 9159277 - DNA, 19 bp, Homo sapiens
ttgaaattgtttgatatgg

SEQ ID NO: 9159278 - DNA, 19 bp, Homo sapiens
ttgaaattgtttgatatgg

SEQ ID NO: 9159279 - DNA, 22 bp, Homo sapiens
ttgaaatgtagtcctgccttca

SEQ ID NO: 9159280 - DNA, 22 bp, Homo sapiens
ttgaaatggcagcagctgacct

SEQ ID NO: 9159281 - DNA, 22 bp, Homo sapiens
ttgaaatggaagtgaaaattct

SEQ ID NO: 9159282 - DNA, 22 bp, Homo sapiens
ttgaaatggcagcagctgacct

SEQ ID NO: 9159283 - DNA, 22 bp, Homo sapiens
ttgaacagtcctaagagaccct

SEQ ID NO: 9159284 - DNA, 22 bp, Homo sapiens
ttgaacattaacttcagtctat

SEQ ID NO: 9159285 - DNA, 22 bp, Homo sapiens
ttgaacaatcaaaagaattcat

SEQ ID NO: 9159286 - DNA, 20 bp, Homo sapiens
ttcttttgataagcttgaca

SEQ ID NO: 9159287 - DNA, 20 bp, Homo sapiens
ttcttttgataagcttgaca

SEQ ID NO: 9159288 - DNA, 22 bp, Homo sapiens
ttcttttgcaagactattgatt

SEQ ID NO: 9159289 - DNA, 22 bp, Homo sapiens
ttcttttggactcaaagagaac

SEQ ID NO: 9159290 - DNA, 22 bp, Homo sapiens
ttcttttgggaattacgtatgc

SEQ ID NO: 9159291 - DNA, 22 bp, Homo sapiens
ttgaaatgatctatttcagtag

SEQ ID NO: 9159292 - DNA, 22 bp, Homo sapiens
ttgaaatgagcaaactgtcagc

SEQ ID NO: 9159293 - DNA, 22 bp, Homo sapiens
ttgaaatgaaatatttaagctc

SEQ ID NO: 9159294 - DNA, 22 bp, Homo sapiens
ttgaaatgagactaattgattg

SEQ ID NO: 9159295 - DNA, 22 bp, Homo sapiens
ttgaaatgcagattccaatcca

SEQ ID NO: 9159296 - DNA, 22 bp, Homo sapiens
ttgaaatgcagattccaatcca

SEQ ID NO: 9159297 - DNA, 22 bp, Homo sapiens
ttgaaatgcatcatcatttaga

SEQ ID NO: 9159298 - DNA, 22 bp, Homo sapiens
ttgaaatggaagtgaaaattct

SEQ ID NO: 9159299 - DNA, 22 bp, Homo sapiens
ttgaaatgctctttggaatcta

SEQ ID NO: 9159300 - DNA, 22 bp, Homo sapiens
ttgaaatgctctttggaatcta

SEQ ID NO: 9159301 - DNA, 22 bp, Homo sapiens
ttgaaatatttgggagtgtttg

SEQ ID NO: 9159302 - DNA, 22 bp, Homo sapiens
ttgaaatgaaatatttaagctc

SEQ ID NO: 9159303 - DNA, 22 bp, Homo sapiens
ttgaaatgaaatatttaagctc

SEQ ID NO: 9159304 - DNA, 22 bp, Homo sapiens
ttgaaatatttgggagtgtttg

SEQ ID NO: 9159305 - DNA, 22 bp, Homo sapiens
ttcttatttcccccttcatcat

SEQ ID NO: 9159306 - DNA, 22 bp, Homo sapiens
ttcttattcttgaaatgtggga

SEQ ID NO: 9159307 - DNA, 22 bp, Homo sapiens
ttcttcaaaacaacactggcct

SEQ ID NO: 9159308 - DNA, 22 bp, Homo sapiens
ttcttcaaccatctacataaac

SEQ ID NO: 9159309 - DNA, 22 bp, Homo sapiens
ttcttcaacaaggacactgtta

SEQ ID NO: 9159310 - DNA, 22 bp, Homo sapiens
ttcttcaacaaggacactgtta

SEQ ID NO: 9159311 - DNA, 22 bp, Homo sapiens
ttcttcaattcccatcccggtc

SEQ ID NO: 9159312 - DNA, 22 bp, Homo sapiens
ttctttggtgggagattgaggt

SEQ ID NO: 9159313 - DNA, 22 bp, Homo sapiens
ttcttcaattttccatatactg

SEQ ID NO: 9159314 - DNA, 22 bp, Homo sapiens
ttcttcagactactgatgattg

SEQ ID NO: 9159315 - DNA, 23 bp, Homo sapiens
ttctttgtggataatctccagtg

SEQ ID NO: 9159316 - DNA, 23 bp, Homo sapiens
ttctttgtggataatctccagtg

SEQ ID NO: 9159317 - DNA, 22 bp, Homo sapiens
ttctttgtgcatccaattttct

SEQ ID NO: 9159318 - DNA, 22 bp, Homo sapiens
ttctttgtgcatccaattttct

SEQ ID NO: 9159319 - DNA, 22 bp, Homo sapiens
ttctttgtaacctttgggaact

SEQ ID NO: 9159320 - DNA, 22 bp, Homo sapiens
ttctttgtaaagccacagtcct

SEQ ID NO: 9159321 - DNA, 22 bp, Homo sapiens
ttctttggtgttacccagctca

SEQ ID NO: 9159322 - DNA, 22 bp, Homo sapiens
ttctttgtggcagtgagctggg

SEQ ID NO: 9159323 - DNA, 20 bp, Homo sapiens
ttctttgttccttacatttg

SEQ ID NO: 9159324 - DNA, 20 bp, Homo sapiens
ttctttgttccttacatttg

SEQ ID NO: 9159325 - DNA, 20 bp, Homo sapiens
ttctttgttccttacatttg

SEQ ID NO: 9159326 - DNA, 20 bp, Homo sapiens
ttctttgttccttacatttg

SEQ ID NO: 9159327 - DNA, 20 bp, Homo sapiens
ttctttgttccttacatttg

SEQ ID NO: 9159328 - DNA, 22 bp, Homo sapiens
ttctttgttgtactttcctaca

SEQ ID NO: 9159329 - DNA, 22 bp, Homo sapiens
ttctttgttgtactttcctaca

SEQ ID NO: 9159330 - DNA, 22 bp, Homo sapiens
ttctttgttgtactttcctaca

SEQ ID NO: 9159331 - DNA, 22 bp, Homo sapiens
ttctttgttgtactttcctaca

SEQ ID NO: 9159332 - DNA, 22 bp, Homo sapiens
ttctttgttgtactttcctaca

SEQ ID NO: 9159333 - DNA, 22 bp, Homo sapiens
ttcttttaatgtctggctttca

SEQ ID NO: 9159334 - DNA, 22 bp, Homo sapiens
ttcttttaatagagatcctgtg

SEQ ID NO: 9159335 - DNA, 22 bp, Homo sapiens
ttcttttaatgtctggctttca

SEQ ID NO: 9159336 - DNA, 22 bp, Homo sapiens
ttcttttaatgttctgaagttt

SEQ ID NO: 9159337 - DNA, 22 bp, Homo sapiens
ttcttatagaagcaaccattgt

SEQ ID NO: 9159338 - DNA, 19 bp, Homo sapiens
ttcttagtctcatgcatga

SEQ ID NO: 9159339 - DNA, 22 bp, Homo sapiens
ttcttagctccagcttcatgtt

SEQ ID NO: 9159340 - DNA, 22 bp, Homo sapiens
ttctgtgttgtgacattctaga

SEQ ID NO: 9159341 - DNA, 19 bp, Homo sapiens
ttctgtaaggacattaatc

SEQ ID NO: 9159342 - DNA, 22 bp, Homo sapiens
ttctgtaagggatttattctga

SEQ ID NO: 9159343 - DNA, 22 bp, Homo sapiens
ttctgtaattctgttagtttca

SEQ ID NO: 9159344 - DNA, 22 bp, Homo sapiens
ttctgtctgatggtgccagaac

SEQ ID NO: 9159345 - DNA, 22 bp, Homo sapiens
ttctgtcttcccactgaggagc

SEQ ID NO: 9159346 - DNA, 22 bp, Homo sapiens
ttctgtgaggacttctcaagga

SEQ ID NO: 9159347 - DNA, 22 bp, Homo sapiens
ttctgtggtctcccatgtctgt

SEQ ID NO: 9159348 - DNA, 22 bp, Homo sapiens
ttctgtggaggtttggaacatt

SEQ ID NO: 9159349 - DNA, 22 bp, Homo sapiens
ttctgtggaatatgaactagca

SEQ ID NO: 9159350 - DNA, 22 bp, Homo sapiens
ttctgtggctgggagcctggct

SEQ ID NO: 9159351 - DNA, 21 bp, Homo sapiens
ttctctggtcaagcacacata

SEQ ID NO: 9159352 - DNA, 22 bp, Homo sapiens
ttctctggggacttggttggag

SEQ ID NO: 9159353 - DNA, 22 bp, Homo sapiens
ttctctggggactgtctctatt

SEQ ID NO: 9159354 - DNA, 22 bp, Homo sapiens
ttctctggggttcagtatctct

SEQ ID NO: 9159355 - DNA, 22 bp, Homo sapiens
ttctctggtaaacacatgcgta

SEQ ID NO: 9159356 - DNA, 22 bp, Homo sapiens
ttctctgggttaggggaactat

SEQ ID NO: 9159357 - DNA, 16 bp, Homo sapiens
ttctctggggttgtgc

SEQ ID NO: 9159358 - DNA, 22 bp, Homo sapiens
ttctctgggacaggaacagttt

SEQ ID NO: 9159359 - DNA, 22 bp, Homo sapiens
ttctctggacagtgaagagagg

SEQ ID NO: 9159360 - DNA, 22 bp, Homo sapiens
ttctctgggcttttcggatccg

SEQ ID NO: 9159361 - DNA, 22 bp, Homo sapiens
ttctctggggactgtctctatt

SEQ ID NO: 9159362 - DNA, 22 bp, Homo sapiens
ttctctgggatctggcaaaagg

SEQ ID NO: 9159363 - DNA, 22 bp, Homo sapiens
ttctggagaaaattctgtcatt

SEQ ID NO: 9159364 - DNA, 22 bp, Homo sapiens
ttctggagaatcaccaccaggc

SEQ ID NO: 9159365 - DNA, 22 bp, Homo sapiens
ttctggagacccagcaacaggg

SEQ ID NO: 9159366 - DNA, 22 bp, Homo sapiens
ttctggagagaaaccttacaaa

SEQ ID NO: 9159367 - DNA, 22 bp, Homo sapiens
ttctggagagaagaccagtgtg

SEQ ID NO: 9159368 - DNA, 22 bp, Homo sapiens
ttctggagagaagaccagtgtg

SEQ ID NO: 9159369 - DNA, 22 bp, Homo sapiens
ttctggagacccagcaacaggg

SEQ ID NO: 9159370 - DNA, 22 bp, Homo sapiens
ttctggagagaaaccttacaaa

SEQ ID NO: 9159371 - DNA, 22 bp, Homo sapiens
ttctggagaataatcagcattg

SEQ ID NO: 9159372 - DNA, 22 bp, Homo sapiens
ttctggagaatcaccaccaggc

SEQ ID NO: 9159373 - DNA, 22 bp, Homo sapiens
ttctggagaataatcagcattg

SEQ ID NO: 9159374 - DNA, 22 bp, Homo sapiens
ttctggagaaaattctgtcatt

SEQ ID NO: 9159375 - DNA, 23 bp, Homo sapiens
ttctggagaaaggaccatagctt

SEQ ID NO: 9159376 - DNA, 23 bp, Homo sapiens
ttctggagaaaggaccatagctt

SEQ ID NO: 9159377 - DNA, 22 bp, Homo sapiens
ttctggagccccaagatctgta

SEQ ID NO: 9159378 - DNA, 22 bp, Homo sapiens
ttctggagccccaagatctgta

SEQ ID NO: 9159379 - DNA, 22 bp, Homo sapiens
ttctggagattgagaaggcatt

SEQ ID NO: 9159380 - DNA, 22 bp, Homo sapiens
ttctggagccccaagatctgta

SEQ ID NO: 9159381 - DNA, 22 bp, Homo sapiens
ttctggagccgggcctgggcag

SEQ ID NO: 9159382 - DNA, 22 bp, Homo sapiens
ttctggagctaaagtccactct

SEQ ID NO: 9159383 - DNA, 22 bp, Homo sapiens
ttctggagccgggcctgggcag

SEQ ID NO: 9159384 - DNA, 22 bp, Homo sapiens
ttctggagctctcgaccccact

SEQ ID NO: 9159385 - DNA, 22 bp, Homo sapiens
ttctggagctaaagtccactct

SEQ ID NO: 9159386 - DNA, 22 bp, Homo sapiens
ttctgtaaacatcaagtgcctg

SEQ ID NO: 9159387 - DNA, 22 bp, Homo sapiens
ttctggagaggaacagaaaggt

SEQ ID NO: 9159388 - DNA, 22 bp, Homo sapiens
ttctggagaggaacagaaaggt

SEQ ID NO: 9159389 - DNA, 22 bp, Homo sapiens
ttctggagatagtcaggcatta

SEQ ID NO: 9159390 - DNA, 22 bp, Homo sapiens
ttctggagatagtcaggcatta

SEQ ID NO: 9159391 - DNA, 22 bp, Homo sapiens
ttctggagatgacttttagaaa

SEQ ID NO: 9159392 - DNA, 22 bp, Homo sapiens
ttctggagatctgcctatggga

SEQ ID NO: 9159393 - DNA, 22 bp, Homo sapiens
ttctggagatgacttttagaaa

SEQ ID NO: 9159394 - DNA, 22 bp, Homo sapiens
ttctggagatctgcctatggga

SEQ ID NO: 9159395 - DNA, 22 bp, Homo sapiens
ttctggagattgagaaggcatt

SEQ ID NO: 9159396 - DNA, 22 bp, Homo sapiens
ttcctggcacactcctgaatgt

SEQ ID NO: 9159397 - DNA, 22 bp, Homo sapiens
ttcctgcccctgagagctccca

SEQ ID NO: 9159398 - DNA, 22 bp, Homo sapiens
ttcctgcagcaaggagaagctg

SEQ ID NO: 9159399 - DNA, 22 bp, Homo sapiens
ttcctggcctctctctgagcag

SEQ ID NO: 9159400 - DNA, 21 bp, Homo sapiens
ttcctggggacttccgtggga

SEQ ID NO: 9159401 - DNA, 22 bp, Homo sapiens
ttcctggccccacccctggaga

SEQ ID NO: 9159402 - DNA, 22 bp, Homo sapiens
ttcctggccccatccatcttca

SEQ ID NO: 9159403 - DNA, 22 bp, Homo sapiens
ttccagttctggctttgccact

SEQ ID NO: 9159404 - DNA, 22 bp, Homo sapiens
ttccagttcttctgtaagcact

SEQ ID NO: 9159405 - DNA, 17 bp, Homo sapiens
ttccagtttagtattgt

SEQ ID NO: 9159406 - DNA, 22 bp, Homo sapiens
ttcctgagaaatttgtacctgg

SEQ ID NO: 9159407 - DNA, 22 bp, Homo sapiens
ttcctgagaaatttgtacctgg

SEQ ID NO: 9159408 - DNA, 22 bp, Homo sapiens
ttcctgagaacatggcagctta

SEQ ID NO: 9159409 - DNA, 22 bp, Homo sapiens
ttcctgagggacttttgagatt

SEQ ID NO: 9159410 - DNA, 22 bp, Homo sapiens
ttcctgagggccccagaggagg

SEQ ID NO: 9159411 - DNA, 22 bp, Homo sapiens
ttcctgagggacttttgagatt

SEQ ID NO: 9159412 - DNA, 22 bp, Homo sapiens
ttcctgaggaggaccaggacca

SEQ ID NO: 9159413 - DNA, 23 bp, Homo sapiens
ttcctgagtgctggagagagtgc

SEQ ID NO: 9159414 - DNA, 22 bp, Homo sapiens
ttcctgagtcgccgagtctatg

SEQ ID NO: 9159415 - DNA, 22 bp, Homo sapiens
ttcctgcagcaaggagaagctg

SEQ ID NO: 9159416 - DNA, 22 bp, Homo sapiens
ttccttggccacactggtgctt

SEQ ID NO: 9159417 - DNA, 22 bp, Homo sapiens
ttccttggccccatgcccaggg

SEQ ID NO: 9159418 - DNA, 22 bp, Homo sapiens
ttccttggaaagagacgtcgct

SEQ ID NO: 9159419 - DNA, 18 bp, Homo sapiens
ttccttgattagagagaa

SEQ ID NO: 9159420 - DNA, 22 bp, Homo sapiens
ttccttgcctcggggtaccttg

SEQ ID NO: 9159421 - DNA, 22 bp, Homo sapiens
ttccttgaatgagtcatggaaa

SEQ ID NO: 9159422 - DNA, 22 bp, Homo sapiens
ttccttgagatgactgtcttgt

SEQ ID NO: 9159423 - DNA, 22 bp, Homo sapiens
ttccttgagatgactgtcttgt

SEQ ID NO: 9159424 - DNA, 22 bp, Homo sapiens
ttccttgaggtattcagtttta

SEQ ID NO: 9159425 - DNA, 22 bp, Homo sapiens
ttccttcttgtaatgatctgcc

SEQ ID NO: 9159426 - DNA, 22 bp, Homo sapiens
ttcctgtatctgcttcttacta

SEQ ID NO: 9159427 - DNA, 22 bp, Homo sapiens
ttcctgggtggtcctggtagag

SEQ ID NO: 9159428 - DNA, 22 bp, Homo sapiens
ttcctggggtactggagaaaat

SEQ ID NO: 9159429 - DNA, 22 bp, Homo sapiens
ttcctggtaaattatgtccagg

SEQ ID NO: 9159430 - DNA, 21 bp, Homo sapiens
ttctctacctctagtgctgta

SEQ ID NO: 9159431 - DNA, 22 bp, Homo sapiens
ttctctaatacattttgacaaa

SEQ ID NO: 9159432 - DNA, 22 bp, Homo sapiens
ttctctatgtgtgttgtagttt

SEQ ID NO: 9159433 - DNA, 22 bp, Homo sapiens
ttctctaggagttctgggatca

SEQ ID NO: 9159434 - DNA, 22 bp, Homo sapiens
ttctctaggactttggagtcct

SEQ ID NO: 9159435 - DNA, 23 bp, Homo sapiens
ttctctagatgaggtgaagatgg

SEQ ID NO: 9159436 - DNA, 23 bp, Homo sapiens
ttctctagatgaggtgaagatgg

SEQ ID NO: 9159437 - DNA, 22 bp, Homo sapiens
ttctctcctacccagtatccat

SEQ ID NO: 9159438 - DNA, 22 bp, Homo sapiens
ttctctcccatgaagcttctat

SEQ ID NO: 9159439 - DNA, 22 bp, Homo sapiens
ttctctcccatgaagcttctat

SEQ ID NO: 9159440 - DNA, 22 bp, Homo sapiens
ttctctcccatgaagcttctat

SEQ ID NO: 9159441 - DNA, 22 bp, Homo sapiens
ttctctctgagagcatctggaa

SEQ ID NO: 9159442 - DNA, 22 bp, Homo sapiens
ttctctccagactgcagtgggt

SEQ ID NO: 9159443 - DNA, 21 bp, Homo sapiens
ttctctccatatgcccagccc

SEQ ID NO: 9159444 - DNA, 21 bp, Homo sapiens
ttctctccatatgcccagccc

SEQ ID NO: 9159445 - DNA, 22 bp, Homo sapiens
ttctctgcagcttaggcccagt

SEQ ID NO: 9159446 - DNA, 22 bp, Homo sapiens
ttctctgcagctcctggctggg

SEQ ID NO: 9159447 - DNA, 22 bp, Homo sapiens
ttctctgatcttgctagactga

SEQ ID NO: 9159448 - DNA, 22 bp, Homo sapiens
ttctctgagtacgtttcagtgt

SEQ ID NO: 9159449 - DNA, 22 bp, Homo sapiens
ttctctgagtcttggtttctta

SEQ ID NO: 9159450 - DNA, 22 bp, Homo sapiens
ttctctgatcttgctagactga

SEQ ID NO: 9159451 - DNA, 22 bp, Homo sapiens
ttctctgatcttgctagactga

SEQ ID NO: 9159452 - DNA, 22 bp, Homo sapiens
ttctctgagatagactaagtgg

SEQ ID NO: 9159453 - DNA, 22 bp, Homo sapiens
ttctctgacccccttaaatatt

SEQ ID NO: 9159454 - DNA, 22 bp, Homo sapiens
ttctctgaaggttgtggaacta

SEQ ID NO: 9159455 - DNA, 22 bp, Homo sapiens
ttctctgaaggttgtggaacta

SEQ ID NO: 9159456 - DNA, 17 bp, Homo sapiens
ttctctgagctgtattg

SEQ ID NO: 9159457 - DNA, 22 bp, Homo sapiens
ttctctgagtacgtttcagtgt

SEQ ID NO: 9159458 - DNA, 22 bp, Homo sapiens
ttctctgagatagactaagtgg

SEQ ID NO: 9159459 - DNA, 17 bp, Homo sapiens
ttctctgagctgtattg

SEQ ID NO: 9159460 - DNA, 22 bp, Homo sapiens
ttctctggaaggctctacggga

SEQ ID NO: 9159461 - DNA, 22 bp, Homo sapiens
ttctctggaactgaaacaagat

SEQ ID NO: 9159462 - DNA, 22 bp, Homo sapiens
ttctctgcctcacaggtctaag

SEQ ID NO: 9159463 - DNA, 22 bp, Homo sapiens
ttctctgcctctagctatattc

SEQ ID NO: 9159464 - DNA, 22 bp, Homo sapiens
ttctctcttactgccatgctgt

SEQ ID NO: 9159465 - DNA, 22 bp, Homo sapiens
ttctctctgtgtcattatggac

SEQ ID NO: 9159466 - DNA, 22 bp, Homo sapiens
ttctctctgtggtcccattttg

SEQ ID NO: 9159467 - DNA, 22 bp, Homo sapiens
ttctctctggacctgggatgcg

SEQ ID NO: 9159468 - DNA, 22 bp, Homo sapiens
ttctctctgagagcatctggaa

SEQ ID NO: 9159469 - DNA, 22 bp, Homo sapiens
ttctctgaaggccatgctcact

SEQ ID NO: 9159470 - DNA, 22 bp, Homo sapiens
ttctctgaaggccatgctcact

SEQ ID NO: 9159471 - DNA, 22 bp, Homo sapiens
ttctctcttttgggtaggaggt

SEQ ID NO: 9159472 - DNA, 22 bp, Homo sapiens
ttctctcttactgccatgctgt

SEQ ID NO: 9159473 - DNA, 22 bp, Homo sapiens
ttctctcttccagttcccactt

SEQ ID NO: 9159474 - DNA, 22 bp, Homo sapiens
ttctctcttttgggtaggaggt

SEQ ID NO: 9159475 - DNA, 22 bp, Homo sapiens
ttctcaggtcaccagggtgcca

SEQ ID NO: 9159476 - DNA, 22 bp, Homo sapiens
ttctcaggtcaccagggtgcca

SEQ ID NO: 9159477 - DNA, 22 bp, Homo sapiens
ttctcaggtagtgctgatgctg

SEQ ID NO: 9159478 - DNA, 22 bp, Homo sapiens
ttctccaactcttttaagtaat

SEQ ID NO: 9159479 - DNA, 22 bp, Homo sapiens
ttctccaacacaagcatgatgt

SEQ ID NO: 9159480 - DNA, 22 bp, Homo sapiens
ttctccaagatgaagctgtgta

SEQ ID NO: 9159481 - DNA, 22 bp, Homo sapiens
ttctcaggtagtgctgatgctg

SEQ ID NO: 9159482 - DNA, 22 bp, Homo sapiens
ttctcagggtcttgtgcaaggg

SEQ ID NO: 9159483 - DNA, 22 bp, Homo sapiens
ttctcagggtctggatggcctg

SEQ ID NO: 9159484 - DNA, 22 bp, Homo sapiens
ttctccaagatgaagctgtgta

SEQ ID NO: 9159485 - DNA, 22 bp, Homo sapiens
ttctccaagggatttctgcctt

SEQ ID NO: 9159486 - DNA, 22 bp, Homo sapiens
ttctccaaggatacagtcctgt

SEQ ID NO: 9159487 - DNA, 22 bp, Homo sapiens
ttctccaatagctgctcatggc

SEQ ID NO: 9159488 - DNA, 22 bp, Homo sapiens
ttctccaaggttcatatttatc

SEQ ID NO: 9159489 - DNA, 22 bp, Homo sapiens
ttctccaagtagaagctaagtt

SEQ ID NO: 9159490 - DNA, 22 bp, Homo sapiens
ttctccaagtagaagctaagtt

SEQ ID NO: 9159491 - DNA, 18 bp, Homo sapiens
ttctccagaaaacatagc

SEQ ID NO: 9159492 - DNA, 18 bp, Homo sapiens
ttctccagaaaacatagc

SEQ ID NO: 9159493 - DNA, 22 bp, Homo sapiens
ttctccacatggtgtgctgtga

SEQ ID NO: 9159494 - DNA, 22 bp, Homo sapiens
ttctccaatagctgctcatggc

SEQ ID NO: 9159495 - DNA, 22 bp, Homo sapiens
ttctccagacacaaaatctaag

SEQ ID NO: 9159496 - DNA, 22 bp, Homo sapiens
ttctccagacacaaaatctaag

SEQ ID NO: 9159497 - DNA, 22 bp, Homo sapiens
ttctccagacaggcagagggaa

SEQ ID NO: 9159498 - DNA, 22 bp, Homo sapiens
ttctccagacaggcagagggaa

SEQ ID NO: 9159499 - DNA, 22 bp, Homo sapiens
ttctccagacaacagagggtga

SEQ ID NO: 9159500 - DNA, 22 bp, Homo sapiens
ttctccagacaacagagggtga

SEQ ID NO: 9159501 - DNA, 22 bp, Homo sapiens
ttctcctgagttcccaggtcta

SEQ ID NO: 9159502 - DNA, 22 bp, Homo sapiens
ttctccagagggctctgcagga

SEQ ID NO: 9159503 - DNA, 22 bp, Homo sapiens
ttctccagagggctctgcagga

SEQ ID NO: 9159504 - DNA, 22 bp, Homo sapiens
ttctccagagggctctgcagga

SEQ ID NO: 9159505 - DNA, 22 bp, Homo sapiens
ttctccagagggctctgcagga

SEQ ID NO: 9159506 - DNA, 22 bp, Homo sapiens
ttctcctctgttggccttccct

SEQ ID NO: 9159507 - DNA, 22 bp, Homo sapiens
ttctccagaccctcctgcagac

SEQ ID NO: 9159508 - DNA, 22 bp, Homo sapiens
ttctccagaccactgcctctgt

SEQ ID NO: 9159509 - DNA, 22 bp, Homo sapiens
ttctccagaccactgcctctgt

SEQ ID NO: 9159510 - DNA, 22 bp, Homo sapiens
ttctccagaccttgtgactatg

SEQ ID NO: 9159511 - DNA, 22 bp, Homo sapiens
ttctccagaccttgtgactatg

SEQ ID NO: 9159512 - DNA, 22 bp, Homo sapiens
ttctccagaccctcctgcagac

SEQ ID NO: 9159513 - DNA, 22 bp, Homo sapiens
ttctccagaccctcctgcagac

SEQ ID NO: 9159514 - DNA, 22 bp, Homo sapiens
ttctccagaccttgtgactatg

SEQ ID NO: 9159515 - DNA, 22 bp, Homo sapiens
ttctcaggcccctgcctggact

SEQ ID NO: 9159516 - DNA, 22 bp, Homo sapiens
ttctcaggcctttgggatggga

SEQ ID NO: 9159517 - DNA, 22 bp, Homo sapiens
ttctcaggcctttgggatggga

SEQ ID NO: 9159518 - DNA, 22 bp, Homo sapiens
ttctcagggcatctcatgaccc

SEQ ID NO: 9159519 - DNA, 22 bp, Homo sapiens
ttctcagggtagaggtgacact

SEQ ID NO: 9159520 - DNA, 22 bp, Homo sapiens
ttctcagggtctggatggcctg

SEQ ID NO: 9159521 - DNA, 22 bp, Homo sapiens
ttctcaggaactcagtgtcagc

SEQ ID NO: 9159522 - DNA, 23 bp, Homo sapiens
ttctcaggagcccccaggtcagg

SEQ ID NO: 9159523 - DNA, 22 bp, Homo sapiens
ttctcagatgattcagataaac

SEQ ID NO: 9159524 - DNA, 22 bp, Homo sapiens
ttctcagatgattcagataaac

SEQ ID NO: 9159525 - DNA, 22 bp, Homo sapiens
ttctcagatgattcagataaac

SEQ ID NO: 9159526 - DNA, 22 bp, Homo sapiens
ttccttggtgcgcctgctgcag

SEQ ID NO: 9159527 - DNA, 17 bp, Homo sapiens
ttccttgggtgctgggt

SEQ ID NO: 9159528 - DNA, 17 bp, Homo sapiens
ttccttgggtgctgggt

SEQ ID NO: 9159529 - DNA, 21 bp, Homo sapiens
ttctcagatcgagtagtgaga

SEQ ID NO: 9159530 - DNA, 22 bp, Homo sapiens
ttctcagatccatcagaagtcc

SEQ ID NO: 9159531 - DNA, 22 bp, Homo sapiens
ttctcagatccatcagaagtcc

SEQ ID NO: 9159532 - DNA, 22 bp, Homo sapiens
ttttctcttgttaatgtactga

SEQ ID NO: 9159533 - DNA, 22 bp, Homo sapiens
ttttctcttgttaatgtactga

SEQ ID NO: 9159534 - DNA, 22 bp, Homo sapiens
ttttctgaagtttaagacattt

SEQ ID NO: 9159535 - DNA, 22 bp, Homo sapiens
ttttctcttccctctggacctg

SEQ ID NO: 9159536 - DNA, 19 bp, Homo sapiens
ttttctcagcttctagcgg

SEQ ID NO: 9159537 - DNA, 22 bp, Homo sapiens
ttttcatttttgtagatgcaag

SEQ ID NO: 9159538 - DNA, 22 bp, Homo sapiens
ttttccaaattagaagtagaga

SEQ ID NO: 9159539 - DNA, 22 bp, Homo sapiens
ttttctgtttgcttcaagacat

SEQ ID NO: 9159540 - DNA, 22 bp, Homo sapiens
ttttctgtgccctgctagctgg

SEQ ID NO: 9159541 - DNA, 22 bp, Homo sapiens
ttttctgtggtcagagcttgag

SEQ ID NO: 9159542 - DNA, 22 bp, Homo sapiens
ttttctgtgtatccaggcttcc

SEQ ID NO: 9159543 - DNA, 22 bp, Homo sapiens
ttttctgttacaaagtacagcg

SEQ ID NO: 9159544 - DNA, 22 bp, Homo sapiens
ttttctgtaagaggactttaat

SEQ ID NO: 9159545 - DNA, 22 bp, Homo sapiens
ttttctgtaagaggactttaat

SEQ ID NO: 9159546 - DNA, 22 bp, Homo sapiens
ttttctgtattattgtgcttca

SEQ ID NO: 9159547 - DNA, 22 bp, Homo sapiens
ttttctgcggtgtgaatggcct

SEQ ID NO: 9159548 - DNA, 22 bp, Homo sapiens
ttttctgcctgcgtgtttagga

SEQ ID NO: 9159549 - DNA, 22 bp, Homo sapiens
ttttattggagtgataccaagc

SEQ ID NO: 9159550 - DNA, 22 bp, Homo sapiens
ttttattggagtgataccaagc

SEQ ID NO: 9159551 - DNA, 22 bp, Homo sapiens
ttttattggagtgataccaagc

SEQ ID NO: 9159552 - DNA, 19 bp, Homo sapiens
ttttcacatactggatcct

SEQ ID NO: 9159553 - DNA, 22 bp, Homo sapiens
ttttattagtggctagatgggg

SEQ ID NO: 9159554 - DNA, 22 bp, Homo sapiens
ttttatgttcctgaagctatct

SEQ ID NO: 9159555 - DNA, 22 bp, Homo sapiens
ttttatgttcctctttatgcga

SEQ ID NO: 9159556 - DNA, 22 bp, Homo sapiens
ttttatgtgtgaaatgctgtct

SEQ ID NO: 9159557 - DNA, 22 bp, Homo sapiens
ttttatgtgtgaaatgctgtct

SEQ ID NO: 9159558 - DNA, 21 bp, Homo sapiens
ttttattgatgaatggccact

SEQ ID NO: 9159559 - DNA, 22 bp, Homo sapiens
ttttattatctttgaatgggac

SEQ ID NO: 9159560 - DNA, 22 bp, Homo sapiens
ttttattgcaataaagtgtgta

SEQ ID NO: 9159561 - DNA, 22 bp, Homo sapiens
ttttattggagtgataccaagc

SEQ ID NO: 9159562 - DNA, 22 bp, Homo sapiens
ttttattgcaataaagtgtgta

SEQ ID NO: 9159563 - DNA, 22 bp, Homo sapiens
ttttattgcaataaagtgtgta

SEQ ID NO: 9159564 - DNA, 22 bp, Homo sapiens
ttttattggagtgataccaagc

SEQ ID NO: 9159565 - DNA, 22 bp, Homo sapiens
tttgtaagtggtagatctaaga

SEQ ID NO: 9159566 - DNA, 22 bp, Homo sapiens
tttgtaagtggtagatctaaga

SEQ ID NO: 9159567 - DNA, 22 bp, Homo sapiens
tttgtaaggctaaataatattc

SEQ ID NO: 9159568 - DNA, 22 bp, Homo sapiens
tttgtaagaactataaattgct

SEQ ID NO: 9159569 - DNA, 22 bp, Homo sapiens
tttgtaaaattagggaattcaa

SEQ ID NO: 9159570 - DNA, 22 bp, Homo sapiens
tttgtaaaaggaggaagcatgg

SEQ ID NO: 9159571 - DNA, 22 bp, Homo sapiens
tttgtaaaattagggaattcaa

SEQ ID NO: 9159572 - DNA, 22 bp, Homo sapiens
tttgtaaaaggaggaagcatgg

SEQ ID NO: 9159573 - DNA, 22 bp, Homo sapiens
tttgtaaatagcagtactcatg

SEQ ID NO: 9159574 - DNA, 22 bp, Homo sapiens
tttgtaaaggcctgaatttcag

SEQ ID NO: 9159575 - DNA, 22 bp, Homo sapiens
tttgtaaagtctgttctgagtt

SEQ ID NO: 9159576 - DNA, 22 bp, Homo sapiens
tttgttaattcttatgttagag

SEQ ID NO: 9159577 - DNA, 22 bp, Homo sapiens
tttgttacaaagaaagaagagc

SEQ ID NO: 9159578 - DNA, 22 bp, Homo sapiens
tttgttacattaaaaagtaggt

SEQ ID NO: 9159579 - DNA, 22 bp, Homo sapiens
tttgttactatagcatagagtg

SEQ ID NO: 9159580 - DNA, 22 bp, Homo sapiens
tttgttaaatatttattgagtg

SEQ ID NO: 9159581 - DNA, 22 bp, Homo sapiens
tttgttaaggagtattgcttct

SEQ ID NO: 9159582 - DNA, 22 bp, Homo sapiens
tttgttaaggagtattgcttct

SEQ ID NO: 9159583 - DNA, 22 bp, Homo sapiens
tttgttacaaagaaagaagagc

SEQ ID NO: 9159584 - DNA, 22 bp, Homo sapiens
tttgttcaacaggtgaaataga

SEQ ID NO: 9159585 - DNA, 22 bp, Homo sapiens
tttgttcaacaggtgaaataga

SEQ ID NO: 9159586 - DNA, 22 bp, Homo sapiens
tttgttcaaggaatagtaaatg

SEQ ID NO: 9159587 - DNA, 22 bp, Homo sapiens
tttgtgttttagctggtgaggc

SEQ ID NO: 9159588 - DNA, 22 bp, Homo sapiens
tttgttaaaatgcagattctgt

SEQ ID NO: 9159589 - DNA, 22 bp, Homo sapiens
tttgttaaaatgcagattctgt

SEQ ID NO: 9159590 - DNA, 22 bp, Homo sapiens
tttgttaaaatgcagattctgt

SEQ ID NO: 9159591 - DNA, 22 bp, Homo sapiens
tttgtgttgtacttctgtgcat

SEQ ID NO: 9159592 - DNA, 22 bp, Homo sapiens
tttgtgttaaatgttaaattca

SEQ ID NO: 9159593 - DNA, 22 bp, Homo sapiens
tttgtgtttatgaagttattct

SEQ ID NO: 9159594 - DNA, 22 bp, Homo sapiens
tttgtgtttatgaagttattct

SEQ ID NO: 9159595 - DNA, 22 bp, Homo sapiens
ttttaacactcagcactatctc

SEQ ID NO: 9159596 - DNA, 21 bp, Homo sapiens
ttttaacaaggatttccctag

SEQ ID NO: 9159597 - DNA, 22 bp, Homo sapiens
ttttaacttaaaatacatagat

SEQ ID NO: 9159598 - DNA, 22 bp, Homo sapiens
ttttaaaggctgtatgaccaag

SEQ ID NO: 9159599 - DNA, 22 bp, Homo sapiens
ttttaaatctccagttgacccc

SEQ ID NO: 9159600 - DNA, 22 bp, Homo sapiens
ttttaaaggatactcttgtcta

SEQ ID NO: 9159601 - DNA, 22 bp, Homo sapiens
ttttaaactgcagaatttagaa

SEQ ID NO: 9159602 - DNA, 22 bp, Homo sapiens
ttttaaactgcagaatttagaa

SEQ ID NO: 9159603 - DNA, 22 bp, Homo sapiens
tttgttcaatccagacaatagc

SEQ ID NO: 9159604 - DNA, 22 bp, Homo sapiens
tttgttcaatccagacaatagc

SEQ ID NO: 9159605 - DNA, 22 bp, Homo sapiens
ttttaattgcaattatggtccc

SEQ ID NO: 9159606 - DNA, 18 bp, Homo sapiens
ttttaatttcaggggtgg

SEQ ID NO: 9159607 - DNA, 23 bp, Homo sapiens
ttttaatttggacataagaagat

SEQ ID NO: 9159608 - DNA, 22 bp, Homo sapiens
ttttatgtaatccttactgtcg

SEQ ID NO: 9159609 - DNA, 22 bp, Homo sapiens
ttttaattcaaagtgaatagtg

SEQ ID NO: 9159610 - DNA, 22 bp, Homo sapiens
ttttaattcaaagtgaatagtg

SEQ ID NO: 9159611 - DNA, 22 bp, Homo sapiens
ttttaatgtgctctgcaatgat

SEQ ID NO: 9159612 - DNA, 22 bp, Homo sapiens
ttttaatcctcttggtatctta

SEQ ID NO: 9159613 - DNA, 22 bp, Homo sapiens
ttttaatcatgcttctatgtcc

SEQ ID NO: 9159614 - DNA, 22 bp, Homo sapiens
tttgaatgagaattattgtcat

SEQ ID NO: 9159615 - DNA, 22 bp, Homo sapiens
tttgaatatgtgcttgttaaat

SEQ ID NO: 9159616 - DNA, 22 bp, Homo sapiens
tttgaatatcacaaactttcaa

SEQ ID NO: 9159617 - DNA, 22 bp, Homo sapiens
tttgaatatacttcaaacaaag

SEQ ID NO: 9159618 - DNA, 22 bp, Homo sapiens
tttgaatatcacaaactttcaa

SEQ ID NO: 9159619 - DNA, 22 bp, Homo sapiens
tttgaatatcacaaactttcaa

SEQ ID NO: 9159620 - DNA, 22 bp, Homo sapiens
tttgaagataaatatggagaaa

SEQ ID NO: 9159621 - DNA, 22 bp, Homo sapiens
tttgaatagggctttgcaggga

SEQ ID NO: 9159622 - DNA, 22 bp, Homo sapiens
tttgaatagcataggattacat

SEQ ID NO: 9159623 - DNA, 22 bp, Homo sapiens
tttgacaattaggtagaaaaag

SEQ ID NO: 9159624 - DNA, 22 bp, Homo sapiens
tttgacaattaggtagaaaaag

SEQ ID NO: 9159625 - DNA, 22 bp, Homo sapiens
tttgacaattaggtagaaaaag

SEQ ID NO: 9159626 - DNA, 22 bp, Homo sapiens
tttgacaagagggcatcttcag

SEQ ID NO: 9159627 - DNA, 22 bp, Homo sapiens
tttgacaacagcaaatgtcaca

SEQ ID NO: 9159628 - DNA, 22 bp, Homo sapiens
tttgacaaccaggcaggtaaga

SEQ ID NO: 9159629 - DNA, 22 bp, Homo sapiens
tttgacaccaggagagaaaaca

SEQ ID NO: 9159630 - DNA, 20 bp, Homo sapiens
tttgacaccttgggagagac

SEQ ID NO: 9159631 - DNA, 22 bp, Homo sapiens
tttgacaattaggtagaaaaag

SEQ ID NO: 9159632 - DNA, 22 bp, Homo sapiens
tttgacaattcatgacatttat

SEQ ID NO: 9159633 - DNA, 19 bp, Homo sapiens
tttgacagagtttgagcat

SEQ ID NO: 9159634 - DNA, 22 bp, Homo sapiens
tttgacaacacgttatttgcct

SEQ ID NO: 9159635 - DNA, 22 bp, Homo sapiens
tttgacaaatccttcagcaatg

SEQ ID NO: 9159636 - DNA, 22 bp, Homo sapiens
tttgacaacacgttatttgcct

SEQ ID NO: 9159637 - DNA, 22 bp, Homo sapiens
tttgacaaaggaaaaatgcaca

SEQ ID NO: 9159638 - DNA, 22 bp, Homo sapiens
tttgacaaaattatgctaatat

SEQ ID NO: 9159639 - DNA, 22 bp, Homo sapiens
tttgaatgtgtgagttaacttt

SEQ ID NO: 9159640 - DNA, 22 bp, Homo sapiens
tttgaatgttttaggtacttaa

SEQ ID NO: 9159641 - DNA, 22 bp, Homo sapiens
tttgaatgcaggacatacagaa

SEQ ID NO: 9159642 - DNA, 22 bp, Homo sapiens
tttgaatggactgagaatcttg

SEQ ID NO: 9159643 - DNA, 22 bp, Homo sapiens
tttctttgtagtagcataatca

SEQ ID NO: 9159644 - DNA, 22 bp, Homo sapiens
tttctttgttgttatcacatca

SEQ ID NO: 9159645 - DNA, 22 bp, Homo sapiens
tttcttttacagtgtggctatt

SEQ ID NO: 9159646 - DNA, 22 bp, Homo sapiens
tttcttttacagtgtggctatt

SEQ ID NO: 9159647 - DNA, 21 bp, Homo sapiens
tttctttctggctctcacagt

SEQ ID NO: 9159648 - DNA, 21 bp, Homo sapiens
tttctttctggctctcacagt

SEQ ID NO: 9159649 - DNA, 22 bp, Homo sapiens
tttcttttgccctgtgggttag

SEQ ID NO: 9159650 - DNA, 22 bp, Homo sapiens
tttcttttgccctgtgggttag

SEQ ID NO: 9159651 - DNA, 22 bp, Homo sapiens
tttcttttgaatagtgtgtggt

SEQ ID NO: 9159652 - DNA, 22 bp, Homo sapiens
tttcttttgccctgtgggttag

SEQ ID NO: 9159653 - DNA, 22 bp, Homo sapiens
tttcttttgctgagaggggcac

SEQ ID NO: 9159654 - DNA, 22 bp, Homo sapiens
tttcttttgctgagaggggcac

SEQ ID NO: 9159655 - DNA, 22 bp, Homo sapiens
tttcttttgctgagaggggcac

SEQ ID NO: 9159656 - DNA, 22 bp, Homo sapiens
tttcttttccaatatccctact

SEQ ID NO: 9159657 - DNA, 22 bp, Homo sapiens
tttcttttccaatatccctact

SEQ ID NO: 9159658 - DNA, 22 bp, Homo sapiens
tttcttttccaatatccctact

SEQ ID NO: 9159659 - DNA, 19 bp, Homo sapiens
tttcttttcccctcagcac

SEQ ID NO: 9159660 - DNA, 19 bp, Homo sapiens
tttcttttcccctcagcac

SEQ ID NO: 9159661 - DNA, 19 bp, Homo sapiens
tttcttttcccctcagcac

SEQ ID NO: 9159662 - DNA, 22 bp, Homo sapiens
tttcccctgaaagcaacctcct

SEQ ID NO: 9159663 - DNA, 17 bp, Homo sapiens
tttccctccttccactc

SEQ ID NO: 9159664 - DNA, 17 bp, Homo sapiens
tttccctccttccactc

SEQ ID NO: 9159665 - DNA, 22 bp, Homo sapiens
tttccctctcatctctattatt

SEQ ID NO: 9159666 - DNA, 22 bp, Homo sapiens
tttccctctcatctctattatt

SEQ ID NO: 9159667 - DNA, 22 bp, Homo sapiens
tttccctctgtgccagcttctc

SEQ ID NO: 9159668 - DNA, 22 bp, Homo sapiens
tttccctgaggcctggacatta

SEQ ID NO: 9159669 - DNA, 22 bp, Homo sapiens
tttcctctccggggcctccagg

SEQ ID NO: 9159670 - DNA, 22 bp, Homo sapiens
tttcctctccggggcctccagg

SEQ ID NO: 9159671 - DNA, 22 bp, Homo sapiens
tttcctcatttatctgctggga

SEQ ID NO: 9159672 - DNA, 22 bp, Homo sapiens
tttcctcacttcatgagagttt

SEQ ID NO: 9159673 - DNA, 22 bp, Homo sapiens
tttcctctaaacgcatttgctt

SEQ ID NO: 9159674 - DNA, 22 bp, Homo sapiens
tttcctcctagcctccagccgc

SEQ ID NO: 9159675 - DNA, 22 bp, Homo sapiens
tttcctcctagcctccagccgc

SEQ ID NO: 9159676 - DNA, 17 bp, Homo sapiens
tttggaaagtgatcatt

SEQ ID NO: 9159677 - DNA, 22 bp, Homo sapiens
tttggaaagacacacagtttta

SEQ ID NO: 9159678 - DNA, 22 bp, Homo sapiens
tttggaaagacacacagtttta

SEQ ID NO: 9159679 - DNA, 22 bp, Homo sapiens
tttggaaagttgtcactttaga

SEQ ID NO: 9159680 - DNA, 22 bp, Homo sapiens
tttggaaagtgtgatttcaagg

SEQ ID NO: 9159681 - DNA, 22 bp, Homo sapiens
tttggaaataattccatctcat

SEQ ID NO: 9159682 - DNA, 22 bp, Homo sapiens
tttggaaagttgtcactttaga

SEQ ID NO: 9159683 - DNA, 22 bp, Homo sapiens
tttggaaatgagaagccacctt

SEQ ID NO: 9159684 - DNA, 22 bp, Homo sapiens
tttggaaatttcatcaatagcc

SEQ ID NO: 9159685 - DNA, 22 bp, Homo sapiens
tttggaaactgcctcagctctt

SEQ ID NO: 9159686 - DNA, 22 bp, Homo sapiens
tttggaaacacggtcatcttcc

SEQ ID NO: 9159687 - DNA, 22 bp, Homo sapiens
tttggaaacacggtcatcttcc

SEQ ID NO: 9159688 - DNA, 22 bp, Homo sapiens
tttggaaaatattgaactggtt

SEQ ID NO: 9159689 - DNA, 22 bp, Homo sapiens
tttggtcttggatttatcagtg

SEQ ID NO: 9159690 - DNA, 22 bp, Homo sapiens
tttggtcttttgtaagttatct

SEQ ID NO: 9159691 - DNA, 22 bp, Homo sapiens
tttggtgatagtgcagagaaat

SEQ ID NO: 9159692 - DNA, 22 bp, Homo sapiens
tttggtgtctgaaaataacagt

SEQ ID NO: 9159693 - DNA, 22 bp, Homo sapiens
tttggttcttatctttggagat

SEQ ID NO: 9159694 - DNA, 22 bp, Homo sapiens
tttgtaaaagcccaagctgtag

SEQ ID NO: 9159695 - DNA, 22 bp, Homo sapiens
tttggtaagtcaggaatgcttc

SEQ ID NO: 9159696 - DNA, 22 bp, Homo sapiens
tttggtaagtcaggaatgcttc

SEQ ID NO: 9159697 - DNA, 17 bp, Homo sapiens
tttggtaatatattaag

SEQ ID NO: 9159698 - DNA, 22 bp, Homo sapiens
tttggtaagtacccacctgggt

SEQ ID NO: 9159699 - DNA, 22 bp, Homo sapiens
tttggtaagtatgaatgcagta

SEQ ID NO: 9159700 - DNA, 22 bp, Homo sapiens
tttggtaagtatgaatgcagta

SEQ ID NO: 9159701 - DNA, 17 bp, Homo sapiens
tttggtaatatattaag

SEQ ID NO: 9159702 - DNA, 22 bp, Homo sapiens
tttggtagtatcaatgtactca

SEQ ID NO: 9159703 - DNA, 22 bp, Homo sapiens
tttggtccaagttttactcttt

SEQ ID NO: 9159704 - DNA, 22 bp, Homo sapiens
tttgagttgcttatttaatagg

SEQ ID NO: 9159705 - DNA, 22 bp, Homo sapiens
tttgataacagtgaatatcatg

SEQ ID NO: 9159706 - DNA, 22 bp, Homo sapiens
tttgataacagtgaatatcatg

SEQ ID NO: 9159707 - DNA, 22 bp, Homo sapiens
tttgataagagctgctgaaact

SEQ ID NO: 9159708 - DNA, 22 bp, Homo sapiens
tttgataatacacaagagaaag

SEQ ID NO: 9159709 - DNA, 22 bp, Homo sapiens
tttgaggttagctagcagatca

SEQ ID NO: 9159710 - DNA, 22 bp, Homo sapiens
tttgaggttagctagcagatca

SEQ ID NO: 9159711 - DNA, 22 bp, Homo sapiens
tttgataattaaaaattgtagt

SEQ ID NO: 9159712 - DNA, 22 bp, Homo sapiens
tttgatatcctatacaagtaaa

SEQ ID NO: 9159713 - DNA, 19 bp, Homo sapiens
tttgatagggcataatata

SEQ ID NO: 9159714 - DNA, 22 bp, Homo sapiens
tttgataattaaaaattgtagt

SEQ ID NO: 9159715 - DNA, 22 bp, Homo sapiens
tttgctttgactgtcagcaagt

SEQ ID NO: 9159716 - DNA, 22 bp, Homo sapiens
tttgctttgactgtcagcaagt

SEQ ID NO: 9159717 - DNA, 22 bp, Homo sapiens
tttgctttgactgtcagcaagt

SEQ ID NO: 9159718 - DNA, 22 bp, Homo sapiens
tttgctttgggaggttgtctgg

SEQ ID NO: 9159719 - DNA, 22 bp, Homo sapiens
tttgctttgggaggttgtctgg

SEQ ID NO: 9159720 - DNA, 22 bp, Homo sapiens
tttgctttctgttgaacagagt

SEQ ID NO: 9159721 - DNA, 18 bp, Homo sapiens
tttgctttccttcttcag

SEQ ID NO: 9159722 - DNA, 22 bp, Homo sapiens
tttgctttctgttgaacagagt

SEQ ID NO: 9159723 - DNA, 22 bp, Homo sapiens
tttgctttcttgattcagatta

SEQ ID NO: 9159724 - DNA, 22 bp, Homo sapiens
tttgctttctgttgaacagagt

SEQ ID NO: 9159725 - DNA, 22 bp, Homo sapiens
tttgctttcccttgtagaaagt

SEQ ID NO: 9159726 - DNA, 22 bp, Homo sapiens
tttgcttgttcaagatttctgt

SEQ ID NO: 9159727 - DNA, 22 bp, Homo sapiens
tttgatttactggatattctca

SEQ ID NO: 9159728 - DNA, 19 bp, Homo sapiens
tttgatgagaatttaagca

SEQ ID NO: 9159729 - DNA, 22 bp, Homo sapiens
tttgatgtcaaaatatcctgtt

SEQ ID NO: 9159730 - DNA, 22 bp, Homo sapiens
tttgatttactggatattctca

SEQ ID NO: 9159731 - DNA, 22 bp, Homo sapiens
tttgattgtcacctaccttgca

SEQ ID NO: 9159732 - DNA, 22 bp, Homo sapiens
tttgattctgtaaaataacagg

SEQ ID NO: 9159733 - DNA, 22 bp, Homo sapiens
tttttagattactcagccacca

SEQ ID NO: 9159734 - DNA, 22 bp, Homo sapiens
tttttagagtgttaccagtata

SEQ ID NO: 9159735 - DNA, 22 bp, Homo sapiens
tttttagaattggctgagaatt

SEQ ID NO: 9159736 - DNA, 22 bp, Homo sapiens
tttttataactcttttgtgaca

SEQ ID NO: 9159737 - DNA, 22 bp, Homo sapiens
tttttataccacctctcactta

SEQ ID NO: 9159738 - DNA, 22 bp, Homo sapiens
tttttataccacctctcactta

SEQ ID NO: 9159739 - DNA, 22 bp, Homo sapiens
tttttataccacctctcactta

SEQ ID NO: 9159740 - DNA, 22 bp, Homo sapiens
ttttgttggcttaagaaataca

SEQ ID NO: 9159741 - DNA, 22 bp, Homo sapiens
ttttgttgtaatatacctatcc

SEQ ID NO: 9159742 - DNA, 22 bp, Homo sapiens
ttttgtttaaaatcctggatgg

SEQ ID NO: 9159743 - DNA, 22 bp, Homo sapiens
ttttgtttaaaatcctggatgg

SEQ ID NO: 9159744 - DNA, 22 bp, Homo sapiens
ttttgtttgtgtccactgcagt

SEQ ID NO: 9159745 - DNA, 22 bp, Homo sapiens
tttttataccacctctcactta

SEQ ID NO: 9159746 - DNA, 22 bp, Homo sapiens
tttttatcttgtatgtgtctct

SEQ ID NO: 9159747 - DNA, 22 bp, Homo sapiens
tttttcagccatgaattacact

SEQ ID NO: 9159748 - DNA, 22 bp, Homo sapiens
gtgaatggggcaggaaggatgg

SEQ ID NO: 9159749 - DNA, 22 bp, Homo sapiens
gtgaatggggcaggaaggatgg

SEQ ID NO: 9159750 - DNA, 22 bp, Homo sapiens
gtgaattaaatatagccaggtc

SEQ ID NO: 9159751 - DNA, 22 bp, Homo sapiens
gtgaatactgtatctcaggaca

SEQ ID NO: 9159752 - DNA, 22 bp, Homo sapiens
gtgaagttggccagtttagttt

SEQ ID NO: 9159753 - DNA, 22 bp, Homo sapiens
gtgaagttttagtatatgtaga

SEQ ID NO: 9159754 - DNA, 22 bp, Homo sapiens
gtgaataactttctatgttaat

SEQ ID NO: 9159755 - DNA, 22 bp, Homo sapiens
gtgcaaaagtaattgcagtact

SEQ ID NO: 9159756 - DNA, 23 bp, Homo sapiens
gtgcagcagtgtctgcagtcatg

SEQ ID NO: 9159757 - DNA, 20 bp, Homo sapiens
gtgcagccaagctgagccgc

SEQ ID NO: 9159758 - DNA, 23 bp, Homo sapiens
gtgcagcagtgtctgcagtcatg

SEQ ID NO: 9159759 - DNA, 23 bp, Homo sapiens
gtgcagcagtgtctgcagtcatg

SEQ ID NO: 9159760 - DNA, 22 bp, Homo sapiens
gtgcagcaggggccctctcacc

SEQ ID NO: 9159761 - DNA, 23 bp, Homo sapiens
gtgcaaagatataccacatggct

SEQ ID NO: 9159762 - DNA, 22 bp, Homo sapiens
gtgcaaagtgcatggggaaggg

SEQ ID NO: 9159763 - DNA, 22 bp, Homo sapiens
gtgcagcttcctggtctcagcc

SEQ ID NO: 9159764 - DNA, 22 bp, Homo sapiens
gtgcagctggtggagtctgggg

SEQ ID NO: 9159765 - DNA, 22 bp, Homo sapiens
gtgcagctgtggtggagccagg

SEQ ID NO: 9159766 - DNA, 22 bp, Homo sapiens
gtgcaggagcaggagccatgtc

SEQ ID NO: 9159767 - DNA, 22 bp, Homo sapiens
gtgcaggacagcacatctcctg

SEQ ID NO: 9159768 - DNA, 22 bp, Homo sapiens
gtgcaggagccaggggtaggaa

SEQ ID NO: 9159769 - DNA, 22 bp, Homo sapiens
gtgcagctgcccaagcctgagc

SEQ ID NO: 9159770 - DNA, 22 bp, Homo sapiens
gtctccagaagcctagacagcc

SEQ ID NO: 9159771 - DNA, 20 bp, Homo sapiens
gtctccactgggggttaacc

SEQ ID NO: 9159772 - DNA, 20 bp, Homo sapiens
gtctccactgggggttaacc

SEQ ID NO: 9159773 - DNA, 22 bp, Homo sapiens
gtctcagttttccaaactgtca

SEQ ID NO: 9159774 - DNA, 22 bp, Homo sapiens
gtctcagtaagaaaggctcctg

SEQ ID NO: 9159775 - DNA, 22 bp, Homo sapiens
gtctcagggactgcttctgggg

SEQ ID NO: 9159776 - DNA, 22 bp, Homo sapiens
gtctctgggtgtgtgatgccaa

SEQ ID NO: 9159777 - DNA, 22 bp, Homo sapiens
gtctctggctttatgctggttt

SEQ ID NO: 9159778 - DNA, 22 bp, Homo sapiens
gtctccagaagcctagacagcc

SEQ ID NO: 9159779 - DNA, 22 bp, Homo sapiens
gtctctgggttaagcagtgcat

SEQ ID NO: 9159780 - DNA, 22 bp, Homo sapiens
gtctctgtcttaggccaggcct

SEQ ID NO: 9159781 - DNA, 22 bp, Homo sapiens
gtctctgtcttaggccaggcct

SEQ ID NO: 9159782 - DNA, 22 bp, Homo sapiens
gtctctgtcatttcaccttccc

SEQ ID NO: 9159783 - DNA, 22 bp, Homo sapiens
gtctctgtcacaactactcatc

SEQ ID NO: 9159784 - DNA, 22 bp, Homo sapiens
gtctctgggttaagcagtgcat

SEQ ID NO: 9159785 - DNA, 22 bp, Homo sapiens
gtctctgtggctggctccttcc

SEQ ID NO: 9159786 - DNA, 22 bp, Homo sapiens
gtctctgtgccttctccccacc

SEQ ID NO: 9159787 - DNA, 22 bp, Homo sapiens
gtctctgtgcccccatttccgt

SEQ ID NO: 9159788 - DNA, 17 bp, Homo sapiens
gtctctgtcttgctttt

SEQ ID NO: 9159789 - DNA, 22 bp, Homo sapiens
gtctcttagaaccttgttttgg

SEQ ID NO: 9159790 - DNA, 21 bp, Homo sapiens
gtctcttaaggctttggctca

SEQ ID NO: 9159791 - DNA, 22 bp, Homo sapiens
gtctctgttatttccagggtca

SEQ ID NO: 9159792 - DNA, 22 bp, Homo sapiens
gtctcttagaatcgcatattgt

SEQ ID NO: 9159793 - DNA, 22 bp, Homo sapiens
gtctctgtgtctgagagagccc

SEQ ID NO: 9159794 - DNA, 22 bp, Homo sapiens
gtctctgtgtctgagagagccc

SEQ ID NO: 9159795 - DNA, 22 bp, Homo sapiens
gtctctgtggtacgtttcatcc

SEQ ID NO: 9159796 - DNA, 22 bp, Homo sapiens
gtctttggatgtaagataaagt

SEQ ID NO: 9159797 - DNA, 22 bp, Homo sapiens
gtgaaggtgtgagccagctgca

SEQ ID NO: 9159798 - DNA, 22 bp, Homo sapiens
gtgaagtgcaaagcagccagtt

SEQ ID NO: 9159799 - DNA, 22 bp, Homo sapiens
gtctttggagaggtgccatttc

SEQ ID NO: 9159800 - DNA, 22 bp, Homo sapiens
gtctttggagaggtgccatttc

SEQ ID NO: 9159801 - DNA, 18 bp, Homo sapiens
gtctttggagtggaggta

SEQ ID NO: 9159802 - DNA, 22 bp, Homo sapiens
gtctttggaggcactgttgagt

SEQ ID NO: 9159803 - DNA, 22 bp, Homo sapiens
gtctttcttaattcaagtgctt

SEQ ID NO: 9159804 - DNA, 22 bp, Homo sapiens
gtctttcttcagagcttggact

SEQ ID NO: 9159805 - DNA, 22 bp, Homo sapiens
gtctttcttcagagcttggact

SEQ ID NO: 9159806 - DNA, 22 bp, Homo sapiens
gtctttcttaattcaagtgctt

SEQ ID NO: 9159807 - DNA, 22 bp, Homo sapiens
gtctttcttaaacaacagaaca

SEQ ID NO: 9159808 - DNA, 22 bp, Homo sapiens
gtctttcttaaacaacagaaca

SEQ ID NO: 9159809 - DNA, 22 bp, Homo sapiens
gtctttcttaaacaacagaaca

SEQ ID NO: 9159810 - DNA, 22 bp, Homo sapiens
gtctttctatgcatagagcaga

SEQ ID NO: 9159811 - DNA, 22 bp, Homo sapiens
gtctttctctggaacagtaaaa

SEQ ID NO: 9159812 - DNA, 22 bp, Homo sapiens
gtctttctctggaacagtaaaa

SEQ ID NO: 9159813 - DNA, 22 bp, Homo sapiens
gtctttctgctgcacggactgc

SEQ ID NO: 9159814 - DNA, 22 bp, Homo sapiens
gtcttacccacagcatctagaa

SEQ ID NO: 9159815 - DNA, 22 bp, Homo sapiens
gtcttagatttcaccgataatg

SEQ ID NO: 9159816 - DNA, 22 bp, Homo sapiens
gtctcttagaatcgcatattgt

SEQ ID NO: 9159817 - DNA, 17 bp, Homo sapiens
gtctcttagcaccgtat

SEQ ID NO: 9159818 - DNA, 22 bp, Homo sapiens
gtctcttagtcaatattttctg

SEQ ID NO: 9159819 - DNA, 22 bp, Homo sapiens
gtctcttagtctcattttctgc

SEQ ID NO: 9159820 - DNA, 22 bp, Homo sapiens
gtctcttatgggcaggagcaca

SEQ ID NO: 9159821 - DNA, 22 bp, Homo sapiens
gtctcttagtctcattttctgc

SEQ ID NO: 9159822 - DNA, 22 bp, Homo sapiens
gtctcttagtcaatattttctg

SEQ ID NO: 9159823 - DNA, 22 bp, Homo sapiens
cagcagagcatttggtaggagg

SEQ ID NO: 9159824 - DNA, 22 bp, Homo sapiens
cagcagagcatttggtaggagg

SEQ ID NO: 9159825 - DNA, 22 bp, Homo sapiens
cagcagagcatttggtaggagg

SEQ ID NO: 9159826 - DNA, 22 bp, Homo sapiens
cagcagagctgggctttgaatt

SEQ ID NO: 9159827 - DNA, 22 bp, Homo sapiens
cagcagagctgggaataaaatt

SEQ ID NO: 9159828 - DNA, 22 bp, Homo sapiens
cagcagagctgggctttgaatt

SEQ ID NO: 9159829 - DNA, 22 bp, Homo sapiens
cagcagagacggtaagcagaac

SEQ ID NO: 9159830 - DNA, 22 bp, Homo sapiens
cagcagagacggtaagcagaac

SEQ ID NO: 9159831 - DNA, 22 bp, Homo sapiens
cagcagagacggtaagcagaac

SEQ ID NO: 9159832 - DNA, 23 bp, Homo sapiens
cagcagagagcagacctttgtgt

SEQ ID NO: 9159833 - DNA, 22 bp, Homo sapiens
cagcagagatgagattcctata

SEQ ID NO: 9159834 - DNA, 22 bp, Homo sapiens
cagcaggtcctgggcgtggcct

SEQ ID NO: 9159835 - DNA, 22 bp, Homo sapiens
cagcaggtctcagcagctcctt

SEQ ID NO: 9159836 - DNA, 22 bp, Homo sapiens
cagcaggtcccactgagggccc

SEQ ID NO: 9159837 - DNA, 22 bp, Homo sapiens
cagcaggtatgtttgttcagca

SEQ ID NO: 9159838 - DNA, 18 bp, Homo sapiens
cagcaggtagagtttggt

SEQ ID NO: 9159839 - DNA, 18 bp, Homo sapiens
cagcaggtagagtttggt

SEQ ID NO: 9159840 - DNA, 22 bp, Homo sapiens
cagcagggttaagtgactcacc

SEQ ID NO: 9159841 - DNA, 22 bp, Homo sapiens
cagcagagctgggctttgaatt

SEQ ID NO: 9159842 - DNA, 20 bp, Homo sapiens
cagcagtggatgagagtttt

SEQ ID NO: 9159843 - DNA, 20 bp, Homo sapiens
cagcagtggatgagagtttt

SEQ ID NO: 9159844 - DNA, 22 bp, Homo sapiens
cagcagtggctgcaggcagctg

SEQ ID NO: 9159845 - DNA, 22 bp, Homo sapiens
cagcagtggccatctgtgtggt

SEQ ID NO: 9159846 - DNA, 22 bp, Homo sapiens
cagcagtggaactacccaggga

SEQ ID NO: 9159847 - DNA, 22 bp, Homo sapiens
cagcagtggaactacccaggga

SEQ ID NO: 9159848 - DNA, 22 bp, Homo sapiens
cagcagtgcttcagtgtgagat

SEQ ID NO: 9159849 - DNA, 22 bp, Homo sapiens
cagcagtgatgtgtgagggttc

SEQ ID NO: 9159850 - DNA, 22 bp, Homo sapiens
cagcagtctgtttcaacaggtc

SEQ ID NO: 9159851 - DNA, 22 bp, Homo sapiens
cagcagtctgtttcaacaggtc

SEQ ID NO: 9159852 - DNA, 22 bp, Homo sapiens
cagcagtagtctctgtggcttt

SEQ ID NO: 9159853 - DNA, 22 bp, Homo sapiens
cagcaggtggacacactcacct

SEQ ID NO: 9159854 - DNA, 21 bp, Homo sapiens
cagcaggtggagcctcttgtc

SEQ ID NO: 9159855 - DNA, 22 bp, Homo sapiens
cagcagtaactcccgtgcagca

SEQ ID NO: 9159856 - DNA, 22 bp, Homo sapiens
cagcagtagtctctgtggcttt

SEQ ID NO: 9159857 - DNA, 22 bp, Homo sapiens
cagcagtcacacaaactctgga

SEQ ID NO: 9159858 - DNA, 18 bp, Homo sapiens
cagcatcttcattaggcc

SEQ ID NO: 9159859 - DNA, 22 bp, Homo sapiens
cagcatcttgaagggtaaacca

SEQ ID NO: 9159860 - DNA, 22 bp, Homo sapiens
cagcatcttctccaaagctgcc

SEQ ID NO: 9159861 - DNA, 22 bp, Homo sapiens
cagcatgactcactgtggtcac

SEQ ID NO: 9159862 - DNA, 22 bp, Homo sapiens
cagcatgaaaagaataggccta

SEQ ID NO: 9159863 - DNA, 22 bp, Homo sapiens
cagcatgcagcccctggcagct

SEQ ID NO: 9159864 - DNA, 22 bp, Homo sapiens
gtcctgtgggcccaccatgagc

SEQ ID NO: 9159865 - DNA, 22 bp, Homo sapiens
gtcctgcaaagttcagcttgct

SEQ ID NO: 9159866 - DNA, 22 bp, Homo sapiens
gtcctgcaaagttcagcttgct

SEQ ID NO: 9159867 - DNA, 22 bp, Homo sapiens
gtcctgaggcaggatgggtttc

SEQ ID NO: 9159868 - DNA, 22 bp, Homo sapiens
gtcctgagccctcagcacagca

SEQ ID NO: 9159869 - DNA, 22 bp, Homo sapiens
gtcctgagatgtcacaaggttt

SEQ ID NO: 9159870 - DNA, 22 bp, Homo sapiens
gtcctgagatgtcacaaggttt

SEQ ID NO: 9159871 - DNA, 22 bp, Homo sapiens
gtcctgaatgcctttaggcaga

SEQ ID NO: 9159872 - DNA, 22 bp, Homo sapiens
gtcctcttgctcattggggcag

SEQ ID NO: 9159873 - DNA, 22 bp, Homo sapiens
gtcctcttagccacttaattat

SEQ ID NO: 9159874 - DNA, 22 bp, Homo sapiens
gtcctgaatgccttcatagtcc

SEQ ID NO: 9159875 - DNA, 22 bp, Homo sapiens
gtcctgaatgccttcatagtcc

SEQ ID NO: 9159876 - DNA, 22 bp, Homo sapiens
cagcagtggctgcaggcagctg

SEQ ID NO: 9159877 - DNA, 22 bp, Homo sapiens
gtcctaccatgaattcactcca

SEQ ID NO: 9159878 - DNA, 22 bp, Homo sapiens
gtcctctgtgtaggctgcagac

SEQ ID NO: 9159879 - DNA, 22 bp, Homo sapiens
gtcctctgtttccatctgactt

SEQ ID NO: 9159880 - DNA, 22 bp, Homo sapiens
gtcctctgttagaaatgtgctt

SEQ ID NO: 9159881 - DNA, 22 bp, Homo sapiens
gtgcattaggctggaatgttga

SEQ ID NO: 9159882 - DNA, 22 bp, Homo sapiens
cagccctgtgcggagggccctg

SEQ ID NO: 9159883 - DNA, 22 bp, Homo sapiens
gtgcatggtaagatgcttcaca

SEQ ID NO: 9159884 - DNA, 21 bp, Homo sapiens
gtgcatggagaaaggcttgct

SEQ ID NO: 9159885 - DNA, 22 bp, Homo sapiens
gtgcatgaagcaggcagctcct

SEQ ID NO: 9159886 - DNA, 22 bp, Homo sapiens
gtgcatgaagactcagaaagtc

SEQ ID NO: 9159887 - DNA, 22 bp, Homo sapiens
gtgcatgaagactcagaaagtc

SEQ ID NO: 9159888 - DNA, 22 bp, Homo sapiens
gtgcatgaacaggagcctaagc

SEQ ID NO: 9159889 - DNA, 21 bp, Homo sapiens
gtgcatgagggaggatagcaa

SEQ ID NO: 9159890 - DNA, 22 bp, Homo sapiens
gtgcaggaggatgacaactgca

SEQ ID NO: 9159891 - DNA, 22 bp, Homo sapiens
gtgcatccactagggctctccc

SEQ ID NO: 9159892 - DNA, 22 bp, Homo sapiens
gtgcaggagctcccgcagtggt

SEQ ID NO: 9159893 - DNA, 22 bp, Homo sapiens
gtgcaggagccaggggtaggaa

SEQ ID NO: 9159894 - DNA, 22 bp, Homo sapiens
gtgcaggagctcccgcagtggt

SEQ ID NO: 9159895 - DNA, 22 bp, Homo sapiens
gtgcaggagcttctggcctgac

SEQ ID NO: 9159896 - DNA, 22 bp, Homo sapiens
gtgcaggagcttctggcctgac

SEQ ID NO: 9159897 - DNA, 20 bp, Homo sapiens
cagcctccactcactcagct

SEQ ID NO: 9159898 - DNA, 22 bp, Homo sapiens
gtgccctgacacacctggtgtg

SEQ ID NO: 9159899 - DNA, 22 bp, Homo sapiens
gtgcctgggacttgctccggat

SEQ ID NO: 9159900 - DNA, 22 bp, Homo sapiens
gtgcctgggacttgctccggat

SEQ ID NO: 9159901 - DNA, 22 bp, Homo sapiens
gtgcctgggggtaatgtaggat

SEQ ID NO: 9159902 - DNA, 20 bp, Homo sapiens
cagcccttgatttacaatcc

SEQ ID NO: 9159903 - DNA, 23 bp, Homo sapiens
cagcccttcctgcatgtttttgt

SEQ ID NO: 9159904 - DNA, 22 bp, Homo sapiens
cagcccttaagagtcatccctc

SEQ ID NO: 9159905 - DNA, 22 bp, Homo sapiens
cagcccttcagggggctgcagg

SEQ ID NO: 9159906 - DNA, 22 bp, Homo sapiens
cagcccttaaatagatatacag

SEQ ID NO: 9159907 - DNA, 20 bp, Homo sapiens
cagccctttatcctcctatg

SEQ ID NO: 9159908 - DNA, 22 bp, Homo sapiens
cagcccttgtttctaaagctgc

SEQ ID NO: 9159909 - DNA, 22 bp, Homo sapiens
cagcccttggctggctccttgc

SEQ ID NO: 9159910 - DNA, 22 bp, Homo sapiens
cagcccttttttggtacaaccg

SEQ ID NO: 9159911 - DNA, 22 bp, Homo sapiens
cagccctttccttctcagcttt

SEQ ID NO: 9159912 - DNA, 22 bp, Homo sapiens
cagccctttccttctcagcttt

SEQ ID NO: 9159913 - DNA, 22 bp, Homo sapiens
cagccgcgctcgtgccagacag

SEQ ID NO: 9159914 - DNA, 19 bp, Homo sapiens
cagcctcaatccctcgggc

SEQ ID NO: 9159915 - DNA, 20 bp, Homo sapiens
cagccctttatcctcctatg

SEQ ID NO: 9159916 - DNA, 21 bp, Homo sapiens
cagctccactaaagcagctgt

SEQ ID NO: 9159917 - DNA, 22 bp, Homo sapiens
cagctccagcccaggcagctcc

SEQ ID NO: 9159918 - DNA, 22 bp, Homo sapiens
gtgctgaggtgggtgggcagcc

SEQ ID NO: 9159919 - DNA, 22 bp, Homo sapiens
cagctccaaagccccactgtcc

SEQ ID NO: 9159920 - DNA, 23 bp, Homo sapiens
cagctcagcacataggaggtact

SEQ ID NO: 9159921 - DNA, 22 bp, Homo sapiens
cagctccagccgactgtaagaa

SEQ ID NO: 9159922 - DNA, 22 bp, Homo sapiens
cagctccagcccaggcagctcc

SEQ ID NO: 9159923 - DNA, 22 bp, Homo sapiens
cagctccagctctgggcgcctc

SEQ ID NO: 9159924 - DNA, 22 bp, Homo sapiens
cagctccatcttgcttatacca

SEQ ID NO: 9159925 - DNA, 23 bp, Homo sapiens
cagctccagtgcactcaggtagc

SEQ ID NO: 9159926 - DNA, 22 bp, Homo sapiens
cagctcccagtggcagctcctt

SEQ ID NO: 9159927 - DNA, 22 bp, Homo sapiens
cagctcccagtggcagctcctt

SEQ ID NO: 9159928 - DNA, 22 bp, Homo sapiens
cagctcccagtggcagctcctt

SEQ ID NO: 9159929 - DNA, 22 bp, Homo sapiens
cagctcccagagtgaccagcag

SEQ ID NO: 9159930 - DNA, 22 bp, Homo sapiens
cagctcccagagtgaccagcag

SEQ ID NO: 9159931 - DNA, 22 bp, Homo sapiens
cagctcccagaactgaccatgt

SEQ ID NO: 9159932 - DNA, 19 bp, Homo sapiens
gtgctgagatgtggtacta

SEQ ID NO: 9159933 - DNA, 22 bp, Homo sapiens
gtgctgagcacagctgcccagg

SEQ ID NO: 9159934 - DNA, 22 bp, Homo sapiens
gtgctgagcacaaggcccagag

SEQ ID NO: 9159935 - DNA, 22 bp, Homo sapiens
gtgctgagcacaaggcccagag

SEQ ID NO: 9159936 - DNA, 22 bp, Homo sapiens
gtgctgagctgcagatgcgctc

SEQ ID NO: 9159937 - DNA, 22 bp, Homo sapiens
gtgctgagatcttccctcactg

SEQ ID NO: 9159938 - DNA, 22 bp, Homo sapiens
gtgcctggggttgagctatgaa

SEQ ID NO: 9159939 - DNA, 22 bp, Homo sapiens
cagctcctagatcggcgaagtg

SEQ ID NO: 9159940 - DNA, 22 bp, Homo sapiens
cagctcctctgttagccctggg

SEQ ID NO: 9159941 - DNA, 22 bp, Homo sapiens
cagctcctcacgagtcttgaaa

SEQ ID NO: 9159942 - DNA, 22 bp, Homo sapiens
cagctcctgcagctgctgccgt

SEQ ID NO: 9159943 - DNA, 22 bp, Homo sapiens
cagctcctgcagctggctccca

SEQ ID NO: 9159944 - DNA, 22 bp, Homo sapiens
cagctcctctgttagccctggg

SEQ ID NO: 9159945 - DNA, 22 bp, Homo sapiens
cagctctgaggaacactccttt

SEQ ID NO: 9159946 - DNA, 21 bp, Homo sapiens
cagctctgagatttctactag

SEQ ID NO: 9159947 - DNA, 22 bp, Homo sapiens
cagctctgaggaacactccttt

SEQ ID NO: 9159948 - DNA, 17 bp, Homo sapiens
cagctctgcagacttcc

SEQ ID NO: 9159949 - DNA, 22 bp, Homo sapiens
ggtgtctgatggtggcttctca

SEQ ID NO: 9159950 - DNA, 22 bp, Homo sapiens
ggtgtctatgattcagtttatg

SEQ ID NO: 9159951 - DNA, 22 bp, Homo sapiens
ggtgtctatgattcagtttatg

SEQ ID NO: 9159952 - DNA, 22 bp, Homo sapiens
ggtgtctgcttccctccagctg

SEQ ID NO: 9159953 - DNA, 22 bp, Homo sapiens
ggtgtctgcttccctccagctg

SEQ ID NO: 9159954 - DNA, 22 bp, Homo sapiens
ggtgtctgcttccctccagctg

SEQ ID NO: 9159955 - DNA, 22 bp, Homo sapiens
ggtgtctggacagtgagccagg

SEQ ID NO: 9159956 - DNA, 19 bp, Homo sapiens
ggtgtgaagtgaggagtta

SEQ ID NO: 9159957 - DNA, 22 bp, Homo sapiens
ggtgtctgttgcctcctggtta

SEQ ID NO: 9159958 - DNA, 22 bp, Homo sapiens
cagcagaagtccgactccagtc

SEQ ID NO: 9159959 - DNA, 22 bp, Homo sapiens
cagcagagaaattacatatttg

SEQ ID NO: 9159960 - DNA, 22 bp, Homo sapiens
cagcagagaaattaaacttctg

SEQ ID NO: 9159961 - DNA, 18 bp, Homo sapiens
cagcagagacattcaaaa

SEQ ID NO: 9159962 - DNA, 22 bp, Homo sapiens
cagcagagaccaagtgatttga

SEQ ID NO: 9159963 - DNA, 22 bp, Homo sapiens
cagcagagaccaagtgatttga

SEQ ID NO: 9159964 - DNA, 22 bp, Homo sapiens
gtaacattttgagcagtaggct

SEQ ID NO: 9159965 - DNA, 16 bp, Homo sapiens
gtaacattctgtagcc

SEQ ID NO: 9159966 - DNA, 22 bp, Homo sapiens
gtaacatttacagttcctagag

SEQ ID NO: 9159967 - DNA, 22 bp, Homo sapiens
gtaacattctagaaacttaaca

SEQ ID NO: 9159968 - DNA, 22 bp, Homo sapiens
gtaactctttggaaaacatttt

SEQ ID NO: 9159969 - DNA, 22 bp, Homo sapiens
gtaactctgggtagaactcatg

SEQ ID NO: 9159970 - DNA, 20 bp, Homo sapiens
gtaactctggctaagtaaat

SEQ ID NO: 9159971 - DNA, 22 bp, Homo sapiens
gtaactggttttcttccctctc

SEQ ID NO: 9159972 - DNA, 23 bp, Homo sapiens
gtaactggggaatttgagctatg

SEQ ID NO: 9159973 - DNA, 22 bp, Homo sapiens
ggtgtgactcgccctcagggac

SEQ ID NO: 9159974 - DNA, 22 bp, Homo sapiens
ggtgtgaattttgaccttttaa

SEQ ID NO: 9159975 - DNA, 22 bp, Homo sapiens
ggtgtgaaatgttcagtgttac

SEQ ID NO: 9159976 - DNA, 22 bp, Homo sapiens
ggtgtgcagtagcaggaggcct

SEQ ID NO: 9159977 - DNA, 20 bp, Homo sapiens
cagcagagacccatggggag

SEQ ID NO: 9159978 - DNA, 20 bp, Homo sapiens
cagcagagacccatggggag

SEQ ID NO: 9159979 - DNA, 22 bp, Homo sapiens
gtaacttaccattgtagcatca

SEQ ID NO: 9159980 - DNA, 22 bp, Homo sapiens
gtaacttatcatttcaatatag

SEQ ID NO: 9159981 - DNA, 22 bp, Homo sapiens
gtaagattagtgagtcacagtg

SEQ ID NO: 9159982 - DNA, 22 bp, Homo sapiens
gtaagatttaaaatagcaattg

SEQ ID NO: 9159983 - DNA, 22 bp, Homo sapiens
cagcagaagcaacattcaggct

SEQ ID NO: 9159984 - DNA, 21 bp, Homo sapiens
cagcagaagcatctatggaag

SEQ ID NO: 9159985 - DNA, 22 bp, Homo sapiens
cagcagaacagttaaagaaacc

SEQ ID NO: 9159986 - DNA, 22 bp, Homo sapiens
cagcagaacagttaaagaaacc

SEQ ID NO: 9159987 - DNA, 22 bp, Homo sapiens
cagcagaacaggcagggaagct

SEQ ID NO: 9159988 - DNA, 22 bp, Homo sapiens
ggtgggaaggccactgaaggtt

SEQ ID NO: 9159989 - DNA, 22 bp, Homo sapiens
ggtgggaaggggccagtgtgcg

SEQ ID NO: 9159990 - DNA, 22 bp, Homo sapiens
ggtgggaaggggccagtgtgcg

SEQ ID NO: 9159991 - DNA, 22 bp, Homo sapiens
ggtggctgtgagcattatgtga

SEQ ID NO: 9159992 - DNA, 22 bp, Homo sapiens
ggtggctggttttataagaggt

SEQ ID NO: 9159993 - DNA, 22 bp, Homo sapiens
ggtggctggttttataagaggt

SEQ ID NO: 9159994 - DNA, 18 bp, Homo sapiens
ggtggctggggacggaca

SEQ ID NO: 9159995 - DNA, 18 bp, Homo sapiens
ggtggctggggacggaca

SEQ ID NO: 9159996 - DNA, 22 bp, Homo sapiens
ggtggctgggattagtagccca

SEQ ID NO: 9159997 - DNA, 22 bp, Homo sapiens
ggtggctggaggagctgatgga

SEQ ID NO: 9159998 - DNA, 22 bp, Homo sapiens
ggtggctggaggagctgatgga

SEQ ID NO: 9159999 - DNA, 22 bp, Homo sapiens
ggtggctgcttcctcaagagga

SEQ ID NO: 9160000 - DNA, 22 bp, Homo sapiens
ggtggcagtgcttgcgggtcta

SEQ ID NO: 9160001 - DNA, 22 bp, Homo sapiens
cagatggaacacagaaaggaga

SEQ ID NO: 9160002 - DNA, 22 bp, Homo sapiens
cagatgcttgttggctggtctc

SEQ ID NO: 9160003 - DNA, 22 bp, Homo sapiens
cagatggaacacagaaaggaga

SEQ ID NO: 9160004 - DNA, 22 bp, Homo sapiens
cagatggaaggcatagaggttt

SEQ ID NO: 9160005 - DNA, 22 bp, Homo sapiens
cagatggaaggcatagaggttt

SEQ ID NO: 9160006 - DNA, 22 bp, Homo sapiens
cagatggcaacagctctgtgac

SEQ ID NO: 9160007 - DNA, 22 bp, Homo sapiens
cagatggaggataaaacatgca

SEQ ID NO: 9160008 - DNA, 22 bp, Homo sapiens
ggtgctggttcagggtggctgt

SEQ ID NO: 9160009 - DNA, 22 bp, Homo sapiens
ggtgctggttcagggtggctgt

SEQ ID NO: 9160010 - DNA, 22 bp, Homo sapiens
ggtggcagtagcactgggcctg

SEQ ID NO: 9160011 - DNA, 22 bp, Homo sapiens
ggtggcagtagcactgggcctg

SEQ ID NO: 9160012 - DNA, 22 bp, Homo sapiens
cagatagcgtttgagagcataa

SEQ ID NO: 9160013 - DNA, 22 bp, Homo sapiens
cagatagcaatttgggcagggg

SEQ ID NO: 9160014 - DNA, 22 bp, Homo sapiens
cagatagcaaatgggtaagcta

SEQ ID NO: 9160015 - DNA, 22 bp, Homo sapiens
cagatagctgactactcttctt

SEQ ID NO: 9160016 - DNA, 22 bp, Homo sapiens
cagatagctgtaaataaatgga

SEQ ID NO: 9160017 - DNA, 22 bp, Homo sapiens
cagatacattaaaatgatgatt

SEQ ID NO: 9160018 - DNA, 22 bp, Homo sapiens
cagataaaggcttactagtagt

SEQ ID NO: 9160019 - DNA, 22 bp, Homo sapiens
cagataaaattaatattaccaa

SEQ ID NO: 9160020 - DNA, 22 bp, Homo sapiens
cagataaatagatagataaact

SEQ ID NO: 9160021 - DNA, 22 bp, Homo sapiens
cagataaatagacttggtcaga

SEQ ID NO: 9160022 - DNA, 22 bp, Homo sapiens
cagataataatatgacttcact

SEQ ID NO: 9160023 - DNA, 22 bp, Homo sapiens
cagatgcttcgtgggtgagcac

SEQ ID NO: 9160024 - DNA, 22 bp, Homo sapiens
cagatgctatagtgctgccata

SEQ ID NO: 9160025 - DNA, 22 bp, Homo sapiens
ggtgcagctggacagagaagcc

SEQ ID NO: 9160026 - DNA, 22 bp, Homo sapiens
ggtgcagcctttgtttctactt

SEQ ID NO: 9160027 - DNA, 18 bp, Homo sapiens
cagatgctaggcctccag

SEQ ID NO: 9160028 - DNA, 22 bp, Homo sapiens
ggtgcagcagtttgttcagctt

SEQ ID NO: 9160029 - DNA, 22 bp, Homo sapiens
ggtgagaggcagaggacagctt

SEQ ID NO: 9160030 - DNA, 22 bp, Homo sapiens
ggggtctgggttgctcggcctt

SEQ ID NO: 9160031 - DNA, 22 bp, Homo sapiens
ggggtctgggttgctcggcctt

SEQ ID NO: 9160032 - DNA, 23 bp, Homo sapiens
ggggtcttggaacaggtggccct

SEQ ID NO: 9160033 - DNA, 22 bp, Homo sapiens
cagagtgaaaactgagctcaaa

SEQ ID NO: 9160034 - DNA, 22 bp, Homo sapiens
ggggtgagatcaaggaagccct

SEQ ID NO: 9160035 - DNA, 22 bp, Homo sapiens
ggggtgagatcaaggaagccct

SEQ ID NO: 9160036 - DNA, 22 bp, Homo sapiens
ggggtcctggaggccagctgga

SEQ ID NO: 9160037 - DNA, 22 bp, Homo sapiens
ggggtcctggaggccagctgga

SEQ ID NO: 9160038 - DNA, 22 bp, Homo sapiens
ggggtcctcggagcctgggtct

SEQ ID NO: 9160039 - DNA, 22 bp, Homo sapiens
ggggtcctcggagcctgggtct

SEQ ID NO: 9160040 - DNA, 22 bp, Homo sapiens
ggggtctgcgccactgtctgcg

SEQ ID NO: 9160041 - DNA, 18 bp, Homo sapiens
cagagtgggccaagagac

SEQ ID NO: 9160042 - DNA, 22 bp, Homo sapiens
cagagtttgcaagggcagaagc

SEQ ID NO: 9160043 - DNA, 22 bp, Homo sapiens
cagagttcaaagcctgctggga

SEQ ID NO: 9160044 - DNA, 22 bp, Homo sapiens
cagaggctgccagccatgtgca

SEQ ID NO: 9160045 - DNA, 22 bp, Homo sapiens
cagaggctgccagccatgtgca

SEQ ID NO: 9160046 - DNA, 22 bp, Homo sapiens
cagaggctgccagccatgtgca

SEQ ID NO: 9160047 - DNA, 22 bp, Homo sapiens
cagaggctgccagccatgtgca

SEQ ID NO: 9160048 - DNA, 22 bp, Homo sapiens
cagaggctgatgtgggatgggc

SEQ ID NO: 9160049 - DNA, 22 bp, Homo sapiens
ggggtagggtgattgtgaagta

SEQ ID NO: 9160050 - DNA, 22 bp, Homo sapiens
ggggtagggtgattgtgaagta

SEQ ID NO: 9160051 - DNA, 22 bp, Homo sapiens
ggggtaggtcatagcccctcta

SEQ ID NO: 9160052 - DNA, 22 bp, Homo sapiens
cagaggctgaccctgctgttgt

SEQ ID NO: 9160053 - DNA, 22 bp, Homo sapiens
cagaggcaggataagaactgcg

SEQ ID NO: 9160054 - DNA, 22 bp, Homo sapiens
cagaggcaggataagaactgcg

SEQ ID NO: 9160055 - DNA, 22 bp, Homo sapiens
cagaggcaggaagatgggcagt

SEQ ID NO: 9160056 - DNA, 22 bp, Homo sapiens
cagaggctgatggctgtagcca

SEQ ID NO: 9160057 - DNA, 16 bp, Homo sapiens
cagagaggacagaggc

SEQ ID NO: 9160058 - DNA, 22 bp, Homo sapiens
cagagagcttagtgtgctgcat

SEQ ID NO: 9160059 - DNA, 22 bp, Homo sapiens
cagagagagtctgtccctgaag

SEQ ID NO: 9160060 - DNA, 22 bp, Homo sapiens
cagagagagtctgtccctgaag

SEQ ID NO: 9160061 - DNA, 22 bp, Homo sapiens
cagagagagtctgtccctgaag

SEQ ID NO: 9160062 - DNA, 22 bp, Homo sapiens
cagagagagtggggtgtggatt

SEQ ID NO: 9160063 - DNA, 22 bp, Homo sapiens
cagagagagtggggtgtggatt

SEQ ID NO: 9160064 - DNA, 22 bp, Homo sapiens
cagagagagtggggtgtggatt

SEQ ID NO: 9160065 - DNA, 22 bp, Homo sapiens
gggccctggacgtggcggcaga

SEQ ID NO: 9160066 - DNA, 22 bp, Homo sapiens
gggccctggatttaagcatgga

SEQ ID NO: 9160067 - DNA, 22 bp, Homo sapiens
gggccctggatttaagcatgga

SEQ ID NO: 9160068 - DNA, 22 bp, Homo sapiens
gggccctggccgaatccctctg

SEQ ID NO: 9160069 - DNA, 22 bp, Homo sapiens
gggccctggacgtggcggcaga

SEQ ID NO: 9160070 - DNA, 22 bp, Homo sapiens
cagagcagcctccagggggagc

SEQ ID NO: 9160071 - DNA, 22 bp, Homo sapiens
cagagcagcctccagggggagc

SEQ ID NO: 9160072 - DNA, 22 bp, Homo sapiens
cagagcagcctccagggggagc

SEQ ID NO: 9160073 - DNA, 21 bp, Homo sapiens
cagagcagcgttctgctgtgg

SEQ ID NO: 9160074 - DNA, 21 bp, Homo sapiens
cagagcagcgttctgctgtgg

SEQ ID NO: 9160075 - DNA, 21 bp, Homo sapiens
cagagcagcgttctgctgtgg

SEQ ID NO: 9160076 - DNA, 17 bp, Homo sapiens
gggcgcgggtagagccc

SEQ ID NO: 9160077 - DNA, 18 bp, Homo sapiens
gggccctggcgtccgccc

SEQ ID NO: 9160078 - DNA, 22 bp, Homo sapiens
gggccctggctttcctgttctt

SEQ ID NO: 9160079 - DNA, 22 bp, Homo sapiens
gggccctggctttcctgttctt

SEQ ID NO: 9160080 - DNA, 20 bp, Homo sapiens
gggccctgggattcagagca

SEQ ID NO: 9160081 - DNA, 18 bp, Homo sapiens
cagagcagaggtggagcg

SEQ ID NO: 9160082 - DNA, 18 bp, Homo sapiens
cagagcagaggtggagcg

SEQ ID NO: 9160083 - DNA, 22 bp, Homo sapiens
cagagcagcagagcttccatgg

SEQ ID NO: 9160084 - DNA, 22 bp, Homo sapiens
cagagcagatttctaagtattg

SEQ ID NO: 9160085 - DNA, 22 bp, Homo sapiens
cagagcagagtgattgttctgg

SEQ ID NO: 9160086 - DNA, 22 bp, Homo sapiens
cagagcagagtgattgttctgg

SEQ ID NO: 9160087 - DNA, 22 bp, Homo sapiens
cagagacagtttcacagggtct

SEQ ID NO: 9160088 - DNA, 20 bp, Homo sapiens
cagagacctgtcttcacaga

SEQ ID NO: 9160089 - DNA, 22 bp, Homo sapiens
cagagagaatatgtagtatgga

SEQ ID NO: 9160090 - DNA, 22 bp, Homo sapiens
cagagactggagtgcagtggcg

SEQ ID NO: 9160091 - DNA, 22 bp, Homo sapiens
cagagagaatcttggcagctga

SEQ ID NO: 9160092 - DNA, 22 bp, Homo sapiens
cagagagaatcttggcagctga

SEQ ID NO: 9160093 - DNA, 22 bp, Homo sapiens
cagagagaatcttggcagctga

SEQ ID NO: 9160094 - DNA, 22 bp, Homo sapiens
cagagagaatcttggcagctga

SEQ ID NO: 9160095 - DNA, 22 bp, Homo sapiens
cagagagagcaggaaacctccg

SEQ ID NO: 9160096 - DNA, 22 bp, Homo sapiens
cagagagagcaggaaacctccg

SEQ ID NO: 9160097 - DNA, 19 bp, Homo sapiens
cagagagaccaaggcgcca

SEQ ID NO: 9160098 - DNA, 22 bp, Homo sapiens
cagagagaggccactgctatta

SEQ ID NO: 9160099 - DNA, 22 bp, Homo sapiens
cagagagaggggctgcctggcc

SEQ ID NO: 9160100 - DNA, 22 bp, Homo sapiens
cagagagagtcaaatctttgct

SEQ ID NO: 9160101 - DNA, 20 bp, Homo sapiens
cagaagcaaggcaggtacct

SEQ ID NO: 9160102 - DNA, 22 bp, Homo sapiens
cagaagcaagtagtgattcttt

SEQ ID NO: 9160103 - DNA, 22 bp, Homo sapiens
cagaagcaagggccaaagtctt

SEQ ID NO: 9160104 - DNA, 22 bp, Homo sapiens
cagaagatgctttgtaaaatga

SEQ ID NO: 9160105 - DNA, 22 bp, Homo sapiens
cagaagcaaatgccttgctgag

SEQ ID NO: 9160106 - DNA, 22 bp, Homo sapiens
cagaagcaaatgccttgctgag

SEQ ID NO: 9160107 - DNA, 22 bp, Homo sapiens
cagaagagtagctgaacaagtt

SEQ ID NO: 9160108 - DNA, 22 bp, Homo sapiens
cagaagagtagctgaacaagtt

SEQ ID NO: 9160109 - DNA, 22 bp, Homo sapiens
cagaagagtagctgaacaagtt

SEQ ID NO: 9160110 - DNA, 22 bp, Homo sapiens
cagaagcagaacactagattta

SEQ ID NO: 9160111 - DNA, 22 bp, Homo sapiens
cagaagcactaggaggaaacgt

SEQ ID NO: 9160112 - DNA, 22 bp, Homo sapiens
cagaagcagattctaaagcaag

SEQ ID NO: 9160113 - DNA, 22 bp, Homo sapiens
cagaagcagattctaaagcaag

SEQ ID NO: 9160114 - DNA, 23 bp, Homo sapiens
cagaagcacctgttgactgctgc

SEQ ID NO: 9160115 - DNA, 22 bp, Homo sapiens
cagaagcacatgtttacatgta

SEQ ID NO: 9160116 - DNA, 22 bp, Homo sapiens
gggctcaggcctggcctctcac

SEQ ID NO: 9160117 - DNA, 22 bp, Homo sapiens
gggctcaggcctggcctctcac

SEQ ID NO: 9160118 - DNA, 22 bp, Homo sapiens
gggctcaggagtttgaggctgc

SEQ ID NO: 9160119 - DNA, 22 bp, Homo sapiens
gggctcaggcctggcctctcac

SEQ ID NO: 9160120 - DNA, 22 bp, Homo sapiens
gggctcagggacacatgtgtgt

SEQ ID NO: 9160121 - DNA, 22 bp, Homo sapiens
gggctcagggacacatgtgtgt

SEQ ID NO: 9160122 - DNA, 22 bp, Homo sapiens
gggctcagggacacatgtgtgt

SEQ ID NO: 9160123 - DNA, 22 bp, Homo sapiens
cagagcttcctgctgggcttct

SEQ ID NO: 9160124 - DNA, 22 bp, Homo sapiens
cagagcttctgacagctgctgc

SEQ ID NO: 9160125 - DNA, 22 bp, Homo sapiens
cagagctgtcatttgccagtga

SEQ ID NO: 9160126 - DNA, 22 bp, Homo sapiens
cagagctgtcatttgccagtga

SEQ ID NO: 9160127 - DNA, 22 bp, Homo sapiens
gggctctgcgctcagctccagc

SEQ ID NO: 9160128 - DNA, 22 bp, Homo sapiens
gggctctgcgctcagctccagc

SEQ ID NO: 9160129 - DNA, 22 bp, Homo sapiens
gggctctgcgctcagctccagc

SEQ ID NO: 9160130 - DNA, 20 bp, Homo sapiens
gggctctgcatccatcagcc

SEQ ID NO: 9160131 - DNA, 22 bp, Homo sapiens
cagaggaagagatacaagccct

SEQ ID NO: 9160132 - DNA, 22 bp, Homo sapiens
cagaggaaatgggaaggagata

SEQ ID NO: 9160133 - DNA, 22 bp, Homo sapiens
cagaggaaatgggaaggagata

SEQ ID NO: 9160134 - DNA, 22 bp, Homo sapiens
cagaggaaatgggaaggagata

SEQ ID NO: 9160135 - DNA, 22 bp, Homo sapiens
cagagctttgtgtcagggctgt

SEQ ID NO: 9160136 - DNA, 22 bp, Homo sapiens
cagagctttttacattaatgat

SEQ ID NO: 9160137 - DNA, 22 bp, Homo sapiens
cagaggaaagtatttctggaag

SEQ ID NO: 9160138 - DNA, 22 bp, Homo sapiens
cagagctttgtgtcagggctgt

SEQ ID NO: 9160139 - DNA, 22 bp, Homo sapiens
cagagctttctgtcacattagt

SEQ ID NO: 9160140 - DNA, 22 bp, Homo sapiens
cagagcttggctgtggttgtga

SEQ ID NO: 9160141 - DNA, 22 bp, Homo sapiens
cagagcttgaatgtccatggtt

SEQ ID NO: 9160142 - DNA, 22 bp, Homo sapiens
cagaggaagcagacacatcttg

SEQ ID NO: 9160143 - DNA, 22 bp, Homo sapiens
cagaggaagcagacacatcttg

SEQ ID NO: 9160144 - DNA, 22 bp, Homo sapiens
cagaggaagagatacaagccct

SEQ ID NO: 9160145 - DNA, 22 bp, Homo sapiens
cagaggaagctgggtgtggagt

SEQ ID NO: 9160146 - DNA, 22 bp, Homo sapiens
cagaggaagctgggtgtggagt

SEQ ID NO: 9160147 - DNA, 22 bp, Homo sapiens
cagaggaaggctctgggaatgt

SEQ ID NO: 9160148 - DNA, 22 bp, Homo sapiens
cagaggaagctgggtgtggagt

SEQ ID NO: 9160149 - DNA, 22 bp, Homo sapiens
cagaggaagggtgctgcgaaag

SEQ ID NO: 9160150 - DNA, 22 bp, Homo sapiens
cagaggaagggtgctgcgaaag

SEQ ID NO: 9160151 - DNA, 22 bp, Homo sapiens
cagaggaaggctctgggaatgt

SEQ ID NO: 9160152 - DNA, 22 bp, Homo sapiens
cagaggaagttccttgatgaga

SEQ ID NO: 9160153 - DNA, 22 bp, Homo sapiens
cagaggaagttccttgatgaga

SEQ ID NO: 9160154 - DNA, 22 bp, Homo sapiens
cagaggacaatagaatggaaag

SEQ ID NO: 9160155 - DNA, 22 bp, Homo sapiens
gggggaggtgaatgcaataagg

SEQ ID NO: 9160156 - DNA, 22 bp, Homo sapiens
gggggaggtgaatgcaataagg

SEQ ID NO: 9160157 - DNA, 22 bp, Homo sapiens
cagaggacaatagaatggaaag

SEQ ID NO: 9160158 - DNA, 22 bp, Homo sapiens
cagaggacatgaaaactcgctc

SEQ ID NO: 9160159 - DNA, 22 bp, Homo sapiens
cagaggacctgtgtggccagag

SEQ ID NO: 9160160 - DNA, 22 bp, Homo sapiens
ggggcggggctctgagaagcat

SEQ ID NO: 9160161 - DNA, 22 bp, Homo sapiens
cagaggcagaccctccagggcg

SEQ ID NO: 9160162 - DNA, 22 bp, Homo sapiens
cagaggcagaatggagatttgg

SEQ ID NO: 9160163 - DNA, 19 bp, Homo sapiens
cagaggcactttctcttag

SEQ ID NO: 9160164 - DNA, 22 bp, Homo sapiens
cagaggcagaatggagatttgg

SEQ ID NO: 9160165 - DNA, 22 bp, Homo sapiens
cagaggcaggaagatgggcagt

SEQ ID NO: 9160166 - DNA, 22 bp, Homo sapiens
cagaggcaggaagatgggcagt

SEQ ID NO: 9160167 - DNA, 22 bp, Homo sapiens
cagaggcagccgggggagaacg

SEQ ID NO: 9160168 - DNA, 22 bp, Homo sapiens
cagaggcagaggtcatctctgg

SEQ ID NO: 9160169 - DNA, 22 bp, Homo sapiens
cagaggcagaggtcatctctgg

SEQ ID NO: 9160170 - DNA, 22 bp, Homo sapiens
cagaggcagaggtcatctctgg

SEQ ID NO: 9160171 - DNA, 22 bp, Homo sapiens
cagaggcagccgggggagaacg

SEQ ID NO: 9160172 - DNA, 22 bp, Homo sapiens
gggggcagtaacctcaaagtgt

SEQ ID NO: 9160173 - DNA, 22 bp, Homo sapiens
gggggcagtaacctcaaagtgt

SEQ ID NO: 9160174 - DNA, 22 bp, Homo sapiens
gggggcagtaaggatatggaaa

SEQ ID NO: 9160175 - DNA, 19 bp, Homo sapiens
cagaggcactttctcttag

SEQ ID NO: 9160176 - DNA, 22 bp, Homo sapiens
gggggatgctcaggaggctgct

SEQ ID NO: 9160177 - DNA, 22 bp, Homo sapiens
gggggatgctcaggaggctgct

SEQ ID NO: 9160178 - DNA, 22 bp, Homo sapiens
gggggatgctcaggaggctgct

SEQ ID NO: 9160179 - DNA, 22 bp, Homo sapiens
gggggcaggtctggaactttga

SEQ ID NO: 9160180 - DNA, 22 bp, Homo sapiens
gggggcaggtctggaactttga

SEQ ID NO: 9160181 - DNA, 22 bp, Homo sapiens
gggggcagaatgtactcttgtc

SEQ ID NO: 9160182 - DNA, 22 bp, Homo sapiens
gggggcagaatgtactcttgtc

SEQ ID NO: 9160183 - DNA, 22 bp, Homo sapiens
caagttatcagggcagttagag

SEQ ID NO: 9160184 - DNA, 22 bp, Homo sapiens
caagttaatatatagaattttg

SEQ ID NO: 9160185 - DNA, 22 bp, Homo sapiens
caagttaattggtattttgatc

SEQ ID NO: 9160186 - DNA, 22 bp, Homo sapiens
caagttaaatttgcatttcaga

SEQ ID NO: 9160187 - DNA, 19 bp, Homo sapiens
caagttaaaatgaggtcat

SEQ ID NO: 9160188 - DNA, 22 bp, Homo sapiens
gctggtggtgggccagttctgt

SEQ ID NO: 9160189 - DNA, 22 bp, Homo sapiens
gctggtggttaccgtgctaatg

SEQ ID NO: 9160190 - DNA, 22 bp, Homo sapiens
gctggtgtgtgaacctagggac

SEQ ID NO: 9160191 - DNA, 22 bp, Homo sapiens
gctggttcacctggctcctccc

SEQ ID NO: 9160192 - DNA, 22 bp, Homo sapiens
gctggtttccttatctataaag

SEQ ID NO: 9160193 - DNA, 22 bp, Homo sapiens
gctggtggtaaggaggaaaaag

SEQ ID NO: 9160194 - DNA, 20 bp, Homo sapiens
gctggtgggggcttgacatg

SEQ ID NO: 9160195 - DNA, 22 bp, Homo sapiens
gctggtggcagagctccgcggc

SEQ ID NO: 9160196 - DNA, 22 bp, Homo sapiens
gctggtggcagagacatcaggt

SEQ ID NO: 9160197 - DNA, 22 bp, Homo sapiens
gctggtggcagagctccgcggc

SEQ ID NO: 9160198 - DNA, 22 bp, Homo sapiens
gctggtggcagagacatcaggt

SEQ ID NO: 9160199 - DNA, 22 bp, Homo sapiens
gctggtggcagagacatcaggt

SEQ ID NO: 9160200 - DNA, 22 bp, Homo sapiens
ggaacactcagtaattcagata

SEQ ID NO: 9160201 - DNA, 22 bp, Homo sapiens
ggaacactcagaaatgctcgtc

SEQ ID NO: 9160202 - DNA, 22 bp, Homo sapiens
ggaacactgccttttattttcc

SEQ ID NO: 9160203 - DNA, 22 bp, Homo sapiens
ggaacactcgtcaaatagcggg

SEQ ID NO: 9160204 - DNA, 22 bp, Homo sapiens
ggaacacaaatgggagagctgg

SEQ ID NO: 9160205 - DNA, 22 bp, Homo sapiens
ggaaatgtaatcacagagggtt

SEQ ID NO: 9160206 - DNA, 22 bp, Homo sapiens
ggaaatggtggaggaaggctta

SEQ ID NO: 9160207 - DNA, 22 bp, Homo sapiens
ggaaattgatctgagctcacct

SEQ ID NO: 9160208 - DNA, 19 bp, Homo sapiens
ggaaatgtggaaacatcct

SEQ ID NO: 9160209 - DNA, 22 bp, Homo sapiens
gcttccagcaaacactggctgc

SEQ ID NO: 9160210 - DNA, 22 bp, Homo sapiens
gcttccagcaccagcagagggg

SEQ ID NO: 9160211 - DNA, 22 bp, Homo sapiens
gcttccagcaaacactggctgc

SEQ ID NO: 9160212 - DNA, 22 bp, Homo sapiens
gcttccagcaccagcagagggg

SEQ ID NO: 9160213 - DNA, 22 bp, Homo sapiens
gcttccagcaccagcagagggg

SEQ ID NO: 9160214 - DNA, 19 bp, Homo sapiens
gcttccagcactgcaggag

SEQ ID NO: 9160215 - DNA, 19 bp, Homo sapiens
gcttccagcactgcaggag

SEQ ID NO: 9160216 - DNA, 22 bp, Homo sapiens
gcttccagggctcagtcactgc

SEQ ID NO: 9160217 - DNA, 20 bp, Homo sapiens
gcttccaggagggctgatat

SEQ ID NO: 9160218 - DNA, 20 bp, Homo sapiens
gcttccaggagggctgatat

SEQ ID NO: 9160219 - DNA, 20 bp, Homo sapiens
gcttccaggagggctgatat

SEQ ID NO: 9160220 - DNA, 20 bp, Homo sapiens
gcttccaggagggctgatat

SEQ ID NO: 9160221 - DNA, 22 bp, Homo sapiens
ggaaatgacttggtgcttcgtt

SEQ ID NO: 9160222 - DNA, 22 bp, Homo sapiens
caatgctgtgctcctcatgagg

SEQ ID NO: 9160223 - DNA, 21 bp, Homo sapiens
caatggcgagatcttggctca

SEQ ID NO: 9160224 - DNA, 22 bp, Homo sapiens
caatggatattttatgtgagaa

SEQ ID NO: 9160225 - DNA, 21 bp, Homo sapiens
caatggcgagatcttggctca

SEQ ID NO: 9160226 - DNA, 22 bp, Homo sapiens
gcttccacctactaaatgccac

SEQ ID NO: 9160227 - DNA, 22 bp, Homo sapiens
gcttccagaatgactaggatgt

SEQ ID NO: 9160228 - DNA, 22 bp, Homo sapiens
gcttccagaatgactaggatgt

SEQ ID NO: 9160229 - DNA, 22 bp, Homo sapiens
caatgtatcaaccagaaagttc

SEQ ID NO: 9160230 - DNA, 20 bp, Homo sapiens
gcttccagaggaggccccgt

SEQ ID NO: 9160231 - DNA, 20 bp, Homo sapiens
gcttccagaggaggccccgt

SEQ ID NO: 9160232 - DNA, 22 bp, Homo sapiens
gcttccagatcccatgctctta

SEQ ID NO: 9160233 - DNA, 22 bp, Homo sapiens
gcttccagatcccatgctctta

SEQ ID NO: 9160234 - DNA, 22 bp, Homo sapiens
gctggctgtgattttgccaaca

SEQ ID NO: 9160235 - DNA, 22 bp, Homo sapiens
gctgggagcaaagccatgcata

SEQ ID NO: 9160236 - DNA, 19 bp, Homo sapiens
gctgggagcagaccctccc

SEQ ID NO: 9160237 - DNA, 19 bp, Homo sapiens
gctgggagcagaccctccc

SEQ ID NO: 9160238 - DNA, 22 bp, Homo sapiens
gctgggagccctggtctgctcc

SEQ ID NO: 9160239 - DNA, 22 bp, Homo sapiens
gctgggagccccgagccagcgc

SEQ ID NO: 9160240 - DNA, 19 bp, Homo sapiens
gctgggagcagaccctccc

SEQ ID NO: 9160241 - DNA, 22 bp, Homo sapiens
gctggccatggggagtgaggag

SEQ ID NO: 9160242 - DNA, 22 bp, Homo sapiens
gctggccatggggagtgaggag

SEQ ID NO: 9160243 - DNA, 22 bp, Homo sapiens
gctggccatggggagtgaggag

SEQ ID NO: 9160244 - DNA, 22 bp, Homo sapiens
gctggccagtgtggtgaccacc

SEQ ID NO: 9160245 - DNA, 22 bp, Homo sapiens
gctgggccccatccctcgagca

SEQ ID NO: 9160246 - DNA, 22 bp, Homo sapiens
gctgggccccatccctcgagca

SEQ ID NO: 9160247 - DNA, 22 bp, Homo sapiens
gctgggccctgggtgccctagc

SEQ ID NO: 9160248 - DNA, 22 bp, Homo sapiens
gctgggccctgggtgccctagc

SEQ ID NO: 9160249 - DNA, 22 bp, Homo sapiens
gctgggccttccgattctcaag

SEQ ID NO: 9160250 - DNA, 20 bp, Homo sapiens
gctgggctaccactggccct

SEQ ID NO: 9160251 - DNA, 20 bp, Homo sapiens
gctgggctaccactggccct

SEQ ID NO: 9160252 - DNA, 20 bp, Homo sapiens
gctgggctaccactggccct

SEQ ID NO: 9160253 - DNA, 22 bp, Homo sapiens
gctgggccgacctgggctgcag

SEQ ID NO: 9160254 - DNA, 22 bp, Homo sapiens
gctgggccagagcagcagcact

SEQ ID NO: 9160255 - DNA, 22 bp, Homo sapiens
gctgggccagagcagcagcact

SEQ ID NO: 9160256 - DNA, 22 bp, Homo sapiens
gctgggagccgtacctgtcacg

SEQ ID NO: 9160257 - DNA, 22 bp, Homo sapiens
gctgggaggaatttggggaata

SEQ ID NO: 9160258 - DNA, 22 bp, Homo sapiens
gctgggagccctggtctgctcc

SEQ ID NO: 9160259 - DNA, 22 bp, Homo sapiens
gctgggagccctggtctgctcc

SEQ ID NO: 9160260 - DNA, 22 bp, Homo sapiens
gctgggagccgtacctgtcacg

SEQ ID NO: 9160261 - DNA, 22 bp, Homo sapiens
caaatttaggtaacagtctgta

SEQ ID NO: 9160262 - DNA, 22 bp, Homo sapiens
gctgaggtcaggagctgtgggg

SEQ ID NO: 9160263 - DNA, 22 bp, Homo sapiens
gctgaggtcaggagctgtgggg

SEQ ID NO: 9160264 - DNA, 22 bp, Homo sapiens
caaatttaagttagaaagcaat

SEQ ID NO: 9160265 - DNA, 22 bp, Homo sapiens
caaatttaagttagaaagcaat

SEQ ID NO: 9160266 - DNA, 22 bp, Homo sapiens
caaatttaagttagaaagcaat

SEQ ID NO: 9160267 - DNA, 22 bp, Homo sapiens
caaatttaagtgaggtctttgt

SEQ ID NO: 9160268 - DNA, 22 bp, Homo sapiens
caaatttaagtgaggtctttgt

SEQ ID NO: 9160269 - DNA, 22 bp, Homo sapiens
gctggcagagctctgggctggg

SEQ ID NO: 9160270 - DNA, 22 bp, Homo sapiens
gctggcagagagctggtgagga

SEQ ID NO: 9160271 - DNA, 22 bp, Homo sapiens
gctggcagagagctggtgagga

SEQ ID NO: 9160272 - DNA, 22 bp, Homo sapiens
gctggcagccaagtgaagaggg

SEQ ID NO: 9160273 - DNA, 22 bp, Homo sapiens
gctggcagccaagtgaagaggg

SEQ ID NO: 9160274 - DNA, 22 bp, Homo sapiens
gctggcagcattagaccctggg

SEQ ID NO: 9160275 - DNA, 20 bp, Homo sapiens
gctggcagatgtcttgagat

SEQ ID NO: 9160276 - DNA, 22 bp, Homo sapiens
cacagcccccttgacactctgg

SEQ ID NO: 9160277 - DNA, 22 bp, Homo sapiens
cacagccctgcgccccagtttg

SEQ ID NO: 9160278 - DNA, 22 bp, Homo sapiens
cacagcattcacagaaagacat

SEQ ID NO: 9160279 - DNA, 22 bp, Homo sapiens
cacagcattaactgggacagct

SEQ ID NO: 9160280 - DNA, 22 bp, Homo sapiens
ggagcagccgcgtctcagggca

SEQ ID NO: 9160281 - DNA, 22 bp, Homo sapiens
ggagcagccacgtctcagggca

SEQ ID NO: 9160282 - DNA, 22 bp, Homo sapiens
cacagcaggcactatacagggc

SEQ ID NO: 9160283 - DNA, 21 bp, Homo sapiens
cacagcagggttcctgggctc

SEQ ID NO: 9160284 - DNA, 21 bp, Homo sapiens
cacagcagggttcctgggctc

SEQ ID NO: 9160285 - DNA, 22 bp, Homo sapiens
cacagcagtctttcactaaata

SEQ ID NO: 9160286 - DNA, 22 bp, Homo sapiens
cacagcattaactgggacagct

SEQ ID NO: 9160287 - DNA, 22 bp, Homo sapiens
ggaggagacagtaaaaagcacg

SEQ ID NO: 9160288 - DNA, 22 bp, Homo sapiens
ggaggagacagtaaaaagcacg

SEQ ID NO: 9160289 - DNA, 22 bp, Homo sapiens
ggaggagacagtaaaaagcacg

SEQ ID NO: 9160290 - DNA, 22 bp, Homo sapiens
ggagctggccgcctatgtgcag

SEQ ID NO: 9160291 - DNA, 20 bp, Homo sapiens
ggagctggcatccagcctct

SEQ ID NO: 9160292 - DNA, 22 bp, Homo sapiens
ggagcagcttgcatgctcaggg

SEQ ID NO: 9160293 - DNA, 22 bp, Homo sapiens
ggagcagcttgcatgctcaggg

SEQ ID NO: 9160294 - DNA, 22 bp, Homo sapiens
ggaggagacggagtgattagtg

SEQ ID NO: 9160295 - DNA, 22 bp, Homo sapiens
ggaggagagaggttgcaaacac

SEQ ID NO: 9160296 - DNA, 22 bp, Homo sapiens
ggaggagagaggttgcaaacac

SEQ ID NO: 9160297 - DNA, 22 bp, Homo sapiens
ggaggagacggagtgattagtg

SEQ ID NO: 9160298 - DNA, 22 bp, Homo sapiens
ggaggagaccctgtgtcagttt

SEQ ID NO: 9160299 - DNA, 22 bp, Homo sapiens
ggaggagattcccctctcactt

SEQ ID NO: 9160300 - DNA, 22 bp, Homo sapiens
ggaggagcacttctgagctcag

SEQ ID NO: 9160301 - DNA, 22 bp, Homo sapiens
ggaggagattcccctctcactt

SEQ ID NO: 9160302 - DNA, 22 bp, Homo sapiens
ggaggagcacttgacggggtct

SEQ ID NO: 9160303 - DNA, 22 bp, Homo sapiens
ggaggagcatgagagggtagtg

SEQ ID NO: 9160304 - DNA, 22 bp, Homo sapiens
cacaggagagctgggaggtgcc

SEQ ID NO: 9160305 - DNA, 22 bp, Homo sapiens
cacaggagaacccacagattct

SEQ ID NO: 9160306 - DNA, 22 bp, Homo sapiens
cacaggagaaaggggaagctcg

SEQ ID NO: 9160307 - DNA, 22 bp, Homo sapiens
cacaggagattgatctattggt

SEQ ID NO: 9160308 - DNA, 22 bp, Homo sapiens
ggaggggcagccatggaactcc

SEQ ID NO: 9160309 - DNA, 22 bp, Homo sapiens
ggaggggatttagtagatgcta

SEQ ID NO: 9160310 - DNA, 22 bp, Homo sapiens
ggaggggatggtttgaccctgg

SEQ ID NO: 9160311 - DNA, 22 bp, Homo sapiens
ggaggggatggtttgaccctgg

SEQ ID NO: 9160312 - DNA, 22 bp, Homo sapiens
ggaggggatggtttgaccctgg

SEQ ID NO: 9160313 - DNA, 22 bp, Homo sapiens
cacagctatggggctgtagcct

SEQ ID NO: 9160314 - DNA, 22 bp, Homo sapiens
cacagctgaagtagccatgtgg

SEQ ID NO: 9160315 - DNA, 22 bp, Homo sapiens
cacagccttgagcgaggacaag

SEQ ID NO: 9160316 - DNA, 22 bp, Homo sapiens
cacagccttgagcgaggacaag

SEQ ID NO: 9160317 - DNA, 22 bp, Homo sapiens
cacagcggcctccgatgctgat

SEQ ID NO: 9160318 - DNA, 22 bp, Homo sapiens
cacagcgccttccccgggagcg

SEQ ID NO: 9160319 - DNA, 22 bp, Homo sapiens
cacagcctttagggtacacaca

SEQ ID NO: 9160320 - DNA, 22 bp, Homo sapiens
cacagctagactaattgctggg

SEQ ID NO: 9160321 - DNA, 22 bp, Homo sapiens
cacagctacctgcatgcctgct

SEQ ID NO: 9160322 - DNA, 22 bp, Homo sapiens
cacagcctccttcagagagcat

SEQ ID NO: 9160323 - DNA, 22 bp, Homo sapiens
cacagcctccttcagagagcat

SEQ ID NO: 9160324 - DNA, 22 bp, Homo sapiens
cacagcctgctgcactcaagaa

SEQ ID NO: 9160325 - DNA, 22 bp, Homo sapiens
cacagcctcctctggctcacgg

SEQ ID NO: 9160326 - DNA, 22 bp, Homo sapiens
cacagcctcctctggctcacgg

SEQ ID NO: 9160327 - DNA, 22 bp, Homo sapiens
cacagccttactgagatccact

SEQ ID NO: 9160328 - DNA, 22 bp, Homo sapiens
ggagaggttatccgtgttatgt

SEQ ID NO: 9160329 - DNA, 22 bp, Homo sapiens
ggagagctgacatcatgatgtt

SEQ ID NO: 9160330 - DNA, 22 bp, Homo sapiens
ggacagctgctttcaggccaca

SEQ ID NO: 9160331 - DNA, 22 bp, Homo sapiens
ggagagctgaagcatggacagg

SEQ ID NO: 9160332 - DNA, 22 bp, Homo sapiens
ggagagttgtttttgcctagat

SEQ ID NO: 9160333 - DNA, 22 bp, Homo sapiens
ggagagtggattccagctgtat

SEQ ID NO: 9160334 - DNA, 22 bp, Homo sapiens
ggacagcattcctagttccaaa

SEQ ID NO: 9160335 - DNA, 22 bp, Homo sapiens
ggacagcattctactgtaggca

SEQ ID NO: 9160336 - DNA, 22 bp, Homo sapiens
cacagcaggcactatacagggc

SEQ ID NO: 9160337 - DNA, 22 bp, Homo sapiens
cacagcaaagacactctcaact

SEQ ID NO: 9160338 - DNA, 22 bp, Homo sapiens
cacagagacagaagcacttatg

SEQ ID NO: 9160339 - DNA, 22 bp, Homo sapiens
ggagatagtccaggtgaaggga

SEQ ID NO: 9160340 - DNA, 22 bp, Homo sapiens
ggaagagaaatgagtcaagact

SEQ ID NO: 9160341 - DNA, 22 bp, Homo sapiens
ggaagagaaatgagtcaagact

SEQ ID NO: 9160342 - DNA, 22 bp, Homo sapiens
ggaacaggaaaggagggatgct

SEQ ID NO: 9160343 - DNA, 22 bp, Homo sapiens
ggaacagccagctcagtttcag

SEQ ID NO: 9160344 - DNA, 22 bp, Homo sapiens
ggaacactgtggttccatagca

SEQ ID NO: 9160345 - DNA, 20 bp, Homo sapiens
ggaacactgttcattctgta

SEQ ID NO: 9160346 - DNA, 22 bp, Homo sapiens
ggaacactggctcaattatatc

SEQ ID NO: 9160347 - DNA, 22 bp, Homo sapiens
ggaacagcgtggggctctcctg

SEQ ID NO: 9160348 - DNA, 22 bp, Homo sapiens
ggaagagagatcccatagatgt

SEQ ID NO: 9160349 - DNA, 22 bp, Homo sapiens
ggaagagagatcccatagatgt

SEQ ID NO: 9160350 - DNA, 19 bp, Homo sapiens
ggaagagaggaaaggtgga

SEQ ID NO: 9160351 - DNA, 22 bp, Homo sapiens
ggaagagaggttcagccctaag

SEQ ID NO: 9160352 - DNA, 22 bp, Homo sapiens
ggaagagattctttacattcat

SEQ ID NO: 9160353 - DNA, 19 bp, Homo sapiens
ggaagagaggaaaggtgga

SEQ ID NO: 9160354 - DNA, 19 bp, Homo sapiens
ggaagagaggaaaggtgga

SEQ ID NO: 9160355 - DNA, 22 bp, Homo sapiens
ggacacagataatcacacagat

SEQ ID NO: 9160356 - DNA, 23 bp, Homo sapiens
ggacacagagataagtgagacaa

SEQ ID NO: 9160357 - DNA, 22 bp, Homo sapiens
ggacagagggttgacagagtat

SEQ ID NO: 9160358 - DNA, 19 bp, Homo sapiens
ggacacagaaagctgcatt

SEQ ID NO: 9160359 - DNA, 19 bp, Homo sapiens
ggacacagaaagctgcatt

SEQ ID NO: 9160360 - DNA, 22 bp, Homo sapiens
ggacaagcctgtgagtgggttt

SEQ ID NO: 9160361 - DNA, 22 bp, Homo sapiens
ggacaagtggcccggtgtgtta

SEQ ID NO: 9160362 - DNA, 22 bp, Homo sapiens
ggacaagcctgtgagtgggttt

SEQ ID NO: 9160363 - DNA, 22 bp, Homo sapiens
ggacaaaggtctggggaacctg

SEQ ID NO: 9160364 - DNA, 22 bp, Homo sapiens
ggacaaaggtctggggaacctg

SEQ ID NO: 9160365 - DNA, 22 bp, Homo sapiens
ggacaaagggtggagcctctga

SEQ ID NO: 9160366 - DNA, 22 bp, Homo sapiens
ggacaaagggtggagcctctga

SEQ ID NO: 9160367 - DNA, 22 bp, Homo sapiens
ggacaaaggtagacagtctctg

SEQ ID NO: 9160368 - DNA, 22 bp, Homo sapiens
ggacaaagggtggagcctctga

SEQ ID NO: 9160369 - DNA, 22 bp, Homo sapiens
ggacaaaggggtacgatctagc

SEQ ID NO: 9160370 - DNA, 22 bp, Homo sapiens
ggacaaagctctgctgcctccc

SEQ ID NO: 9160371 - DNA, 22 bp, Homo sapiens
ggacaaaggggagcctgccccg

SEQ ID NO: 9160372 - DNA, 22 bp, Homo sapiens
ggacaaagggctagccacaact

SEQ ID NO: 9160373 - DNA, 22 bp, Homo sapiens
ggacaaagctctgctgcctccc

SEQ ID NO: 9160374 - DNA, 22 bp, Homo sapiens
ggacaaagcctggtggcaggtg

SEQ ID NO: 9160375 - DNA, 22 bp, Homo sapiens
ggaaggggtcacctcctgatga

SEQ ID NO: 9160376 - DNA, 22 bp, Homo sapiens
cagaaatagacaatggcagtgg

SEQ ID NO: 9160377 - DNA, 22 bp, Homo sapiens
cagaaatgcctgcttctctctc

SEQ ID NO: 9160378 - DNA, 22 bp, Homo sapiens
cagaaatgcctgcttctctctc

SEQ ID NO: 9160379 - DNA, 22 bp, Homo sapiens
cagaaatggaagttctggttta

SEQ ID NO: 9160380 - DNA, 22 bp, Homo sapiens
cagaaatggtctgttcagctta

SEQ ID NO: 9160381 - DNA, 22 bp, Homo sapiens
cagaaatgtactgacatgcagt

SEQ ID NO: 9160382 - DNA, 22 bp, Homo sapiens
cagaaatgtactgacatgcagt

SEQ ID NO: 9160383 - DNA, 22 bp, Homo sapiens
cagaaatgtactgacatgcagt

SEQ ID NO: 9160384 - DNA, 22 bp, Homo sapiens
cagaaatggagcccaggaatct

SEQ ID NO: 9160385 - DNA, 22 bp, Homo sapiens
cagaaatggagcccaggaatct

SEQ ID NO: 9160386 - DNA, 22 bp, Homo sapiens
cagaaatggagcccaggaatct

SEQ ID NO: 9160387 - DNA, 19 bp, Homo sapiens
ggctgctggttacagaggc

SEQ ID NO: 9160388 - DNA, 20 bp, Homo sapiens
ggctgctggtttggctctgt

SEQ ID NO: 9160389 - DNA, 22 bp, Homo sapiens
ggctgctgtactgatgtcagtt

SEQ ID NO: 9160390 - DNA, 22 bp, Homo sapiens
ggctgctgggtcatgatgcaga

SEQ ID NO: 9160391 - DNA, 19 bp, Homo sapiens
ggctgctggttacagaggc

SEQ ID NO: 9160392 - DNA, 22 bp, Homo sapiens
ggctggcttggtgagctgtcac

SEQ ID NO: 9160393 - DNA, 22 bp, Homo sapiens
cagaacagaatcgtgtggtgag

SEQ ID NO: 9160394 - DNA, 23 bp, Homo sapiens
ggctgggagctccgggtgcacgt

SEQ ID NO: 9160395 - DNA, 22 bp, Homo sapiens
ggctgggagccccacagagtca

SEQ ID NO: 9160396 - DNA, 23 bp, Homo sapiens
ggctgggagctccgggtgcacgt

SEQ ID NO: 9160397 - DNA, 22 bp, Homo sapiens
cagaacagaaacgttgttccat

SEQ ID NO: 9160398 - DNA, 22 bp, Homo sapiens
cagaacagaaacgttgttccat

SEQ ID NO: 9160399 - DNA, 20 bp, Homo sapiens
cagaaatttgtaaaagggat

SEQ ID NO: 9160400 - DNA, 22 bp, Homo sapiens
cagaaatgttctaatgattcag

SEQ ID NO: 9160401 - DNA, 22 bp, Homo sapiens
cagaaatgtgatgtacacacac

SEQ ID NO: 9160402 - DNA, 22 bp, Homo sapiens
cagaaatgtttgttaatattgt

SEQ ID NO: 9160403 - DNA, 22 bp, Homo sapiens
cagaaatgtttatgcttttgaa

SEQ ID NO: 9160404 - DNA, 22 bp, Homo sapiens
cagaaatgtttatatgtggtgt

SEQ ID NO: 9160405 - DNA, 20 bp, Homo sapiens
cagaacagtctgagaggcca

SEQ ID NO: 9160406 - DNA, 22 bp, Homo sapiens
cagaacagtcgcctgcatggat

SEQ ID NO: 9160407 - DNA, 22 bp, Homo sapiens
cagaagagtagctgaacaagtt

SEQ ID NO: 9160408 - DNA, 22 bp, Homo sapiens
cagaagaggactgggtagctca

SEQ ID NO: 9160409 - DNA, 22 bp, Homo sapiens
cagaagaggactgggtagctca

SEQ ID NO: 9160410 - DNA, 22 bp, Homo sapiens
cagaacattcactcatatgtgg

SEQ ID NO: 9160411 - DNA, 22 bp, Homo sapiens
cagaagaggactgggtagctca

SEQ ID NO: 9160412 - DNA, 22 bp, Homo sapiens
cagaacagtacctagcacatag

SEQ ID NO: 9160413 - DNA, 22 bp, Homo sapiens
cagaacagtacctagcacatag

SEQ ID NO: 9160414 - DNA, 23 bp, Homo sapiens
cagaacagtaaaagatgccatgg

SEQ ID NO: 9160415 - DNA, 23 bp, Homo sapiens
cagaacagtaaaagatgccatgg

SEQ ID NO: 9160416 - DNA, 23 bp, Homo sapiens
cagaacagtaaaagatgccatgg

SEQ ID NO: 9160417 - DNA, 22 bp, Homo sapiens
cagaacaggtcatgcttgctgt

SEQ ID NO: 9160418 - DNA, 22 bp, Homo sapiens
cagaacagagtcaaaagtatgt

SEQ ID NO: 9160419 - DNA, 22 bp, Homo sapiens
cagaacagagtcaaaagtatgt

SEQ ID NO: 9160420 - DNA, 22 bp, Homo sapiens
cagaacagagtcaaaagtatgt

SEQ ID NO: 9160421 - DNA, 22 bp, Homo sapiens
cagaacagagtcaaaagtatgt

SEQ ID NO: 9160422 - DNA, 19 bp, Homo sapiens
cagaacagaggtcatggcc

SEQ ID NO: 9160423 - DNA, 22 bp, Homo sapiens
cagaacagagcctgaatctctc

SEQ ID NO: 9160424 - DNA, 22 bp, Homo sapiens
ggcttgaagggaggaaagcagg

SEQ ID NO: 9160425 - DNA, 23 bp, Homo sapiens
ggcttgagctggaacagcttggt

SEQ ID NO: 9160426 - DNA, 23 bp, Homo sapiens
ggcttggccctcaagggccctgc

SEQ ID NO: 9160427 - DNA, 22 bp, Homo sapiens
cagaacagagcctgaatctctc

SEQ ID NO: 9160428 - DNA, 22 bp, Homo sapiens
cagaacagacttaacagggctg

SEQ ID NO: 9160429 - DNA, 23 bp, Homo sapiens
ggcttggccctcaagggccctgc

SEQ ID NO: 9160430 - DNA, 22 bp, Homo sapiens
ggcttcttgtgtgtcaggctct

SEQ ID NO: 9160431 - DNA, 22 bp, Homo sapiens
ggcttcttgtgtgtcaggctct

SEQ ID NO: 9160432 - DNA, 23 bp, Homo sapiens
ggcttcttgcctgtcttggtgct

SEQ ID NO: 9160433 - DNA, 22 bp, Homo sapiens
ggcttcttctctgtgtccagca

SEQ ID NO: 9160434 - DNA, 20 bp, Homo sapiens
ggcttctttacatctgtgtt

SEQ ID NO: 9160435 - DNA, 20 bp, Homo sapiens
ggcttctttacatctgtgtt

SEQ ID NO: 9160436 - DNA, 22 bp, Homo sapiens
ggcttctttcagagtgaataga

SEQ ID NO: 9160437 - DNA, 22 bp, Homo sapiens
ggcttctttgtaacgtgccagc

SEQ ID NO: 9160438 - DNA, 22 bp, Homo sapiens
ggcttgaaagaataggaatgca

SEQ ID NO: 9160439 - DNA, 20 bp, Homo sapiens
ggcttcttcaggtgtctatt

SEQ ID NO: 9160440 - DNA, 20 bp, Homo sapiens
cactgccctccagcctgagc

SEQ ID NO: 9160441 - DNA, 22 bp, Homo sapiens
cactgccctcactgtggttctc

SEQ ID NO: 9160442 - DNA, 22 bp, Homo sapiens
cactgcccaggcacccatcttg

SEQ ID NO: 9160443 - DNA, 22 bp, Homo sapiens
cactgcccaggcacccatcttg

SEQ ID NO: 9160444 - DNA, 22 bp, Homo sapiens
cactgcccaggcacccatcttg

SEQ ID NO: 9160445 - DNA, 22 bp, Homo sapiens
cactgcccttacatgccctgca

SEQ ID NO: 9160446 - DNA, 22 bp, Homo sapiens
cactgcccttacatgccctgca

SEQ ID NO: 9160447 - DNA, 22 bp, Homo sapiens
cactgcccttacatgccctgca

SEQ ID NO: 9160448 - DNA, 22 bp, Homo sapiens
cactgccctgggggttgccatc

SEQ ID NO: 9160449 - DNA, 22 bp, Homo sapiens
cactgcctccccaggctccaca

SEQ ID NO: 9160450 - DNA, 20 bp, Homo sapiens
cactgccctccagcctgagc

SEQ ID NO: 9160451 - DNA, 22 bp, Homo sapiens
cactgccctgggggttgccatc

SEQ ID NO: 9160452 - DNA, 22 bp, Homo sapiens
cactgcccaggacctgccaccc

SEQ ID NO: 9160453 - DNA, 22 bp, Homo sapiens
cactgcccagcgtcttaggcac

SEQ ID NO: 9160454 - DNA, 22 bp, Homo sapiens
cactgcccagcgtcttaggcac

SEQ ID NO: 9160455 - DNA, 22 bp, Homo sapiens
cactgcccagcgtcttaggcac

SEQ ID NO: 9160456 - DNA, 22 bp, Homo sapiens
cactgcccagagggcagcattg

SEQ ID NO: 9160457 - DNA, 18 bp, Homo sapiens
ggctcctgtgatcacatt

SEQ ID NO: 9160458 - DNA, 22 bp, Homo sapiens
ggctcctgtggcaagacagctt

SEQ ID NO: 9160459 - DNA, 22 bp, Homo sapiens
ggctcctgtcctcctggagctc

SEQ ID NO: 9160460 - DNA, 22 bp, Homo sapiens
ggctcctgtcccctcagctgct

SEQ ID NO: 9160461 - DNA, 22 bp, Homo sapiens
ggctcctgtagatctctaaagc

SEQ ID NO: 9160462 - DNA, 19 bp, Homo sapiens
ggctcctggggctcagccc

SEQ ID NO: 9160463 - DNA, 16 bp, Homo sapiens
ggctcctggttccttc

SEQ ID NO: 9160464 - DNA, 22 bp, Homo sapiens
ggctcctgggggtgctcctgcc

SEQ ID NO: 9160465 - DNA, 22 bp, Homo sapiens
ggctcctgggggtgctcctgcc

SEQ ID NO: 9160466 - DNA, 22 bp, Homo sapiens
ggcgccgcactcggtgcagccg

SEQ ID NO: 9160467 - DNA, 22 bp, Homo sapiens
ggcgccgcactcggtgcagccg

SEQ ID NO: 9160468 - DNA, 22 bp, Homo sapiens
ggcgccgcactcggtgcagccg

SEQ ID NO: 9160469 - DNA, 22 bp, Homo sapiens
ggcgcggcctctgggtcggttt

SEQ ID NO: 9160470 - DNA, 22 bp, Homo sapiens
ggcgctcagtgttgccccagag

SEQ ID NO: 9160471 - DNA, 22 bp, Homo sapiens
cactgaggctgggggagaaggt

SEQ ID NO: 9160472 - DNA, 22 bp, Homo sapiens
cactgaggctgggggagaaggt

SEQ ID NO: 9160473 - DNA, 21 bp, Homo sapiens
cactgaggtcaggggtagggt

SEQ ID NO: 9160474 - DNA, 21 bp, Homo sapiens
cactgaggtcaggggtagggt

SEQ ID NO: 9160475 - DNA, 21 bp, Homo sapiens
cactgaggtcaggggtagggt

SEQ ID NO: 9160476 - DNA, 22 bp, Homo sapiens
ggctccagtttccccttggggc

SEQ ID NO: 9160477 - DNA, 22 bp, Homo sapiens
ggctccagtttccccttggggc

SEQ ID NO: 9160478 - DNA, 22 bp, Homo sapiens
ggctgaggctcatgccatcttg

SEQ ID NO: 9160479 - DNA, 22 bp, Homo sapiens
ggctgaggctcatgccatcttg

SEQ ID NO: 9160480 - DNA, 22 bp, Homo sapiens
ggctgcagaggcgatctgaggt

SEQ ID NO: 9160481 - DNA, 22 bp, Homo sapiens
ggctgaggctcatgccatcttg

SEQ ID NO: 9160482 - DNA, 22 bp, Homo sapiens
ggctgcagatagccagccacca

SEQ ID NO: 9160483 - DNA, 22 bp, Homo sapiens
ggctgcagaggtcactttatag

SEQ ID NO: 9160484 - DNA, 22 bp, Homo sapiens
ggctgcagattgtagtctgtta

SEQ ID NO: 9160485 - DNA, 22 bp, Homo sapiens
ggctgcagcggattggggattg

SEQ ID NO: 9160486 - DNA, 22 bp, Homo sapiens
cactgtccaatagatacataat

SEQ ID NO: 9160487 - DNA, 22 bp, Homo sapiens
cactgtctattaatataactta

SEQ ID NO: 9160488 - DNA, 22 bp, Homo sapiens
cactgtccctgtttcctggaaa

SEQ ID NO: 9160489 - DNA, 22 bp, Homo sapiens
cactgtccatgcttgctaaccc

SEQ ID NO: 9160490 - DNA, 22 bp, Homo sapiens
ggctgcagcagagggactcacg

SEQ ID NO: 9160491 - DNA, 22 bp, Homo sapiens
cactgtgctcctaactagctgt

SEQ ID NO: 9160492 - DNA, 22 bp, Homo sapiens
cactgtgaaaaatggagtggtc

SEQ ID NO: 9160493 - DNA, 22 bp, Homo sapiens
cactgtcttttgtgaagacaat

SEQ ID NO: 9160494 - DNA, 22 bp, Homo sapiens
ggctgccttgaccctggctccg

SEQ ID NO: 9160495 - DNA, 22 bp, Homo sapiens
ggctgccttgaccctggctccg

SEQ ID NO: 9160496 - DNA, 22 bp, Homo sapiens
cactgtctgtgtgtccttgggg

SEQ ID NO: 9160497 - DNA, 22 bp, Homo sapiens
cactgtctgcttcgactcttca

SEQ ID NO: 9160498 - DNA, 22 bp, Homo sapiens
cactgtctgggacatgtggtct

SEQ ID NO: 9160499 - DNA, 22 bp, Homo sapiens
cactgtctcctagggggacttc

SEQ ID NO: 9160500 - DNA, 22 bp, Homo sapiens
cactgtctgagctggtgattag

SEQ ID NO: 9160501 - DNA, 22 bp, Homo sapiens
cactgtcttcagtttcactgca

SEQ ID NO: 9160502 - DNA, 22 bp, Homo sapiens
cactgtcttgattactatgggt

SEQ ID NO: 9160503 - DNA, 22 bp, Homo sapiens
ggctgcggccgcgggtctgtgc

SEQ ID NO: 9160504 - DNA, 22 bp, Homo sapiens
ggctgctcaaggactctgatcg

SEQ ID NO: 9160505 - DNA, 22 bp, Homo sapiens
ggctgcctttagaacggatgct

SEQ ID NO: 9160506 - DNA, 19 bp, Homo sapiens
ggctgcctttccttaccag

SEQ ID NO: 9160507 - DNA, 19 bp, Homo sapiens
ggctgcctttccttaccag

SEQ ID NO: 9160508 - DNA, 18 bp, Homo sapiens
ggctgctcgctctccccg

SEQ ID NO: 9160509 - DNA, 18 bp, Homo sapiens
ggctgctcctctccctac

SEQ ID NO: 9160510 - DNA, 22 bp, Homo sapiens
ggctgctcaaggactctgatcg

SEQ ID NO: 9160511 - DNA, 22 bp, Homo sapiens
ggctgcggccgcgggtctgtgc

SEQ ID NO: 9160512 - DNA, 22 bp, Homo sapiens
ggagtttcttgagcccttaagg

SEQ ID NO: 9160513 - DNA, 21 bp, Homo sapiens
ggagtttttctggaagggact

SEQ ID NO: 9160514 - DNA, 22 bp, Homo sapiens
ggagtgaatcactagatgcaga

SEQ ID NO: 9160515 - DNA, 22 bp, Homo sapiens
ggagtgaagtggcgcgatctcg

SEQ ID NO: 9160516 - DNA, 22 bp, Homo sapiens
ggagtgactcacagctgggaca

SEQ ID NO: 9160517 - DNA, 22 bp, Homo sapiens
ggagtgactcacagctgggaca

SEQ ID NO: 9160518 - DNA, 22 bp, Homo sapiens
ggagtgactcacagctgggaca

SEQ ID NO: 9160519 - DNA, 22 bp, Homo sapiens
ggagtctgttttacatgcagga

SEQ ID NO: 9160520 - DNA, 22 bp, Homo sapiens
ggagtctgttttacatgcagga

SEQ ID NO: 9160521 - DNA, 21 bp, Homo sapiens
ggagtctgtggatgctgtttc

SEQ ID NO: 9160522 - DNA, 22 bp, Homo sapiens
ggagtctgtcacctgtttctct

SEQ ID NO: 9160523 - DNA, 22 bp, Homo sapiens
ggagtctgggaattggagagaa

SEQ ID NO: 9160524 - DNA, 22 bp, Homo sapiens
ggagtctggagtggggcccaag

SEQ ID NO: 9160525 - DNA, 22 bp, Homo sapiens
ggagtctgctcccagacatgat

SEQ ID NO: 9160526 - DNA, 22 bp, Homo sapiens
ggagtctgctcccagacatgat

SEQ ID NO: 9160527 - DNA, 22 bp, Homo sapiens
ggagtctgcggcagacactgta

SEQ ID NO: 9160528 - DNA, 22 bp, Homo sapiens
ggagtctgattttttatgggtg

SEQ ID NO: 9160529 - DNA, 22 bp, Homo sapiens
ggagtctgattttttatgggtg

SEQ ID NO: 9160530 - DNA, 22 bp, Homo sapiens
ggaggtggaggttgcagtgagc

SEQ ID NO: 9160531 - DNA, 22 bp, Homo sapiens
ggataagaaaattgtaataact

SEQ ID NO: 9160532 - DNA, 22 bp, Homo sapiens
ggcagctgcaaatctgctctgt

SEQ ID NO: 9160533 - DNA, 22 bp, Homo sapiens
ggcagctgcaaatctgctctgt

SEQ ID NO: 9160534 - DNA, 22 bp, Homo sapiens
ggcaggaaatgggataagggct

SEQ ID NO: 9160535 - DNA, 22 bp, Homo sapiens
ggcaggaaaacaatgagccagg

SEQ ID NO: 9160536 - DNA, 22 bp, Homo sapiens
ggcagctgcaaatctgctctgt

SEQ ID NO: 9160537 - DNA, 22 bp, Homo sapiens
ggcaggaacacagatggtgccg

SEQ ID NO: 9160538 - DNA, 22 bp, Homo sapiens
ggcaggaagtagcagtctgagc

SEQ ID NO: 9160539 - DNA, 22 bp, Homo sapiens
ggcaggaagtagcagtctgagc

SEQ ID NO: 9160540 - DNA, 22 bp, Homo sapiens
ggcaggaagctcatgtggactg

SEQ ID NO: 9160541 - DNA, 21 bp, Homo sapiens
cacatgcatgcacaggttgta

SEQ ID NO: 9160542 - DNA, 22 bp, Homo sapiens
cacatgcataaggataattact

SEQ ID NO: 9160543 - DNA, 23 bp, Homo sapiens
cacatgcaggcagtggccttcaa

SEQ ID NO: 9160544 - DNA, 22 bp, Homo sapiens
ggcaggactgatcagtgggatg

SEQ ID NO: 9160545 - DNA, 20 bp, Homo sapiens
ggcaggacccggtagggagc

SEQ ID NO: 9160546 - DNA, 22 bp, Homo sapiens
ggcaggactctcaggaccaagc

SEQ ID NO: 9160547 - DNA, 22 bp, Homo sapiens
ggcaggaataaattatggactt

SEQ ID NO: 9160548 - DNA, 22 bp, Homo sapiens
ggcaggacaggggaatgtttgg

SEQ ID NO: 9160549 - DNA, 22 bp, Homo sapiens
ggcagtcacaggggagactggg

SEQ ID NO: 9160550 - DNA, 19 bp, Homo sapiens
ggcagtcacggtcaggagc

SEQ ID NO: 9160551 - DNA, 22 bp, Homo sapiens
cacatttctaggaaattaaatg

SEQ ID NO: 9160552 - DNA, 22 bp, Homo sapiens
ggcaggtgtggtgaccagagat

SEQ ID NO: 9160553 - DNA, 21 bp, Homo sapiens
ggcagtaagccaaatccattt

SEQ ID NO: 9160554 - DNA, 22 bp, Homo sapiens
ggcaggtgtgagctgtaaagga

SEQ ID NO: 9160555 - DNA, 22 bp, Homo sapiens
ggcaggtgccttctgtgctagc

SEQ ID NO: 9160556 - DNA, 22 bp, Homo sapiens
ggccccaggcctttggtctggc

SEQ ID NO: 9160557 - DNA, 22 bp, Homo sapiens
ggccccaggcctttggtctggc

SEQ ID NO: 9160558 - DNA, 22 bp, Homo sapiens
ggccccaggcctttggtctggc

SEQ ID NO: 9160559 - DNA, 22 bp, Homo sapiens
ggccccaggcctttggtctggc

SEQ ID NO: 9160560 - DNA, 22 bp, Homo sapiens
ggccccaggacctccacggtcc

SEQ ID NO: 9160561 - DNA, 22 bp, Homo sapiens
ggccccagcttcaaccccgtgg

SEQ ID NO: 9160562 - DNA, 22 bp, Homo sapiens
ggccccagggaagaaggtggtc

SEQ ID NO: 9160563 - DNA, 22 bp, Homo sapiens
ggccccagggattaggccaacc

SEQ ID NO: 9160564 - DNA, 17 bp, Homo sapiens
ggcctgtgtggctgcag

SEQ ID NO: 9160565 - DNA, 22 bp, Homo sapiens
ggcgaggccgggacaggctgga

SEQ ID NO: 9160566 - DNA, 22 bp, Homo sapiens
ggcgcagttgagcgtgctgttc

SEQ ID NO: 9160567 - DNA, 22 bp, Homo sapiens
ggcgcccccttcaaacagagca

SEQ ID NO: 9160568 - DNA, 22 bp, Homo sapiens
ggcgcccatcggtgcagagggc

SEQ ID NO: 9160569 - DNA, 22 bp, Homo sapiens
ggcgccccatgatgagggctag

SEQ ID NO: 9160570 - DNA, 22 bp, Homo sapiens
ggcccagagtctgcaatggagt

SEQ ID NO: 9160571 - DNA, 21 bp, Homo sapiens
ggccccagcccatgggttctc

SEQ ID NO: 9160572 - DNA, 19 bp, Homo sapiens
ggccccagccagggtatca

SEQ ID NO: 9160573 - DNA, 22 bp, Homo sapiens
ggccccagcctcagtcccctga

SEQ ID NO: 9160574 - DNA, 21 bp, Homo sapiens
ggccccagcccatgggttctc

SEQ ID NO: 9160575 - DNA, 22 bp, Homo sapiens
ggcccagagtctgcaatggagt

SEQ ID NO: 9160576 - DNA, 22 bp, Homo sapiens
ggcccagattagaagctgaatg

SEQ ID NO: 9160577 - DNA, 22 bp, Homo sapiens
ggcccagaatacatgaagtata

SEQ ID NO: 9160578 - DNA, 22 bp, Homo sapiens
cacccagccttcacacaggagt

SEQ ID NO: 9160579 - DNA, 21 bp, Homo sapiens
ggccagctcggaaggtcccat

SEQ ID NO: 9160580 - DNA, 21 bp, Homo sapiens
ggccagctcggaaggtcccat

SEQ ID NO: 9160581 - DNA, 22 bp, Homo sapiens
cacccagccttcacacaggagt

SEQ ID NO: 9160582 - DNA, 22 bp, Homo sapiens
ggccagctacccatctgcgtca

SEQ ID NO: 9160583 - DNA, 22 bp, Homo sapiens
ggccagctacccatctgcgtca

SEQ ID NO: 9160584 - DNA, 22 bp, Homo sapiens
ggccagctccttggcagtgcct

SEQ ID NO: 9160585 - DNA, 22 bp, Homo sapiens
cacccaggcaggtggctgagaa

SEQ ID NO: 9160586 - DNA, 22 bp, Homo sapiens
cacccaggcaggtggctgagaa

SEQ ID NO: 9160587 - DNA, 22 bp, Homo sapiens
cacccaggacaggccagatgtg

SEQ ID NO: 9160588 - DNA, 22 bp, Homo sapiens
caccaccaggcaggacaccgaa

SEQ ID NO: 9160589 - DNA, 22 bp, Homo sapiens
caccactgaattgttcactttc

SEQ ID NO: 9160590 - DNA, 22 bp, Homo sapiens
ggccagcctggggctcccagac

SEQ ID NO: 9160591 - DNA, 22 bp, Homo sapiens
ggccagcctggggctcccagac

SEQ ID NO: 9160592 - DNA, 22 bp, Homo sapiens
ggccagcctggggctcccagac

SEQ ID NO: 9160593 - DNA, 18 bp, Homo sapiens
ggccagccccaggccagc

SEQ ID NO: 9160594 - DNA, 18 bp, Homo sapiens
ggccagccccaggccagc

SEQ ID NO: 9160595 - DNA, 23 bp, Homo sapiens
ggccactttgtgtcagtatgtgc

SEQ ID NO: 9160596 - DNA, 22 bp, Homo sapiens
ggccactgtttcctgggcagtt

SEQ ID NO: 9160597 - DNA, 23 bp, Homo sapiens
gaggtacagcaccagtgaatagg

SEQ ID NO: 9160598 - DNA, 22 bp, Homo sapiens
gaggtagacttcttggaagtag

SEQ ID NO: 9160599 - DNA, 22 bp, Homo sapiens
gaggtagacttcttggaagtag

SEQ ID NO: 9160600 - DNA, 22 bp, Homo sapiens
gaggtagacttcttggaagtag

SEQ ID NO: 9160601 - DNA, 22 bp, Homo sapiens
gaggggtcacatgggctggctt

SEQ ID NO: 9160602 - DNA, 22 bp, Homo sapiens
gaggtaggaggtaggtattgtg

SEQ ID NO: 9160603 - DNA, 22 bp, Homo sapiens
gaggtaggctgtgaaagggggt

SEQ ID NO: 9160604 - DNA, 22 bp, Homo sapiens
gaggttggggctgcagtgagct

SEQ ID NO: 9160605 - DNA, 22 bp, Homo sapiens
gagtccagcagaatgagccaag

SEQ ID NO: 9160606 - DNA, 22 bp, Homo sapiens
gaggttggtgaggggacacggt

SEQ ID NO: 9160607 - DNA, 22 bp, Homo sapiens
gagtccagctctgcctcttact

SEQ ID NO: 9160608 - DNA, 18 bp, Homo sapiens
gagtccaggctcttcacc

SEQ ID NO: 9160609 - DNA, 22 bp, Homo sapiens
gagtccaggatttgagctctgt

SEQ ID NO: 9160610 - DNA, 22 bp, Homo sapiens
gagggcagaaaattatgcggtg

SEQ ID NO: 9160611 - DNA, 22 bp, Homo sapiens
gagggcactgggtttcaatgtc

SEQ ID NO: 9160612 - DNA, 22 bp, Homo sapiens
gagggcactcgagactacggca

SEQ ID NO: 9160613 - DNA, 22 bp, Homo sapiens
gagggcacgaaacaaccacttc

SEQ ID NO: 9160614 - DNA, 22 bp, Homo sapiens
gagggggcgtgcaaggctccgc

SEQ ID NO: 9160615 - DNA, 22 bp, Homo sapiens
gagggggcgtgcaaggctccgc

SEQ ID NO: 9160616 - DNA, 19 bp, Homo sapiens
gaggggaggaattgacaag

SEQ ID NO: 9160617 - DNA, 19 bp, Homo sapiens
gaggggaggaattgacaag

SEQ ID NO: 9160618 - DNA, 22 bp, Homo sapiens
gagggggcgtgcaaggctccgc

SEQ ID NO: 9160619 - DNA, 22 bp, Homo sapiens
gagggggctagcgcagtgccca

SEQ ID NO: 9160620 - DNA, 22 bp, Homo sapiens
gagggggctccctgaagccagt

SEQ ID NO: 9160621 - DNA, 22 bp, Homo sapiens
gagggggtctatgaggtagagc

SEQ ID NO: 9160622 - DNA, 22 bp, Homo sapiens
gaggggggcgccctgcagtgca

SEQ ID NO: 9160623 - DNA, 22 bp, Homo sapiens
gagggggctctgccaacctgtc

SEQ ID NO: 9160624 - DNA, 22 bp, Homo sapiens
gaggccacagctatcagggaca

SEQ ID NO: 9160625 - DNA, 22 bp, Homo sapiens
gaggccacagtcagtgttcatc

SEQ ID NO: 9160626 - DNA, 22 bp, Homo sapiens
gaggccacagtgtctgggggcc

SEQ ID NO: 9160627 - DNA, 22 bp, Homo sapiens
gaggccacagtgtctgggggcc

SEQ ID NO: 9160628 - DNA, 22 bp, Homo sapiens
gaggccacattacttggtgggt

SEQ ID NO: 9160629 - DNA, 23 bp, Homo sapiens
gaggccacattcccctgcttgag

SEQ ID NO: 9160630 - DNA, 22 bp, Homo sapiens
gaggctgttaggagggactctg

SEQ ID NO: 9160631 - DNA, 23 bp, Homo sapiens
gaggccacattcccctgcttgag

SEQ ID NO: 9160632 - DNA, 22 bp, Homo sapiens
gaggccaagttggagaccaggt

SEQ ID NO: 9160633 - DNA, 22 bp, Homo sapiens
gaggccaatcaatagggcaata

SEQ ID NO: 9160634 - DNA, 17 bp, Homo sapiens
gaggccaaggcaggcgg

SEQ ID NO: 9160635 - DNA, 22 bp, Homo sapiens
gaggccaaggtgggcagatcac

SEQ ID NO: 9160636 - DNA, 22 bp, Homo sapiens
atgtcacatggttctggggcct

SEQ ID NO: 9160637 - DNA, 22 bp, Homo sapiens
atgtcacattggagctgctgga

SEQ ID NO: 9160638 - DNA, 22 bp, Homo sapiens
atgtcacatctgggatggccct

SEQ ID NO: 9160639 - DNA, 22 bp, Homo sapiens
atgtcacatgagagcgcagcac

SEQ ID NO: 9160640 - DNA, 22 bp, Homo sapiens
gagggcacaaaggcaacattca

SEQ ID NO: 9160641 - DNA, 22 bp, Homo sapiens
gagggatgtgcctgaaggcagg

SEQ ID NO: 9160642 - DNA, 22 bp, Homo sapiens
gagggatggtgtgagaggctca

SEQ ID NO: 9160643 - DNA, 22 bp, Homo sapiens
gagggatgtcaggggaccttgg

SEQ ID NO: 9160644 - DNA, 22 bp, Homo sapiens
gagggaaaggttaatacatgat

SEQ ID NO: 9160645 - DNA, 22 bp, Homo sapiens
gagggaagaaagaattgatgcg

SEQ ID NO: 9160646 - DNA, 22 bp, Homo sapiens
gaggcttcccgcccatgctgga

SEQ ID NO: 9160647 - DNA, 22 bp, Homo sapiens
gaggctgttcagtgtccagctt

SEQ ID NO: 9160648 - DNA, 22 bp, Homo sapiens
gaggcttctgtaaccctgtcct

SEQ ID NO: 9160649 - DNA, 22 bp, Homo sapiens
gaggcttgcaccatgagcacca

SEQ ID NO: 9160650 - DNA, 22 bp, Homo sapiens
gagggaaaataaaattgcagta

SEQ ID NO: 9160651 - DNA, 22 bp, Homo sapiens
gagggaaaataaaattgcagta

SEQ ID NO: 9160652 - DNA, 22 bp, Homo sapiens
gaggcttttctctaaatagtgg

SEQ ID NO: 9160653 - DNA, 22 bp, Homo sapiens
gaggcttttcttcaggtatcaa

SEQ ID NO: 9160654 - DNA, 22 bp, Homo sapiens
gaggcttttggctaataactgt

SEQ ID NO: 9160655 - DNA, 22 bp, Homo sapiens
gaggctttcacaaggttagttc

SEQ ID NO: 9160656 - DNA, 22 bp, Homo sapiens
gaggctttataactatttgttc

SEQ ID NO: 9160657 - DNA, 22 bp, Homo sapiens
gaggctttacctagtaaagtgg

SEQ ID NO: 9160658 - DNA, 22 bp, Homo sapiens
gaggcttttagtatggggactg

SEQ ID NO: 9160659 - DNA, 22 bp, Homo sapiens
gaggcttttagtatggggactg

SEQ ID NO: 9160660 - DNA, 22 bp, Homo sapiens
gaggctttggttataaaagatc

SEQ ID NO: 9160661 - DNA, 22 bp, Homo sapiens
gaggctttgaatgcacggttca

SEQ ID NO: 9160662 - DNA, 22 bp, Homo sapiens
atgtttccgtgagcatccttga

SEQ ID NO: 9160663 - DNA, 22 bp, Homo sapiens
atgtttccgtgagcatccttga

SEQ ID NO: 9160664 - DNA, 22 bp, Homo sapiens
atgtttcccataagattttctg

SEQ ID NO: 9160665 - DNA, 22 bp, Homo sapiens
atgtttccattttcttgtatca

SEQ ID NO: 9160666 - DNA, 22 bp, Homo sapiens
atgtttccaggttcttcctatg

SEQ ID NO: 9160667 - DNA, 22 bp, Homo sapiens
atgtttccaggttcttcctatg

SEQ ID NO: 9160668 - DNA, 22 bp, Homo sapiens
gatctggaatctgaaggctgag

SEQ ID NO: 9160669 - DNA, 22 bp, Homo sapiens
gatctgaatcaatagaataact

SEQ ID NO: 9160670 - DNA, 22 bp, Homo sapiens
gatctgaatcaatagaataact

SEQ ID NO: 9160671 - DNA, 22 bp, Homo sapiens
gatctgagatctaaaccagagg

SEQ ID NO: 9160672 - DNA, 22 bp, Homo sapiens
gatctgagaaatccttggccag

SEQ ID NO: 9160673 - DNA, 22 bp, Homo sapiens
gatctgaagatatgaaatattt

SEQ ID NO: 9160674 - DNA, 22 bp, Homo sapiens
gatctgaagagttattttctga

SEQ ID NO: 9160675 - DNA, 22 bp, Homo sapiens
gatctgaaccttgcctgttggg

SEQ ID NO: 9160676 - DNA, 22 bp, Homo sapiens
gatctgaagagcaatgaaatat

SEQ ID NO: 9160677 - DNA, 22 bp, Homo sapiens
gatctcaaagcagtgtgggttg

SEQ ID NO: 9160678 - DNA, 22 bp, Homo sapiens
gagttagctgtgagtctcatat

SEQ ID NO: 9160679 - DNA, 22 bp, Homo sapiens
gagttagcgtgacaccctcgct

SEQ ID NO: 9160680 - DNA, 22 bp, Homo sapiens
gagttagagccatagagcacgg

SEQ ID NO: 9160681 - DNA, 22 bp, Homo sapiens
gagttagcaaagggtggcaggg

SEQ ID NO: 9160682 - DNA, 22 bp, Homo sapiens
gatatttacaaatttgccaata

SEQ ID NO: 9160683 - DNA, 22 bp, Homo sapiens
gatcctcttttcctaggaaggt

SEQ ID NO: 9160684 - DNA, 22 bp, Homo sapiens
gatcctgttagatcccattaga

SEQ ID NO: 9160685 - DNA, 22 bp, Homo sapiens
gatcctgttataatttggatgt

SEQ ID NO: 9160686 - DNA, 22 bp, Homo sapiens
gatcctgtggttttcctgtgca

SEQ ID NO: 9160687 - DNA, 22 bp, Homo sapiens
gatcctgttagaaatgtagact

SEQ ID NO: 9160688 - DNA, 22 bp, Homo sapiens
gatcctgtgcatggggtgatgg

SEQ ID NO: 9160689 - DNA, 22 bp, Homo sapiens
gatcctgtctccgcaccgtgtt

SEQ ID NO: 9160690 - DNA, 22 bp, Homo sapiens
gatcctgtctgtggagtcagca

SEQ ID NO: 9160691 - DNA, 22 bp, Homo sapiens
gatcctgtcccaagagtgacag

SEQ ID NO: 9160692 - DNA, 22 bp, Homo sapiens
atgtttcaccagttttataaga

SEQ ID NO: 9160693 - DNA, 22 bp, Homo sapiens
atgtttcagatacagatcaaat

SEQ ID NO: 9160694 - DNA, 22 bp, Homo sapiens
atgtttcaggcgaactaacatg

SEQ ID NO: 9160695 - DNA, 22 bp, Homo sapiens
atgtttcagggtgatagaaggt

SEQ ID NO: 9160696 - DNA, 22 bp, Homo sapiens
atgtttcatgactgagcaaaat

SEQ ID NO: 9160697 - DNA, 22 bp, Homo sapiens
atgtttcatgactgagcaaaat

SEQ ID NO: 9160698 - DNA, 22 bp, Homo sapiens
atgtttcatgactgagcaaaat

SEQ ID NO: 9160699 - DNA, 22 bp, Homo sapiens
atgtttcatttagatatcaggc

SEQ ID NO: 9160700 - DNA, 22 bp, Homo sapiens
gagttaaatagcttaggattca

SEQ ID NO: 9160701 - DNA, 22 bp, Homo sapiens
gagttaaatgacttggttaagg

SEQ ID NO: 9160702 - DNA, 21 bp, Homo sapiens
gagtgcaggtctgatgccatc

SEQ ID NO: 9160703 - DNA, 22 bp, Homo sapiens
atgtttattttgcagagtaggg

SEQ ID NO: 9160704 - DNA, 22 bp, Homo sapiens
atgtttcaatgcactttagcct

SEQ ID NO: 9160705 - DNA, 22 bp, Homo sapiens
atgtttcaaatatatagagttg

SEQ ID NO: 9160706 - DNA, 22 bp, Homo sapiens
atgtttcaagagaaaaagagac

SEQ ID NO: 9160707 - DNA, 22 bp, Homo sapiens
gagtccaggctgttgctcatct

SEQ ID NO: 9160708 - DNA, 22 bp, Homo sapiens
gagtccagtagttaggacagag

SEQ ID NO: 9160709 - DNA, 22 bp, Homo sapiens
gagtccagttagtgaggctggg

SEQ ID NO: 9160710 - DNA, 23 bp, Homo sapiens
gagtgcagaatagacatgcagtg

SEQ ID NO: 9160711 - DNA, 22 bp, Homo sapiens
gagtccagttctttccagcagt

SEQ ID NO: 9160712 - DNA, 23 bp, Homo sapiens
gagtgcagaatagacatgcagtg

SEQ ID NO: 9160713 - DNA, 23 bp, Homo sapiens
gagtgcagaatagacatgcagtg

SEQ ID NO: 9160714 - DNA, 23 bp, Homo sapiens
gagtgcagaatagacatgcagtg

SEQ ID NO: 9160715 - DNA, 22 bp, Homo sapiens
gagtgcagatgaacagaagatt

SEQ ID NO: 9160716 - DNA, 22 bp, Homo sapiens
gagtgcaggcctgagcaccatc

SEQ ID NO: 9160717 - DNA, 22 bp, Homo sapiens
gagtgcaggcctgagcaccatc

SEQ ID NO: 9160718 - DNA, 21 bp, Homo sapiens
gagtgcagcaaggtagagtct

SEQ ID NO: 9160719 - DNA, 22 bp, Homo sapiens
gagtgcagatgccagccccagt

SEQ ID NO: 9160720 - DNA, 22 bp, Homo sapiens
gaggaaggaatgcagtgtatgc

SEQ ID NO: 9160721 - DNA, 22 bp, Homo sapiens
gaggaaggagggaaagcgcgcg

SEQ ID NO: 9160722 - DNA, 22 bp, Homo sapiens
atggtttaagggagaatattga

SEQ ID NO: 9160723 - DNA, 22 bp, Homo sapiens
gaggaaggatttagtttgaggg

SEQ ID NO: 9160724 - DNA, 22 bp, Homo sapiens
gaggaagccccattgaagccag

SEQ ID NO: 9160725 - DNA, 22 bp, Homo sapiens
gaggaagcagggcttggctgag

SEQ ID NO: 9160726 - DNA, 22 bp, Homo sapiens
gaggaagctgcgtggcatttca

SEQ ID NO: 9160727 - DNA, 22 bp, Homo sapiens
gaggaagccccattgaagccag

SEQ ID NO: 9160728 - DNA, 22 bp, Homo sapiens
gaggaagatggttgagtggtcc

SEQ ID NO: 9160729 - DNA, 22 bp, Homo sapiens
gaggaagcagggcttggctgag

SEQ ID NO: 9160730 - DNA, 22 bp, Homo sapiens
gagctctgtccacacttggaga

SEQ ID NO: 9160731 - DNA, 22 bp, Homo sapiens
gagctctgcggaaaacgtgccg

SEQ ID NO: 9160732 - DNA, 22 bp, Homo sapiens
gagcttggctggacctcacgga

SEQ ID NO: 9160733 - DNA, 22 bp, Homo sapiens
gagctggggcggatactcagct

SEQ ID NO: 9160734 - DNA, 22 bp, Homo sapiens
gagctctgtgaatgtggggagg

SEQ ID NO: 9160735 - DNA, 22 bp, Homo sapiens
gagctttgatcgctaagcctca

SEQ ID NO: 9160736 - DNA, 22 bp, Homo sapiens
atgtaaattgtactgacacacg

SEQ ID NO: 9160737 - DNA, 22 bp, Homo sapiens
atgtaaattgtactgacacacg

SEQ ID NO: 9160738 - DNA, 22 bp, Homo sapiens
atgtaaagtatctgaaatgctg

SEQ ID NO: 9160739 - DNA, 22 bp, Homo sapiens
atgtaaagttacttgagttttg

SEQ ID NO: 9160740 - DNA, 22 bp, Homo sapiens
atgtaacacccacttttatagc

SEQ ID NO: 9160741 - DNA, 22 bp, Homo sapiens
atgtaacaggtgaagctctgag

SEQ ID NO: 9160742 - DNA, 22 bp, Homo sapiens
atgtaactgaaggaaatgcatg

SEQ ID NO: 9160743 - DNA, 22 bp, Homo sapiens
atgtaagagctttgcagggaaa

SEQ ID NO: 9160744 - DNA, 22 bp, Homo sapiens
atgtaagagtctaagattgtag

SEQ ID NO: 9160745 - DNA, 22 bp, Homo sapiens
atgtaattattaacacctgtgc

SEQ ID NO: 9160746 - DNA, 22 bp, Homo sapiens
atgtaatttatgttatccataa

SEQ ID NO: 9160747 - DNA, 22 bp, Homo sapiens
atgtaatttgccctcaagttaa

SEQ ID NO: 9160748 - DNA, 22 bp, Homo sapiens
atgtacaacctgcatgacagtc

SEQ ID NO: 9160749 - DNA, 22 bp, Homo sapiens
atgtacaaaatgccactgaatt

SEQ ID NO: 9160750 - DNA, 22 bp, Homo sapiens
atgtacaacctgcatgacagtc

SEQ ID NO: 9160751 - DNA, 22 bp, Homo sapiens
atgtacaacctgcatgacagtc

SEQ ID NO: 9160752 - DNA, 22 bp, Homo sapiens
atgtacaatctatcacaagaag

SEQ ID NO: 9160753 - DNA, 22 bp, Homo sapiens
atgtcacagcaggagtattctt

SEQ ID NO: 9160754 - DNA, 22 bp, Homo sapiens
atgtcacagctcccattcctcc

SEQ ID NO: 9160755 - DNA, 18 bp, Homo sapiens
atgtcacagagggctgaa

SEQ ID NO: 9160756 - DNA, 22 bp, Homo sapiens
atgtcacagcaggagtattctt

SEQ ID NO: 9160757 - DNA, 22 bp, Homo sapiens
atgtatttctatgtagtgaaga

SEQ ID NO: 9160758 - DNA, 21 bp, Homo sapiens
atgtcaaatgctttattttat

SEQ ID NO: 9160759 - DNA, 22 bp, Homo sapiens
gagccctcttccctagtgatcg

SEQ ID NO: 9160760 - DNA, 22 bp, Homo sapiens
gagcagtgactggagcatgaga

SEQ ID NO: 9160761 - DNA, 22 bp, Homo sapiens
gagcagtaggagaaccctgagc

SEQ ID NO: 9160762 - DNA, 22 bp, Homo sapiens
gagcaggtgcctgtagctctct

SEQ ID NO: 9160763 - DNA, 22 bp, Homo sapiens
gagcagggcttgtcctcctcat

SEQ ID NO: 9160764 - DNA, 22 bp, Homo sapiens
gagcagggcttgtcctcctcat

SEQ ID NO: 9160765 - DNA, 17 bp, Homo sapiens
gagcagggatgcggttc

SEQ ID NO: 9160766 - DNA, 22 bp, Homo sapiens
gagcagggccacttctgtacct

SEQ ID NO: 9160767 - DNA, 22 bp, Homo sapiens
gagcagggccacttctgtacct

SEQ ID NO: 9160768 - DNA, 22 bp, Homo sapiens
gagcagctctgtgcctggagac

SEQ ID NO: 9160769 - DNA, 22 bp, Homo sapiens
gagcagctctgtgcctggagac

SEQ ID NO: 9160770 - DNA, 22 bp, Homo sapiens
gagcagctctgggtgacccagt

SEQ ID NO: 9160771 - DNA, 22 bp, Homo sapiens
gagcagctctgggtgacccagt

SEQ ID NO: 9160772 - DNA, 22 bp, Homo sapiens
gagcagctgagctggaatgaga

SEQ ID NO: 9160773 - DNA, 22 bp, Homo sapiens
gagcagctgagctggaatgaga

SEQ ID NO: 9160774 - DNA, 22 bp, Homo sapiens
gagcagctgagctggaatgaga

SEQ ID NO: 9160775 - DNA, 22 bp, Homo sapiens
gagcagctctgtgcctggagac

SEQ ID NO: 9160776 - DNA, 19 bp, Homo sapiens
gagcagctgcacccattga

SEQ ID NO: 9160777 - DNA, 22 bp, Homo sapiens
gagcagggagacaactctggtg

SEQ ID NO: 9160778 - DNA, 22 bp, Homo sapiens
gagcagctgagctggaatgaga

SEQ ID NO: 9160779 - DNA, 22 bp, Homo sapiens
gagcagggagacaactctggtg

SEQ ID NO: 9160780 - DNA, 22 bp, Homo sapiens
gagcagggagacaactctggtg

SEQ ID NO: 9160781 - DNA, 17 bp, Homo sapiens
gagcagggatgcggttc

SEQ ID NO: 9160782 - DNA, 22 bp, Homo sapiens
gagcctggggaccctcctgagt

SEQ ID NO: 9160783 - DNA, 22 bp, Homo sapiens
gagcctgggtccttccctggga

SEQ ID NO: 9160784 - DNA, 22 bp, Homo sapiens
gagcctgggtccttccctggga

SEQ ID NO: 9160785 - DNA, 22 bp, Homo sapiens
gagcctggcctcctgcctcagc

SEQ ID NO: 9160786 - DNA, 22 bp, Homo sapiens
gagcctggcctcctgcctcagc

SEQ ID NO: 9160787 - DNA, 22 bp, Homo sapiens
gagcctggcctcctgcctcagc

SEQ ID NO: 9160788 - DNA, 22 bp, Homo sapiens
gagcctggcctcctgcctcagc

SEQ ID NO: 9160789 - DNA, 23 bp, Homo sapiens
gagctctgcactaggccctggga

SEQ ID NO: 9160790 - DNA, 23 bp, Homo sapiens
gagctctgcactaggccctggga

SEQ ID NO: 9160791 - DNA, 18 bp, Homo sapiens
gagctctgcctcccagtc

SEQ ID NO: 9160792 - DNA, 18 bp, Homo sapiens
gagctctgcctcccagtc

SEQ ID NO: 9160793 - DNA, 22 bp, Homo sapiens
gagctctgccatggctcccacc

SEQ ID NO: 9160794 - DNA, 22 bp, Homo sapiens
gagctctgccatggctcccacc

SEQ ID NO: 9160795 - DNA, 22 bp, Homo sapiens
gagcgcggtccccacggaggat

SEQ ID NO: 9160796 - DNA, 19 bp, Homo sapiens
gagcgcagagggcagggga

SEQ ID NO: 9160797 - DNA, 22 bp, Homo sapiens
gagcctgtgagccccaactcca

SEQ ID NO: 9160798 - DNA, 22 bp, Homo sapiens
gagcctgtgtttcctgtagcca

SEQ ID NO: 9160799 - DNA, 22 bp, Homo sapiens
gagcctgtgagccccaactcca

SEQ ID NO: 9160800 - DNA, 22 bp, Homo sapiens
gagaggctgaaatcacaggagc

SEQ ID NO: 9160801 - DNA, 22 bp, Homo sapiens
gagaggctgactggctgtcctg

SEQ ID NO: 9160802 - DNA, 22 bp, Homo sapiens
gagaggctgatcctgcagagaa

SEQ ID NO: 9160803 - DNA, 22 bp, Homo sapiens
gagaggctgatcctgcagagaa

SEQ ID NO: 9160804 - DNA, 22 bp, Homo sapiens
gagaggctgatcctgcagagaa

SEQ ID NO: 9160805 - DNA, 22 bp, Homo sapiens
gagaggctgatcctgcagagaa

SEQ ID NO: 9160806 - DNA, 22 bp, Homo sapiens
gagaggctggcagtgccaggtt

SEQ ID NO: 9160807 - DNA, 22 bp, Homo sapiens
gagaggctggcagtgccaggtt

SEQ ID NO: 9160808 - DNA, 22 bp, Homo sapiens
gagaggctggcagtgccaggtt

SEQ ID NO: 9160809 - DNA, 22 bp, Homo sapiens
gagaggaatgaggttaaggact

SEQ ID NO: 9160810 - DNA, 22 bp, Homo sapiens
gagaggctctgaggactggggt

SEQ ID NO: 9160811 - DNA, 22 bp, Homo sapiens
gagaggaagccttctgtacttg

SEQ ID NO: 9160812 - DNA, 22 bp, Homo sapiens
gagaggaatatcattatattag

SEQ ID NO: 9160813 - DNA, 22 bp, Homo sapiens
atgcttttggtctttggtccgg

SEQ ID NO: 9160814 - DNA, 22 bp, Homo sapiens
atgcttttcctaaaatgatgcc

SEQ ID NO: 9160815 - DNA, 22 bp, Homo sapiens
atgcttttcctaaaatgatgcc

SEQ ID NO: 9160816 - DNA, 22 bp, Homo sapiens
gagcacagggaatagacagata

SEQ ID NO: 9160817 - DNA, 22 bp, Homo sapiens
gagaggtgaaggctgccctggg

SEQ ID NO: 9160818 - DNA, 22 bp, Homo sapiens
gagcagctcgagaaggaagcag

SEQ ID NO: 9160819 - DNA, 22 bp, Homo sapiens
gagcagctcgagaaggaagcag

SEQ ID NO: 9160820 - DNA, 22 bp, Homo sapiens
gagcagctcgagaaggaagcag

SEQ ID NO: 9160821 - DNA, 22 bp, Homo sapiens
gagcagctcgagaaggaagcag

SEQ ID NO: 9160822 - DNA, 22 bp, Homo sapiens
gagcagctccagccgcatgact

SEQ ID NO: 9160823 - DNA, 22 bp, Homo sapiens
gagcagctccagccgcatgact

SEQ ID NO: 9160824 - DNA, 22 bp, Homo sapiens
gagcagctcaggcacttagcca

SEQ ID NO: 9160825 - DNA, 22 bp, Homo sapiens
gagcagctcagaggactagtgt

SEQ ID NO: 9160826 - DNA, 22 bp, Homo sapiens
gagcacagtaaagcagtgtcac

SEQ ID NO: 9160827 - DNA, 22 bp, Homo sapiens
gagcagctaaaattctcatgca

SEQ ID NO: 9160828 - DNA, 22 bp, Homo sapiens
gagcagctaaaattctcatgca

SEQ ID NO: 9160829 - DNA, 22 bp, Homo sapiens
gagcagctagataaagcccttc

SEQ ID NO: 9160830 - DNA, 22 bp, Homo sapiens
atgaatccaaagtttactatta

SEQ ID NO: 9160831 - DNA, 22 bp, Homo sapiens
atgaatccagcaaacagtgagg

SEQ ID NO: 9160832 - DNA, 22 bp, Homo sapiens
atgaatgaagaacatctgtgcc

SEQ ID NO: 9160833 - DNA, 22 bp, Homo sapiens
atgaataagtaaactcctttgg

SEQ ID NO: 9160834 - DNA, 22 bp, Homo sapiens
atgaatacgcggtcatacacat

SEQ ID NO: 9160835 - DNA, 22 bp, Homo sapiens
cttgagtacagatcatattatt

SEQ ID NO: 9160836 - DNA, 22 bp, Homo sapiens
cttgagtaaagaagtattttag

SEQ ID NO: 9160837 - DNA, 22 bp, Homo sapiens
cttgagtacagatcatattatt

SEQ ID NO: 9160838 - DNA, 22 bp, Homo sapiens
atgaataaaacattttaatcag

SEQ ID NO: 9160839 - DNA, 22 bp, Homo sapiens
cttgagcatcggatggaatttc

SEQ ID NO: 9160840 - DNA, 22 bp, Homo sapiens
atcttcccaggctggggagagg

SEQ ID NO: 9160841 - DNA, 22 bp, Homo sapiens
atcttcccaggctggggagagg

SEQ ID NO: 9160842 - DNA, 22 bp, Homo sapiens
atcttcccaggctggggagagg

SEQ ID NO: 9160843 - DNA, 22 bp, Homo sapiens
atcttcccaggctggggagagg

SEQ ID NO: 9160844 - DNA, 22 bp, Homo sapiens
atcttcccaggctggggagagg

SEQ ID NO: 9160845 - DNA, 22 bp, Homo sapiens
cttgagaagagatttatatttg

SEQ ID NO: 9160846 - DNA, 22 bp, Homo sapiens
atcttcaaagggatgtccatgg

SEQ ID NO: 9160847 - DNA, 22 bp, Homo sapiens
atcttcaactcagagagtgctg

SEQ ID NO: 9160848 - DNA, 22 bp, Homo sapiens
atcttcaacaacaaattgcctc

SEQ ID NO: 9160849 - DNA, 22 bp, Homo sapiens
atcttcaaagcacatcgtttgt

SEQ ID NO: 9160850 - DNA, 19 bp, Homo sapiens
atcttcaaagccagcagca

SEQ ID NO: 9160851 - DNA, 22 bp, Homo sapiens
atcttcaaggaaaaaatacagt

SEQ ID NO: 9160852 - DNA, 22 bp, Homo sapiens
atcttcaaggaaaaaatacagt

SEQ ID NO: 9160853 - DNA, 22 bp, Homo sapiens
atcttcaacttgatcatttgaa

SEQ ID NO: 9160854 - DNA, 22 bp, Homo sapiens
atcttcaacttgatcatttgaa

SEQ ID NO: 9160855 - DNA, 22 bp, Homo sapiens
atcttcagcgaggtttcctttc

SEQ ID NO: 9160856 - DNA, 22 bp, Homo sapiens
gaaaagagaacatctgaggatc

SEQ ID NO: 9160857 - DNA, 22 bp, Homo sapiens
gaaaagaactgcatgggattaa

SEQ ID NO: 9160858 - DNA, 22 bp, Homo sapiens
gaaaagaactgcatgggattaa

SEQ ID NO: 9160859 - DNA, 22 bp, Homo sapiens
gaaaacttggatctctagaatg

SEQ ID NO: 9160860 - DNA, 22 bp, Homo sapiens
gaaaacttggatctctagaatg

SEQ ID NO: 9160861 - DNA, 22 bp, Homo sapiens
gaaaacttggatctctagaatg

SEQ ID NO: 9160862 - DNA, 22 bp, Homo sapiens
gaaaagaactgcatgggattaa

SEQ ID NO: 9160863 - DNA, 22 bp, Homo sapiens
gaaaactgtgattagaatgcct

SEQ ID NO: 9160864 - DNA, 22 bp, Homo sapiens
gaaaactgtgattagaatgcct

SEQ ID NO: 9160865 - DNA, 22 bp, Homo sapiens
gaaaactattggcctagaacaa

SEQ ID NO: 9160866 - DNA, 22 bp, Homo sapiens
gaaaataggctgcatctccttc

SEQ ID NO: 9160867 - DNA, 22 bp, Homo sapiens
gaaaatagttcatcacaatgat

SEQ ID NO: 9160868 - DNA, 22 bp, Homo sapiens
atgaatgagcttagaggctgac

SEQ ID NO: 9160869 - DNA, 19 bp, Homo sapiens
atgaatgatccggtttctc

SEQ ID NO: 9160870 - DNA, 22 bp, Homo sapiens
atgaatgatttgtcagtcacag

SEQ ID NO: 9160871 - DNA, 22 bp, Homo sapiens
atgaatgcatgcttattttgca

SEQ ID NO: 9160872 - DNA, 22 bp, Homo sapiens
ctttttccagcttcagggtggg

SEQ ID NO: 9160873 - DNA, 22 bp, Homo sapiens
atgaatgtaagtggatttcttt

SEQ ID NO: 9160874 - DNA, 22 bp, Homo sapiens
atgaattaaggataactggtct

SEQ ID NO: 9160875 - DNA, 22 bp, Homo sapiens
gaaaacatccagagatagacct

SEQ ID NO: 9160876 - DNA, 22 bp, Homo sapiens
gaaaacatccagagatagacct

SEQ ID NO: 9160877 - DNA, 19 bp, Homo sapiens
gaaaacatgggtgagggtc

SEQ ID NO: 9160878 - DNA, 22 bp, Homo sapiens
gaaatatacatgaagtcggctg

SEQ ID NO: 9160879 - DNA, 22 bp, Homo sapiens
gaaatatacatgaagtcggctg

SEQ ID NO: 9160880 - DNA, 22 bp, Homo sapiens
gaaaatgagcctcagctacatt

SEQ ID NO: 9160881 - DNA, 22 bp, Homo sapiens
gaaaatgagcctcagctacatt

SEQ ID NO: 9160882 - DNA, 22 bp, Homo sapiens
gaaaatgcctctggcattaaac

SEQ ID NO: 9160883 - DNA, 22 bp, Homo sapiens
gaaaatgtgtcatccctactgt

SEQ ID NO: 9160884 - DNA, 22 bp, Homo sapiens
gaaatgaaacaggcttttaagg

SEQ ID NO: 9160885 - DNA, 22 bp, Homo sapiens
gaaatgaaatagcaccaaggtt

SEQ ID NO: 9160886 - DNA, 22 bp, Homo sapiens
gaaatgaaatagcaccaaggtt

SEQ ID NO: 9160887 - DNA, 22 bp, Homo sapiens
gaaatgaactgattatcattgc

SEQ ID NO: 9160888 - DNA, 22 bp, Homo sapiens
gaaatcttttaaccattcattt

SEQ ID NO: 9160889 - DNA, 22 bp, Homo sapiens
atgaggcattcacagaaggcac

SEQ ID NO: 9160890 - DNA, 22 bp, Homo sapiens
atgaggcatgtgaggagaaggg

SEQ ID NO: 9160891 - DNA, 22 bp, Homo sapiens
gaacatagtaaatgtcacattt

SEQ ID NO: 9160892 - DNA, 19 bp, Homo sapiens
gaacaatttgttagctctc

SEQ ID NO: 9160893 - DNA, 22 bp, Homo sapiens
gaacataactattgtgaatagt

SEQ ID NO: 9160894 - DNA, 22 bp, Homo sapiens
gaaatgaactgattatcattgc

SEQ ID NO: 9160895 - DNA, 22 bp, Homo sapiens
gaaatgacaaggacattcctgt

SEQ ID NO: 9160896 - DNA, 22 bp, Homo sapiens
gaaatgatgtctgtgctgccac

SEQ ID NO: 9160897 - DNA, 22 bp, Homo sapiens
atgaggcagtctggcctgaggg

SEQ ID NO: 9160898 - DNA, 22 bp, Homo sapiens
atgaggcatgggatcaaaatga

SEQ ID NO: 9160899 - DNA, 22 bp, Homo sapiens
gaacatcatgaagaaaacatat

SEQ ID NO: 9160900 - DNA, 22 bp, Homo sapiens
gaacatttccagaaaggaacta

SEQ ID NO: 9160901 - DNA, 18 bp, Homo sapiens
gaacttttggctttgtgt

SEQ ID NO: 9160902 - DNA, 22 bp, Homo sapiens
gaactttgtggggctgagagga

SEQ ID NO: 9160903 - DNA, 22 bp, Homo sapiens
gaagaaacaggggcttggggag

SEQ ID NO: 9160904 - DNA, 22 bp, Homo sapiens
gaactttgcaaatgtcagaagc

SEQ ID NO: 9160905 - DNA, 22 bp, Homo sapiens
gaacatttgatgatgacattgg

SEQ ID NO: 9160906 - DNA, 22 bp, Homo sapiens
gaacatttgatgatgacattgg

SEQ ID NO: 9160907 - DNA, 22 bp, Homo sapiens
gaacatttgatgatgacattgg

SEQ ID NO: 9160908 - DNA, 22 bp, Homo sapiens
atgcaatttactgtacataaat

SEQ ID NO: 9160909 - DNA, 22 bp, Homo sapiens
atgcaatcatatggcatacagc

SEQ ID NO: 9160910 - DNA, 22 bp, Homo sapiens
atgcacaaacccacaattagtc

SEQ ID NO: 9160911 - DNA, 22 bp, Homo sapiens
gaagaaagattggcatgcttca

SEQ ID NO: 9160912 - DNA, 22 bp, Homo sapiens
gaagaaagattggcatgcttca

SEQ ID NO: 9160913 - DNA, 22 bp, Homo sapiens
gaagaaagatcaaatagtttcc

SEQ ID NO: 9160914 - DNA, 22 bp, Homo sapiens
gaagaaagatcaaatagtttcc

SEQ ID NO: 9160915 - DNA, 22 bp, Homo sapiens
atgcaagacccagaaatcatta

SEQ ID NO: 9160916 - DNA, 22 bp, Homo sapiens
atgcaagagggaaaaggaaata

SEQ ID NO: 9160917 - DNA, 23 bp, Homo sapiens
atgcaagagtttctcaaactgga

SEQ ID NO: 9160918 - DNA, 22 bp, Homo sapiens
atgcaagatcacaccaaacacg

SEQ ID NO: 9160919 - DNA, 22 bp, Homo sapiens
atgcaagattcagcaggaagat

SEQ ID NO: 9160920 - DNA, 22 bp, Homo sapiens
atgcaagatgtatagaagactt

SEQ ID NO: 9160921 - DNA, 22 bp, Homo sapiens
atgccacttcattccagcctcg

SEQ ID NO: 9160922 - DNA, 22 bp, Homo sapiens
atgccacttcattccagcctcg

SEQ ID NO: 9160923 - DNA, 22 bp, Homo sapiens
atgccacttcattccagcctcg

SEQ ID NO: 9160924 - DNA, 22 bp, Homo sapiens
atgcccaatgtcacaatttttg

SEQ ID NO: 9160925 - DNA, 22 bp, Homo sapiens
atgcccaatgtcacaatttttg

SEQ ID NO: 9160926 - DNA, 22 bp, Homo sapiens
atgcccaatgtaggccccagga

SEQ ID NO: 9160927 - DNA, 22 bp, Homo sapiens
atgcatatcacagtctccatgt

SEQ ID NO: 9160928 - DNA, 22 bp, Homo sapiens
atgcatatatacatacacagtc

SEQ ID NO: 9160929 - DNA, 20 bp, Homo sapiens
atgcatatatgtggtgtctg

SEQ ID NO: 9160930 - DNA, 22 bp, Homo sapiens
atgcatatcagtgattgtttgc

SEQ ID NO: 9160931 - DNA, 22 bp, Homo sapiens
atgcatatctcctatctcctca

SEQ ID NO: 9160932 - DNA, 22 bp, Homo sapiens
atgcatatgcatctgtgtacat

SEQ ID NO: 9160933 - DNA, 22 bp, Homo sapiens
atgcatatgcaatgcacaattt

SEQ ID NO: 9160934 - DNA, 22 bp, Homo sapiens
atgcccctggccactcatattg

SEQ ID NO: 9160935 - DNA, 22 bp, Homo sapiens
atgcccctggccactcatattg

SEQ ID NO: 9160936 - DNA, 22 bp, Homo sapiens
atgcccctggcctggggaacat

SEQ ID NO: 9160937 - DNA, 22 bp, Homo sapiens
atgcccctggcctggggaacat

SEQ ID NO: 9160938 - DNA, 22 bp, Homo sapiens
atgcccctccttgtggtcgccc

SEQ ID NO: 9160939 - DNA, 22 bp, Homo sapiens
atgcccctccttgtggtcgccc

SEQ ID NO: 9160940 - DNA, 22 bp, Homo sapiens
atgcccagaaccccctggatgg

SEQ ID NO: 9160941 - DNA, 22 bp, Homo sapiens
atgcccagggctggtgaggtcc

SEQ ID NO: 9160942 - DNA, 22 bp, Homo sapiens
atgccctgcatcaagtgacact

SEQ ID NO: 9160943 - DNA, 22 bp, Homo sapiens
atgccctgccaagcaggctaaa

SEQ ID NO: 9160944 - DNA, 22 bp, Homo sapiens
atgccctgaggaatgtcacgct

SEQ ID NO: 9160945 - DNA, 22 bp, Homo sapiens
atgcccttcatttatcatgaaa

SEQ ID NO: 9160946 - DNA, 22 bp, Homo sapiens
atgccctttaatttcactgtta

SEQ ID NO: 9160947 - DNA, 21 bp, Homo sapiens
atgcccttcactcaaggccag

SEQ ID NO: 9160948 - DNA, 22 bp, Homo sapiens
atgcccttcaacgtgaggattt

SEQ ID NO: 9160949 - DNA, 22 bp, Homo sapiens
atgcccttatgccagaggcaat

SEQ ID NO: 9160950 - DNA, 22 bp, Homo sapiens
gacagggaggaaagagactgct

SEQ ID NO: 9160951 - DNA, 22 bp, Homo sapiens
atgcctctgctcttggtcctca

SEQ ID NO: 9160952 - DNA, 22 bp, Homo sapiens
atgcctctgctcttggtcctca

SEQ ID NO: 9160953 - DNA, 20 bp, Homo sapiens
atgcctctaattttgcaaac

SEQ ID NO: 9160954 - DNA, 22 bp, Homo sapiens
gaatcatgctcaataatgcttg

SEQ ID NO: 9160955 - DNA, 22 bp, Homo sapiens
gaatgtccctgcagttgctgcc

SEQ ID NO: 9160956 - DNA, 22 bp, Homo sapiens
gaatgtcctcctggatcactcc

SEQ ID NO: 9160957 - DNA, 22 bp, Homo sapiens
gaatgtctaaacatagctttta

SEQ ID NO: 9160958 - DNA, 22 bp, Homo sapiens
gaatgtctccaacttggggaaa

SEQ ID NO: 9160959 - DNA, 22 bp, Homo sapiens
gaatgtctatgtaaccgagggg

SEQ ID NO: 9160960 - DNA, 22 bp, Homo sapiens
gaatgtctttttggtacttata

SEQ ID NO: 9160961 - DNA, 22 bp, Homo sapiens
gaatgtcttctgttcccagctg

SEQ ID NO: 9160962 - DNA, 22 bp, Homo sapiens
gaatgtcttcaaaactagactg

SEQ ID NO: 9160963 - DNA, 22 bp, Homo sapiens
gaatgtcttattgctcgttgta

SEQ ID NO: 9160964 - DNA, 19 bp, Homo sapiens
gaatgtctcctacttctga

SEQ ID NO: 9160965 - DNA, 22 bp, Homo sapiens
gaatgtctgtttcaacaagcac

SEQ ID NO: 9160966 - DNA, 21 bp, Homo sapiens
gaatgtctgccttcacaatga

SEQ ID NO: 9160967 - DNA, 22 bp, Homo sapiens
gaatgtgggctgtgaagaggag

SEQ ID NO: 9160968 - DNA, 22 bp, Homo sapiens
atgcatatagaacatttgacat

SEQ ID NO: 9160969 - DNA, 22 bp, Homo sapiens
atgcatataatggccagaacaa

SEQ ID NO: 9160970 - DNA, 22 bp, Homo sapiens
atgcatataaggcacatgtatt

SEQ ID NO: 9160971 - DNA, 22 bp, Homo sapiens
atgcataatgtatgtattgact

SEQ ID NO: 9160972 - DNA, 19 bp, Homo sapiens
gaatgtttctgtctcttct

SEQ ID NO: 9160973 - DNA, 20 bp, Homo sapiens
gaatgtttcacttgctccat

SEQ ID NO: 9160974 - DNA, 22 bp, Homo sapiens
gaagcagaaggtttggacgtgc

SEQ ID NO: 9160975 - DNA, 22 bp, Homo sapiens
gaagcacatggctgtgagcaac

SEQ ID NO: 9160976 - DNA, 22 bp, Homo sapiens
gaagcagagcctaaggcagaca

SEQ ID NO: 9160977 - DNA, 22 bp, Homo sapiens
gaatcaggattcaagatcagct

SEQ ID NO: 9160978 - DNA, 22 bp, Homo sapiens
gaatcatggctgtgtcttcagc

SEQ ID NO: 9160979 - DNA, 22 bp, Homo sapiens
gaatgtaatagtcagtagaaca

SEQ ID NO: 9160980 - DNA, 22 bp, Homo sapiens
gaagcaatttagaatcagaagc

SEQ ID NO: 9160981 - DNA, 22 bp, Homo sapiens
gaagcaatttagaatcagaagc

SEQ ID NO: 9160982 - DNA, 22 bp, Homo sapiens
gaagcacatggctgtgagcaac

SEQ ID NO: 9160983 - DNA, 22 bp, Homo sapiens
gaagcaatgtgttttcaacatt

SEQ ID NO: 9160984 - DNA, 22 bp, Homo sapiens
gaccccaggcagatcagggggt

SEQ ID NO: 9160985 - DNA, 22 bp, Homo sapiens
gaccccagaggaaggggcgccg

SEQ ID NO: 9160986 - DNA, 22 bp, Homo sapiens
gaccctccactcactgctgtgt

SEQ ID NO: 9160987 - DNA, 22 bp, Homo sapiens
gacccggctccaggcccagcag

SEQ ID NO: 9160988 - DNA, 22 bp, Homo sapiens
gacccggctccaggcccagcag

SEQ ID NO: 9160989 - DNA, 18 bp, Homo sapiens
gaccccgggatctgtcga

SEQ ID NO: 9160990 - DNA, 22 bp, Homo sapiens
gactggggtaaggtgaggaggt

SEQ ID NO: 9160991 - DNA, 22 bp, Homo sapiens
gactggggtaaggtgaggaggt

SEQ ID NO: 9160992 - DNA, 22 bp, Homo sapiens
gactttctaatgctctgtagat

SEQ ID NO: 9160993 - DNA, 22 bp, Homo sapiens
gactttctgaaggtctcgcagt

SEQ ID NO: 9160994 - DNA, 22 bp, Homo sapiens
gactttctctcctcccaggtgt

SEQ ID NO: 9160995 - DNA, 22 bp, Homo sapiens
gactttctgagtcaaagaaagg

SEQ ID NO: 9160996 - DNA, 22 bp, Homo sapiens
gaccctgccatgagtgacaggg

SEQ ID NO: 9160997 - DNA, 22 bp, Homo sapiens
gaccctggaactttcagcagag

SEQ ID NO: 9160998 - DNA, 22 bp, Homo sapiens
gaccctggaactttcagcagag

SEQ ID NO: 9160999 - DNA, 22 bp, Homo sapiens
gaccctctagatggaagcactg

SEQ ID NO: 9161000 - DNA, 20 bp, Homo sapiens
atgctttcttgtgtgctgct

SEQ ID NO: 9161001 - DNA, 22 bp, Homo sapiens
atgctttggccaatgagaagtg

SEQ ID NO: 9161002 - DNA, 22 bp, Homo sapiens
atgctttgaagtttttcctcat

SEQ ID NO: 9161003 - DNA, 22 bp, Homo sapiens
atgctttgtttaaagattttca

SEQ ID NO: 9161004 - DNA, 22 bp, Homo sapiens
atgcttttaactcctttatccc

SEQ ID NO: 9161005 - DNA, 22 bp, Homo sapiens
atgcttttccaggagaaatata

SEQ ID NO: 9161006 - DNA, 22 bp, Homo sapiens
atgcttttatgtcacatggtca

SEQ ID NO: 9161007 - DNA, 22 bp, Homo sapiens
atgcttttccaggagaaatata

SEQ ID NO: 9161008 - DNA, 22 bp, Homo sapiens
atgcttttccaggagaaatata

SEQ ID NO: 9161009 - DNA, 22 bp, Homo sapiens
gactttggagcagaaagaaatt

SEQ ID NO: 9161010 - DNA, 22 bp, Homo sapiens
gactttggagcagctacttcct

SEQ ID NO: 9161011 - DNA, 22 bp, Homo sapiens
gactttggcatctagacattgt

SEQ ID NO: 9161012 - DNA, 17 bp, Homo sapiens
gactttggagtttcata

SEQ ID NO: 9161013 - DNA, 22 bp, Homo sapiens
gactttggattcattatctgga

SEQ ID NO: 9161014 - DNA, 22 bp, Homo sapiens
gactttgccacttgctccagct

SEQ ID NO: 9161015 - DNA, 21 bp, Homo sapiens
gactttcttaccagatttttg

SEQ ID NO: 9161016 - DNA, 22 bp, Homo sapiens
gactttctgtccagtgatttct

SEQ ID NO: 9161017 - DNA, 22 bp, Homo sapiens
gactttctgctatactttctgt

SEQ ID NO: 9161018 - DNA, 22 bp, Homo sapiens
gactttctgatgtaaacattta

SEQ ID NO: 9161019 - DNA, 22 bp, Homo sapiens
gactttcttaggccccctaata

SEQ ID NO: 9161020 - DNA, 22 bp, Homo sapiens
gactttcttgcagaaatattcc

SEQ ID NO: 9161021 - DNA, 22 bp, Homo sapiens
gactttcttgtagtgtctgatg

SEQ ID NO: 9161022 - DNA, 22 bp, Homo sapiens
gacagtgcatttcctggcatgg

SEQ ID NO: 9161023 - DNA, 22 bp, Homo sapiens
gacagtgttacaatttaatgga

SEQ ID NO: 9161024 - DNA, 22 bp, Homo sapiens
gacagtttggatgggggtttgc

SEQ ID NO: 9161025 - DNA, 22 bp, Homo sapiens
gacagtttaggttcaaatctca

SEQ ID NO: 9161026 - DNA, 22 bp, Homo sapiens
gacagtttaggttcaaatctca

SEQ ID NO: 9161027 - DNA, 22 bp, Homo sapiens
gacagggccgcagatggagact

SEQ ID NO: 9161028 - DNA, 22 bp, Homo sapiens
gacagggcatggtgcagagttc

SEQ ID NO: 9161029 - DNA, 22 bp, Homo sapiens
gacagggaggagcagagcttct

SEQ ID NO: 9161030 - DNA, 22 bp, Homo sapiens
gacagggaggagcagagcttct

SEQ ID NO: 9161031 - DNA, 22 bp, Homo sapiens
gacagggaggagcagagcttct

SEQ ID NO: 9161032 - DNA, 22 bp, Homo sapiens
gacagggaggaaagagactgct

SEQ ID NO: 9161033 - DNA, 22 bp, Homo sapiens
gacagggaggaaagagactgct

SEQ ID NO: 9161034 - DNA, 22 bp, Homo sapiens
gacagggaggaaagagactgct

SEQ ID NO: 9161035 - DNA, 22 bp, Homo sapiens
gacataaaattcaataatttgt

SEQ ID NO: 9161036 - DNA, 22 bp, Homo sapiens
gacagttttgctgaaattgagc

SEQ ID NO: 9161037 - DNA, 22 bp, Homo sapiens
atgcttaatacactgttaaagg

SEQ ID NO: 9161038 - DNA, 22 bp, Homo sapiens
atgcttggcagagttctttttc

SEQ ID NO: 9161039 - DNA, 22 bp, Homo sapiens
atgcttgtactaaaaaaatatt

SEQ ID NO: 9161040 - DNA, 20 bp, Homo sapiens
atgcttaagtgttcattatt

SEQ ID NO: 9161041 - DNA, 22 bp, Homo sapiens
atgctttacagttttccaaaca

SEQ ID NO: 9161042 - DNA, 19 bp, Homo sapiens
atgctttatgttatttctt

SEQ ID NO: 9161043 - DNA, 22 bp, Homo sapiens
atgctttatacaaaacacttaa

SEQ ID NO: 9161044 - DNA, 22 bp, Homo sapiens
gcaaaaaatgcttgttgcttag

SEQ ID NO: 9161045 - DNA, 22 bp, Homo sapiens
gcaaaatttacactccttcttc

SEQ ID NO: 9161046 - DNA, 22 bp, Homo sapiens
gcaaaacagtcgatgcctccca

SEQ ID NO: 9161047 - DNA, 23 bp, Homo sapiens
gcaacagagaagtaggagatggc

SEQ ID NO: 9161048 - DNA, 22 bp, Homo sapiens
gcaacagcccaggttctgtgtg

SEQ ID NO: 9161049 - DNA, 22 bp, Homo sapiens
gcaacagcccaggttctgtgtg

SEQ ID NO: 9161050 - DNA, 20 bp, Homo sapiens
gcaactagggagacacagct

SEQ ID NO: 9161051 - DNA, 22 bp, Homo sapiens
gcacacaggggagttctcagaa

SEQ ID NO: 9161052 - DNA, 22 bp, Homo sapiens
gcaaattagtggccaagcccaa

SEQ ID NO: 9161053 - DNA, 22 bp, Homo sapiens
gcaaattaaccaatcatgctcg

SEQ ID NO: 9161054 - DNA, 21 bp, Homo sapiens
gcaaatgttcaggaaaaaaga

SEQ ID NO: 9161055 - DNA, 23 bp, Homo sapiens
gcacagagcagttaggggaagat

SEQ ID NO: 9161056 - DNA, 18 bp, Homo sapiens
gcacagagcccaggctct

SEQ ID NO: 9161057 - DNA, 18 bp, Homo sapiens
gcacagagcaagtttcat

SEQ ID NO: 9161058 - DNA, 23 bp, Homo sapiens
gcacagagcagttaggggaagat

SEQ ID NO: 9161059 - DNA, 22 bp, Homo sapiens
gcacagaggaagcacagactct

SEQ ID NO: 9161060 - DNA, 22 bp, Homo sapiens
gcacagagcttgtttacatttg

SEQ ID NO: 9161061 - DNA, 22 bp, Homo sapiens
gcacagggagacagccgtggcc

SEQ ID NO: 9161062 - DNA, 22 bp, Homo sapiens
gcacagggagcaggtctctggt

SEQ ID NO: 9161063 - DNA, 22 bp, Homo sapiens
gcacagggagcaggtctctggt

SEQ ID NO: 9161064 - DNA, 21 bp, Homo sapiens
gcacagggacagatcatcaca

SEQ ID NO: 9161065 - DNA, 22 bp, Homo sapiens
gcacagggagacagccgtggcc

SEQ ID NO: 9161066 - DNA, 22 bp, Homo sapiens
gcacaggctctcttggggacac

SEQ ID NO: 9161067 - DNA, 17 bp, Homo sapiens
gcacagaggccaaagga

SEQ ID NO: 9161068 - DNA, 22 bp, Homo sapiens
gcactggggtcatagcctccag

SEQ ID NO: 9161069 - DNA, 22 bp, Homo sapiens
gcactgggggcagcagtgaggg

SEQ ID NO: 9161070 - DNA, 22 bp, Homo sapiens
gcactgggtgtgaggcagcgtc

SEQ ID NO: 9161071 - DNA, 22 bp, Homo sapiens
gcactgggtgtgaggcagcgtc

SEQ ID NO: 9161072 - DNA, 22 bp, Homo sapiens
gcactggttaccctgagtggct

SEQ ID NO: 9161073 - DNA, 22 bp, Homo sapiens
gcactggtatcacctgagagct

SEQ ID NO: 9161074 - DNA, 22 bp, Homo sapiens
gcactggtatcacctgagagct

SEQ ID NO: 9161075 - DNA, 22 bp, Homo sapiens
gcacagggcaacaggtctgtta

SEQ ID NO: 9161076 - DNA, 22 bp, Homo sapiens
gcacagggcaacaggtctgtta

SEQ ID NO: 9161077 - DNA, 22 bp, Homo sapiens
gcacagggaggctggcctggcc

SEQ ID NO: 9161078 - DNA, 22 bp, Homo sapiens
gcacagggccctgtgcgtaggt

SEQ ID NO: 9161079 - DNA, 22 bp, Homo sapiens
gcacagggccctgtgcgtaggt

SEQ ID NO: 9161080 - DNA, 23 bp, Homo sapiens
gcactgggctctcagcaaggtgt

SEQ ID NO: 9161081 - DNA, 22 bp, Homo sapiens
gcagaggctgggtgtcccagtc

SEQ ID NO: 9161082 - DNA, 22 bp, Homo sapiens
gcagaggctctttaatgcttag

SEQ ID NO: 9161083 - DNA, 22 bp, Homo sapiens
gcagaggctgggtgtcccagtc

SEQ ID NO: 9161084 - DNA, 22 bp, Homo sapiens
gcagaggctgtagggaaggttg

SEQ ID NO: 9161085 - DNA, 22 bp, Homo sapiens
gcagaggcctaggtggaaggcc

SEQ ID NO: 9161086 - DNA, 22 bp, Homo sapiens
gcagaggcctaggtggaaggcc

SEQ ID NO: 9161087 - DNA, 22 bp, Homo sapiens
gcagaggctccattttacagat

SEQ ID NO: 9161088 - DNA, 22 bp, Homo sapiens
gcagaggctccattttacagat

SEQ ID NO: 9161089 - DNA, 22 bp, Homo sapiens
gcagaggcctgaaggtggcggg

SEQ ID NO: 9161090 - DNA, 22 bp, Homo sapiens
gcagaggcctgaaggtggcggg

SEQ ID NO: 9161091 - DNA, 18 bp, Homo sapiens
gcagatgagtagtgtacc

SEQ ID NO: 9161092 - DNA, 18 bp, Homo sapiens
gcagatgagtagtgtacc

SEQ ID NO: 9161093 - DNA, 22 bp, Homo sapiens
gcagaggggaagctgaggaatt

SEQ ID NO: 9161094 - DNA, 22 bp, Homo sapiens
gcagaggccatcaactttgcca

SEQ ID NO: 9161095 - DNA, 22 bp, Homo sapiens
gcagaattgaaatgtgtcactt

SEQ ID NO: 9161096 - DNA, 16 bp, Homo sapiens
gcagaggaaaggggag

SEQ ID NO: 9161097 - DNA, 22 bp, Homo sapiens
gcagaatgtaggccttcagtgt

SEQ ID NO: 9161098 - DNA, 22 bp, Homo sapiens
gcagaattctacagatgataaa

SEQ ID NO: 9161099 - DNA, 22 bp, Homo sapiens
gcagaagtggtgctgtgccact

SEQ ID NO: 9161100 - DNA, 22 bp, Homo sapiens
gcagaagggaataaggagcttt

SEQ ID NO: 9161101 - DNA, 22 bp, Homo sapiens
gcagaagggaataaggagcttt

SEQ ID NO: 9161102 - DNA, 21 bp, Homo sapiens
gcagaagtggctacatctcca

SEQ ID NO: 9161103 - DNA, 22 bp, Homo sapiens
gcagaagtggattctacaattt

SEQ ID NO: 9161104 - DNA, 22 bp, Homo sapiens
gcagaaggtctggcacttcagg

SEQ ID NO: 9161105 - DNA, 22 bp, Homo sapiens
gcagcaggtccgcatcatcatc

SEQ ID NO: 9161106 - DNA, 22 bp, Homo sapiens
gcagcaggtccgcatcatcatc

SEQ ID NO: 9161107 - DNA, 21 bp, Homo sapiens
gcagccaggactttgggctgg

SEQ ID NO: 9161108 - DNA, 22 bp, Homo sapiens
gcagccaggaagcctttccctc

SEQ ID NO: 9161109 - DNA, 22 bp, Homo sapiens
gcagatgcagagatggctgggg

SEQ ID NO: 9161110 - DNA, 22 bp, Homo sapiens
gcagatgccagatcatgcaggg

SEQ ID NO: 9161111 - DNA, 22 bp, Homo sapiens
gcagatgcaactgcaggtgagt

SEQ ID NO: 9161112 - DNA, 21 bp, Homo sapiens
gcagccaggactttgggctgg

SEQ ID NO: 9161113 - DNA, 21 bp, Homo sapiens
gcagccaggactttgggctgg

SEQ ID NO: 9161114 - DNA, 22 bp, Homo sapiens
gcagccagggagagaaccaggg

SEQ ID NO: 9161115 - DNA, 22 bp, Homo sapiens
gcagccaggctacagcgggctt

SEQ ID NO: 9161116 - DNA, 22 bp, Homo sapiens
gcagccagggctaagctgggga

SEQ ID NO: 9161117 - DNA, 22 bp, Homo sapiens
gcagccagggctaagctgggga

SEQ ID NO: 9161118 - DNA, 22 bp, Homo sapiens
gcagccagggagagaaccaggg

SEQ ID NO: 9161119 - DNA, 22 bp, Homo sapiens
gcagccaggtttgaggaccact

SEQ ID NO: 9161120 - DNA, 19 bp, Homo sapiens
gcagccaggtgctctacct

SEQ ID NO: 9161121 - DNA, 19 bp, Homo sapiens
gcagccaggtgctctacct

SEQ ID NO: 9161122 - DNA, 22 bp, Homo sapiens
gcagccaggggctgtgacctgt

SEQ ID NO: 9161123 - DNA, 22 bp, Homo sapiens
gcagccaggtttgaggaccact

SEQ ID NO: 9161124 - DNA, 22 bp, Homo sapiens
gcagcctgggcaacagagtgag

SEQ ID NO: 9161125 - DNA, 22 bp, Homo sapiens
gcagcctgttgtaccagcctgt

SEQ ID NO: 9161126 - DNA, 22 bp, Homo sapiens
gcagcctgggcaacagagtgag

SEQ ID NO: 9161127 - DNA, 22 bp, Homo sapiens
gcagccttcagtttggcaggag

SEQ ID NO: 9161128 - DNA, 22 bp, Homo sapiens
gcaggagagtctgtgccaggtt

SEQ ID NO: 9161129 - DNA, 22 bp, Homo sapiens
attgtaagtagaaatgttatgg

SEQ ID NO: 9161130 - DNA, 22 bp, Homo sapiens
attgtaacatgttcagatcact

SEQ ID NO: 9161131 - DNA, 22 bp, Homo sapiens
attgtaacatgttcagatcact

SEQ ID NO: 9161132 - DNA, 22 bp, Homo sapiens
attgtaacagacacatcagatt

SEQ ID NO: 9161133 - DNA, 22 bp, Homo sapiens
attgtaacaggatccctgtggc

SEQ ID NO: 9161134 - DNA, 21 bp, Homo sapiens
gcagtgcagcttggagggtag

SEQ ID NO: 9161135 - DNA, 22 bp, Homo sapiens
attgtacaatgctgaggtttgg

SEQ ID NO: 9161136 - DNA, 22 bp, Homo sapiens
gcagtgattggatcagagatgg

SEQ ID NO: 9161137 - DNA, 22 bp, Homo sapiens
gcagtgcattactcacatgttt

SEQ ID NO: 9161138 - DNA, 22 bp, Homo sapiens
gcagtgcatgtcggaactcatt

SEQ ID NO: 9161139 - DNA, 22 bp, Homo sapiens
gcagtgcaggaacatagcttct

SEQ ID NO: 9161140 - DNA, 18 bp, Homo sapiens
gcagtgcaggaagaagag

SEQ ID NO: 9161141 - DNA, 22 bp, Homo sapiens
gcagtgcaggacaaatcagtgc

SEQ ID NO: 9161142 - DNA, 22 bp, Homo sapiens
gcagtgcagtgggacagggcgc

SEQ ID NO: 9161143 - DNA, 22 bp, Homo sapiens
gcagtgcagtgggacagggcgc

SEQ ID NO: 9161144 - DNA, 22 bp, Homo sapiens
gcagtgctgagaggtgatcgga

SEQ ID NO: 9161145 - DNA, 22 bp, Homo sapiens
gcagtgctctgcctataatgga

SEQ ID NO: 9161146 - DNA, 22 bp, Homo sapiens
attgtgcagcacagatcatgac

SEQ ID NO: 9161147 - DNA, 22 bp, Homo sapiens
attgtgcagcacagatcatgac

SEQ ID NO: 9161148 - DNA, 22 bp, Homo sapiens
attgtgcagcagtggtacctgg

SEQ ID NO: 9161149 - DNA, 22 bp, Homo sapiens
attgttcaaagtgctttgcatg

SEQ ID NO: 9161150 - DNA, 22 bp, Homo sapiens
attgttccacttccttgtttgc

SEQ ID NO: 9161151 - DNA, 22 bp, Homo sapiens
attgtttacactaacttcataa

SEQ ID NO: 9161152 - DNA, 22 bp, Homo sapiens
attgttctggatatttacattg

SEQ ID NO: 9161153 - DNA, 22 bp, Homo sapiens
attgttccttagaaccatgcct

SEQ ID NO: 9161154 - DNA, 22 bp, Homo sapiens
attgttccctactgttcaactg

SEQ ID NO: 9161155 - DNA, 22 bp, Homo sapiens
attgttttaattccattgtgaa

SEQ ID NO: 9161156 - DNA, 22 bp, Homo sapiens
attgttttattaaatgagccct

SEQ ID NO: 9161157 - DNA, 22 bp, Homo sapiens
gccactgtcctgtgcctgtgct

SEQ ID NO: 9161158 - DNA, 22 bp, Homo sapiens
gccactgtagagtatggacaag

SEQ ID NO: 9161159 - DNA, 22 bp, Homo sapiens
gccactgtcatcttgtgaagca

SEQ ID NO: 9161160 - DNA, 22 bp, Homo sapiens
gccactggcatctagttggtag

SEQ ID NO: 9161161 - DNA, 22 bp, Homo sapiens
gccactggcgctgtgcagagtg

SEQ ID NO: 9161162 - DNA, 20 bp, Homo sapiens
gccactgggcaccagcaggg

SEQ ID NO: 9161163 - DNA, 22 bp, Homo sapiens
gccactggcgctgtgcagagtg

SEQ ID NO: 9161164 - DNA, 22 bp, Homo sapiens
atttaaatgcttaagagggttt

SEQ ID NO: 9161165 - DNA, 22 bp, Homo sapiens
atttaaagtggtagattggcag

SEQ ID NO: 9161166 - DNA, 23 bp, Homo sapiens
attgtttttggctctcagggaat

SEQ ID NO: 9161167 - DNA, 22 bp, Homo sapiens
attgttttgtttcccagtgact

SEQ ID NO: 9161168 - DNA, 22 bp, Homo sapiens
attgttttgtttcccagtgact

SEQ ID NO: 9161169 - DNA, 22 bp, Homo sapiens
attgttttccaaagatgctgct

SEQ ID NO: 9161170 - DNA, 22 bp, Homo sapiens
attgttttgtagaatgaccctt

SEQ ID NO: 9161171 - DNA, 22 bp, Homo sapiens
attgttttgtagaatgaccctt

SEQ ID NO: 9161172 - DNA, 16 bp, Homo sapiens
attgttttcaattaga

SEQ ID NO: 9161173 - DNA, 22 bp, Homo sapiens
gcattcagggttcacggtcaac

SEQ ID NO: 9161174 - DNA, 22 bp, Homo sapiens
gcattcaggaaccggaagggta

SEQ ID NO: 9161175 - DNA, 22 bp, Homo sapiens
gcattcagcctaaagagaaaag

SEQ ID NO: 9161176 - DNA, 21 bp, Homo sapiens
gccactgcactccagcctggg

SEQ ID NO: 9161177 - DNA, 21 bp, Homo sapiens
gccactgcactccagcctggg

SEQ ID NO: 9161178 - DNA, 22 bp, Homo sapiens
gccactggacccagaaagggaa

SEQ ID NO: 9161179 - DNA, 22 bp, Homo sapiens
gccactggacccagggttatca

SEQ ID NO: 9161180 - DNA, 22 bp, Homo sapiens
gccactggagacagtggggaag

SEQ ID NO: 9161181 - DNA, 22 bp, Homo sapiens
gccactggcatctagttggtag

SEQ ID NO: 9161182 - DNA, 22 bp, Homo sapiens
gccactgcactccagcccaggc

SEQ ID NO: 9161183 - DNA, 22 bp, Homo sapiens
gccaccttccaaaataatcaca

SEQ ID NO: 9161184 - DNA, 22 bp, Homo sapiens
gccacagtcaggacggggagag

SEQ ID NO: 9161185 - DNA, 22 bp, Homo sapiens
gccactcatgggaggtgtgcaa

SEQ ID NO: 9161186 - DNA, 19 bp, Homo sapiens
gccactcctgatgctgccc

SEQ ID NO: 9161187 - DNA, 22 bp, Homo sapiens
gccactcacatgtaccagatgc

SEQ ID NO: 9161188 - DNA, 19 bp, Homo sapiens
gccactcctgatgctgccc

SEQ ID NO: 9161189 - DNA, 22 bp, Homo sapiens
gcagggattgtcaatgctgctc

SEQ ID NO: 9161190 - DNA, 22 bp, Homo sapiens
gcagggatgctgaggctcagtg

SEQ ID NO: 9161191 - DNA, 22 bp, Homo sapiens
gcagggatgctgaggctcagtg

SEQ ID NO: 9161192 - DNA, 22 bp, Homo sapiens
gcagggaggtttgctgacctgg

SEQ ID NO: 9161193 - DNA, 22 bp, Homo sapiens
gcaggggtagagattgctggtg

SEQ ID NO: 9161194 - DNA, 16 bp, Homo sapiens
gcaggggtgggtggag

SEQ ID NO: 9161195 - DNA, 22 bp, Homo sapiens
gcaggggtggaggctgtcctgt

SEQ ID NO: 9161196 - DNA, 21 bp, Homo sapiens
gcagggtcctttccattccta

SEQ ID NO: 9161197 - DNA, 22 bp, Homo sapiens
gcagggtcgctctaggagatca

SEQ ID NO: 9161198 - DNA, 22 bp, Homo sapiens
gcagggtaggtgacaggtagtc

SEQ ID NO: 9161199 - DNA, 22 bp, Homo sapiens
attgtaaatagtgccacaataa

SEQ ID NO: 9161200 - DNA, 22 bp, Homo sapiens
attgtaaatagtgccacaataa

SEQ ID NO: 9161201 - DNA, 22 bp, Homo sapiens
attgtaaatagtgccacaataa

SEQ ID NO: 9161202 - DNA, 22 bp, Homo sapiens
attgtaaatagtgccacaataa

SEQ ID NO: 9161203 - DNA, 22 bp, Homo sapiens
attgtaaaagtattctaagatt

SEQ ID NO: 9161204 - DNA, 22 bp, Homo sapiens
attgtaaaagtattctaagatt

SEQ ID NO: 9161205 - DNA, 22 bp, Homo sapiens
gcagggaggaagagatgcttcc

SEQ ID NO: 9161206 - DNA, 22 bp, Homo sapiens
gcagggaggaagagatgcttcc

SEQ ID NO: 9161207 - DNA, 22 bp, Homo sapiens
gcagggaggaagagatgcttcc

SEQ ID NO: 9161208 - DNA, 22 bp, Homo sapiens
gcagggaggaagagatgcttcc

SEQ ID NO: 9161209 - DNA, 22 bp, Homo sapiens
gcagggagggcctttcatgaca

SEQ ID NO: 9161210 - DNA, 22 bp, Homo sapiens
gcagggagggcctttcatgaca

SEQ ID NO: 9161211 - DNA, 22 bp, Homo sapiens
gcagggagggcctttcatgaca

SEQ ID NO: 9161212 - DNA, 22 bp, Homo sapiens
gcagggactttggcaacaggtg

SEQ ID NO: 9161213 - DNA, 22 bp, Homo sapiens
gcagggacgccagggacagcaa

SEQ ID NO: 9161214 - DNA, 22 bp, Homo sapiens
gcaggctgtggtatgttgggca

SEQ ID NO: 9161215 - DNA, 22 bp, Homo sapiens
gcaggctgtctaaagttagagt

SEQ ID NO: 9161216 - DNA, 22 bp, Homo sapiens
gcaggctgtctaaagttagagt

SEQ ID NO: 9161217 - DNA, 22 bp, Homo sapiens
gcaggctgtgaggctcagatgg

SEQ ID NO: 9161218 - DNA, 22 bp, Homo sapiens
gcaggagcagtcaggggcagct

SEQ ID NO: 9161219 - DNA, 18 bp, Homo sapiens
gcaggagatgggtggggt

SEQ ID NO: 9161220 - DNA, 22 bp, Homo sapiens
gcaggagcagtcaggggcagct

SEQ ID NO: 9161221 - DNA, 22 bp, Homo sapiens
gcaggatgaactaacacctgca

SEQ ID NO: 9161222 - DNA, 22 bp, Homo sapiens
gcaggatgggtgtagcccagca

SEQ ID NO: 9161223 - DNA, 22 bp, Homo sapiens
gcaggatgggtgtagcccagca

SEQ ID NO: 9161224 - DNA, 22 bp, Homo sapiens
gcaggatggtggaaggcctgct

SEQ ID NO: 9161225 - DNA, 22 bp, Homo sapiens
gcaggatggtggaaggcctgct

SEQ ID NO: 9161226 - DNA, 22 bp, Homo sapiens
gcaggatggtggaaggcctgct

SEQ ID NO: 9161227 - DNA, 22 bp, Homo sapiens
gcaggatgccagggcagcagcg

SEQ ID NO: 9161228 - DNA, 22 bp, Homo sapiens
gcaggatgccagggcagcagcg

SEQ ID NO: 9161229 - DNA, 22 bp, Homo sapiens
gcaggatgaaggcagaggctga

SEQ ID NO: 9161230 - DNA, 22 bp, Homo sapiens
gcaggatgaaggcagaggctga

SEQ ID NO: 9161231 - DNA, 18 bp, Homo sapiens
attttgaacaatgctgta

SEQ ID NO: 9161232 - DNA, 22 bp, Homo sapiens
attttgaaaccaagttatttcc

SEQ ID NO: 9161233 - DNA, 22 bp, Homo sapiens
gcctggctcctaagagcacaac

SEQ ID NO: 9161234 - DNA, 22 bp, Homo sapiens
gcctggctccctctgcagctcc

SEQ ID NO: 9161235 - DNA, 22 bp, Homo sapiens
gcctggctcacagagcagcctt

SEQ ID NO: 9161236 - DNA, 22 bp, Homo sapiens
gcctggctccctctgcagctcc

SEQ ID NO: 9161237 - DNA, 22 bp, Homo sapiens
attttcttctctccctggctgc

SEQ ID NO: 9161238 - DNA, 22 bp, Homo sapiens
attttgaaaagcatttgagtaa

SEQ ID NO: 9161239 - DNA, 22 bp, Homo sapiens
gcctgcccacggggctggcata

SEQ ID NO: 9161240 - DNA, 22 bp, Homo sapiens
gcctgcccacggggctggcata

SEQ ID NO: 9161241 - DNA, 23 bp, Homo sapiens
attttacaggtcagttccttgaa

SEQ ID NO: 9161242 - DNA, 22 bp, Homo sapiens
attttacataaggaaggtttaa

SEQ ID NO: 9161243 - DNA, 23 bp, Homo sapiens
gcctgccgcctggctgagaactg

SEQ ID NO: 9161244 - DNA, 22 bp, Homo sapiens
gcctgccctgaaagaggtgaag

SEQ ID NO: 9161245 - DNA, 22 bp, Homo sapiens
gcctgcctagaattgcagcttt

SEQ ID NO: 9161246 - DNA, 21 bp, Homo sapiens
gcctgccctctgtgatggcca

SEQ ID NO: 9161247 - DNA, 21 bp, Homo sapiens
gcctgccctctgtgatggcca

SEQ ID NO: 9161248 - DNA, 21 bp, Homo sapiens
gcctgccctctgtgatggcca

SEQ ID NO: 9161249 - DNA, 22 bp, Homo sapiens
gcctgccctgaaagaggtgaag

SEQ ID NO: 9161250 - DNA, 21 bp, Homo sapiens
gcctgccccatgtttctgttg

SEQ ID NO: 9161251 - DNA, 21 bp, Homo sapiens
gcctgccccatgtttctgttg

SEQ ID NO: 9161252 - DNA, 22 bp, Homo sapiens
gcctgccccttcctgggcaggg

SEQ ID NO: 9161253 - DNA, 22 bp, Homo sapiens
gcctgccccttcctgggcaggg

SEQ ID NO: 9161254 - DNA, 22 bp, Homo sapiens
atttgcaatgatttcagtgctt

SEQ ID NO: 9161255 - DNA, 22 bp, Homo sapiens
atttgcaattactcatgtcatt

SEQ ID NO: 9161256 - DNA, 22 bp, Homo sapiens
atttgcatatctgatagactaa

SEQ ID NO: 9161257 - DNA, 22 bp, Homo sapiens
atttgcataatagtgatttgta

SEQ ID NO: 9161258 - DNA, 22 bp, Homo sapiens
atttgcataaggatgctactgt

SEQ ID NO: 9161259 - DNA, 18 bp, Homo sapiens
atttgcaggcatgcaggc

SEQ ID NO: 9161260 - DNA, 22 bp, Homo sapiens
atttgcagctaggatccaaagt

SEQ ID NO: 9161261 - DNA, 22 bp, Homo sapiens
atttgcagaagggagggggacc

SEQ ID NO: 9161262 - DNA, 22 bp, Homo sapiens
atttgacccgcctcagacccca

SEQ ID NO: 9161263 - DNA, 22 bp, Homo sapiens
atttgaccaggaaaggaggatg

SEQ ID NO: 9161264 - DNA, 20 bp, Homo sapiens
atttgacttggagagagaaa

SEQ ID NO: 9161265 - DNA, 23 bp, Homo sapiens
atttgacagagcatagcatttct

SEQ ID NO: 9161266 - DNA, 22 bp, Homo sapiens
atttcttccttctcctagaaga

SEQ ID NO: 9161267 - DNA, 23 bp, Homo sapiens
atttgagaaagtatttttaagac

SEQ ID NO: 9161268 - DNA, 22 bp, Homo sapiens
atttgagcatataagtggccca

SEQ ID NO: 9161269 - DNA, 22 bp, Homo sapiens
atttgagcacctagataccctg

SEQ ID NO: 9161270 - DNA, 22 bp, Homo sapiens
atttgagcttggtagaggagag

SEQ ID NO: 9161271 - DNA, 22 bp, Homo sapiens
atttgattagctgtgtaatttt

SEQ ID NO: 9161272 - DNA, 22 bp, Homo sapiens
atttgattagctgtgtaatttt

SEQ ID NO: 9161273 - DNA, 22 bp, Homo sapiens
atttgattagctgtgtaatttt

SEQ ID NO: 9161274 - DNA, 22 bp, Homo sapiens
attttaataagattcccaagta

SEQ ID NO: 9161275 - DNA, 22 bp, Homo sapiens
atttgccttactgaagaaggag

SEQ ID NO: 9161276 - DNA, 22 bp, Homo sapiens
atttgcatatctgatagactaa

SEQ ID NO: 9161277 - DNA, 22 bp, Homo sapiens
atttgcctgtaagacaaggcct

SEQ ID NO: 9161278 - DNA, 22 bp, Homo sapiens
atttgccatgaagagtgtttga

SEQ ID NO: 9161279 - DNA, 22 bp, Homo sapiens
gcccagccagagctgtgtgatg

SEQ ID NO: 9161280 - DNA, 22 bp, Homo sapiens
gcccagcccagaaaggttcgga

SEQ ID NO: 9161281 - DNA, 22 bp, Homo sapiens
gcccagccacagtcactttcat

SEQ ID NO: 9161282 - DNA, 22 bp, Homo sapiens
gcccagccacagtcactttcat

SEQ ID NO: 9161283 - DNA, 18 bp, Homo sapiens
gccagaggtactactgat

SEQ ID NO: 9161284 - DNA, 22 bp, Homo sapiens
gccagaggtatcaaagatagta

SEQ ID NO: 9161285 - DNA, 22 bp, Homo sapiens
gccagaggggctcgaaggcgcg

SEQ ID NO: 9161286 - DNA, 22 bp, Homo sapiens
gccagaggggctcgaaggcgcg

SEQ ID NO: 9161287 - DNA, 22 bp, Homo sapiens
atttacataatagactttaggt

SEQ ID NO: 9161288 - DNA, 22 bp, Homo sapiens
atttacattccatggtggttac

SEQ ID NO: 9161289 - DNA, 22 bp, Homo sapiens
atttacattccatggtggttac

SEQ ID NO: 9161290 - DNA, 22 bp, Homo sapiens
atttacatttatttgagaaggt

SEQ ID NO: 9161291 - DNA, 22 bp, Homo sapiens
atttacatttatttgagaaggt

SEQ ID NO: 9161292 - DNA, 22 bp, Homo sapiens
atttacatttatttgagaaggt

SEQ ID NO: 9161293 - DNA, 17 bp, Homo sapiens
atttacattgtcaccga

SEQ ID NO: 9161294 - DNA, 17 bp, Homo sapiens
atttacattgtcaccga

SEQ ID NO: 9161295 - DNA, 22 bp, Homo sapiens
atttacatttatttgagaaggt

SEQ ID NO: 9161296 - DNA, 18 bp, Homo sapiens
gccagagggaagcaggtg

SEQ ID NO: 9161297 - DNA, 18 bp, Homo sapiens
gccagagggaagcaggtg

SEQ ID NO: 9161298 - DNA, 22 bp, Homo sapiens
gccagagggattcctggtgtgt

SEQ ID NO: 9161299 - DNA, 22 bp, Homo sapiens
atttactaatgtcatatcgcgt

SEQ ID NO: 9161300 - DNA, 19 bp, Homo sapiens
gccctcctcactgagctct

SEQ ID NO: 9161301 - DNA, 19 bp, Homo sapiens
gccctcctcactgagctct

SEQ ID NO: 9161302 - DNA, 22 bp, Homo sapiens
gccctcctgcaggggcttctgg

SEQ ID NO: 9161303 - DNA, 22 bp, Homo sapiens
gccctcctggcaggcagtgatg

SEQ ID NO: 9161304 - DNA, 22 bp, Homo sapiens
gccctgagttgagccttccaaa

SEQ ID NO: 9161305 - DNA, 22 bp, Homo sapiens
gccctgcaccccaatggcatga

SEQ ID NO: 9161306 - DNA, 22 bp, Homo sapiens
gccctccatggtgatccaggcc

SEQ ID NO: 9161307 - DNA, 22 bp, Homo sapiens
gccctcccctctgggtggtgag

SEQ ID NO: 9161308 - DNA, 23 bp, Homo sapiens
gccctccctcccaggtgggtgtt

SEQ ID NO: 9161309 - DNA, 22 bp, Homo sapiens
gccctgccctctcggcactcgc

SEQ ID NO: 9161310 - DNA, 22 bp, Homo sapiens
gccctgccctctcggcactcgc

SEQ ID NO: 9161311 - DNA, 22 bp, Homo sapiens
gccctgcagtgcggaggtggca

SEQ ID NO: 9161312 - DNA, 19 bp, Homo sapiens
gccctgcaggaggtggggc

SEQ ID NO: 9161313 - DNA, 22 bp, Homo sapiens
gccctgcaccccaatggcatga

SEQ ID NO: 9161314 - DNA, 23 bp, Homo sapiens
gccctgcccttagcacactcaca

SEQ ID NO: 9161315 - DNA, 22 bp, Homo sapiens
gccctccacctggtctctctgg

SEQ ID NO: 9161316 - DNA, 22 bp, Homo sapiens
gccccgcgcctggctccaggtg

SEQ ID NO: 9161317 - DNA, 22 bp, Homo sapiens
gcccctccatccatcaccgggg

SEQ ID NO: 9161318 - DNA, 22 bp, Homo sapiens
gcccaggagttcaagtctagtg

SEQ ID NO: 9161319 - DNA, 22 bp, Homo sapiens
gcccaggagttgaagggctgac

SEQ ID NO: 9161320 - DNA, 22 bp, Homo sapiens
gcccaggagttcaagtctagtg

SEQ ID NO: 9161321 - DNA, 22 bp, Homo sapiens
gcccaggagttgaagggctgac

SEQ ID NO: 9161322 - DNA, 22 bp, Homo sapiens
gcccaggagttgaagggctgac

SEQ ID NO: 9161323 - DNA, 22 bp, Homo sapiens
gcccagcccctgggtggacgtg

SEQ ID NO: 9161324 - DNA, 22 bp, Homo sapiens
gcccaggaggtggaggtgcagt

SEQ ID NO: 9161325 - DNA, 22 bp, Homo sapiens
gcccaggaggtggaggtgcagt

SEQ ID NO: 9161326 - DNA, 22 bp, Homo sapiens
gcccaggaggtggaggtgcagt

SEQ ID NO: 9161327 - DNA, 22 bp, Homo sapiens
gcccaggaggttgggctgtgca

SEQ ID NO: 9161328 - DNA, 22 bp, Homo sapiens
gcccaggagttcaaggctgcag

SEQ ID NO: 9161329 - DNA, 22 bp, Homo sapiens
gcccaggaggttgggctgtgca

SEQ ID NO: 9161330 - DNA, 22 bp, Homo sapiens
gcccaggagttcaaggctgcag

SEQ ID NO: 9161331 - DNA, 22 bp, Homo sapiens
gcctggctcctaaggactggct

SEQ ID NO: 9161332 - DNA, 22 bp, Homo sapiens
gcctggctcctaagagcacaac

SEQ ID NO: 9161333 - DNA, 22 bp, Homo sapiens
gcctggctcctaaggactggct

SEQ ID NO: 9161334 - DNA, 22 bp, Homo sapiens
gcctggctcctaaggactggct

SEQ ID NO: 9161335 - DNA, 21 bp, Homo sapiens
gcctggctctcactggcctgg

SEQ ID NO: 9161336 - DNA, 22 bp, Homo sapiens
gcctggctcgggcactcgccag

SEQ ID NO: 9161337 - DNA, 21 bp, Homo sapiens
gcctggctctcactggcctgg

SEQ ID NO: 9161338 - DNA, 21 bp, Homo sapiens
gcctggctctcactggcctgg

SEQ ID NO: 9161339 - DNA, 21 bp, Homo sapiens
gcctggctctcactggcctgg

SEQ ID NO: 9161340 - DNA, 22 bp, Homo sapiens
gcctggctctgagggagctcct

SEQ ID NO: 9161341 - DNA, 22 bp, Homo sapiens
gcctggctctgagtttctctcc

SEQ ID NO: 9161342 - DNA, 22 bp, Homo sapiens
gcctggctctgagggagctcct

SEQ ID NO: 9161343 - DNA, 22 bp, Homo sapiens
gcgcaggcccgggtcagggccg

SEQ ID NO: 9161344 - DNA, 22 bp, Homo sapiens
gcgccccatctacagtactttt

SEQ ID NO: 9161345 - DNA, 22 bp, Homo sapiens
gcgcaggcccgggtcagggccg

SEQ ID NO: 9161346 - DNA, 22 bp, Homo sapiens
gcgtttaaagatagctaataag

SEQ ID NO: 9161347 - DNA, 22 bp, Homo sapiens
gcgtttaagtgatgatcgtctt

SEQ ID NO: 9161348 - DNA, 22 bp, Homo sapiens
gcgtggggtaggtagacatgga

SEQ ID NO: 9161349 - DNA, 22 bp, Homo sapiens
gctaacattgattcagtgcctg

SEQ ID NO: 9161350 - DNA, 22 bp, Homo sapiens
gctaaataatcttcttctgaca

SEQ ID NO: 9161351 - DNA, 22 bp, Homo sapiens
gctaatgtgatagagcagaaag

SEQ ID NO: 9161352 - DNA, 22 bp, Homo sapiens
gctatgcaggagcctaatgaca

SEQ ID NO: 9161353 - DNA, 22 bp, Homo sapiens
gctcaaaggttgatagctgtgc

SEQ ID NO: 9161354 - DNA, 22 bp, Homo sapiens
gctcaaagaggcctccaaatcc

SEQ ID NO: 9161355 - DNA, 22 bp, Homo sapiens
gctattgtttattttgaatcta

SEQ ID NO: 9161356 - DNA, 22 bp, Homo sapiens
gctatttctttaaattgatctc

SEQ ID NO: 9161357 - DNA, 22 bp, Homo sapiens
gctatttttgagccatttataa

SEQ ID NO: 9161358 - DNA, 22 bp, Homo sapiens
gctctatgaacctgaatctcac

SEQ ID NO: 9161359 - DNA, 22 bp, Homo sapiens
gctctaggagaggggcagtcca

SEQ ID NO: 9161360 - DNA, 22 bp, Homo sapiens
gctctagattgttacaaagttc

SEQ ID NO: 9161361 - DNA, 22 bp, Homo sapiens
gctctagaaagaaggatgtggg

SEQ ID NO: 9161362 - DNA, 22 bp, Homo sapiens
gctctaaagaacccagaggagt

SEQ ID NO: 9161363 - DNA, 22 bp, Homo sapiens
gctccaggctgctctgtcccat

SEQ ID NO: 9161364 - DNA, 22 bp, Homo sapiens
gctccaggctgctctgtcccat

SEQ ID NO: 9161365 - DNA, 22 bp, Homo sapiens
gctccaggctgctctgtcccat

SEQ ID NO: 9161366 - DNA, 17 bp, Homo sapiens
gctccaggcgtgagtga

SEQ ID NO: 9161367 - DNA, 22 bp, Homo sapiens
gctccaggctgctctgtcccat

SEQ ID NO: 9161368 - DNA, 19 bp, Homo sapiens
gctcctggatgacctgtgg

SEQ ID NO: 9161369 - DNA, 22 bp, Homo sapiens
gctcgaccgccagaaacttcct

SEQ ID NO: 9161370 - DNA, 22 bp, Homo sapiens
gctcctttattttctctcgtgt

SEQ ID NO: 9161371 - DNA, 22 bp, Homo sapiens
gctcgcgccgcaccggtccacc

SEQ ID NO: 9161372 - DNA, 22 bp, Homo sapiens
gctcggagtcccacctgggaaa

SEQ ID NO: 9161373 - DNA, 22 bp, Homo sapiens
gctcgcttagattttcctctga

SEQ ID NO: 9161374 - DNA, 22 bp, Homo sapiens
gctccaggcagcatagtggatg

SEQ ID NO: 9161375 - DNA, 22 bp, Homo sapiens
gctccaggcagcatagtggatg

SEQ ID NO: 9161376 - DNA, 22 bp, Homo sapiens
gctccaggcagcatagtggatg

SEQ ID NO: 9161377 - DNA, 22 bp, Homo sapiens
gctccaggccacggcttcttgg

SEQ ID NO: 9161378 - DNA, 22 bp, Homo sapiens
gctccaggcgagctggaccaga

SEQ ID NO: 9161379 - DNA, 22 bp, Homo sapiens
gctccaggccccagcgttccgc

SEQ ID NO: 9161380 - DNA, 22 bp, Homo sapiens
gctccaggccccagcgttccgc

SEQ ID NO: 9161381 - DNA, 17 bp, Homo sapiens
gctccaggcgtgagtga

SEQ ID NO: 9161382 - DNA, 22 bp, Homo sapiens
gctccaggcgagctggaccaga

SEQ ID NO: 9161383 - DNA, 17 bp, Homo sapiens
gctccaggcgtgagtga

SEQ ID NO: 9161384 - DNA, 22 bp, Homo sapiens
gctcagggtcccttggtgctgg

SEQ ID NO: 9161385 - DNA, 22 bp, Homo sapiens
gctcagggctaaggctgagggg

SEQ ID NO: 9161386 - DNA, 22 bp, Homo sapiens
caaatattccaggtacatccct

SEQ ID NO: 9161387 - DNA, 19 bp, Homo sapiens
gctctgagaggggcatggg

SEQ ID NO: 9161388 - DNA, 22 bp, Homo sapiens
gctctgagaggatgctgagcag

SEQ ID NO: 9161389 - DNA, 22 bp, Homo sapiens
gctctgaagggtgagctgttcg

SEQ ID NO: 9161390 - DNA, 22 bp, Homo sapiens
gctctgaacttccaccttttca

SEQ ID NO: 9161391 - DNA, 22 bp, Homo sapiens
gctctgaatcaatcagataagg

SEQ ID NO: 9161392 - DNA, 22 bp, Homo sapiens
caaatcatggctctagcttaca

SEQ ID NO: 9161393 - DNA, 22 bp, Homo sapiens
caaatcatggaataactagaga

SEQ ID NO: 9161394 - DNA, 22 bp, Homo sapiens
caaatctatatgttgatattct

SEQ ID NO: 9161395 - DNA, 22 bp, Homo sapiens
caaatctgagtctacaatttta

SEQ ID NO: 9161396 - DNA, 22 bp, Homo sapiens
caaatctaggatgcatgtagtg

SEQ ID NO: 9161397 - DNA, 22 bp, Homo sapiens
caaatctaggatgcatgtagtg

SEQ ID NO: 9161398 - DNA, 22 bp, Homo sapiens
gctctgggtgaagggtaccatt

SEQ ID NO: 9161399 - DNA, 22 bp, Homo sapiens
gctctgggtgaagggtaccatt

SEQ ID NO: 9161400 - DNA, 22 bp, Homo sapiens
gctctgggtgaatggcagattg

SEQ ID NO: 9161401 - DNA, 20 bp, Homo sapiens
gctctgggtggtaaatgact

SEQ ID NO: 9161402 - DNA, 22 bp, Homo sapiens
gctctgggtgaatggcagattg

SEQ ID NO: 9161403 - DNA, 22 bp, Homo sapiens
gctctgggtgaatggcagattg

SEQ ID NO: 9161404 - DNA, 15 bp, Homo sapiens
gctctgggtatttga

SEQ ID NO: 9161405 - DNA, 22 bp, Homo sapiens
caaatgaagaaccttctcacct

SEQ ID NO: 9161406 - DNA, 22 bp, Homo sapiens
caaatgaaaatggcgtcttgga

SEQ ID NO: 9161407 - DNA, 22 bp, Homo sapiens
gctctgggtgaacttggagcaa

SEQ ID NO: 9161408 - DNA, 22 bp, Homo sapiens
gctgagctgggacagtcctggg

SEQ ID NO: 9161409 - DNA, 22 bp, Homo sapiens
gctctgggttctgatttatgag

SEQ ID NO: 9161410 - DNA, 22 bp, Homo sapiens
gctctgggttctgatttatgag

SEQ ID NO: 9161411 - DNA, 22 bp, Homo sapiens
gctgactttgcctgtctttagc

SEQ ID NO: 9161412 - DNA, 22 bp, Homo sapiens
gctctggttccagcgcgcccga

SEQ ID NO: 9161413 - DNA, 20 bp, Homo sapiens
gctgactgtttgggtggcgg

SEQ ID NO: 9161414 - DNA, 22 bp, Homo sapiens
gctgaggacatcatggaaggaa

SEQ ID NO: 9161415 - DNA, 22 bp, Homo sapiens
gctgaggacatcatggaaggaa

SEQ ID NO: 9161416 - DNA, 22 bp, Homo sapiens
gctgaggacatcatggaaggaa

SEQ ID NO: 9161417 - DNA, 22 bp, Homo sapiens
gctgaggacatcatggaaggaa

SEQ ID NO: 9161418 - DNA, 20 bp, Homo sapiens
gctgaggagcagtgtggttg

SEQ ID NO: 9161419 - DNA, 20 bp, Homo sapiens
gctgaggagcagtgtggttg

SEQ ID NO: 9161420 - DNA, 22 bp, Homo sapiens
gctgaggacatacacattgtgc

SEQ ID NO: 9161421 - DNA, 22 bp, Homo sapiens
gctgaggacatacacattgtgc

SEQ ID NO: 9161422 - DNA, 22 bp, Homo sapiens
gctgaggaagtcaggtggccca

SEQ ID NO: 9161423 - DNA, 22 bp, Homo sapiens
gctgaggaagtcaggtggccca

SEQ ID NO: 9161424 - DNA, 22 bp, Homo sapiens
gctgaggaagtcaggtggccca

SEQ ID NO: 9161425 - DNA, 22 bp, Homo sapiens
gctgaggaagtcaggtggccca

SEQ ID NO: 9161426 - DNA, 22 bp, Homo sapiens
gctgaggaaaggctggaaggga

SEQ ID NO: 9161427 - DNA, 22 bp, Homo sapiens
gctgaggaaaggctggaaggga

SEQ ID NO: 9161428 - DNA, 22 bp, Homo sapiens
gctgaggaagtcaggtggccca

SEQ ID NO: 9161429 - DNA, 22 bp, Homo sapiens
gctgaggaaggtttcttatcaa

SEQ ID NO: 9161430 - DNA, 22 bp, Homo sapiens
gctgaggaaggtttcttatcaa

SEQ ID NO: 9161431 - DNA, 22 bp, Homo sapiens
gctgaggaaaggctggaaggga

SEQ ID NO: 9161432 - DNA, 22 bp, Homo sapiens
gctgaggaaaggctggaaggga

SEQ ID NO: 9161433 - DNA, 22 bp, Homo sapiens
gctgaggaaaccaatgctcaga

SEQ ID NO: 9161434 - DNA, 22 bp, Homo sapiens
gctgaggaaaccaatgctcaga

SEQ ID NO: 9161435 - DNA, 22 bp, Homo sapiens
gctgaggaaaccaatgctcaga

SEQ ID NO: 9161436 - DNA, 22 bp, Homo sapiens
caaatgaatagggagtgtgatg

SEQ ID NO: 9161437 - DNA, 22 bp, Homo sapiens
caaatgaatatttccatgggtt

SEQ ID NO: 9161438 - DNA, 22 bp, Homo sapiens
caaatgaatatttccatgggtt

SEQ ID NO: 9161439 - DNA, 22 bp, Homo sapiens
caaatgaatttccctgcaaatg

SEQ ID NO: 9161440 - DNA, 22 bp, Homo sapiens
caaatgaagggagctgaagtct

SEQ ID NO: 9161441 - DNA, 20 bp, Homo sapiens
caaatgaagctgttggcctc

SEQ ID NO: 9161442 - DNA, 22 bp, Homo sapiens
caaatgaagagggcaacttctg

SEQ ID NO: 9161443 - DNA, 22 bp, Homo sapiens
gctgaggaggtgtggttaggtg

SEQ ID NO: 9161444 - DNA, 22 bp, Homo sapiens
caaatgaagaaccttctcacct

SEQ ID NO: 9161445 - DNA, 22 bp, Homo sapiens
gctgaggaggtgtggttaggtg

SEQ ID NO: 9161446 - DNA, 22 bp, Homo sapiens
gctgaggaggtgtggttaggtg

SEQ ID NO: 9161447 - DNA, 22 bp, Homo sapiens
gctgaggagcgagaactctgct

SEQ ID NO: 9161448 - DNA, 22 bp, Homo sapiens
gctgaggagcgagaactctgct

SEQ ID NO: 9161449 - DNA, 22 bp, Homo sapiens
caaatgaaggtggtgggtcatt

SEQ ID NO: 9161450 - DNA, 22 bp, Homo sapiens
caaatgaaggtggtgggtcatt

SEQ ID NO: 9161451 - DNA, 22 bp, Homo sapiens
caaatgaagggagctgaagtct

SEQ ID NO: 9161452 - DNA, 22 bp, Homo sapiens
caaatgaagggagctgaagtct

SEQ ID NO: 9161453 - DNA, 22 bp, Homo sapiens
caaatgaagtccaaagggctta

SEQ ID NO: 9161454 - DNA, 22 bp, Homo sapiens
ctatcactctctatttgttctt

SEQ ID NO: 9161455 - DNA, 22 bp, Homo sapiens
ctagtgaaatttgcaagtaatt

SEQ ID NO: 9161456 - DNA, 22 bp, Homo sapiens
agtcagcatctgcactgtgctg

SEQ ID NO: 9161457 - DNA, 22 bp, Homo sapiens
agtcagcatctgcactgtgctg

SEQ ID NO: 9161458 - DNA, 22 bp, Homo sapiens
agtcagcattttcactgagcta

SEQ ID NO: 9161459 - DNA, 19 bp, Homo sapiens
agtcagcatgcatgtgact

SEQ ID NO: 9161460 - DNA, 22 bp, Homo sapiens
agtcagcagtgaaagcacagcc

SEQ ID NO: 9161461 - DNA, 22 bp, Homo sapiens
agtcagcagtgaaagcacagcc

SEQ ID NO: 9161462 - DNA, 22 bp, Homo sapiens
agtcagcagtgaaagcacagcc

SEQ ID NO: 9161463 - DNA, 22 bp, Homo sapiens
agtcagcagcctggccaggaga

SEQ ID NO: 9161464 - DNA, 22 bp, Homo sapiens
agtcagcactcctgaggatcac

SEQ ID NO: 9161465 - DNA, 22 bp, Homo sapiens
agtcaggaacctcagcaagtct

SEQ ID NO: 9161466 - DNA, 22 bp, Homo sapiens
agtcaggatatgccttgtgggc

SEQ ID NO: 9161467 - DNA, 22 bp, Homo sapiens
agtcaggagctgctgcattgta

SEQ ID NO: 9161468 - DNA, 22 bp, Homo sapiens
agtcaggagctgctgcattgta

SEQ ID NO: 9161469 - DNA, 22 bp, Homo sapiens
ctattgaattaactattaaagt

SEQ ID NO: 9161470 - DNA, 22 bp, Homo sapiens
ctattgtagtaagggaaagcca

SEQ ID NO: 9161471 - DNA, 22 bp, Homo sapiens
ctatttaagaataaaaggggca

SEQ ID NO: 9161472 - DNA, 22 bp, Homo sapiens
ctatctcagataacctgcacca

SEQ ID NO: 9161473 - DNA, 20 bp, Homo sapiens
ctatctcctggcgtgccttc

SEQ ID NO: 9161474 - DNA, 22 bp, Homo sapiens
ctatctttcgattctagcttaa

SEQ ID NO: 9161475 - DNA, 22 bp, Homo sapiens
ctatcttttgttcattttgagt

SEQ ID NO: 9161476 - DNA, 22 bp, Homo sapiens
ctatctttcgattctagcttaa

SEQ ID NO: 9161477 - DNA, 22 bp, Homo sapiens
ctatcttttgttcattttgagt

SEQ ID NO: 9161478 - DNA, 22 bp, Homo sapiens
ctatgaccccagcatgaataag

SEQ ID NO: 9161479 - DNA, 22 bp, Homo sapiens
ctatgaccccagcatgaataag

SEQ ID NO: 9161480 - DNA, 22 bp, Homo sapiens
ctaggagaatattatagtagtg

SEQ ID NO: 9161481 - DNA, 22 bp, Homo sapiens
ctaggaggcgggggctgcagta

SEQ ID NO: 9161482 - DNA, 22 bp, Homo sapiens
ctaggaaagacacagagagttt

SEQ ID NO: 9161483 - DNA, 22 bp, Homo sapiens
ctaggaaagacacagagagttt

SEQ ID NO: 9161484 - DNA, 22 bp, Homo sapiens
ctaggaaatactgtttcaaggc

SEQ ID NO: 9161485 - DNA, 21 bp, Homo sapiens
agtcacattgggggtttaggg

SEQ ID NO: 9161486 - DNA, 20 bp, Homo sapiens
agtcacattgagcttttgga

SEQ ID NO: 9161487 - DNA, 22 bp, Homo sapiens
agtcacatttgggggtgtcaaa

SEQ ID NO: 9161488 - DNA, 22 bp, Homo sapiens
agtcacatggcagagagaagtt

SEQ ID NO: 9161489 - DNA, 22 bp, Homo sapiens
agtcacatggactcaggatgac

SEQ ID NO: 9161490 - DNA, 22 bp, Homo sapiens
agtcacatgcattttcttcaat

SEQ ID NO: 9161491 - DNA, 22 bp, Homo sapiens
agtcacattctggggtactggg

SEQ ID NO: 9161492 - DNA, 22 bp, Homo sapiens
agtcacatgggattagaaccca

SEQ ID NO: 9161493 - DNA, 22 bp, Homo sapiens
agtcacatgagtttctctttat

SEQ ID NO: 9161494 - DNA, 22 bp, Homo sapiens
agtcacatgatccctgggcctg

SEQ ID NO: 9161495 - DNA, 20 bp, Homo sapiens
agtcacatgcatacacaagt

SEQ ID NO: 9161496 - DNA, 22 bp, Homo sapiens
agtcacatgagtttctctttat

SEQ ID NO: 9161497 - DNA, 22 bp, Homo sapiens
agtcacatgaggaaggggaagg

SEQ ID NO: 9161498 - DNA, 22 bp, Homo sapiens
agtcacatgagcactaattagg

SEQ ID NO: 9161499 - DNA, 22 bp, Homo sapiens
agtcacatgcattttcttcaat

SEQ ID NO: 9161500 - DNA, 20 bp, Homo sapiens
agtcacatgcatacacaagt

SEQ ID NO: 9161501 - DNA, 22 bp, Homo sapiens
agtcacatagtgttttggaatc

SEQ ID NO: 9161502 - DNA, 22 bp, Homo sapiens
agtcacatagtgttttggaatc

SEQ ID NO: 9161503 - DNA, 22 bp, Homo sapiens
agtcacatcgattataaaattt

SEQ ID NO: 9161504 - DNA, 22 bp, Homo sapiens
agtcacatgagcactaattagg

SEQ ID NO: 9161505 - DNA, 23 bp, Homo sapiens
agtcacatcttagcagccaggtc

SEQ ID NO: 9161506 - DNA, 22 bp, Homo sapiens
agtcacatagctctggtttctt

SEQ ID NO: 9161507 - DNA, 22 bp, Homo sapiens
agtcacatagctctggtttctt

SEQ ID NO: 9161508 - DNA, 22 bp, Homo sapiens
agtcacatagaagtgggtttaa

SEQ ID NO: 9161509 - DNA, 22 bp, Homo sapiens
agtcacaggttcttgggattag

SEQ ID NO: 9161510 - DNA, 22 bp, Homo sapiens
agtatttctgaatattatcata

SEQ ID NO: 9161511 - DNA, 22 bp, Homo sapiens
agtatttctgaatattatcata

SEQ ID NO: 9161512 - DNA, 18 bp, Homo sapiens
agtatttctgcatgtctt

SEQ ID NO: 9161513 - DNA, 22 bp, Homo sapiens
agtatttctgctcatgaaagag

SEQ ID NO: 9161514 - DNA, 22 bp, Homo sapiens
agtcaagagacttaaaatattt

SEQ ID NO: 9161515 - DNA, 22 bp, Homo sapiens
agtcaaggtggaccagaaaaat

SEQ ID NO: 9161516 - DNA, 22 bp, Homo sapiens
agtcaaggtggaccagaaaaat

SEQ ID NO: 9161517 - DNA, 22 bp, Homo sapiens
agtaggcattgtgaaactgcat

SEQ ID NO: 9161518 - DNA, 22 bp, Homo sapiens
agtaggcatagaaagaagcacc

SEQ ID NO: 9161519 - DNA, 22 bp, Homo sapiens
agtaggcagaagtggcattcgg

SEQ ID NO: 9161520 - DNA, 22 bp, Homo sapiens
agtaggctgttttatgggccaa

SEQ ID NO: 9161521 - DNA, 22 bp, Homo sapiens
agtagggagaccggaggccgcc

SEQ ID NO: 9161522 - DNA, 20 bp, Homo sapiens
agtaggggaatgcaagagca

SEQ ID NO: 9161523 - DNA, 19 bp, Homo sapiens
agtagcagaaagtgcagtg

SEQ ID NO: 9161524 - DNA, 22 bp, Homo sapiens
agtagcagaaggtcttgaaggg

SEQ ID NO: 9161525 - DNA, 22 bp, Homo sapiens
agtagcagtgacagctgaggta

SEQ ID NO: 9161526 - DNA, 22 bp, Homo sapiens
agtagcataaatagtggtagta

SEQ ID NO: 9161527 - DNA, 22 bp, Homo sapiens
agtaggaggcgggagcatgaag

SEQ ID NO: 9161528 - DNA, 22 bp, Homo sapiens
agtaacaagtgccaacgttaga

SEQ ID NO: 9161529 - DNA, 22 bp, Homo sapiens
agtaacaaatgcatctgggcat

SEQ ID NO: 9161530 - DNA, 22 bp, Homo sapiens
agtagcacaattttgtccctaa

SEQ ID NO: 9161531 - DNA, 22 bp, Homo sapiens
agtagaggccaggcctccctgg

SEQ ID NO: 9161532 - DNA, 22 bp, Homo sapiens
agtagaggagataggattgtta

SEQ ID NO: 9161533 - DNA, 22 bp, Homo sapiens
ccttctccctctgagaggaacc

SEQ ID NO: 9161534 - DNA, 22 bp, Homo sapiens
ccttctccctctgagaggaacc

SEQ ID NO: 9161535 - DNA, 22 bp, Homo sapiens
agtaaaaatatgcttgtggcta

SEQ ID NO: 9161536 - DNA, 22 bp, Homo sapiens
ccttctcccctctgcagggtgt

SEQ ID NO: 9161537 - DNA, 22 bp, Homo sapiens
ccttccaggttttggctccatt

SEQ ID NO: 9161538 - DNA, 22 bp, Homo sapiens
ccttccaggttttggctccatt

SEQ ID NO: 9161539 - DNA, 22 bp, Homo sapiens
ccttccaggttttggctccatt

SEQ ID NO: 9161540 - DNA, 22 bp, Homo sapiens
ccttccagggtttttgccaatc

SEQ ID NO: 9161541 - DNA, 22 bp, Homo sapiens
agtaaatgattattttgccaac

SEQ ID NO: 9161542 - DNA, 22 bp, Homo sapiens
agtaaataacagagaaaatggg

SEQ ID NO: 9161543 - DNA, 22 bp, Homo sapiens
agtaaagcggtgtcacagaatg

SEQ ID NO: 9161544 - DNA, 22 bp, Homo sapiens
agtaaacataatttacctgtag

SEQ ID NO: 9161545 - DNA, 22 bp, Homo sapiens
agtaaacattttcatattttct

SEQ ID NO: 9161546 - DNA, 22 bp, Homo sapiens
agtaaactgtgggtacagatgt

SEQ ID NO: 9161547 - DNA, 22 bp, Homo sapiens
agtaaagcctactcaaccacac

SEQ ID NO: 9161548 - DNA, 22 bp, Homo sapiens
aggtggcagagtgacaggctga

SEQ ID NO: 9161549 - DNA, 22 bp, Homo sapiens
cctgtgggtacaacagggtcac

SEQ ID NO: 9161550 - DNA, 22 bp, Homo sapiens
cctgtgggaggggcctggcgcg

SEQ ID NO: 9161551 - DNA, 22 bp, Homo sapiens
cctgtgggagcccaggcagata

SEQ ID NO: 9161552 - DNA, 22 bp, Homo sapiens
cctgtgggccctggacagagac

SEQ ID NO: 9161553 - DNA, 22 bp, Homo sapiens
cctgtgggccaaggacctgcca

SEQ ID NO: 9161554 - DNA, 22 bp, Homo sapiens
cctgtgggccctggacagagac

SEQ ID NO: 9161555 - DNA, 22 bp, Homo sapiens
cctgtgggccctggacagagac

SEQ ID NO: 9161556 - DNA, 22 bp, Homo sapiens
ccttccaagtgcttgccgcttt

SEQ ID NO: 9161557 - DNA, 22 bp, Homo sapiens
ccttccagaaagcacttagtta

SEQ ID NO: 9161558 - DNA, 22 bp, Homo sapiens
ccttccagaaagcacttagtta

SEQ ID NO: 9161559 - DNA, 22 bp, Homo sapiens
ccttccagatgtaagagctgat

SEQ ID NO: 9161560 - DNA, 22 bp, Homo sapiens
ccttccagaggcgtgacaccct

SEQ ID NO: 9161561 - DNA, 22 bp, Homo sapiens
ccttccagaggcgtgacaccct

SEQ ID NO: 9161562 - DNA, 22 bp, Homo sapiens
ccttccaggagtctctgcaggt

SEQ ID NO: 9161563 - DNA, 22 bp, Homo sapiens
ccttccagatgtaagagctgat

SEQ ID NO: 9161564 - DNA, 22 bp, Homo sapiens
ccttccagggctctccagaacc

SEQ ID NO: 9161565 - DNA, 22 bp, Homo sapiens
ccttccagggagcaggcagtgt

SEQ ID NO: 9161566 - DNA, 22 bp, Homo sapiens
ccttccaggctggaggcttggg

SEQ ID NO: 9161567 - DNA, 22 bp, Homo sapiens
ccttccaggagtctctgcaggt

SEQ ID NO: 9161568 - DNA, 22 bp, Homo sapiens
cctgtttattgtgaagaaccca

SEQ ID NO: 9161569 - DNA, 22 bp, Homo sapiens
cctgtttatctatctagagatg

SEQ ID NO: 9161570 - DNA, 22 bp, Homo sapiens
cctgtgggagcccaggcagata

SEQ ID NO: 9161571 - DNA, 22 bp, Homo sapiens
aggtgcagctggtggagtctgg

SEQ ID NO: 9161572 - DNA, 22 bp, Homo sapiens
aggtgcaggagctgtgcaggga

SEQ ID NO: 9161573 - DNA, 18 bp, Homo sapiens
aggtgcagcctctgaggc

SEQ ID NO: 9161574 - DNA, 22 bp, Homo sapiens
aggtgcagctggtggagtctgg

SEQ ID NO: 9161575 - DNA, 18 bp, Homo sapiens
aggtgcagcctctgaggc

SEQ ID NO: 9161576 - DNA, 22 bp, Homo sapiens
aggtgcagcatgagtccaacgg

SEQ ID NO: 9161577 - DNA, 17 bp, Homo sapiens
aggtgcagaggcagagc

SEQ ID NO: 9161578 - DNA, 22 bp, Homo sapiens
cctgggtccaattctggcttgt

SEQ ID NO: 9161579 - DNA, 21 bp, Homo sapiens
aggtgcagagccagggaccag

SEQ ID NO: 9161580 - DNA, 21 bp, Homo sapiens
aggtgcagagccagggaccag

SEQ ID NO: 9161581 - DNA, 17 bp, Homo sapiens
aggtgcagaggcagagc

SEQ ID NO: 9161582 - DNA, 22 bp, Homo sapiens
cctgggtcactcaggcaggcgg

SEQ ID NO: 9161583 - DNA, 22 bp, Homo sapiens
cctgggtcactcaggcaggcgg

SEQ ID NO: 9161584 - DNA, 22 bp, Homo sapiens
cctgggtcaccaggcccaggca

SEQ ID NO: 9161585 - DNA, 22 bp, Homo sapiens
cctgggtcaccaggcccaggca

SEQ ID NO: 9161586 - DNA, 22 bp, Homo sapiens
cctgggtacccttggcggcctt

SEQ ID NO: 9161587 - DNA, 22 bp, Homo sapiens
cctggggtatataggtgaatat

SEQ ID NO: 9161588 - DNA, 22 bp, Homo sapiens
cctggggtcacttgcagccgca

SEQ ID NO: 9161589 - DNA, 22 bp, Homo sapiens
cctggggtcagggacgctgtgc

SEQ ID NO: 9161590 - DNA, 19 bp, Homo sapiens
aggtcctgatcagcaagga

SEQ ID NO: 9161591 - DNA, 23 bp, Homo sapiens
aggtcctggacatatgtgcatca

SEQ ID NO: 9161592 - DNA, 22 bp, Homo sapiens
aggtcctgatgatctctgagag

SEQ ID NO: 9161593 - DNA, 22 bp, Homo sapiens
aggtcctgatgatctctgagag

SEQ ID NO: 9161594 - DNA, 22 bp, Homo sapiens
aggtcctggactgctcttgtta

SEQ ID NO: 9161595 - DNA, 22 bp, Homo sapiens
aggtcctggactgctcttgtta

SEQ ID NO: 9161596 - DNA, 22 bp, Homo sapiens
aggtcctggtcttgagtcttaa

SEQ ID NO: 9161597 - DNA, 22 bp, Homo sapiens
aggtcctgggagttctagtgtg

SEQ ID NO: 9161598 - DNA, 20 bp, Homo sapiens
aggtcctgggactggcagag

SEQ ID NO: 9161599 - DNA, 22 bp, Homo sapiens
aggtcctgggagttctagtgtg

SEQ ID NO: 9161600 - DNA, 22 bp, Homo sapiens
aggtcctggtgaccatggagtt

SEQ ID NO: 9161601 - DNA, 20 bp, Homo sapiens
aggtcctggttctctgggat

SEQ ID NO: 9161602 - DNA, 22 bp, Homo sapiens
aggtcctggtgaccatggagtt

SEQ ID NO: 9161603 - DNA, 22 bp, Homo sapiens
aggtcctggtgaccatggagtt

SEQ ID NO: 9161604 - DNA, 20 bp, Homo sapiens
aggtcctggttctctgggat

SEQ ID NO: 9161605 - DNA, 20 bp, Homo sapiens
aggtcctggttctctgggat

SEQ ID NO: 9161606 - DNA, 20 bp, Homo sapiens
aggtcctggttctctgggat

SEQ ID NO: 9161607 - DNA, 22 bp, Homo sapiens
cctgggctttgagggcaggatg

SEQ ID NO: 9161608 - DNA, 22 bp, Homo sapiens
cctgggctttgagggcaggatg

SEQ ID NO: 9161609 - DNA, 22 bp, Homo sapiens
cctggggctctgcacagagcag

SEQ ID NO: 9161610 - DNA, 22 bp, Homo sapiens
cctggggctccagagcagcgga

SEQ ID NO: 9161611 - DNA, 22 bp, Homo sapiens
cctggggctttctttgtatcat

SEQ ID NO: 9161612 - DNA, 22 bp, Homo sapiens
cctggggctctgcacagagcag

SEQ ID NO: 9161613 - DNA, 22 bp, Homo sapiens
cctggggctctgcacagagcag

SEQ ID NO: 9161614 - DNA, 20 bp, Homo sapiens
cctggggtacactggcatgt

SEQ ID NO: 9161615 - DNA, 22 bp, Homo sapiens
cctggggctttctttgtatcat

SEQ ID NO: 9161616 - DNA, 22 bp, Homo sapiens
aggtaaattcagcagtgacatt

SEQ ID NO: 9161617 - DNA, 22 bp, Homo sapiens
aggtaaattcagcagtgacatt

SEQ ID NO: 9161618 - DNA, 22 bp, Homo sapiens
aggtaacatgtggtgctataag

SEQ ID NO: 9161619 - DNA, 22 bp, Homo sapiens
aggtaacactacttagtatact

SEQ ID NO: 9161620 - DNA, 22 bp, Homo sapiens
aggtaacactacttagtatact

SEQ ID NO: 9161621 - DNA, 22 bp, Homo sapiens
aggtaaagacagtgaaagaggg

SEQ ID NO: 9161622 - DNA, 22 bp, Homo sapiens
aggtaaagaaaggtgtaacatt

SEQ ID NO: 9161623 - DNA, 22 bp, Homo sapiens
aggtaaggctgtaagctaagcc

SEQ ID NO: 9161624 - DNA, 22 bp, Homo sapiens
aggtaagccttgcctgagaaaa

SEQ ID NO: 9161625 - DNA, 22 bp, Homo sapiens
aggtaactgtggctaggtaact

SEQ ID NO: 9161626 - DNA, 22 bp, Homo sapiens
aggtacagatgaaagtctagtt

SEQ ID NO: 9161627 - DNA, 22 bp, Homo sapiens
aggtaaggtttggaggcagtgg

SEQ ID NO: 9161628 - DNA, 22 bp, Homo sapiens
aggtaattactagagttattta

SEQ ID NO: 9161629 - DNA, 22 bp, Homo sapiens
agggttgtaagtgtatggtttc

SEQ ID NO: 9161630 - DNA, 22 bp, Homo sapiens
agggttgcttgagcccaggagt

SEQ ID NO: 9161631 - DNA, 22 bp, Homo sapiens
aggtaaaatagatagtatttct

SEQ ID NO: 9161632 - DNA, 22 bp, Homo sapiens
aggtaaacaggagaaaatgaga

SEQ ID NO: 9161633 - DNA, 22 bp, Homo sapiens
aggtaaaatgagtctccattat

SEQ ID NO: 9161634 - DNA, 22 bp, Homo sapiens
aggtaaaatagatagtatttct

SEQ ID NO: 9161635 - DNA, 22 bp, Homo sapiens
agggttctgccagtgtcttgag

SEQ ID NO: 9161636 - DNA, 22 bp, Homo sapiens
agggttgcaccatgttggtcag

SEQ ID NO: 9161637 - DNA, 22 bp, Homo sapiens
agggttgcagcagaggcccagt

SEQ ID NO: 9161638 - DNA, 22 bp, Homo sapiens
agggttgcaggggccatgccca

SEQ ID NO: 9161639 - DNA, 22 bp, Homo sapiens
agggttgcctctgagtgctccg

SEQ ID NO: 9161640 - DNA, 22 bp, Homo sapiens
agggttctgccagtgtcttgag

SEQ ID NO: 9161641 - DNA, 22 bp, Homo sapiens
agggttgcatttttagaggctc

SEQ ID NO: 9161642 - DNA, 20 bp, Homo sapiens
agggttcccttgttcagcag

SEQ ID NO: 9161643 - DNA, 19 bp, Homo sapiens
agggttacccgctgccacc

SEQ ID NO: 9161644 - DNA, 22 bp, Homo sapiens
agggtgggctagactcttcccc

SEQ ID NO: 9161645 - DNA, 22 bp, Homo sapiens
cctgagtagctggaattaaagg

SEQ ID NO: 9161646 - DNA, 22 bp, Homo sapiens
cctgagtcaagatgtatggtaa

SEQ ID NO: 9161647 - DNA, 22 bp, Homo sapiens
cctgagtccaaaagtctttagc

SEQ ID NO: 9161648 - DNA, 21 bp, Homo sapiens
cctgaggtttctggcctctgt

SEQ ID NO: 9161649 - DNA, 22 bp, Homo sapiens
aggtcagctgtgtgtgcatgag

SEQ ID NO: 9161650 - DNA, 22 bp, Homo sapiens
aggtcagctgctgataggcagc

SEQ ID NO: 9161651 - DNA, 22 bp, Homo sapiens
aggtcagctgcactggtgtaat

SEQ ID NO: 9161652 - DNA, 21 bp, Homo sapiens
aggtcagcccagctctggaag

SEQ ID NO: 9161653 - DNA, 21 bp, Homo sapiens
aggtcagcccagctctggaag

SEQ ID NO: 9161654 - DNA, 22 bp, Homo sapiens
aggtcagcatgctcctctctgt

SEQ ID NO: 9161655 - DNA, 22 bp, Homo sapiens
aggtcaccatggcatgctccac

SEQ ID NO: 9161656 - DNA, 22 bp, Homo sapiens
aggtcaccatggcatgctccac

SEQ ID NO: 9161657 - DNA, 22 bp, Homo sapiens
aggtcagggtattcacgtctgt

SEQ ID NO: 9161658 - DNA, 21 bp, Homo sapiens
cctgggagaattgggtgtggc

SEQ ID NO: 9161659 - DNA, 22 bp, Homo sapiens
aggtcagtgtagtggtttgggc

SEQ ID NO: 9161660 - DNA, 22 bp, Homo sapiens
cctgggaggctgaggctgcagt

SEQ ID NO: 9161661 - DNA, 22 bp, Homo sapiens
cctgggaggctgtgggtctgct

SEQ ID NO: 9161662 - DNA, 22 bp, Homo sapiens
cctgggaggctgtgggtctgct

SEQ ID NO: 9161663 - DNA, 22 bp, Homo sapiens
cctgggaggtggaggttgcagc

SEQ ID NO: 9161664 - DNA, 22 bp, Homo sapiens
cctgggaggtggaggttgcagc

SEQ ID NO: 9161665 - DNA, 22 bp, Homo sapiens
cctgggaggtggaggttgcagt

SEQ ID NO: 9161666 - DNA, 22 bp, Homo sapiens
cctgggaggtggaggttgcagt

SEQ ID NO: 9161667 - DNA, 22 bp, Homo sapiens
cctgggaggtggaggttgcagc

SEQ ID NO: 9161668 - DNA, 22 bp, Homo sapiens
cctgggaggctgtttccagcct

SEQ ID NO: 9161669 - DNA, 22 bp, Homo sapiens
agtggaggttacagctgtacat

SEQ ID NO: 9161670 - DNA, 22 bp, Homo sapiens
agtggaggcactaattggattt

SEQ ID NO: 9161671 - DNA, 22 bp, Homo sapiens
agtggaggttacagctgtacat

SEQ ID NO: 9161672 - DNA, 22 bp, Homo sapiens
agtggagacaggacagtcgata

SEQ ID NO: 9161673 - DNA, 22 bp, Homo sapiens
agtggagacaggacagtcgata

SEQ ID NO: 9161674 - DNA, 22 bp, Homo sapiens
agtggagaatatgcagaaagcc

SEQ ID NO: 9161675 - DNA, 22 bp, Homo sapiens
agtggagaatatgcagaaagcc

SEQ ID NO: 9161676 - DNA, 22 bp, Homo sapiens
agtggagaagaggatggtctcc

SEQ ID NO: 9161677 - DNA, 22 bp, Homo sapiens
agtggaccagaagactgaagct

SEQ ID NO: 9161678 - DNA, 22 bp, Homo sapiens
agtggaatttcatgaagatcca

SEQ ID NO: 9161679 - DNA, 22 bp, Homo sapiens
agtggaaggtcaggggacagtg

SEQ ID NO: 9161680 - DNA, 22 bp, Homo sapiens
agtggaaggtcaggggacagtg

SEQ ID NO: 9161681 - DNA, 22 bp, Homo sapiens
agtggaaggtcaggggacagtg

SEQ ID NO: 9161682 - DNA, 22 bp, Homo sapiens
agtgcttttatatcattaatcc

SEQ ID NO: 9161683 - DNA, 22 bp, Homo sapiens
agtgcttttgtcattgaatctt

SEQ ID NO: 9161684 - DNA, 22 bp, Homo sapiens
agtgctttgtgctctcactgca

SEQ ID NO: 9161685 - DNA, 22 bp, Homo sapiens
agtgctttgtagtttcattgtg

SEQ ID NO: 9161686 - DNA, 22 bp, Homo sapiens
agtgctttgtagtttcattgtg

SEQ ID NO: 9161687 - DNA, 22 bp, Homo sapiens
agtgctttgtgctctcactgca

SEQ ID NO: 9161688 - DNA, 22 bp, Homo sapiens
agtggattctgtgtgagatgta

SEQ ID NO: 9161689 - DNA, 22 bp, Homo sapiens
agtggatggtattgggaccagg

SEQ ID NO: 9161690 - DNA, 22 bp, Homo sapiens
agtggaggttattgagttaagg

SEQ ID NO: 9161691 - DNA, 22 bp, Homo sapiens
agtggcagaagccaagtctgca

SEQ ID NO: 9161692 - DNA, 20 bp, Homo sapiens
agtggcagggaaatggaaag

SEQ ID NO: 9161693 - DNA, 20 bp, Homo sapiens
agtggcagggaaatggaaag

SEQ ID NO: 9161694 - DNA, 22 bp, Homo sapiens
agtggcagggctggctgctgca

SEQ ID NO: 9161695 - DNA, 22 bp, Homo sapiens
agtggcagtggggcagggccct

SEQ ID NO: 9161696 - DNA, 22 bp, Homo sapiens
agtggcagtggggcagggccct

SEQ ID NO: 9161697 - DNA, 22 bp, Homo sapiens
agtggcagtttgggagctacag

SEQ ID NO: 9161698 - DNA, 22 bp, Homo sapiens
agtggcatcaaatcaaggtttg

SEQ ID NO: 9161699 - DNA, 20 bp, Homo sapiens
agtgccagggcaggtgagag

SEQ ID NO: 9161700 - DNA, 22 bp, Homo sapiens
agtgccctggcccagctggacc

SEQ ID NO: 9161701 - DNA, 22 bp, Homo sapiens
agtgcctggcacatggaaggtg

SEQ ID NO: 9161702 - DNA, 22 bp, Homo sapiens
agtgccttacaagagtgagggg

SEQ ID NO: 9161703 - DNA, 22 bp, Homo sapiens
agtgctgggtactgttcccatt

SEQ ID NO: 9161704 - DNA, 22 bp, Homo sapiens
agtgctgtaacaacttatttgg

SEQ ID NO: 9161705 - DNA, 22 bp, Homo sapiens
agtgccttgtgtgtgggcagcc

SEQ ID NO: 9161706 - DNA, 22 bp, Homo sapiens
agtgatttactaccatattggg

SEQ ID NO: 9161707 - DNA, 22 bp, Homo sapiens
agtgatttatgtatgtgcacgt

SEQ ID NO: 9161708 - DNA, 22 bp, Homo sapiens
agtgatttatggaaggccaaaa

SEQ ID NO: 9161709 - DNA, 22 bp, Homo sapiens
agtgatttcatcattttatcaa

SEQ ID NO: 9161710 - DNA, 22 bp, Homo sapiens
agtgatgtctcagagacggaag

SEQ ID NO: 9161711 - DNA, 22 bp, Homo sapiens
agtgatgtctaacttgatccct

SEQ ID NO: 9161712 - DNA, 22 bp, Homo sapiens
agtgatgttgactagctataag

SEQ ID NO: 9161713 - DNA, 19 bp, Homo sapiens
agtgcattttatgtttcaa

SEQ ID NO: 9161714 - DNA, 22 bp, Homo sapiens
agtgcattcagtattcataggc

SEQ ID NO: 9161715 - DNA, 22 bp, Homo sapiens
agtgcattcagtattcataggc

SEQ ID NO: 9161716 - DNA, 22 bp, Homo sapiens
agtgcatgttcactggcatggt

SEQ ID NO: 9161717 - DNA, 22 bp, Homo sapiens
agtgataaaggtgtgatatgaa

SEQ ID NO: 9161718 - DNA, 22 bp, Homo sapiens
agtgatcaatgcttgtcattgt

SEQ ID NO: 9161719 - DNA, 22 bp, Homo sapiens
agtgatcagctagatctacttg

SEQ ID NO: 9161720 - DNA, 22 bp, Homo sapiens
agtgataggacatatggatttt

SEQ ID NO: 9161721 - DNA, 22 bp, Homo sapiens
agtgatagcaaataaaatgtaa

SEQ ID NO: 9161722 - DNA, 22 bp, Homo sapiens
agtgataatgtggtaattattt

SEQ ID NO: 9161723 - DNA, 22 bp, Homo sapiens
agtgatggggccctgcactgat

SEQ ID NO: 9161724 - DNA, 22 bp, Homo sapiens
agtgatgtaacaaacagagtta

SEQ ID NO: 9161725 - DNA, 22 bp, Homo sapiens
agtgaggggcagctgagtgggc

SEQ ID NO: 9161726 - DNA, 22 bp, Homo sapiens
agtgaggggattcaggcaaggt

SEQ ID NO: 9161727 - DNA, 22 bp, Homo sapiens
agtgaggggcagctgagtgggc

SEQ ID NO: 9161728 - DNA, 22 bp, Homo sapiens
agtgaggggcagctgagtgggc

SEQ ID NO: 9161729 - DNA, 22 bp, Homo sapiens
agtgagtggagagctctaggtt

SEQ ID NO: 9161730 - DNA, 22 bp, Homo sapiens
agtgaggtcatactggagaggg

SEQ ID NO: 9161731 - DNA, 22 bp, Homo sapiens
agtgaggtcaggatctcaggga

SEQ ID NO: 9161732 - DNA, 22 bp, Homo sapiens
agtgaggtggggtcacagggac

SEQ ID NO: 9161733 - DNA, 22 bp, Homo sapiens
agtgaaatgatagtgtaaatac

SEQ ID NO: 9161734 - DNA, 22 bp, Homo sapiens
agtgaaatgactgaatcagata

SEQ ID NO: 9161735 - DNA, 22 bp, Homo sapiens
agtgaaatgactgaatcagata

SEQ ID NO: 9161736 - DNA, 22 bp, Homo sapiens
agtgaaatgatagtgtaaatac

SEQ ID NO: 9161737 - DNA, 19 bp, Homo sapiens
agtgaaatggagtattcaa

SEQ ID NO: 9161738 - DNA, 22 bp, Homo sapiens
agtgaaatggatgctgctactg

SEQ ID NO: 9161739 - DNA, 22 bp, Homo sapiens
agtgaaatgattctgagcaaga

SEQ ID NO: 9161740 - DNA, 19 bp, Homo sapiens
agtgaaatggagtattcaa

SEQ ID NO: 9161741 - DNA, 21 bp, Homo sapiens
agtgaaatgaagtgtatgctc

SEQ ID NO: 9161742 - DNA, 21 bp, Homo sapiens
agtgaaatgaagtgtatgctc

SEQ ID NO: 9161743 - DNA, 22 bp, Homo sapiens
agtgaaatcctggtcaacaggt

SEQ ID NO: 9161744 - DNA, 22 bp, Homo sapiens
agtgaaatcctggtcaacaggt

SEQ ID NO: 9161745 - DNA, 22 bp, Homo sapiens
agtgaaattcctggtctttgtt

SEQ ID NO: 9161746 - DNA, 22 bp, Homo sapiens
agtgacttcttaaaccatggtc

SEQ ID NO: 9161747 - DNA, 22 bp, Homo sapiens
agtgacttctccgtggcaggat

SEQ ID NO: 9161748 - DNA, 21 bp, Homo sapiens
agtgaaattgcatcagaggga

SEQ ID NO: 9161749 - DNA, 22 bp, Homo sapiens
agtgaaaacactagttcttgcc

SEQ ID NO: 9161750 - DNA, 22 bp, Homo sapiens
agtgaaaagatgcatttctctg

SEQ ID NO: 9161751 - DNA, 22 bp, Homo sapiens
agtgaaaggttgagaatattct

SEQ ID NO: 9161752 - DNA, 22 bp, Homo sapiens
agtgaaatagcatttatgaagc

SEQ ID NO: 9161753 - DNA, 22 bp, Homo sapiens
agtgaaatactgtcgtttttag

SEQ ID NO: 9161754 - DNA, 22 bp, Homo sapiens
agtgaaatcaggttttgactgc

SEQ ID NO: 9161755 - DNA, 22 bp, Homo sapiens
agtgaaatatgcccattgctgt

SEQ ID NO: 9161756 - DNA, 22 bp, Homo sapiens
agtgaaataaagctgcctatgg

SEQ ID NO: 9161757 - DNA, 23 bp, Homo sapiens
ctcaccaagcgccgccgctgtgt

SEQ ID NO: 9161758 - DNA, 22 bp, Homo sapiens
ctcaccagacatggaacctgtc

SEQ ID NO: 9161759 - DNA, 22 bp, Homo sapiens
ctcacatgagatctgtacatcc

SEQ ID NO: 9161760 - DNA, 22 bp, Homo sapiens
ctcacatagtaagcagtcagta

SEQ ID NO: 9161761 - DNA, 22 bp, Homo sapiens
agtctttatacagaaatatatg

SEQ ID NO: 9161762 - DNA, 22 bp, Homo sapiens
agtctttatacagaaatatatg

SEQ ID NO: 9161763 - DNA, 22 bp, Homo sapiens
agtctttatgattgtcaaagta

SEQ ID NO: 9161764 - DNA, 22 bp, Homo sapiens
agtctttattgtcgtcactaga

SEQ ID NO: 9161765 - DNA, 19 bp, Homo sapiens
agtctttcccactcgtctt

SEQ ID NO: 9161766 - DNA, 22 bp, Homo sapiens
agtctttcctgcttgactgttc

SEQ ID NO: 9161767 - DNA, 22 bp, Homo sapiens
agtctttcctgcttgactgttc

SEQ ID NO: 9161768 - DNA, 22 bp, Homo sapiens
agtctttcctgcttgactgttc

SEQ ID NO: 9161769 - DNA, 22 bp, Homo sapiens
agtctttgaagttctgacagag

SEQ ID NO: 9161770 - DNA, 21 bp, Homo sapiens
agtctttgataaagacaaagt

SEQ ID NO: 9161771 - DNA, 22 bp, Homo sapiens
agtctttccttttggaagaaaa

SEQ ID NO: 9161772 - DNA, 19 bp, Homo sapiens
agtctcacccaagcagtct

SEQ ID NO: 9161773 - DNA, 22 bp, Homo sapiens
agtctattttagctgcatatgt

SEQ ID NO: 9161774 - DNA, 22 bp, Homo sapiens
agtctatattgtgaaagtaaaa

SEQ ID NO: 9161775 - DNA, 22 bp, Homo sapiens
agtctagtaggatctctgggct

SEQ ID NO: 9161776 - DNA, 22 bp, Homo sapiens
agtctattgcctaacagagagg

SEQ ID NO: 9161777 - DNA, 22 bp, Homo sapiens
agtcctgggtctggagaatgga

SEQ ID NO: 9161778 - DNA, 22 bp, Homo sapiens
agtgtgagatgattgaggagca

SEQ ID NO: 9161779 - DNA, 22 bp, Homo sapiens
agtgtctttgtctctcaagcac

SEQ ID NO: 9161780 - DNA, 22 bp, Homo sapiens
agtgtgagtaattcagggaggg

SEQ ID NO: 9161781 - DNA, 22 bp, Homo sapiens
agtgtgagtaattcagggaggg

SEQ ID NO: 9161782 - DNA, 22 bp, Homo sapiens
agtgtgagcctacaggccaaag

SEQ ID NO: 9161783 - DNA, 22 bp, Homo sapiens
agtgtccaagtcttctgtttgt

SEQ ID NO: 9161784 - DNA, 22 bp, Homo sapiens
agtgtccaactcagcttgtcaa

SEQ ID NO: 9161785 - DNA, 20 bp, Homo sapiens
agtgtctgggcctcaggccc

SEQ ID NO: 9161786 - DNA, 22 bp, Homo sapiens
agtgtatttgagcatctcctta

SEQ ID NO: 9161787 - DNA, 22 bp, Homo sapiens
agtgtattgctttcatcatttt

SEQ ID NO: 9161788 - DNA, 22 bp, Homo sapiens
agtgtattgtctcacagttctt

SEQ ID NO: 9161789 - DNA, 19 bp, Homo sapiens
agtgtatttttttctgtag

SEQ ID NO: 9161790 - DNA, 22 bp, Homo sapiens
agtgtatttgcctataaaaatg

SEQ ID NO: 9161791 - DNA, 20 bp, Homo sapiens
agtgtatttgggtagagtgt

SEQ ID NO: 9161792 - DNA, 19 bp, Homo sapiens
agtgtatttttttctgtag

SEQ ID NO: 9161793 - DNA, 21 bp, Homo sapiens
ctctggagtttgaaggctggg

SEQ ID NO: 9161794 - DNA, 22 bp, Homo sapiens
agtgtacaaaatgatagataaa

SEQ ID NO: 9161795 - DNA, 21 bp, Homo sapiens
ctctggagtttgaaggctggg

SEQ ID NO: 9161796 - DNA, 22 bp, Homo sapiens
agtgtattcagaatgtagcaaa

SEQ ID NO: 9161797 - DNA, 22 bp, Homo sapiens
agtgtattgctttcatcatttt

SEQ ID NO: 9161798 - DNA, 22 bp, Homo sapiens
agtgtattgattggaacagcct

SEQ ID NO: 9161799 - DNA, 22 bp, Homo sapiens
agtgtattatcagaaactgtgg

SEQ ID NO: 9161800 - DNA, 22 bp, Homo sapiens
agtgtcattccagggaccctcg

SEQ ID NO: 9161801 - DNA, 22 bp, Homo sapiens
agtgtcagcctgggcaaggaac

SEQ ID NO: 9161802 - DNA, 17 bp, Homo sapiens
agtgtcagggcccttcc

SEQ ID NO: 9161803 - DNA, 18 bp, Homo sapiens
agtgtcagctgcagctca

SEQ ID NO: 9161804 - DNA, 22 bp, Homo sapiens
agtgtcagcctgggcaaggaac

SEQ ID NO: 9161805 - DNA, 17 bp, Homo sapiens
agtgtcagaagacagtt

SEQ ID NO: 9161806 - DNA, 20 bp, Homo sapiens
ctctggagttggggaacatt

SEQ ID NO: 9161807 - DNA, 20 bp, Homo sapiens
ctctggagttggggaacatt

SEQ ID NO: 9161808 - DNA, 22 bp, Homo sapiens
ctctggagttcttcaagctact

SEQ ID NO: 9161809 - DNA, 22 bp, Homo sapiens
ctctggagttcttcaagctact

SEQ ID NO: 9161810 - DNA, 22 bp, Homo sapiens
ctctggagttctcatgaggaac

SEQ ID NO: 9161811 - DNA, 22 bp, Homo sapiens
ctctggagttcccttgatctga

SEQ ID NO: 9161812 - DNA, 22 bp, Homo sapiens
ctctggagttcttcaagctact

SEQ ID NO: 9161813 - DNA, 22 bp, Homo sapiens
ctctggagttctcatgaggaac

SEQ ID NO: 9161814 - DNA, 22 bp, Homo sapiens
ctctggagttctcatgaggaac

SEQ ID NO: 9161815 - DNA, 22 bp, Homo sapiens
ctctggagttcccttgatctga

SEQ ID NO: 9161816 - DNA, 22 bp, Homo sapiens
ctctggagttagtgatctgggc

SEQ ID NO: 9161817 - DNA, 22 bp, Homo sapiens
ctctggagtgtctggccagggt

SEQ ID NO: 9161818 - DNA, 22 bp, Homo sapiens
ctctggagttagtgatctgggc

SEQ ID NO: 9161819 - DNA, 22 bp, Homo sapiens
ctctggagtgtctggccagggt

SEQ ID NO: 9161820 - DNA, 22 bp, Homo sapiens
ctctggagtgtctggccagggt

SEQ ID NO: 9161821 - DNA, 22 bp, Homo sapiens
ctctggagtgggtggccgggag

SEQ ID NO: 9161822 - DNA, 22 bp, Homo sapiens
ctctggagtgggtggccgggag

SEQ ID NO: 9161823 - DNA, 22 bp, Homo sapiens
ctctggagtgggtggccgggag

SEQ ID NO: 9161824 - DNA, 19 bp, Homo sapiens
agtggtagatgagcaggag

SEQ ID NO: 9161825 - DNA, 22 bp, Homo sapiens
agtgggtggcgcagaggaggaa

SEQ ID NO: 9161826 - DNA, 22 bp, Homo sapiens
agtgggtggcgcagaggaggaa

SEQ ID NO: 9161827 - DNA, 22 bp, Homo sapiens
agtgggtggcgcagaggaggaa

SEQ ID NO: 9161828 - DNA, 22 bp, Homo sapiens
agtggccatggcaggtgagcat

SEQ ID NO: 9161829 - DNA, 22 bp, Homo sapiens
agtggcccctagggaacagcct

SEQ ID NO: 9161830 - DNA, 22 bp, Homo sapiens
agtggccctggagtgactcgta

SEQ ID NO: 9161831 - DNA, 22 bp, Homo sapiens
agtggccatccctcaggtaggc

SEQ ID NO: 9161832 - DNA, 22 bp, Homo sapiens
agtggccagtgctgctctgggg

SEQ ID NO: 9161833 - DNA, 22 bp, Homo sapiens
agtggcggggattagcagtgtt

SEQ ID NO: 9161834 - DNA, 22 bp, Homo sapiens
agtggctatgcatgactggaat

SEQ ID NO: 9161835 - DNA, 22 bp, Homo sapiens
agtggcctggagccccgcctgg

SEQ ID NO: 9161836 - DNA, 22 bp, Homo sapiens
agtggcctggagccccgcctgg

SEQ ID NO: 9161837 - DNA, 22 bp, Homo sapiens
agtggcccttagtggcaaagtc

SEQ ID NO: 9161838 - DNA, 22 bp, Homo sapiens
agtgggtgagcttggtctagat

SEQ ID NO: 9161839 - DNA, 22 bp, Homo sapiens
agtgggtcagagagctccagat

SEQ ID NO: 9161840 - DNA, 22 bp, Homo sapiens
agtggggagtttccagatgtgt

SEQ ID NO: 9161841 - DNA, 22 bp, Homo sapiens
agtgtggctgcgtagggctctc

SEQ ID NO: 9161842 - DNA, 22 bp, Homo sapiens
agtgtgggccacgcagctgagc

SEQ ID NO: 9161843 - DNA, 17 bp, Homo sapiens
agtgttctgggttgccc

SEQ ID NO: 9161844 - DNA, 18 bp, Homo sapiens
agtgttctcgttttataa

SEQ ID NO: 9161845 - DNA, 17 bp, Homo sapiens
agtgttctgggttgccc

SEQ ID NO: 9161846 - DNA, 22 bp, Homo sapiens
agtgtttatttacagatggttt

SEQ ID NO: 9161847 - DNA, 20 bp, Homo sapiens
agtgtgcatttagagtctgc

SEQ ID NO: 9161848 - DNA, 22 bp, Homo sapiens
agtgtgcatttgcagaagaccc

SEQ ID NO: 9161849 - DNA, 22 bp, Homo sapiens
agtgtgcatggtggaggcttgc

SEQ ID NO: 9161850 - DNA, 22 bp, Homo sapiens
agtgtttttacaagcactctgg

SEQ ID NO: 9161851 - DNA, 22 bp, Homo sapiens
agttaaagaaagataattcgcc

SEQ ID NO: 9161852 - DNA, 22 bp, Homo sapiens
agttaacacaagtaagattcca

SEQ ID NO: 9161853 - DNA, 22 bp, Homo sapiens
agttaaatgtcagtagcttaac

SEQ ID NO: 9161854 - DNA, 22 bp, Homo sapiens
agtgtttgcatctcattgattt

SEQ ID NO: 9161855 - DNA, 22 bp, Homo sapiens
agtgtttgcatctcattgattt

SEQ ID NO: 9161856 - DNA, 22 bp, Homo sapiens
agtgtttgagacacatttcact

SEQ ID NO: 9161857 - DNA, 22 bp, Homo sapiens
agtgtttgagacacatttcact

SEQ ID NO: 9161858 - DNA, 22 bp, Homo sapiens
agtgtttgggggccttgtaaca

SEQ ID NO: 9161859 - DNA, 22 bp, Homo sapiens
ctgagctcaagtgatctgccca

SEQ ID NO: 9161860 - DNA, 22 bp, Homo sapiens
ctgagccagctggcatgtgcta

SEQ ID NO: 9161861 - DNA, 22 bp, Homo sapiens
ctgagccagctggcatgtgcta

SEQ ID NO: 9161862 - DNA, 22 bp, Homo sapiens
ctgagccagcgggctcactttt

SEQ ID NO: 9161863 - DNA, 22 bp, Homo sapiens
ctgagcagccccaccagccatt

SEQ ID NO: 9161864 - DNA, 22 bp, Homo sapiens
ctgagcagccccaccagccatt

SEQ ID NO: 9161865 - DNA, 22 bp, Homo sapiens
agttaacacatccagaatagag

SEQ ID NO: 9161866 - DNA, 22 bp, Homo sapiens
ctgagctgctttgcttttgggg

SEQ ID NO: 9161867 - DNA, 22 bp, Homo sapiens
ctgagctgctcccgctgcagcg

SEQ ID NO: 9161868 - DNA, 22 bp, Homo sapiens
agttatttcagtaacataatag

SEQ ID NO: 9161869 - DNA, 22 bp, Homo sapiens
ctgagctgcggcaggcacctgg

SEQ ID NO: 9161870 - DNA, 22 bp, Homo sapiens
ctgagctgctcccgctgcagcg

SEQ ID NO: 9161871 - DNA, 22 bp, Homo sapiens
ctgagctgcggcaggcacctgg

SEQ ID NO: 9161872 - DNA, 22 bp, Homo sapiens
ctgagctgacatcttcctcttt

SEQ ID NO: 9161873 - DNA, 22 bp, Homo sapiens
ctgagctgagccaaatctgtct

SEQ ID NO: 9161874 - DNA, 22 bp, Homo sapiens
ctgagctgcagtcctggctctg

SEQ ID NO: 9161875 - DNA, 22 bp, Homo sapiens
ctgagctgcagtcctggctctg

SEQ ID NO: 9161876 - DNA, 20 bp, Homo sapiens
ctgagctgagctccatgggt

SEQ ID NO: 9161877 - DNA, 20 bp, Homo sapiens
ctgagctgagctccatgggt

SEQ ID NO: 9161878 - DNA, 20 bp, Homo sapiens
ctgagctgagctccatgggt

SEQ ID NO: 9161879 - DNA, 22 bp, Homo sapiens
agttccttcctgagctattgct

SEQ ID NO: 9161880 - DNA, 22 bp, Homo sapiens
agttccagaactggaaaaggac

SEQ ID NO: 9161881 - DNA, 22 bp, Homo sapiens
agttccagctgtgaccagaaaa

SEQ ID NO: 9161882 - DNA, 22 bp, Homo sapiens
agttccagctgtgaccagaaaa

SEQ ID NO: 9161883 - DNA, 22 bp, Homo sapiens
agttcccaaattacaggccaca

SEQ ID NO: 9161884 - DNA, 22 bp, Homo sapiens
agttccagtgtgagagaacatg

SEQ ID NO: 9161885 - DNA, 22 bp, Homo sapiens
agttatttcagtaacataatag

SEQ ID NO: 9161886 - DNA, 22 bp, Homo sapiens
ctgctgtgccttaaaatgcaag

SEQ ID NO: 9161887 - DNA, 22 bp, Homo sapiens
ctgctgtgcttgtggccacccg

SEQ ID NO: 9161888 - DNA, 22 bp, Homo sapiens
ctgctgtgcaggtgcctatgat

SEQ ID NO: 9161889 - DNA, 22 bp, Homo sapiens
ctgctgtgcatatttatctagg

SEQ ID NO: 9161890 - DNA, 22 bp, Homo sapiens
ctgctgtgcctcttttcacgtg

SEQ ID NO: 9161891 - DNA, 22 bp, Homo sapiens
ctgctgtgcagacagactctct

SEQ ID NO: 9161892 - DNA, 22 bp, Homo sapiens
ctgctgggggacacaggtccgg

SEQ ID NO: 9161893 - DNA, 22 bp, Homo sapiens
ctgctgggggacacaggtccgg

SEQ ID NO: 9161894 - DNA, 22 bp, Homo sapiens
ctgctgggggacacaggtccgg

SEQ ID NO: 9161895 - DNA, 22 bp, Homo sapiens
ctgctgggggacacaggtccgg

SEQ ID NO: 9161896 - DNA, 22 bp, Homo sapiens
ctgctgtggtgtcaagcatctc

SEQ ID NO: 9161897 - DNA, 22 bp, Homo sapiens
ctgctgtgtatcattttagatg

SEQ ID NO: 9161898 - DNA, 18 bp, Homo sapiens
ctgctgtgtcgtctgggc

SEQ ID NO: 9161899 - DNA, 22 bp, Homo sapiens
ctgctgtgtcagagtccagggg

SEQ ID NO: 9161900 - DNA, 22 bp, Homo sapiens
atacaagttaatgagaatgaca

SEQ ID NO: 9161901 - DNA, 22 bp, Homo sapiens
ctgctgtgggcagggtagctgg

SEQ ID NO: 9161902 - DNA, 20 bp, Homo sapiens
ctgctgtggtcctttatttt

SEQ ID NO: 9161903 - DNA, 22 bp, Homo sapiens
ctgctgtgggttaagacactgt

SEQ ID NO: 9161904 - DNA, 21 bp, Homo sapiens
ctgctgtggcccccgacatgc

SEQ ID NO: 9161905 - DNA, 22 bp, Homo sapiens
ctgctgtggccagccaggtcaa

SEQ ID NO: 9161906 - DNA, 22 bp, Homo sapiens
ctgctgtggatgcaggacctca

SEQ ID NO: 9161907 - DNA, 21 bp, Homo sapiens
atacacatacacataaatgtg

SEQ ID NO: 9161908 - DNA, 19 bp, Homo sapiens
atacacatacgtaaactga

SEQ ID NO: 9161909 - DNA, 22 bp, Homo sapiens
atacacatatatacacgtttaa

SEQ ID NO: 9161910 - DNA, 22 bp, Homo sapiens
atacaagttgcccaaatgatta

SEQ ID NO: 9161911 - DNA, 22 bp, Homo sapiens
atacacatgcacacatgtgtgt

SEQ ID NO: 9161912 - DNA, 20 bp, Homo sapiens
atacacatattcttgcaact

SEQ ID NO: 9161913 - DNA, 19 bp, Homo sapiens
ctgctcagagcagctccag

SEQ ID NO: 9161914 - DNA, 20 bp, Homo sapiens
ctgctcagaccaactcttct

SEQ ID NO: 9161915 - DNA, 19 bp, Homo sapiens
ctgctcaggtcagtctgtc

SEQ ID NO: 9161916 - DNA, 19 bp, Homo sapiens
ctgctcaggtcagtctgtc

SEQ ID NO: 9161917 - DNA, 22 bp, Homo sapiens
ctgctgggcctggtctctgagg

SEQ ID NO: 9161918 - DNA, 22 bp, Homo sapiens
ctgctgggcagaggctgcatga

SEQ ID NO: 9161919 - DNA, 22 bp, Homo sapiens
ctgctgggctcctcatgtgact

SEQ ID NO: 9161920 - DNA, 22 bp, Homo sapiens
ctgctgggcctggtctctgagg

SEQ ID NO: 9161921 - DNA, 22 bp, Homo sapiens
ctgctggggaggcgcctcgacg

SEQ ID NO: 9161922 - DNA, 22 bp, Homo sapiens
ctgctaaacctctctgagagct

SEQ ID NO: 9161923 - DNA, 22 bp, Homo sapiens
ctgctacagtttaaaggggaag

SEQ ID NO: 9161924 - DNA, 22 bp, Homo sapiens
ctgcctgtgccaatgctccttt

SEQ ID NO: 9161925 - DNA, 22 bp, Homo sapiens
ctgcctgtgcatgcagtcagaa

SEQ ID NO: 9161926 - DNA, 22 bp, Homo sapiens
ctgcctggtgcggtgcccaccc

SEQ ID NO: 9161927 - DNA, 22 bp, Homo sapiens
ctgcctggaaggagcaagggga

SEQ ID NO: 9161928 - DNA, 22 bp, Homo sapiens
ataaaggaaattccatgtctaa

SEQ ID NO: 9161929 - DNA, 22 bp, Homo sapiens
ctgcctgggttcaagtcctgtt

SEQ ID NO: 9161930 - DNA, 22 bp, Homo sapiens
ctgcctgggttcaagtcctgtt

SEQ ID NO: 9161931 - DNA, 22 bp, Homo sapiens
ctgcctgggttcaagtcctgtt

SEQ ID NO: 9161932 - DNA, 22 bp, Homo sapiens
ctgcaggctcgaagacacggat

SEQ ID NO: 9161933 - DNA, 22 bp, Homo sapiens
ataaaagaagttttggtacttg

SEQ ID NO: 9161934 - DNA, 22 bp, Homo sapiens
ataaaacttattagaattgtgt

SEQ ID NO: 9161935 - DNA, 22 bp, Homo sapiens
ataaaacttattagaattgtgt

SEQ ID NO: 9161936 - DNA, 22 bp, Homo sapiens
ataaaacttattagaattgtgt

SEQ ID NO: 9161937 - DNA, 22 bp, Homo sapiens
ataaaacttattagaattgtgt

SEQ ID NO: 9161938 - DNA, 22 bp, Homo sapiens
ataaaaatgagggcggtagcta

SEQ ID NO: 9161939 - DNA, 22 bp, Homo sapiens
ataaaaatgagggcggtagcta

SEQ ID NO: 9161940 - DNA, 22 bp, Homo sapiens
agttctgtggctgtgccctgta

SEQ ID NO: 9161941 - DNA, 22 bp, Homo sapiens
agttcttattgaatagaaatca

SEQ ID NO: 9161942 - DNA, 22 bp, Homo sapiens
agttctgttgtctagggaagcc

SEQ ID NO: 9161943 - DNA, 22 bp, Homo sapiens
agttttgtaattctcaaaaata

SEQ ID NO: 9161944 - DNA, 22 bp, Homo sapiens
agttctataattaaaatgaagg

SEQ ID NO: 9161945 - DNA, 22 bp, Homo sapiens
agttccttgatgttctatggac

SEQ ID NO: 9161946 - DNA, 22 bp, Homo sapiens
agttccttttatctgagtctaa

SEQ ID NO: 9161947 - DNA, 22 bp, Homo sapiens
agttctcaaggttaggaaaagt

SEQ ID NO: 9161948 - DNA, 22 bp, Homo sapiens
agttctgtggctgtgccctgta

SEQ ID NO: 9161949 - DNA, 22 bp, Homo sapiens
agttctgtgacaatatcattac

SEQ ID NO: 9161950 - DNA, 22 bp, Homo sapiens
agttctggcgcccatgagcaga

SEQ ID NO: 9161951 - DNA, 22 bp, Homo sapiens
agttctggaactctacagcaac

SEQ ID NO: 9161952 - DNA, 22 bp, Homo sapiens
agttctgggccctgggttgctt

SEQ ID NO: 9161953 - DNA, 22 bp, Homo sapiens
agttctggtggtttggagatct

SEQ ID NO: 9161954 - DNA, 22 bp, Homo sapiens
agttctgggaggtgcacgtcca

SEQ ID NO: 9161955 - DNA, 22 bp, Homo sapiens
agttctgggaaaaacatggcca

SEQ ID NO: 9161956 - DNA, 22 bp, Homo sapiens
agttctggcggctgtcggcact

SEQ ID NO: 9161957 - DNA, 22 bp, Homo sapiens
agttctcttggaagttatgtga

SEQ ID NO: 9161958 - DNA, 22 bp, Homo sapiens
agttctctatgaagtctattgt

SEQ ID NO: 9161959 - DNA, 22 bp, Homo sapiens
agttctctatgaagtctattgt

SEQ ID NO: 9161960 - DNA, 22 bp, Homo sapiens
agttctctcccctgctgttcag

SEQ ID NO: 9161961 - DNA, 22 bp, Homo sapiens
ataaagctatttttaattctgt

SEQ ID NO: 9161962 - DNA, 22 bp, Homo sapiens
ataaagcatgcttgtttggaga

SEQ ID NO: 9161963 - DNA, 22 bp, Homo sapiens
ataaagcatctagtctgtcact

SEQ ID NO: 9161964 - DNA, 22 bp, Homo sapiens
ataaagcaatagattgtgtaat

SEQ ID NO: 9161965 - DNA, 22 bp, Homo sapiens
ataaagcaagcataccattaag

SEQ ID NO: 9161966 - DNA, 21 bp, Homo sapiens
ataaagacaaacactatttgg

SEQ ID NO: 9161967 - DNA, 22 bp, Homo sapiens
ataaacttgagtctcagagtat

SEQ ID NO: 9161968 - DNA, 22 bp, Homo sapiens
ataaagcaaataggactattgc

SEQ ID NO: 9161969 - DNA, 22 bp, Homo sapiens
ataaactcatgccaagaaatga

SEQ ID NO: 9161970 - DNA, 22 bp, Homo sapiens
ataaaccagaagtaaaagctac

SEQ ID NO: 9161971 - DNA, 22 bp, Homo sapiens
ataaaatctttatgtgctctgc

SEQ ID NO: 9161972 - DNA, 22 bp, Homo sapiens
ataaacatctgtttctcttctg

SEQ ID NO: 9161973 - DNA, 22 bp, Homo sapiens
ataaacatctgtttctcttctg

SEQ ID NO: 9161974 - DNA, 22 bp, Homo sapiens
ctgcagggaactgaggcccaga

SEQ ID NO: 9161975 - DNA, 22 bp, Homo sapiens
ctgcagggaccacaagcaggtt

SEQ ID NO: 9161976 - DNA, 22 bp, Homo sapiens
ctgcagggaccacaagcaggtt

SEQ ID NO: 9161977 - DNA, 22 bp, Homo sapiens
ctgcagggaccacaagcaggtt

SEQ ID NO: 9161978 - DNA, 22 bp, Homo sapiens
ctgcagggacccaagtctttgg

SEQ ID NO: 9161979 - DNA, 22 bp, Homo sapiens
ctgcaggctgagcgcctgccgg

SEQ ID NO: 9161980 - DNA, 22 bp, Homo sapiens
ctgcaggcttccagggctgtgg

SEQ ID NO: 9161981 - DNA, 22 bp, Homo sapiens
ctgcaggcttccagggctgtgg

SEQ ID NO: 9161982 - DNA, 22 bp, Homo sapiens
ctgcagggaactgaggcccaga

SEQ ID NO: 9161983 - DNA, 22 bp, Homo sapiens
ctgcagggaactgaggcccaga

SEQ ID NO: 9161984 - DNA, 22 bp, Homo sapiens
ctggccggtatttgcctctggg

SEQ ID NO: 9161985 - DNA, 22 bp, Homo sapiens
ctggcctagctctctgcttgaa

SEQ ID NO: 9161986 - DNA, 22 bp, Homo sapiens
ctggcctcagagggtcatggtg

SEQ ID NO: 9161987 - DNA, 22 bp, Homo sapiens
ctggcctcagagggtcatggtg

SEQ ID NO: 9161988 - DNA, 22 bp, Homo sapiens
ctggccctatgagcctcctgat

SEQ ID NO: 9161989 - DNA, 22 bp, Homo sapiens
ctggccagaagcacctttggcg

SEQ ID NO: 9161990 - DNA, 20 bp, Homo sapiens
ctggccagaacgcctacaca

SEQ ID NO: 9161991 - DNA, 22 bp, Homo sapiens
ctggcaggtctcgctgacgtgt

SEQ ID NO: 9161992 - DNA, 22 bp, Homo sapiens
ctggcaggtccagctggactca

SEQ ID NO: 9161993 - DNA, 22 bp, Homo sapiens
ctggcaggtggaggttgcagtg

SEQ ID NO: 9161994 - DNA, 22 bp, Homo sapiens
ctggcaggtggaggttgcagtg

SEQ ID NO: 9161995 - DNA, 22 bp, Homo sapiens
ctggcaggttatagagctgccc

SEQ ID NO: 9161996 - DNA, 22 bp, Homo sapiens
ctggcaggtggatggggactcc

SEQ ID NO: 9161997 - DNA, 22 bp, Homo sapiens
ctggcaggttatagagctgccc

SEQ ID NO: 9161998 - DNA, 22 bp, Homo sapiens
ctggcaggttatagagctgccc

SEQ ID NO: 9161999 - DNA, 22 bp, Homo sapiens
ctggccactgcgggcctctgcc

SEQ ID NO: 9162000 - DNA, 22 bp, Homo sapiens
ctggccactgcgggcctctgcc

SEQ ID NO: 9162001 - DNA, 22 bp, Homo sapiens
ctggccactggtggtcataggc

SEQ ID NO: 9162002 - DNA, 22 bp, Homo sapiens
ctggccactggtggtcataggc

SEQ ID NO: 9162003 - DNA, 22 bp, Homo sapiens
ctggccactggaggtggcaccc

SEQ ID NO: 9162004 - DNA, 20 bp, Homo sapiens
atacacatgcagacagatgc

SEQ ID NO: 9162005 - DNA, 20 bp, Homo sapiens
atacacatgcagacagatgc

SEQ ID NO: 9162006 - DNA, 22 bp, Homo sapiens
atacacatgttattgtggaagc

SEQ ID NO: 9162007 - DNA, 22 bp, Homo sapiens
atacacattactttctgtctga

SEQ ID NO: 9162008 - DNA, 22 bp, Homo sapiens
ctggagtggccggtgctgtggc

SEQ ID NO: 9162009 - DNA, 22 bp, Homo sapiens
ctggagtgcagtggcatgatca

SEQ ID NO: 9162010 - DNA, 22 bp, Homo sapiens
ctggagtgcagtggcatgatca

SEQ ID NO: 9162011 - DNA, 22 bp, Homo sapiens
ctggcacagagtgagcattcaa

SEQ ID NO: 9162012 - DNA, 22 bp, Homo sapiens
ctggcacaaaagaaaactgcca

SEQ ID NO: 9162013 - DNA, 22 bp, Homo sapiens
ctggcacaaaagaaaactgcca

SEQ ID NO: 9162014 - DNA, 22 bp, Homo sapiens
ctggcacaaatggaaaccaagc

SEQ ID NO: 9162015 - DNA, 22 bp, Homo sapiens
ctggcacacaagtatttccttt

SEQ ID NO: 9162016 - DNA, 22 bp, Homo sapiens
ctggcacaatgtcacttttgct

SEQ ID NO: 9162017 - DNA, 22 bp, Homo sapiens
atacatgtgtgtgcatacatgt

SEQ ID NO: 9162018 - DNA, 22 bp, Homo sapiens
atacatgtgtgagcgaagatgt

SEQ ID NO: 9162019 - DNA, 22 bp, Homo sapiens
atacatgtgtccctgatttatt

SEQ ID NO: 9162020 - DNA, 22 bp, Homo sapiens
atacatgtgtccctgatttatt

SEQ ID NO: 9162021 - DNA, 22 bp, Homo sapiens
atacatgtgggtctaaacatat

SEQ ID NO: 9162022 - DNA, 22 bp, Homo sapiens
atacatgtcatcatatgtttgt

SEQ ID NO: 9162023 - DNA, 22 bp, Homo sapiens
atacatgtacataaatgtagca

SEQ ID NO: 9162024 - DNA, 22 bp, Homo sapiens
ctggcacataattagtgatcct

SEQ ID NO: 9162025 - DNA, 22 bp, Homo sapiens
ctggcacaggatccgagacctt

SEQ ID NO: 9162026 - DNA, 22 bp, Homo sapiens
ctggcacagccactgcaggcag

SEQ ID NO: 9162027 - DNA, 22 bp, Homo sapiens
atacatgtaactgcattgtaat

SEQ ID NO: 9162028 - DNA, 22 bp, Homo sapiens
atatacagtatgtactgtggtt

SEQ ID NO: 9162029 - DNA, 22 bp, Homo sapiens
atatacaggtggtatgtgtaaa

SEQ ID NO: 9162030 - DNA, 22 bp, Homo sapiens
atatacactgtttcagttgaag

SEQ ID NO: 9162031 - DNA, 22 bp, Homo sapiens
atatacactccactgatacagg

SEQ ID NO: 9162032 - DNA, 22 bp, Homo sapiens
atatacactcaccatggtattt

SEQ ID NO: 9162033 - DNA, 22 bp, Homo sapiens
ctggctgatctcaatcatggct

SEQ ID NO: 9162034 - DNA, 22 bp, Homo sapiens
ctggctgatctcctgaatgtct

SEQ ID NO: 9162035 - DNA, 22 bp, Homo sapiens
atatacacatgtgtatacattt

SEQ ID NO: 9162036 - DNA, 22 bp, Homo sapiens
atataatacaacctgctaagtg

SEQ ID NO: 9162037 - DNA, 19 bp, Homo sapiens
ctggctgcaatgccagggt

SEQ ID NO: 9162038 - DNA, 19 bp, Homo sapiens
ctggctgcaatgccagggt

SEQ ID NO: 9162039 - DNA, 22 bp, Homo sapiens
ctgggagctggatgccctgccc

SEQ ID NO: 9162040 - DNA, 22 bp, Homo sapiens
ctgggagctggatgccctgccc

SEQ ID NO: 9162041 - DNA, 22 bp, Homo sapiens
ctgggagctgtcaggagcgtgt

SEQ ID NO: 9162042 - DNA, 22 bp, Homo sapiens
ctgggagcttgttaggaatgca

SEQ ID NO: 9162043 - DNA, 22 bp, Homo sapiens
ctgggagctgtcaggagcgtgt

SEQ ID NO: 9162044 - DNA, 22 bp, Homo sapiens
ctgggagaggctgctccgctct

SEQ ID NO: 9162045 - DNA, 22 bp, Homo sapiens
atatacttggagactatcattg

SEQ ID NO: 9162046 - DNA, 22 bp, Homo sapiens
atatactgaggagactttatat

SEQ ID NO: 9162047 - DNA, 22 bp, Homo sapiens
atatactgtaggccactataag

SEQ ID NO: 9162048 - DNA, 22 bp, Homo sapiens
atatactgatagctgcacttct

SEQ ID NO: 9162049 - DNA, 22 bp, Homo sapiens
atatacttccccattatggggg

SEQ ID NO: 9162050 - DNA, 22 bp, Homo sapiens
atatacttccccattatggggg

SEQ ID NO: 9162051 - DNA, 22 bp, Homo sapiens
atatactgtgttccatggacca

SEQ ID NO: 9162052 - DNA, 22 bp, Homo sapiens
atatactgtagtggtttagagc

SEQ ID NO: 9162053 - DNA, 19 bp, Homo sapiens
atatacatactgtgtgcat

SEQ ID NO: 9162054 - DNA, 20 bp, Homo sapiens
atataccatcccacaacagg

SEQ ID NO: 9162055 - DNA, 22 bp, Homo sapiens
atatacatgggaatatgtggag

SEQ ID NO: 9162056 - DNA, 22 bp, Homo sapiens
atatacatgggaatatgtggag

SEQ ID NO: 9162057 - DNA, 22 bp, Homo sapiens
ctggctcttggctagggagagt

SEQ ID NO: 9162058 - DNA, 19 bp, Homo sapiens
ctggctcttgggtggagga

SEQ ID NO: 9162059 - DNA, 22 bp, Homo sapiens
ctggctcttgcgactcagcttg

SEQ ID NO: 9162060 - DNA, 22 bp, Homo sapiens
atataaagtgtttagaaagctg

SEQ ID NO: 9162061 - DNA, 22 bp, Homo sapiens
ctggctctttcctagctaggct

SEQ ID NO: 9162062 - DNA, 22 bp, Homo sapiens
ctggctgacaccttgatagcag

SEQ ID NO: 9162063 - DNA, 22 bp, Homo sapiens
ctggctctttcctagctaggct

SEQ ID NO: 9162064 - DNA, 22 bp, Homo sapiens
ctggctctttcctagctaggct

SEQ ID NO: 9162065 - DNA, 22 bp, Homo sapiens
atagtttgtgaaacacagcagt

SEQ ID NO: 9162066 - DNA, 22 bp, Homo sapiens
atagttttctatgcactgttat

SEQ ID NO: 9162067 - DNA, 22 bp, Homo sapiens
atataaagaagtggaaaatgag

SEQ ID NO: 9162068 - DNA, 22 bp, Homo sapiens
atataaagaagtggaaaatgag

SEQ ID NO: 9162069 - DNA, 22 bp, Homo sapiens
atataaagagcttagtatagtg

SEQ ID NO: 9162070 - DNA, 22 bp, Homo sapiens
atataaagaagtggaaaatgag

SEQ ID NO: 9162071 - DNA, 23 bp, Homo sapiens
atataaacaccagatagattgta

SEQ ID NO: 9162072 - DNA, 19 bp, Homo sapiens
ctggcctgtgtcctgtgct

SEQ ID NO: 9162073 - DNA, 22 bp, Homo sapiens
ctggcctgtgggctgtctccgg

SEQ ID NO: 9162074 - DNA, 22 bp, Homo sapiens
ctggcctgtgggctgtctccgg

SEQ ID NO: 9162075 - DNA, 19 bp, Homo sapiens
ctggcctgtgtcctgtgct

SEQ ID NO: 9162076 - DNA, 22 bp, Homo sapiens
ctggctagataaaaccagccaa

SEQ ID NO: 9162077 - DNA, 22 bp, Homo sapiens
ctggctaattgtcagttgttac

SEQ ID NO: 9162078 - DNA, 22 bp, Homo sapiens
ctggctagcacctcagctcaga

SEQ ID NO: 9162079 - DNA, 22 bp, Homo sapiens
ctggctcaatttgtactgctgt

SEQ ID NO: 9162080 - DNA, 22 bp, Homo sapiens
ctggctcaatttgtactgctgt

SEQ ID NO: 9162081 - DNA, 22 bp, Homo sapiens
atagtttccattgctgaccaaa

SEQ ID NO: 9162082 - DNA, 22 bp, Homo sapiens
atagtttaccttccagatggct

SEQ ID NO: 9162083 - DNA, 22 bp, Homo sapiens
cttcttaaagattacacaatga

SEQ ID NO: 9162084 - DNA, 22 bp, Homo sapiens
cttcttaaatatttggctgact

SEQ ID NO: 9162085 - DNA, 22 bp, Homo sapiens
cttcttaaattggattgctatt

SEQ ID NO: 9162086 - DNA, 22 bp, Homo sapiens
cttcttaatcataacggtatct

SEQ ID NO: 9162087 - DNA, 22 bp, Homo sapiens
cttcttaatcccttatatattt

SEQ ID NO: 9162088 - DNA, 22 bp, Homo sapiens
cttcttaactgtatatactatg

SEQ ID NO: 9162089 - DNA, 22 bp, Homo sapiens
atctggtatgaggttttgcttt

SEQ ID NO: 9162090 - DNA, 22 bp, Homo sapiens
atctggctcacttagtctagga

SEQ ID NO: 9162091 - DNA, 22 bp, Homo sapiens
atctgtaaagataatcatatgt

SEQ ID NO: 9162092 - DNA, 22 bp, Homo sapiens
atctgtaaagataatcatatgt

SEQ ID NO: 9162093 - DNA, 22 bp, Homo sapiens
atctgtaacatcagtagcagaa

SEQ ID NO: 9162094 - DNA, 22 bp, Homo sapiens
atctgtaacacacagaggagaa

SEQ ID NO: 9162095 - DNA, 22 bp, Homo sapiens
atctggttttggctgtgtccct

SEQ ID NO: 9162096 - DNA, 22 bp, Homo sapiens
atctggttctttgtatttcctt

SEQ ID NO: 9162097 - DNA, 22 bp, Homo sapiens
atctggttcttcttaggcatca

SEQ ID NO: 9162098 - DNA, 22 bp, Homo sapiens
atctgtaactgctatcatctcc

SEQ ID NO: 9162099 - DNA, 22 bp, Homo sapiens
atctgtaattttgaatgcaaat

SEQ ID NO: 9162100 - DNA, 22 bp, Homo sapiens
atctgtaattttgaatgcaaat

SEQ ID NO: 9162101 - DNA, 22 bp, Homo sapiens
atctgtcagcctgggattaggg

SEQ ID NO: 9162102 - DNA, 22 bp, Homo sapiens
atctgtcaagatagactctgca

SEQ ID NO: 9162103 - DNA, 22 bp, Homo sapiens
atctgtcaggagcaaggactac

SEQ ID NO: 9162104 - DNA, 22 bp, Homo sapiens
atctgtgtatgtgaccttatct

SEQ ID NO: 9162105 - DNA, 22 bp, Homo sapiens
atctgtggcgcaaacaaaggct

SEQ ID NO: 9162106 - DNA, 22 bp, Homo sapiens
atctgtggctggtgagaggcag

SEQ ID NO: 9162107 - DNA, 22 bp, Homo sapiens
atctgtgtatgaaagtataact

SEQ ID NO: 9162108 - DNA, 22 bp, Homo sapiens
atcttatttaacacagcaaaac

SEQ ID NO: 9162109 - DNA, 22 bp, Homo sapiens
atctgttcttgtgtcagtaatt

SEQ ID NO: 9162110 - DNA, 22 bp, Homo sapiens
atctgttatgaaatttggttgt

SEQ ID NO: 9162111 - DNA, 22 bp, Homo sapiens
atctgtctatgtggctatgtat

SEQ ID NO: 9162112 - DNA, 22 bp, Homo sapiens
atctgtctggaggcctggcatg

SEQ ID NO: 9162113 - DNA, 22 bp, Homo sapiens
atctgtgagtatttttgtttat

SEQ ID NO: 9162114 - DNA, 22 bp, Homo sapiens
cttctgagaggggctaggagca

SEQ ID NO: 9162115 - DNA, 22 bp, Homo sapiens
cttctccttatatgtcccgttc

SEQ ID NO: 9162116 - DNA, 22 bp, Homo sapiens
cttctccttatatgtcccgttc

SEQ ID NO: 9162117 - DNA, 22 bp, Homo sapiens
cttctcggccgtgtggatgcgc

SEQ ID NO: 9162118 - DNA, 22 bp, Homo sapiens
cttctccttatatgtcccgttc

SEQ ID NO: 9162119 - DNA, 23 bp, Homo sapiens
atctcctgagaacccacagtggt

SEQ ID NO: 9162120 - DNA, 23 bp, Homo sapiens
atctcctgagaacccacagtggt

SEQ ID NO: 9162121 - DNA, 22 bp, Homo sapiens
atctcgttttgagaactgtgtt

SEQ ID NO: 9162122 - DNA, 22 bp, Homo sapiens
cttccttgtggtccttctcatt

SEQ ID NO: 9162123 - DNA, 18 bp, Homo sapiens
atctcccattggccaagg

SEQ ID NO: 9162124 - DNA, 22 bp, Homo sapiens
cttctgtgtagaaaggtagccc

SEQ ID NO: 9162125 - DNA, 22 bp, Homo sapiens
cttctgtgatttggttaggata

SEQ ID NO: 9162126 - DNA, 22 bp, Homo sapiens
cttctgagttaacagtagattt

SEQ ID NO: 9162127 - DNA, 22 bp, Homo sapiens
cttctgagcagacctcctgggg

SEQ ID NO: 9162128 - DNA, 22 bp, Homo sapiens
cttctgagatgttgttttacag

SEQ ID NO: 9162129 - DNA, 22 bp, Homo sapiens
cttctgcagaattaattcacta

SEQ ID NO: 9162130 - DNA, 22 bp, Homo sapiens
cttctgcaggagtcaactctgg

SEQ ID NO: 9162131 - DNA, 22 bp, Homo sapiens
cttctgcaggccttattttagt

SEQ ID NO: 9162132 - DNA, 22 bp, Homo sapiens
cttctgcactgaccttttgtcc

SEQ ID NO: 9162133 - DNA, 22 bp, Homo sapiens
cttcaagatatttctagaatca

SEQ ID NO: 9162134 - DNA, 22 bp, Homo sapiens
cttcaagttgggcggcgggcag

SEQ ID NO: 9162135 - DNA, 22 bp, Homo sapiens
cttcaagttgtctgagggtggg

SEQ ID NO: 9162136 - DNA, 22 bp, Homo sapiens
cttcaatttttggtatgatgga

SEQ ID NO: 9162137 - DNA, 22 bp, Homo sapiens
cttccttctgaagcatagaagc

SEQ ID NO: 9162138 - DNA, 22 bp, Homo sapiens
cttccttctgtaagaccagttg

SEQ ID NO: 9162139 - DNA, 22 bp, Homo sapiens
cttccttctcactagcagcgcc

SEQ ID NO: 9162140 - DNA, 22 bp, Homo sapiens
cttccttctgaagcatagaagc

SEQ ID NO: 9162141 - DNA, 22 bp, Homo sapiens
cttccttccacaccttcagaat

SEQ ID NO: 9162142 - DNA, 22 bp, Homo sapiens
cttccttccacaccttcagaat

SEQ ID NO: 9162143 - DNA, 22 bp, Homo sapiens
cttccttccttccccgaaatgc

SEQ ID NO: 9162144 - DNA, 22 bp, Homo sapiens
cttattataaaatcctgtttga

SEQ ID NO: 9162145 - DNA, 22 bp, Homo sapiens
cttattcaatgctggaaatgtt

SEQ ID NO: 9162146 - DNA, 22 bp, Homo sapiens
cttattagaaagaaaagacatg

SEQ ID NO: 9162147 - DNA, 22 bp, Homo sapiens
cttattaatggaatcctaatga

SEQ ID NO: 9162148 - DNA, 22 bp, Homo sapiens
cttatgtataatgttccacata

SEQ ID NO: 9162149 - DNA, 22 bp, Homo sapiens
cttcaaattcgaggagtagatg

SEQ ID NO: 9162150 - DNA, 22 bp, Homo sapiens
cttcaacagttttagaacactg

SEQ ID NO: 9162151 - DNA, 22 bp, Homo sapiens
cttcaactttgtaagtagaatt

SEQ ID NO: 9162152 - DNA, 22 bp, Homo sapiens
cttattcatatattctcggtag

SEQ ID NO: 9162153 - DNA, 22 bp, Homo sapiens
cttattcataagtcagacacac

SEQ ID NO: 9162154 - DNA, 22 bp, Homo sapiens
cttattcagaccttggattctt

SEQ ID NO: 9162155 - DNA, 22 bp, Homo sapiens
cttattcagaaggagaaatgga

SEQ ID NO: 9162156 - DNA, 21 bp, Homo sapiens
cttattcactgttatttatca

SEQ ID NO: 9162157 - DNA, 22 bp, Homo sapiens
cttattcagcaagtttgggtac

SEQ ID NO: 9162158 - DNA, 22 bp, Homo sapiens
cttattcagatacagactcttg

SEQ ID NO: 9162159 - DNA, 22 bp, Homo sapiens
cttattcagcacttgctctgta

SEQ ID NO: 9162160 - DNA, 22 bp, Homo sapiens
atccatttcagtgttccacttg

SEQ ID NO: 9162161 - DNA, 22 bp, Homo sapiens
atccatttaattgaggggaagg

SEQ ID NO: 9162162 - DNA, 18 bp, Homo sapiens
atccatttaatgcctgga

SEQ ID NO: 9162163 - DNA, 18 bp, Homo sapiens
atccatttaatgcctgga

SEQ ID NO: 9162164 - DNA, 22 bp, Homo sapiens
atccatggaggacaagagcaat

SEQ ID NO: 9162165 - DNA, 22 bp, Homo sapiens
atccattattgggccaataaag

SEQ ID NO: 9162166 - DNA, 22 bp, Homo sapiens
atccatgttcataagaattgta

SEQ ID NO: 9162167 - DNA, 22 bp, Homo sapiens
atccatttcctccactataaag

SEQ ID NO: 9162168 - DNA, 22 bp, Homo sapiens
atccatttctatcttgctgagg

SEQ ID NO: 9162169 - DNA, 22 bp, Homo sapiens
atccatttgacataatttcagc

SEQ ID NO: 9162170 - DNA, 22 bp, Homo sapiens
atccatttgacataatttcagc

SEQ ID NO: 9162171 - DNA, 22 bp, Homo sapiens
atccatttgaaagaacagtcca

SEQ ID NO: 9162172 - DNA, 22 bp, Homo sapiens
cttagcaagaatcagctgctgg

SEQ ID NO: 9162173 - DNA, 22 bp, Homo sapiens
cttagcaaatgcctgtgctgct

SEQ ID NO: 9162174 - DNA, 22 bp, Homo sapiens
cttatctgtaaaatggatacaa

SEQ ID NO: 9162175 - DNA, 22 bp, Homo sapiens
cttaataataggtgaggctatg

SEQ ID NO: 9162176 - DNA, 22 bp, Homo sapiens
cttaataaatggtagctgttat

SEQ ID NO: 9162177 - DNA, 22 bp, Homo sapiens
cttaatctcacctgcaaagtcc

SEQ ID NO: 9162178 - DNA, 22 bp, Homo sapiens
cttaatctcacctgcaaagtcc

SEQ ID NO: 9162179 - DNA, 22 bp, Homo sapiens
atccatcctgccatctgagtag

SEQ ID NO: 9162180 - DNA, 22 bp, Homo sapiens
atccatcatttcaccgccacta

SEQ ID NO: 9162181 - DNA, 20 bp, Homo sapiens
atccatcatgtccatgactt

SEQ ID NO: 9162182 - DNA, 22 bp, Homo sapiens
atccatcagaagggcaaaattt

SEQ ID NO: 9162183 - DNA, 22 bp, Homo sapiens
atccatcagaagggcaaaattt

SEQ ID NO: 9162184 - DNA, 22 bp, Homo sapiens
ctgtttctccacactcttccca

SEQ ID NO: 9162185 - DNA, 22 bp, Homo sapiens
ctgtttctccacactcttccca

SEQ ID NO: 9162186 - DNA, 19 bp, Homo sapiens
atcatcactcatggtcctg

SEQ ID NO: 9162187 - DNA, 23 bp, Homo sapiens
atcataggccctagagagaaggc

SEQ ID NO: 9162188 - DNA, 22 bp, Homo sapiens
atcatacagaacctgagcactt

SEQ ID NO: 9162189 - DNA, 19 bp, Homo sapiens
atcatacatgttacactct

SEQ ID NO: 9162190 - DNA, 22 bp, Homo sapiens
atcatacatgtaactaagtaaa

SEQ ID NO: 9162191 - DNA, 22 bp, Homo sapiens
cttaagatgaggtcatgctata

SEQ ID NO: 9162192 - DNA, 22 bp, Homo sapiens
cttaagatttgagatacctaat

SEQ ID NO: 9162193 - DNA, 22 bp, Homo sapiens
cttaagatttgcgatacctaat

SEQ ID NO: 9162194 - DNA, 22 bp, Homo sapiens
cttaacagagagaagtgttgct

SEQ ID NO: 9162195 - DNA, 21 bp, Homo sapiens
cttaacattttaaatgaaagg

SEQ ID NO: 9162196 - DNA, 22 bp, Homo sapiens
ctggtcccagaggcaagagatg

SEQ ID NO: 9162197 - DNA, 22 bp, Homo sapiens
ctggtcccagctctgccaccaa

SEQ ID NO: 9162198 - DNA, 22 bp, Homo sapiens
ctggtcccagcagagctctgag

SEQ ID NO: 9162199 - DNA, 22 bp, Homo sapiens
ctggtccctgcagtgtgctggg

SEQ ID NO: 9162200 - DNA, 22 bp, Homo sapiens
ctggtccctggacctccctgga

SEQ ID NO: 9162201 - DNA, 20 bp, Homo sapiens
ctgggtggcaagcaaggggg

SEQ ID NO: 9162202 - DNA, 18 bp, Homo sapiens
ctgggtctccaggctgcc

SEQ ID NO: 9162203 - DNA, 22 bp, Homo sapiens
ctgggtctccggcagcctcggg

SEQ ID NO: 9162204 - DNA, 22 bp, Homo sapiens
atattcaaattacatttactaa

SEQ ID NO: 9162205 - DNA, 22 bp, Homo sapiens
atattattctagtaacagtgat

SEQ ID NO: 9162206 - DNA, 18 bp, Homo sapiens
ctgggtctccaggctgcc

SEQ ID NO: 9162207 - DNA, 18 bp, Homo sapiens
ctgggtctccaggctgcc

SEQ ID NO: 9162208 - DNA, 18 bp, Homo sapiens
ctgggtctccaggctgcc

SEQ ID NO: 9162209 - DNA, 22 bp, Homo sapiens
atattcactgagcataaagcca

SEQ ID NO: 9162210 - DNA, 22 bp, Homo sapiens
atattcacagtaagtgtagcag

SEQ ID NO: 9162211 - DNA, 23 bp, Homo sapiens
atattcacgccgccagaggtccc

SEQ ID NO: 9162212 - DNA, 22 bp, Homo sapiens
atattcactcctggtgagacta

SEQ ID NO: 9162213 - DNA, 22 bp, Homo sapiens
ctgggggcaagcagacagctgt

SEQ ID NO: 9162214 - DNA, 19 bp, Homo sapiens
ctggggctttggtactgcc

SEQ ID NO: 9162215 - DNA, 19 bp, Homo sapiens
ctggggctttggtactgcc

SEQ ID NO: 9162216 - DNA, 23 bp, Homo sapiens
ctggggctttcaaatctgggcag

SEQ ID NO: 9162217 - DNA, 23 bp, Homo sapiens
ctggggctttcaaatctgggcag

SEQ ID NO: 9162218 - DNA, 22 bp, Homo sapiens
atattattctagtaacagtgat

SEQ ID NO: 9162219 - DNA, 22 bp, Homo sapiens
atattattctagtaacagtgat

SEQ ID NO: 9162220 - DNA, 22 bp, Homo sapiens
ctgggggcaatggtcagagtgt

SEQ ID NO: 9162221 - DNA, 22 bp, Homo sapiens
ctggggcatctgacagataaat

SEQ ID NO: 9162222 - DNA, 22 bp, Homo sapiens
ctggggcatctgacagataaat

SEQ ID NO: 9162223 - DNA, 22 bp, Homo sapiens
ctggggcatgggcccctagagg

SEQ ID NO: 9162224 - DNA, 22 bp, Homo sapiens
ctggggcatcatccattctttc

SEQ ID NO: 9162225 - DNA, 19 bp, Homo sapiens
ctgggaggtgttcagagaa

SEQ ID NO: 9162226 - DNA, 22 bp, Homo sapiens
ctggggctgtaggaggacttat

SEQ ID NO: 9162227 - DNA, 22 bp, Homo sapiens
ctggggctgtaggaggacttat

SEQ ID NO: 9162228 - DNA, 22 bp, Homo sapiens
ctggggcttcaatgcttcggtg

SEQ ID NO: 9162229 - DNA, 22 bp, Homo sapiens
ctggggctgtgggagacaaggc

SEQ ID NO: 9162230 - DNA, 22 bp, Homo sapiens
ctggggcttcaatgcttcggtg

SEQ ID NO: 9162231 - DNA, 22 bp, Homo sapiens
ctggggctgtgggagacaaggc

SEQ ID NO: 9162232 - DNA, 22 bp, Homo sapiens
ctgggaggacaacttggagctc

SEQ ID NO: 9162233 - DNA, 22 bp, Homo sapiens
ctgggaggacaacttggagctc

SEQ ID NO: 9162234 - DNA, 22 bp, Homo sapiens
ctgggaggcggaggttgcagtg

SEQ ID NO: 9162235 - DNA, 22 bp, Homo sapiens
ctgggaggattcattgaggtga

SEQ ID NO: 9162236 - DNA, 22 bp, Homo sapiens
ctgggaggacaacttggagctc

SEQ ID NO: 9162237 - DNA, 22 bp, Homo sapiens
ctgggaggtggaggttgcattg

SEQ ID NO: 9162238 - DNA, 22 bp, Homo sapiens
ctgggaggtgaacagaaaaact

SEQ ID NO: 9162239 - DNA, 22 bp, Homo sapiens
ctgggaggtgaacagaaaaact

SEQ ID NO: 9162240 - DNA, 22 bp, Homo sapiens
ctgggaggcggaggttgtagtg

SEQ ID NO: 9162241 - DNA, 22 bp, Homo sapiens
atcagctggaacaagtgtctga

SEQ ID NO: 9162242 - DNA, 22 bp, Homo sapiens
atcagctgctacattggcctct

SEQ ID NO: 9162243 - DNA, 19 bp, Homo sapiens
ctgtccttggctgcactgt

SEQ ID NO: 9162244 - DNA, 22 bp, Homo sapiens
ctgtcgcctggtcctctctgga

SEQ ID NO: 9162245 - DNA, 22 bp, Homo sapiens
ctgtcgctgccaacagggctgg

SEQ ID NO: 9162246 - DNA, 22 bp, Homo sapiens
ctgtctagttaggatgccagca

SEQ ID NO: 9162247 - DNA, 22 bp, Homo sapiens
ctgtctccagggcaggtgcagg

SEQ ID NO: 9162248 - DNA, 22 bp, Homo sapiens
ctgtctccagggcaggtgcagg

SEQ ID NO: 9162249 - DNA, 23 bp, Homo sapiens
ctgtctcctgggctaggtggaat

SEQ ID NO: 9162250 - DNA, 22 bp, Homo sapiens
ctgtctctgataagctcgaggg

SEQ ID NO: 9162251 - DNA, 22 bp, Homo sapiens
ctgtctcctccactgcatggga

SEQ ID NO: 9162252 - DNA, 22 bp, Homo sapiens
ctgtctcctccactgcatggga

SEQ ID NO: 9162253 - DNA, 22 bp, Homo sapiens
ctgtctcctccactgcatggga

SEQ ID NO: 9162254 - DNA, 22 bp, Homo sapiens
ctgtctcctccactgcatggga

SEQ ID NO: 9162255 - DNA, 22 bp, Homo sapiens
ctgtctcctcctttgttcttaa

SEQ ID NO: 9162256 - DNA, 22 bp, Homo sapiens
ctgtctcctcctttgttcttaa

SEQ ID NO: 9162257 - DNA, 22 bp, Homo sapiens
ctgtctccagggcaggtgcagg

SEQ ID NO: 9162258 - DNA, 22 bp, Homo sapiens
ctgtctccgccctcttggtagg

SEQ ID NO: 9162259 - DNA, 22 bp, Homo sapiens
ctgtctcctccactgcatggga

SEQ ID NO: 9162260 - DNA, 22 bp, Homo sapiens
ctgtctcctccactgcatggga

SEQ ID NO: 9162261 - DNA, 22 bp, Homo sapiens
atcataaagtgctatctgattg

SEQ ID NO: 9162262 - DNA, 22 bp, Homo sapiens
atcatacactcacataaacaga

SEQ ID NO: 9162263 - DNA, 22 bp, Homo sapiens
atcatacactcacataaacaga

SEQ ID NO: 9162264 - DNA, 22 bp, Homo sapiens
atcatacactcacataaacaga

SEQ ID NO: 9162265 - DNA, 22 bp, Homo sapiens
atcataaaccactttgtaatct

SEQ ID NO: 9162266 - DNA, 22 bp, Homo sapiens
atcataaaccactttgtaatct

SEQ ID NO: 9162267 - DNA, 22 bp, Homo sapiens
atcataaaccactttgtaatct

SEQ ID NO: 9162268 - DNA, 22 bp, Homo sapiens
atcataaaattgcaccatttct

SEQ ID NO: 9162269 - DNA, 22 bp, Homo sapiens
atcagtttttattaatgtagct

SEQ ID NO: 9162270 - DNA, 22 bp, Homo sapiens
atcataaaattgcaccatttct

SEQ ID NO: 9162271 - DNA, 22 bp, Homo sapiens
atcagtttttattaatgtagct

SEQ ID NO: 9162272 - DNA, 22 bp, Homo sapiens
atcagttttgttcactactata

SEQ ID NO: 9162273 - DNA, 22 bp, Homo sapiens
atcagttttgggggacatactg

SEQ ID NO: 9162274 - DNA, 22 bp, Homo sapiens
atcagtttgtatatgaaacact

SEQ ID NO: 9162275 - DNA, 22 bp, Homo sapiens
atcagtttctaccatgtggaat

SEQ ID NO: 9162276 - DNA, 22 bp, Homo sapiens
atcagtttctaccatgtggaat

SEQ ID NO: 9162277 - DNA, 22 bp, Homo sapiens
atcagtttcacttgcttgcaaa

SEQ ID NO: 9162278 - DNA, 22 bp, Homo sapiens
atcagtttatacttataaatct

SEQ ID NO: 9162279 - DNA, 22 bp, Homo sapiens
atcagtttggaacattcaggcc

SEQ ID NO: 9162280 - DNA, 22 bp, Homo sapiens
atcagtttctgtgaagaacaca

SEQ ID NO: 9162281 - DNA, 22 bp, Homo sapiens
atcagtttgataataaggcttg

SEQ ID NO: 9162282 - DNA, 22 bp, Homo sapiens
ctgtaacttagcatggttacta

SEQ ID NO: 9162283 - DNA, 22 bp, Homo sapiens
ctgtaacttaatgagaggcaga

SEQ ID NO: 9162284 - DNA, 22 bp, Homo sapiens
ctgtaactctgccaagaaggct

SEQ ID NO: 9162285 - DNA, 22 bp, Homo sapiens
ctgtaatcccagctacctggga

SEQ ID NO: 9162286 - DNA, 22 bp, Homo sapiens
ctgtaatcccagctacctggga

SEQ ID NO: 9162287 - DNA, 22 bp, Homo sapiens
ctgtaatcccagctactcggga

SEQ ID NO: 9162288 - DNA, 22 bp, Homo sapiens
atcagagccttatgcttctcat

SEQ ID NO: 9162289 - DNA, 22 bp, Homo sapiens
atcagcaggaagggcaccttta

SEQ ID NO: 9162290 - DNA, 22 bp, Homo sapiens
atcagcaggcatattaactgaa

SEQ ID NO: 9162291 - DNA, 22 bp, Homo sapiens
atcagcagatgctcaatgaaca

SEQ ID NO: 9162292 - DNA, 22 bp, Homo sapiens
atcagcagatgctcaatgaaca

SEQ ID NO: 9162293 - DNA, 22 bp, Homo sapiens
atcagcaatctcgtgtattagg

SEQ ID NO: 9162294 - DNA, 22 bp, Homo sapiens
atcagagctagtacttgcaggt

SEQ ID NO: 9162295 - DNA, 22 bp, Homo sapiens
atcagcagtgtctacctcggtg

SEQ ID NO: 9162296 - DNA, 22 bp, Homo sapiens
atcagctaattagaattaggat

SEQ ID NO: 9162297 - DNA, 22 bp, Homo sapiens
atcacagagctcccttccactg

SEQ ID NO: 9162298 - DNA, 22 bp, Homo sapiens
atcacagagattgcttttaaaa

SEQ ID NO: 9162299 - DNA, 22 bp, Homo sapiens
atcacaatgtacgttaaaatgt

SEQ ID NO: 9162300 - DNA, 22 bp, Homo sapiens
atcacacagagcattaggggcc

SEQ ID NO: 9162301 - DNA, 22 bp, Homo sapiens
atcacacagcaaggtggaggca

SEQ ID NO: 9162302 - DNA, 22 bp, Homo sapiens
atcacaaaggtctcagagcaca

SEQ ID NO: 9162303 - DNA, 22 bp, Homo sapiens
atcacaaaggtctcagagcaca

SEQ ID NO: 9162304 - DNA, 22 bp, Homo sapiens
aggagtgggggcgagaagttaa

SEQ ID NO: 9162305 - DNA, 22 bp, Homo sapiens
aggagtcacctgcccaaagtca

SEQ ID NO: 9162306 - DNA, 22 bp, Homo sapiens
aggagtcacctgcccaaagtca

SEQ ID NO: 9162307 - DNA, 22 bp, Homo sapiens
aggagtcacctgcccaaagtca

SEQ ID NO: 9162308 - DNA, 22 bp, Homo sapiens
aggagtgggggcgagaagttaa

SEQ ID NO: 9162309 - DNA, 22 bp, Homo sapiens
aggagtgggggcgagaagttaa

SEQ ID NO: 9162310 - DNA, 22 bp, Homo sapiens
catcatttcacttagatgaagt

SEQ ID NO: 9162311 - DNA, 22 bp, Homo sapiens
catcatttgttcacttgattcc

SEQ ID NO: 9162312 - DNA, 22 bp, Homo sapiens
catcattttattaaccaagaaa

SEQ ID NO: 9162313 - DNA, 22 bp, Homo sapiens
catcatttcacttagatgaagt

SEQ ID NO: 9162314 - DNA, 22 bp, Homo sapiens
aggagggtttcaatgggatgag

SEQ ID NO: 9162315 - DNA, 22 bp, Homo sapiens
aggagggtttcaatgggatgag

SEQ ID NO: 9162316 - DNA, 22 bp, Homo sapiens
aggaggtgacagcctgcatctg

SEQ ID NO: 9162317 - DNA, 22 bp, Homo sapiens
aggagggtggcctcatgtgagt

SEQ ID NO: 9162318 - DNA, 22 bp, Homo sapiens
aggagggtggcctcatgtgagt

SEQ ID NO: 9162319 - DNA, 22 bp, Homo sapiens
aggagggttctctggacagagg

SEQ ID NO: 9162320 - DNA, 22 bp, Homo sapiens
aggaggctggttcaggccatat

SEQ ID NO: 9162321 - DNA, 22 bp, Homo sapiens
aggaggctggttcaggccatat

SEQ ID NO: 9162322 - DNA, 22 bp, Homo sapiens
aggaggctggttcaggccatat

SEQ ID NO: 9162323 - DNA, 22 bp, Homo sapiens
aggaggggcaatgatagtctgg

SEQ ID NO: 9162324 - DNA, 22 bp, Homo sapiens
aggaggggcatagaaatgtaat

SEQ ID NO: 9162325 - DNA, 22 bp, Homo sapiens
aggaggggcaatgatagtctgg

SEQ ID NO: 9162326 - DNA, 22 bp, Homo sapiens
aggaggctggttcaggccatat

SEQ ID NO: 9162327 - DNA, 22 bp, Homo sapiens
catcagaagaaagacaaatgat

SEQ ID NO: 9162328 - DNA, 22 bp, Homo sapiens
catcactggctgctgacagatg

SEQ ID NO: 9162329 - DNA, 22 bp, Homo sapiens
catcactggcatcatgggaggg

SEQ ID NO: 9162330 - DNA, 22 bp, Homo sapiens
aggaggctgggcacagtggcct

SEQ ID NO: 9162331 - DNA, 22 bp, Homo sapiens
aggaggctgggcacagtggcct

SEQ ID NO: 9162332 - DNA, 22 bp, Homo sapiens
aggaggctgcaaccctgaggcc

SEQ ID NO: 9162333 - DNA, 22 bp, Homo sapiens
aggaggctgcaaccctgaggcc

SEQ ID NO: 9162334 - DNA, 22 bp, Homo sapiens
cagttctctgtgcctcgctggg

SEQ ID NO: 9162335 - DNA, 21 bp, Homo sapiens
cagttctcttagatttccagt

SEQ ID NO: 9162336 - DNA, 23 bp, Homo sapiens
cagttcccactgtctgtcacaag

SEQ ID NO: 9162337 - DNA, 22 bp, Homo sapiens
cagttccctccgccagcacttc

SEQ ID NO: 9162338 - DNA, 22 bp, Homo sapiens
cagttcctggttccattcttct

SEQ ID NO: 9162339 - DNA, 22 bp, Homo sapiens
catattttagttgctgaacagc

SEQ ID NO: 9162340 - DNA, 22 bp, Homo sapiens
catcacccggaactgtgtctgc

SEQ ID NO: 9162341 - DNA, 22 bp, Homo sapiens
catcactacaaatttaagaaat

SEQ ID NO: 9162342 - DNA, 22 bp, Homo sapiens
cagttcatagtcttcatgtctc

SEQ ID NO: 9162343 - DNA, 22 bp, Homo sapiens
cagttcagctagaagaaacaaa

SEQ ID NO: 9162344 - DNA, 21 bp, Homo sapiens
cagttatcaagaggatgctga

SEQ ID NO: 9162345 - DNA, 22 bp, Homo sapiens
cagttattatgaggtcattagg

SEQ ID NO: 9162346 - DNA, 21 bp, Homo sapiens
cagttattcttgatgtgtgtg

SEQ ID NO: 9162347 - DNA, 22 bp, Homo sapiens
aggagctgggcccaaggatgct

SEQ ID NO: 9162348 - DNA, 22 bp, Homo sapiens
aggagctgggagaaggactaaa

SEQ ID NO: 9162349 - DNA, 22 bp, Homo sapiens
aggagctgggagaaggactaaa

SEQ ID NO: 9162350 - DNA, 22 bp, Homo sapiens
aggagctgggctgctgctggga

SEQ ID NO: 9162351 - DNA, 22 bp, Homo sapiens
aggagctgggctgctgctggga

SEQ ID NO: 9162352 - DNA, 22 bp, Homo sapiens
aggagctggcctagaaaggaga

SEQ ID NO: 9162353 - DNA, 22 bp, Homo sapiens
aggagctggcctagaaaggaga

SEQ ID NO: 9162354 - DNA, 22 bp, Homo sapiens
aggagctggccactaggatgca

SEQ ID NO: 9162355 - DNA, 22 bp, Homo sapiens
aggagctggccactaggatgca

SEQ ID NO: 9162356 - DNA, 22 bp, Homo sapiens
cagtggaaatcagagtgagagt

SEQ ID NO: 9162357 - DNA, 22 bp, Homo sapiens
cagtggaaatcagagtgagagt

SEQ ID NO: 9162358 - DNA, 22 bp, Homo sapiens
cagtggaagctggctgtgaaga

SEQ ID NO: 9162359 - DNA, 22 bp, Homo sapiens
cagtggaatatataggggattt

SEQ ID NO: 9162360 - DNA, 22 bp, Homo sapiens
cagtggaatacgagcagatgtc

SEQ ID NO: 9162361 - DNA, 22 bp, Homo sapiens
aggagctgatagtctatggaga

SEQ ID NO: 9162362 - DNA, 22 bp, Homo sapiens
cagtggagagacttttactctt

SEQ ID NO: 9162363 - DNA, 23 bp, Homo sapiens
cagtggagactcatgcttcctta

SEQ ID NO: 9162364 - DNA, 23 bp, Homo sapiens
cagtggagactcatgcttcctta

SEQ ID NO: 9162365 - DNA, 22 bp, Homo sapiens
aggagccaagatgctgtctggc

SEQ ID NO: 9162366 - DNA, 22 bp, Homo sapiens
aggagccaagatggggcaagta

SEQ ID NO: 9162367 - DNA, 17 bp, Homo sapiens
cagtgcttctgcttctt

SEQ ID NO: 9162368 - DNA, 20 bp, Homo sapiens
cagtgcttcctcctttcttt

SEQ ID NO: 9162369 - DNA, 22 bp, Homo sapiens
cagtggaaactatgctgctgga

SEQ ID NO: 9162370 - DNA, 22 bp, Homo sapiens
cagtgcttttaaaacaacatca

SEQ ID NO: 9162371 - DNA, 22 bp, Homo sapiens
cagtggaaatcagagtgagagt

SEQ ID NO: 9162372 - DNA, 22 bp, Homo sapiens
cagtggaaactatgctgctgga

SEQ ID NO: 9162373 - DNA, 22 bp, Homo sapiens
aggagcagcttctgaaccatgt

SEQ ID NO: 9162374 - DNA, 22 bp, Homo sapiens
aggagccaaacatattgagaga

SEQ ID NO: 9162375 - DNA, 22 bp, Homo sapiens
aggagccaaaagctgaacaaga

SEQ ID NO: 9162376 - DNA, 22 bp, Homo sapiens
aggagcagcccactcctgtcct

SEQ ID NO: 9162377 - DNA, 22 bp, Homo sapiens
aggagcagcccactcctgtcct

SEQ ID NO: 9162378 - DNA, 22 bp, Homo sapiens
aggagcagattggtaagatcat

SEQ ID NO: 9162379 - DNA, 20 bp, Homo sapiens
aggagatgatccagagtcag

SEQ ID NO: 9162380 - DNA, 22 bp, Homo sapiens
aggagatcagcttagggaaggt

SEQ ID NO: 9162381 - DNA, 23 bp, Homo sapiens
cagtgcagggcaactcagactcc

SEQ ID NO: 9162382 - DNA, 22 bp, Homo sapiens
cagtgcaggctgggggccctgc

SEQ ID NO: 9162383 - DNA, 23 bp, Homo sapiens
cagtgcagggcaactcagactcc

SEQ ID NO: 9162384 - DNA, 22 bp, Homo sapiens
cagtgcagccaaggacaggcac

SEQ ID NO: 9162385 - DNA, 22 bp, Homo sapiens
cagtgcagccaaggacaggcac

SEQ ID NO: 9162386 - DNA, 22 bp, Homo sapiens
cagtgcaggaagtgagatgcct

SEQ ID NO: 9162387 - DNA, 22 bp, Homo sapiens
cagtgcaggctgggggccctgc

SEQ ID NO: 9162388 - DNA, 22 bp, Homo sapiens
cagtgagggcccccttccaggt

SEQ ID NO: 9162389 - DNA, 22 bp, Homo sapiens
cagtgcagccaaggacaggcac

SEQ ID NO: 9162390 - DNA, 22 bp, Homo sapiens
cagtgaggctctgctgagcggt

SEQ ID NO: 9162391 - DNA, 22 bp, Homo sapiens
cagtgaggctctgctgagcggt

SEQ ID NO: 9162392 - DNA, 22 bp, Homo sapiens
aggacaaaggaccagatctgga

SEQ ID NO: 9162393 - DNA, 22 bp, Homo sapiens
aggacaaaggaccagatctgga

SEQ ID NO: 9162394 - DNA, 22 bp, Homo sapiens
aggacaagacaaggaccagaga

SEQ ID NO: 9162395 - DNA, 22 bp, Homo sapiens
cagtgaggagtccagggcagag

SEQ ID NO: 9162396 - DNA, 22 bp, Homo sapiens
cagtgaggagtccagggcagag

SEQ ID NO: 9162397 - DNA, 18 bp, Homo sapiens
cagtgaggatgaagggtt

SEQ ID NO: 9162398 - DNA, 22 bp, Homo sapiens
cagtgaggatgataattaaggt

SEQ ID NO: 9162399 - DNA, 18 bp, Homo sapiens
cagtgaggatgaagggtt

SEQ ID NO: 9162400 - DNA, 20 bp, Homo sapiens
cagtgaggaggtgctggggg

SEQ ID NO: 9162401 - DNA, 22 bp, Homo sapiens
aggaatttggggttacatgatg

SEQ ID NO: 9162402 - DNA, 22 bp, Homo sapiens
aggaatttgctggaacacagat

SEQ ID NO: 9162403 - DNA, 22 bp, Homo sapiens
aggaattcaagaccagctgggc

SEQ ID NO: 9162404 - DNA, 22 bp, Homo sapiens
aggaattcaagaccagctgggc

SEQ ID NO: 9162405 - DNA, 22 bp, Homo sapiens
aggaattcaagaccagctgggc

SEQ ID NO: 9162406 - DNA, 23 bp, Homo sapiens
aggagttgagggttgggttggca

SEQ ID NO: 9162407 - DNA, 22 bp, Homo sapiens
aggatcaggccctctagggtag

SEQ ID NO: 9162408 - DNA, 23 bp, Homo sapiens
aggatcctggtacaggagcagag

SEQ ID NO: 9162409 - DNA, 22 bp, Homo sapiens
aggatctgtgagtgctgcagac

SEQ ID NO: 9162410 - DNA, 22 bp, Homo sapiens
aggatcagtgaatactcagggt

SEQ ID NO: 9162411 - DNA, 22 bp, Homo sapiens
aggcacagggatgcggagccag

SEQ ID NO: 9162412 - DNA, 22 bp, Homo sapiens
aggcacaggcctcagcacccag

SEQ ID NO: 9162413 - DNA, 22 bp, Homo sapiens
catgtgtgagtgagcagtcttc

SEQ ID NO: 9162414 - DNA, 22 bp, Homo sapiens
catgtgtgggacccttaggttg

SEQ ID NO: 9162415 - DNA, 23 bp, Homo sapiens
catgtgtgacagtatcactgttt

SEQ ID NO: 9162416 - DNA, 22 bp, Homo sapiens
catgtgtgacaaactgcctgca

SEQ ID NO: 9162417 - DNA, 22 bp, Homo sapiens
catgtgtgaatcttgtgatcat

SEQ ID NO: 9162418 - DNA, 22 bp, Homo sapiens
catgtgtgaagactgcgggcca

SEQ ID NO: 9162419 - DNA, 22 bp, Homo sapiens
catgtctgagtagagtgtgatt

SEQ ID NO: 9162420 - DNA, 22 bp, Homo sapiens
catgtctgagtagagtgtgatt

SEQ ID NO: 9162421 - DNA, 22 bp, Homo sapiens
catgtccttctcattgcctcat

SEQ ID NO: 9162422 - DNA, 22 bp, Homo sapiens
catgtccttctcattgcctcat

SEQ ID NO: 9162423 - DNA, 20 bp, Homo sapiens
aggcacagttcctagttggg

SEQ ID NO: 9162424 - DNA, 22 bp, Homo sapiens
aggcacagtggctcacacctgt

SEQ ID NO: 9162425 - DNA, 22 bp, Homo sapiens
aggcacagtgcctggaatcaaa

SEQ ID NO: 9162426 - DNA, 22 bp, Homo sapiens
aggcacagtgcctggaatcaaa

SEQ ID NO: 9162427 - DNA, 22 bp, Homo sapiens
aggcacaggtggacttcacagt

SEQ ID NO: 9162428 - DNA, 22 bp, Homo sapiens
aggcacaggtggacttcacagt

SEQ ID NO: 9162429 - DNA, 19 bp, Homo sapiens
aggcacaggttgtctggac

SEQ ID NO: 9162430 - DNA, 22 bp, Homo sapiens
aggcacagtttcatccccgggc

SEQ ID NO: 9162431 - DNA, 22 bp, Homo sapiens
aggcactgaaaggtggccagag

SEQ ID NO: 9162432 - DNA, 22 bp, Homo sapiens
aggcactgaagtggtaaatgta

SEQ ID NO: 9162433 - DNA, 22 bp, Homo sapiens
aggcactgaagtggtaaatgta

SEQ ID NO: 9162434 - DNA, 22 bp, Homo sapiens
aggcactgaaggaagcttgcgc

SEQ ID NO: 9162435 - DNA, 22 bp, Homo sapiens
aggcactgacaattctggactg

SEQ ID NO: 9162436 - DNA, 22 bp, Homo sapiens
aggcactgacagattctgtgtc

SEQ ID NO: 9162437 - DNA, 22 bp, Homo sapiens
aggcactgacaattctggactg

SEQ ID NO: 9162438 - DNA, 22 bp, Homo sapiens
aggcactgactcaagggagcca

SEQ ID NO: 9162439 - DNA, 16 bp, Homo sapiens
aggcagagatttaccc

SEQ ID NO: 9162440 - DNA, 16 bp, Homo sapiens
aggcagagatttaccc

SEQ ID NO: 9162441 - DNA, 16 bp, Homo sapiens
aggcagagatttaccc

SEQ ID NO: 9162442 - DNA, 22 bp, Homo sapiens
aggcagagagcagtggccgtct

SEQ ID NO: 9162443 - DNA, 22 bp, Homo sapiens
aggcagagagcagtggccgtct

SEQ ID NO: 9162444 - DNA, 22 bp, Homo sapiens
aggcagagagcagtggccgtct

SEQ ID NO: 9162445 - DNA, 22 bp, Homo sapiens
aggcagagagcagtggccgtct

SEQ ID NO: 9162446 - DNA, 22 bp, Homo sapiens
aggcactttaggatcaggttga

SEQ ID NO: 9162447 - DNA, 22 bp, Homo sapiens
aggcactttccttgaggagttt

SEQ ID NO: 9162448 - DNA, 22 bp, Homo sapiens
aggcactttctgtatgctagtt

SEQ ID NO: 9162449 - DNA, 22 bp, Homo sapiens
aggcagctttcagtgtctctca

SEQ ID NO: 9162450 - DNA, 22 bp, Homo sapiens
aggcagctttctggtgcaccat

SEQ ID NO: 9162451 - DNA, 22 bp, Homo sapiens
aggcagctttaactggtagtag

SEQ ID NO: 9162452 - DNA, 22 bp, Homo sapiens
aggcagctttaactggtagtag

SEQ ID NO: 9162453 - DNA, 22 bp, Homo sapiens
aggcagcttctgattagcagcg

SEQ ID NO: 9162454 - DNA, 22 bp, Homo sapiens
aggcagcttaagccctggccca

SEQ ID NO: 9162455 - DNA, 22 bp, Homo sapiens
aggcagcttctgattagcagcg

SEQ ID NO: 9162456 - DNA, 22 bp, Homo sapiens
aggcagcttctgattagcagcg

SEQ ID NO: 9162457 - DNA, 20 bp, Homo sapiens
aggcagctggccaggcaggt

SEQ ID NO: 9162458 - DNA, 20 bp, Homo sapiens
aggcagctggccaggcaggt

SEQ ID NO: 9162459 - DNA, 20 bp, Homo sapiens
aggcagctggccaggcaggt

SEQ ID NO: 9162460 - DNA, 20 bp, Homo sapiens
aggcagctggccaggcaggt

SEQ ID NO: 9162461 - DNA, 22 bp, Homo sapiens
aggcagctgtgaggactggatt

SEQ ID NO: 9162462 - DNA, 22 bp, Homo sapiens
aggcagctgtgaggactggatt

SEQ ID NO: 9162463 - DNA, 20 bp, Homo sapiens
aggcagctgggaaatgaggg

SEQ ID NO: 9162464 - DNA, 20 bp, Homo sapiens
aggcagctgggaaatgaggg

SEQ ID NO: 9162465 - DNA, 23 bp, Homo sapiens
aggcagctgggtagcatctttct

SEQ ID NO: 9162466 - DNA, 22 bp, Homo sapiens
aggcagctggcagcacccaggg

SEQ ID NO: 9162467 - DNA, 22 bp, Homo sapiens
aggcagctggcagcacccaggg

SEQ ID NO: 9162468 - DNA, 22 bp, Homo sapiens
aggcagaggagaatgatcttcc

SEQ ID NO: 9162469 - DNA, 22 bp, Homo sapiens
aggcagaggagaatgatcttcc

SEQ ID NO: 9162470 - DNA, 22 bp, Homo sapiens
aggcagaggagaatgatcttcc

SEQ ID NO: 9162471 - DNA, 22 bp, Homo sapiens
aggcagaggaagggtggatttg

SEQ ID NO: 9162472 - DNA, 22 bp, Homo sapiens
aggcagaggaagggtggatttg

SEQ ID NO: 9162473 - DNA, 22 bp, Homo sapiens
aggcagaggaagggtggatttg

SEQ ID NO: 9162474 - DNA, 22 bp, Homo sapiens
aggcagagctgggttttgaaat

SEQ ID NO: 9162475 - DNA, 22 bp, Homo sapiens
aggcagagctgggttttgaaat

SEQ ID NO: 9162476 - DNA, 22 bp, Homo sapiens
aggcagagctgggttttgaaat

SEQ ID NO: 9162477 - DNA, 22 bp, Homo sapiens
aggcagagctgatgttctgtga

SEQ ID NO: 9162478 - DNA, 22 bp, Homo sapiens
aggcagagctgatgttctgtga

SEQ ID NO: 9162479 - DNA, 22 bp, Homo sapiens
aggcagagctgatgttctgtga

SEQ ID NO: 9162480 - DNA, 22 bp, Homo sapiens
aggcagagctgatgttctgtga

SEQ ID NO: 9162481 - DNA, 22 bp, Homo sapiens
aggcagagctaggaagaattgt

SEQ ID NO: 9162482 - DNA, 22 bp, Homo sapiens
aggcagagctaggaagaattgt

SEQ ID NO: 9162483 - DNA, 22 bp, Homo sapiens
aggcagagctaggaagaattgt

SEQ ID NO: 9162484 - DNA, 23 bp, Homo sapiens
aggcagagccaaggtcaaaaccc

SEQ ID NO: 9162485 - DNA, 23 bp, Homo sapiens
aggcagagccaaggtcaaaaccc

SEQ ID NO: 9162486 - DNA, 20 bp, Homo sapiens
aggcagagcgcacttttaga

SEQ ID NO: 9162487 - DNA, 20 bp, Homo sapiens
aggcagagcgcacttttaga

SEQ ID NO: 9162488 - DNA, 20 bp, Homo sapiens
aggcagagcgcacttttaga

SEQ ID NO: 9162489 - DNA, 20 bp, Homo sapiens
aggcagagcgcacttttaga

SEQ ID NO: 9162490 - DNA, 22 bp, Homo sapiens
aggcaggctagtcgcttgagcc

SEQ ID NO: 9162491 - DNA, 22 bp, Homo sapiens
aggcaggccctctggaaaggta

SEQ ID NO: 9162492 - DNA, 22 bp, Homo sapiens
aggcaggcctacacaatgggag

SEQ ID NO: 9162493 - DNA, 22 bp, Homo sapiens
aggcaggcctacacaatgggag

SEQ ID NO: 9162494 - DNA, 18 bp, Homo sapiens
aggcaggcggatcacaag

SEQ ID NO: 9162495 - DNA, 22 bp, Homo sapiens
aggcaggcctacacaatgggag

SEQ ID NO: 9162496 - DNA, 19 bp, Homo sapiens
ccaaaggaagtttccctcc

SEQ ID NO: 9162497 - DNA, 22 bp, Homo sapiens
ccaaaggatgtccctgtgtttt

SEQ ID NO: 9162498 - DNA, 22 bp, Homo sapiens
ccaaagcaagtcacatgatcaa

SEQ ID NO: 9162499 - DNA, 22 bp, Homo sapiens
ccaaagcaagtcacatgatcaa

SEQ ID NO: 9162500 - DNA, 22 bp, Homo sapiens
ccaaagcaagtcacatgatcaa

SEQ ID NO: 9162501 - DNA, 22 bp, Homo sapiens
ccaaagagctagaattataggc

SEQ ID NO: 9162502 - DNA, 22 bp, Homo sapiens
ccaaagacagacttgactagag

SEQ ID NO: 9162503 - DNA, 21 bp, Homo sapiens
ccaaagaactgccatttgtca

SEQ ID NO: 9162504 - DNA, 22 bp, Homo sapiens
aggcaggcccctgagaatagac

SEQ ID NO: 9162505 - DNA, 23 bp, Homo sapiens
aggcaggcagttcagctgttgtt

SEQ ID NO: 9162506 - DNA, 22 bp, Homo sapiens
ccaaaattattacatttgtagg

SEQ ID NO: 9162507 - DNA, 22 bp, Homo sapiens
ccaaaattattacatttgtagg

SEQ ID NO: 9162508 - DNA, 22 bp, Homo sapiens
ccaaagaaacccaagctcaggg

SEQ ID NO: 9162509 - DNA, 22 bp, Homo sapiens
ccaaaccatccatctccaggct

SEQ ID NO: 9162510 - DNA, 22 bp, Homo sapiens
ccaaaataacagcccaattcac

SEQ ID NO: 9162511 - DNA, 22 bp, Homo sapiens
ccaaaattaagcctcttatgtt

SEQ ID NO: 9162512 - DNA, 22 bp, Homo sapiens
ccaaaatgtttgaatgcatgtg

SEQ ID NO: 9162513 - DNA, 23 bp, Homo sapiens
caggaaatcaattcttccagcat

SEQ ID NO: 9162514 - DNA, 22 bp, Homo sapiens
caggaaatagttcagtcaaact

SEQ ID NO: 9162515 - DNA, 22 bp, Homo sapiens
caggaaaaggagactttagcac

SEQ ID NO: 9162516 - DNA, 17 bp, Homo sapiens
caggaaaatatgagtga

SEQ ID NO: 9162517 - DNA, 17 bp, Homo sapiens
caggaaaatatgagtga

SEQ ID NO: 9162518 - DNA, 17 bp, Homo sapiens
caggaaaatatgagtga

SEQ ID NO: 9162519 - DNA, 22 bp, Homo sapiens
agctcttttgctctccaagttt

SEQ ID NO: 9162520 - DNA, 22 bp, Homo sapiens
agctgaaacttcccattaattg

SEQ ID NO: 9162521 - DNA, 22 bp, Homo sapiens
agctgaaaattagtgatagttt

SEQ ID NO: 9162522 - DNA, 22 bp, Homo sapiens
agctgaagaaatgggaagcatt

SEQ ID NO: 9162523 - DNA, 22 bp, Homo sapiens
agctgaaattttactgagtata

SEQ ID NO: 9162524 - DNA, 17 bp, Homo sapiens
agctgaaattgctgaag

SEQ ID NO: 9162525 - DNA, 22 bp, Homo sapiens
agctgaaagtgctttgaggact

SEQ ID NO: 9162526 - DNA, 22 bp, Homo sapiens
agctgaaagggtgttggagtgt

SEQ ID NO: 9162527 - DNA, 22 bp, Homo sapiens
agctgaaattcacaaggatcca

SEQ ID NO: 9162528 - DNA, 22 bp, Homo sapiens
agctgaaattcacaaggatcca

SEQ ID NO: 9162529 - DNA, 22 bp, Homo sapiens
caggaagaagggtggtgagtcc

SEQ ID NO: 9162530 - DNA, 22 bp, Homo sapiens
caggaagaagggtggtgagtcc

SEQ ID NO: 9162531 - DNA, 22 bp, Homo sapiens
caggaagaccagggctgtggct

SEQ ID NO: 9162532 - DNA, 22 bp, Homo sapiens
caggaacctgtgcgtagggatg

SEQ ID NO: 9162533 - DNA, 22 bp, Homo sapiens
caggaacctgctccaagaggca

SEQ ID NO: 9162534 - DNA, 22 bp, Homo sapiens
caggaactggaaccctggccga

SEQ ID NO: 9162535 - DNA, 22 bp, Homo sapiens
caggaagaaagaggtgaggtgt

SEQ ID NO: 9162536 - DNA, 22 bp, Homo sapiens
caggaagaaagaggtgaggtgt

SEQ ID NO: 9162537 - DNA, 22 bp, Homo sapiens
caggaacctaatgaaggctcac

SEQ ID NO: 9162538 - DNA, 22 bp, Homo sapiens
caggaacccaatgggccaggcc

SEQ ID NO: 9162539 - DNA, 22 bp, Homo sapiens
agctgccctttatgatgctgaa

SEQ ID NO: 9162540 - DNA, 22 bp, Homo sapiens
agctgccctgggtcttgctgct

SEQ ID NO: 9162541 - DNA, 22 bp, Homo sapiens
agctgcccttaataggcattca

SEQ ID NO: 9162542 - DNA, 22 bp, Homo sapiens
agctgccctgtggggagggttg

SEQ ID NO: 9162543 - DNA, 22 bp, Homo sapiens
agctgccgatgcccagctgcat

SEQ ID NO: 9162544 - DNA, 22 bp, Homo sapiens
agctgccgatgcccagctgcat

SEQ ID NO: 9162545 - DNA, 20 bp, Homo sapiens
agctgcccttttcacatgtt

SEQ ID NO: 9162546 - DNA, 22 bp, Homo sapiens
agctgccctggcggagctgctc

SEQ ID NO: 9162547 - DNA, 22 bp, Homo sapiens
agctgccctggcggagctgctc

SEQ ID NO: 9162548 - DNA, 22 bp, Homo sapiens
agctgccctgggctggagatgg

SEQ ID NO: 9162549 - DNA, 22 bp, Homo sapiens
agctgccctggcggagctgctc

SEQ ID NO: 9162550 - DNA, 20 bp, Homo sapiens
agctgcccctgggcactgcc

SEQ ID NO: 9162551 - DNA, 20 bp, Homo sapiens
agctgcccctgggcactgcc

SEQ ID NO: 9162552 - DNA, 22 bp, Homo sapiens
caggaagaccagggctgtggct

SEQ ID NO: 9162553 - DNA, 22 bp, Homo sapiens
caggaagaccagggctgtggct

SEQ ID NO: 9162554 - DNA, 22 bp, Homo sapiens
agctgccccgaggcggcgggaa

SEQ ID NO: 9162555 - DNA, 22 bp, Homo sapiens
agctgcccccagggctgtgctt

SEQ ID NO: 9162556 - DNA, 22 bp, Homo sapiens
agctgcccctcattttcaccac

SEQ ID NO: 9162557 - DNA, 22 bp, Homo sapiens
agctgcctgccatgccgctggt

SEQ ID NO: 9162558 - DNA, 22 bp, Homo sapiens
agctgcctcctggtgccccatc

SEQ ID NO: 9162559 - DNA, 23 bp, Homo sapiens
agctggaaatggccgagctctgc

SEQ ID NO: 9162560 - DNA, 22 bp, Homo sapiens
agctggaaaatccaagaccttg

SEQ ID NO: 9162561 - DNA, 22 bp, Homo sapiens
agctggaagctgatgagcacag

SEQ ID NO: 9162562 - DNA, 22 bp, Homo sapiens
agctggaagctgatgagcacag

SEQ ID NO: 9162563 - DNA, 22 bp, Homo sapiens
agctggaacgtcacaggagcag

SEQ ID NO: 9162564 - DNA, 22 bp, Homo sapiens
agctgctttgctgggcaggccc

SEQ ID NO: 9162565 - DNA, 22 bp, Homo sapiens
agctgggtggagggcccacggt

SEQ ID NO: 9162566 - DNA, 22 bp, Homo sapiens
agctgggtgcggtggctcatgc

SEQ ID NO: 9162567 - DNA, 22 bp, Homo sapiens
agctgggtggcctctcctcggg

SEQ ID NO: 9162568 - DNA, 21 bp, Homo sapiens
agctgggtgggctgagtgaca

SEQ ID NO: 9162569 - DNA, 22 bp, Homo sapiens
agctgggtggtgctgagccttg

SEQ ID NO: 9162570 - DNA, 22 bp, Homo sapiens
agctgggtgcggtggctcatgc

SEQ ID NO: 9162571 - DNA, 19 bp, Homo sapiens
agctggggcggtgtgtgtt

SEQ ID NO: 9162572 - DNA, 22 bp, Homo sapiens
caggcagagtgaggtggtctaa

SEQ ID NO: 9162573 - DNA, 19 bp, Homo sapiens
agctggggcggtgtgtgtt

SEQ ID NO: 9162574 - DNA, 20 bp, Homo sapiens
caggcagaggatgctgacca

SEQ ID NO: 9162575 - DNA, 20 bp, Homo sapiens
caggcagaggatgctgacca

SEQ ID NO: 9162576 - DNA, 20 bp, Homo sapiens
caggcagaggatgctgacca

SEQ ID NO: 9162577 - DNA, 22 bp, Homo sapiens
caggcagagtcagattagactt

SEQ ID NO: 9162578 - DNA, 22 bp, Homo sapiens
agctggtgaacctgaggcacag

SEQ ID NO: 9162579 - DNA, 22 bp, Homo sapiens
agctggtgaacctgaggcacag

SEQ ID NO: 9162580 - DNA, 22 bp, Homo sapiens
agctggtgaacctgaggcacag

SEQ ID NO: 9162581 - DNA, 22 bp, Homo sapiens
agctggtgaacctgaggcacag

SEQ ID NO: 9162582 - DNA, 22 bp, Homo sapiens
agctggtgatgtggtccctcac

SEQ ID NO: 9162583 - DNA, 22 bp, Homo sapiens
agctgggttcagaggcacatgg

SEQ ID NO: 9162584 - DNA, 22 bp, Homo sapiens
agctgggttcagaggcacatgg

SEQ ID NO: 9162585 - DNA, 22 bp, Homo sapiens
agctgggtgttcttgggcctaa

SEQ ID NO: 9162586 - DNA, 22 bp, Homo sapiens
agctgggttcagaggcacatgg

SEQ ID NO: 9162587 - DNA, 22 bp, Homo sapiens
agctggtaacattagtcagtat

SEQ ID NO: 9162588 - DNA, 22 bp, Homo sapiens
agctggtaagtggcagagattc

SEQ ID NO: 9162589 - DNA, 22 bp, Homo sapiens
agctggtaaaggggaaagcaga

SEQ ID NO: 9162590 - DNA, 22 bp, Homo sapiens
agctgggtttctggcaggctta

SEQ ID NO: 9162591 - DNA, 22 bp, Homo sapiens
agctggtatttctgaaggaaag

SEQ ID NO: 9162592 - DNA, 22 bp, Homo sapiens
caggcagagctgaagatagatg

SEQ ID NO: 9162593 - DNA, 22 bp, Homo sapiens
agctgggactcaactgtctggg

SEQ ID NO: 9162594 - DNA, 22 bp, Homo sapiens
agctggaggagtttctcctagc

SEQ ID NO: 9162595 - DNA, 22 bp, Homo sapiens
agctggaggagtttctcctagc

SEQ ID NO: 9162596 - DNA, 22 bp, Homo sapiens
agctgggactcaactgtctggg

SEQ ID NO: 9162597 - DNA, 22 bp, Homo sapiens
agctgggactcaactgtctggg

SEQ ID NO: 9162598 - DNA, 22 bp, Homo sapiens
agctggagattctggggacagt

SEQ ID NO: 9162599 - DNA, 19 bp, Homo sapiens
agctggagattggagggca

SEQ ID NO: 9162600 - DNA, 22 bp, Homo sapiens
agctggagccagtgtgaggctt

SEQ ID NO: 9162601 - DNA, 22 bp, Homo sapiens
agctggagaaacctgggagggt

SEQ ID NO: 9162602 - DNA, 22 bp, Homo sapiens
agctggagaaacctgggagggt

SEQ ID NO: 9162603 - DNA, 22 bp, Homo sapiens
agctggaattacaggcacgcac

SEQ ID NO: 9162604 - DNA, 22 bp, Homo sapiens
agctggagatgcccagcaccgg

SEQ ID NO: 9162605 - DNA, 22 bp, Homo sapiens
agctggagagtttccaggaagg

SEQ ID NO: 9162606 - DNA, 22 bp, Homo sapiens
agcttctctctttgcactcaca

SEQ ID NO: 9162607 - DNA, 22 bp, Homo sapiens
agcttctcctggtacagaactg

SEQ ID NO: 9162608 - DNA, 22 bp, Homo sapiens
agcttctctctttgcactcaca

SEQ ID NO: 9162609 - DNA, 22 bp, Homo sapiens
agcttctggaaggcaaggcttg

SEQ ID NO: 9162610 - DNA, 23 bp, Homo sapiens
agcttctggttcaggtcaagcag

SEQ ID NO: 9162611 - DNA, 22 bp, Homo sapiens
agctttctagactctgtggtca

SEQ ID NO: 9162612 - DNA, 22 bp, Homo sapiens
agctttcactgatatgctttga

SEQ ID NO: 9162613 - DNA, 22 bp, Homo sapiens
agcttctgttcatcttccaggc

SEQ ID NO: 9162614 - DNA, 22 bp, Homo sapiens
agctttatatttaatgaattct

SEQ ID NO: 9162615 - DNA, 22 bp, Homo sapiens
agctttattcatgatttcaggg

SEQ ID NO: 9162616 - DNA, 21 bp, Homo sapiens
caggcttgaggaatgtgcctg

SEQ ID NO: 9162617 - DNA, 22 bp, Homo sapiens
caggcttgctagaggagccaaa

SEQ ID NO: 9162618 - DNA, 22 bp, Homo sapiens
agcttctcaggagtctgaggca

SEQ ID NO: 9162619 - DNA, 22 bp, Homo sapiens
agcttctccatctgcccagaga

SEQ ID NO: 9162620 - DNA, 22 bp, Homo sapiens
agcttctccatctgcccagaga

SEQ ID NO: 9162621 - DNA, 22 bp, Homo sapiens
caggctgtggatcaggagcctt

SEQ ID NO: 9162622 - DNA, 22 bp, Homo sapiens
caggcttaggagtcagcctgct

SEQ ID NO: 9162623 - DNA, 22 bp, Homo sapiens
caggctgtgggagtcaggaccc

SEQ ID NO: 9162624 - DNA, 22 bp, Homo sapiens
agctggtgctcggggagctggc

SEQ ID NO: 9162625 - DNA, 22 bp, Homo sapiens
caggctggagttacctttaggg

SEQ ID NO: 9162626 - DNA, 22 bp, Homo sapiens
agctggtgctgaagctcttgag

SEQ ID NO: 9162627 - DNA, 22 bp, Homo sapiens
aggaaacaacttggcatgagcc

SEQ ID NO: 9162628 - DNA, 22 bp, Homo sapiens
aggaaacagaggtgccacaata

SEQ ID NO: 9162629 - DNA, 22 bp, Homo sapiens
aggaaacagaggtgccacaata

SEQ ID NO: 9162630 - DNA, 22 bp, Homo sapiens
aggaaacaacttggcatgagcc

SEQ ID NO: 9162631 - DNA, 22 bp, Homo sapiens
aggaaaatggaccagagttgtt

SEQ ID NO: 9162632 - DNA, 22 bp, Homo sapiens
aggaaaatcaatgtctttttaa

SEQ ID NO: 9162633 - DNA, 22 bp, Homo sapiens
aggaaaagtgtgaagtatggag

SEQ ID NO: 9162634 - DNA, 22 bp, Homo sapiens
aggaaaaataaggcagcagggc

SEQ ID NO: 9162635 - DNA, 22 bp, Homo sapiens
aggaaaaataaggcagcagggc

SEQ ID NO: 9162636 - DNA, 22 bp, Homo sapiens
aggaaaaataaggcagcagggc

SEQ ID NO: 9162637 - DNA, 20 bp, Homo sapiens
aggaaaaatggaaactggag

SEQ ID NO: 9162638 - DNA, 20 bp, Homo sapiens
aggaaaaatggaaactggag

SEQ ID NO: 9162639 - DNA, 20 bp, Homo sapiens
aggaaaagggtggtggtaga

SEQ ID NO: 9162640 - DNA, 22 bp, Homo sapiens
aggaaaacagaccaaggagctc

SEQ ID NO: 9162641 - DNA, 22 bp, Homo sapiens
aggaaaacacagtattgatgga

SEQ ID NO: 9162642 - DNA, 20 bp, Homo sapiens
aggaaaaatggaaactggag

SEQ ID NO: 9162643 - DNA, 22 bp, Homo sapiens
aggaaaacagaccaaggagctc

SEQ ID NO: 9162644 - DNA, 22 bp, Homo sapiens
agctttctagactctgtggtca

SEQ ID NO: 9162645 - DNA, 22 bp, Homo sapiens
agctttctagatttggaattgt

SEQ ID NO: 9162646 - DNA, 22 bp, Homo sapiens
agctttctagtttagccatctt

SEQ ID NO: 9162647 - DNA, 22 bp, Homo sapiens
agctttctatatatgagttgct

SEQ ID NO: 9162648 - DNA, 20 bp, Homo sapiens
agctttctccttggagctcc

SEQ ID NO: 9162649 - DNA, 22 bp, Homo sapiens
agctttctcttctttagaaagt

SEQ ID NO: 9162650 - DNA, 22 bp, Homo sapiens
cagggacagcgggactctgaca

SEQ ID NO: 9162651 - DNA, 22 bp, Homo sapiens
cagggacattggtggccaggtt

SEQ ID NO: 9162652 - DNA, 22 bp, Homo sapiens
cagggacattggtggccaggtt

SEQ ID NO: 9162653 - DNA, 22 bp, Homo sapiens
cagggacccgcacaggtagcat

SEQ ID NO: 9162654 - DNA, 22 bp, Homo sapiens
agctttgggccactggctggat

SEQ ID NO: 9162655 - DNA, 22 bp, Homo sapiens
agctttgggggaggtagtctgt

SEQ ID NO: 9162656 - DNA, 22 bp, Homo sapiens
agctttgggggtaggtatagag

SEQ ID NO: 9162657 - DNA, 22 bp, Homo sapiens
agctttggggacagccaaggtt

SEQ ID NO: 9162658 - DNA, 22 bp, Homo sapiens
agctttggggacagccaaggtt

SEQ ID NO: 9162659 - DNA, 22 bp, Homo sapiens
cagggactcccagggtagctcc

SEQ ID NO: 9162660 - DNA, 22 bp, Homo sapiens
aggaagagtgttacctatgggt

SEQ ID NO: 9162661 - DNA, 22 bp, Homo sapiens
aggaagagtgttacctatgggt

SEQ ID NO: 9162662 - DNA, 22 bp, Homo sapiens
aggaagcaaaaggcagggtcta

SEQ ID NO: 9162663 - DNA, 22 bp, Homo sapiens
aggaagcaaaaggcagggtcta

SEQ ID NO: 9162664 - DNA, 22 bp, Homo sapiens
aggaagagggtggcagataatc

SEQ ID NO: 9162665 - DNA, 22 bp, Homo sapiens
aggaagagggtggcagataatc

SEQ ID NO: 9162666 - DNA, 22 bp, Homo sapiens
aggaagagggtggcagataatc

SEQ ID NO: 9162667 - DNA, 22 bp, Homo sapiens
aggaagaggtagctgtcaaggg

SEQ ID NO: 9162668 - DNA, 22 bp, Homo sapiens
aggaagaggtagctgtcaaggg

SEQ ID NO: 9162669 - DNA, 22 bp, Homo sapiens
aggaagaggtagctgtcaaggg

SEQ ID NO: 9162670 - DNA, 22 bp, Homo sapiens
aggaagaggtagctgtcaaggg

SEQ ID NO: 9162671 - DNA, 22 bp, Homo sapiens
aggaagaggtagctgtcaaggg

SEQ ID NO: 9162672 - DNA, 22 bp, Homo sapiens
cagggtttcaccatgttagcag

SEQ ID NO: 9162673 - DNA, 22 bp, Homo sapiens
cagggtttcaccatgttagcag

SEQ ID NO: 9162674 - DNA, 22 bp, Homo sapiens
cagggttggtttctcctcaggc

SEQ ID NO: 9162675 - DNA, 22 bp, Homo sapiens
cagggtgtatagtgtagaagtt

SEQ ID NO: 9162676 - DNA, 22 bp, Homo sapiens
cagggtggtaccagcatctagt

SEQ ID NO: 9162677 - DNA, 22 bp, Homo sapiens
aggaaacattgatattgggaaa

SEQ ID NO: 9162678 - DNA, 22 bp, Homo sapiens
aggaaacatgaatctgccttga

SEQ ID NO: 9162679 - DNA, 22 bp, Homo sapiens
aggaaacatccttatctattct

SEQ ID NO: 9162680 - DNA, 22 bp, Homo sapiens
aggaaacatccttatctattct

SEQ ID NO: 9162681 - DNA, 22 bp, Homo sapiens
aggaaacatccttatctattct

SEQ ID NO: 9162682 - DNA, 22 bp, Homo sapiens
aggaaacatccttatctattct

SEQ ID NO: 9162683 - DNA, 22 bp, Homo sapiens
aggaaacagtgaacttggcagg

SEQ ID NO: 9162684 - DNA, 22 bp, Homo sapiens
aggaaacagtgaacttggcagg

SEQ ID NO: 9162685 - DNA, 22 bp, Homo sapiens
aggaaacagagtgaagcttggg

SEQ ID NO: 9162686 - DNA, 22 bp, Homo sapiens
aggaaacagagtgaagcttggg

SEQ ID NO: 9162687 - DNA, 22 bp, Homo sapiens
aggaaacaggcagcctttgaac

SEQ ID NO: 9162688 - DNA, 22 bp, Homo sapiens
aggaaacagttggtaatgcata

SEQ ID NO: 9162689 - DNA, 22 bp, Homo sapiens
aggaaacagttggtaatgcata

SEQ ID NO: 9162690 - DNA, 22 bp, Homo sapiens
aggaatgttaaagattaagagc

SEQ ID NO: 9162691 - DNA, 22 bp, Homo sapiens
caggtcctgcagggagagtaaa

SEQ ID NO: 9162692 - DNA, 22 bp, Homo sapiens
caggtcctgccttggttaccct

SEQ ID NO: 9162693 - DNA, 22 bp, Homo sapiens
caggtcctcgggggaggccggc

SEQ ID NO: 9162694 - DNA, 22 bp, Homo sapiens
caggtccctgcgccccggcctc

SEQ ID NO: 9162695 - DNA, 22 bp, Homo sapiens
caggtcccgttccccagagatt

SEQ ID NO: 9162696 - DNA, 22 bp, Homo sapiens
caggtcccgttccccagagatt

SEQ ID NO: 9162697 - DNA, 22 bp, Homo sapiens
caggtcctggcatcaggcaggt

SEQ ID NO: 9162698 - DNA, 22 bp, Homo sapiens
aggaatgaactcgagtgatctg

SEQ ID NO: 9162699 - DNA, 22 bp, Homo sapiens
aggaaggggagaagttaaagct

SEQ ID NO: 9162700 - DNA, 22 bp, Homo sapiens
aggaaggggagaagttaaagct

SEQ ID NO: 9162701 - DNA, 22 bp, Homo sapiens
aggaagggtggatagtaacgtg

SEQ ID NO: 9162702 - DNA, 22 bp, Homo sapiens
aggaagggttctttctgtttat

SEQ ID NO: 9162703 - DNA, 22 bp, Homo sapiens
aggaagggttctttctgtttat

SEQ ID NO: 9162704 - DNA, 22 bp, Homo sapiens
aggaagggttctttgtgaaaga

SEQ ID NO: 9162705 - DNA, 22 bp, Homo sapiens
aggaagggttctttgtgaaaga

SEQ ID NO: 9162706 - DNA, 22 bp, Homo sapiens
aggaagggtggatagtaacgtg

SEQ ID NO: 9162707 - DNA, 22 bp, Homo sapiens
aggaagggtgtcatgagccctt

SEQ ID NO: 9162708 - DNA, 22 bp, Homo sapiens
aggaagggtgtcatgagccctt

SEQ ID NO: 9162709 - DNA, 22 bp, Homo sapiens
caggtcccctcccctaccaggc

SEQ ID NO: 9162710 - DNA, 22 bp, Homo sapiens
aggaagggttctttgtgaaaga

SEQ ID NO: 9162711 - DNA, 22 bp, Homo sapiens
aggaagggttctttgtgaaaga

SEQ ID NO: 9162712 - DNA, 22 bp, Homo sapiens
aggaagggttctttgtgaaaga

SEQ ID NO: 9162713 - DNA, 22 bp, Homo sapiens
aggaagtcagctgccatgctgt

SEQ ID NO: 9162714 - DNA, 22 bp, Homo sapiens
ccaggtctcgggtctgctcgtg

SEQ ID NO: 9162715 - DNA, 22 bp, Homo sapiens
ccaggtctgcgggcggcaggca

SEQ ID NO: 9162716 - DNA, 22 bp, Homo sapiens
ccaggtctggaaccaccagggc

SEQ ID NO: 9162717 - DNA, 22 bp, Homo sapiens
aggctgaggcaggtggatcacc

SEQ ID NO: 9162718 - DNA, 22 bp, Homo sapiens
aggctgaggcaagaggatcact

SEQ ID NO: 9162719 - DNA, 22 bp, Homo sapiens
aggctgaggcaggtggatcacc

SEQ ID NO: 9162720 - DNA, 22 bp, Homo sapiens
ccagggctggtggctgcagagg

SEQ ID NO: 9162721 - DNA, 22 bp, Homo sapiens
ccagggctggtggctgcagagg

SEQ ID NO: 9162722 - DNA, 22 bp, Homo sapiens
ccagggctggtggctgcagagg

SEQ ID NO: 9162723 - DNA, 22 bp, Homo sapiens
ccagggctgggtttgtcggtgt

SEQ ID NO: 9162724 - DNA, 22 bp, Homo sapiens
ccagggctgggtttgtcggtgt

SEQ ID NO: 9162725 - DNA, 22 bp, Homo sapiens
ccagggctggtggctgcagagg

SEQ ID NO: 9162726 - DNA, 22 bp, Homo sapiens
aggctgagctgacctggtttgg

SEQ ID NO: 9162727 - DNA, 22 bp, Homo sapiens
aggctgagctgacctggtttgg

SEQ ID NO: 9162728 - DNA, 22 bp, Homo sapiens
ccagggctggtgggagatgctg

SEQ ID NO: 9162729 - DNA, 22 bp, Homo sapiens
aggctgaggatccctgtgttct

SEQ ID NO: 9162730 - DNA, 22 bp, Homo sapiens
aggctgaggatcgtactttcca

SEQ ID NO: 9162731 - DNA, 23 bp, Homo sapiens
ccagggctacgggcaccgtcctg

SEQ ID NO: 9162732 - DNA, 23 bp, Homo sapiens
ccagggctacgggcaccgtcctg

SEQ ID NO: 9162733 - DNA, 22 bp, Homo sapiens
ccagggcctgccacttagcaag

SEQ ID NO: 9162734 - DNA, 22 bp, Homo sapiens
ccagggcctgccacttagcaag

SEQ ID NO: 9162735 - DNA, 22 bp, Homo sapiens
ccagggcctgagggcgacgccc

SEQ ID NO: 9162736 - DNA, 22 bp, Homo sapiens
ccagggcctcgtgttctgagtg

SEQ ID NO: 9162737 - DNA, 22 bp, Homo sapiens
ccagggcctcgtgttctgagtg

SEQ ID NO: 9162738 - DNA, 22 bp, Homo sapiens
ccagggcagcgcccctccacgc

SEQ ID NO: 9162739 - DNA, 20 bp, Homo sapiens
ccagggctggctcctgggat

SEQ ID NO: 9162740 - DNA, 20 bp, Homo sapiens
ccagggctggctcctgggat

SEQ ID NO: 9162741 - DNA, 20 bp, Homo sapiens
ccagggctggctcctgggat

SEQ ID NO: 9162742 - DNA, 20 bp, Homo sapiens
ccagggctggctcctgggat

SEQ ID NO: 9162743 - DNA, 22 bp, Homo sapiens
ccagggctggaccagtgcttgg

SEQ ID NO: 9162744 - DNA, 22 bp, Homo sapiens
ccagggctggaccagtgcttgg

SEQ ID NO: 9162745 - DNA, 22 bp, Homo sapiens
ccagggctcaggctcccagtgg

SEQ ID NO: 9162746 - DNA, 22 bp, Homo sapiens
ccagggctcaggctcccagtgg

SEQ ID NO: 9162747 - DNA, 22 bp, Homo sapiens
ccagggctccattgctcatcct

SEQ ID NO: 9162748 - DNA, 19 bp, Homo sapiens
ccagggctccaagctgagt

SEQ ID NO: 9162749 - DNA, 22 bp, Homo sapiens
aggctaagtgattagtgacata

SEQ ID NO: 9162750 - DNA, 19 bp, Homo sapiens
aggctaaagagtcttgcgt

SEQ ID NO: 9162751 - DNA, 22 bp, Homo sapiens
aggctacaggagacgccaggag

SEQ ID NO: 9162752 - DNA, 22 bp, Homo sapiens
aggctacatgttggggtggaag

SEQ ID NO: 9162753 - DNA, 22 bp, Homo sapiens
aggctacactgttttgatgtct

SEQ ID NO: 9162754 - DNA, 22 bp, Homo sapiens
aggctacagatacagaggctac

SEQ ID NO: 9162755 - DNA, 22 bp, Homo sapiens
aggctacagatacagaggctac

SEQ ID NO: 9162756 - DNA, 22 bp, Homo sapiens
aggctacagcctcaagagtgca

SEQ ID NO: 9162757 - DNA, 22 bp, Homo sapiens
ccaggctgctgttggtgtccgc

SEQ ID NO: 9162758 - DNA, 22 bp, Homo sapiens
ccaggctgctgttggtgtccgc

SEQ ID NO: 9162759 - DNA, 22 bp, Homo sapiens
ccaggctctgcgctggacatgg

SEQ ID NO: 9162760 - DNA, 22 bp, Homo sapiens
ccaggctgctgttggtgtccgc

SEQ ID NO: 9162761 - DNA, 22 bp, Homo sapiens
ccaggctctgcgctggacatgg

SEQ ID NO: 9162762 - DNA, 21 bp, Homo sapiens
ccaggctgggagggcagttcc

SEQ ID NO: 9162763 - DNA, 22 bp, Homo sapiens
ccaggctgggcggggaacctgg

SEQ ID NO: 9162764 - DNA, 22 bp, Homo sapiens
ccaggctgggctacaagttgag

SEQ ID NO: 9162765 - DNA, 22 bp, Homo sapiens
ccaggctgggctacaagttgag

SEQ ID NO: 9162766 - DNA, 22 bp, Homo sapiens
ccaggctggagtgcaatggcat

SEQ ID NO: 9162767 - DNA, 22 bp, Homo sapiens
ccaggctgctttattactctgt

SEQ ID NO: 9162768 - DNA, 22 bp, Homo sapiens
aggctgggaaggtaaagttgta

SEQ ID NO: 9162769 - DNA, 22 bp, Homo sapiens
aggctggctggcaggggacaca

SEQ ID NO: 9162770 - DNA, 22 bp, Homo sapiens
ccatttgttttcgctaccatgg

SEQ ID NO: 9162771 - DNA, 22 bp, Homo sapiens
ccatttgttgtgtattaatatt

SEQ ID NO: 9162772 - DNA, 22 bp, Homo sapiens
ccatttgtggtttatttgctct

SEQ ID NO: 9162773 - DNA, 22 bp, Homo sapiens
ccatttgtggtttatttgctct

SEQ ID NO: 9162774 - DNA, 22 bp, Homo sapiens
aggctgggctccgcccaactcc

SEQ ID NO: 9162775 - DNA, 22 bp, Homo sapiens
aggctggggaattgaatttgct

SEQ ID NO: 9162776 - DNA, 22 bp, Homo sapiens
aggctgggctccgcccaactcc

SEQ ID NO: 9162777 - DNA, 22 bp, Homo sapiens
aggctgggcaccgttttgatcc

SEQ ID NO: 9162778 - DNA, 22 bp, Homo sapiens
aggctgggaaggtaaagttgta

SEQ ID NO: 9162779 - DNA, 20 bp, Homo sapiens
aggctggggtgttttgccca

SEQ ID NO: 9162780 - DNA, 22 bp, Homo sapiens
aggctggggaattgaatttgct

SEQ ID NO: 9162781 - DNA, 22 bp, Homo sapiens
aggctggccctactggctgcct

SEQ ID NO: 9162782 - DNA, 22 bp, Homo sapiens
aggctggcgacatctggcgggc

SEQ ID NO: 9162783 - DNA, 22 bp, Homo sapiens
ccatttagtaaggaagaacagc

SEQ ID NO: 9162784 - DNA, 22 bp, Homo sapiens
ccatttaacacagagttttcca

SEQ ID NO: 9162785 - DNA, 22 bp, Homo sapiens
ccatttatagatgtatttggct

SEQ ID NO: 9162786 - DNA, 22 bp, Homo sapiens
aggctggcggtgactgctctga

SEQ ID NO: 9162787 - DNA, 22 bp, Homo sapiens
aggctggagagtgcagtggcgt

SEQ ID NO: 9162788 - DNA, 22 bp, Homo sapiens
aggctggagagtgcagtggcgt

SEQ ID NO: 9162789 - DNA, 22 bp, Homo sapiens
aggctggccagtgctgcagtgg

SEQ ID NO: 9162790 - DNA, 22 bp, Homo sapiens
aggctggccagtgctgcagtgg

SEQ ID NO: 9162791 - DNA, 22 bp, Homo sapiens
aggctggcccacctcttgtctt

SEQ ID NO: 9162792 - DNA, 22 bp, Homo sapiens
aggctgcttcttgtccttggca

SEQ ID NO: 9162793 - DNA, 22 bp, Homo sapiens
aggctgctttattcacaatagc

SEQ ID NO: 9162794 - DNA, 22 bp, Homo sapiens
aggctgctctgcgaagtcagct

SEQ ID NO: 9162795 - DNA, 22 bp, Homo sapiens
aggctgcttcagctgcagggag

SEQ ID NO: 9162796 - DNA, 22 bp, Homo sapiens
aggctgctcagtagatggagct

SEQ ID NO: 9162797 - DNA, 22 bp, Homo sapiens
ccaggtcttgtttgacatcaat

SEQ ID NO: 9162798 - DNA, 21 bp, Homo sapiens
ccaggtcttggtccttggact

SEQ ID NO: 9162799 - DNA, 22 bp, Homo sapiens
ccaggtctttgactaatatgct

SEQ ID NO: 9162800 - DNA, 21 bp, Homo sapiens
ccaggtcttggtccttggact

SEQ ID NO: 9162801 - DNA, 22 bp, Homo sapiens
ccaggtcttggcccccggacct

SEQ ID NO: 9162802 - DNA, 22 bp, Homo sapiens
ccaggtctttggccttggcact

SEQ ID NO: 9162803 - DNA, 22 bp, Homo sapiens
ccaggtctggcactggccagtc

SEQ ID NO: 9162804 - DNA, 22 bp, Homo sapiens
ccaggtctggaaccaccagggc

SEQ ID NO: 9162805 - DNA, 19 bp, Homo sapiens
ccaggtctggggccagatt

SEQ ID NO: 9162806 - DNA, 22 bp, Homo sapiens
ccaggtctggcactggccagtc

SEQ ID NO: 9162807 - DNA, 22 bp, Homo sapiens
ccaggtctgtcttcttagctca

SEQ ID NO: 9162808 - DNA, 22 bp, Homo sapiens
ccaggtcttcactttactgaag

SEQ ID NO: 9162809 - DNA, 22 bp, Homo sapiens
ccagcaggagagaacatttccc

SEQ ID NO: 9162810 - DNA, 22 bp, Homo sapiens
ccagcaggagagaacatttccc

SEQ ID NO: 9162811 - DNA, 22 bp, Homo sapiens
ccagcaggagactagcaacata

SEQ ID NO: 9162812 - DNA, 22 bp, Homo sapiens
ccagcaggagactagcaacata

SEQ ID NO: 9162813 - DNA, 22 bp, Homo sapiens
ccagcaggagactagcaacata

SEQ ID NO: 9162814 - DNA, 22 bp, Homo sapiens
ccagcaggagactagcaacata

SEQ ID NO: 9162815 - DNA, 22 bp, Homo sapiens
ccagcaggcagtcatatccttt

SEQ ID NO: 9162816 - DNA, 22 bp, Homo sapiens
ccagctccggtgtgcttatttc

SEQ ID NO: 9162817 - DNA, 22 bp, Homo sapiens
ccagctccggtgtgcttatttc

SEQ ID NO: 9162818 - DNA, 22 bp, Homo sapiens
ccagcaggagatgcctgtgtct

SEQ ID NO: 9162819 - DNA, 22 bp, Homo sapiens
ccagctctgcttgcccagtcag

SEQ ID NO: 9162820 - DNA, 22 bp, Homo sapiens
ccagctctggcttcttgctggg

SEQ ID NO: 9162821 - DNA, 22 bp, Homo sapiens
ccagctcttttggctgagtgag

SEQ ID NO: 9162822 - DNA, 22 bp, Homo sapiens
ccagctcttggtgcacttacat

SEQ ID NO: 9162823 - DNA, 22 bp, Homo sapiens
ccagctctgtaagctgtgaaat

SEQ ID NO: 9162824 - DNA, 22 bp, Homo sapiens
ccagctggcccagctgtgctcc

SEQ ID NO: 9162825 - DNA, 22 bp, Homo sapiens
ccagctggcccagctgtgctcc

SEQ ID NO: 9162826 - DNA, 22 bp, Homo sapiens
aggcctctggaggtggcagtgt

SEQ ID NO: 9162827 - DNA, 22 bp, Homo sapiens
aggcctctgggcctgcgggttt

SEQ ID NO: 9162828 - DNA, 22 bp, Homo sapiens
aggcctgcctggatcacacaga

SEQ ID NO: 9162829 - DNA, 22 bp, Homo sapiens
aggcctgccttgagcaaccagc

SEQ ID NO: 9162830 - DNA, 22 bp, Homo sapiens
aggcctgccttgagcaaccagc

SEQ ID NO: 9162831 - DNA, 22 bp, Homo sapiens
ccagctggcaggagagtcaggg

SEQ ID NO: 9162832 - DNA, 22 bp, Homo sapiens
ccagctggcaggagagtcaggg

SEQ ID NO: 9162833 - DNA, 22 bp, Homo sapiens
ccagctggcactgtggctgccc

SEQ ID NO: 9162834 - DNA, 22 bp, Homo sapiens
ccagctggcactgtggctgccc

SEQ ID NO: 9162835 - DNA, 22 bp, Homo sapiens
ccagctggagccaaggtggact

SEQ ID NO: 9162836 - DNA, 22 bp, Homo sapiens
ccagctggagctcgcagatagg

SEQ ID NO: 9162837 - DNA, 22 bp, Homo sapiens
ccagctggagccaaggtggact

SEQ ID NO: 9162838 - DNA, 22 bp, Homo sapiens
ccagctggaagagtgcagaact

SEQ ID NO: 9162839 - DNA, 22 bp, Homo sapiens
ccagctgagaagtgtaaagtga

SEQ ID NO: 9162840 - DNA, 22 bp, Homo sapiens
ccagctggaaacaaatagagtg

SEQ ID NO: 9162841 - DNA, 22 bp, Homo sapiens
ccagctggaacggcagcccagc

SEQ ID NO: 9162842 - DNA, 22 bp, Homo sapiens
ccagctgacgatgcctggtctc

SEQ ID NO: 9162843 - DNA, 22 bp, Homo sapiens
aggcctggctttggtttgctga

SEQ ID NO: 9162844 - DNA, 22 bp, Homo sapiens
aggcctggcctgggcggcattg

SEQ ID NO: 9162845 - DNA, 22 bp, Homo sapiens
aggcctgctgtgtagcctgttg

SEQ ID NO: 9162846 - DNA, 22 bp, Homo sapiens
aggcctgctgtcttgaggccaa

SEQ ID NO: 9162847 - DNA, 22 bp, Homo sapiens
aggcctgcttacaatgttatcc

SEQ ID NO: 9162848 - DNA, 22 bp, Homo sapiens
aggcctggccccagttgctagg

SEQ ID NO: 9162849 - DNA, 22 bp, Homo sapiens
aggcctggcatgagacctgaga

SEQ ID NO: 9162850 - DNA, 22 bp, Homo sapiens
ccaggaaggcaggcctccccgc

SEQ ID NO: 9162851 - DNA, 22 bp, Homo sapiens
ccaggaaggatcgtttgggagt

SEQ ID NO: 9162852 - DNA, 22 bp, Homo sapiens
ccaggaaggcaggcctccccgc

SEQ ID NO: 9162853 - DNA, 22 bp, Homo sapiens
ccaggaaggcaggcctccccgc

SEQ ID NO: 9162854 - DNA, 22 bp, Homo sapiens
ccaggaaggcctggatgccccc

SEQ ID NO: 9162855 - DNA, 22 bp, Homo sapiens
ccaggaaggcctggatgccccc

SEQ ID NO: 9162856 - DNA, 22 bp, Homo sapiens
ccaggaaggcgttgttcctctc

SEQ ID NO: 9162857 - DNA, 22 bp, Homo sapiens
aggcgctgcgctggggccagaa

SEQ ID NO: 9162858 - DNA, 22 bp, Homo sapiens
aggcgctgtgcttggggctgga

SEQ ID NO: 9162859 - DNA, 22 bp, Homo sapiens
aggcgtgggaggatctgaggcc

SEQ ID NO: 9162860 - DNA, 22 bp, Homo sapiens
aggcggtgtgctttgcagagca

SEQ ID NO: 9162861 - DNA, 22 bp, Homo sapiens
aggcggtggccaaggagcggga

SEQ ID NO: 9162862 - DNA, 22 bp, Homo sapiens
aggcgctgtgcttggggctgga

SEQ ID NO: 9162863 - DNA, 22 bp, Homo sapiens
aggcggcttctgaggaggctgc

SEQ ID NO: 9162864 - DNA, 22 bp, Homo sapiens
aggcggcttctgaggaggctgc

SEQ ID NO: 9162865 - DNA, 22 bp, Homo sapiens
aggcctgtcccagctgaggacg

SEQ ID NO: 9162866 - DNA, 22 bp, Homo sapiens
aggcctgtctggggctcagcca

SEQ ID NO: 9162867 - DNA, 22 bp, Homo sapiens
ccaggacaagccagagggacag

SEQ ID NO: 9162868 - DNA, 22 bp, Homo sapiens
ccaggacaagccagagggacag

SEQ ID NO: 9162869 - DNA, 22 bp, Homo sapiens
ccaggaagtatgacccaacaga

SEQ ID NO: 9162870 - DNA, 22 bp, Homo sapiens
ccaggaaggtgtttaactagag

SEQ ID NO: 9162871 - DNA, 22 bp, Homo sapiens
ccaggaaggtgtttaactagag

SEQ ID NO: 9162872 - DNA, 22 bp, Homo sapiens
ccaggaaggtatgggaagaaaa

SEQ ID NO: 9162873 - DNA, 22 bp, Homo sapiens
ccaggaaggtatgggaagaaaa

SEQ ID NO: 9162874 - DNA, 22 bp, Homo sapiens
ccactgggggctgcaggcactc

SEQ ID NO: 9162875 - DNA, 22 bp, Homo sapiens
aggcaggctgctatggagtaga

SEQ ID NO: 9162876 - DNA, 22 bp, Homo sapiens
aggcaggctgctatggagtaga

SEQ ID NO: 9162877 - DNA, 18 bp, Homo sapiens
aggcaggctggagtgact

SEQ ID NO: 9162878 - DNA, 22 bp, Homo sapiens
ccagaaaatgcagaacatagaa

SEQ ID NO: 9162879 - DNA, 22 bp, Homo sapiens
ccagaaacacctggattctgtt

SEQ ID NO: 9162880 - DNA, 22 bp, Homo sapiens
ccagaaatcctctctttcttgc

SEQ ID NO: 9162881 - DNA, 22 bp, Homo sapiens
ccagaaatgagtagaggatgct

SEQ ID NO: 9162882 - DNA, 22 bp, Homo sapiens
ccagaaaggtaaacactggatt

SEQ ID NO: 9162883 - DNA, 22 bp, Homo sapiens
ccagaacacagtggaagaatat

SEQ ID NO: 9162884 - DNA, 22 bp, Homo sapiens
ccagaacacagtggaagaatat

SEQ ID NO: 9162885 - DNA, 22 bp, Homo sapiens
ccagaaatggccctcaggtgac

SEQ ID NO: 9162886 - DNA, 22 bp, Homo sapiens
ccagaaatggccctcaggtgac

SEQ ID NO: 9162887 - DNA, 22 bp, Homo sapiens
ccagaaatggccctagtcagag

SEQ ID NO: 9162888 - DNA, 22 bp, Homo sapiens
ccagaagaacttaattcaaaac

SEQ ID NO: 9162889 - DNA, 22 bp, Homo sapiens
ccagaagacaagaatgttctta

SEQ ID NO: 9162890 - DNA, 22 bp, Homo sapiens
ccagaagaccccgtccacctcc

SEQ ID NO: 9162891 - DNA, 22 bp, Homo sapiens
aggccacagtcagtgggtgctg

SEQ ID NO: 9162892 - DNA, 22 bp, Homo sapiens
aggccacagtactttgcagacc

SEQ ID NO: 9162893 - DNA, 22 bp, Homo sapiens
aggccacaagaactaccccatc

SEQ ID NO: 9162894 - DNA, 22 bp, Homo sapiens
aggccacagtactttgcagacc

SEQ ID NO: 9162895 - DNA, 22 bp, Homo sapiens
ccagagaaaaatgtgtccctgt

SEQ ID NO: 9162896 - DNA, 22 bp, Homo sapiens
ccagacagttccttgaggttca

SEQ ID NO: 9162897 - DNA, 22 bp, Homo sapiens
ccagaccctttcttggcatgtg

SEQ ID NO: 9162898 - DNA, 22 bp, Homo sapiens
ccagaccctttcttggcatgtg

SEQ ID NO: 9162899 - DNA, 22 bp, Homo sapiens
ccagacctgcaaggctgagagg

SEQ ID NO: 9162900 - DNA, 19 bp, Homo sapiens
ccagcagctttgattctct

SEQ ID NO: 9162901 - DNA, 22 bp, Homo sapiens
ccagcaggaaagtgacgtttga

SEQ ID NO: 9162902 - DNA, 22 bp, Homo sapiens
ccagcaggactttggaaatatg

SEQ ID NO: 9162903 - DNA, 22 bp, Homo sapiens
aggccatgaggtcatgggagat

SEQ ID NO: 9162904 - DNA, 22 bp, Homo sapiens
aggccaggtggtcatgcttgct

SEQ ID NO: 9162905 - DNA, 22 bp, Homo sapiens
aggccaggatagcatggatcag

SEQ ID NO: 9162906 - DNA, 22 bp, Homo sapiens
aggccagtggttctctgtgtcc

SEQ ID NO: 9162907 - DNA, 17 bp, Homo sapiens
ccagagctactgagact

SEQ ID NO: 9162908 - DNA, 22 bp, Homo sapiens
ccagagctaaacacacaggctg

SEQ ID NO: 9162909 - DNA, 22 bp, Homo sapiens
ccagagctaaacacacaggctg

SEQ ID NO: 9162910 - DNA, 17 bp, Homo sapiens
ccagagctactgagact

SEQ ID NO: 9162911 - DNA, 17 bp, Homo sapiens
ccagagctactgagact

SEQ ID NO: 9162912 - DNA, 22 bp, Homo sapiens
ccagagctgagggagcctgagc

SEQ ID NO: 9162913 - DNA, 22 bp, Homo sapiens
ccagagctgagggagcctgagc

SEQ ID NO: 9162914 - DNA, 20 bp, Homo sapiens
ccagagctgatggctgcccg

SEQ ID NO: 9162915 - DNA, 22 bp, Homo sapiens
ccagagctgagggagcctgagc

SEQ ID NO: 9162916 - DNA, 22 bp, Homo sapiens
ccagagctgaggagatgggctt

SEQ ID NO: 9162917 - DNA, 23 bp, Homo sapiens
ccagagctctttcatgcttccat

SEQ ID NO: 9162918 - DNA, 22 bp, Homo sapiens
ccagagctccagggctacagaa

SEQ ID NO: 9162919 - DNA, 22 bp, Homo sapiens
ccagagctccagggctacagaa

SEQ ID NO: 9162920 - DNA, 22 bp, Homo sapiens
ccagagctccagggctacagaa

SEQ ID NO: 9162921 - DNA, 22 bp, Homo sapiens
ccagagcctggcatctgcataa

SEQ ID NO: 9162922 - DNA, 21 bp, Homo sapiens
ccagagcctgctgagccccct

SEQ ID NO: 9162923 - DNA, 22 bp, Homo sapiens
aggccaccaccctatctcctgg

SEQ ID NO: 9162924 - DNA, 22 bp, Homo sapiens
aggccacattgtgattcccgca

SEQ ID NO: 9162925 - DNA, 22 bp, Homo sapiens
aggccaccaccctatctcctgg

SEQ ID NO: 9162926 - DNA, 22 bp, Homo sapiens
aggccacattgtgattcccgca

SEQ ID NO: 9162927 - DNA, 22 bp, Homo sapiens
aggccacatagcttgcatgtag

SEQ ID NO: 9162928 - DNA, 22 bp, Homo sapiens
aggccacagttgaggccagcaa

SEQ ID NO: 9162929 - DNA, 22 bp, Homo sapiens
aggccacatagcttgcatgtag

SEQ ID NO: 9162930 - DNA, 21 bp, Homo sapiens
ccccagcaccttgccagcctg

SEQ ID NO: 9162931 - DNA, 22 bp, Homo sapiens
ccccagcactaccagaagccag

SEQ ID NO: 9162932 - DNA, 22 bp, Homo sapiens
ccccagcactaccagaagccag

SEQ ID NO: 9162933 - DNA, 22 bp, Homo sapiens
ccccagcacaggctcctcagat

SEQ ID NO: 9162934 - DNA, 22 bp, Homo sapiens
ccccagcacaggctcctcagat

SEQ ID NO: 9162935 - DNA, 22 bp, Homo sapiens
ccccagcacaggctcctcagat

SEQ ID NO: 9162936 - DNA, 22 bp, Homo sapiens
ccccagcactctgactcttacc

SEQ ID NO: 9162937 - DNA, 22 bp, Homo sapiens
ccctcacttcacgctctgcaga

SEQ ID NO: 9162938 - DNA, 22 bp, Homo sapiens
ccctcactgtccttgggccctt

SEQ ID NO: 9162939 - DNA, 22 bp, Homo sapiens
ccctcaccaggctccaggcatg

SEQ ID NO: 9162940 - DNA, 22 bp, Homo sapiens
ccctcaccaggctccaggcatg

SEQ ID NO: 9162941 - DNA, 22 bp, Homo sapiens
ccctagtccacaggttcctgga

SEQ ID NO: 9162942 - DNA, 22 bp, Homo sapiens
ccctagggtttggccagagccc

SEQ ID NO: 9162943 - DNA, 19 bp, Homo sapiens
ccctaggggctcctgaggg

SEQ ID NO: 9162944 - DNA, 22 bp, Homo sapiens
ccctaggggcaatgatggtgct

SEQ ID NO: 9162945 - DNA, 22 bp, Homo sapiens
ccctagggctaagcaggactgc

SEQ ID NO: 9162946 - DNA, 22 bp, Homo sapiens
ccctaggggcaatgatggtgct

SEQ ID NO: 9162947 - DNA, 22 bp, Homo sapiens
ccccagaagtttgcacaagaga

SEQ ID NO: 9162948 - DNA, 22 bp, Homo sapiens
ccccagagaaagtcagcagcat

SEQ ID NO: 9162949 - DNA, 22 bp, Homo sapiens
ccccagagagcaccatgaagcc

SEQ ID NO: 9162950 - DNA, 22 bp, Homo sapiens
ccccagagtgagggattgagtg

SEQ ID NO: 9162951 - DNA, 22 bp, Homo sapiens
ccccagagagcaccatgaagcc

SEQ ID NO: 9162952 - DNA, 22 bp, Homo sapiens
ccccagagtgagggattgagtg

SEQ ID NO: 9162953 - DNA, 22 bp, Homo sapiens
ccccagaaggggacagagggta

SEQ ID NO: 9162954 - DNA, 22 bp, Homo sapiens
ccccagaaggggacagagggta

SEQ ID NO: 9162955 - DNA, 22 bp, Homo sapiens
ccccagaaagcctggcactagg

SEQ ID NO: 9162956 - DNA, 22 bp, Homo sapiens
ccccactctcggccagataggc

SEQ ID NO: 9162957 - DNA, 22 bp, Homo sapiens
cccatgctgagtggcctgagat

SEQ ID NO: 9162958 - DNA, 22 bp, Homo sapiens
cccatgctgagtggcctgagat

SEQ ID NO: 9162959 - DNA, 22 bp, Homo sapiens
cccatggagtgcctgagggcca

SEQ ID NO: 9162960 - DNA, 22 bp, Homo sapiens
cccatggcttaggagggagtgt

SEQ ID NO: 9162961 - DNA, 20 bp, Homo sapiens
ccctcccagatgcttcccaa

SEQ ID NO: 9162962 - DNA, 22 bp, Homo sapiens
ccctccatgagtgtgctgctgg

SEQ ID NO: 9162963 - DNA, 22 bp, Homo sapiens
ccctcagctccaccctcagcag

SEQ ID NO: 9162964 - DNA, 22 bp, Homo sapiens
ccctcagctcaagcccctgtgc

SEQ ID NO: 9162965 - DNA, 22 bp, Homo sapiens
ccctcagctccaccctcagcag

SEQ ID NO: 9162966 - DNA, 22 bp, Homo sapiens
ccctgccaatcccgtctctctg

SEQ ID NO: 9162967 - DNA, 23 bp, Homo sapiens
ccctgcatctgtccctcaccagt

SEQ ID NO: 9162968 - DNA, 22 bp, Homo sapiens
ccctgcagtgtgacctcaccta

SEQ ID NO: 9162969 - DNA, 22 bp, Homo sapiens
ccctgccagatgtgcttcagtt

SEQ ID NO: 9162970 - DNA, 23 bp, Homo sapiens
ccctgcccattgagcaggacgtc

SEQ ID NO: 9162971 - DNA, 23 bp, Homo sapiens
ccctgcccattgagcaggacgtc

SEQ ID NO: 9162972 - DNA, 22 bp, Homo sapiens
ccctgccccaggcggcttcact

SEQ ID NO: 9162973 - DNA, 22 bp, Homo sapiens
ccctgccccaggcggcttcact

SEQ ID NO: 9162974 - DNA, 22 bp, Homo sapiens
ccctgccccaggcggcttcact

SEQ ID NO: 9162975 - DNA, 21 bp, Homo sapiens
ccctgccctcaaggacagtgc

SEQ ID NO: 9162976 - DNA, 21 bp, Homo sapiens
ccctgccctcaaggacagtgc

SEQ ID NO: 9162977 - DNA, 22 bp, Homo sapiens
ccctgccctggagacacttaaa

SEQ ID NO: 9162978 - DNA, 22 bp, Homo sapiens
ccctgcccatcggggcggcctg

SEQ ID NO: 9162979 - DNA, 22 bp, Homo sapiens
ccctgcccatcggggcggcctg

SEQ ID NO: 9162980 - DNA, 22 bp, Homo sapiens
ccctgcccaccacatgctggga

SEQ ID NO: 9162981 - DNA, 22 bp, Homo sapiens
ccctgcccaccacatgctggga

SEQ ID NO: 9162982 - DNA, 22 bp, Homo sapiens
ccctgccagggtcctgacagac

SEQ ID NO: 9162983 - DNA, 18 bp, Homo sapiens
ccctgccagctcccagca

SEQ ID NO: 9162984 - DNA, 18 bp, Homo sapiens
ccctgccagctcccagca

SEQ ID NO: 9162985 - DNA, 22 bp, Homo sapiens
ccctgccagggtcctgacagac

SEQ ID NO: 9162986 - DNA, 22 bp, Homo sapiens
ccctgcccaccacatgctggga

SEQ ID NO: 9162987 - DNA, 22 bp, Homo sapiens
ccctgctgtgtagcggaggaac

SEQ ID NO: 9162988 - DNA, 22 bp, Homo sapiens
ccctgctgtgcctgactgccat

SEQ ID NO: 9162989 - DNA, 22 bp, Homo sapiens
ccctgctgtgcctgactgccat

SEQ ID NO: 9162990 - DNA, 22 bp, Homo sapiens
ccctgctgtgtcccacctggaa

SEQ ID NO: 9162991 - DNA, 22 bp, Homo sapiens
ccctgctgtgtcccacctggaa

SEQ ID NO: 9162992 - DNA, 22 bp, Homo sapiens
ccctgctgtcaggtgctgggag

SEQ ID NO: 9162993 - DNA, 22 bp, Homo sapiens
ccctgctgtccctcagtcctgc

SEQ ID NO: 9162994 - DNA, 22 bp, Homo sapiens
ccctgctgtccctcagtcctgc

SEQ ID NO: 9162995 - DNA, 22 bp, Homo sapiens
ccctgctgtccctcagtcctgc

SEQ ID NO: 9162996 - DNA, 22 bp, Homo sapiens
ccctgctgtgcctgactgccat

SEQ ID NO: 9162997 - DNA, 22 bp, Homo sapiens
ccctgccctggagacacttaaa

SEQ ID NO: 9162998 - DNA, 22 bp, Homo sapiens
ccctgctgcaggcttcaggagg

SEQ ID NO: 9162999 - DNA, 22 bp, Homo sapiens
ccctgctgcaggcttcaggagg

SEQ ID NO: 9163000 - DNA, 22 bp, Homo sapiens
ccctgccctgggcagaagtggg

SEQ ID NO: 9163001 - DNA, 22 bp, Homo sapiens
ccctgctgtcaggtgctgggag

SEQ ID NO: 9163002 - DNA, 22 bp, Homo sapiens
ccctgctgtcaggtgctgggag

SEQ ID NO: 9163003 - DNA, 22 bp, Homo sapiens
ccctgctgccttcacccaggac

SEQ ID NO: 9163004 - DNA, 22 bp, Homo sapiens
ccctgctgccttcacccaggac

SEQ ID NO: 9163005 - DNA, 22 bp, Homo sapiens
ccctgctgcatggcctccacga

SEQ ID NO: 9163006 - DNA, 22 bp, Homo sapiens
ccctgctgcatggcctccacga

SEQ ID NO: 9163007 - DNA, 22 bp, Homo sapiens
ccctgctgcatggcctccacga

SEQ ID NO: 9163008 - DNA, 22 bp, Homo sapiens
cccaggaggtcgaagctgcagt

SEQ ID NO: 9163009 - DNA, 22 bp, Homo sapiens
cccaggaggtcgaagctgcagt

SEQ ID NO: 9163010 - DNA, 22 bp, Homo sapiens
cccaggaggtcgaagctgcagt

SEQ ID NO: 9163011 - DNA, 23 bp, Homo sapiens
cccaggctacaaattatgctctg

SEQ ID NO: 9163012 - DNA, 23 bp, Homo sapiens
cccaggctacaaattatgctctg

SEQ ID NO: 9163013 - DNA, 22 bp, Homo sapiens
cccaggaggtcaaggctgcagt

SEQ ID NO: 9163014 - DNA, 22 bp, Homo sapiens
cccaggaggtcaaggctgcagt

SEQ ID NO: 9163015 - DNA, 22 bp, Homo sapiens
cccaggaggtcgaagctgcagt

SEQ ID NO: 9163016 - DNA, 22 bp, Homo sapiens
cccaggctgatgttcagcgggt

SEQ ID NO: 9163017 - DNA, 22 bp, Homo sapiens
cccaggctgatgttcagcgggt

SEQ ID NO: 9163018 - DNA, 22 bp, Homo sapiens
cccaggctgatgttcagcgggt

SEQ ID NO: 9163019 - DNA, 22 bp, Homo sapiens
cccaggctgatgggatgggcca

SEQ ID NO: 9163020 - DNA, 22 bp, Homo sapiens
cccaggctgatgggatgggcca

SEQ ID NO: 9163021 - DNA, 22 bp, Homo sapiens
cccaggctgcatgagtccatgg

SEQ ID NO: 9163022 - DNA, 22 bp, Homo sapiens
cccaggctgcatgagtccatgg

SEQ ID NO: 9163023 - DNA, 22 bp, Homo sapiens
cccaggctgcatgagtccatgg

SEQ ID NO: 9163024 - DNA, 22 bp, Homo sapiens
cccaggctgccacgattactgc

SEQ ID NO: 9163025 - DNA, 22 bp, Homo sapiens
cccaggctgcgtatccacaata

SEQ ID NO: 9163026 - DNA, 22 bp, Homo sapiens
cccaggctgccacgattactgc

SEQ ID NO: 9163027 - DNA, 22 bp, Homo sapiens
cccaggctgcgtatccacaata

SEQ ID NO: 9163028 - DNA, 22 bp, Homo sapiens
cccagtttcaactttccagtgg

SEQ ID NO: 9163029 - DNA, 22 bp, Homo sapiens
cccagtcatcctgcaggtgaaa

SEQ ID NO: 9163030 - DNA, 22 bp, Homo sapiens
cccagttttctgattgaagagc

SEQ ID NO: 9163031 - DNA, 22 bp, Homo sapiens
cccatcacagacactgggttat

SEQ ID NO: 9163032 - DNA, 22 bp, Homo sapiens
cccatcacagacactgggttat

SEQ ID NO: 9163033 - DNA, 22 bp, Homo sapiens
cccatcaggaacccaggagccc

SEQ ID NO: 9163034 - DNA, 22 bp, Homo sapiens
cccatccctgattttcactcgt

SEQ ID NO: 9163035 - DNA, 22 bp, Homo sapiens
cccatcggcaaggtaggtgatt

SEQ ID NO: 9163036 - DNA, 22 bp, Homo sapiens
cccatgaactgtcttgctgtag

SEQ ID NO: 9163037 - DNA, 22 bp, Homo sapiens
cccaggcttttctcttgcccca

SEQ ID NO: 9163038 - DNA, 22 bp, Homo sapiens
cccaggcttttaagttagacag

SEQ ID NO: 9163039 - DNA, 22 bp, Homo sapiens
cccaggcttttaagttagacag

SEQ ID NO: 9163040 - DNA, 22 bp, Homo sapiens
cccaggcttttctcttgcccca

SEQ ID NO: 9163041 - DNA, 22 bp, Homo sapiens
cccaggcttttctcttgcccca

SEQ ID NO: 9163042 - DNA, 22 bp, Homo sapiens
cccaggctgtgcaaacttcaaa

SEQ ID NO: 9163043 - DNA, 22 bp, Homo sapiens
cccaggcttcccaatcagaagg

SEQ ID NO: 9163044 - DNA, 18 bp, Homo sapiens
cccaggctttgtgggtct

SEQ ID NO: 9163045 - DNA, 18 bp, Homo sapiens
cccaggctttgtgggtct

SEQ ID NO: 9163046 - DNA, 18 bp, Homo sapiens
cccaggctttgtgggtct

SEQ ID NO: 9163047 - DNA, 22 bp, Homo sapiens
cccaggctggaattccaggcct

SEQ ID NO: 9163048 - DNA, 22 bp, Homo sapiens
cccaggctggaattccaggcct

SEQ ID NO: 9163049 - DNA, 22 bp, Homo sapiens
cccaggctgtctgtcctttgct

SEQ ID NO: 9163050 - DNA, 22 bp, Homo sapiens
cccaggctggtcctgaactcct

SEQ ID NO: 9163051 - DNA, 22 bp, Homo sapiens
cccaggctgtgcaaacttcaaa

SEQ ID NO: 9163052 - DNA, 22 bp, Homo sapiens
aggctgtcttcctccctcttgg

SEQ ID NO: 9163053 - DNA, 22 bp, Homo sapiens
aggctgtgacagggtcatggag

SEQ ID NO: 9163054 - DNA, 22 bp, Homo sapiens
cccaggaatgagcaggcagggg

SEQ ID NO: 9163055 - DNA, 22 bp, Homo sapiens
cccaggaatgagcaggcagggg

SEQ ID NO: 9163056 - DNA, 22 bp, Homo sapiens
cccaggaatgagcaggcagggg

SEQ ID NO: 9163057 - DNA, 22 bp, Homo sapiens
cccaggaatgaggggcggaggc

SEQ ID NO: 9163058 - DNA, 22 bp, Homo sapiens
cccaggaatgaggggcggaggc

SEQ ID NO: 9163059 - DNA, 22 bp, Homo sapiens
aggctgtctcagcctgcttgca

SEQ ID NO: 9163060 - DNA, 21 bp, Homo sapiens
aggctgtcctttgccagccct

SEQ ID NO: 9163061 - DNA, 22 bp, Homo sapiens
aggctgtcctctcttgctcagt

SEQ ID NO: 9163062 - DNA, 22 bp, Homo sapiens
aggctgtcctctcttgctcagt

SEQ ID NO: 9163063 - DNA, 22 bp, Homo sapiens
aggctggtgcctgcagtgaatc

SEQ ID NO: 9163064 - DNA, 22 bp, Homo sapiens
aggctgtagatctagacatgta

SEQ ID NO: 9163065 - DNA, 22 bp, Homo sapiens
aggctggtagtatttagtcaca

SEQ ID NO: 9163066 - DNA, 22 bp, Homo sapiens
aggctgggtacctgtcatatgc

SEQ ID NO: 9163067 - DNA, 22 bp, Homo sapiens
aggctgggtacctgtcatatgc

SEQ ID NO: 9163068 - DNA, 23 bp, Homo sapiens
cccaggagcctgagtcctctctg

SEQ ID NO: 9163069 - DNA, 22 bp, Homo sapiens
cccaggagccatctgtcttggc

SEQ ID NO: 9163070 - DNA, 22 bp, Homo sapiens
cccaggagatggaggttgcagt

SEQ ID NO: 9163071 - DNA, 22 bp, Homo sapiens
cccaggagatgcactccattgg

SEQ ID NO: 9163072 - DNA, 22 bp, Homo sapiens
cccaggaatgggaaggaggaat

SEQ ID NO: 9163073 - DNA, 22 bp, Homo sapiens
cccaggaatgggaaggaggaat

SEQ ID NO: 9163074 - DNA, 22 bp, Homo sapiens
cccaggagcttctctctgcctc

SEQ ID NO: 9163075 - DNA, 22 bp, Homo sapiens
cccaggaggtagaggttgcagt

SEQ ID NO: 9163076 - DNA, 23 bp, Homo sapiens
cccaggagcctgagtcctctctg

SEQ ID NO: 9163077 - DNA, 22 bp, Homo sapiens
cccaggagcttctctctgcctc

SEQ ID NO: 9163078 - DNA, 20 bp, Homo sapiens
cccaggagctgtgccccatc

SEQ ID NO: 9163079 - DNA, 22 bp, Homo sapiens
aggggatggagctggaaggcag

SEQ ID NO: 9163080 - DNA, 22 bp, Homo sapiens
aggggatggagctggaaggcag

SEQ ID NO: 9163081 - DNA, 22 bp, Homo sapiens
aggggatgcctagtggagtctc

SEQ ID NO: 9163082 - DNA, 22 bp, Homo sapiens
aggggatgcctgaggatctgta

SEQ ID NO: 9163083 - DNA, 22 bp, Homo sapiens
aggggatgcctgaggatctgta

SEQ ID NO: 9163084 - DNA, 22 bp, Homo sapiens
aggggatgcctgaggatctgta

SEQ ID NO: 9163085 - DNA, 22 bp, Homo sapiens
aggggcaaatgtgagcctggaa

SEQ ID NO: 9163086 - DNA, 22 bp, Homo sapiens
aggggatggagctggaaggcag

SEQ ID NO: 9163087 - DNA, 22 bp, Homo sapiens
aggggatggagctggaaggcag

SEQ ID NO: 9163088 - DNA, 18 bp, Homo sapiens
aggggcagcttgtgtgga

SEQ ID NO: 9163089 - DNA, 22 bp, Homo sapiens
cctcttccactgggccccatcc

SEQ ID NO: 9163090 - DNA, 23 bp, Homo sapiens
aggggcagcaagttttggtgtta

SEQ ID NO: 9163091 - DNA, 22 bp, Homo sapiens
aggggcagcctcacaatcctct

SEQ ID NO: 9163092 - DNA, 22 bp, Homo sapiens
aggggaggtgtccccaaatctc

SEQ ID NO: 9163093 - DNA, 22 bp, Homo sapiens
aggggaggtgtccccaaatctc

SEQ ID NO: 9163094 - DNA, 22 bp, Homo sapiens
aggggatgcctagtggagtctc

SEQ ID NO: 9163095 - DNA, 22 bp, Homo sapiens
aggggaggcagcgataaacctg

SEQ ID NO: 9163096 - DNA, 22 bp, Homo sapiens
aggggaggagcttttcttgcct

SEQ ID NO: 9163097 - DNA, 22 bp, Homo sapiens
aggggaggagcttttcttgcct

SEQ ID NO: 9163098 - DNA, 22 bp, Homo sapiens
aggggaggcagcgataaacctg

SEQ ID NO: 9163099 - DNA, 22 bp, Homo sapiens
agggctggctccgttaccttga

SEQ ID NO: 9163100 - DNA, 22 bp, Homo sapiens
agggctggctccgttaccttga

SEQ ID NO: 9163101 - DNA, 22 bp, Homo sapiens
agggctggctaggtgcgttccc

SEQ ID NO: 9163102 - DNA, 22 bp, Homo sapiens
agggctggctaggtgcgttccc

SEQ ID NO: 9163103 - DNA, 22 bp, Homo sapiens
agggctggccacatgatttggt

SEQ ID NO: 9163104 - DNA, 22 bp, Homo sapiens
agggctggccacatgatttggt

SEQ ID NO: 9163105 - DNA, 22 bp, Homo sapiens
agggctggcatctctaatgctg

SEQ ID NO: 9163106 - DNA, 22 bp, Homo sapiens
agggctggcatctctaatgctg

SEQ ID NO: 9163107 - DNA, 22 bp, Homo sapiens
agggtatgttttaggctgagtt

SEQ ID NO: 9163108 - DNA, 22 bp, Homo sapiens
cctgaggtggctgcagcactgc

SEQ ID NO: 9163109 - DNA, 22 bp, Homo sapiens
agggtagggccgtagggccatg

SEQ ID NO: 9163110 - DNA, 22 bp, Homo sapiens
agggtagggtaaatgatgcatc

SEQ ID NO: 9163111 - DNA, 22 bp, Homo sapiens
agggtaggaactgagtggaagg

SEQ ID NO: 9163112 - DNA, 22 bp, Homo sapiens
agggtagggcccggagacagac

SEQ ID NO: 9163113 - DNA, 22 bp, Homo sapiens
agggtagggcccggagacagac

SEQ ID NO: 9163114 - DNA, 22 bp, Homo sapiens
agggtagggcccggagacagac

SEQ ID NO: 9163115 - DNA, 22 bp, Homo sapiens
cctgagagtgagtgccacctta

SEQ ID NO: 9163116 - DNA, 22 bp, Homo sapiens
cctgagagtaggtgtctcttta

SEQ ID NO: 9163117 - DNA, 22 bp, Homo sapiens
cctgagagtgagggcctcctta

SEQ ID NO: 9163118 - DNA, 22 bp, Homo sapiens
cctgagagtgagtgcctcctta

SEQ ID NO: 9163119 - DNA, 22 bp, Homo sapiens
cctgaaatgactccagctgagt

SEQ ID NO: 9163120 - DNA, 22 bp, Homo sapiens
cctgaaatccatagtttacact

SEQ ID NO: 9163121 - DNA, 22 bp, Homo sapiens
cctgaaatgagttctgctcact

SEQ ID NO: 9163122 - DNA, 21 bp, Homo sapiens
cctgaaattctcactagctta

SEQ ID NO: 9163123 - DNA, 22 bp, Homo sapiens
cctgaaatgactccagctgagt

SEQ ID NO: 9163124 - DNA, 22 bp, Homo sapiens
cctgaaatgagttctgctcact

SEQ ID NO: 9163125 - DNA, 22 bp, Homo sapiens
cctgaactctaaatagagcagt

SEQ ID NO: 9163126 - DNA, 22 bp, Homo sapiens
cctgaagaacctcacgggcact

SEQ ID NO: 9163127 - DNA, 22 bp, Homo sapiens
cctgaagaagttgttatggtct

SEQ ID NO: 9163128 - DNA, 22 bp, Homo sapiens
cctgaaatttgaagacctgaat

SEQ ID NO: 9163129 - DNA, 21 bp, Homo sapiens
cctgaaattctcactagctta

SEQ ID NO: 9163130 - DNA, 22 bp, Homo sapiens
cctgaaatttgaagacctgaat

SEQ ID NO: 9163131 - DNA, 22 bp, Homo sapiens
cctgaacaaatggcatagccaa

SEQ ID NO: 9163132 - DNA, 22 bp, Homo sapiens
cctgaagagtgaatgtggcagt

SEQ ID NO: 9163133 - DNA, 22 bp, Homo sapiens
cctgaagacaacttttatcacc

SEQ ID NO: 9163134 - DNA, 22 bp, Homo sapiens
cctgagaggccctctcactgtc

SEQ ID NO: 9163135 - DNA, 22 bp, Homo sapiens
cctgagagtaggtgtctcttta

SEQ ID NO: 9163136 - DNA, 22 bp, Homo sapiens
cctgagaggttggcctgtccag

SEQ ID NO: 9163137 - DNA, 22 bp, Homo sapiens
cctgagagcgagtggcctcatg

SEQ ID NO: 9163138 - DNA, 22 bp, Homo sapiens
cctgagaggccctctcactgtc

SEQ ID NO: 9163139 - DNA, 22 bp, Homo sapiens
cctgagagccagtgcctgccca

SEQ ID NO: 9163140 - DNA, 22 bp, Homo sapiens
cctgagagcattccacactgaa

SEQ ID NO: 9163141 - DNA, 22 bp, Homo sapiens
cctgagagcattccacactgaa

SEQ ID NO: 9163142 - DNA, 22 bp, Homo sapiens
cctgagagcattccacactgaa

SEQ ID NO: 9163143 - DNA, 22 bp, Homo sapiens
cctgagagagtgagccctgaca

SEQ ID NO: 9163144 - DNA, 22 bp, Homo sapiens
cctgagagcagcttcctgctta

SEQ ID NO: 9163145 - DNA, 22 bp, Homo sapiens
cctgagagcagcttcctgctta

SEQ ID NO: 9163146 - DNA, 22 bp, Homo sapiens
agggcgaggagacggaggcaca

SEQ ID NO: 9163147 - DNA, 22 bp, Homo sapiens
agggcgaggagacggaggcaca

SEQ ID NO: 9163148 - DNA, 22 bp, Homo sapiens
agggcgacaatggagagcgttt

SEQ ID NO: 9163149 - DNA, 22 bp, Homo sapiens
agggcgacaatggagagcgttt

SEQ ID NO: 9163150 - DNA, 22 bp, Homo sapiens
agggcgtggtggtgctggagca

SEQ ID NO: 9163151 - DNA, 19 bp, Homo sapiens
agggcgtggtggcacatgt

SEQ ID NO: 9163152 - DNA, 20 bp, Homo sapiens
agggcctgttgcaagcgttt

SEQ ID NO: 9163153 - DNA, 20 bp, Homo sapiens
cctcaggccagttttaaagt

SEQ ID NO: 9163154 - DNA, 22 bp, Homo sapiens
cctcaggccctgtccctgcgcc

SEQ ID NO: 9163155 - DNA, 22 bp, Homo sapiens
agggctggagccacagctggga

SEQ ID NO: 9163156 - DNA, 22 bp, Homo sapiens
agggctggagccacagctggga

SEQ ID NO: 9163157 - DNA, 22 bp, Homo sapiens
agggctggagccacagctggga

SEQ ID NO: 9163158 - DNA, 22 bp, Homo sapiens
agggctggagccacagctggga

SEQ ID NO: 9163159 - DNA, 22 bp, Homo sapiens
agggctggagccacagctggga

SEQ ID NO: 9163160 - DNA, 22 bp, Homo sapiens
agggctggcaagggattgaaat

SEQ ID NO: 9163161 - DNA, 22 bp, Homo sapiens
agggctggcaagggattgaaat

SEQ ID NO: 9163162 - DNA, 22 bp, Homo sapiens
agggctggagggtactagttta

SEQ ID NO: 9163163 - DNA, 22 bp, Homo sapiens
agggctggagggtactagttta

SEQ ID NO: 9163164 - DNA, 22 bp, Homo sapiens
agggctggcaagggattgaaat

SEQ ID NO: 9163165 - DNA, 22 bp, Homo sapiens
agggcgtggtggtgctggagca

SEQ ID NO: 9163166 - DNA, 22 bp, Homo sapiens
agggcgtggtggtgctggagca

SEQ ID NO: 9163167 - DNA, 22 bp, Homo sapiens
agggctgctttgctaaatatgg

SEQ ID NO: 9163168 - DNA, 22 bp, Homo sapiens
agggctggagccacagctggga

SEQ ID NO: 9163169 - DNA, 19 bp, Homo sapiens
agggcctgcagctcaagct

SEQ ID NO: 9163170 - DNA, 19 bp, Homo sapiens
agggcctgcagctcaagct

SEQ ID NO: 9163171 - DNA, 19 bp, Homo sapiens
agggcctgcagctcaagct

SEQ ID NO: 9163172 - DNA, 19 bp, Homo sapiens
agggcctgcagctcaagct

SEQ ID NO: 9163173 - DNA, 22 bp, Homo sapiens
agggcctgcatcaggagcttgg

SEQ ID NO: 9163174 - DNA, 22 bp, Homo sapiens
agggcctgcatcaggagcttgg

SEQ ID NO: 9163175 - DNA, 19 bp, Homo sapiens
agggcctgcagctcaagct

SEQ ID NO: 9163176 - DNA, 22 bp, Homo sapiens
agggcctgcatcaggagcttgg

SEQ ID NO: 9163177 - DNA, 22 bp, Homo sapiens
agggcctgagctggctgacctc

SEQ ID NO: 9163178 - DNA, 22 bp, Homo sapiens
agggcctgaggctgacggggag

SEQ ID NO: 9163179 - DNA, 23 bp, Homo sapiens
agggcctgatggctcccgctggc

SEQ ID NO: 9163180 - DNA, 22 bp, Homo sapiens
ccctgctttgcacccaggctgg

SEQ ID NO: 9163181 - DNA, 23 bp, Homo sapiens
agggcctcaggagggctgcatgg

SEQ ID NO: 9163182 - DNA, 22 bp, Homo sapiens
ccctggaactcctaggcaagca

SEQ ID NO: 9163183 - DNA, 22 bp, Homo sapiens
agggcctgagctctcctccagt

SEQ ID NO: 9163184 - DNA, 22 bp, Homo sapiens
agggcctcagtgttctcatctg

SEQ ID NO: 9163185 - DNA, 22 bp, Homo sapiens
cctcagcttgatttctgcagag

SEQ ID NO: 9163186 - DNA, 23 bp, Homo sapiens
agggcctggcgtggagtgtgtgc

SEQ ID NO: 9163187 - DNA, 23 bp, Homo sapiens
agggcctggcgtggagtgtgtgc

SEQ ID NO: 9163188 - DNA, 23 bp, Homo sapiens
agggcctggcgtggagtgtgtgc

SEQ ID NO: 9163189 - DNA, 20 bp, Homo sapiens
agggcctggagtacagcagg

SEQ ID NO: 9163190 - DNA, 22 bp, Homo sapiens
agggcctggaactggagaccac

SEQ ID NO: 9163191 - DNA, 22 bp, Homo sapiens
agggcctggaactgtgggcagg

SEQ ID NO: 9163192 - DNA, 22 bp, Homo sapiens
agggcctggaactgtgggcagg

SEQ ID NO: 9163193 - DNA, 22 bp, Homo sapiens
agggcctggaactgtgggcagg

SEQ ID NO: 9163194 - DNA, 22 bp, Homo sapiens
agggcctggaactgtgggcagg

SEQ ID NO: 9163195 - DNA, 20 bp, Homo sapiens
agggcctgctctgtggtgtc

SEQ ID NO: 9163196 - DNA, 20 bp, Homo sapiens
agggcctgctctgtggtgtc

SEQ ID NO: 9163197 - DNA, 20 bp, Homo sapiens
agggcctgctctgtggtgtc

SEQ ID NO: 9163198 - DNA, 19 bp, Homo sapiens
accaggagacagtgagctt

SEQ ID NO: 9163199 - DNA, 20 bp, Homo sapiens
accaggagatggaggcaggg

SEQ ID NO: 9163200 - DNA, 22 bp, Homo sapiens
accaggagagattttattgaga

SEQ ID NO: 9163201 - DNA, 22 bp, Homo sapiens
accaggagaggcacttgcaatg

SEQ ID NO: 9163202 - DNA, 23 bp, Homo sapiens
accaggagaaaagctttgcggga

SEQ ID NO: 9163203 - DNA, 19 bp, Homo sapiens
accaggagacagtgagctt

SEQ ID NO: 9163204 - DNA, 22 bp, Homo sapiens
accaggaacaagccatggagga

SEQ ID NO: 9163205 - DNA, 22 bp, Homo sapiens
accaggagcattttttattagt

SEQ ID NO: 9163206 - DNA, 22 bp, Homo sapiens
accaggagccacaggaggagcc

SEQ ID NO: 9163207 - DNA, 23 bp, Homo sapiens
accaggagccaagatctccctgg

SEQ ID NO: 9163208 - DNA, 22 bp, Homo sapiens
accaggagccatagagtcaggc

SEQ ID NO: 9163209 - DNA, 22 bp, Homo sapiens
accaggaggaagtgttaatgat

SEQ ID NO: 9163210 - DNA, 22 bp, Homo sapiens
accaggaggcctggagcacaaa

SEQ ID NO: 9163211 - DNA, 22 bp, Homo sapiens
accaggaggcctggagcacaaa

SEQ ID NO: 9163212 - DNA, 22 bp, Homo sapiens
accaggaggctacactgtccca

SEQ ID NO: 9163213 - DNA, 22 bp, Homo sapiens
accaggaggccttggttctgag

SEQ ID NO: 9163214 - DNA, 23 bp, Homo sapiens
aggcttcctatcttagagctggg

SEQ ID NO: 9163215 - DNA, 22 bp, Homo sapiens
accaaggagacaaaggtgtatt

SEQ ID NO: 9163216 - DNA, 22 bp, Homo sapiens
accaaggaagagattctcagtt

SEQ ID NO: 9163217 - DNA, 22 bp, Homo sapiens
accaaggagaaggtgcaagctt

SEQ ID NO: 9163218 - DNA, 22 bp, Homo sapiens
accaaggaagaatctatttgag

SEQ ID NO: 9163219 - DNA, 22 bp, Homo sapiens
accaaggaagagattctcagtt

SEQ ID NO: 9163220 - DNA, 22 bp, Homo sapiens
accaaccagggacttggctccc

SEQ ID NO: 9163221 - DNA, 22 bp, Homo sapiens
accacaggaattgctctgtggt

SEQ ID NO: 9163222 - DNA, 22 bp, Homo sapiens
accacaggaattgctctgtggt

SEQ ID NO: 9163223 - DNA, 22 bp, Homo sapiens
accagctgaactgcagcccagg

SEQ ID NO: 9163224 - DNA, 22 bp, Homo sapiens
accacagaggaatttgaagagg

SEQ ID NO: 9163225 - DNA, 22 bp, Homo sapiens
accaaggagtttggtattttag

SEQ ID NO: 9163226 - DNA, 22 bp, Homo sapiens
accaatcaaaatgtatggagct

SEQ ID NO: 9163227 - DNA, 22 bp, Homo sapiens
accaggctgttgggcccagtgt

SEQ ID NO: 9163228 - DNA, 22 bp, Homo sapiens
accagggcacaggagtctgaag

SEQ ID NO: 9163229 - DNA, 22 bp, Homo sapiens
accaggagtctagcctagtcaa

SEQ ID NO: 9163230 - DNA, 22 bp, Homo sapiens
accaggctgtgaagtgagacta

SEQ ID NO: 9163231 - DNA, 19 bp, Homo sapiens
accaggagtatcagagctg

SEQ ID NO: 9163232 - DNA, 22 bp, Homo sapiens
accaggagggaccctggtggcc

SEQ ID NO: 9163233 - DNA, 22 bp, Homo sapiens
accaggaggctacactgtccca

SEQ ID NO: 9163234 - DNA, 22 bp, Homo sapiens
accagggcacattccggccaga

SEQ ID NO: 9163235 - DNA, 22 bp, Homo sapiens
accagggcccgggagagctctc

SEQ ID NO: 9163236 - DNA, 22 bp, Homo sapiens
accagggcagccgaggtgtgtc

SEQ ID NO: 9163237 - DNA, 22 bp, Homo sapiens
accagggcagccgaggtgtgtc

SEQ ID NO: 9163238 - DNA, 22 bp, Homo sapiens
accagggcagccgaggtgtgtc

SEQ ID NO: 9163239 - DNA, 22 bp, Homo sapiens
accagggcccgggagagctctc

SEQ ID NO: 9163240 - DNA, 22 bp, Homo sapiens
accagggcccgggagagctctc

SEQ ID NO: 9163241 - DNA, 22 bp, Homo sapiens
accagggcccgggagagctctc

SEQ ID NO: 9163242 - DNA, 22 bp, Homo sapiens
accagggcggcttgaggaggca

SEQ ID NO: 9163243 - DNA, 22 bp, Homo sapiens
accagggccgcgggcgactagc

SEQ ID NO: 9163244 - DNA, 22 bp, Homo sapiens
accagggcttacagcagtagct

SEQ ID NO: 9163245 - DNA, 22 bp, Homo sapiens
accagggttgagtcagctgcgt

SEQ ID NO: 9163246 - DNA, 22 bp, Homo sapiens
accagggctgggataggtcagg

SEQ ID NO: 9163247 - DNA, 22 bp, Homo sapiens
accagggctgggataggtcagg

SEQ ID NO: 9163248 - DNA, 22 bp, Homo sapiens
accagggctgggataggtcagg

SEQ ID NO: 9163249 - DNA, 22 bp, Homo sapiens
accagggctgacaatctgatgg

SEQ ID NO: 9163250 - DNA, 22 bp, Homo sapiens
accagttaaagggaaattgaaa

SEQ ID NO: 9163251 - DNA, 22 bp, Homo sapiens
accagttaaagaatatgaggcc

SEQ ID NO: 9163252 - DNA, 22 bp, Homo sapiens
accagtggatgaatgctggacc

SEQ ID NO: 9163253 - DNA, 22 bp, Homo sapiens
accagtgggtgtcattccctta

SEQ ID NO: 9163254 - DNA, 22 bp, Homo sapiens
accagtgacttcattcctaaaa

SEQ ID NO: 9163255 - DNA, 22 bp, Homo sapiens
accagtgcttcctgctggagct

SEQ ID NO: 9163256 - DNA, 22 bp, Homo sapiens
accagtccgcggagctccgggg

SEQ ID NO: 9163257 - DNA, 22 bp, Homo sapiens
accagtctgttgttgcagagtg

SEQ ID NO: 9163258 - DNA, 22 bp, Homo sapiens
accagtctaggcaatgggggct

SEQ ID NO: 9163259 - DNA, 20 bp, Homo sapiens
accaggtggctgatgacacc

SEQ ID NO: 9163260 - DNA, 22 bp, Homo sapiens
accaggtggccccagcgtggtt

SEQ ID NO: 9163261 - DNA, 22 bp, Homo sapiens
accatataacaagtttaggaga

SEQ ID NO: 9163262 - DNA, 22 bp, Homo sapiens
accagttttttatacatcttct

SEQ ID NO: 9163263 - DNA, 22 bp, Homo sapiens
accagtttgtaacctgttttca

SEQ ID NO: 9163264 - DNA, 22 bp, Homo sapiens
accagttacatcttagcaagca

SEQ ID NO: 9163265 - DNA, 22 bp, Homo sapiens
accagttattagccctacaact

SEQ ID NO: 9163266 - DNA, 22 bp, Homo sapiens
accagtttaataactgctcaag

SEQ ID NO: 9163267 - DNA, 22 bp, Homo sapiens
agggccagttctacctctgaat

SEQ ID NO: 9163268 - DNA, 22 bp, Homo sapiens
agggccatttgctggagctttg

SEQ ID NO: 9163269 - DNA, 22 bp, Homo sapiens
agggcctcctaatttcctcata

SEQ ID NO: 9163270 - DNA, 22 bp, Homo sapiens
accctggactggggctgaggct

SEQ ID NO: 9163271 - DNA, 22 bp, Homo sapiens
accctggagcaataatccctgg

SEQ ID NO: 9163272 - DNA, 22 bp, Homo sapiens
accctgcctgacaacagaggat

SEQ ID NO: 9163273 - DNA, 22 bp, Homo sapiens
accccagaggcggaggctgcag

SEQ ID NO: 9163274 - DNA, 22 bp, Homo sapiens
accccagaggcggaggctgcag

SEQ ID NO: 9163275 - DNA, 22 bp, Homo sapiens
accccagcgcatatggtctgcg

SEQ ID NO: 9163276 - DNA, 22 bp, Homo sapiens
acccatgagtgtatctttaaaa

SEQ ID NO: 9163277 - DNA, 22 bp, Homo sapiens
acccatccagtgtccctgctag

SEQ ID NO: 9163278 - DNA, 22 bp, Homo sapiens
acccatcacttttaggctttgc

SEQ ID NO: 9163279 - DNA, 22 bp, Homo sapiens
acccatcagcggctggagctgg

SEQ ID NO: 9163280 - DNA, 17 bp, Homo sapiens
acccattttgcacaggc

SEQ ID NO: 9163281 - DNA, 22 bp, Homo sapiens
acccatttcataaacatgcttt

SEQ ID NO: 9163282 - DNA, 22 bp, Homo sapiens
accccacagcatacaaaggcac

SEQ ID NO: 9163283 - DNA, 20 bp, Homo sapiens
accccacagagtccattgca

SEQ ID NO: 9163284 - DNA, 22 bp, Homo sapiens
acccatttttaaatataacttg

SEQ ID NO: 9163285 - DNA, 22 bp, Homo sapiens
accccaagacagtagaagagaa

SEQ ID NO: 9163286 - DNA, 22 bp, Homo sapiens
accctggagcaataatccctgg

SEQ ID NO: 9163287 - DNA, 22 bp, Homo sapiens
accctggattgggaaccagaag

SEQ ID NO: 9163288 - DNA, 22 bp, Homo sapiens
accctggattgggaaccagaag

SEQ ID NO: 9163289 - DNA, 22 bp, Homo sapiens
accctggcagccttctgtcctg

SEQ ID NO: 9163290 - DNA, 22 bp, Homo sapiens
accctggcagccttctgtcctg

SEQ ID NO: 9163291 - DNA, 18 bp, Homo sapiens
accctgggcaattcactc

SEQ ID NO: 9163292 - DNA, 22 bp, Homo sapiens
accctgggacctggaggtggat

SEQ ID NO: 9163293 - DNA, 22 bp, Homo sapiens
accctgggcttggcctgctcag

SEQ ID NO: 9163294 - DNA, 22 bp, Homo sapiens
accctgggggtggccagtgcca

SEQ ID NO: 9163295 - DNA, 22 bp, Homo sapiens
accctgggggtggccagtgcca

SEQ ID NO: 9163296 - DNA, 22 bp, Homo sapiens
accctggggtcacccttctctg

SEQ ID NO: 9163297 - DNA, 22 bp, Homo sapiens
accctgggttcccgcagcacca

SEQ ID NO: 9163298 - DNA, 22 bp, Homo sapiens
accctgggtgagaggcaaacag

SEQ ID NO: 9163299 - DNA, 22 bp, Homo sapiens
accctgggtctcaatcatccta

SEQ ID NO: 9163300 - DNA, 22 bp, Homo sapiens
acccaccacagtggctggcaca

SEQ ID NO: 9163301 - DNA, 19 bp, Homo sapiens
agggcctgagcagatgttg

SEQ ID NO: 9163302 - DNA, 22 bp, Homo sapiens
acccactgtcatctctgaccac

SEQ ID NO: 9163303 - DNA, 22 bp, Homo sapiens
acccactgtagccactctgggt

SEQ ID NO: 9163304 - DNA, 22 bp, Homo sapiens
acccacgaagatgagcggcatg

SEQ ID NO: 9163305 - DNA, 22 bp, Homo sapiens
acccagagaactgtgccttgag

SEQ ID NO: 9163306 - DNA, 22 bp, Homo sapiens
acccactgtcatctctgaccac

SEQ ID NO: 9163307 - DNA, 22 bp, Homo sapiens
agggcctgagaccgtggcttga

SEQ ID NO: 9163308 - DNA, 22 bp, Homo sapiens
agggcctgacacccttgccagc

SEQ ID NO: 9163309 - DNA, 22 bp, Homo sapiens
agggcctgagaccgtggcttga

SEQ ID NO: 9163310 - DNA, 19 bp, Homo sapiens
agggcctgagcagatgttg

SEQ ID NO: 9163311 - DNA, 22 bp, Homo sapiens
agggcctctgagccagttctgg

SEQ ID NO: 9163312 - DNA, 21 bp, Homo sapiens
agggcctctcatttgtgccag

SEQ ID NO: 9163313 - DNA, 22 bp, Homo sapiens
acccagagactagcacggtaca

SEQ ID NO: 9163314 - DNA, 22 bp, Homo sapiens
acccagggaccccgctgacgcc

SEQ ID NO: 9163315 - DNA, 22 bp, Homo sapiens
acccagggaccccgctgacgcc

SEQ ID NO: 9163316 - DNA, 22 bp, Homo sapiens
acccagggtagaacctcagagc

SEQ ID NO: 9163317 - DNA, 22 bp, Homo sapiens
acccagggtagagtgcagtggc

SEQ ID NO: 9163318 - DNA, 22 bp, Homo sapiens
acccagggtagagtgcagtggc

SEQ ID NO: 9163319 - DNA, 22 bp, Homo sapiens
acccagggtttgagctctgcag

SEQ ID NO: 9163320 - DNA, 22 bp, Homo sapiens
acccagggtcaccccgtagggt

SEQ ID NO: 9163321 - DNA, 22 bp, Homo sapiens
acccagggttcctgggtcccag

SEQ ID NO: 9163322 - DNA, 22 bp, Homo sapiens
acccagggtcaccccgtagggt

SEQ ID NO: 9163323 - DNA, 19 bp, Homo sapiens
acccagggttgatgtccag

SEQ ID NO: 9163324 - DNA, 22 bp, Homo sapiens
acccagggtttgagctctgcag

SEQ ID NO: 9163325 - DNA, 19 bp, Homo sapiens
acccagggttgatgtccag

SEQ ID NO: 9163326 - DNA, 22 bp, Homo sapiens
acatctttttggaaacggctga

SEQ ID NO: 9163327 - DNA, 22 bp, Homo sapiens
aggccagccctgggctgagaga

SEQ ID NO: 9163328 - DNA, 22 bp, Homo sapiens
acatgaaaagactatctgatta

SEQ ID NO: 9163329 - DNA, 22 bp, Homo sapiens
acatgaaaagactatctgatta

SEQ ID NO: 9163330 - DNA, 22 bp, Homo sapiens
aggccagcattctctctccagg

SEQ ID NO: 9163331 - DNA, 18 bp, Homo sapiens
aggccagccctgctactg

SEQ ID NO: 9163332 - DNA, 22 bp, Homo sapiens
aggccagcagcatgacggcatc

SEQ ID NO: 9163333 - DNA, 22 bp, Homo sapiens
aggccagcagacgtgggactga

SEQ ID NO: 9163334 - DNA, 22 bp, Homo sapiens
aggccagcatgcagttctaagg

SEQ ID NO: 9163335 - DNA, 22 bp, Homo sapiens
acatgaaacctgagtctaactc

SEQ ID NO: 9163336 - DNA, 22 bp, Homo sapiens
acatgaaacctgagtctaactc

SEQ ID NO: 9163337 - DNA, 20 bp, Homo sapiens
acatgaaaggaaacaggaaa

SEQ ID NO: 9163338 - DNA, 22 bp, Homo sapiens
aggccctgagaaaatccctgca

SEQ ID NO: 9163339 - DNA, 22 bp, Homo sapiens
aggcccagggctgctctctgaa

SEQ ID NO: 9163340 - DNA, 19 bp, Homo sapiens
aggcatgggaagagaagtc

SEQ ID NO: 9163341 - DNA, 22 bp, Homo sapiens
aggcatggctttaggcaggcgt

SEQ ID NO: 9163342 - DNA, 22 bp, Homo sapiens
aggcatggggctgcagtcaggt

SEQ ID NO: 9163343 - DNA, 22 bp, Homo sapiens
aggcatggggctgcagtcaggt

SEQ ID NO: 9163344 - DNA, 22 bp, Homo sapiens
aggcatgggtagaagagaagcc

SEQ ID NO: 9163345 - DNA, 19 bp, Homo sapiens
aggcatgggaagagaagtc

SEQ ID NO: 9163346 - DNA, 19 bp, Homo sapiens
aggcatgggaagagaagtc

SEQ ID NO: 9163347 - DNA, 19 bp, Homo sapiens
aggcatgggaagagaagtc

SEQ ID NO: 9163348 - DNA, 22 bp, Homo sapiens
acatacatgggattaaaaaatt

SEQ ID NO: 9163349 - DNA, 22 bp, Homo sapiens
acatacatggtgctttcttggt

SEQ ID NO: 9163350 - DNA, 22 bp, Homo sapiens
acatacatgggattaaaaaatt

SEQ ID NO: 9163351 - DNA, 22 bp, Homo sapiens
aggcagtgttcttctaagggca

SEQ ID NO: 9163352 - DNA, 20 bp, Homo sapiens
aggcagttagaaggagatga

SEQ ID NO: 9163353 - DNA, 22 bp, Homo sapiens
aggcatggcatggggcagatgt

SEQ ID NO: 9163354 - DNA, 22 bp, Homo sapiens
aggcatgggtagaagagaagcc

SEQ ID NO: 9163355 - DNA, 22 bp, Homo sapiens
aggcatgggtagaagagaagcc

SEQ ID NO: 9163356 - DNA, 22 bp, Homo sapiens
aggcatgggtagaagagaagcc

SEQ ID NO: 9163357 - DNA, 18 bp, Homo sapiens
aggcatggtggtgcgcac

SEQ ID NO: 9163358 - DNA, 18 bp, Homo sapiens
aggcatggtggtgcgcac

SEQ ID NO: 9163359 - DNA, 22 bp, Homo sapiens
aggccacaatttgatttggttt

SEQ ID NO: 9163360 - DNA, 22 bp, Homo sapiens
aggccacacaactcttagagat

SEQ ID NO: 9163361 - DNA, 18 bp, Homo sapiens
aggccacactccagaaca

SEQ ID NO: 9163362 - DNA, 22 bp, Homo sapiens
aggccacagagagtgcatgtgc

SEQ ID NO: 9163363 - DNA, 22 bp, Homo sapiens
aggccacagagagtgcatgtgc

SEQ ID NO: 9163364 - DNA, 22 bp, Homo sapiens
aggccacaggcaccctgtgttc

SEQ ID NO: 9163365 - DNA, 22 bp, Homo sapiens
aggccacaggtggaagccagag

SEQ ID NO: 9163366 - DNA, 22 bp, Homo sapiens
aggccacaggtggaagccagag

SEQ ID NO: 9163367 - DNA, 22 bp, Homo sapiens
aggccacagtactttgcagacc

SEQ ID NO: 9163368 - DNA, 22 bp, Homo sapiens
aggccacaggattgcacagcat

SEQ ID NO: 9163369 - DNA, 22 bp, Homo sapiens
aggccacaggattgcacagcat

SEQ ID NO: 9163370 - DNA, 22 bp, Homo sapiens
aggccacaggagtactgtcggt

SEQ ID NO: 9163371 - DNA, 22 bp, Homo sapiens
aggccacagcctgggaggtgac

SEQ ID NO: 9163372 - DNA, 22 bp, Homo sapiens
aggccacagcctgggaggtgac

SEQ ID NO: 9163373 - DNA, 22 bp, Homo sapiens
aggccacagatactgtgaagta

SEQ ID NO: 9163374 - DNA, 22 bp, Homo sapiens
acattcaagatgcattcactta

SEQ ID NO: 9163375 - DNA, 22 bp, Homo sapiens
acattaagatgtgctgtaggat

SEQ ID NO: 9163376 - DNA, 22 bp, Homo sapiens
acattaatgaggtgatgacaca

SEQ ID NO: 9163377 - DNA, 22 bp, Homo sapiens
aggccctgcaggagtggggaca

SEQ ID NO: 9163378 - DNA, 22 bp, Homo sapiens
acattcaaggcagcactgagtg

SEQ ID NO: 9163379 - DNA, 22 bp, Homo sapiens
acattcaaggccttctgacaca

SEQ ID NO: 9163380 - DNA, 22 bp, Homo sapiens
acattcaaggccttctgacaca

SEQ ID NO: 9163381 - DNA, 22 bp, Homo sapiens
acattcatgcaccttcctatcc

SEQ ID NO: 9163382 - DNA, 22 bp, Homo sapiens
acattcatgtcccacttctagc

SEQ ID NO: 9163383 - DNA, 22 bp, Homo sapiens
acattcatgtcccacttctagc

SEQ ID NO: 9163384 - DNA, 22 bp, Homo sapiens
acattcatgtcccacttctagc

SEQ ID NO: 9163385 - DNA, 22 bp, Homo sapiens
acattcctgaggaaatacattc

SEQ ID NO: 9163386 - DNA, 22 bp, Homo sapiens
acattctacagttaaccattag

SEQ ID NO: 9163387 - DNA, 22 bp, Homo sapiens
acattctaacattgtacagata

SEQ ID NO: 9163388 - DNA, 22 bp, Homo sapiens
acattctaaagcatgctcagga

SEQ ID NO: 9163389 - DNA, 19 bp, Homo sapiens
acattcccatcagcaatgt

SEQ ID NO: 9163390 - DNA, 22 bp, Homo sapiens
acattcctgaatgggcacattt

SEQ ID NO: 9163391 - DNA, 22 bp, Homo sapiens
acattcctgaggaaatacattc

SEQ ID NO: 9163392 - DNA, 22 bp, Homo sapiens
acattcctcagtgccagttgag

SEQ ID NO: 9163393 - DNA, 22 bp, Homo sapiens
acattcttgaagtgaagtttat

SEQ ID NO: 9163394 - DNA, 22 bp, Homo sapiens
acattctagaagtctttgcaat

SEQ ID NO: 9163395 - DNA, 22 bp, Homo sapiens
acattctatgaagataatttta

SEQ ID NO: 9163396 - DNA, 22 bp, Homo sapiens
aggctccagcccaaggctgcag

SEQ ID NO: 9163397 - DNA, 22 bp, Homo sapiens
aggctccagcccaaggctgcag

SEQ ID NO: 9163398 - DNA, 22 bp, Homo sapiens
aggctccagggctgtgtgggag

SEQ ID NO: 9163399 - DNA, 22 bp, Homo sapiens
aggctgtgcaattagggtaaga

SEQ ID NO: 9163400 - DNA, 22 bp, Homo sapiens
aggctgtgattccaccactctc

SEQ ID NO: 9163401 - DNA, 22 bp, Homo sapiens
aggctgtgcaattagggtaaga

SEQ ID NO: 9163402 - DNA, 22 bp, Homo sapiens
aggcttcagcctagagctggag

SEQ ID NO: 9163403 - DNA, 22 bp, Homo sapiens
aggcttcagtagggagcatgtc

SEQ ID NO: 9163404 - DNA, 22 bp, Homo sapiens
acattgaatgtatgtgatgaaa

SEQ ID NO: 9163405 - DNA, 22 bp, Homo sapiens
acattgaagtgtctggcctcct

SEQ ID NO: 9163406 - DNA, 22 bp, Homo sapiens
acattgaacatggcaggacatt

SEQ ID NO: 9163407 - DNA, 22 bp, Homo sapiens
acattgaacatggcaggacatt

SEQ ID NO: 9163408 - DNA, 22 bp, Homo sapiens
aggctccacggtcactggctct

SEQ ID NO: 9163409 - DNA, 22 bp, Homo sapiens
aggctccagcagccagaggaag

SEQ ID NO: 9163410 - DNA, 23 bp, Homo sapiens
aggctccactccctgggatgtgg

SEQ ID NO: 9163411 - DNA, 22 bp, Homo sapiens
aggctccagccaatgggtctgt

SEQ ID NO: 9163412 - DNA, 22 bp, Homo sapiens
aggctccagcagccagaggaag

SEQ ID NO: 9163413 - DNA, 22 bp, Homo sapiens
aggctccagcagccagaggaag

SEQ ID NO: 9163414 - DNA, 22 bp, Homo sapiens
aggcaacataacacgaaagtct

SEQ ID NO: 9163415 - DNA, 19 bp, Homo sapiens
aggcacaattctgagaagc

SEQ ID NO: 9163416 - DNA, 22 bp, Homo sapiens
aggcacaaagacagaaaagcac

SEQ ID NO: 9163417 - DNA, 22 bp, Homo sapiens
aggcaactaggcctctgcctca

SEQ ID NO: 9163418 - DNA, 22 bp, Homo sapiens
aggcaacatgggccaggcagaa

SEQ ID NO: 9163419 - DNA, 22 bp, Homo sapiens
aggcacagagaagtaaagtatc

SEQ ID NO: 9163420 - DNA, 22 bp, Homo sapiens
aggcacagaatggcattcagtg

SEQ ID NO: 9163421 - DNA, 22 bp, Homo sapiens
aggcacagaatggcattcagtg

SEQ ID NO: 9163422 - DNA, 22 bp, Homo sapiens
aggcacagatttggggaaagca

SEQ ID NO: 9163423 - DNA, 22 bp, Homo sapiens
aggcacagatttggggaaagca

SEQ ID NO: 9163424 - DNA, 22 bp, Homo sapiens
aggcacagatttggggaaagca

SEQ ID NO: 9163425 - DNA, 18 bp, Homo sapiens
aggcacagagcatacata

SEQ ID NO: 9163426 - DNA, 22 bp, Homo sapiens
aggcacagatttggggaaagca

SEQ ID NO: 9163427 - DNA, 18 bp, Homo sapiens
aggcacagagcatacata

SEQ ID NO: 9163428 - DNA, 22 bp, Homo sapiens
acatacatcaagtatcacaaga

SEQ ID NO: 9163429 - DNA, 22 bp, Homo sapiens
acatacatcaagtatcacaaga

SEQ ID NO: 9163430 - DNA, 23 bp, Homo sapiens
acatacatggagataaagtgatg

SEQ ID NO: 9163431 - DNA, 23 bp, Homo sapiens
acatacatggagataaagtgatg

SEQ ID NO: 9163432 - DNA, 23 bp, Homo sapiens
acatacatggagataaagtgatg

SEQ ID NO: 9163433 - DNA, 21 bp, Homo sapiens
acatacataccttaccacctt

SEQ ID NO: 9163434 - DNA, 22 bp, Homo sapiens
acatacatatgacaactttcct

SEQ ID NO: 9163435 - DNA, 22 bp, Homo sapiens
acatacatatgtttaaatgcat

SEQ ID NO: 9163436 - DNA, 23 bp, Homo sapiens
acatacataagcaccacattttg

SEQ ID NO: 9163437 - DNA, 22 bp, Homo sapiens
acatacacatgaatatattttt

SEQ ID NO: 9163438 - DNA, 22 bp, Homo sapiens
acatacacaagcgtacatgaac

SEQ ID NO: 9163439 - DNA, 22 bp, Homo sapiens
acatacacaagcgtacatgaac

SEQ ID NO: 9163440 - DNA, 22 bp, Homo sapiens
acataaatttcactgttccgtg

SEQ ID NO: 9163441 - DNA, 22 bp, Homo sapiens
acataacaatcataggacatag

SEQ ID NO: 9163442 - DNA, 22 bp, Homo sapiens
aggcaaaagaatgtcataaatg

SEQ ID NO: 9163443 - DNA, 22 bp, Homo sapiens
aggcaaagaagttggtcaggag

SEQ ID NO: 9163444 - DNA, 22 bp, Homo sapiens
aggcaaagagccagcaaatctg

SEQ ID NO: 9163445 - DNA, 22 bp, Homo sapiens
aggcaaagagccagcaaatctg

SEQ ID NO: 9163446 - DNA, 22 bp, Homo sapiens
aggcaaagaggatattttgggg

SEQ ID NO: 9163447 - DNA, 22 bp, Homo sapiens
aggcaaagcgataccagagcta

SEQ ID NO: 9163448 - DNA, 21 bp, Homo sapiens
aggaggggtctttcccactga

SEQ ID NO: 9163449 - DNA, 21 bp, Homo sapiens
aggaggggtctttcccactga

SEQ ID NO: 9163450 - DNA, 22 bp, Homo sapiens
aggaggggttctcgggtgctga

SEQ ID NO: 9163451 - DNA, 22 bp, Homo sapiens
aggaggggttctcgggtgctga

SEQ ID NO: 9163452 - DNA, 22 bp, Homo sapiens
aggaggggttctcgggtgctga

SEQ ID NO: 9163453 - DNA, 22 bp, Homo sapiens
aggaggggttctcgggtgctga

SEQ ID NO: 9163454 - DNA, 22 bp, Homo sapiens
aggaggggttctcgggtgctga

SEQ ID NO: 9163455 - DNA, 20 bp, Homo sapiens
aggatggcaagcaagtgcat

SEQ ID NO: 9163456 - DNA, 22 bp, Homo sapiens
aggagggtacaatgggtggaaa

SEQ ID NO: 9163457 - DNA, 17 bp, Homo sapiens
aggagggaaatagcttg

SEQ ID NO: 9163458 - DNA, 17 bp, Homo sapiens
aggagggaaatagcttg

SEQ ID NO: 9163459 - DNA, 17 bp, Homo sapiens
aggagggaaatagcttg

SEQ ID NO: 9163460 - DNA, 22 bp, Homo sapiens
aggaggcttttgcaggtgccac

SEQ ID NO: 9163461 - DNA, 22 bp, Homo sapiens
aggaggcttttgcaggtgccac

SEQ ID NO: 9163462 - DNA, 21 bp, Homo sapiens
aggagctggagaaaactttcc

SEQ ID NO: 9163463 - DNA, 22 bp, Homo sapiens
aggaggctgtggagcactccat

SEQ ID NO: 9163464 - DNA, 22 bp, Homo sapiens
aggaggcttttgcaggtgccac

SEQ ID NO: 9163465 - DNA, 20 bp, Homo sapiens
aggagggacctggattggcg

SEQ ID NO: 9163466 - DNA, 20 bp, Homo sapiens
aggagggacctggattggcg

SEQ ID NO: 9163467 - DNA, 22 bp, Homo sapiens
aggagggagatgcccatcctgg

SEQ ID NO: 9163468 - DNA, 22 bp, Homo sapiens
aggaggggcatagaaatgtaat

SEQ ID NO: 9163469 - DNA, 22 bp, Homo sapiens
aggaggggcatagaaatgtaat

SEQ ID NO: 9163470 - DNA, 20 bp, Homo sapiens
aggagaccaagccaagtgga

SEQ ID NO: 9163471 - DNA, 22 bp, Homo sapiens
aggagacccagaatgttgctgt

SEQ ID NO: 9163472 - DNA, 19 bp, Homo sapiens
acaggggctagcggaagca

SEQ ID NO: 9163473 - DNA, 22 bp, Homo sapiens
aggagacatctaactgtaggtt

SEQ ID NO: 9163474 - DNA, 23 bp, Homo sapiens
aggagacagggaagtgcctggct

SEQ ID NO: 9163475 - DNA, 22 bp, Homo sapiens
aggagacagtttggacgtgtag

SEQ ID NO: 9163476 - DNA, 17 bp, Homo sapiens
aggaagggcaagtttct

SEQ ID NO: 9163477 - DNA, 17 bp, Homo sapiens
aggaagggcaagtttct

SEQ ID NO: 9163478 - DNA, 22 bp, Homo sapiens
aggaagggatacataggatagt

SEQ ID NO: 9163479 - DNA, 23 bp, Homo sapiens
aggaaggaggtcctaacagtatc

SEQ ID NO: 9163480 - DNA, 22 bp, Homo sapiens
aggaaggagggcagatattaag

SEQ ID NO: 9163481 - DNA, 20 bp, Homo sapiens
aggaaggagaatctgagcaa

SEQ ID NO: 9163482 - DNA, 23 bp, Homo sapiens
aggaaggaggtcctaacagtatc

SEQ ID NO: 9163483 - DNA, 23 bp, Homo sapiens
aggaaggaggtcctaacagtatc

SEQ ID NO: 9163484 - DNA, 23 bp, Homo sapiens
aggaaggaggtcctaacagtatc

SEQ ID NO: 9163485 - DNA, 22 bp, Homo sapiens
aggaaggcacattgttggctaa

SEQ ID NO: 9163486 - DNA, 22 bp, Homo sapiens
aggaagggatacataggatagt

SEQ ID NO: 9163487 - DNA, 22 bp, Homo sapiens
aggaagggatacataggatagt

SEQ ID NO: 9163488 - DNA, 22 bp, Homo sapiens
aggaagggagcagtttgttgtt

SEQ ID NO: 9163489 - DNA, 22 bp, Homo sapiens
aggaaggcttctttggtcttct

SEQ ID NO: 9163490 - DNA, 22 bp, Homo sapiens
aggaaggcatgaggtgttcaca

SEQ ID NO: 9163491 - DNA, 22 bp, Homo sapiens
aggaagctaaccagggagtgag

SEQ ID NO: 9163492 - DNA, 23 bp, Homo sapiens
aggaagctaagtgtggctgcgga

SEQ ID NO: 9163493 - DNA, 22 bp, Homo sapiens
aggaagctagagccaccggact

SEQ ID NO: 9163494 - DNA, 20 bp, Homo sapiens
aggaaggagaatctgagcaa

SEQ ID NO: 9163495 - DNA, 23 bp, Homo sapiens
aggaagctaccaattttgtaggc

SEQ ID NO: 9163496 - DNA, 22 bp, Homo sapiens
aggaagctagaaggtcttcttt

SEQ ID NO: 9163497 - DNA, 17 bp, Homo sapiens
aggaagcgagctggcct

SEQ ID NO: 9163498 - DNA, 22 bp, Homo sapiens
aggaagcctggggctgccctcg

SEQ ID NO: 9163499 - DNA, 22 bp, Homo sapiens
aggaagcccaagtctcatcttc

SEQ ID NO: 9163500 - DNA, 22 bp, Homo sapiens
aggaagcccaagtctcatcttc

SEQ ID NO: 9163501 - DNA, 22 bp, Homo sapiens
aggaagcctggcattaaaaagc

SEQ ID NO: 9163502 - DNA, 22 bp, Homo sapiens
aggagctggaatggtccttttg

SEQ ID NO: 9163503 - DNA, 22 bp, Homo sapiens
aggagctgctttggtgcggttt

SEQ ID NO: 9163504 - DNA, 22 bp, Homo sapiens
aggagctgcttaaatggttggt

SEQ ID NO: 9163505 - DNA, 22 bp, Homo sapiens
aggagctgcactgggagttttt

SEQ ID NO: 9163506 - DNA, 22 bp, Homo sapiens
aggagctgcaaatattagtaat

SEQ ID NO: 9163507 - DNA, 22 bp, Homo sapiens
aggagctgcatggatacctggt

SEQ ID NO: 9163508 - DNA, 22 bp, Homo sapiens
aggagctgcttaaatggttggt

SEQ ID NO: 9163509 - DNA, 22 bp, Homo sapiens
aggagctgcagattctgccttg

SEQ ID NO: 9163510 - DNA, 22 bp, Homo sapiens
aggagcctccttctcatgtgca

SEQ ID NO: 9163511 - DNA, 22 bp, Homo sapiens
aggagcctccatggtcacattc

SEQ ID NO: 9163512 - DNA, 22 bp, Homo sapiens
aggagcctgaatcagagggtga

SEQ ID NO: 9163513 - DNA, 22 bp, Homo sapiens
aggagcctgaatcagagggtga

SEQ ID NO: 9163514 - DNA, 22 bp, Homo sapiens
aggagcctgagtcacagtgcct

SEQ ID NO: 9163515 - DNA, 22 bp, Homo sapiens
aggagctgatgattctttgatc

SEQ ID NO: 9163516 - DNA, 22 bp, Homo sapiens
aggagctgcaaaaccggccgct

SEQ ID NO: 9163517 - DNA, 22 bp, Homo sapiens
aggagctgcaaaaccggccgct

SEQ ID NO: 9163518 - DNA, 23 bp, Homo sapiens
aggagcccctaattctgggcagc

SEQ ID NO: 9163519 - DNA, 22 bp, Homo sapiens
aggagcccagcctgggctcgga

SEQ ID NO: 9163520 - DNA, 23 bp, Homo sapiens
aggagcccaaggagaggtaactt

SEQ ID NO: 9163521 - DNA, 22 bp, Homo sapiens
aggagcccctcttcagtcctgg

SEQ ID NO: 9163522 - DNA, 22 bp, Homo sapiens
aggagccctccgttgcttcatc

SEQ ID NO: 9163523 - DNA, 22 bp, Homo sapiens
aggagccctgcgggaggcagag

SEQ ID NO: 9163524 - DNA, 22 bp, Homo sapiens
acaggggctccgaaggtgaggg

SEQ ID NO: 9163525 - DNA, 22 bp, Homo sapiens
acaggggctccgaaggtgaggg

SEQ ID NO: 9163526 - DNA, 22 bp, Homo sapiens
acaggggctccgaaggtgaggg

SEQ ID NO: 9163527 - DNA, 22 bp, Homo sapiens
acagggggtcccatggcctgga

SEQ ID NO: 9163528 - DNA, 22 bp, Homo sapiens
acaggggtgcatggtgcatggt

SEQ ID NO: 9163529 - DNA, 22 bp, Homo sapiens
acaggggtgcatggtgcatggt

SEQ ID NO: 9163530 - DNA, 22 bp, Homo sapiens
aggagccattttccaagggcga

SEQ ID NO: 9163531 - DNA, 22 bp, Homo sapiens
aggagccattttccaagggcga

SEQ ID NO: 9163532 - DNA, 20 bp, Homo sapiens
aggagccattgactgcagca

SEQ ID NO: 9163533 - DNA, 21 bp, Homo sapiens
aggagccatgtggtctgatgg

SEQ ID NO: 9163534 - DNA, 21 bp, Homo sapiens
aggagccatgtggtctgatgg

SEQ ID NO: 9163535 - DNA, 20 bp, Homo sapiens
aggagccattgactgcagca

SEQ ID NO: 9163536 - DNA, 22 bp, Homo sapiens
aggagcagaccgtagtcctgca

SEQ ID NO: 9163537 - DNA, 18 bp, Homo sapiens
aggaagcaggaggaaggc

SEQ ID NO: 9163538 - DNA, 18 bp, Homo sapiens
aggaagcaggaggaaggc

SEQ ID NO: 9163539 - DNA, 22 bp, Homo sapiens
aggaagagcattcacatggtag

SEQ ID NO: 9163540 - DNA, 22 bp, Homo sapiens
aggaagccacgagtggcacggg

SEQ ID NO: 9163541 - DNA, 18 bp, Homo sapiens
aggaaagaaaggcaggtg

SEQ ID NO: 9163542 - DNA, 18 bp, Homo sapiens
aggaaagaaaggcaggtg

SEQ ID NO: 9163543 - DNA, 18 bp, Homo sapiens
aggaaagaaaggcaggtg

SEQ ID NO: 9163544 - DNA, 22 bp, Homo sapiens
aggaaagaaaggaggtgcattt

SEQ ID NO: 9163545 - DNA, 22 bp, Homo sapiens
aggaaactaacttatctttata

SEQ ID NO: 9163546 - DNA, 22 bp, Homo sapiens
aggaaactaattagtagaataa

SEQ ID NO: 9163547 - DNA, 22 bp, Homo sapiens
aggaaaaagagttgctgccttc

SEQ ID NO: 9163548 - DNA, 22 bp, Homo sapiens
aggaaactcccctacatctcaa

SEQ ID NO: 9163549 - DNA, 22 bp, Homo sapiens
aggaaactttcttttgcttcat

SEQ ID NO: 9163550 - DNA, 19 bp, Homo sapiens
aggaaactgtcttttccag

SEQ ID NO: 9163551 - DNA, 19 bp, Homo sapiens
aggaaactgtcttttccag

SEQ ID NO: 9163552 - DNA, 22 bp, Homo sapiens
aggaaactgatgttttttacaa

SEQ ID NO: 9163553 - DNA, 22 bp, Homo sapiens
agctttggttgccatgatctga

SEQ ID NO: 9163554 - DNA, 22 bp, Homo sapiens
agctttggttgaggggagtgtg

SEQ ID NO: 9163555 - DNA, 22 bp, Homo sapiens
agctttggttgaggggagtgtg

SEQ ID NO: 9163556 - DNA, 20 bp, Homo sapiens
agctttggttaagccagtgg

SEQ ID NO: 9163557 - DNA, 22 bp, Homo sapiens
agctttggtgctgtcacacaaa

SEQ ID NO: 9163558 - DNA, 22 bp, Homo sapiens
agctttggtgctgtcacacaaa

SEQ ID NO: 9163559 - DNA, 23 bp, Homo sapiens
agctttgtgaaagcagacatggg

SEQ ID NO: 9163560 - DNA, 22 bp, Homo sapiens
agctttgtttcacatacacctt

SEQ ID NO: 9163561 - DNA, 22 bp, Homo sapiens
agctttgtatttgagcatacga

SEQ ID NO: 9163562 - DNA, 22 bp, Homo sapiens
agcttcagtgtcaggcccgtgg

SEQ ID NO: 9163563 - DNA, 22 bp, Homo sapiens
agcttcataattccttgactca

SEQ ID NO: 9163564 - DNA, 22 bp, Homo sapiens
agcttcatctttatgtacagga

SEQ ID NO: 9163565 - DNA, 20 bp, Homo sapiens
agcttcattatagcccacag

SEQ ID NO: 9163566 - DNA, 22 bp, Homo sapiens
aggaaaaaagtctgtgattata

SEQ ID NO: 9163567 - DNA, 22 bp, Homo sapiens
aggaaaaaagtctgtgattata

SEQ ID NO: 9163568 - DNA, 22 bp, Homo sapiens
aggaaaaagagttgctgccttc

SEQ ID NO: 9163569 - DNA, 22 bp, Homo sapiens
aggaaaaagagttgctgccttc

SEQ ID NO: 9163570 - DNA, 22 bp, Homo sapiens
aggaaaaacctgttaatggtag

SEQ ID NO: 9163571 - DNA, 22 bp, Homo sapiens
aggaaaaacctgttaatggtag

SEQ ID NO: 9163572 - DNA, 22 bp, Homo sapiens
agctgggagctgaaggctgatt

SEQ ID NO: 9163573 - DNA, 22 bp, Homo sapiens
agctgggagctgaaggctgatt

SEQ ID NO: 9163574 - DNA, 22 bp, Homo sapiens
agctgggaggctcctctgtgac

SEQ ID NO: 9163575 - DNA, 22 bp, Homo sapiens
agctgggaggtgggcagtgaga

SEQ ID NO: 9163576 - DNA, 22 bp, Homo sapiens
agctgggaggtgggcagtgaga

SEQ ID NO: 9163577 - DNA, 22 bp, Homo sapiens
agctgggatgaggagcatcctt

SEQ ID NO: 9163578 - DNA, 22 bp, Homo sapiens
agctggttaagggtggagttaa

SEQ ID NO: 9163579 - DNA, 22 bp, Homo sapiens
agctgtgggcctgggagagctg

SEQ ID NO: 9163580 - DNA, 21 bp, Homo sapiens
agctgtggcgaggggaacatg

SEQ ID NO: 9163581 - DNA, 22 bp, Homo sapiens
agctggttcactaagcataata

SEQ ID NO: 9163582 - DNA, 22 bp, Homo sapiens
agctggttcagtttctgggcct

SEQ ID NO: 9163583 - DNA, 22 bp, Homo sapiens
agctgtggccagatgtgagcgg

SEQ ID NO: 9163584 - DNA, 22 bp, Homo sapiens
agctgtggggaggaggctagca

SEQ ID NO: 9163585 - DNA, 19 bp, Homo sapiens
agctgtggggcctagcacc

SEQ ID NO: 9163586 - DNA, 22 bp, Homo sapiens
agctgtggttctgggcagcgac

SEQ ID NO: 9163587 - DNA, 22 bp, Homo sapiens
agctgtgtaagtcatgtaggtg

SEQ ID NO: 9163588 - DNA, 22 bp, Homo sapiens
agctgtgtaagtcatgtaggtg

SEQ ID NO: 9163589 - DNA, 22 bp, Homo sapiens
agctgtggtgttttcaagccct

SEQ ID NO: 9163590 - DNA, 22 bp, Homo sapiens
agctgtggtgttttcaagccct

SEQ ID NO: 9163591 - DNA, 22 bp, Homo sapiens
agctgtggtgttttcaagccct

SEQ ID NO: 9163592 - DNA, 22 bp, Homo sapiens
agctgtggtcttcaagttgcct

SEQ ID NO: 9163593 - DNA, 22 bp, Homo sapiens
agcttcagcttgcagctgtgat

SEQ ID NO: 9163594 - DNA, 22 bp, Homo sapiens
agcttcagcttgcagctgtgat

SEQ ID NO: 9163595 - DNA, 22 bp, Homo sapiens
agcttcagggacttgtggcaga

SEQ ID NO: 9163596 - DNA, 20 bp, Homo sapiens
agcttcaggctcaagagaac

SEQ ID NO: 9163597 - DNA, 20 bp, Homo sapiens
agcttcaggctcaagagaac

SEQ ID NO: 9163598 - DNA, 22 bp, Homo sapiens
agcttattatcttatcaagctt

SEQ ID NO: 9163599 - DNA, 22 bp, Homo sapiens
agcttcaaggttcaaggatgct

SEQ ID NO: 9163600 - DNA, 22 bp, Homo sapiens
agctgtgtaggatcataacacg

SEQ ID NO: 9163601 - DNA, 22 bp, Homo sapiens
agcttattaccactccttgggg

SEQ ID NO: 9163602 - DNA, 22 bp, Homo sapiens
agcttattaatttttctgcatg

SEQ ID NO: 9163603 - DNA, 22 bp, Homo sapiens
agcttattaaaaacggattgct

SEQ ID NO: 9163604 - DNA, 22 bp, Homo sapiens
agcttatagatctctctgatat

SEQ ID NO: 9163605 - DNA, 22 bp, Homo sapiens
agcttatattctagtgatgcca

SEQ ID NO: 9163606 - DNA, 22 bp, Homo sapiens
agcttataatgtaactaaggac

SEQ ID NO: 9163607 - DNA, 21 bp, Homo sapiens
agctgctgtggccagaatcca

SEQ ID NO: 9163608 - DNA, 22 bp, Homo sapiens
agctgctgtggccacatctggc

SEQ ID NO: 9163609 - DNA, 22 bp, Homo sapiens
agctgctgtgtgctcaggcagg

SEQ ID NO: 9163610 - DNA, 22 bp, Homo sapiens
agctgctgtggggctcggcctg

SEQ ID NO: 9163611 - DNA, 22 bp, Homo sapiens
agctgctgtttcttgcacgtat

SEQ ID NO: 9163612 - DNA, 22 bp, Homo sapiens
agctgctgtgtgctcaggcagg

SEQ ID NO: 9163613 - DNA, 23 bp, Homo sapiens
agctgctgggcctgccgtggcct

SEQ ID NO: 9163614 - DNA, 22 bp, Homo sapiens
agctgctggggagggcagacac

SEQ ID NO: 9163615 - DNA, 22 bp, Homo sapiens
agctgctgtggccacatctggc

SEQ ID NO: 9163616 - DNA, 22 bp, Homo sapiens
agctgctgtcctaggcactgta

SEQ ID NO: 9163617 - DNA, 22 bp, Homo sapiens
agctgctgtcctaggcactgta

SEQ ID NO: 9163618 - DNA, 22 bp, Homo sapiens
acagccccccgctcagtttcca

SEQ ID NO: 9163619 - DNA, 22 bp, Homo sapiens
acagcccaggactccagtgggc

SEQ ID NO: 9163620 - DNA, 22 bp, Homo sapiens
acagcccaggactccagtgggc

SEQ ID NO: 9163621 - DNA, 22 bp, Homo sapiens
acagcccaggactccagtgggc

SEQ ID NO: 9163622 - DNA, 22 bp, Homo sapiens
acagcccagaaagcctaagggg

SEQ ID NO: 9163623 - DNA, 22 bp, Homo sapiens
acagcccagaaagcctaagggg

SEQ ID NO: 9163624 - DNA, 22 bp, Homo sapiens
acagcccagctctttctctgca

SEQ ID NO: 9163625 - DNA, 22 bp, Homo sapiens
agctggccttcggtgtcactgg

SEQ ID NO: 9163626 - DNA, 22 bp, Homo sapiens
agctggctatgccctgtgaacc

SEQ ID NO: 9163627 - DNA, 21 bp, Homo sapiens
agctggctctctctggagaga

SEQ ID NO: 9163628 - DNA, 22 bp, Homo sapiens
acagcctgatttatggagcagt

SEQ ID NO: 9163629 - DNA, 22 bp, Homo sapiens
acagcctgatttatggagcagt

SEQ ID NO: 9163630 - DNA, 22 bp, Homo sapiens
acagcctgagagtggagctggc

SEQ ID NO: 9163631 - DNA, 22 bp, Homo sapiens
agctggcagctctcaggggtac

SEQ ID NO: 9163632 - DNA, 22 bp, Homo sapiens
acagcctgatttatggagcagt

SEQ ID NO: 9163633 - DNA, 22 bp, Homo sapiens
acagcctgcagccccaggtcgc

SEQ ID NO: 9163634 - DNA, 22 bp, Homo sapiens
agctggcaggggttcacactgc

SEQ ID NO: 9163635 - DNA, 23 bp, Homo sapiens
acagccagttcacctctccttgg

SEQ ID NO: 9163636 - DNA, 23 bp, Homo sapiens
acagccagttcacctctccttgg

SEQ ID NO: 9163637 - DNA, 22 bp, Homo sapiens
acagcccaagtcacctgcagga

SEQ ID NO: 9163638 - DNA, 22 bp, Homo sapiens
acagcccaagtcacctgcagga

SEQ ID NO: 9163639 - DNA, 22 bp, Homo sapiens
agctgcagccgcagctgtggcc

SEQ ID NO: 9163640 - DNA, 22 bp, Homo sapiens
agctgcagcctcatgattcggt

SEQ ID NO: 9163641 - DNA, 22 bp, Homo sapiens
acagcccaagtcacctgcagga

SEQ ID NO: 9163642 - DNA, 22 bp, Homo sapiens
agctgcagccctcctgcatggc

SEQ ID NO: 9163643 - DNA, 22 bp, Homo sapiens
agctgcaggattatggaatgga

SEQ ID NO: 9163644 - DNA, 22 bp, Homo sapiens
agctgcaggattatggaatgga

SEQ ID NO: 9163645 - DNA, 22 bp, Homo sapiens
agctgcaggagtcgcctaggat

SEQ ID NO: 9163646 - DNA, 22 bp, Homo sapiens
agctgcagcttcctagtccagc

SEQ ID NO: 9163647 - DNA, 22 bp, Homo sapiens
agctgcaggaagtagaagcgga

SEQ ID NO: 9163648 - DNA, 22 bp, Homo sapiens
agctgcagcgttcatttttcca

SEQ ID NO: 9163649 - DNA, 22 bp, Homo sapiens
agctgcagctgttttctgagtg

SEQ ID NO: 9163650 - DNA, 22 bp, Homo sapiens
acagccagtaaggaaagaccca

SEQ ID NO: 9163651 - DNA, 22 bp, Homo sapiens
acagccagtaatctacccctgt

SEQ ID NO: 9163652 - DNA, 22 bp, Homo sapiens
agctcccagaagccagagtcgg

SEQ ID NO: 9163653 - DNA, 22 bp, Homo sapiens
agctccaggtgcaagtcatggt

SEQ ID NO: 9163654 - DNA, 22 bp, Homo sapiens
agctccaggtgcaagtcatggt

SEQ ID NO: 9163655 - DNA, 20 bp, Homo sapiens
agctccagtgctgacgcttc

SEQ ID NO: 9163656 - DNA, 20 bp, Homo sapiens
agctccagtgctgacgcttc

SEQ ID NO: 9163657 - DNA, 20 bp, Homo sapiens
agctccagtgctgacgcttc

SEQ ID NO: 9163658 - DNA, 22 bp, Homo sapiens
agctccaggtgcaagtcatggt

SEQ ID NO: 9163659 - DNA, 22 bp, Homo sapiens
agctccaggtgcaagtcatggt

SEQ ID NO: 9163660 - DNA, 22 bp, Homo sapiens
actgcatttggtaaagtcaaga

SEQ ID NO: 9163661 - DNA, 22 bp, Homo sapiens
actgcagcctagggaccacagt

SEQ ID NO: 9163662 - DNA, 22 bp, Homo sapiens
actgcagcaggtaagagcattt

SEQ ID NO: 9163663 - DNA, 22 bp, Homo sapiens
agtgctgaacatagaatggaca

SEQ ID NO: 9163664 - DNA, 21 bp, Homo sapiens
agtgctgaaaaagcatgtctc

SEQ ID NO: 9163665 - DNA, 22 bp, Homo sapiens
actgcacttcaccctgggtgac

SEQ ID NO: 9163666 - DNA, 22 bp, Homo sapiens
actgcacttcaccctgggtgac

SEQ ID NO: 9163667 - DNA, 22 bp, Homo sapiens
actgcactccagcctgggtgat

SEQ ID NO: 9163668 - DNA, 22 bp, Homo sapiens
actgcactccagcctgggtgat

SEQ ID NO: 9163669 - DNA, 22 bp, Homo sapiens
actgcactcctgcctgggtaac

SEQ ID NO: 9163670 - DNA, 22 bp, Homo sapiens
actgcactcctgcctgggtaac

SEQ ID NO: 9163671 - DNA, 22 bp, Homo sapiens
actgcactcctgcctgggtaac

SEQ ID NO: 9163672 - DNA, 22 bp, Homo sapiens
agtgaatatttttagacaccca

SEQ ID NO: 9163673 - DNA, 22 bp, Homo sapiens
agtgaagtaaaagatgtgcatc

SEQ ID NO: 9163674 - DNA, 21 bp, Homo sapiens
agtgaagagtgaaacacatgg

SEQ ID NO: 9163675 - DNA, 22 bp, Homo sapiens
agtgaagatatactgttgtcct

SEQ ID NO: 9163676 - DNA, 22 bp, Homo sapiens
agtgaaggtttacagggcccct

SEQ ID NO: 9163677 - DNA, 22 bp, Homo sapiens
actgagatgctggatgaccctg

SEQ ID NO: 9163678 - DNA, 22 bp, Homo sapiens
actgagatgagttgcatagatt

SEQ ID NO: 9163679 - DNA, 22 bp, Homo sapiens
actgagcaatgcagtgggagcg

SEQ ID NO: 9163680 - DNA, 22 bp, Homo sapiens
actgagatgaatagatggcaag

SEQ ID NO: 9163681 - DNA, 21 bp, Homo sapiens
actgagagatgttggatcata

SEQ ID NO: 9163682 - DNA, 22 bp, Homo sapiens
actgagagcgtgtacaaactta

SEQ ID NO: 9163683 - DNA, 22 bp, Homo sapiens
actgagagtcaagatagcatgg

SEQ ID NO: 9163684 - DNA, 22 bp, Homo sapiens
agtgaagaggaagtggggcaca

SEQ ID NO: 9163685 - DNA, 22 bp, Homo sapiens
agtgaacaaaggtagtgagcat

SEQ ID NO: 9163686 - DNA, 22 bp, Homo sapiens
agtgaaatttgtttagataggt

SEQ ID NO: 9163687 - DNA, 22 bp, Homo sapiens
actgaatttgtgtagatggtct

SEQ ID NO: 9163688 - DNA, 21 bp, Homo sapiens
actctgccagtctcctgcact

SEQ ID NO: 9163689 - DNA, 21 bp, Homo sapiens
actctgaaaattaatagttat

SEQ ID NO: 9163690 - DNA, 22 bp, Homo sapiens
actctgaaccaattcgcaatga

SEQ ID NO: 9163691 - DNA, 22 bp, Homo sapiens
actctgaaatagaggctggtgg

SEQ ID NO: 9163692 - DNA, 22 bp, Homo sapiens
actctgaattaattgctctcaa

SEQ ID NO: 9163693 - DNA, 22 bp, Homo sapiens
actctgaatgtgcatgtaaatc

SEQ ID NO: 9163694 - DNA, 22 bp, Homo sapiens
actggctggactctgacctctt

SEQ ID NO: 9163695 - DNA, 22 bp, Homo sapiens
actggctggactctgacctctt

SEQ ID NO: 9163696 - DNA, 22 bp, Homo sapiens
actggctggagttgccaaggct

SEQ ID NO: 9163697 - DNA, 22 bp, Homo sapiens
actggctgatcacctgcctcag

SEQ ID NO: 9163698 - DNA, 22 bp, Homo sapiens
actggcatctgtgggtagaggc

SEQ ID NO: 9163699 - DNA, 22 bp, Homo sapiens
actggcatctgtgggtagaggc

SEQ ID NO: 9163700 - DNA, 22 bp, Homo sapiens
actggcattccagcactataat

SEQ ID NO: 9163701 - DNA, 19 bp, Homo sapiens
actgcctgaggctcacagg

SEQ ID NO: 9163702 - DNA, 22 bp, Homo sapiens
actgcctggcctggcctcactg

SEQ ID NO: 9163703 - DNA, 22 bp, Homo sapiens
actgcctcttggtgctgagaga

SEQ ID NO: 9163704 - DNA, 22 bp, Homo sapiens
actgcctcttggtgctgagaga

SEQ ID NO: 9163705 - DNA, 22 bp, Homo sapiens
actgcctgagctattggaaaag

SEQ ID NO: 9163706 - DNA, 22 bp, Homo sapiens
actgccctgtaactgccaggta

SEQ ID NO: 9163707 - DNA, 22 bp, Homo sapiens
actgccctgtaactgccaggta

SEQ ID NO: 9163708 - DNA, 22 bp, Homo sapiens
actgcccttgtcctggcacacc

SEQ ID NO: 9163709 - DNA, 22 bp, Homo sapiens
actgcccagaagagatgaaagt

SEQ ID NO: 9163710 - DNA, 21 bp, Homo sapiens
actgcccaccagttaacgctg

SEQ ID NO: 9163711 - DNA, 22 bp, Homo sapiens
actgcccaggaatctcaaagaa

SEQ ID NO: 9163712 - DNA, 22 bp, Homo sapiens
actgcccatgtgcatcaagtag

SEQ ID NO: 9163713 - DNA, 22 bp, Homo sapiens
actgcccagtgattggtggtta

SEQ ID NO: 9163714 - DNA, 22 bp, Homo sapiens
actgcccattatggtagtcact

SEQ ID NO: 9163715 - DNA, 22 bp, Homo sapiens
actgccctccagcctgggtgac

SEQ ID NO: 9163716 - DNA, 22 bp, Homo sapiens
actgcccattaaaggtgctttg

SEQ ID NO: 9163717 - DNA, 22 bp, Homo sapiens
actgccctcccatctattgcaa

SEQ ID NO: 9163718 - DNA, 22 bp, Homo sapiens
actgccctggagacagcagagt

SEQ ID NO: 9163719 - DNA, 22 bp, Homo sapiens
actgcccacagtgaatggttgg

SEQ ID NO: 9163720 - DNA, 22 bp, Homo sapiens
actgcccacatctctttccgct

SEQ ID NO: 9163721 - DNA, 22 bp, Homo sapiens
actgccagtattcacgttcctg

SEQ ID NO: 9163722 - DNA, 22 bp, Homo sapiens
actgccaggtaagtgctcctgc

SEQ ID NO: 9163723 - DNA, 22 bp, Homo sapiens
actgccaggtgctccatctgaa

SEQ ID NO: 9163724 - DNA, 22 bp, Homo sapiens
actgccaggccagtagaacata

SEQ ID NO: 9163725 - DNA, 22 bp, Homo sapiens
actgccaatggtagtttgatgg

SEQ ID NO: 9163726 - DNA, 22 bp, Homo sapiens
actgccaatggtagtttgatgg

SEQ ID NO: 9163727 - DNA, 22 bp, Homo sapiens
actgccaatggtagtttgatgg

SEQ ID NO: 9163728 - DNA, 22 bp, Homo sapiens
actgccagaggaggtatctgaa

SEQ ID NO: 9163729 - DNA, 23 bp, Homo sapiens
actgccagattgaaggtttctta

SEQ ID NO: 9163730 - DNA, 22 bp, Homo sapiens
actgggcaccatcatgagatgg

SEQ ID NO: 9163731 - DNA, 22 bp, Homo sapiens
actgggcaccatcatgagatgg

SEQ ID NO: 9163732 - DNA, 22 bp, Homo sapiens
actgggaggcaaagagcaagga

SEQ ID NO: 9163733 - DNA, 22 bp, Homo sapiens
actgggaggcaaagagcaagga

SEQ ID NO: 9163734 - DNA, 22 bp, Homo sapiens
actggctgtgtaacctcaggca

SEQ ID NO: 9163735 - DNA, 22 bp, Homo sapiens
actggcttcaaaccgtttcacc

SEQ ID NO: 9163736 - DNA, 22 bp, Homo sapiens
agtgtcctggcaagggtttcag

SEQ ID NO: 9163737 - DNA, 22 bp, Homo sapiens
actggcttgaagtagattcaaa

SEQ ID NO: 9163738 - DNA, 22 bp, Homo sapiens
actggcttcagggggaaagtcc

SEQ ID NO: 9163739 - DNA, 22 bp, Homo sapiens
actggcttggcaggaggaagat

SEQ ID NO: 9163740 - DNA, 22 bp, Homo sapiens
actggcttggcaggaggaagat

SEQ ID NO: 9163741 - DNA, 22 bp, Homo sapiens
actgggcctggattggcgtgtc

SEQ ID NO: 9163742 - DNA, 22 bp, Homo sapiens
actgggcctgtacagagaaaac

SEQ ID NO: 9163743 - DNA, 22 bp, Homo sapiens
actgggccgcgctgcagagggc

SEQ ID NO: 9163744 - DNA, 22 bp, Homo sapiens
actgggccagatcagagcaact

SEQ ID NO: 9163745 - DNA, 22 bp, Homo sapiens
actgggccagacactgattccc

SEQ ID NO: 9163746 - DNA, 22 bp, Homo sapiens
actgggcatcccatggcagagc

SEQ ID NO: 9163747 - DNA, 20 bp, Homo sapiens
actgggcatacctgtcctgt

SEQ ID NO: 9163748 - DNA, 20 bp, Homo sapiens
actgggcatacctgtcctgt

SEQ ID NO: 9163749 - DNA, 22 bp, Homo sapiens
actgggcagggaaggagaccga

SEQ ID NO: 9163750 - DNA, 22 bp, Homo sapiens
actgggcattttgaacgttctt

SEQ ID NO: 9163751 - DNA, 22 bp, Homo sapiens
agtatacagtaatgacatatct

SEQ ID NO: 9163752 - DNA, 22 bp, Homo sapiens
agtatacagtaatgacatatct

SEQ ID NO: 9163753 - DNA, 22 bp, Homo sapiens
actccaggggttgctatttaca

SEQ ID NO: 9163754 - DNA, 22 bp, Homo sapiens
agtatacaaataaatgtgtaat

SEQ ID NO: 9163755 - DNA, 22 bp, Homo sapiens
agtagtttgggcagtgacagat

SEQ ID NO: 9163756 - DNA, 22 bp, Homo sapiens
agtagtttttaagaggtataaa

SEQ ID NO: 9163757 - DNA, 21 bp, Homo sapiens
agtagtttagcacagggtttg

SEQ ID NO: 9163758 - DNA, 21 bp, Homo sapiens
agtagtttagcacagggtttg

SEQ ID NO: 9163759 - DNA, 22 bp, Homo sapiens
agtagtgaacagccacaggatt

SEQ ID NO: 9163760 - DNA, 22 bp, Homo sapiens
agtagaaagttgcaggaggaat

SEQ ID NO: 9163761 - DNA, 22 bp, Homo sapiens
agtacttttttgatatctgagt

SEQ ID NO: 9163762 - DNA, 22 bp, Homo sapiens
agtactttacttcttacagttt

SEQ ID NO: 9163763 - DNA, 22 bp, Homo sapiens
agtactttgcactttgctcaga

SEQ ID NO: 9163764 - DNA, 22 bp, Homo sapiens
agtaataatagctgtaaagtgc

SEQ ID NO: 9163765 - DNA, 22 bp, Homo sapiens
agtaataatagtagccggcatt

SEQ ID NO: 9163766 - DNA, 21 bp, Homo sapiens
agtacatctcaaatgtaaatc

SEQ ID NO: 9163767 - DNA, 22 bp, Homo sapiens
agtacatttattaatggtaaaa

SEQ ID NO: 9163768 - DNA, 22 bp, Homo sapiens
agtacccttttcactgtcacaa

SEQ ID NO: 9163769 - DNA, 23 bp, Homo sapiens
agtacatttgacccaaataagct

SEQ ID NO: 9163770 - DNA, 23 bp, Homo sapiens
agtacatttgacccaaataagct

SEQ ID NO: 9163771 - DNA, 22 bp, Homo sapiens
aggtggggaaaccagcgatccc

SEQ ID NO: 9163772 - DNA, 22 bp, Homo sapiens
aggtggggaaaccagcgatccc

SEQ ID NO: 9163773 - DNA, 22 bp, Homo sapiens
aggtgggcggattcatgaggtc

SEQ ID NO: 9163774 - DNA, 22 bp, Homo sapiens
actccagggttttgcacctgga

SEQ ID NO: 9163775 - DNA, 22 bp, Homo sapiens
actccagggtgactctgtctga

SEQ ID NO: 9163776 - DNA, 22 bp, Homo sapiens
actccagggtgactctgtctga

SEQ ID NO: 9163777 - DNA, 22 bp, Homo sapiens
actccagggtgactctgtctga

SEQ ID NO: 9163778 - DNA, 22 bp, Homo sapiens
actccagggtgactctgtctga

SEQ ID NO: 9163779 - DNA, 22 bp, Homo sapiens
actccagggtgactctgtctga

SEQ ID NO: 9163780 - DNA, 22 bp, Homo sapiens
actccctccaaatctgcacagt

SEQ ID NO: 9163781 - DNA, 22 bp, Homo sapiens
actcctgccacacagatgctgt

SEQ ID NO: 9163782 - DNA, 22 bp, Homo sapiens
actcccttggtggagaatgcaa

SEQ ID NO: 9163783 - DNA, 22 bp, Homo sapiens
agtcaccatctgtggcagcctg

SEQ ID NO: 9163784 - DNA, 22 bp, Homo sapiens
agtcacccaggtgtgatggatg

SEQ ID NO: 9163785 - DNA, 22 bp, Homo sapiens
actcctggggctgccatcacag

SEQ ID NO: 9163786 - DNA, 22 bp, Homo sapiens
agtcactgtttcagaactgagt

SEQ ID NO: 9163787 - DNA, 22 bp, Homo sapiens
agtcactgtttcagaactgagt

SEQ ID NO: 9163788 - DNA, 22 bp, Homo sapiens
agtcactgggctgcttcctata

SEQ ID NO: 9163789 - DNA, 22 bp, Homo sapiens
agtcactgggctgcttcctata

SEQ ID NO: 9163790 - DNA, 22 bp, Homo sapiens
actctcccttggagcctcaggc

SEQ ID NO: 9163791 - DNA, 22 bp, Homo sapiens
actctctgtctaaatgcagttt

SEQ ID NO: 9163792 - DNA, 22 bp, Homo sapiens
actctctgtggttctactttgc

SEQ ID NO: 9163793 - DNA, 22 bp, Homo sapiens
actctctgtgatggaggccagc

SEQ ID NO: 9163794 - DNA, 22 bp, Homo sapiens
actctctgggcatgccccacca

SEQ ID NO: 9163795 - DNA, 22 bp, Homo sapiens
actctctggtattggcaagttt

SEQ ID NO: 9163796 - DNA, 22 bp, Homo sapiens
actctctggtgtagaaagacct

SEQ ID NO: 9163797 - DNA, 22 bp, Homo sapiens
actctctgagctaccaggtgag

SEQ ID NO: 9163798 - DNA, 22 bp, Homo sapiens
actaaatatttgagaggtgtag

SEQ ID NO: 9163799 - DNA, 22 bp, Homo sapiens
actaaatatttgagaggtgtag

SEQ ID NO: 9163800 - DNA, 22 bp, Homo sapiens
actacagtactatatctatagg

SEQ ID NO: 9163801 - DNA, 22 bp, Homo sapiens
aggtgactggtttatctggcag

SEQ ID NO: 9163802 - DNA, 22 bp, Homo sapiens
actacatttctcagtacctgaa

SEQ ID NO: 9163803 - DNA, 22 bp, Homo sapiens
actagaaaattcctagaaacta

SEQ ID NO: 9163804 - DNA, 22 bp, Homo sapiens
actagaaactaatggattatta

SEQ ID NO: 9163805 - DNA, 22 bp, Homo sapiens
actagaaagcactaagctaggc

SEQ ID NO: 9163806 - DNA, 22 bp, Homo sapiens
aggtgggcactccgctcgaggt

SEQ ID NO: 9163807 - DNA, 22 bp, Homo sapiens
aggtgaatgctcacattctaat

SEQ ID NO: 9163808 - DNA, 22 bp, Homo sapiens
aggtgaatgcctgaggcctctg

SEQ ID NO: 9163809 - DNA, 22 bp, Homo sapiens
accttttttcagaactctaaag

SEQ ID NO: 9163810 - DNA, 22 bp, Homo sapiens
acctttttccaaagcttcttac

SEQ ID NO: 9163811 - DNA, 22 bp, Homo sapiens
acctttatgtttgattacaatt

SEQ ID NO: 9163812 - DNA, 22 bp, Homo sapiens
acctttcaaagtggctatcact

SEQ ID NO: 9163813 - DNA, 20 bp, Homo sapiens
acctttcaaatgattcagca

SEQ ID NO: 9163814 - DNA, 21 bp, Homo sapiens
aggtccagttctgtcttggac

SEQ ID NO: 9163815 - DNA, 22 bp, Homo sapiens
acctttccaagtatcaggtggt

SEQ ID NO: 9163816 - DNA, 22 bp, Homo sapiens
acctttcacggtatcagacatc

SEQ ID NO: 9163817 - DNA, 22 bp, Homo sapiens
acctttcattaaagtctgtagt

SEQ ID NO: 9163818 - DNA, 22 bp, Homo sapiens
acctttcattaaagtctgtagt

SEQ ID NO: 9163819 - DNA, 22 bp, Homo sapiens
aggtccaggttccgtttctgcg

SEQ ID NO: 9163820 - DNA, 22 bp, Homo sapiens
aggtccagactgtgtaccctag

SEQ ID NO: 9163821 - DNA, 22 bp, Homo sapiens
acccttccaaatgagcttatta

SEQ ID NO: 9163822 - DNA, 22 bp, Homo sapiens
acccttggttttgcagagctgt

SEQ ID NO: 9163823 - DNA, 22 bp, Homo sapiens
acccttcatagaggagaagctg

SEQ ID NO: 9163824 - DNA, 22 bp, Homo sapiens
accctgtgtcacagtggcctgt

SEQ ID NO: 9163825 - DNA, 22 bp, Homo sapiens
accctgtgcagagaagtgagcg

SEQ ID NO: 9163826 - DNA, 22 bp, Homo sapiens
aggtatttcatggagcaagcag

SEQ ID NO: 9163827 - DNA, 22 bp, Homo sapiens
aggtatttcccaaagtggcatg

SEQ ID NO: 9163828 - DNA, 22 bp, Homo sapiens
aggtatttcctttaaagaaact

SEQ ID NO: 9163829 - DNA, 22 bp, Homo sapiens
aggtatttgttatttgagagtg

SEQ ID NO: 9163830 - DNA, 22 bp, Homo sapiens
aggtatttgtctcagattgggt

SEQ ID NO: 9163831 - DNA, 20 bp, Homo sapiens
aggtcaacacctagtaagtg

SEQ ID NO: 9163832 - DNA, 22 bp, Homo sapiens
aggtcaaaagcaaggccaggtt

SEQ ID NO: 9163833 - DNA, 22 bp, Homo sapiens
aggtcaaaatcaggcagggaag

SEQ ID NO: 9163834 - DNA, 23 bp, Homo sapiens
aggtcaaccacaagctgacaaac

SEQ ID NO: 9163835 - DNA, 22 bp, Homo sapiens
acttggttgcttctgaaatgac

SEQ ID NO: 9163836 - DNA, 22 bp, Homo sapiens
actttaaaactgatcatcagag

SEQ ID NO: 9163837 - DNA, 22 bp, Homo sapiens
actttaaaactgatcatcagag

SEQ ID NO: 9163838 - DNA, 22 bp, Homo sapiens
atacaaagacaaatctcaatct

SEQ ID NO: 9163839 - DNA, 22 bp, Homo sapiens
acttggttgatgtcataaggtt

SEQ ID NO: 9163840 - DNA, 22 bp, Homo sapiens
acttggttgcaaatgaattatt

SEQ ID NO: 9163841 - DNA, 22 bp, Homo sapiens
acttggttgatgtcataaggtt

SEQ ID NO: 9163842 - DNA, 22 bp, Homo sapiens
atacaaaatatatactggagac

SEQ ID NO: 9163843 - DNA, 22 bp, Homo sapiens
atacaaaatatatactggagac

SEQ ID NO: 9163844 - DNA, 22 bp, Homo sapiens
atacaaaatatatactggagac

SEQ ID NO: 9163845 - DNA, 22 bp, Homo sapiens
atacaaaaattagccgggagta

SEQ ID NO: 9163846 - DNA, 22 bp, Homo sapiens
atacaaaaattagccgggagta

SEQ ID NO: 9163847 - DNA, 22 bp, Homo sapiens
atacaaaaattagccgggagta

SEQ ID NO: 9163848 - DNA, 22 bp, Homo sapiens
acttctctccacccaagtccct

SEQ ID NO: 9163849 - DNA, 21 bp, Homo sapiens
actttacaatttacatagtga

SEQ ID NO: 9163850 - DNA, 20 bp, Homo sapiens
actttacagagaagactgac

SEQ ID NO: 9163851 - DNA, 22 bp, Homo sapiens
actttacacatcttttctcatt

SEQ ID NO: 9163852 - DNA, 22 bp, Homo sapiens
atacatcacctatatattcaca

SEQ ID NO: 9163853 - DNA, 22 bp, Homo sapiens
atacatcatgctccatatattt

SEQ ID NO: 9163854 - DNA, 22 bp, Homo sapiens
actttacaaactcctcactgtt

SEQ ID NO: 9163855 - DNA, 22 bp, Homo sapiens
actttaaggaggcactcatctc

SEQ ID NO: 9163856 - DNA, 23 bp, Homo sapiens
acttttcaattagctatgcttaa

SEQ ID NO: 9163857 - DNA, 22 bp, Homo sapiens
actttgtgcccaacagaaagaa

SEQ ID NO: 9163858 - DNA, 22 bp, Homo sapiens
actttgtataagacaataaaga

SEQ ID NO: 9163859 - DNA, 22 bp, Homo sapiens
atagatattagcaaaattttat

SEQ ID NO: 9163860 - DNA, 22 bp, Homo sapiens
actttggacgccatgctgtttg

SEQ ID NO: 9163861 - DNA, 22 bp, Homo sapiens
actttggacaatttattactgt

SEQ ID NO: 9163862 - DNA, 22 bp, Homo sapiens
actttgggaagctgcaattgcc

SEQ ID NO: 9163863 - DNA, 22 bp, Homo sapiens
atagagtgatgtaaggtatgtg

SEQ ID NO: 9163864 - DNA, 22 bp, Homo sapiens
atagataatgtgtagcagtgat

SEQ ID NO: 9163865 - DNA, 22 bp, Homo sapiens
atagagttttattttccaataa

SEQ ID NO: 9163866 - DNA, 22 bp, Homo sapiens
actttgcaaggtactaactgta

SEQ ID NO: 9163867 - DNA, 22 bp, Homo sapiens
atacatctagagtcataaaaac

SEQ ID NO: 9163868 - DNA, 22 bp, Homo sapiens
atacatcatttcccatcaatcg

SEQ ID NO: 9163869 - DNA, 22 bp, Homo sapiens
actttgccccaaagaagttggt

SEQ ID NO: 9163870 - DNA, 22 bp, Homo sapiens
actttgcccagaactgtcccag

SEQ ID NO: 9163871 - DNA, 22 bp, Homo sapiens
actttgccattgcaaatacaca

SEQ ID NO: 9163872 - DNA, 22 bp, Homo sapiens
actttgcccagaactgtcccag

SEQ ID NO: 9163873 - DNA, 22 bp, Homo sapiens
actttgccattgcaaatacaca

SEQ ID NO: 9163874 - DNA, 22 bp, Homo sapiens
actttgccacattctttaggcc

SEQ ID NO: 9163875 - DNA, 22 bp, Homo sapiens
actttgccatgttgtatgacta

SEQ ID NO: 9163876 - DNA, 22 bp, Homo sapiens
actttgccatgttgtatgacta

SEQ ID NO: 9163877 - DNA, 22 bp, Homo sapiens
actttgccacattctttaggcc

SEQ ID NO: 9163878 - DNA, 22 bp, Homo sapiens
actttgcagagccagaagagaa

SEQ ID NO: 9163879 - DNA, 22 bp, Homo sapiens
actttgctgcaggtttaaagag

SEQ ID NO: 9163880 - DNA, 22 bp, Homo sapiens
actttgccctacagcagctctg

SEQ ID NO: 9163881 - DNA, 22 bp, Homo sapiens
actttgcctacaagcccatggt

SEQ ID NO: 9163882 - DNA, 22 bp, Homo sapiens
actttgccctacagcagctctg

SEQ ID NO: 9163883 - DNA, 22 bp, Homo sapiens
actttgcctacaagcccatggt

SEQ ID NO: 9163884 - DNA, 22 bp, Homo sapiens
actttgccccaggtctcatgac

SEQ ID NO: 9163885 - DNA, 22 bp, Homo sapiens
actttgccccaaagaagttggt

SEQ ID NO: 9163886 - DNA, 22 bp, Homo sapiens
actttgccccaggtctcatgac

SEQ ID NO: 9163887 - DNA, 22 bp, Homo sapiens
actttgctcatattgagtttct

SEQ ID NO: 9163888 - DNA, 22 bp, Homo sapiens
actttgccttcttactgtgttg

SEQ ID NO: 9163889 - DNA, 22 bp, Homo sapiens
actttgccttcttactgtgttg

SEQ ID NO: 9163890 - DNA, 22 bp, Homo sapiens
actttgccttcttactgtgttg

SEQ ID NO: 9163891 - DNA, 22 bp, Homo sapiens
actttgcctccttgatagtttc

SEQ ID NO: 9163892 - DNA, 22 bp, Homo sapiens
actttgcctccttgatagtttc

SEQ ID NO: 9163893 - DNA, 22 bp, Homo sapiens
actgggctcccaggcttgtcat

SEQ ID NO: 9163894 - DNA, 22 bp, Homo sapiens
actgggctcataatgtcataga

SEQ ID NO: 9163895 - DNA, 22 bp, Homo sapiens
actgggctccagatgtgatacg

SEQ ID NO: 9163896 - DNA, 22 bp, Homo sapiens
actgggctccaaggacctggag

SEQ ID NO: 9163897 - DNA, 22 bp, Homo sapiens
actgggctcataatgtcataga

SEQ ID NO: 9163898 - DNA, 21 bp, Homo sapiens
actgggctagcctgacttctg

SEQ ID NO: 9163899 - DNA, 22 bp, Homo sapiens
actgggctcaagtgattgtcct

SEQ ID NO: 9163900 - DNA, 22 bp, Homo sapiens
actgggctagagtggaagctgg

SEQ ID NO: 9163901 - DNA, 22 bp, Homo sapiens
actgggctaccccaccattacc

SEQ ID NO: 9163902 - DNA, 22 bp, Homo sapiens
actgggccttgtgtgtctcatc

SEQ ID NO: 9163903 - DNA, 22 bp, Homo sapiens
agttttatggctcaacctaata

SEQ ID NO: 9163904 - DNA, 22 bp, Homo sapiens
agttttataaaggcacctcagt

SEQ ID NO: 9163905 - DNA, 21 bp, Homo sapiens
agttttatattataagctaaa

SEQ ID NO: 9163906 - DNA, 22 bp, Homo sapiens
ataaaaactgacccatcctttg

SEQ ID NO: 9163907 - DNA, 22 bp, Homo sapiens
ataaaaactgacccatcctttg

SEQ ID NO: 9163908 - DNA, 22 bp, Homo sapiens
actgttcaagcaaatgacattg

SEQ ID NO: 9163909 - DNA, 22 bp, Homo sapiens
actgttgtcaggctgctttgga

SEQ ID NO: 9163910 - DNA, 22 bp, Homo sapiens
actgttgtcaggctgctttgga

SEQ ID NO: 9163911 - DNA, 22 bp, Homo sapiens
agtttttctcccctggcttcat

SEQ ID NO: 9163912 - DNA, 23 bp, Homo sapiens
agtttttctgcatggttctgtat

SEQ ID NO: 9163913 - DNA, 22 bp, Homo sapiens
agtttttctcccctggcttcat

SEQ ID NO: 9163914 - DNA, 22 bp, Homo sapiens
agtttttgagaatttactatgt

SEQ ID NO: 9163915 - DNA, 22 bp, Homo sapiens
agtttttcctgattttacagaa

SEQ ID NO: 9163916 - DNA, 18 bp, Homo sapiens
agtttttaggaagaaatg

SEQ ID NO: 9163917 - DNA, 18 bp, Homo sapiens
agtttttaggaagaaatg

SEQ ID NO: 9163918 - DNA, 22 bp, Homo sapiens
agttttatgtagacaattcatt

SEQ ID NO: 9163919 - DNA, 22 bp, Homo sapiens
agttttatggctcaacctaata

SEQ ID NO: 9163920 - DNA, 23 bp, Homo sapiens
agtttttaatggtcatagctgag

SEQ ID NO: 9163921 - DNA, 23 bp, Homo sapiens
agtttttaatggtcatagctgag

SEQ ID NO: 9163922 - DNA, 18 bp, Homo sapiens
ataaagtgctaataatgg

SEQ ID NO: 9163923 - DNA, 18 bp, Homo sapiens
ataaagtgctaataatgg

SEQ ID NO: 9163924 - DNA, 22 bp, Homo sapiens
ataaagtcatttcaaaagttga

SEQ ID NO: 9163925 - DNA, 22 bp, Homo sapiens
actgtttctcaaattatgtggt

SEQ ID NO: 9163926 - DNA, 22 bp, Homo sapiens
actgttttcctaatgagcaaga

SEQ ID NO: 9163927 - DNA, 22 bp, Homo sapiens
actgttttctgtaaagggccag

SEQ ID NO: 9163928 - DNA, 22 bp, Homo sapiens
acttaaaaacagatccagcagg

SEQ ID NO: 9163929 - DNA, 22 bp, Homo sapiens
actgttttcttagctccctgct

SEQ ID NO: 9163930 - DNA, 22 bp, Homo sapiens
acttaaaaagaatcttttcacg

SEQ ID NO: 9163931 - DNA, 22 bp, Homo sapiens
acttctaatcagaaggtctggt

SEQ ID NO: 9163932 - DNA, 22 bp, Homo sapiens
acttccttgtcaggtgcatcat

SEQ ID NO: 9163933 - DNA, 22 bp, Homo sapiens
acttccttttcaaccatacagc

SEQ ID NO: 9163934 - DNA, 22 bp, Homo sapiens
acttccttccaaacattcattt

SEQ ID NO: 9163935 - DNA, 19 bp, Homo sapiens
ataaataaaaagtgggaga

SEQ ID NO: 9163936 - DNA, 19 bp, Homo sapiens
ataaataaaaagtgggaga

SEQ ID NO: 9163937 - DNA, 16 bp, Homo sapiens
acttttccaccttttt

SEQ ID NO: 9163938 - DNA, 22 bp, Homo sapiens
acttttctaagcaatggtcttg

SEQ ID NO: 9163939 - DNA, 22 bp, Homo sapiens
acttttctccctcctgccttca

SEQ ID NO: 9163940 - DNA, 22 bp, Homo sapiens
acttttctccctcctgccttca

SEQ ID NO: 9163941 - DNA, 22 bp, Homo sapiens
acttttctgcagatgatctctt

SEQ ID NO: 9163942 - DNA, 22 bp, Homo sapiens
actttttacagggtgtatacca

SEQ ID NO: 9163943 - DNA, 22 bp, Homo sapiens
acttttttataaggaagaagat

SEQ ID NO: 9163944 - DNA, 22 bp, Homo sapiens
actttttacagggtgtatacca

SEQ ID NO: 9163945 - DNA, 22 bp, Homo sapiens
actttttctcagaaggattggt

SEQ ID NO: 9163946 - DNA, 22 bp, Homo sapiens
agaaaaacacaatcgggcctcc

SEQ ID NO: 9163947 - DNA, 21 bp, Homo sapiens
agaaaaacacgatataagccc

SEQ ID NO: 9163948 - DNA, 21 bp, Homo sapiens
agaaaaacacgatataagccc

SEQ ID NO: 9163949 - DNA, 23 bp, Homo sapiens
agaaaaacaggattgtgttccta

SEQ ID NO: 9163950 - DNA, 22 bp, Homo sapiens
agaaaaactaagagtgggtggt

SEQ ID NO: 9163951 - DNA, 21 bp, Homo sapiens
agaaaaaccagcatgttttca

SEQ ID NO: 9163952 - DNA, 19 bp, Homo sapiens
agaaaaactggtactgctg

SEQ ID NO: 9163953 - DNA, 19 bp, Homo sapiens
agaaaaactggtactgctg

SEQ ID NO: 9163954 - DNA, 22 bp, Homo sapiens
atcaaaaccttgacttttaatg

SEQ ID NO: 9163955 - DNA, 21 bp, Homo sapiens
atatttttgtttggactgtca

SEQ ID NO: 9163956 - DNA, 22 bp, Homo sapiens
atattttggtagctctcaatga

SEQ ID NO: 9163957 - DNA, 22 bp, Homo sapiens
atatttttccatgtgggactct

SEQ ID NO: 9163958 - DNA, 22 bp, Homo sapiens
agaaagattttcaacaggaggt

SEQ ID NO: 9163959 - DNA, 22 bp, Homo sapiens
agaaagcacagcgggtccattt

SEQ ID NO: 9163960 - DNA, 22 bp, Homo sapiens
agaaagcacagcgggtccattt

SEQ ID NO: 9163961 - DNA, 22 bp, Homo sapiens
atcaaaatgctccagtgatggt

SEQ ID NO: 9163962 - DNA, 22 bp, Homo sapiens
agaaagaggatgcagatctcat

SEQ ID NO: 9163963 - DNA, 22 bp, Homo sapiens
agaaagcatctccattgtaggt

SEQ ID NO: 9163964 - DNA, 22 bp, Homo sapiens
agaaagcactctgtcttttacc

SEQ ID NO: 9163965 - DNA, 22 bp, Homo sapiens
agaaagcctcaatcttcaggcc

SEQ ID NO: 9163966 - DNA, 22 bp, Homo sapiens
agaaagccttatgtacagaggc

SEQ ID NO: 9163967 - DNA, 22 bp, Homo sapiens
agaaagcctcaatcttcaggcc

SEQ ID NO: 9163968 - DNA, 22 bp, Homo sapiens
agaaagccttatgtacagaggc

SEQ ID NO: 9163969 - DNA, 22 bp, Homo sapiens
atcagtgtttgcatgggagctt

SEQ ID NO: 9163970 - DNA, 22 bp, Homo sapiens
atcagttagttactgctaagat

SEQ ID NO: 9163971 - DNA, 22 bp, Homo sapiens
atcagtttaaatgggctgttgg

SEQ ID NO: 9163972 - DNA, 22 bp, Homo sapiens
atcagcaatcaaattgcagagt

SEQ ID NO: 9163973 - DNA, 22 bp, Homo sapiens
atcagtatcctgcagtttctat

SEQ ID NO: 9163974 - DNA, 22 bp, Homo sapiens
atcagtgcatcctgccacaaag

SEQ ID NO: 9163975 - DNA, 20 bp, Homo sapiens
agaacctaagttaaaacaca

SEQ ID NO: 9163976 - DNA, 22 bp, Homo sapiens
agaaccatgagtttgagtatct

SEQ ID NO: 9163977 - DNA, 22 bp, Homo sapiens
agaacctgcctttactctcctt

SEQ ID NO: 9163978 - DNA, 22 bp, Homo sapiens
atctctggcaatgcagcatcgt

SEQ ID NO: 9163979 - DNA, 22 bp, Homo sapiens
atctctgctagccttcttcagg

SEQ ID NO: 9163980 - DNA, 22 bp, Homo sapiens
agaaccagctagtcttgctttt

SEQ ID NO: 9163981 - DNA, 22 bp, Homo sapiens
agaacatatctgttttctaact

SEQ ID NO: 9163982 - DNA, 23 bp, Homo sapiens
agaacagtgactaatatagagag

SEQ ID NO: 9163983 - DNA, 22 bp, Homo sapiens
agaacataattatcataaactg

SEQ ID NO: 9163984 - DNA, 22 bp, Homo sapiens
atccccagaaaataggtgccta

SEQ ID NO: 9163985 - DNA, 22 bp, Homo sapiens
atcccatttcctagtacatcat

SEQ ID NO: 9163986 - DNA, 22 bp, Homo sapiens
atccccacgatatagccaaagc

SEQ ID NO: 9163987 - DNA, 22 bp, Homo sapiens
atccatttgtttactgatggac

SEQ ID NO: 9163988 - DNA, 22 bp, Homo sapiens
atccatttgtttactgatggac

SEQ ID NO: 9163989 - DNA, 22 bp, Homo sapiens
atccattttaactgttagtgca

SEQ ID NO: 9163990 - DNA, 22 bp, Homo sapiens
atccattttctctctgtggggt

SEQ ID NO: 9163991 - DNA, 22 bp, Homo sapiens
atccattttccttggcagcagg

SEQ ID NO: 9163992 - DNA, 22 bp, Homo sapiens
atccattttccttggcagcagg

SEQ ID NO: 9163993 - DNA, 22 bp, Homo sapiens
atccaggagtcgtggcgctcag

SEQ ID NO: 9163994 - DNA, 19 bp, Homo sapiens
agaaatctcgagatttgtt

SEQ ID NO: 9163995 - DNA, 21 bp, Homo sapiens
atcccagcacccaggagtgca

SEQ ID NO: 9163996 - DNA, 22 bp, Homo sapiens
atcccagatggaggctggtcac

SEQ ID NO: 9163997 - DNA, 22 bp, Homo sapiens
atcccaggggttgtatcttccc

SEQ ID NO: 9163998 - DNA, 22 bp, Homo sapiens
atccatttttgcaaagttgttc

SEQ ID NO: 9163999 - DNA, 22 bp, Homo sapiens
atccatttttgcaaagttgttc

SEQ ID NO: 9164000 - DNA, 22 bp, Homo sapiens
atccattttttcagaatgctct

SEQ ID NO: 9164001 - DNA, 22 bp, Homo sapiens
atccattttttcagaatgctct

SEQ ID NO: 9164002 - DNA, 22 bp, Homo sapiens
atcccaagtagcaatcctggta

SEQ ID NO: 9164003 - DNA, 16 bp, Homo sapiens
atcccagaggctagag

SEQ ID NO: 9164004 - DNA, 22 bp, Homo sapiens
atcccagagaataatgatcagg

SEQ ID NO: 9164005 - DNA, 22 bp, Homo sapiens
atcccacacccctacaacatat

SEQ ID NO: 9164006 - DNA, 22 bp, Homo sapiens
atctgccaatgccatgagaaga

SEQ ID NO: 9164007 - DNA, 22 bp, Homo sapiens
agaaggcactcacactggcacg

SEQ ID NO: 9164008 - DNA, 22 bp, Homo sapiens
agaaggcactcacactggcacg

SEQ ID NO: 9164009 - DNA, 22 bp, Homo sapiens
agaaggcagatgggacggagca

SEQ ID NO: 9164010 - DNA, 22 bp, Homo sapiens
agaaggcagatgggacggagca

SEQ ID NO: 9164011 - DNA, 22 bp, Homo sapiens
agaaggcagatgggacggagca

SEQ ID NO: 9164012 - DNA, 22 bp, Homo sapiens
agaaggagtgtacaggtcatgc

SEQ ID NO: 9164013 - DNA, 22 bp, Homo sapiens
agaagctgtggtatgaaatgtg

SEQ ID NO: 9164014 - DNA, 22 bp, Homo sapiens
agaagccacaggcctcgtctgg

SEQ ID NO: 9164015 - DNA, 22 bp, Homo sapiens
agaagccacaggcctcgtctgg

SEQ ID NO: 9164016 - DNA, 22 bp, Homo sapiens
agaagccacaggaaagcagctt

SEQ ID NO: 9164017 - DNA, 21 bp, Homo sapiens
agaaggcaccagcaaggactg

SEQ ID NO: 9164018 - DNA, 22 bp, Homo sapiens
agaaggcaccgtggccaatatt

SEQ ID NO: 9164019 - DNA, 22 bp, Homo sapiens
agaaggcacagtgctgctaaga

SEQ ID NO: 9164020 - DNA, 22 bp, Homo sapiens
atctctggtccaaatgttacct

SEQ ID NO: 9164021 - DNA, 22 bp, Homo sapiens
atctctggttgttttgctccca

SEQ ID NO: 9164022 - DNA, 22 bp, Homo sapiens
atctctgggtccatagaagaga

SEQ ID NO: 9164023 - DNA, 22 bp, Homo sapiens
atctctggcccctggggtccga

SEQ ID NO: 9164024 - DNA, 22 bp, Homo sapiens
atctctgggctttgagtttgtt

SEQ ID NO: 9164025 - DNA, 22 bp, Homo sapiens
atctctggccttccttttccaa

SEQ ID NO: 9164026 - DNA, 22 bp, Homo sapiens
atctctgtaattacatgatatt

SEQ ID NO: 9164027 - DNA, 22 bp, Homo sapiens
atctcttatgtcacataaacca

SEQ ID NO: 9164028 - DNA, 22 bp, Homo sapiens
atctcttcccaactccacattc

SEQ ID NO: 9164029 - DNA, 22 bp, Homo sapiens
agaagccaatcagctctctgct

SEQ ID NO: 9164030 - DNA, 22 bp, Homo sapiens
agaagccaatcagctctctgct

SEQ ID NO: 9164031 - DNA, 22 bp, Homo sapiens
agaagccaatccttgtctctct

SEQ ID NO: 9164032 - DNA, 22 bp, Homo sapiens
agaagccaattctgtgtgagtc

SEQ ID NO: 9164033 - DNA, 22 bp, Homo sapiens
agaagccaatccttgtctctct

SEQ ID NO: 9164034 - DNA, 22 bp, Homo sapiens
agaagccacaggaaagcagctt

SEQ ID NO: 9164035 - DNA, 22 bp, Homo sapiens
agaagccacaggcctcgtctgg

SEQ ID NO: 9164036 - DNA, 22 bp, Homo sapiens
agaagccaattctgtgtgagtc

SEQ ID NO: 9164037 - DNA, 22 bp, Homo sapiens
agaagccaattctgtgtgagtc

SEQ ID NO: 9164038 - DNA, 22 bp, Homo sapiens
agaagccaagaacagacagtgc

SEQ ID NO: 9164039 - DNA, 22 bp, Homo sapiens
agaagccaagaacagacagtgc

SEQ ID NO: 9164040 - DNA, 22 bp, Homo sapiens
agaagccaacagggcaggagag

SEQ ID NO: 9164041 - DNA, 22 bp, Homo sapiens
atctctttgatggctcctgtga

SEQ ID NO: 9164042 - DNA, 20 bp, Homo sapiens
agaagccaagtgacatgttt

SEQ ID NO: 9164043 - DNA, 20 bp, Homo sapiens
agaagccaagtgacatgttt

SEQ ID NO: 9164044 - DNA, 20 bp, Homo sapiens
agaagccaagtgacatgttt

SEQ ID NO: 9164045 - DNA, 22 bp, Homo sapiens
agaagccaatcagctctctgct

SEQ ID NO: 9164046 - DNA, 22 bp, Homo sapiens
atgcatattgtcatttagtcct

SEQ ID NO: 9164047 - DNA, 22 bp, Homo sapiens
atgcatattggattagcagcca

SEQ ID NO: 9164048 - DNA, 22 bp, Homo sapiens
atgcatattcttagcccctcct

SEQ ID NO: 9164049 - DNA, 22 bp, Homo sapiens
atgcatattgattatagattca

SEQ ID NO: 9164050 - DNA, 22 bp, Homo sapiens
atgcatatgtacccatgttctg

SEQ ID NO: 9164051 - DNA, 22 bp, Homo sapiens
atgcatatgtacttgcatatgt

SEQ ID NO: 9164052 - DNA, 22 bp, Homo sapiens
atgcatatgtgtgcacacgtgt

SEQ ID NO: 9164053 - DNA, 22 bp, Homo sapiens
atgcatatttcatgaatctttg

SEQ ID NO: 9164054 - DNA, 22 bp, Homo sapiens
atgcatatttcttggagcacct

SEQ ID NO: 9164055 - DNA, 22 bp, Homo sapiens
atgcatatttcttgggcttacc

SEQ ID NO: 9164056 - DNA, 18 bp, Homo sapiens
atgcatattttaagttgt

SEQ ID NO: 9164057 - DNA, 21 bp, Homo sapiens
atgcatattttaagttgtgtc

SEQ ID NO: 9164058 - DNA, 22 bp, Homo sapiens
atgccaaagcccaagttcatca

SEQ ID NO: 9164059 - DNA, 22 bp, Homo sapiens
atgccaaaatgttacatttctt

SEQ ID NO: 9164060 - DNA, 22 bp, Homo sapiens
atgccaaaatgttacatttctt

SEQ ID NO: 9164061 - DNA, 22 bp, Homo sapiens
atgcatattttctactatatcg

SEQ ID NO: 9164062 - DNA, 22 bp, Homo sapiens
atgcatcaaagtctgaaatttc

SEQ ID NO: 9164063 - DNA, 22 bp, Homo sapiens
atgcatattttctgttggtgac

SEQ ID NO: 9164064 - DNA, 22 bp, Homo sapiens
atgcatttgtaaaatataatcg

SEQ ID NO: 9164065 - DNA, 20 bp, Homo sapiens
agacagaatcagagataaag

SEQ ID NO: 9164066 - DNA, 22 bp, Homo sapiens
agacagaacagaataattgttg

SEQ ID NO: 9164067 - DNA, 22 bp, Homo sapiens
atgatacattgcaaaattttaa

SEQ ID NO: 9164068 - DNA, 19 bp, Homo sapiens
atgatacaggtgaaaattg

SEQ ID NO: 9164069 - DNA, 22 bp, Homo sapiens
atgatacatcttcatgtcagtg

SEQ ID NO: 9164070 - DNA, 22 bp, Homo sapiens
atgcatatggcttgagggaata

SEQ ID NO: 9164071 - DNA, 22 bp, Homo sapiens
atgcaggttggatcctatgccc

SEQ ID NO: 9164072 - DNA, 22 bp, Homo sapiens
atgcagggttctgggctagaga

SEQ ID NO: 9164073 - DNA, 20 bp, Homo sapiens
atgatagtcagaaaactagc

SEQ ID NO: 9164074 - DNA, 22 bp, Homo sapiens
atgatacatttacctatggtct

SEQ ID NO: 9164075 - DNA, 23 bp, Homo sapiens
atgatagaaactcttgtagtctc

SEQ ID NO: 9164076 - DNA, 22 bp, Homo sapiens
agacgagggcccccaggacagc

SEQ ID NO: 9164077 - DNA, 22 bp, Homo sapiens
agacgagggcctggcacacagt

SEQ ID NO: 9164078 - DNA, 22 bp, Homo sapiens
atgcctggtcccacctctaggt

SEQ ID NO: 9164079 - DNA, 22 bp, Homo sapiens
atgcctggtatgaagcaaggaa

SEQ ID NO: 9164080 - DNA, 22 bp, Homo sapiens
atgcctgtgctatattctcaca

SEQ ID NO: 9164081 - DNA, 22 bp, Homo sapiens
atgcctttctctgtagaaagaa

SEQ ID NO: 9164082 - DNA, 22 bp, Homo sapiens
agactctgataagcaactcttg

SEQ ID NO: 9164083 - DNA, 22 bp, Homo sapiens
atgcggagccccaagcttgaag

SEQ ID NO: 9164084 - DNA, 22 bp, Homo sapiens
agactctgattccctcatgtca

SEQ ID NO: 9164085 - DNA, 22 bp, Homo sapiens
agacctggtgatagctgtccta

SEQ ID NO: 9164086 - DNA, 22 bp, Homo sapiens
agaccttagtagcttttaatgg

SEQ ID NO: 9164087 - DNA, 22 bp, Homo sapiens
agacctggtttatcaccagcat

SEQ ID NO: 9164088 - DNA, 22 bp, Homo sapiens
agacctggtttatcaccagcat

SEQ ID NO: 9164089 - DNA, 22 bp, Homo sapiens
agacctgggtgccctgtgcttt

SEQ ID NO: 9164090 - DNA, 22 bp, Homo sapiens
agacctgggtgccctgtgcttt

SEQ ID NO: 9164091 - DNA, 22 bp, Homo sapiens
agacctggattccaatcctacc

SEQ ID NO: 9164092 - DNA, 22 bp, Homo sapiens
agacctgggttcgagtcctaac

SEQ ID NO: 9164093 - DNA, 22 bp, Homo sapiens
agacctgggttcgagtcctaac

SEQ ID NO: 9164094 - DNA, 22 bp, Homo sapiens
agacctggattccaatcctacc

SEQ ID NO: 9164095 - DNA, 22 bp, Homo sapiens
agacctggattccaatcctacc

SEQ ID NO: 9164096 - DNA, 22 bp, Homo sapiens
agacctggagtggggcctcagg

SEQ ID NO: 9164097 - DNA, 22 bp, Homo sapiens
agacctgaagagtatcttcaga

SEQ ID NO: 9164098 - DNA, 22 bp, Homo sapiens
agaatattgaaagttcttgaca

SEQ ID NO: 9164099 - DNA, 22 bp, Homo sapiens
agaatattgaaagttcttgaca

SEQ ID NO: 9164100 - DNA, 22 bp, Homo sapiens
agaatcaaagagaaatactttg

SEQ ID NO: 9164101 - DNA, 22 bp, Homo sapiens
agaatcaaagagaaatactttg

SEQ ID NO: 9164102 - DNA, 22 bp, Homo sapiens
agaatcaattagattctatgag

SEQ ID NO: 9164103 - DNA, 22 bp, Homo sapiens
atgaggctctcaacaccttgag

SEQ ID NO: 9164104 - DNA, 22 bp, Homo sapiens
atgaggctgaaacacagaggct

SEQ ID NO: 9164105 - DNA, 22 bp, Homo sapiens
agacaagactaggcagttgttg

SEQ ID NO: 9164106 - DNA, 22 bp, Homo sapiens
agacaagaaactgggagtctct

SEQ ID NO: 9164107 - DNA, 22 bp, Homo sapiens
agacaagaaactgggagtctct

SEQ ID NO: 9164108 - DNA, 22 bp, Homo sapiens
agacaagaaactgggagtctct

SEQ ID NO: 9164109 - DNA, 22 bp, Homo sapiens
agacaaatttcctgcaatgaag

SEQ ID NO: 9164110 - DNA, 22 bp, Homo sapiens
agacagaaataggagaaaccag

SEQ ID NO: 9164111 - DNA, 22 bp, Homo sapiens
agacagaacagaataattgttg

SEQ ID NO: 9164112 - DNA, 21 bp, Homo sapiens
agacagaacaactgctctcca

SEQ ID NO: 9164113 - DNA, 21 bp, Homo sapiens
agacagaacaactgctctcca

SEQ ID NO: 9164114 - DNA, 22 bp, Homo sapiens
agacacattttcagctctgcca

SEQ ID NO: 9164115 - DNA, 22 bp, Homo sapiens
agaatattcatctgtattctta

SEQ ID NO: 9164116 - DNA, 22 bp, Homo sapiens
agaatatgaggaaactgtgaat

SEQ ID NO: 9164117 - DNA, 22 bp, Homo sapiens
agaatatagttaccaaattctg

SEQ ID NO: 9164118 - DNA, 22 bp, Homo sapiens
agaatataaagataattctgtt

SEQ ID NO: 9164119 - DNA, 22 bp, Homo sapiens
atgaaggcagttttataagatt

SEQ ID NO: 9164120 - DNA, 21 bp, Homo sapiens
atgaaggcagtgccaagggct

SEQ ID NO: 9164121 - DNA, 22 bp, Homo sapiens
atgaagggaatataagtgctgc

SEQ ID NO: 9164122 - DNA, 22 bp, Homo sapiens
atgaagggtgtccctgtgagca

SEQ ID NO: 9164123 - DNA, 22 bp, Homo sapiens
atctgcctggctccaggtgagc

SEQ ID NO: 9164124 - DNA, 20 bp, Homo sapiens
atctgctgagaatgaaaggc

SEQ ID NO: 9164125 - DNA, 18 bp, Homo sapiens
atctgctggcaggtctgg

SEQ ID NO: 9164126 - DNA, 22 bp, Homo sapiens
atctgcttagaattcattgtcc

SEQ ID NO: 9164127 - DNA, 22 bp, Homo sapiens
atctgctgttcttcacagcttg

SEQ ID NO: 9164128 - DNA, 22 bp, Homo sapiens
atgaagcgttcgagataggtag

SEQ ID NO: 9164129 - DNA, 22 bp, Homo sapiens
atgaacacaatacgtgcatgca

SEQ ID NO: 9164130 - DNA, 22 bp, Homo sapiens
agagccctctgcaatgcctcag

SEQ ID NO: 9164131 - DNA, 22 bp, Homo sapiens
agagccctaaaccctgccttgg

SEQ ID NO: 9164132 - DNA, 22 bp, Homo sapiens
agagccctctcattggcttatt

SEQ ID NO: 9164133 - DNA, 22 bp, Homo sapiens
agagccctgaagcagagctaaa

SEQ ID NO: 9164134 - DNA, 22 bp, Homo sapiens
agagccctgacggggacagatg

SEQ ID NO: 9164135 - DNA, 22 bp, Homo sapiens
agagccctgcagttcttcagga

SEQ ID NO: 9164136 - DNA, 22 bp, Homo sapiens
agagccctggagggcagtcccg

SEQ ID NO: 9164137 - DNA, 22 bp, Homo sapiens
agagccctgtggactgtcaagt

SEQ ID NO: 9164138 - DNA, 22 bp, Homo sapiens
agagccctgcagttcttcagga

SEQ ID NO: 9164139 - DNA, 22 bp, Homo sapiens
agagccctgcagttcttcagga

SEQ ID NO: 9164140 - DNA, 22 bp, Homo sapiens
agagccctttctccaggcacct

SEQ ID NO: 9164141 - DNA, 22 bp, Homo sapiens
agagccctttctccaggcacct

SEQ ID NO: 9164142 - DNA, 22 bp, Homo sapiens
agagcccttgccctcagtcacc

SEQ ID NO: 9164143 - DNA, 22 bp, Homo sapiens
agagcctgaggccctgagaggg

SEQ ID NO: 9164144 - DNA, 22 bp, Homo sapiens
agagctgaaaaagctgacccgg

SEQ ID NO: 9164145 - DNA, 21 bp, Homo sapiens
agagcctgagatcttccagca

SEQ ID NO: 9164146 - DNA, 23 bp, Homo sapiens
agagcctgaaagacttctggcac

SEQ ID NO: 9164147 - DNA, 22 bp, Homo sapiens
agagcctgaggatgtcccagct

SEQ ID NO: 9164148 - DNA, 22 bp, Homo sapiens
agagcctgagcctgatcttgaa

SEQ ID NO: 9164149 - DNA, 22 bp, Homo sapiens
agagcctgagcctgaaagccct

SEQ ID NO: 9164150 - DNA, 22 bp, Homo sapiens
agagctggacgtctgagcccta

SEQ ID NO: 9164151 - DNA, 22 bp, Homo sapiens
agagctggaatcagacctcagg

SEQ ID NO: 9164152 - DNA, 22 bp, Homo sapiens
agagctggacgtctgagcccta

SEQ ID NO: 9164153 - DNA, 22 bp, Homo sapiens
agagctggagcagccccactgg

SEQ ID NO: 9164154 - DNA, 22 bp, Homo sapiens
agagctggagcagccccactgg

SEQ ID NO: 9164155 - DNA, 22 bp, Homo sapiens
agagctggagatgcaggtttcg

SEQ ID NO: 9164156 - DNA, 22 bp, Homo sapiens
agagctggcagcagcttctcct

SEQ ID NO: 9164157 - DNA, 22 bp, Homo sapiens
agagctggcactgaccctcacc

SEQ ID NO: 9164158 - DNA, 22 bp, Homo sapiens
agagctggcagcagcttctcct

SEQ ID NO: 9164159 - DNA, 22 bp, Homo sapiens
agagctggatggtcaagatggc

SEQ ID NO: 9164160 - DNA, 22 bp, Homo sapiens
agagctggatggtcaagatggc

SEQ ID NO: 9164161 - DNA, 22 bp, Homo sapiens
agagctggctggtagccctgat

SEQ ID NO: 9164162 - DNA, 22 bp, Homo sapiens
agagctggctgtgggtgacttt

SEQ ID NO: 9164163 - DNA, 22 bp, Homo sapiens
agagctggctggtagccctgat

SEQ ID NO: 9164164 - DNA, 22 bp, Homo sapiens
agagctggctgctgcggtgctt

SEQ ID NO: 9164165 - DNA, 22 bp, Homo sapiens
agagctggccagggatcactct

SEQ ID NO: 9164166 - DNA, 22 bp, Homo sapiens
agagctggccagggatcactct

SEQ ID NO: 9164167 - DNA, 21 bp, Homo sapiens
agagctggcctgccaggccct

SEQ ID NO: 9164168 - DNA, 22 bp, Homo sapiens
agagcagatggccagggggcct

SEQ ID NO: 9164169 - DNA, 22 bp, Homo sapiens
agagcagatggagctggaagag

SEQ ID NO: 9164170 - DNA, 22 bp, Homo sapiens
agagcagatggagctggaagag

SEQ ID NO: 9164171 - DNA, 22 bp, Homo sapiens
agagcagatggagctggaagag

SEQ ID NO: 9164172 - DNA, 22 bp, Homo sapiens
agagcagatggagctggaagag

SEQ ID NO: 9164173 - DNA, 22 bp, Homo sapiens
agagcagcacgttgtccccaca

SEQ ID NO: 9164174 - DNA, 20 bp, Homo sapiens
agagcagcagttggtgaggt

SEQ ID NO: 9164175 - DNA, 22 bp, Homo sapiens
agagcagatggccagggggcct

SEQ ID NO: 9164176 - DNA, 22 bp, Homo sapiens
agagccagttgttaagcactta

SEQ ID NO: 9164177 - DNA, 22 bp, Homo sapiens
agagcccagaaagtatgtcata

SEQ ID NO: 9164178 - DNA, 20 bp, Homo sapiens
agagcccagatgtctgtatt

SEQ ID NO: 9164179 - DNA, 22 bp, Homo sapiens
agagcccaggcaggcatccagg

SEQ ID NO: 9164180 - DNA, 22 bp, Homo sapiens
agagcccctcggtggaggggtc

SEQ ID NO: 9164181 - DNA, 22 bp, Homo sapiens
agagcccctggtggagtgagaa

SEQ ID NO: 9164182 - DNA, 22 bp, Homo sapiens
agagcccctggtggagtgagaa

SEQ ID NO: 9164183 - DNA, 22 bp, Homo sapiens
agagcccatcagtggcagtgga

SEQ ID NO: 9164184 - DNA, 22 bp, Homo sapiens
agagcagagtggctgtagcttg

SEQ ID NO: 9164185 - DNA, 22 bp, Homo sapiens
agagcagagggctctgggacaa

SEQ ID NO: 9164186 - DNA, 22 bp, Homo sapiens
agagcagagtggctgtagcttg

SEQ ID NO: 9164187 - DNA, 22 bp, Homo sapiens
agagcagagggctctgggacaa

SEQ ID NO: 9164188 - DNA, 22 bp, Homo sapiens
agagcagagggctctgggacaa

SEQ ID NO: 9164189 - DNA, 22 bp, Homo sapiens
agagcagagggctctgggacaa

SEQ ID NO: 9164190 - DNA, 22 bp, Homo sapiens
agagcactgcgccggctcggaa

SEQ ID NO: 9164191 - DNA, 22 bp, Homo sapiens
agagcactttcgagagccggag

SEQ ID NO: 9164192 - DNA, 22 bp, Homo sapiens
agagcagaggcatggccgtggg

SEQ ID NO: 9164193 - DNA, 22 bp, Homo sapiens
agagcaccccgggaagagcaag

SEQ ID NO: 9164194 - DNA, 22 bp, Homo sapiens
agagcacggccaccatttacaa

SEQ ID NO: 9164195 - DNA, 22 bp, Homo sapiens
agagcactgagtgagcaaggcc

SEQ ID NO: 9164196 - DNA, 22 bp, Homo sapiens
agagaggtttgctggaagattc

SEQ ID NO: 9164197 - DNA, 22 bp, Homo sapiens
agagagttgaggaagcaacact

SEQ ID NO: 9164198 - DNA, 22 bp, Homo sapiens
agagagttctttctagttgaag

SEQ ID NO: 9164199 - DNA, 22 bp, Homo sapiens
agagaaggtcactaaggaccca

SEQ ID NO: 9164200 - DNA, 22 bp, Homo sapiens
agagaaggtcactaaggaccca

SEQ ID NO: 9164201 - DNA, 22 bp, Homo sapiens
agagaagtgagcttgttcactc

SEQ ID NO: 9164202 - DNA, 22 bp, Homo sapiens
agagaagggtgtagcctgggcc

SEQ ID NO: 9164203 - DNA, 22 bp, Homo sapiens
agagaaggtcactaaggaccca

SEQ ID NO: 9164204 - DNA, 22 bp, Homo sapiens
agagaagggtgtagcctgggcc

SEQ ID NO: 9164205 - DNA, 22 bp, Homo sapiens
agagaagggtgtagcctgggcc

SEQ ID NO: 9164206 - DNA, 22 bp, Homo sapiens
agagaagtgtcatttcagtttt

SEQ ID NO: 9164207 - DNA, 22 bp, Homo sapiens
agagaagtgtcatttcagtttt

SEQ ID NO: 9164208 - DNA, 22 bp, Homo sapiens
agagaatacagggtaacaggaa

SEQ ID NO: 9164209 - DNA, 23 bp, Homo sapiens
agagaaaaatatctgggcacatt

SEQ ID NO: 9164210 - DNA, 22 bp, Homo sapiens
agagaaaactcattgaggtgtc

SEQ ID NO: 9164211 - DNA, 23 bp, Homo sapiens
agagaaaaatatctgggcacatt

SEQ ID NO: 9164212 - DNA, 19 bp, Homo sapiens
agagaaggatcctatggtt

SEQ ID NO: 9164213 - DNA, 22 bp, Homo sapiens
agactttaatgtgcaaatgaaa

SEQ ID NO: 9164214 - DNA, 22 bp, Homo sapiens
agactttaatgtgcaaatgaaa

SEQ ID NO: 9164215 - DNA, 22 bp, Homo sapiens
agactttaatgtgcaaatgaaa

SEQ ID NO: 9164216 - DNA, 21 bp, Homo sapiens
agactttgcttgcagagagtc

SEQ ID NO: 9164217 - DNA, 22 bp, Homo sapiens
agactgtgccacacatgggagt

SEQ ID NO: 9164218 - DNA, 21 bp, Homo sapiens
agacttccatcctgagagagg

SEQ ID NO: 9164219 - DNA, 22 bp, Homo sapiens
agagagcattgaggaaatcttc

SEQ ID NO: 9164220 - DNA, 22 bp, Homo sapiens
agagagcatggcacagaggggt

SEQ ID NO: 9164221 - DNA, 22 bp, Homo sapiens
agagagaagcaatcagtggcca

SEQ ID NO: 9164222 - DNA, 22 bp, Homo sapiens
agagagcatggcacagaggggt

SEQ ID NO: 9164223 - DNA, 22 bp, Homo sapiens
agagagcagtggatcacctagc

SEQ ID NO: 9164224 - DNA, 22 bp, Homo sapiens
agagagaagcaatcagtggcca

SEQ ID NO: 9164225 - DNA, 22 bp, Homo sapiens
agagagaagcaatcagtggcca

SEQ ID NO: 9164226 - DNA, 22 bp, Homo sapiens
agagacaatgccaatgcacacg

SEQ ID NO: 9164227 - DNA, 22 bp, Homo sapiens
agagacaatgccaatgcacacg

SEQ ID NO: 9164228 - DNA, 22 bp, Homo sapiens
agagacaaacactgcaacttct

SEQ ID NO: 9164229 - DNA, 22 bp, Homo sapiens
agagacaagaaatacctgggac

SEQ ID NO: 9164230 - DNA, 22 bp, Homo sapiens
agagacaaacactgcaacttct

SEQ ID NO: 9164231 - DNA, 22 bp, Homo sapiens
agagaattggagcagtgacagg

SEQ ID NO: 9164232 - DNA, 22 bp, Homo sapiens
agagaattacagaagaatgtca

SEQ ID NO: 9164233 - DNA, 22 bp, Homo sapiens
agagaattacagaagaatgtca

SEQ ID NO: 9164234 - DNA, 22 bp, Homo sapiens
agagaggatttgtttttctcct

SEQ ID NO: 9164235 - DNA, 22 bp, Homo sapiens
agagagctgtcctgggacaccc

SEQ ID NO: 9164236 - DNA, 22 bp, Homo sapiens
agagaggcattcggtgatccca

SEQ ID NO: 9164237 - DNA, 22 bp, Homo sapiens
agagaggatttgtttttctcct

SEQ ID NO: 9164238 - DNA, 22 bp, Homo sapiens
agagagctctgctgctgcccag

SEQ ID NO: 9164239 - DNA, 22 bp, Homo sapiens
agagagcctgagtggcagctat

SEQ ID NO: 9164240 - DNA, 22 bp, Homo sapiens
agagagcctgagtggcagctat

SEQ ID NO: 9164241 - DNA, 22 bp, Homo sapiens
agagaggctgggcgtagggctt

SEQ ID NO: 9164242 - DNA, 22 bp, Homo sapiens
agagaggctgggcgtagggctt

SEQ ID NO: 9164243 - DNA, 22 bp, Homo sapiens
agagaggttaaggagctcttgt

SEQ ID NO: 9164244 - DNA, 22 bp, Homo sapiens
agagaggttggctaggatgttt

SEQ ID NO: 9164245 - DNA, 22 bp, Homo sapiens
attttcaccctgaatatattga

SEQ ID NO: 9164246 - DNA, 22 bp, Homo sapiens
attttcagaacattcattcact

SEQ ID NO: 9164247 - DNA, 22 bp, Homo sapiens
attttcaccctgaatatattga

SEQ ID NO: 9164248 - DNA, 22 bp, Homo sapiens
attttcaagggagaggcctctg

SEQ ID NO: 9164249 - DNA, 22 bp, Homo sapiens
agatgtggccggctagggagag

SEQ ID NO: 9164250 - DNA, 22 bp, Homo sapiens
agatgtggcctttgggagatta

SEQ ID NO: 9164251 - DNA, 22 bp, Homo sapiens
agatgtggatcctagggtagaa

SEQ ID NO: 9164252 - DNA, 22 bp, Homo sapiens
attttagttttagcatccatgc

SEQ ID NO: 9164253 - DNA, 22 bp, Homo sapiens
attttatccccactggattaca

SEQ ID NO: 9164254 - DNA, 22 bp, Homo sapiens
attttcaaaacatctgctgtgt

SEQ ID NO: 9164255 - DNA, 23 bp, Homo sapiens
attttagctgaatgacttcttta

SEQ ID NO: 9164256 - DNA, 22 bp, Homo sapiens
attttagtacctcaagtatcca

SEQ ID NO: 9164257 - DNA, 22 bp, Homo sapiens
attttagtacctcaagtatcca

SEQ ID NO: 9164258 - DNA, 22 bp, Homo sapiens
attttagtacctcaagtatcca

SEQ ID NO: 9164259 - DNA, 22 bp, Homo sapiens
agcaaatattttgttgaagtgc

SEQ ID NO: 9164260 - DNA, 22 bp, Homo sapiens
agatgttatcattcagagtagc

SEQ ID NO: 9164261 - DNA, 22 bp, Homo sapiens
agcaaagctatctctatggaga

SEQ ID NO: 9164262 - DNA, 22 bp, Homo sapiens
agcaaagctatctctatggaga

SEQ ID NO: 9164263 - DNA, 22 bp, Homo sapiens
agcaaagctcatgacattacag

SEQ ID NO: 9164264 - DNA, 22 bp, Homo sapiens
agatgtgtttctagttcctgca

SEQ ID NO: 9164265 - DNA, 22 bp, Homo sapiens
agatgtgtttctagttcctgca

SEQ ID NO: 9164266 - DNA, 22 bp, Homo sapiens
agatgtggttattctcttcctt

SEQ ID NO: 9164267 - DNA, 22 bp, Homo sapiens
agatgtgggtgtcaggcagtga

SEQ ID NO: 9164268 - DNA, 22 bp, Homo sapiens
agatgtggtagttgaagggaag

SEQ ID NO: 9164269 - DNA, 22 bp, Homo sapiens
agatgtggtgaaatgcctccca

SEQ ID NO: 9164270 - DNA, 22 bp, Homo sapiens
agatgtgggtgtcaggcagtga

SEQ ID NO: 9164271 - DNA, 22 bp, Homo sapiens
agatgtgggcaaaaggcttagc

SEQ ID NO: 9164272 - DNA, 22 bp, Homo sapiens
agatgtgggcaaaaggcttagc

SEQ ID NO: 9164273 - DNA, 22 bp, Homo sapiens
agatgtgggagatgcttctgca

SEQ ID NO: 9164274 - DNA, 22 bp, Homo sapiens
caaagatatgacatggaaaatg

SEQ ID NO: 9164275 - DNA, 22 bp, Homo sapiens
caaagatatgacatggaaaatg

SEQ ID NO: 9164276 - DNA, 22 bp, Homo sapiens
caaagatatgacatggaaaatg

SEQ ID NO: 9164277 - DNA, 17 bp, Homo sapiens
caaaccagtaagactgc

SEQ ID NO: 9164278 - DNA, 22 bp, Homo sapiens
caaaccagtaggaagtctatta

SEQ ID NO: 9164279 - DNA, 22 bp, Homo sapiens
caaaggcaggtcatggccactt

SEQ ID NO: 9164280 - DNA, 22 bp, Homo sapiens
caaaggcaggccccctgtgcag

SEQ ID NO: 9164281 - DNA, 22 bp, Homo sapiens
caaaggcaggtgctgaatattc

SEQ ID NO: 9164282 - DNA, 22 bp, Homo sapiens
caaaggcaggtgctgaatattc

SEQ ID NO: 9164283 - DNA, 22 bp, Homo sapiens
caaaggcaggtgctgaatattc

SEQ ID NO: 9164284 - DNA, 22 bp, Homo sapiens
caaagcaagggctgaagactcc

SEQ ID NO: 9164285 - DNA, 22 bp, Homo sapiens
caaagcaagggctgaagactcc

SEQ ID NO: 9164286 - DNA, 22 bp, Homo sapiens
caaagcaaggctcagtttgaac

SEQ ID NO: 9164287 - DNA, 22 bp, Homo sapiens
caaagcaaggctcagtttgaac

SEQ ID NO: 9164288 - DNA, 22 bp, Homo sapiens
caaagattttagaatttgcaat

SEQ ID NO: 9164289 - DNA, 22 bp, Homo sapiens
agcaacatatatcaatgcctga

SEQ ID NO: 9164290 - DNA, 19 bp, Homo sapiens
agcaacctgggccaatgta

SEQ ID NO: 9164291 - DNA, 22 bp, Homo sapiens
agcaacctgccagtcactcagt

SEQ ID NO: 9164292 - DNA, 22 bp, Homo sapiens
agcaacctgccaccacaggcaa

SEQ ID NO: 9164293 - DNA, 20 bp, Homo sapiens
agcaagagtaaggacagcga

SEQ ID NO: 9164294 - DNA, 22 bp, Homo sapiens
agcaagagcatgtcggcctggt

SEQ ID NO: 9164295 - DNA, 22 bp, Homo sapiens
agcaagaagggcaaggaagttt

SEQ ID NO: 9164296 - DNA, 22 bp, Homo sapiens
agcaagaaaatctctgtccaat

SEQ ID NO: 9164297 - DNA, 22 bp, Homo sapiens
agcaagaaatcttcagtgttct

SEQ ID NO: 9164298 - DNA, 22 bp, Homo sapiens
agcaagaaatcttcagtgttct

SEQ ID NO: 9164299 - DNA, 22 bp, Homo sapiens
agcaagaaatcttcagtgttct

SEQ ID NO: 9164300 - DNA, 22 bp, Homo sapiens
agatggagaccttggatgaact

SEQ ID NO: 9164301 - DNA, 22 bp, Homo sapiens
agatggagttagtaccagagtc

SEQ ID NO: 9164302 - DNA, 22 bp, Homo sapiens
agatggagtggagatgagtaaa

SEQ ID NO: 9164303 - DNA, 22 bp, Homo sapiens
agatggagtggagatgagtaaa

SEQ ID NO: 9164304 - DNA, 22 bp, Homo sapiens
agatggagttgtagcagtgact

SEQ ID NO: 9164305 - DNA, 22 bp, Homo sapiens
agatggagttgtagcagtgact

SEQ ID NO: 9164306 - DNA, 22 bp, Homo sapiens
agatggagttgtagcagtgact

SEQ ID NO: 9164307 - DNA, 19 bp, Homo sapiens
agatggcaaaatgcaaaga

SEQ ID NO: 9164308 - DNA, 17 bp, Homo sapiens
agatggcaggaggcaga

SEQ ID NO: 9164309 - DNA, 17 bp, Homo sapiens
agatggcaggaggcaga

SEQ ID NO: 9164310 - DNA, 22 bp, Homo sapiens
agatggcttccttctcactgtg

SEQ ID NO: 9164311 - DNA, 22 bp, Homo sapiens
agatggctttgcttttagaagc

SEQ ID NO: 9164312 - DNA, 22 bp, Homo sapiens
agatgggccttcgagcatgccc

SEQ ID NO: 9164313 - DNA, 17 bp, Homo sapiens
agatggcctctaagatt

SEQ ID NO: 9164314 - DNA, 22 bp, Homo sapiens
agatcagactttgtgactagga

SEQ ID NO: 9164315 - DNA, 22 bp, Homo sapiens
agatgcactataaaagcatctt

SEQ ID NO: 9164316 - DNA, 22 bp, Homo sapiens
agatgcaatgctgaatttgagt

SEQ ID NO: 9164317 - DNA, 22 bp, Homo sapiens
agatccactcgaatccaggaat

SEQ ID NO: 9164318 - DNA, 22 bp, Homo sapiens
agatccagatccttcctggttg

SEQ ID NO: 9164319 - DNA, 22 bp, Homo sapiens
agatgctgtcacacacactgtt

SEQ ID NO: 9164320 - DNA, 22 bp, Homo sapiens
agatgctgtcacacacactgtt

SEQ ID NO: 9164321 - DNA, 21 bp, Homo sapiens
agatgctgtgctccaggagca

SEQ ID NO: 9164322 - DNA, 22 bp, Homo sapiens
agatatttaaatcagacaaaga

SEQ ID NO: 9164323 - DNA, 22 bp, Homo sapiens
agatatttaaatcagacaaaga

SEQ ID NO: 9164324 - DNA, 22 bp, Homo sapiens
agatcaatgtgtcagaagagat

SEQ ID NO: 9164325 - DNA, 22 bp, Homo sapiens
agatcaaagccatgagagattt

SEQ ID NO: 9164326 - DNA, 22 bp, Homo sapiens
agatattttgtgtgatgtttca

SEQ ID NO: 9164327 - DNA, 22 bp, Homo sapiens
agatattttgtgtgatgtttca

SEQ ID NO: 9164328 - DNA, 22 bp, Homo sapiens
agagtggcagcaagtcaggtag

SEQ ID NO: 9164329 - DNA, 22 bp, Homo sapiens
agagtggagagaaacaactctg

SEQ ID NO: 9164330 - DNA, 22 bp, Homo sapiens
agagtggcaccttacctgagac

SEQ ID NO: 9164331 - DNA, 22 bp, Homo sapiens
attggctttcttttgtgaaaat

SEQ ID NO: 9164332 - DNA, 20 bp, Homo sapiens
attggctggggttctgatgc

SEQ ID NO: 9164333 - DNA, 20 bp, Homo sapiens
attggccaggcataaaacac

SEQ ID NO: 9164334 - DNA, 22 bp, Homo sapiens
attggccatttgcatgtattat

SEQ ID NO: 9164335 - DNA, 22 bp, Homo sapiens
attggccatttgcatgtattat

SEQ ID NO: 9164336 - DNA, 22 bp, Homo sapiens
attggccatttgcatgtattat

SEQ ID NO: 9164337 - DNA, 22 bp, Homo sapiens
agagtgagggggcactgagacg

SEQ ID NO: 9164338 - DNA, 22 bp, Homo sapiens
agagtgagggggcactgagacg

SEQ ID NO: 9164339 - DNA, 22 bp, Homo sapiens
agagtgagggggcactgagacg

SEQ ID NO: 9164340 - DNA, 22 bp, Homo sapiens
agagtctgatatttgtaccaga

SEQ ID NO: 9164341 - DNA, 22 bp, Homo sapiens
agagtctgatatttgtaccaga

SEQ ID NO: 9164342 - DNA, 22 bp, Homo sapiens
agagtctgatatttgtaccaga

SEQ ID NO: 9164343 - DNA, 20 bp, Homo sapiens
agagtgagactccatctcag

SEQ ID NO: 9164344 - DNA, 22 bp, Homo sapiens
agagtgcagaggtcaaagaaca

SEQ ID NO: 9164345 - DNA, 22 bp, Homo sapiens
agagtgcaaccgaaacaagcag

SEQ ID NO: 9164346 - DNA, 22 bp, Homo sapiens
agagtgatcctaattgatttgg

SEQ ID NO: 9164347 - DNA, 22 bp, Homo sapiens
agagtgcaaccgaaacaagcag

SEQ ID NO: 9164348 - DNA, 22 bp, Homo sapiens
agagtgcagataagagaatgtt

SEQ ID NO: 9164349 - DNA, 22 bp, Homo sapiens
agagtgcagaggtcaaagaaca

SEQ ID NO: 9164350 - DNA, 22 bp, Homo sapiens
agagtctgaggaggaccaacag

SEQ ID NO: 9164351 - DNA, 22 bp, Homo sapiens
agagtctgaggaggaccaacag

SEQ ID NO: 9164352 - DNA, 22 bp, Homo sapiens
agagtctgaggaggaccaacag

SEQ ID NO: 9164353 - DNA, 21 bp, Homo sapiens
agagtctgagctcttaaccac

SEQ ID NO: 9164354 - DNA, 21 bp, Homo sapiens
agagtctgagctcttaaccac

SEQ ID NO: 9164355 - DNA, 22 bp, Homo sapiens
agagtctgaggcagctgcagcc

SEQ ID NO: 9164356 - DNA, 22 bp, Homo sapiens
agagtctgatatttgtaccaga

SEQ ID NO: 9164357 - DNA, 22 bp, Homo sapiens
agagtctgatatttgtaccaga

SEQ ID NO: 9164358 - DNA, 22 bp, Homo sapiens
agagtccaggtgggctggaggc

SEQ ID NO: 9164359 - DNA, 18 bp, Homo sapiens
agagtccagggtgaggtg

SEQ ID NO: 9164360 - DNA, 22 bp, Homo sapiens
agagtccctcttcccaggaggc

SEQ ID NO: 9164361 - DNA, 22 bp, Homo sapiens
agagtcccagggacactccaga

SEQ ID NO: 9164362 - DNA, 22 bp, Homo sapiens
agagtcaccaaagtaaaacagt

SEQ ID NO: 9164363 - DNA, 22 bp, Homo sapiens
agagtcaccaaagggccaacat

SEQ ID NO: 9164364 - DNA, 22 bp, Homo sapiens
agagtcaacatcgagccactgg

SEQ ID NO: 9164365 - DNA, 22 bp, Homo sapiens
agagtcaagtagggcatgggct

SEQ ID NO: 9164366 - DNA, 22 bp, Homo sapiens
agagtccaaatgtgcagttatg

SEQ ID NO: 9164367 - DNA, 22 bp, Homo sapiens
agagtcagtaacatatatggta

SEQ ID NO: 9164368 - DNA, 22 bp, Homo sapiens
agagtcaccttttcctcaggat

SEQ ID NO: 9164369 - DNA, 22 bp, Homo sapiens
agagtcagactaagccatggtg

SEQ ID NO: 9164370 - DNA, 22 bp, Homo sapiens
agaggggcaagtaaagagtctt

SEQ ID NO: 9164371 - DNA, 22 bp, Homo sapiens
agaggggaggcgaaccagagtc

SEQ ID NO: 9164372 - DNA, 22 bp, Homo sapiens
agaggggaggcgaaccagagtc

SEQ ID NO: 9164373 - DNA, 22 bp, Homo sapiens
agaggggacagccacctgcccg

SEQ ID NO: 9164374 - DNA, 23 bp, Homo sapiens
agaggggagcatctgctggctga

SEQ ID NO: 9164375 - DNA, 22 bp, Homo sapiens
agaggggagagctaagcaattc

SEQ ID NO: 9164376 - DNA, 22 bp, Homo sapiens
agaggctgggcaggacccacag

SEQ ID NO: 9164377 - DNA, 22 bp, Homo sapiens
agaggctgggcaggacccacag

SEQ ID NO: 9164378 - DNA, 22 bp, Homo sapiens
agaggctgggcaggacccacag

SEQ ID NO: 9164379 - DNA, 22 bp, Homo sapiens
agaggctgggtacgggccacct

SEQ ID NO: 9164380 - DNA, 22 bp, Homo sapiens
agaggctgggaagggtccccgg

SEQ ID NO: 9164381 - DNA, 19 bp, Homo sapiens
agaggctgtcacctgtagc

SEQ ID NO: 9164382 - DNA, 22 bp, Homo sapiens
agagggctggacgcaggttgga

SEQ ID NO: 9164383 - DNA, 22 bp, Homo sapiens
agagggcagtctcagattggga

SEQ ID NO: 9164384 - DNA, 22 bp, Homo sapiens
agagggcagggcggtaagtcct

SEQ ID NO: 9164385 - DNA, 22 bp, Homo sapiens
agaggcaagttcagagctagga

SEQ ID NO: 9164386 - DNA, 22 bp, Homo sapiens
agaggcaatgaaagcagtctct

SEQ ID NO: 9164387 - DNA, 22 bp, Homo sapiens
agaggcacaacagtcccattgt

SEQ ID NO: 9164388 - DNA, 22 bp, Homo sapiens
agaggcacaaactggaaaggac

SEQ ID NO: 9164389 - DNA, 22 bp, Homo sapiens
agaggcaagttcagagctagga

SEQ ID NO: 9164390 - DNA, 19 bp, Homo sapiens
agaggcaagggtggaagta

SEQ ID NO: 9164391 - DNA, 19 bp, Homo sapiens
agaggcaagggctcatgac

SEQ ID NO: 9164392 - DNA, 22 bp, Homo sapiens
agaggcaagggacctttctggg

SEQ ID NO: 9164393 - DNA, 22 bp, Homo sapiens
agaggcaaggcaggattcttct

SEQ ID NO: 9164394 - DNA, 22 bp, Homo sapiens
agaggcaagattatcagggcat

SEQ ID NO: 9164395 - DNA, 22 bp, Homo sapiens
agaggcaactgatttctgccag

SEQ ID NO: 9164396 - DNA, 22 bp, Homo sapiens
agagctgggaccgtctggaagt

SEQ ID NO: 9164397 - DNA, 21 bp, Homo sapiens
agagctgggacttgcctgaga

SEQ ID NO: 9164398 - DNA, 22 bp, Homo sapiens
agagctggctgtgggtgacttt

SEQ ID NO: 9164399 - DNA, 20 bp, Homo sapiens
agagctgggaagctccctat

SEQ ID NO: 9164400 - DNA, 20 bp, Homo sapiens
agagctgggaagctccctat

SEQ ID NO: 9164401 - DNA, 22 bp, Homo sapiens
agagctgggaccgtctggaagt

SEQ ID NO: 9164402 - DNA, 22 bp, Homo sapiens
agaggcacccagttaagctgca

SEQ ID NO: 9164403 - DNA, 22 bp, Homo sapiens
agaggcaccatctggaacagcc

SEQ ID NO: 9164404 - DNA, 22 bp, Homo sapiens
agaggcactaagggaagagcag

SEQ ID NO: 9164405 - DNA, 22 bp, Homo sapiens
attacacagcggttactactag

SEQ ID NO: 9164406 - DNA, 22 bp, Homo sapiens
attacacaggctggctctttga

SEQ ID NO: 9164407 - DNA, 22 bp, Homo sapiens
attacacatagacattcgttca

SEQ ID NO: 9164408 - DNA, 22 bp, Homo sapiens
attacagtaacagctacaatgc

SEQ ID NO: 9164409 - DNA, 22 bp, Homo sapiens
attacagcttgctcagtttgca

SEQ ID NO: 9164410 - DNA, 22 bp, Homo sapiens
attacagtaacagctacaatgc

SEQ ID NO: 9164411 - DNA, 22 bp, Homo sapiens
agaggcaggaggttgacttgag

SEQ ID NO: 9164412 - DNA, 22 bp, Homo sapiens
agaggcaggaggttgacttgag

SEQ ID NO: 9164413 - DNA, 22 bp, Homo sapiens
attacagagtcttgggaggtca

SEQ ID NO: 9164414 - DNA, 22 bp, Homo sapiens
agaggccagcccaggccaccga

SEQ ID NO: 9164415 - DNA, 22 bp, Homo sapiens
agaggccagcactgcagggaag

SEQ ID NO: 9164416 - DNA, 23 bp, Homo sapiens
agaggcaggagtggcttgcccgg

SEQ ID NO: 9164417 - DNA, 22 bp, Homo sapiens
agaggccagatcatcatagatg

SEQ ID NO: 9164418 - DNA, 22 bp, Homo sapiens
agaggccaccttctcttgagaa

SEQ ID NO: 9164419 - DNA, 22 bp, Homo sapiens
agaggctggattgagcatagac

SEQ ID NO: 9164420 - DNA, 18 bp, Homo sapiens
agaggctggacaggggat

SEQ ID NO: 9164421 - DNA, 22 bp, Homo sapiens
agaggccaggctgcagagggat

SEQ ID NO: 9164422 - DNA, 22 bp, Homo sapiens
agaggctgcacttgctcatgat

SEQ ID NO: 9164423 - DNA, 22 bp, Homo sapiens
agaggctgcacttgctcatgat

SEQ ID NO: 9164424 - DNA, 22 bp, Homo sapiens
agaggctgcacttgctcatgat

SEQ ID NO: 9164425 - DNA, 22 bp, Homo sapiens
agaggctgcacttgctcatgat

SEQ ID NO: 9164426 - DNA, 22 bp, Homo sapiens
agaggctgatggagtagtgtct

SEQ ID NO: 9164427 - DNA, 22 bp, Homo sapiens
caccagagccacttggaggtca

SEQ ID NO: 9164428 - DNA, 22 bp, Homo sapiens
caccagagtgagtggactgtcg

SEQ ID NO: 9164429 - DNA, 22 bp, Homo sapiens
caccagagtgggtgagggtgat

SEQ ID NO: 9164430 - DNA, 22 bp, Homo sapiens
caccagagttgtccaaatgatt

SEQ ID NO: 9164431 - DNA, 22 bp, Homo sapiens
caccagagttgtccaaatgatt

SEQ ID NO: 9164432 - DNA, 23 bp, Homo sapiens
caccactttctccttctccttgg

SEQ ID NO: 9164433 - DNA, 23 bp, Homo sapiens
caccactttctccttctccttgg

SEQ ID NO: 9164434 - DNA, 20 bp, Homo sapiens
caccagcagcagctgccacc

SEQ ID NO: 9164435 - DNA, 22 bp, Homo sapiens
caccagcagcggtgtgagggtg

SEQ ID NO: 9164436 - DNA, 20 bp, Homo sapiens
caccagcagcagctgccacc

SEQ ID NO: 9164437 - DNA, 22 bp, Homo sapiens
agcagggctctgccatgggccc

SEQ ID NO: 9164438 - DNA, 22 bp, Homo sapiens
agcagggctgcagtgtgtcttt

SEQ ID NO: 9164439 - DNA, 22 bp, Homo sapiens
agcagggctgcagtgtgtcttt

SEQ ID NO: 9164440 - DNA, 22 bp, Homo sapiens
agcagggctctgtggagggtgg

SEQ ID NO: 9164441 - DNA, 22 bp, Homo sapiens
agcagggctctgtggagggtgg

SEQ ID NO: 9164442 - DNA, 22 bp, Homo sapiens
agcagggcaggtaaggatcaga

SEQ ID NO: 9164443 - DNA, 22 bp, Homo sapiens
agcagggcagcttttttcagaa

SEQ ID NO: 9164444 - DNA, 22 bp, Homo sapiens
caccactgtatccctagcactt

SEQ ID NO: 9164445 - DNA, 19 bp, Homo sapiens
caccacttctttttgcatc

SEQ ID NO: 9164446 - DNA, 22 bp, Homo sapiens
caccacttcataggctttaagg

SEQ ID NO: 9164447 - DNA, 22 bp, Homo sapiens
cacatttaatcctttataagta

SEQ ID NO: 9164448 - DNA, 22 bp, Homo sapiens
agcagggcagctgatgcgcacg

SEQ ID NO: 9164449 - DNA, 22 bp, Homo sapiens
agcagggcaaagtcaggctaac

SEQ ID NO: 9164450 - DNA, 22 bp, Homo sapiens
agcagggcaaagtcaggctaac

SEQ ID NO: 9164451 - DNA, 17 bp, Homo sapiens
agcagggagtcaaggga

SEQ ID NO: 9164452 - DNA, 19 bp, Homo sapiens
agcagggagtggttgtggg

SEQ ID NO: 9164453 - DNA, 22 bp, Homo sapiens
agcagggaggcccagggcactg

SEQ ID NO: 9164454 - DNA, 22 bp, Homo sapiens
agcagggaggcccagggcactg

SEQ ID NO: 9164455 - DNA, 22 bp, Homo sapiens
agcagggagaccatctcttcct

SEQ ID NO: 9164456 - DNA, 22 bp, Homo sapiens
agcagggagaccatctcttcct

SEQ ID NO: 9164457 - DNA, 22 bp, Homo sapiens
agcagggaggcggtgtgctggc

SEQ ID NO: 9164458 - DNA, 22 bp, Homo sapiens
agcagggaggcggtgtgctggc

SEQ ID NO: 9164459 - DNA, 22 bp, Homo sapiens
agcagggaggtctagcacgtgg

SEQ ID NO: 9164460 - DNA, 22 bp, Homo sapiens
cacagcagagggagccattgaa

SEQ ID NO: 9164461 - DNA, 21 bp, Homo sapiens
agcagctgggcaacatggagg

SEQ ID NO: 9164462 - DNA, 21 bp, Homo sapiens
agcagctgggcaacatggagg

SEQ ID NO: 9164463 - DNA, 21 bp, Homo sapiens
agcagctgggcaacatggagg

SEQ ID NO: 9164464 - DNA, 21 bp, Homo sapiens
agcagctgggcaacatggagg

SEQ ID NO: 9164465 - DNA, 22 bp, Homo sapiens
agcaggaactcagggagttctc

SEQ ID NO: 9164466 - DNA, 22 bp, Homo sapiens
agcaggaactgacaccaagcca

SEQ ID NO: 9164467 - DNA, 22 bp, Homo sapiens
agcaggaaggctttgggggttc

SEQ ID NO: 9164468 - DNA, 22 bp, Homo sapiens
agcaggaaggggcctagcctgg

SEQ ID NO: 9164469 - DNA, 22 bp, Homo sapiens
agcaggaaggtctgtgtgagtc

SEQ ID NO: 9164470 - DNA, 22 bp, Homo sapiens
agcaggaaggggcctagcctgg

SEQ ID NO: 9164471 - DNA, 22 bp, Homo sapiens
agcaggaagtcctctcaggaga

SEQ ID NO: 9164472 - DNA, 17 bp, Homo sapiens
agcaggaccccagagca

SEQ ID NO: 9164473 - DNA, 22 bp, Homo sapiens
cacagcaatagctaactgatac

SEQ ID NO: 9164474 - DNA, 22 bp, Homo sapiens
cacagcaatagctaactgatac

SEQ ID NO: 9164475 - DNA, 22 bp, Homo sapiens
cacagcaagagctaaatgacca

SEQ ID NO: 9164476 - DNA, 22 bp, Homo sapiens
agcagtgattctcttggactca

SEQ ID NO: 9164477 - DNA, 22 bp, Homo sapiens
agcagtgattctcttggactca

SEQ ID NO: 9164478 - DNA, 22 bp, Homo sapiens
agcagtgatgcatgacagccta

SEQ ID NO: 9164479 - DNA, 22 bp, Homo sapiens
agcagtgatgaaatgagcatcc

SEQ ID NO: 9164480 - DNA, 22 bp, Homo sapiens
agcagtgagtgggaggaccatg

SEQ ID NO: 9164481 - DNA, 22 bp, Homo sapiens
agcagtgagtaacacagaccag

SEQ ID NO: 9164482 - DNA, 23 bp, Homo sapiens
agcagtgagtaaacagataggat

SEQ ID NO: 9164483 - DNA, 22 bp, Homo sapiens
agcagtgagtaacacagaccag

SEQ ID NO: 9164484 - DNA, 22 bp, Homo sapiens
agcagtgagtgggaggaccatg

SEQ ID NO: 9164485 - DNA, 22 bp, Homo sapiens
agcagtgagccataagtgctag

SEQ ID NO: 9164486 - DNA, 22 bp, Homo sapiens
agcagtgacttgctttgtttcc

SEQ ID NO: 9164487 - DNA, 22 bp, Homo sapiens
agcagtgaaacagctgcatatg

SEQ ID NO: 9164488 - DNA, 22 bp, Homo sapiens
agcagtcttgagggatgctaga

SEQ ID NO: 9164489 - DNA, 22 bp, Homo sapiens
agcagtgaaacagctgcatatg

SEQ ID NO: 9164490 - DNA, 22 bp, Homo sapiens
agcatgaaaggcgtgccaactt

SEQ ID NO: 9164491 - DNA, 22 bp, Homo sapiens
agcatgaagacttcagagctag

SEQ ID NO: 9164492 - DNA, 18 bp, Homo sapiens
agcatgagagaggctgtg

SEQ ID NO: 9164493 - DNA, 22 bp, Homo sapiens
agcatgatgtagaatcactgga

SEQ ID NO: 9164494 - DNA, 22 bp, Homo sapiens
agcatgaaagcataggacagtc

SEQ ID NO: 9164495 - DNA, 22 bp, Homo sapiens
agcatataggaaatgttgaatc

SEQ ID NO: 9164496 - DNA, 22 bp, Homo sapiens
agcagtcaggcctcagagccgt

SEQ ID NO: 9164497 - DNA, 20 bp, Homo sapiens
agcagtaggacctctgggcc

SEQ ID NO: 9164498 - DNA, 20 bp, Homo sapiens
agcagtaggacctctgggcc

SEQ ID NO: 9164499 - DNA, 22 bp, Homo sapiens
agcaggttgttttcttcaatat

SEQ ID NO: 9164500 - DNA, 22 bp, Homo sapiens
agcaggttaaaccaaaatataa

SEQ ID NO: 9164501 - DNA, 22 bp, Homo sapiens
agcaggtttgttttcttctgag

SEQ ID NO: 9164502 - DNA, 23 bp, Homo sapiens
agcagtaacttcagaaacatcag

SEQ ID NO: 9164503 - DNA, 19 bp, Homo sapiens
agcaggtgggtaagaaaat

SEQ ID NO: 9164504 - DNA, 22 bp, Homo sapiens
agcaggtgtcggcgagggtctt

SEQ ID NO: 9164505 - DNA, 22 bp, Homo sapiens
agcaggtgtttgtatcataagg

SEQ ID NO: 9164506 - DNA, 22 bp, Homo sapiens
agcaggtgttggctgggccatc

SEQ ID NO: 9164507 - DNA, 22 bp, Homo sapiens
agcaggtgttagggatccaatg

SEQ ID NO: 9164508 - DNA, 22 bp, Homo sapiens
agcaggtgttagggatccaatg

SEQ ID NO: 9164509 - DNA, 22 bp, Homo sapiens
agcaggtgttagggatccaatg

SEQ ID NO: 9164510 - DNA, 22 bp, Homo sapiens
agcaggtgggcatgaaagctga

SEQ ID NO: 9164511 - DNA, 22 bp, Homo sapiens
agcaggtgggcatgaaagctga

SEQ ID NO: 9164512 - DNA, 22 bp, Homo sapiens
agcagggctggggcacgagcca

SEQ ID NO: 9164513 - DNA, 22 bp, Homo sapiens
agcagggctggatttggcaaga

SEQ ID NO: 9164514 - DNA, 22 bp, Homo sapiens
cactgtgggtcccagactggag

SEQ ID NO: 9164515 - DNA, 22 bp, Homo sapiens
cactgtggggtttggctggaac

SEQ ID NO: 9164516 - DNA, 22 bp, Homo sapiens
cactgtgtaagaagatgggctt

SEQ ID NO: 9164517 - DNA, 22 bp, Homo sapiens
agcattaataagaaatggctcc

SEQ ID NO: 9164518 - DNA, 22 bp, Homo sapiens
cactggtgagtccagaagtcat

SEQ ID NO: 9164519 - DNA, 22 bp, Homo sapiens
cacttaaaactcctggaattgt

SEQ ID NO: 9164520 - DNA, 23 bp, Homo sapiens
cactgtgttacatgttgaagatg

SEQ ID NO: 9164521 - DNA, 22 bp, Homo sapiens
agcatggggcaatgcatgtgct

SEQ ID NO: 9164522 - DNA, 22 bp, Homo sapiens
agcatggggctccgcaatgaac

SEQ ID NO: 9164523 - DNA, 22 bp, Homo sapiens
agcatggctttggaggatagca

SEQ ID NO: 9164524 - DNA, 22 bp, Homo sapiens
agcatggccacgggggtaggta

SEQ ID NO: 9164525 - DNA, 22 bp, Homo sapiens
agcatggcattattggaaggac

SEQ ID NO: 9164526 - DNA, 22 bp, Homo sapiens
agcatggacagtggcagcagtg

SEQ ID NO: 9164527 - DNA, 23 bp, Homo sapiens
agcatggaataggaaagaggcag

SEQ ID NO: 9164528 - DNA, 22 bp, Homo sapiens
agcatggacagtggcagcagtg

SEQ ID NO: 9164529 - DNA, 23 bp, Homo sapiens
agcatggaagaagctggactcct

SEQ ID NO: 9164530 - DNA, 20 bp, Homo sapiens
agcactgtctgaccagtggc

SEQ ID NO: 9164531 - DNA, 22 bp, Homo sapiens
agcactgggaacgcatggggcc

SEQ ID NO: 9164532 - DNA, 22 bp, Homo sapiens
agcactgctttagagcctctgc

SEQ ID NO: 9164533 - DNA, 22 bp, Homo sapiens
agcactctggagtaggagtggg

SEQ ID NO: 9164534 - DNA, 22 bp, Homo sapiens
agcactcctgtctttccccttt

SEQ ID NO: 9164535 - DNA, 22 bp, Homo sapiens
agcactagctttaagcattctg

SEQ ID NO: 9164536 - DNA, 22 bp, Homo sapiens
agcactagacatgtaagtgagc

SEQ ID NO: 9164537 - DNA, 22 bp, Homo sapiens
agcaccttgagatcaagcagtg

SEQ ID NO: 9164538 - DNA, 22 bp, Homo sapiens
agcaccttgctcttggccttcc

SEQ ID NO: 9164539 - DNA, 22 bp, Homo sapiens
agcaccttgatcttggacttcc

SEQ ID NO: 9164540 - DNA, 22 bp, Homo sapiens
agcaccttgagatcaagcagtg

SEQ ID NO: 9164541 - DNA, 21 bp, Homo sapiens
agcaccttcaattctattgtc

SEQ ID NO: 9164542 - DNA, 22 bp, Homo sapiens
agcacctgtgtgagctagatgt

SEQ ID NO: 9164543 - DNA, 22 bp, Homo sapiens
agcacctgtgttcatgcctcat

SEQ ID NO: 9164544 - DNA, 21 bp, Homo sapiens
agcaccttacagctataatgg

SEQ ID NO: 9164545 - DNA, 22 bp, Homo sapiens
agcacctgttgcacttcataat

SEQ ID NO: 9164546 - DNA, 20 bp, Homo sapiens
agcacctgtgtagaagcatc

SEQ ID NO: 9164547 - DNA, 20 bp, Homo sapiens
agcacctgtgtagaagcatc

SEQ ID NO: 9164548 - DNA, 22 bp, Homo sapiens
caaagggaaacgcagtgtcaag

SEQ ID NO: 9164549 - DNA, 22 bp, Homo sapiens
caaaggcatgtgagtatatgtg

SEQ ID NO: 9164550 - DNA, 22 bp, Homo sapiens
caaaggcatgtgagtatatgtg

SEQ ID NO: 9164551 - DNA, 22 bp, Homo sapiens
caaaggcatcggcaattaggga

SEQ ID NO: 9164552 - DNA, 22 bp, Homo sapiens
caaaggcagttactgaatgaag

SEQ ID NO: 9164553 - DNA, 22 bp, Homo sapiens
caaaggcagttactgaatgaag

SEQ ID NO: 9164554 - DNA, 22 bp, Homo sapiens
caaaggcatgtgagtatatgtg

SEQ ID NO: 9164555 - DNA, 20 bp, Homo sapiens
agcaccagtgggggcagccc

SEQ ID NO: 9164556 - DNA, 22 bp, Homo sapiens
agcacctgcttgtgactaggga

SEQ ID NO: 9164557 - DNA, 22 bp, Homo sapiens
agcacctgcttgtgactaggga

SEQ ID NO: 9164558 - DNA, 22 bp, Homo sapiens
agcacctggagggctgggacct

SEQ ID NO: 9164559 - DNA, 22 bp, Homo sapiens
agcacctggagggctgggacct

SEQ ID NO: 9164560 - DNA, 19 bp, Homo sapiens
agcacctgtgagagcctgg

SEQ ID NO: 9164561 - DNA, 17 bp, Homo sapiens
agcacctgtccagtccc

SEQ ID NO: 9164562 - DNA, 22 bp, Homo sapiens
agcacctgtcacaagcagaagg

SEQ ID NO: 9164563 - DNA, 23 bp, Homo sapiens
agcacctgtgatttcctagctct

SEQ ID NO: 9164564 - DNA, 19 bp, Homo sapiens
agcacctgtgagagcctgg

SEQ ID NO: 9164565 - DNA, 22 bp, Homo sapiens
agcacctgtcacaagcagaagg

SEQ ID NO: 9164566 - DNA, 22 bp, Homo sapiens
agcacctgggctggaagacccc

SEQ ID NO: 9164567 - DNA, 22 bp, Homo sapiens
agcacctgtcaagtccaggctg

SEQ ID NO: 9164568 - DNA, 22 bp, Homo sapiens
agcacctggatttgatagtcag

SEQ ID NO: 9164569 - DNA, 21 bp, Homo sapiens
agcagaggcagaatgtatgca

SEQ ID NO: 9164570 - DNA, 21 bp, Homo sapiens
agcagaggctgcctggtgact

SEQ ID NO: 9164571 - DNA, 22 bp, Homo sapiens
agcagagctgggatcctgggtc

SEQ ID NO: 9164572 - DNA, 22 bp, Homo sapiens
agcagagctttttggactcaga

SEQ ID NO: 9164573 - DNA, 22 bp, Homo sapiens
agcagaggaggatttagttagg

SEQ ID NO: 9164574 - DNA, 22 bp, Homo sapiens
agcagaggaggatttagttagg

SEQ ID NO: 9164575 - DNA, 22 bp, Homo sapiens
agcagaggacagttcttaggaa

SEQ ID NO: 9164576 - DNA, 22 bp, Homo sapiens
agcagaggacagttcttaggaa

SEQ ID NO: 9164577 - DNA, 22 bp, Homo sapiens
agcagagcgcctgctcagaggg

SEQ ID NO: 9164578 - DNA, 22 bp, Homo sapiens
agcagagaccatatagcccaga

SEQ ID NO: 9164579 - DNA, 22 bp, Homo sapiens
agcagagacctggttttgttga

SEQ ID NO: 9164580 - DNA, 22 bp, Homo sapiens
agcactgtgagcaccagcacgc

SEQ ID NO: 9164581 - DNA, 22 bp, Homo sapiens
agcactgtgagcaccagcacgc

SEQ ID NO: 9164582 - DNA, 22 bp, Homo sapiens
agcactgtgatttataacattt

SEQ ID NO: 9164583 - DNA, 22 bp, Homo sapiens
agcactgtggggaactcacaga

SEQ ID NO: 9164584 - DNA, 20 bp, Homo sapiens
agcagagtgcccatcccgga

SEQ ID NO: 9164585 - DNA, 22 bp, Homo sapiens
agcagaggtttgttggaaacct

SEQ ID NO: 9164586 - DNA, 21 bp, Homo sapiens
agcagaggggacatgtttgat

SEQ ID NO: 9164587 - DNA, 22 bp, Homo sapiens
agcagaggtgtttattatggga

SEQ ID NO: 9164588 - DNA, 22 bp, Homo sapiens
agcagaggtgtttattatggga

SEQ ID NO: 9164589 - DNA, 20 bp, Homo sapiens
agcagagtgcccatcccgga

SEQ ID NO: 9164590 - DNA, 20 bp, Homo sapiens
agcagagtgcccatcccgga

SEQ ID NO: 9164591 - DNA, 22 bp, Homo sapiens
caataagtaataggcatctaat

SEQ ID NO: 9164592 - DNA, 22 bp, Homo sapiens
caataatatcctgtgctgtttg

SEQ ID NO: 9164593 - DNA, 20 bp, Homo sapiens
caataatttacttccctatt

SEQ ID NO: 9164594 - DNA, 22 bp, Homo sapiens
caataatttacattggatacca

SEQ ID NO: 9164595 - DNA, 22 bp, Homo sapiens
caataattgctttccagagtta

SEQ ID NO: 9164596 - DNA, 21 bp, Homo sapiens
agcagcagatctggtgagggc

SEQ ID NO: 9164597 - DNA, 21 bp, Homo sapiens
agcagcagatctggtgagggc

SEQ ID NO: 9164598 - DNA, 22 bp, Homo sapiens
agcagccagagaatgatgcagt

SEQ ID NO: 9164599 - DNA, 22 bp, Homo sapiens
agcagccagagaatgatgcagt

SEQ ID NO: 9164600 - DNA, 22 bp, Homo sapiens
agcagcctcccagggagcagcc

SEQ ID NO: 9164601 - DNA, 22 bp, Homo sapiens
agcagcctctgtagaggtctcc

SEQ ID NO: 9164602 - DNA, 22 bp, Homo sapiens
agcagccttaggtattgtgatt

SEQ ID NO: 9164603 - DNA, 22 bp, Homo sapiens
agcagcctggtctctcgccaat

SEQ ID NO: 9164604 - DNA, 22 bp, Homo sapiens
agcagccctagggattgctgtt

SEQ ID NO: 9164605 - DNA, 23 bp, Homo sapiens
agcagccctgggacctggcctgc

SEQ ID NO: 9164606 - DNA, 22 bp, Homo sapiens
agcagcagagctctggtctgca

SEQ ID NO: 9164607 - DNA, 22 bp, Homo sapiens
agcagcagagctctggtctgca

SEQ ID NO: 9164608 - DNA, 19 bp, Homo sapiens
agcagcagaagtgtgcctt

SEQ ID NO: 9164609 - DNA, 22 bp, Homo sapiens
agcagcagaggtcagaaaggta

SEQ ID NO: 9164610 - DNA, 22 bp, Homo sapiens
agcagcagaggtcagaaaggta

SEQ ID NO: 9164611 - DNA, 22 bp, Homo sapiens
agcagcagaggtcagaaaggta

SEQ ID NO: 9164612 - DNA, 22 bp, Homo sapiens
agcagcagaggtcagaaaggta

SEQ ID NO: 9164613 - DNA, 22 bp, Homo sapiens
agcagcagaggtcagaaaggta

SEQ ID NO: 9164614 - DNA, 22 bp, Homo sapiens
agcagcagatcaaacaggcttg

SEQ ID NO: 9164615 - DNA, 22 bp, Homo sapiens
agcagcagatcaaacaggcttg

SEQ ID NO: 9164616 - DNA, 22 bp, Homo sapiens
agcagcagatcaaacaggcttg

SEQ ID NO: 9164617 - DNA, 22 bp, Homo sapiens
agcagcagatcaaacaggcttg

SEQ ID NO: 9164618 - DNA, 22 bp, Homo sapiens
agcagcagatcaaacaggcttg

SEQ ID NO: 9164619 - DNA, 22 bp, Homo sapiens
agcagcagatcaaacaggcttg

SEQ ID NO: 9164620 - DNA, 16 bp, Homo sapiens
caatacatggcatttc

SEQ ID NO: 9164621 - DNA, 22 bp, Homo sapiens
caatactgagtttacattcatc

SEQ ID NO: 9164622 - DNA, 22 bp, Homo sapiens
caatactgagtttacattcatc

SEQ ID NO: 9164623 - DNA, 18 bp, Homo sapiens
caatactgagaggtgggg

SEQ ID NO: 9164624 - DNA, 22 bp, Homo sapiens
caatacatcaggtcaaaatgtg

SEQ ID NO: 9164625 - DNA, 22 bp, Homo sapiens
caatacatcaggtcaaaatgtg

SEQ ID NO: 9164626 - DNA, 22 bp, Homo sapiens
caatacactaaacttctctgaa

SEQ ID NO: 9164627 - DNA, 22 bp, Homo sapiens
caatacaattaccagttaatca

SEQ ID NO: 9164628 - DNA, 22 bp, Homo sapiens
cacagaacatccttagctcatg

SEQ ID NO: 9164629 - DNA, 22 bp, Homo sapiens
agcagccttgtgactccggggt

SEQ ID NO: 9164630 - DNA, 21 bp, Homo sapiens
agcagccttgtgtgccaggca

SEQ ID NO: 9164631 - DNA, 22 bp, Homo sapiens
agcagctcaaagcctgcaagga

SEQ ID NO: 9164632 - DNA, 22 bp, Homo sapiens
agcagctatttcttccagagag

SEQ ID NO: 9164633 - DNA, 22 bp, Homo sapiens
agcagctagacttcagaatctg

SEQ ID NO: 9164634 - DNA, 22 bp, Homo sapiens
agcagctagaatagtgcctggt

SEQ ID NO: 9164635 - DNA, 19 bp, Homo sapiens
agcagcgtttaaaaaatgc

SEQ ID NO: 9164636 - DNA, 22 bp, Homo sapiens
agcagcctttgatcatctggga

SEQ ID NO: 9164637 - DNA, 22 bp, Homo sapiens
agcagctcagaggcaccagggc

SEQ ID NO: 9164638 - DNA, 22 bp, Homo sapiens
cacagagctcaagtcttagaaa

SEQ ID NO: 9164639 - DNA, 22 bp, Homo sapiens
agcagctgcttttcttcattgg

SEQ ID NO: 9164640 - DNA, 22 bp, Homo sapiens
cacagagcaggggtctgtgtca

SEQ ID NO: 9164641 - DNA, 22 bp, Homo sapiens
cacagagcaggggtctgtgtca

SEQ ID NO: 9164642 - DNA, 22 bp, Homo sapiens
agcagctggaactaatagtggt

SEQ ID NO: 9164643 - DNA, 22 bp, Homo sapiens
agcagctggaacatatgaagaa

SEQ ID NO: 9164644 - DNA, 22 bp, Homo sapiens
agcagctggaacatatgaagaa

SEQ ID NO: 9164645 - DNA, 22 bp, Homo sapiens
agcagctggaacatatgaagaa

SEQ ID NO: 9164646 - DNA, 17 bp, Homo sapiens
agcagctggcacaggag

SEQ ID NO: 9164647 - DNA, 17 bp, Homo sapiens
agcagctggcacaggag

SEQ ID NO: 9164648 - DNA, 17 bp, Homo sapiens
agcagctggcacaggag

SEQ ID NO: 9164649 - DNA, 17 bp, Homo sapiens
agcagctggcacaggag

SEQ ID NO: 9164650 - DNA, 21 bp, Homo sapiens
agcagctgggcaacatggagg

SEQ ID NO: 9164651 - DNA, 21 bp, Homo sapiens
agcagctgggcaacatggagg

SEQ ID NO: 9164652 - DNA, 22 bp, Homo sapiens
agcagctggaactaatagtggt

SEQ ID NO: 9164653 - DNA, 19 bp, Homo sapiens
agcagctggaggtggagtg

SEQ ID NO: 9164654 - DNA, 19 bp, Homo sapiens
agcagctggaggtggagtg

SEQ ID NO: 9164655 - DNA, 17 bp, Homo sapiens
agcagctggcacaggag

SEQ ID NO: 9164656 - DNA, 22 bp, Homo sapiens
agctaaggaatcagaagaggtt

SEQ ID NO: 9164657 - DNA, 20 bp, Homo sapiens
agctaagaggaaaagtgaga

SEQ ID NO: 9164658 - DNA, 22 bp, Homo sapiens
agctacacttaaccacatagca

SEQ ID NO: 9164659 - DNA, 22 bp, Homo sapiens
agctacacccctttacagtcct

SEQ ID NO: 9164660 - DNA, 22 bp, Homo sapiens
agctacacacacaggtgtttta

SEQ ID NO: 9164661 - DNA, 22 bp, Homo sapiens
agctacacaggaggactcttct

SEQ ID NO: 9164662 - DNA, 20 bp, Homo sapiens
agctacaatgcgaagctggc

SEQ ID NO: 9164663 - DNA, 22 bp, Homo sapiens
agctacaagtcatcagctatca

SEQ ID NO: 9164664 - DNA, 22 bp, Homo sapiens
agctacaaaattactaagtcct

SEQ ID NO: 9164665 - DNA, 22 bp, Homo sapiens
agctacctggcttatcactgtc

SEQ ID NO: 9164666 - DNA, 22 bp, Homo sapiens
agctacctgatccttcttctga

SEQ ID NO: 9164667 - DNA, 22 bp, Homo sapiens
agctagaactacaggcatgtgc

SEQ ID NO: 9164668 - DNA, 22 bp, Homo sapiens
agctagactttccctttccatg

SEQ ID NO: 9164669 - DNA, 22 bp, Homo sapiens
agcctgggccctgcctcttctc

SEQ ID NO: 9164670 - DNA, 22 bp, Homo sapiens
agcctgggccctgcctcttctc

SEQ ID NO: 9164671 - DNA, 18 bp, Homo sapiens
agcctgggctctgcctgg

SEQ ID NO: 9164672 - DNA, 22 bp, Homo sapiens
agcctgggttagggttcttccc

SEQ ID NO: 9164673 - DNA, 22 bp, Homo sapiens
agctaagacttagtgacttagt

SEQ ID NO: 9164674 - DNA, 22 bp, Homo sapiens
agctaagaacttgagctctgga

SEQ ID NO: 9164675 - DNA, 22 bp, Homo sapiens
agctaacatggaggaaaaagtt

SEQ ID NO: 9164676 - DNA, 23 bp, Homo sapiens
agctaacagatcgacaaagtata

SEQ ID NO: 9164677 - DNA, 20 bp, Homo sapiens
agcggaccaggccattgttg

SEQ ID NO: 9164678 - DNA, 22 bp, Homo sapiens
cagcaactgtgcctgacacaca

SEQ ID NO: 9164679 - DNA, 22 bp, Homo sapiens
cagcaacatgtggtagtgtagg

SEQ ID NO: 9164680 - DNA, 22 bp, Homo sapiens
cagcaaattttaatactgcttt

SEQ ID NO: 9164681 - DNA, 22 bp, Homo sapiens
cagatgtacatgaagggcaatg

SEQ ID NO: 9164682 - DNA, 22 bp, Homo sapiens
cagatgtgccgcggcgccgctc

SEQ ID NO: 9164683 - DNA, 22 bp, Homo sapiens
cagatgtgcctccagggctttg

SEQ ID NO: 9164684 - DNA, 22 bp, Homo sapiens
cagatggggcaaggccatctgt

SEQ ID NO: 9164685 - DNA, 22 bp, Homo sapiens
cagatggctgccttcttgctgt

SEQ ID NO: 9164686 - DNA, 22 bp, Homo sapiens
agcctgggcaacaacacagcga

SEQ ID NO: 9164687 - DNA, 21 bp, Homo sapiens
agcctgggaggcggaggttgc

SEQ ID NO: 9164688 - DNA, 19 bp, Homo sapiens
agcctggctttgctctgct

SEQ ID NO: 9164689 - DNA, 17 bp, Homo sapiens
agcctgggaaggagtga

SEQ ID NO: 9164690 - DNA, 19 bp, Homo sapiens
agcctggctttgctctgct

SEQ ID NO: 9164691 - DNA, 19 bp, Homo sapiens
agcctggctttgctctgct

SEQ ID NO: 9164692 - DNA, 19 bp, Homo sapiens
agcctggctttgctctgct

SEQ ID NO: 9164693 - DNA, 22 bp, Homo sapiens
cagcaagaacagcctgatgtgc

SEQ ID NO: 9164694 - DNA, 22 bp, Homo sapiens
cagcaagaaaattcacatgctc

SEQ ID NO: 9164695 - DNA, 22 bp, Homo sapiens
cagcaagaaaattcacatgctc

SEQ ID NO: 9164696 - DNA, 22 bp, Homo sapiens
cagcaagaatcagacaacctca

SEQ ID NO: 9164697 - DNA, 22 bp, Homo sapiens
agctcctgtgtgaagcctccct

SEQ ID NO: 9164698 - DNA, 22 bp, Homo sapiens
agctcctgtggcagctcttctg

SEQ ID NO: 9164699 - DNA, 22 bp, Homo sapiens
agctctgggattctcaggccac

SEQ ID NO: 9164700 - DNA, 22 bp, Homo sapiens
agctcctgtctcaagggagcct

SEQ ID NO: 9164701 - DNA, 22 bp, Homo sapiens
agctctgtgttcacagcactaa

SEQ ID NO: 9164702 - DNA, 22 bp, Homo sapiens
agctctgtgttcacagcactaa

SEQ ID NO: 9164703 - DNA, 22 bp, Homo sapiens
agctctgtgcaggcagaggcat

SEQ ID NO: 9164704 - DNA, 22 bp, Homo sapiens
agctctgggccaggaaccctaa

SEQ ID NO: 9164705 - DNA, 19 bp, Homo sapiens
agctctgtcaggctacata

SEQ ID NO: 9164706 - DNA, 18 bp, Homo sapiens
agctcctggtctcaggga

SEQ ID NO: 9164707 - DNA, 18 bp, Homo sapiens
agctcctggtctcaggga

SEQ ID NO: 9164708 - DNA, 20 bp, Homo sapiens
agctcctggtataggtgcct

SEQ ID NO: 9164709 - DNA, 22 bp, Homo sapiens
agctcctgggggttccaagcag

SEQ ID NO: 9164710 - DNA, 22 bp, Homo sapiens
agctcctggtgcctcagccgaa

SEQ ID NO: 9164711 - DNA, 22 bp, Homo sapiens
agctcctggtctttgtccagag

SEQ ID NO: 9164712 - DNA, 22 bp, Homo sapiens
agctcctgtctcaagggagcct

SEQ ID NO: 9164713 - DNA, 22 bp, Homo sapiens
agctcctgtctcaagggagcct

SEQ ID NO: 9164714 - DNA, 22 bp, Homo sapiens
agctcctgtctcaagggagcct

SEQ ID NO: 9164715 - DNA, 22 bp, Homo sapiens
agctcctgtagtacatattatt

SEQ ID NO: 9164716 - DNA, 23 bp, Homo sapiens
agctcctgtaaggtggtcgtcac

SEQ ID NO: 9164717 - DNA, 22 bp, Homo sapiens
agctcctgggccatcacaacca

SEQ ID NO: 9164718 - DNA, 19 bp, Homo sapiens
agctcctgggctctgggcc

SEQ ID NO: 9164719 - DNA, 19 bp, Homo sapiens
agctcctgggctctgggcc

SEQ ID NO: 9164720 - DNA, 22 bp, Homo sapiens
agctcctgggcacctctttcac

SEQ ID NO: 9164721 - DNA, 22 bp, Homo sapiens
agctcctgggccaagcccatgc

SEQ ID NO: 9164722 - DNA, 22 bp, Homo sapiens
agctcctgggccaagcccatgc

SEQ ID NO: 9164723 - DNA, 22 bp, Homo sapiens
agctcctggctttcctctcacc

SEQ ID NO: 9164724 - DNA, 22 bp, Homo sapiens
agctcctggctttcctctcacc

SEQ ID NO: 9164725 - DNA, 22 bp, Homo sapiens
agctcctgggagcaggtggtac

SEQ ID NO: 9164726 - DNA, 22 bp, Homo sapiens
agctcctggcaaggtcatggtg

SEQ ID NO: 9164727 - DNA, 22 bp, Homo sapiens
agctaggaaattgaggctgaga

SEQ ID NO: 9164728 - DNA, 22 bp, Homo sapiens
agctaggaaattgaggctgaga

SEQ ID NO: 9164729 - DNA, 20 bp, Homo sapiens
agctaggagaaagcatggag

SEQ ID NO: 9164730 - DNA, 22 bp, Homo sapiens
agctaggacaggtagagatggg

SEQ ID NO: 9164731 - DNA, 20 bp, Homo sapiens
agctaggagaaagcatggag

SEQ ID NO: 9164732 - DNA, 23 bp, Homo sapiens
agctccagaacatagcacaggaa

SEQ ID NO: 9164733 - DNA, 23 bp, Homo sapiens
agctccagaacatagcacaggaa

SEQ ID NO: 9164734 - DNA, 23 bp, Homo sapiens
agctccagaacatagcacaggaa

SEQ ID NO: 9164735 - DNA, 23 bp, Homo sapiens
agctccagaacatagcacaggaa

SEQ ID NO: 9164736 - DNA, 23 bp, Homo sapiens
agctccagaacatagcacaggaa

SEQ ID NO: 9164737 - DNA, 22 bp, Homo sapiens
agctccagaagcctgcaaggta

SEQ ID NO: 9164738 - DNA, 22 bp, Homo sapiens
agctccagaagcctgcaaggta

SEQ ID NO: 9164739 - DNA, 22 bp, Homo sapiens
agctccagaggcagtgatgaag

SEQ ID NO: 9164740 - DNA, 22 bp, Homo sapiens
agctccagcccatctgctcgtg

SEQ ID NO: 9164741 - DNA, 22 bp, Homo sapiens
agctccaggataagacaggtgc

SEQ ID NO: 9164742 - DNA, 22 bp, Homo sapiens
agctccaggataagacaggtgc

SEQ ID NO: 9164743 - DNA, 19 bp, Homo sapiens
agctccaggcctggatgct

SEQ ID NO: 9164744 - DNA, 19 bp, Homo sapiens
agctccaggcctggatgct

SEQ ID NO: 9164745 - DNA, 23 bp, Homo sapiens
agctccagctgacgtgggcagcc

SEQ ID NO: 9164746 - DNA, 23 bp, Homo sapiens
agctccagctgacgtgggcagcc

SEQ ID NO: 9164747 - DNA, 22 bp, Homo sapiens
agctccagcctcttctggaggt

SEQ ID NO: 9164748 - DNA, 22 bp, Homo sapiens
agctccagccgctgatgggttt

SEQ ID NO: 9164749 - DNA, 22 bp, Homo sapiens
agctccagcctcttctggaggt

SEQ ID NO: 9164750 - DNA, 22 bp, Homo sapiens
agctccagcggatggtcttata

SEQ ID NO: 9164751 - DNA, 22 bp, Homo sapiens
agctccagcctcttctggaggt

SEQ ID NO: 9164752 - DNA, 21 bp, Homo sapiens
agctccaggctcctggggttc

SEQ ID NO: 9164753 - DNA, 21 bp, Homo sapiens
agctccaggctcctggggttc

SEQ ID NO: 9164754 - DNA, 22 bp, Homo sapiens
agctccagggaaagagtggatc

SEQ ID NO: 9164755 - DNA, 22 bp, Homo sapiens
agctcctgattctcagagatag

SEQ ID NO: 9164756 - DNA, 20 bp, Homo sapiens
agctcctggactagagagtg

SEQ ID NO: 9164757 - DNA, 22 bp, Homo sapiens
agctcctggatgaggcttatgt

SEQ ID NO: 9164758 - DNA, 22 bp, Homo sapiens
agctcctggaggtgcgcactcg

SEQ ID NO: 9164759 - DNA, 22 bp, Homo sapiens
agctcctgcttgacagaagagg

SEQ ID NO: 9164760 - DNA, 22 bp, Homo sapiens
agccagcccctgactgtgtcct

SEQ ID NO: 9164761 - DNA, 22 bp, Homo sapiens
agccagccgggggaccacagtg

SEQ ID NO: 9164762 - DNA, 22 bp, Homo sapiens
agccagctaccggggctcctgg

SEQ ID NO: 9164763 - DNA, 22 bp, Homo sapiens
agccagctaccggggctcctgg

SEQ ID NO: 9164764 - DNA, 22 bp, Homo sapiens
agccagcctgatctcttcttgc

SEQ ID NO: 9164765 - DNA, 22 bp, Homo sapiens
agccagctaccggggctcctgg

SEQ ID NO: 9164766 - DNA, 22 bp, Homo sapiens
agccagcatcccttcagtctcc

SEQ ID NO: 9164767 - DNA, 22 bp, Homo sapiens
agccagcatcttgcttcttgag

SEQ ID NO: 9164768 - DNA, 20 bp, Homo sapiens
agccagccacttcctgctcc

SEQ ID NO: 9164769 - DNA, 20 bp, Homo sapiens
agccagccacttcctgctcc

SEQ ID NO: 9164770 - DNA, 22 bp, Homo sapiens
agccagcatgaagacagaggcc

SEQ ID NO: 9164771 - DNA, 22 bp, Homo sapiens
agccagcaggtgagtgcagcct

SEQ ID NO: 9164772 - DNA, 22 bp, Homo sapiens
agccagcaggtgagtgcagcct

SEQ ID NO: 9164773 - DNA, 22 bp, Homo sapiens
agccagcagggcttagaggaca

SEQ ID NO: 9164774 - DNA, 22 bp, Homo sapiens
agccagcaggaacgtctaggtt

SEQ ID NO: 9164775 - DNA, 22 bp, Homo sapiens
agccagatgaagaggtccttaa

SEQ ID NO: 9164776 - DNA, 21 bp, Homo sapiens
agccagatccattttgcatgg

SEQ ID NO: 9164777 - DNA, 21 bp, Homo sapiens
agccagatccattttgcatgg

SEQ ID NO: 9164778 - DNA, 22 bp, Homo sapiens
agccagatgtgagaaagaacac

SEQ ID NO: 9164779 - DNA, 21 bp, Homo sapiens
agccagcaacacagcatctcc

SEQ ID NO: 9164780 - DNA, 22 bp, Homo sapiens
agccagcacggcgccatggagt

SEQ ID NO: 9164781 - DNA, 22 bp, Homo sapiens
agccagcacggcgccatggagt

SEQ ID NO: 9164782 - DNA, 22 bp, Homo sapiens
agccagcactttttctctgggc

SEQ ID NO: 9164783 - DNA, 22 bp, Homo sapiens
agccagcacggatttcccagga

SEQ ID NO: 9164784 - DNA, 21 bp, Homo sapiens
agccagcaacacagcatctcc

SEQ ID NO: 9164785 - DNA, 22 bp, Homo sapiens
cactttctgtgttgtgcaaaaa

SEQ ID NO: 9164786 - DNA, 22 bp, Homo sapiens
cactttctgtgttgtgcaaaaa

SEQ ID NO: 9164787 - DNA, 22 bp, Homo sapiens
agccagagatccatccctagga

SEQ ID NO: 9164788 - DNA, 22 bp, Homo sapiens
agccagataaaagcatttaaag

SEQ ID NO: 9164789 - DNA, 22 bp, Homo sapiens
agccagataaaagcatttaaag

SEQ ID NO: 9164790 - DNA, 22 bp, Homo sapiens
agccagatccaggagacagctc

SEQ ID NO: 9164791 - DNA, 22 bp, Homo sapiens
agccagagttgaatgtgagtct

SEQ ID NO: 9164792 - DNA, 22 bp, Homo sapiens
agccagatccaggagacagctc

SEQ ID NO: 9164793 - DNA, 22 bp, Homo sapiens
cactttctcatgaatttggccc

SEQ ID NO: 9164794 - DNA, 22 bp, Homo sapiens
cactttattataaatttgagag

SEQ ID NO: 9164795 - DNA, 19 bp, Homo sapiens
cactttatttctgttttgt

SEQ ID NO: 9164796 - DNA, 22 bp, Homo sapiens
cagagacccttctcagtggcca

SEQ ID NO: 9164797 - DNA, 22 bp, Homo sapiens
agccaggccagactcacaccct

SEQ ID NO: 9164798 - DNA, 17 bp, Homo sapiens
agccaggcatatgaagt

SEQ ID NO: 9164799 - DNA, 22 bp, Homo sapiens
cagagacattcagtaaattatc

SEQ ID NO: 9164800 - DNA, 22 bp, Homo sapiens
cagagaaagggtgaattccttc

SEQ ID NO: 9164801 - DNA, 22 bp, Homo sapiens
cagagacatccatgttagttgg

SEQ ID NO: 9164802 - DNA, 22 bp, Homo sapiens
cagagacatgtggcctgcacgt

SEQ ID NO: 9164803 - DNA, 22 bp, Homo sapiens
cagagccttagttctcctagaa

SEQ ID NO: 9164804 - DNA, 22 bp, Homo sapiens
cagagccttagttctcctagaa

SEQ ID NO: 9164805 - DNA, 22 bp, Homo sapiens
cagagccttagttctcctagaa

SEQ ID NO: 9164806 - DNA, 19 bp, Homo sapiens
cagagccttcagtgactcc

SEQ ID NO: 9164807 - DNA, 22 bp, Homo sapiens
cagagccttcctagcagactct

SEQ ID NO: 9164808 - DNA, 22 bp, Homo sapiens
cagagctcagagctgccaggca

SEQ ID NO: 9164809 - DNA, 22 bp, Homo sapiens
cagagctcagagctgccaggca

SEQ ID NO: 9164810 - DNA, 22 bp, Homo sapiens
cagagcccagggcctacgtccc

SEQ ID NO: 9164811 - DNA, 22 bp, Homo sapiens
cagagcctggcgatgtcatgga

SEQ ID NO: 9164812 - DNA, 22 bp, Homo sapiens
agccaggccttagggagaggca

SEQ ID NO: 9164813 - DNA, 22 bp, Homo sapiens
agccaggccttttctcaaggtt

SEQ ID NO: 9164814 - DNA, 22 bp, Homo sapiens
cagagcccaagagcaagccatg

SEQ ID NO: 9164815 - DNA, 22 bp, Homo sapiens
agccaggccagctgtcttgagt

SEQ ID NO: 9164816 - DNA, 20 bp, Homo sapiens
agccaggcctcaagttaagt

SEQ ID NO: 9164817 - DNA, 22 bp, Homo sapiens
agccaggccagctgtcttgagt

SEQ ID NO: 9164818 - DNA, 22 bp, Homo sapiens
agccaggccttagggagaggca

SEQ ID NO: 9164819 - DNA, 22 bp, Homo sapiens
agccctgcgtgccaggggactg

SEQ ID NO: 9164820 - DNA, 23 bp, Homo sapiens
agccctgctgagacccagctccc

SEQ ID NO: 9164821 - DNA, 23 bp, Homo sapiens
agccctgctgagacccagctccc

SEQ ID NO: 9164822 - DNA, 22 bp, Homo sapiens
agccccagttccctggaagtct

SEQ ID NO: 9164823 - DNA, 22 bp, Homo sapiens
agcccccaaaagtgcttatgat

SEQ ID NO: 9164824 - DNA, 22 bp, Homo sapiens
agccctggaagccacagtccta

SEQ ID NO: 9164825 - DNA, 22 bp, Homo sapiens
agccctggaagccacagtccta

SEQ ID NO: 9164826 - DNA, 22 bp, Homo sapiens
agccctggaagccacagtccta

SEQ ID NO: 9164827 - DNA, 22 bp, Homo sapiens
agccctggaccttagcccccac

SEQ ID NO: 9164828 - DNA, 22 bp, Homo sapiens
agccctggaccttagcccccac

SEQ ID NO: 9164829 - DNA, 22 bp, Homo sapiens
agccctggattctgaggtccaa

SEQ ID NO: 9164830 - DNA, 22 bp, Homo sapiens
agccctggattctgaggtccaa

SEQ ID NO: 9164831 - DNA, 22 bp, Homo sapiens
agccctggatggacagtttccc

SEQ ID NO: 9164832 - DNA, 22 bp, Homo sapiens
agccctggagcaaaggtgtctt

SEQ ID NO: 9164833 - DNA, 22 bp, Homo sapiens
agccctggcagagccaggtagt

SEQ ID NO: 9164834 - DNA, 22 bp, Homo sapiens
agccctggcagagccaggtagt

SEQ ID NO: 9164835 - DNA, 22 bp, Homo sapiens
agccctgggcgttactgggatg

SEQ ID NO: 9164836 - DNA, 22 bp, Homo sapiens
agccctgggcagccaaggaagc

SEQ ID NO: 9164837 - DNA, 22 bp, Homo sapiens
agccctgggcgttactgggatg

SEQ ID NO: 9164838 - DNA, 22 bp, Homo sapiens
cagatggccagaggcagctgca

SEQ ID NO: 9164839 - DNA, 22 bp, Homo sapiens
cagatggctgccaagatgggct

SEQ ID NO: 9164840 - DNA, 20 bp, Homo sapiens
cagatgggacgtggaggagt

SEQ ID NO: 9164841 - DNA, 22 bp, Homo sapiens
cagatggcatttcctttctggc

SEQ ID NO: 9164842 - DNA, 19 bp, Homo sapiens
cagatggccacctacttgc

SEQ ID NO: 9164843 - DNA, 20 bp, Homo sapiens
cagatggcacgtcagggcat

SEQ ID NO: 9164844 - DNA, 22 bp, Homo sapiens
cagatggcagggcagctctgca

SEQ ID NO: 9164845 - DNA, 22 bp, Homo sapiens
agccctggctcccagcagcgct

SEQ ID NO: 9164846 - DNA, 22 bp, Homo sapiens
agccctgggagattttctgggt

SEQ ID NO: 9164847 - DNA, 22 bp, Homo sapiens
agccctgggcacctgtgagggg

SEQ ID NO: 9164848 - DNA, 22 bp, Homo sapiens
agccctgggaggccagcttgta

SEQ ID NO: 9164849 - DNA, 22 bp, Homo sapiens
agccctgggatacagtaaaagc

SEQ ID NO: 9164850 - DNA, 22 bp, Homo sapiens
agccctggcccggctgtgcttt

SEQ ID NO: 9164851 - DNA, 22 bp, Homo sapiens
agccccacactctctctgagaa

SEQ ID NO: 9164852 - DNA, 22 bp, Homo sapiens
agcccatggtgtactctgtggc

SEQ ID NO: 9164853 - DNA, 22 bp, Homo sapiens
agcccatgtggctgaggcttct

SEQ ID NO: 9164854 - DNA, 22 bp, Homo sapiens
agcccatgcaacaggcctagcg

SEQ ID NO: 9164855 - DNA, 22 bp, Homo sapiens
agcccatgcaacaggcctagcg

SEQ ID NO: 9164856 - DNA, 22 bp, Homo sapiens
agcccatgcagaccttcccaga

SEQ ID NO: 9164857 - DNA, 22 bp, Homo sapiens
agcccatgcaacaggcctagcg

SEQ ID NO: 9164858 - DNA, 22 bp, Homo sapiens
agcccaggttgaggctgcagtg

SEQ ID NO: 9164859 - DNA, 20 bp, Homo sapiens
agcccatctcccacagctac

SEQ ID NO: 9164860 - DNA, 22 bp, Homo sapiens
agcccaggttgaggctgcagtg

SEQ ID NO: 9164861 - DNA, 22 bp, Homo sapiens
agcccaggttgaggctgcagtg

SEQ ID NO: 9164862 - DNA, 22 bp, Homo sapiens
agcccaggttgaggctgcagtg

SEQ ID NO: 9164863 - DNA, 22 bp, Homo sapiens
agccccaggatgggccgcagga

SEQ ID NO: 9164864 - DNA, 22 bp, Homo sapiens
agccccagcccctctctcacaa

SEQ ID NO: 9164865 - DNA, 22 bp, Homo sapiens
agccccagtaagggagggcctg

SEQ ID NO: 9164866 - DNA, 22 bp, Homo sapiens
agccccaggcccggacgcctct

SEQ ID NO: 9164867 - DNA, 22 bp, Homo sapiens
agccagtttaagcaggaggggt

SEQ ID NO: 9164868 - DNA, 22 bp, Homo sapiens
agccagtttgcttgtaataaca

SEQ ID NO: 9164869 - DNA, 19 bp, Homo sapiens
agccagttctagacaatgg

SEQ ID NO: 9164870 - DNA, 22 bp, Homo sapiens
agccagttggctatgaggagga

SEQ ID NO: 9164871 - DNA, 19 bp, Homo sapiens
agccagttggtaagaggct

SEQ ID NO: 9164872 - DNA, 22 bp, Homo sapiens
agcccaggttctaaagccaaac

SEQ ID NO: 9164873 - DNA, 22 bp, Homo sapiens
agcccaggttctaaagccaaac

SEQ ID NO: 9164874 - DNA, 22 bp, Homo sapiens
agcccagggacagggcggatgt

SEQ ID NO: 9164875 - DNA, 22 bp, Homo sapiens
agcccagggacagggcggatgt

SEQ ID NO: 9164876 - DNA, 22 bp, Homo sapiens
agccagtgccagtcatgcctgc

SEQ ID NO: 9164877 - DNA, 22 bp, Homo sapiens
cagagctctgacagctacagcc

SEQ ID NO: 9164878 - DNA, 22 bp, Homo sapiens
cagagctctctttgctactaca

SEQ ID NO: 9164879 - DNA, 22 bp, Homo sapiens
agccagtgggattagagcctct

SEQ ID NO: 9164880 - DNA, 22 bp, Homo sapiens
agccagtgggattagagcctct

SEQ ID NO: 9164881 - DNA, 22 bp, Homo sapiens
agccagtgttaagtgactggtt

SEQ ID NO: 9164882 - DNA, 22 bp, Homo sapiens
agccagttcaagttatggcgtt

SEQ ID NO: 9164883 - DNA, 22 bp, Homo sapiens
aaatgctatttgggaacaacat

SEQ ID NO: 9164884 - DNA, 22 bp, Homo sapiens
aaatgcctctgggttattctag

SEQ ID NO: 9164885 - DNA, 22 bp, Homo sapiens
aaatgcctctgctgtacacaat

SEQ ID NO: 9164886 - DNA, 22 bp, Homo sapiens
aaatgcctcattttctctcact

SEQ ID NO: 9164887 - DNA, 22 bp, Homo sapiens
aaatgcctgaatggtatttggt

SEQ ID NO: 9164888 - DNA, 22 bp, Homo sapiens
aaatgctaacaaggaatgctgc

SEQ ID NO: 9164889 - DNA, 22 bp, Homo sapiens
aaatgctaaatgcagcaagtag

SEQ ID NO: 9164890 - DNA, 22 bp, Homo sapiens
aaatgccttcaaacacttaagg

SEQ ID NO: 9164891 - DNA, 22 bp, Homo sapiens
aaatgctacacaggaattctca

SEQ ID NO: 9164892 - DNA, 22 bp, Homo sapiens
aaatgctacacaggaattctca

SEQ ID NO: 9164893 - DNA, 18 bp, Homo sapiens
aaatgctaggctacatga

SEQ ID NO: 9164894 - DNA, 18 bp, Homo sapiens
aaatgctaggctacatga

SEQ ID NO: 9164895 - DNA, 22 bp, Homo sapiens
aaatcattatttacagttctga

SEQ ID NO: 9164896 - DNA, 22 bp, Homo sapiens
aaatccagctacggggcaacat

SEQ ID NO: 9164897 - DNA, 22 bp, Homo sapiens
aaatcatggtggaagaaacaga

SEQ ID NO: 9164898 - DNA, 22 bp, Homo sapiens
aaatcatgttggcacaataaaa

SEQ ID NO: 9164899 - DNA, 22 bp, Homo sapiens
aaatatgtgatcagtgaataaa

SEQ ID NO: 9164900 - DNA, 22 bp, Homo sapiens
aaatatgtgatcagtgaataaa

SEQ ID NO: 9164901 - DNA, 22 bp, Homo sapiens
aaatatgttttccagttgtcat

SEQ ID NO: 9164902 - DNA, 22 bp, Homo sapiens
aaatattattgcttaaggggag

SEQ ID NO: 9164903 - DNA, 22 bp, Homo sapiens
aaatatgttttccagttgtcat

SEQ ID NO: 9164904 - DNA, 22 bp, Homo sapiens
aaatattagggagaacagggac

SEQ ID NO: 9164905 - DNA, 22 bp, Homo sapiens
aaatcagttgttatattaaaga

SEQ ID NO: 9164906 - DNA, 22 bp, Homo sapiens
aaatcagtaaatgttcattaac

SEQ ID NO: 9164907 - DNA, 22 bp, Homo sapiens
aaatcagtaaatgttcattaac

SEQ ID NO: 9164908 - DNA, 22 bp, Homo sapiens
aaatatgtatggagttcatgaa

SEQ ID NO: 9164909 - DNA, 22 bp, Homo sapiens
aaatatgtatggagttcatgaa

SEQ ID NO: 9164910 - DNA, 22 bp, Homo sapiens
aaatatgtgatcagtgaataaa

SEQ ID NO: 9164911 - DNA, 22 bp, Homo sapiens
aaatatgtaaccaaggtgaagt

SEQ ID NO: 9164912 - DNA, 22 bp, Homo sapiens
aaatatgtaaccaaggtgaagt

SEQ ID NO: 9164913 - DNA, 22 bp, Homo sapiens
aaatatgagggtgatgcccaga

SEQ ID NO: 9164914 - DNA, 22 bp, Homo sapiens
aaactaagggagatgtgggctg

SEQ ID NO: 9164915 - DNA, 23 bp, Homo sapiens
aaactaagggagtagatgagatg

SEQ ID NO: 9164916 - DNA, 20 bp, Homo sapiens
aaactaaaggtgtttggttt

SEQ ID NO: 9164917 - DNA, 22 bp, Homo sapiens
aaatataatttctgcctcaata

SEQ ID NO: 9164918 - DNA, 23 bp, Homo sapiens
aaactacatttatagtttttctc

SEQ ID NO: 9164919 - DNA, 22 bp, Homo sapiens
aaactacatctcatggatgagg

SEQ ID NO: 9164920 - DNA, 22 bp, Homo sapiens
aaactaaacctggcttagtaag

SEQ ID NO: 9164921 - DNA, 22 bp, Homo sapiens
aaatagaattggaagcagagtt

SEQ ID NO: 9164922 - DNA, 22 bp, Homo sapiens
aaatagaattggaagcagagtt

SEQ ID NO: 9164923 - DNA, 20 bp, Homo sapiens
aaacgagccatcattctggt

SEQ ID NO: 9164924 - DNA, 22 bp, Homo sapiens
aaatagaaaccaacaaggtcag

SEQ ID NO: 9164925 - DNA, 22 bp, Homo sapiens
aaatagaaaccaacaaggtcag

SEQ ID NO: 9164926 - DNA, 22 bp, Homo sapiens
aaatagaattaactagctactg

SEQ ID NO: 9164927 - DNA, 21 bp, Homo sapiens
aaatactgtcaaatggtgggt

SEQ ID NO: 9164928 - DNA, 22 bp, Homo sapiens
aaatactgtgaataaaggtttt

SEQ ID NO: 9164929 - DNA, 22 bp, Homo sapiens
aaatactgtgaataaaggtttt

SEQ ID NO: 9164930 - DNA, 22 bp, Homo sapiens
aaatactgtctctgagagagcc

SEQ ID NO: 9164931 - DNA, 22 bp, Homo sapiens
aaatactgtccaccatggagca

SEQ ID NO: 9164932 - DNA, 22 bp, Homo sapiens
aaatactgtagataatagagtt

SEQ ID NO: 9164933 - DNA, 22 bp, Homo sapiens
aaatacagattctgactcagag

SEQ ID NO: 9164934 - DNA, 22 bp, Homo sapiens
aaatactgttttattccatgat

SEQ ID NO: 9164935 - DNA, 22 bp, Homo sapiens
aaatactgttgaatgaagtaag

SEQ ID NO: 9164936 - DNA, 22 bp, Homo sapiens
aaatactgttgaatgaagtaag

SEQ ID NO: 9164937 - DNA, 22 bp, Homo sapiens
aaatactgttgaatgaagtaag

SEQ ID NO: 9164938 - DNA, 22 bp, Homo sapiens
aaagtgcattgtttgtgttcct

SEQ ID NO: 9164939 - DNA, 22 bp, Homo sapiens
aaagtcattttccagaccagta

SEQ ID NO: 9164940 - DNA, 22 bp, Homo sapiens
aaagtgcagtccatgaaattaa

SEQ ID NO: 9164941 - DNA, 22 bp, Homo sapiens
aaagtcatttagccttatctcc

SEQ ID NO: 9164942 - DNA, 22 bp, Homo sapiens
aaacactgtacaatctgcaggg

SEQ ID NO: 9164943 - DNA, 22 bp, Homo sapiens
aaacactgtacaatctgcaggg

SEQ ID NO: 9164944 - DNA, 22 bp, Homo sapiens
aaacactggtatgatgtatagt

SEQ ID NO: 9164945 - DNA, 20 bp, Homo sapiens
aaacactggctggggcacag

SEQ ID NO: 9164946 - DNA, 20 bp, Homo sapiens
aaacactggctggggcacag

SEQ ID NO: 9164947 - DNA, 22 bp, Homo sapiens
aaacactgcgtggtggcaactc

SEQ ID NO: 9164948 - DNA, 22 bp, Homo sapiens
aaacactgcgtggtggcaactc

SEQ ID NO: 9164949 - DNA, 22 bp, Homo sapiens
aaacactggcaatttcatgcac

SEQ ID NO: 9164950 - DNA, 22 bp, Homo sapiens
aaacactgcagggtttacttga

SEQ ID NO: 9164951 - DNA, 22 bp, Homo sapiens
aaacactgatggatatttttcc

SEQ ID NO: 9164952 - DNA, 22 bp, Homo sapiens
aaacatcataggcatgcatgat

SEQ ID NO: 9164953 - DNA, 22 bp, Homo sapiens
aaacatcataggcatgcatgat

SEQ ID NO: 9164954 - DNA, 22 bp, Homo sapiens
aaacagttttgccaaaaggaca

SEQ ID NO: 9164955 - DNA, 22 bp, Homo sapiens
aaagatgtgcctgtttcatagt

SEQ ID NO: 9164956 - DNA, 22 bp, Homo sapiens
aaagcaataggttaggtcaaga

SEQ ID NO: 9164957 - DNA, 22 bp, Homo sapiens
aaagcaataggttaggtcaaga

SEQ ID NO: 9164958 - DNA, 22 bp, Homo sapiens
aaagatgtccaagtaaagttaa

SEQ ID NO: 9164959 - DNA, 22 bp, Homo sapiens
aaagatgtcatacacattaaga

SEQ ID NO: 9164960 - DNA, 22 bp, Homo sapiens
aaagatgtcagtttgaaataac

SEQ ID NO: 9164961 - DNA, 22 bp, Homo sapiens
aaagatgtcagtttgaaataac

SEQ ID NO: 9164962 - DNA, 22 bp, Homo sapiens
aaagatgtcagtttgaaataac

SEQ ID NO: 9164963 - DNA, 22 bp, Homo sapiens
aaagatgtcagtttgaaataac

SEQ ID NO: 9164964 - DNA, 22 bp, Homo sapiens
aaagcaatgcccgttcattatc

SEQ ID NO: 9164965 - DNA, 22 bp, Homo sapiens
aaagcaatgcccgttcattatc

SEQ ID NO: 9164966 - DNA, 22 bp, Homo sapiens
aaagcaatgcccgttcattatc

SEQ ID NO: 9164967 - DNA, 22 bp, Homo sapiens
aaagcaatgatggtagacacgt

SEQ ID NO: 9164968 - DNA, 22 bp, Homo sapiens
aaagcaatctagttccaattct

SEQ ID NO: 9164969 - DNA, 22 bp, Homo sapiens
aaagcaatagtaatggtaatag

SEQ ID NO: 9164970 - DNA, 22 bp, Homo sapiens
aaagcaatagtaatggtaatag

SEQ ID NO: 9164971 - DNA, 22 bp, Homo sapiens
aaagcaatcagattcagatgtc

SEQ ID NO: 9164972 - DNA, 22 bp, Homo sapiens
aaagcaatcagattcagatgtc

SEQ ID NO: 9164973 - DNA, 22 bp, Homo sapiens
aaagcaatcagattcagatgtc

SEQ ID NO: 9164974 - DNA, 22 bp, Homo sapiens
aaagcaatcagattcagatgtc

SEQ ID NO: 9164975 - DNA, 22 bp, Homo sapiens
aaagcaatgcttgtggaatgta

SEQ ID NO: 9164976 - DNA, 22 bp, Homo sapiens
aaagcaatgcttgtggaatgta

SEQ ID NO: 9164977 - DNA, 22 bp, Homo sapiens
aaaggcatgtgggctggttgta

SEQ ID NO: 9164978 - DNA, 22 bp, Homo sapiens
aaaggcattttaattctaaaga

SEQ ID NO: 9164979 - DNA, 22 bp, Homo sapiens
aaaggccaagcatgaggtggac

SEQ ID NO: 9164980 - DNA, 22 bp, Homo sapiens
aaaggccacacagagcagggag

SEQ ID NO: 9164981 - DNA, 22 bp, Homo sapiens
aaaggccactgcaagggaaggt

SEQ ID NO: 9164982 - DNA, 22 bp, Homo sapiens
aaaggcctctgtcctagtgcct

SEQ ID NO: 9164983 - DNA, 22 bp, Homo sapiens
aaaggcctctgtcctagtgcct

SEQ ID NO: 9164984 - DNA, 22 bp, Homo sapiens
aaaggccttgagctgggtgcca

SEQ ID NO: 9164985 - DNA, 22 bp, Homo sapiens
aaaggcctgtgcttctaatgtg

SEQ ID NO: 9164986 - DNA, 22 bp, Homo sapiens
aaaggccttaaagagcatgcct

SEQ ID NO: 9164987 - DNA, 22 bp, Homo sapiens
aaaaagatagcattgtgctcct

SEQ ID NO: 9164988 - DNA, 22 bp, Homo sapiens
aaaaagatgtcctgaagtttag

SEQ ID NO: 9164989 - DNA, 22 bp, Homo sapiens
aaaaagatgtcctgaagtttag

SEQ ID NO: 9164990 - DNA, 22 bp, Homo sapiens
aaaaagatgtcctgaagtttag

SEQ ID NO: 9164991 - DNA, 22 bp, Homo sapiens
aaaaatgaaacggctggttggc

SEQ ID NO: 9164992 - DNA, 21 bp, Homo sapiens
aaaaatgaagttgttcaggaa

SEQ ID NO: 9164993 - DNA, 21 bp, Homo sapiens
aaaaatgaagttgttcaggaa

SEQ ID NO: 9164994 - DNA, 21 bp, Homo sapiens
aaaaatgaagttgttcaggaa

SEQ ID NO: 9164995 - DNA, 19 bp, Homo sapiens
aaaaacttagtccagaaag

SEQ ID NO: 9164996 - DNA, 22 bp, Homo sapiens
aaaaactgtaattacttttgca

SEQ ID NO: 9164997 - DNA, 22 bp, Homo sapiens
aaaaactgtaattacttttgca

SEQ ID NO: 9164998 - DNA, 22 bp, Homo sapiens
aaaaactgtaattacttttgca

SEQ ID NO: 9164999 - DNA, 22 bp, Homo sapiens
aaaaactgtaattacttttgca

SEQ ID NO: 9165000 - DNA, 22 bp, Homo sapiens
aaaaactggtaactattcccca

SEQ ID NO: 9165001 - DNA, 22 bp, Homo sapiens
aaaaactggtaactattcccca

SEQ ID NO: 9165002 - DNA, 22 bp, Homo sapiens
aaaaagagaaatgctctagtcc

SEQ ID NO: 9165003 - DNA, 22 bp, Homo sapiens
aaaaatgcttggacttaataaa

SEQ ID NO: 9165004 - DNA, 22 bp, Homo sapiens
aaaaatgctgtggtagctgtgt

SEQ ID NO: 9165005 - DNA, 22 bp, Homo sapiens
aaaaatgtgaccacagggtgtt

SEQ ID NO: 9165006 - DNA, 22 bp, Homo sapiens
aaaaggctcttcaaaatggaag

SEQ ID NO: 9165007 - DNA, 22 bp, Homo sapiens
aaaaatgtcattatggaactga

SEQ ID NO: 9165008 - DNA, 19 bp, Homo sapiens
aaaagtctattcaattaca

SEQ ID NO: 9165009 - DNA, 19 bp, Homo sapiens
aaaagtctattcaattaca

SEQ ID NO: 9165010 - DNA, 22 bp, Homo sapiens
aaaagtctctctgagtaaaagt

SEQ ID NO: 9165011 - DNA, 22 bp, Homo sapiens
aaaagtctgctctcatttcaga

SEQ ID NO: 9165012 - DNA, 22 bp, Homo sapiens
aaaagtctgctctcatttcaga

SEQ ID NO: 9165013 - DNA, 22 bp, Homo sapiens
aaaagtctgctttctattatca

SEQ ID NO: 9165014 - DNA, 22 bp, Homo sapiens
aaaagtctacaagcttcaacaa

SEQ ID NO: 9165015 - DNA, 22 bp, Homo sapiens
aaaagtattttgagcactttat

SEQ ID NO: 9165016 - DNA, 22 bp, Homo sapiens
aaaagggacgacaacaggccac

SEQ ID NO: 9165017 - DNA, 22 bp, Homo sapiens
aaacaaagcatcttgctatgca

SEQ ID NO: 9165018 - DNA, 22 bp, Homo sapiens
aaacacaatgtttctttgttct

SEQ ID NO: 9165019 - DNA, 22 bp, Homo sapiens
aaacacaatgtttctttgttct

SEQ ID NO: 9165020 - DNA, 22 bp, Homo sapiens
aaaagtgtccagattatgaaga

SEQ ID NO: 9165021 - DNA, 22 bp, Homo sapiens
aaaagtcttgtcaaggttccca

SEQ ID NO: 9165022 - DNA, 22 bp, Homo sapiens
aaaagtctgctttctattatca

SEQ ID NO: 9165023 - DNA, 22 bp, Homo sapiens
aaaatagatgaaaggaagtctg

SEQ ID NO: 9165024 - DNA, 22 bp, Homo sapiens
aaaatagataatgccagggtca

SEQ ID NO: 9165025 - DNA, 22 bp, Homo sapiens
aaaatagttaacgttcagagta

SEQ ID NO: 9165026 - DNA, 22 bp, Homo sapiens
aaaatagcctcacataattgct

SEQ ID NO: 9165027 - DNA, 22 bp, Homo sapiens
aaaatagcctcacataattgct

SEQ ID NO: 9165028 - DNA, 22 bp, Homo sapiens
aaaatagcctcacataattgct

SEQ ID NO: 9165029 - DNA, 22 bp, Homo sapiens
aaaatagattctaggatgtctt

SEQ ID NO: 9165030 - DNA, 22 bp, Homo sapiens
aaaatagatgaaaggaagtctg

SEQ ID NO: 9165031 - DNA, 22 bp, Homo sapiens
aaacatttttcttcatcatcct

SEQ ID NO: 9165032 - DNA, 22 bp, Homo sapiens
aaacatttgcaactcggtttgg

SEQ ID NO: 9165033 - DNA, 22 bp, Homo sapiens
aaacatttttctaggtcttggt

SEQ ID NO: 9165034 - DNA, 22 bp, Homo sapiens
aaacatttttctaggtcttggt

SEQ ID NO: 9165035 - DNA, 22 bp, Homo sapiens
aaacatttgcaactcggtttgg

SEQ ID NO: 9165036 - DNA, 22 bp, Homo sapiens
aaacatttgcaactcggtttgg

SEQ ID NO: 9165037 - DNA, 22 bp, Homo sapiens
aaacatttgcaactcggtttgg

SEQ ID NO: 9165038 - DNA, 23 bp, Homo sapiens
aaacatttctcttttcctgcctc

SEQ ID NO: 9165039 - DNA, 23 bp, Homo sapiens
aaacatttctcttttcctgcctc

SEQ ID NO: 9165040 - DNA, 22 bp, Homo sapiens
aaacatgagttaaaagtaactg

SEQ ID NO: 9165041 - DNA, 22 bp, Homo sapiens
aaacatgagttaaaagtaactg

SEQ ID NO: 9165042 - DNA, 22 bp, Homo sapiens
aaacatgagttaaaagtaactg

SEQ ID NO: 9165043 - DNA, 22 bp, Homo sapiens
aaacatgagttaaaagtaactg

SEQ ID NO: 9165044 - DNA, 22 bp, Homo sapiens
aaacatgagttaaaagtaactg

SEQ ID NO: 9165045 - DNA, 22 bp, Homo sapiens
aaacatgagcatttctgtttaa

SEQ ID NO: 9165046 - DNA, 22 bp, Homo sapiens
aaacatgagcatctcttcaagc

SEQ ID NO: 9165047 - DNA, 22 bp, Homo sapiens
aaactggtgtcactgagggctg

SEQ ID NO: 9165048 - DNA, 22 bp, Homo sapiens
aaactggtttctgagatggaac

SEQ ID NO: 9165049 - DNA, 22 bp, Homo sapiens
aaactgtaaacacagcagtaca

SEQ ID NO: 9165050 - DNA, 22 bp, Homo sapiens
aaactggtattcaaatgtttgg

SEQ ID NO: 9165051 - DNA, 22 bp, Homo sapiens
aaaccagtgatagactagacac

SEQ ID NO: 9165052 - DNA, 22 bp, Homo sapiens
aaaccagtgatagactagacac

SEQ ID NO: 9165053 - DNA, 22 bp, Homo sapiens
aaaccatggagtaagttcacat

SEQ ID NO: 9165054 - DNA, 22 bp, Homo sapiens
aaaccaaacatttgcggtggtg

SEQ ID NO: 9165055 - DNA, 22 bp, Homo sapiens
aaacatttttcttcatcatcct

SEQ ID NO: 9165056 - DNA, 22 bp, Homo sapiens
aaacatgaatagatattaaaca

SEQ ID NO: 9165057 - DNA, 22 bp, Homo sapiens
aaacatgagcacttgcttcata

SEQ ID NO: 9165058 - DNA, 22 bp, Homo sapiens
aaacatgaatagatattaaaca

SEQ ID NO: 9165059 - DNA, 22 bp, Homo sapiens
aaacatgagcacttgcttcata

SEQ ID NO: 9165060 - DNA, 22 bp, Homo sapiens
aaacatgagcatctcttcaagc

SEQ ID NO: 9165061 - DNA, 22 bp, Homo sapiens
aaacacaggtactgcagaagtg

SEQ ID NO: 9165062 - DNA, 22 bp, Homo sapiens
aaagatgagtccggcagacata

SEQ ID NO: 9165063 - DNA, 22 bp, Homo sapiens
aaagatgtcacaagatgtgatg

SEQ ID NO: 9165064 - DNA, 22 bp, Homo sapiens
aaagatgcctaactcagaagat

SEQ ID NO: 9165065 - DNA, 22 bp, Homo sapiens
aaagagctttagaaatctcaga

SEQ ID NO: 9165066 - DNA, 22 bp, Homo sapiens
aaagaagatggagacctgacta

SEQ ID NO: 9165067 - DNA, 22 bp, Homo sapiens
aaagaagagctggaaggagtct

SEQ ID NO: 9165068 - DNA, 22 bp, Homo sapiens
aaagaagacagacatttctttc

SEQ ID NO: 9165069 - DNA, 22 bp, Homo sapiens
aaagaagacagacatttctttc

SEQ ID NO: 9165070 - DNA, 22 bp, Homo sapiens
aaagaagagctggaaggagtct

SEQ ID NO: 9165071 - DNA, 18 bp, Homo sapiens
aaagaaggattggagagc

SEQ ID NO: 9165072 - DNA, 22 bp, Homo sapiens
aaagaagggacagactgcctct

SEQ ID NO: 9165073 - DNA, 17 bp, Homo sapiens
aaagagcttggagtgtt

SEQ ID NO: 9165074 - DNA, 22 bp, Homo sapiens
aaagaaggacctggaggaggat

SEQ ID NO: 9165075 - DNA, 22 bp, Homo sapiens
aaacttcttgctgcattttctg

SEQ ID NO: 9165076 - DNA, 22 bp, Homo sapiens
aaacttcttgctgcattttctg

SEQ ID NO: 9165077 - DNA, 23 bp, Homo sapiens
aaacttgctatggctgaaatcat

SEQ ID NO: 9165078 - DNA, 22 bp, Homo sapiens
aaactttaggaaggaatttaca

SEQ ID NO: 9165079 - DNA, 22 bp, Homo sapiens
aaactttaggaaggaatttaca

SEQ ID NO: 9165080 - DNA, 22 bp, Homo sapiens
aaactttaggaaggaatttaca

SEQ ID NO: 9165081 - DNA, 19 bp, Homo sapiens
aaagaactttgggctaggc

SEQ ID NO: 9165082 - DNA, 22 bp, Homo sapiens
aaagaacttatcctagaatttg

SEQ ID NO: 9165083 - DNA, 22 bp, Homo sapiens
aaacttggccgcatccaccggg

SEQ ID NO: 9165084 - DNA, 22 bp, Homo sapiens
aaacttgtcattgtaatggtat

SEQ ID NO: 9165085 - DNA, 22 bp, Homo sapiens
aaactttaagacagtcctcaag

SEQ ID NO: 9165086 - DNA, 22 bp, Homo sapiens
aaactttaggaaggaatttaca

SEQ ID NO: 9165087 - DNA, 22 bp, Homo sapiens
aaactttaaatttgtacctctg

SEQ ID NO: 9165088 - DNA, 22 bp, Homo sapiens
aagaaagtgggtaatatgattt

SEQ ID NO: 9165089 - DNA, 23 bp, Homo sapiens
aagaagttacctaaagttgtact

SEQ ID NO: 9165090 - DNA, 22 bp, Homo sapiens
aagaagttaggtgtaacaatat

SEQ ID NO: 9165091 - DNA, 22 bp, Homo sapiens
aagaaagtgatgagctacagat

SEQ ID NO: 9165092 - DNA, 22 bp, Homo sapiens
aagaatgtggcatttatttata

SEQ ID NO: 9165093 - DNA, 22 bp, Homo sapiens
aagaatgtgggtggatatgatg

SEQ ID NO: 9165094 - DNA, 22 bp, Homo sapiens
aagaatgcatcaaaagtcagag

SEQ ID NO: 9165095 - DNA, 22 bp, Homo sapiens
aagaatgtcgttggtattttaa

SEQ ID NO: 9165096 - DNA, 22 bp, Homo sapiens
aagaatgattacaaagcaacga

SEQ ID NO: 9165097 - DNA, 22 bp, Homo sapiens
aagaatgattacaaagcaacga

SEQ ID NO: 9165098 - DNA, 22 bp, Homo sapiens
aagaatgagctcaaagatctta

SEQ ID NO: 9165099 - DNA, 23 bp, Homo sapiens
aacttttagagtttaacagtgtt

SEQ ID NO: 9165100 - DNA, 23 bp, Homo sapiens
aacttttagagtttaacagtgtt

SEQ ID NO: 9165101 - DNA, 22 bp, Homo sapiens
aacttttcacaggctagctctt

SEQ ID NO: 9165102 - DNA, 22 bp, Homo sapiens
aacttttcataagggcaaattt

SEQ ID NO: 9165103 - DNA, 22 bp, Homo sapiens
aacttttcattccaaaggtgct

SEQ ID NO: 9165104 - DNA, 22 bp, Homo sapiens
aacttttcattgaatcatgtca

SEQ ID NO: 9165105 - DNA, 22 bp, Homo sapiens
aagaaaggatatatgggaggta

SEQ ID NO: 9165106 - DNA, 22 bp, Homo sapiens
aagaaaggatatatgggaggta

SEQ ID NO: 9165107 - DNA, 22 bp, Homo sapiens
aagaaagctgaatattctgtgt

SEQ ID NO: 9165108 - DNA, 22 bp, Homo sapiens
aagaaagctgaatattctgtgt

SEQ ID NO: 9165109 - DNA, 22 bp, Homo sapiens
aacttttctgtgttgtccggga

SEQ ID NO: 9165110 - DNA, 22 bp, Homo sapiens
aactttgctggaaaattggagc

SEQ ID NO: 9165111 - DNA, 22 bp, Homo sapiens
aactttgcttgggtcaaactca

SEQ ID NO: 9165112 - DNA, 22 bp, Homo sapiens
aactttgcttgggtcaaactca

SEQ ID NO: 9165113 - DNA, 22 bp, Homo sapiens
aactttgcttttgtgggtaaag

SEQ ID NO: 9165114 - DNA, 22 bp, Homo sapiens
aactttgtgtgtttaatatggc

SEQ ID NO: 9165115 - DNA, 22 bp, Homo sapiens
aactttgtgtgtttaatatggc

SEQ ID NO: 9165116 - DNA, 22 bp, Homo sapiens
aactttgtcttttatgcttaca

SEQ ID NO: 9165117 - DNA, 23 bp, Homo sapiens
aactttgccaggagacagcacag

SEQ ID NO: 9165118 - DNA, 20 bp, Homo sapiens
aactttgcattttattctcc

SEQ ID NO: 9165119 - DNA, 22 bp, Homo sapiens
aactttgcataactaactacag

SEQ ID NO: 9165120 - DNA, 22 bp, Homo sapiens
aactttctttgcatctaagttt

SEQ ID NO: 9165121 - DNA, 22 bp, Homo sapiens
aactttctttgcatctaagttt

SEQ ID NO: 9165122 - DNA, 22 bp, Homo sapiens
aactttctttcacagaagtatc

SEQ ID NO: 9165123 - DNA, 22 bp, Homo sapiens
aagaggagaaaggctggctttg

SEQ ID NO: 9165124 - DNA, 22 bp, Homo sapiens
aagaggagaaaggctggctttg

SEQ ID NO: 9165125 - DNA, 22 bp, Homo sapiens
aagaggaccagtagataaattt

SEQ ID NO: 9165126 - DNA, 22 bp, Homo sapiens
aagaggaatgggtgtgtttatg

SEQ ID NO: 9165127 - DNA, 22 bp, Homo sapiens
aagaggaccagtagataaattt

SEQ ID NO: 9165128 - DNA, 22 bp, Homo sapiens
aagaggaagtctccatggagag

SEQ ID NO: 9165129 - DNA, 22 bp, Homo sapiens
aagaggaagtctccatggagag

SEQ ID NO: 9165130 - DNA, 22 bp, Homo sapiens
aagaggaagtctccatggagag

SEQ ID NO: 9165131 - DNA, 22 bp, Homo sapiens
aagaggaagtctccatggagag

SEQ ID NO: 9165132 - DNA, 22 bp, Homo sapiens
aagagcctggctgctaggctca

SEQ ID NO: 9165133 - DNA, 22 bp, Homo sapiens
aagagccttggcaatgagtcct

SEQ ID NO: 9165134 - DNA, 22 bp, Homo sapiens
aagagccgctccggccagggag

SEQ ID NO: 9165135 - DNA, 22 bp, Homo sapiens
aagagcctccctagaggtgaag

SEQ ID NO: 9165136 - DNA, 22 bp, Homo sapiens
aagagcccttttcagtctagtt

SEQ ID NO: 9165137 - DNA, 22 bp, Homo sapiens
aagagcccttgttcataattat

SEQ ID NO: 9165138 - DNA, 22 bp, Homo sapiens
aagagcattttgtaaaatcctt

SEQ ID NO: 9165139 - DNA, 22 bp, Homo sapiens
aagagccagtgggaaagtcttg

SEQ ID NO: 9165140 - DNA, 22 bp, Homo sapiens
aagagccagctagtgaagaggc

SEQ ID NO: 9165141 - DNA, 22 bp, Homo sapiens
aagaatgttagtttctgataca

SEQ ID NO: 9165142 - DNA, 22 bp, Homo sapiens
aagaatgttcttgtagtcatga

SEQ ID NO: 9165143 - DNA, 22 bp, Homo sapiens
aagacactgatactctgtgatt

SEQ ID NO: 9165144 - DNA, 22 bp, Homo sapiens
aagagcagtgttttactcagct

SEQ ID NO: 9165145 - DNA, 20 bp, Homo sapiens
aagagaggaagttatactag

SEQ ID NO: 9165146 - DNA, 22 bp, Homo sapiens
aagacagagactctgcaacagg

SEQ ID NO: 9165147 - DNA, 22 bp, Homo sapiens
aagacagagactctgcaacagg

SEQ ID NO: 9165148 - DNA, 22 bp, Homo sapiens
aagacagaccacgtgacagggc

SEQ ID NO: 9165149 - DNA, 22 bp, Homo sapiens
aagcacctgggttatatcttag

SEQ ID NO: 9165150 - DNA, 22 bp, Homo sapiens
aagcacctgcagttgacaaaaa

SEQ ID NO: 9165151 - DNA, 22 bp, Homo sapiens
aagcacctctatgattgctttt

SEQ ID NO: 9165152 - DNA, 22 bp, Homo sapiens
aagcacagctggaacagcagga

SEQ ID NO: 9165153 - DNA, 17 bp, Homo sapiens
aaatatgacctcaaagt

SEQ ID NO: 9165154 - DNA, 22 bp, Homo sapiens
aaatatgactagaatgccaggt

SEQ ID NO: 9165155 - DNA, 22 bp, Homo sapiens
aaatatgaatgataagagttat

SEQ ID NO: 9165156 - DNA, 22 bp, Homo sapiens
aaatatgaatgataagagttat

SEQ ID NO: 9165157 - DNA, 22 bp, Homo sapiens
aaatatgaatgataagagttat

SEQ ID NO: 9165158 - DNA, 22 bp, Homo sapiens
aaatatccataagcacatctat

SEQ ID NO: 9165159 - DNA, 19 bp, Homo sapiens
aaatatcagagagatgata

SEQ ID NO: 9165160 - DNA, 22 bp, Homo sapiens
aaatatcattctggtgcacaga

SEQ ID NO: 9165161 - DNA, 22 bp, Homo sapiens
aaatatcatttataacttttaa

SEQ ID NO: 9165162 - DNA, 22 bp, Homo sapiens
aagaggagaaaggctggctttg

SEQ ID NO: 9165163 - DNA, 22 bp, Homo sapiens
aagaggagacttcagcaacttg

SEQ ID NO: 9165164 - DNA, 22 bp, Homo sapiens
aagaggagacttcagcaacttg

SEQ ID NO: 9165165 - DNA, 22 bp, Homo sapiens
aagaggagacttcagcaacttg

SEQ ID NO: 9165166 - DNA, 22 bp, Homo sapiens
aagaggaggacggttcccagaa

SEQ ID NO: 9165167 - DNA, 22 bp, Homo sapiens
aagaggaggacggttcccagaa

SEQ ID NO: 9165168 - DNA, 18 bp, Homo sapiens
aagaggaggaaacccagg

SEQ ID NO: 9165169 - DNA, 18 bp, Homo sapiens
aagaggaggaaacccagg

SEQ ID NO: 9165170 - DNA, 18 bp, Homo sapiens
aagaggaggagcaggttg

SEQ ID NO: 9165171 - DNA, 18 bp, Homo sapiens
aagaggaggagcaggttg

SEQ ID NO: 9165172 - DNA, 18 bp, Homo sapiens
aagaggaggagcaggttg

SEQ ID NO: 9165173 - DNA, 22 bp, Homo sapiens
aagcaaagtgctttgcctccag

SEQ ID NO: 9165174 - DNA, 22 bp, Homo sapiens
aagcaaagtgaattttgccaag

SEQ ID NO: 9165175 - DNA, 22 bp, Homo sapiens
aagcaaaggcaggagcttgtga

SEQ ID NO: 9165176 - DNA, 22 bp, Homo sapiens
aagcaaaggcaggagcttgtga

SEQ ID NO: 9165177 - DNA, 22 bp, Homo sapiens
aagcaaagagtttagtgggtga

SEQ ID NO: 9165178 - DNA, 22 bp, Homo sapiens
aagcaaaggaaagctgactttt

SEQ ID NO: 9165179 - DNA, 22 bp, Homo sapiens
aagcaaatgaaccagaggtaat

SEQ ID NO: 9165180 - DNA, 22 bp, Homo sapiens
aagcaaattctggaggtgaggt

SEQ ID NO: 9165181 - DNA, 22 bp, Homo sapiens
aagccagattccttaagcacag

SEQ ID NO: 9165182 - DNA, 22 bp, Homo sapiens
aagccagattccttaagcacag

SEQ ID NO: 9165183 - DNA, 22 bp, Homo sapiens
aagccagatcaaagtgtccagg

SEQ ID NO: 9165184 - DNA, 22 bp, Homo sapiens
aagccagagtttttgagaactt

SEQ ID NO: 9165185 - DNA, 22 bp, Homo sapiens
aagccactatggtgattctcaa

SEQ ID NO: 9165186 - DNA, 22 bp, Homo sapiens
aagccaatgttgcctgggtttc

SEQ ID NO: 9165187 - DNA, 22 bp, Homo sapiens
aagccaatggattggttgcttt

SEQ ID NO: 9165188 - DNA, 22 bp, Homo sapiens
aagccaccctggctgcacatgc

SEQ ID NO: 9165189 - DNA, 22 bp, Homo sapiens
aagccactgcggtttcccatcc

SEQ ID NO: 9165190 - DNA, 22 bp, Homo sapiens
aagccactatggtgattctcaa

SEQ ID NO: 9165191 - DNA, 22 bp, Homo sapiens
aagccactgagatttcactgca

SEQ ID NO: 9165192 - DNA, 22 bp, Homo sapiens
aagccactcacaataactgtcc

SEQ ID NO: 9165193 - DNA, 22 bp, Homo sapiens
aagccaatgatacgggtgatct

SEQ ID NO: 9165194 - DNA, 22 bp, Homo sapiens
aagccaatgctagcccacatgc

SEQ ID NO: 9165195 - DNA, 23 bp, Homo sapiens
aagcatggttcacagttagtact

SEQ ID NO: 9165196 - DNA, 22 bp, Homo sapiens
aagcagcagccatcccccaagg

SEQ ID NO: 9165197 - DNA, 22 bp, Homo sapiens
aagcatggtggatgatacagtg

SEQ ID NO: 9165198 - DNA, 22 bp, Homo sapiens
aagcagcagacctgattttgaa

SEQ ID NO: 9165199 - DNA, 22 bp, Homo sapiens
aagcagcacgctttgccaacaa

SEQ ID NO: 9165200 - DNA, 22 bp, Homo sapiens
aagcagcacgctttgccaacaa

SEQ ID NO: 9165201 - DNA, 22 bp, Homo sapiens
aagcagcagcaggattaaagag

SEQ ID NO: 9165202 - DNA, 22 bp, Homo sapiens
aagcagcacagtaatattggtg

SEQ ID NO: 9165203 - DNA, 22 bp, Homo sapiens
aagcagcacagcaatgactcta

SEQ ID NO: 9165204 - DNA, 22 bp, Homo sapiens
aagcagcacagcaatgactcta

SEQ ID NO: 9165205 - DNA, 22 bp, Homo sapiens
aagcactgtgcctcatatctga

SEQ ID NO: 9165206 - DNA, 22 bp, Homo sapiens
aagcactgtacaaatgtcactt

SEQ ID NO: 9165207 - DNA, 22 bp, Homo sapiens
aagcacttggttttggaaagtt

SEQ ID NO: 9165208 - DNA, 22 bp, Homo sapiens
aagcacttagaagagtgcctgc

SEQ ID NO: 9165209 - DNA, 22 bp, Homo sapiens
aagcactgagcacagtggctga

SEQ ID NO: 9165210 - DNA, 22 bp, Homo sapiens
aagcactggagatgccagagtg

SEQ ID NO: 9165211 - DNA, 22 bp, Homo sapiens
aagcagaaaaactgagctccaa

SEQ ID NO: 9165212 - DNA, 22 bp, Homo sapiens
aagcagaaaaactgagctccaa

SEQ ID NO: 9165213 - DNA, 22 bp, Homo sapiens
aagcagagttagcttgtcacct

SEQ ID NO: 9165214 - DNA, 22 bp, Homo sapiens
aagcagatgggactccaaggca

SEQ ID NO: 9165215 - DNA, 22 bp, Homo sapiens
aagcagatgcagctaataaagc

SEQ ID NO: 9165216 - DNA, 22 bp, Homo sapiens
aagcagagttagcttgtcacct

SEQ ID NO: 9165217 - DNA, 22 bp, Homo sapiens
aagcagcaagtttatttctatc

SEQ ID NO: 9165218 - DNA, 22 bp, Homo sapiens
aagcagcaagtttatttctatc

SEQ ID NO: 9165219 - DNA, 22 bp, Homo sapiens
aacagctttgtgctcagatttg

SEQ ID NO: 9165220 - DNA, 22 bp, Homo sapiens
aacagctttgtatacagtaact

SEQ ID NO: 9165221 - DNA, 22 bp, Homo sapiens
aacagctttgcttctggagaca

SEQ ID NO: 9165222 - DNA, 22 bp, Homo sapiens
aacagctttgagcagttctgta

SEQ ID NO: 9165223 - DNA, 22 bp, Homo sapiens
aacagctttagaggataatagt

SEQ ID NO: 9165224 - DNA, 22 bp, Homo sapiens
aacagcagctgaggagctgggc

SEQ ID NO: 9165225 - DNA, 22 bp, Homo sapiens
aacagcagctgaggagctgggc

SEQ ID NO: 9165226 - DNA, 23 bp, Homo sapiens
aacacattgctaattacattcaa

SEQ ID NO: 9165227 - DNA, 22 bp, Homo sapiens
aacagcagcatgacagctgggt

SEQ ID NO: 9165228 - DNA, 22 bp, Homo sapiens
aacagcagcatgacagctgggt

SEQ ID NO: 9165229 - DNA, 23 bp, Homo sapiens
aacacattgctaattacattcaa

SEQ ID NO: 9165230 - DNA, 22 bp, Homo sapiens
aacacatgggtgtttattgtac

SEQ ID NO: 9165231 - DNA, 22 bp, Homo sapiens
aacacatgggtgtttattgtac

SEQ ID NO: 9165232 - DNA, 22 bp, Homo sapiens
aacacatggcaagagcaggaaa

SEQ ID NO: 9165233 - DNA, 22 bp, Homo sapiens
aacacatatttatatatgcaca

SEQ ID NO: 9165234 - DNA, 22 bp, Homo sapiens
aacacatatttatatatgcaca

SEQ ID NO: 9165235 - DNA, 21 bp, Homo sapiens
aacacatccagagtatttgac

SEQ ID NO: 9165236 - DNA, 22 bp, Homo sapiens
aacacatatttatatatgcaca

SEQ ID NO: 9165237 - DNA, 22 bp, Homo sapiens
aacacatatttatatatgcaca

SEQ ID NO: 9165238 - DNA, 22 bp, Homo sapiens
aacacataggcagagcatgaca

SEQ ID NO: 9165239 - DNA, 22 bp, Homo sapiens
aacacatatttatatatgcaca

SEQ ID NO: 9165240 - DNA, 22 bp, Homo sapiens
aacaagaacacctacagttcta

SEQ ID NO: 9165241 - DNA, 22 bp, Homo sapiens
aacaagaacacctacagttcta

SEQ ID NO: 9165242 - DNA, 22 bp, Homo sapiens
aacaagaacacctacagttcta

SEQ ID NO: 9165243 - DNA, 22 bp, Homo sapiens
aacaacttgcgttcagagatgt

SEQ ID NO: 9165244 - DNA, 22 bp, Homo sapiens
aacaatgtgaagtgctgttcag

SEQ ID NO: 9165245 - DNA, 22 bp, Homo sapiens
aacaattgacacttcattgtga

SEQ ID NO: 9165246 - DNA, 22 bp, Homo sapiens
aacacaaaaattctcaggggca

SEQ ID NO: 9165247 - DNA, 22 bp, Homo sapiens
aacacataggcagagcatgaca

SEQ ID NO: 9165248 - DNA, 22 bp, Homo sapiens
aaagcacatagtagaaggattt

SEQ ID NO: 9165249 - DNA, 22 bp, Homo sapiens
aaagcacattacaagctcagtc

SEQ ID NO: 9165250 - DNA, 22 bp, Homo sapiens
aaagcactatagccaaatagcc

SEQ ID NO: 9165251 - DNA, 22 bp, Homo sapiens
aaagcacatgagtagtgtagta

SEQ ID NO: 9165252 - DNA, 22 bp, Homo sapiens
aaagcacaggagagttcagtaa

SEQ ID NO: 9165253 - DNA, 22 bp, Homo sapiens
aaagcacagggtgctagagagt

SEQ ID NO: 9165254 - DNA, 22 bp, Homo sapiens
aaagcacaggagagttcagtaa

SEQ ID NO: 9165255 - DNA, 22 bp, Homo sapiens
aaagcacagagctcccacagga

SEQ ID NO: 9165256 - DNA, 22 bp, Homo sapiens
aaagcaatttaatggaccatga

SEQ ID NO: 9165257 - DNA, 22 bp, Homo sapiens
aaagcaattgtggtttttgtca

SEQ ID NO: 9165258 - DNA, 22 bp, Homo sapiens
aacaaccaaaaagatgaatgta

SEQ ID NO: 9165259 - DNA, 22 bp, Homo sapiens
aacaactgaaaagctttttctg

SEQ ID NO: 9165260 - DNA, 22 bp, Homo sapiens
aacaactgagcaggagtgacag

SEQ ID NO: 9165261 - DNA, 22 bp, Homo sapiens
aacaacagctgctaaagagttg

SEQ ID NO: 9165262 - DNA, 22 bp, Homo sapiens
aaatggtaccctaatggccaga

SEQ ID NO: 9165263 - DNA, 22 bp, Homo sapiens
aaatggtagtagcattccatat

SEQ ID NO: 9165264 - DNA, 22 bp, Homo sapiens
aaatggtagtagcattccatat

SEQ ID NO: 9165265 - DNA, 22 bp, Homo sapiens
aaatggtaagacaacacattat

SEQ ID NO: 9165266 - DNA, 22 bp, Homo sapiens
aaagcaatgtctctgcctggtt

SEQ ID NO: 9165267 - DNA, 22 bp, Homo sapiens
aaagcaattacaaaagggataa

SEQ ID NO: 9165268 - DNA, 22 bp, Homo sapiens
aaagcaatgggtctaaggtaaa

SEQ ID NO: 9165269 - DNA, 22 bp, Homo sapiens
aaagcaattgtggtttttgcca

SEQ ID NO: 9165270 - DNA, 22 bp, Homo sapiens
aaagcaattgtggtttttgtca

SEQ ID NO: 9165271 - DNA, 22 bp, Homo sapiens
aaagcaattacaaaagggataa

SEQ ID NO: 9165272 - DNA, 22 bp, Homo sapiens
aaagcaatggcacatgatggta

SEQ ID NO: 9165273 - DNA, 22 bp, Homo sapiens
aaagcaatggcacatgatggta

SEQ ID NO: 9165274 - DNA, 22 bp, Homo sapiens
aaagcaatgggtctaaggtaaa

SEQ ID NO: 9165275 - DNA, 22 bp, Homo sapiens
aaagcaatagagggtaagactg

SEQ ID NO: 9165276 - DNA, 22 bp, Homo sapiens
aaagcaatagagggtaagactg

SEQ ID NO: 9165277 - DNA, 22 bp, Homo sapiens
aaagcaagtctctacaaagtac

SEQ ID NO: 9165278 - DNA, 22 bp, Homo sapiens
aacttgaattctgccattcaga

SEQ ID NO: 9165279 - DNA, 22 bp, Homo sapiens
aacttgctggcacgtgtatgga

SEQ ID NO: 9165280 - DNA, 22 bp, Homo sapiens
aacttgcttcaacttatttcac

SEQ ID NO: 9165281 - DNA, 23 bp, Homo sapiens
aactgagataatgtatgtaaagc

SEQ ID NO: 9165282 - DNA, 22 bp, Homo sapiens
aactgaaatcaatcagtgattc

SEQ ID NO: 9165283 - DNA, 22 bp, Homo sapiens
aactgaaacttaggaagtaatc

SEQ ID NO: 9165284 - DNA, 22 bp, Homo sapiens
aactcagtcataaagcgaatgc

SEQ ID NO: 9165285 - DNA, 22 bp, Homo sapiens
aactgaaagtttcacctgaggt

SEQ ID NO: 9165286 - DNA, 22 bp, Homo sapiens
aactatttttggagctaactct

SEQ ID NO: 9165287 - DNA, 22 bp, Homo sapiens
aactattcaccaccttgtggta

SEQ ID NO: 9165288 - DNA, 22 bp, Homo sapiens
aactatgttaataagtttcatt

SEQ ID NO: 9165289 - DNA, 22 bp, Homo sapiens
aactatgttaataagtttcatt

SEQ ID NO: 9165290 - DNA, 22 bp, Homo sapiens
aactatgttaataagtttcatt

SEQ ID NO: 9165291 - DNA, 22 bp, Homo sapiens
aactatgtgatatcatccttgc

SEQ ID NO: 9165292 - DNA, 22 bp, Homo sapiens
aactatgttaataagtttcatt

SEQ ID NO: 9165293 - DNA, 21 bp, Homo sapiens
aactatggaggaaataagtcc

SEQ ID NO: 9165294 - DNA, 20 bp, Homo sapiens
aactatagccgatctgctgg

SEQ ID NO: 9165295 - DNA, 22 bp, Homo sapiens
aactcaaagatgcatgacgctt

SEQ ID NO: 9165296 - DNA, 22 bp, Homo sapiens
aactcacacaagtattgcctgc

SEQ ID NO: 9165297 - DNA, 22 bp, Homo sapiens
aactaatacattaatacatgtg

SEQ ID NO: 9165298 - DNA, 22 bp, Homo sapiens
aactaatacattaatacatgtg

SEQ ID NO: 9165299 - DNA, 22 bp, Homo sapiens
aactatacatatttacatagac

SEQ ID NO: 9165300 - DNA, 22 bp, Homo sapiens
aactaatacattaatacatgtg

SEQ ID NO: 9165301 - DNA, 22 bp, Homo sapiens
aacatttcttctgaaactgagt

SEQ ID NO: 9165302 - DNA, 22 bp, Homo sapiens
aacatttgcagaggaaagctat

SEQ ID NO: 9165303 - DNA, 22 bp, Homo sapiens
aacagtcttggaagtcttgtta

SEQ ID NO: 9165304 - DNA, 22 bp, Homo sapiens
aacattctactgtactgcattg

SEQ ID NO: 9165305 - DNA, 22 bp, Homo sapiens
aacattctatgtgcattcagaa

SEQ ID NO: 9165306 - DNA, 22 bp, Homo sapiens
aacatttctgagaatatcagtt

SEQ ID NO: 9165307 - DNA, 22 bp, Homo sapiens
aacatttcattggaagctatgt

SEQ ID NO: 9165308 - DNA, 22 bp, Homo sapiens
aacattaattacagtcaaacat

SEQ ID NO: 9165309 - DNA, 22 bp, Homo sapiens
aacattcacctctacctccttc

SEQ ID NO: 9165310 - DNA, 22 bp, Homo sapiens
aacattcaattgaggaagttaa

SEQ ID NO: 9165311 - DNA, 22 bp, Homo sapiens
aacattcaaaacccagttcagt

SEQ ID NO: 9165312 - DNA, 22 bp, Homo sapiens
aacatttattgagcacctactg

SEQ ID NO: 9165313 - DNA, 22 bp, Homo sapiens
aacatttattctaattctggga

SEQ ID NO: 9165314 - DNA, 22 bp, Homo sapiens
aacatttatggtagtcattgca

SEQ ID NO: 9165315 - DNA, 22 bp, Homo sapiens
aacatttatggtagtcattgca

SEQ ID NO: 9165316 - DNA, 22 bp, Homo sapiens
aacatttatatgggttcatgaa

SEQ ID NO: 9165317 - DNA, 22 bp, Homo sapiens
aacatttatgattgaggtaaat

SEQ ID NO: 9165318 - DNA, 22 bp, Homo sapiens
aacatttatgattgaggtaaat

SEQ ID NO: 9165319 - DNA, 22 bp, Homo sapiens
aacatttatgattgaggtaaat

SEQ ID NO: 9165320 - DNA, 22 bp, Homo sapiens
aacatttacaaatccttctgca

SEQ ID NO: 9165321 - DNA, 22 bp, Homo sapiens
aacatttacaaatccttctgca

SEQ ID NO: 9165322 - DNA, 22 bp, Homo sapiens
aacatttacaaatccttctgca

SEQ ID NO: 9165323 - DNA, 22 bp, Homo sapiens
aacatttaggaaggacctcctc

SEQ ID NO: 9165324 - DNA, 22 bp, Homo sapiens
aacatttaggaaggacctcctc

SEQ ID NO: 9165325 - DNA, 22 bp, Homo sapiens
aacatttaggaaggacctcctc

SEQ ID NO: 9165326 - DNA, 22 bp, Homo sapiens
aatcacatgtgctcaattttaa

SEQ ID NO: 9165327 - DNA, 21 bp, Homo sapiens
aacatttcaggatccaaattg

SEQ ID NO: 9165328 - DNA, 22 bp, Homo sapiens
aacatttcagcacctgattcct

SEQ ID NO: 9165329 - DNA, 22 bp, Homo sapiens
aacatttcagcaaataagaaca

SEQ ID NO: 9165330 - DNA, 22 bp, Homo sapiens
aacatttattgagcacctactg

SEQ ID NO: 9165331 - DNA, 22 bp, Homo sapiens
aacatttattgagcacctactg

SEQ ID NO: 9165332 - DNA, 22 bp, Homo sapiens
aacattgttttgcacaactctt

SEQ ID NO: 9165333 - DNA, 22 bp, Homo sapiens
aacattgttttccctatatcca

SEQ ID NO: 9165334 - DNA, 20 bp, Homo sapiens
aacattgaaagtctagaaga

SEQ ID NO: 9165335 - DNA, 22 bp, Homo sapiens
aacataaatttgaagtggcaaa

SEQ ID NO: 9165336 - DNA, 22 bp, Homo sapiens
aacagtttgtggatagcttgta

SEQ ID NO: 9165337 - DNA, 22 bp, Homo sapiens
aacagtttgtggatagcttgta

SEQ ID NO: 9165338 - DNA, 22 bp, Homo sapiens
aacatgtttccagtgtaaggcc

SEQ ID NO: 9165339 - DNA, 22 bp, Homo sapiens
aacattctggttctaaaaacct

SEQ ID NO: 9165340 - DNA, 21 bp, Homo sapiens
aactcccagtgccttcccagc

SEQ ID NO: 9165341 - DNA, 22 bp, Homo sapiens
aactccagcaggaaggtgagaa

SEQ ID NO: 9165342 - DNA, 22 bp, Homo sapiens
aactcagttctttccacaatgc

SEQ ID NO: 9165343 - DNA, 22 bp, Homo sapiens
aactcagtgtgtttcttagtat

SEQ ID NO: 9165344 - DNA, 22 bp, Homo sapiens
aaccatgtactttattctgttt

SEQ ID NO: 9165345 - DNA, 22 bp, Homo sapiens
aaccatggatttcagttcacct

SEQ ID NO: 9165346 - DNA, 22 bp, Homo sapiens
aaccaggatttaagattctaga

SEQ ID NO: 9165347 - DNA, 22 bp, Homo sapiens
aaccaggtgactcatggtgagc

SEQ ID NO: 9165348 - DNA, 22 bp, Homo sapiens
aaccagtttaagcaaataactg

SEQ ID NO: 9165349 - DNA, 22 bp, Homo sapiens
aaccagtttagtcatgctgtaa

SEQ ID NO: 9165350 - DNA, 22 bp, Homo sapiens
aaccagtttaagcaaataactg

SEQ ID NO: 9165351 - DNA, 22 bp, Homo sapiens
aaccagtttcaaagaaaattgc

SEQ ID NO: 9165352 - DNA, 22 bp, Homo sapiens
aatcacttgtaaggaattcaat

SEQ ID NO: 9165353 - DNA, 23 bp, Homo sapiens
aatcacttccctccaaatggatt

SEQ ID NO: 9165354 - DNA, 20 bp, Homo sapiens
aatcactttgtacaggaagc

SEQ ID NO: 9165355 - DNA, 22 bp, Homo sapiens
aaccagatcgactgttaacagc

SEQ ID NO: 9165356 - DNA, 22 bp, Homo sapiens
aataaaatggtcagttttctca

SEQ ID NO: 9165357 - DNA, 22 bp, Homo sapiens
aataaaatggtcagttttctca

SEQ ID NO: 9165358 - DNA, 22 bp, Homo sapiens
aagtttgggcataaggctgtct

SEQ ID NO: 9165359 - DNA, 22 bp, Homo sapiens
aataaaatggtcagttttctca

SEQ ID NO: 9165360 - DNA, 22 bp, Homo sapiens
aagtttggcaagttggtttagt

SEQ ID NO: 9165361 - DNA, 22 bp, Homo sapiens
aagtttgatgagtttctggagg

SEQ ID NO: 9165362 - DNA, 22 bp, Homo sapiens
aagtttgagagcctttagtata

SEQ ID NO: 9165363 - DNA, 22 bp, Homo sapiens
aagtttctgttcatatctctga

SEQ ID NO: 9165364 - DNA, 22 bp, Homo sapiens
aagtttctgttcgctttaataa

SEQ ID NO: 9165365 - DNA, 22 bp, Homo sapiens
aagtttctgttcatatctctga

SEQ ID NO: 9165366 - DNA, 22 bp, Homo sapiens
aagtttctgttcgctttaataa

SEQ ID NO: 9165367 - DNA, 22 bp, Homo sapiens
aagtttctttattagcttgtcc

SEQ ID NO: 9165368 - DNA, 22 bp, Homo sapiens
aagtttctgtatgctcttctgt

SEQ ID NO: 9165369 - DNA, 22 bp, Homo sapiens
aagtttctgttcatatctctga

SEQ ID NO: 9165370 - DNA, 22 bp, Homo sapiens
aagtttctgttcatatctctga

SEQ ID NO: 9165371 - DNA, 22 bp, Homo sapiens
aagtttctgtatgctcttctgt

SEQ ID NO: 9165372 - DNA, 22 bp, Homo sapiens
aagtttctgtatgctcttctgt

SEQ ID NO: 9165373 - DNA, 20 bp, Homo sapiens
aagtttctggtttatatctt

SEQ ID NO: 9165374 - DNA, 20 bp, Homo sapiens
aagtttctggtttatatctt

SEQ ID NO: 9165375 - DNA, 20 bp, Homo sapiens
aagtttctggtttatatctt

SEQ ID NO: 9165376 - DNA, 22 bp, Homo sapiens
aagtttctggaccttacctgct

SEQ ID NO: 9165377 - DNA, 22 bp, Homo sapiens
aagtttctggaccttacctgct

SEQ ID NO: 9165378 - DNA, 22 bp, Homo sapiens
aagtttctgggcaagacaaggc

SEQ ID NO: 9165379 - DNA, 22 bp, Homo sapiens
aagtttctgccatactgtggtg

SEQ ID NO: 9165380 - DNA, 22 bp, Homo sapiens
aagtttctgatattgttaaagc

SEQ ID NO: 9165381 - DNA, 22 bp, Homo sapiens
aagtttctgatattgttaaagc

SEQ ID NO: 9165382 - DNA, 22 bp, Homo sapiens
aacagtttcagttactgatgag

SEQ ID NO: 9165383 - DNA, 22 bp, Homo sapiens
aataaactgctcaattgcatca

SEQ ID NO: 9165384 - DNA, 20 bp, Homo sapiens
aataaactactgagagatgt

SEQ ID NO: 9165385 - DNA, 20 bp, Homo sapiens
aataaactactgagagatgt

SEQ ID NO: 9165386 - DNA, 22 bp, Homo sapiens
aataaacaaatctttcctgtgg

SEQ ID NO: 9165387 - DNA, 22 bp, Homo sapiens
aataaacaaatccttccttccc

SEQ ID NO: 9165388 - DNA, 22 bp, Homo sapiens
aataaacaaatccttccttccc

SEQ ID NO: 9165389 - DNA, 22 bp, Homo sapiens
aataaacaaatccttccttccc

SEQ ID NO: 9165390 - DNA, 22 bp, Homo sapiens
aacactgctgctgggttctgtg

SEQ ID NO: 9165391 - DNA, 22 bp, Homo sapiens
aacactgagggaaaagagatag

SEQ ID NO: 9165392 - DNA, 22 bp, Homo sapiens
aacactgagggaaaagagatag

SEQ ID NO: 9165393 - DNA, 22 bp, Homo sapiens
aagtatttcagcggttctttgt

SEQ ID NO: 9165394 - DNA, 22 bp, Homo sapiens
aagtattctacaaagaaattga

SEQ ID NO: 9165395 - DNA, 22 bp, Homo sapiens
aagtattcataaggacatatgt

SEQ ID NO: 9165396 - DNA, 22 bp, Homo sapiens
aagtcaaaccttgctcacagga

SEQ ID NO: 9165397 - DNA, 22 bp, Homo sapiens
aagtatttctggcctgtgaaag

SEQ ID NO: 9165398 - DNA, 22 bp, Homo sapiens
aagttgaatcagtaacacagtt

SEQ ID NO: 9165399 - DNA, 22 bp, Homo sapiens
aagttgaagcatgaaccaaggt

SEQ ID NO: 9165400 - DNA, 22 bp, Homo sapiens
aagttgaagcatgaaccaaggt

SEQ ID NO: 9165401 - DNA, 22 bp, Homo sapiens
aagttgaatcagtaacacagtt

SEQ ID NO: 9165402 - DNA, 23 bp, Homo sapiens
aagttcttaggttgatactaatg

SEQ ID NO: 9165403 - DNA, 22 bp, Homo sapiens
aagttcttgagccctattctag

SEQ ID NO: 9165404 - DNA, 22 bp, Homo sapiens
aagttctgccaggctgtggcag

SEQ ID NO: 9165405 - DNA, 22 bp, Homo sapiens
aacactggttctgactacacag

SEQ ID NO: 9165406 - DNA, 22 bp, Homo sapiens
aacactggacaggaggctaggt

SEQ ID NO: 9165407 - DNA, 20 bp, Homo sapiens
aacactgcttctatattttc

SEQ ID NO: 9165408 - DNA, 22 bp, Homo sapiens
aacactgggataggtgatagac

SEQ ID NO: 9165409 - DNA, 22 bp, Homo sapiens
aacactggtttggcattagatg

SEQ ID NO: 9165410 - DNA, 22 bp, Homo sapiens
aacaagatgttttgatatatgt

SEQ ID NO: 9165411 - DNA, 22 bp, Homo sapiens
aacaagtaagtttatatatatt

SEQ ID NO: 9165412 - DNA, 22 bp, Homo sapiens
aacaagttactcttaaagtata

SEQ ID NO: 9165413 - DNA, 22 bp, Homo sapiens
aacaagttactcttaaagtata

SEQ ID NO: 9165414 - DNA, 22 bp, Homo sapiens
aacaagttactcttaaagtata

SEQ ID NO: 9165415 - DNA, 22 bp, Homo sapiens
aacaagttgttgaaaataatta

SEQ ID NO: 9165416 - DNA, 22 bp, Homo sapiens
aagggagacagttgtgtgagga

SEQ ID NO: 9165417 - DNA, 22 bp, Homo sapiens
aagggagacagttgtgtgagga

SEQ ID NO: 9165418 - DNA, 22 bp, Homo sapiens
aacaataactagacatgccatg

SEQ ID NO: 9165419 - DNA, 22 bp, Homo sapiens
aacaataactagacatgccatg

SEQ ID NO: 9165420 - DNA, 22 bp, Homo sapiens
aagggagacagttgtgtgagga

SEQ ID NO: 9165421 - DNA, 22 bp, Homo sapiens
aaggccacgtctccttccagag

SEQ ID NO: 9165422 - DNA, 22 bp, Homo sapiens
aaggccacgtctccttccagag

SEQ ID NO: 9165423 - DNA, 22 bp, Homo sapiens
aaggccacagagcctcagagag

SEQ ID NO: 9165424 - DNA, 22 bp, Homo sapiens
aaggccaaggctgcagtgagcc

SEQ ID NO: 9165425 - DNA, 22 bp, Homo sapiens
aaggccacacttgctggccagc

SEQ ID NO: 9165426 - DNA, 22 bp, Homo sapiens
aaggccactgaagaaatcacaa

SEQ ID NO: 9165427 - DNA, 22 bp, Homo sapiens
aacaaatgtgtggcagtgtggg

SEQ ID NO: 9165428 - DNA, 20 bp, Homo sapiens
aaatttaggaaattttacgc

SEQ ID NO: 9165429 - DNA, 22 bp, Homo sapiens
aaatttcagttggaatgagctc

SEQ ID NO: 9165430 - DNA, 22 bp, Homo sapiens
aaatttcagttacctttacgtt

SEQ ID NO: 9165431 - DNA, 22 bp, Homo sapiens
aaatttcagttacctttacgtt

SEQ ID NO: 9165432 - DNA, 21 bp, Homo sapiens
aagggagataggaatcaggcc

SEQ ID NO: 9165433 - DNA, 22 bp, Homo sapiens
aagggagccaagaaagcagggc

SEQ ID NO: 9165434 - DNA, 22 bp, Homo sapiens
aagggagccaagaaagcagggc

SEQ ID NO: 9165435 - DNA, 22 bp, Homo sapiens
aagggagccaagaaagcagggc

SEQ ID NO: 9165436 - DNA, 22 bp, Homo sapiens
aagggagcaaatggacagacgg

SEQ ID NO: 9165437 - DNA, 22 bp, Homo sapiens
aagggagcttaggagatcaggc

SEQ ID NO: 9165438 - DNA, 22 bp, Homo sapiens
aagggagcggggagaccctatg

SEQ ID NO: 9165439 - DNA, 22 bp, Homo sapiens
aagggaggaggatttattgtac

SEQ ID NO: 9165440 - DNA, 22 bp, Homo sapiens
aaggggaagtagcaccagaggt

SEQ ID NO: 9165441 - DNA, 22 bp, Homo sapiens
aagggctggagactgggtcttc

SEQ ID NO: 9165442 - DNA, 22 bp, Homo sapiens
aaggggagttagtgataaaacc

SEQ ID NO: 9165443 - DNA, 22 bp, Homo sapiens
aaggggaagtagcaccagaggt

SEQ ID NO: 9165444 - DNA, 22 bp, Homo sapiens
aaggggaatagagtgggttgtg

SEQ ID NO: 9165445 - DNA, 22 bp, Homo sapiens
aaggggatttaaggtaagaaga

SEQ ID NO: 9165446 - DNA, 21 bp, Homo sapiens
aaggggcaaacccaggacacc

SEQ ID NO: 9165447 - DNA, 21 bp, Homo sapiens
aaggggcaaacccaggacacc

SEQ ID NO: 9165448 - DNA, 21 bp, Homo sapiens
aaggggcaaacccaggacacc

SEQ ID NO: 9165449 - DNA, 22 bp, Homo sapiens
aagggggagaggtgtttggatg

SEQ ID NO: 9165450 - DNA, 22 bp, Homo sapiens
aacaataattgcggttctctat

SEQ ID NO: 9165451 - DNA, 22 bp, Homo sapiens
aagggggaaatcctagcgccgc

SEQ ID NO: 9165452 - DNA, 22 bp, Homo sapiens
aacaatctccaagaccaatgtg

SEQ ID NO: 9165453 - DNA, 22 bp, Homo sapiens
aacaatgaccacacaatgtact

SEQ ID NO: 9165454 - DNA, 22 bp, Homo sapiens
aacaatgaccacacaatgtact

SEQ ID NO: 9165455 - DNA, 22 bp, Homo sapiens
aacaatctgttcgatagaaaat

SEQ ID NO: 9165456 - DNA, 22 bp, Homo sapiens
aacaatctgttcgatagaaaat

SEQ ID NO: 9165457 - DNA, 22 bp, Homo sapiens
aagtacagaaatagcaggtgca

SEQ ID NO: 9165458 - DNA, 22 bp, Homo sapiens
aagtatgacatttaagacaatt

SEQ ID NO: 9165459 - DNA, 22 bp, Homo sapiens
aaggacatttctgactaatgca

SEQ ID NO: 9165460 - DNA, 22 bp, Homo sapiens
aaggacaggttggggcttcagg

SEQ ID NO: 9165461 - DNA, 22 bp, Homo sapiens
aaggacaggttggggcttcagg

SEQ ID NO: 9165462 - DNA, 22 bp, Homo sapiens
aaggacagggatggttgattgt

SEQ ID NO: 9165463 - DNA, 22 bp, Homo sapiens
aaattattataggcagagctga

SEQ ID NO: 9165464 - DNA, 22 bp, Homo sapiens
aaattattataggcagagctga

SEQ ID NO: 9165465 - DNA, 22 bp, Homo sapiens
aaattatcatgggggagaaaca

SEQ ID NO: 9165466 - DNA, 22 bp, Homo sapiens
aaattatcatgggggagaaaca

SEQ ID NO: 9165467 - DNA, 22 bp, Homo sapiens
aaattatcatgattattgtgta

SEQ ID NO: 9165468 - DNA, 22 bp, Homo sapiens
aaattataggtgccaccttgga

SEQ ID NO: 9165469 - DNA, 22 bp, Homo sapiens
aaattaactatcacttttgtga

SEQ ID NO: 9165470 - DNA, 22 bp, Homo sapiens
aaattgttgatctacagtaagg

SEQ ID NO: 9165471 - DNA, 22 bp, Homo sapiens
aaatttaaaaagcagcattgca

SEQ ID NO: 9165472 - DNA, 22 bp, Homo sapiens
aaattgcattttaaaggtagat

SEQ ID NO: 9165473 - DNA, 22 bp, Homo sapiens
aaattgctaaattgtaagaggg

SEQ ID NO: 9165474 - DNA, 22 bp, Homo sapiens
aaattgctagttgcttttttca

SEQ ID NO: 9165475 - DNA, 22 bp, Homo sapiens
aaatttaaaaagcagcattgca

SEQ ID NO: 9165476 - DNA, 22 bp, Homo sapiens
aaatttaaggaggtgctcactt

SEQ ID NO: 9165477 - DNA, 22 bp, Homo sapiens
aaggactaaaagaagggtttct

SEQ ID NO: 9165478 - DNA, 22 bp, Homo sapiens
aaggactaatgaatagatgaat

SEQ ID NO: 9165479 - DNA, 22 bp, Homo sapiens
aaggactagatattcatacatg

SEQ ID NO: 9165480 - DNA, 22 bp, Homo sapiens
aaggactagattatacaatagg

SEQ ID NO: 9165481 - DNA, 22 bp, Homo sapiens
aaggactctccagctagcaaat

SEQ ID NO: 9165482 - DNA, 22 bp, Homo sapiens
aaggacctgattttgagcatct

SEQ ID NO: 9165483 - DNA, 22 bp, Homo sapiens
aaggagaaatggtagatgtgca

SEQ ID NO: 9165484 - DNA, 22 bp, Homo sapiens
aagctgtgaaatagattacaca

SEQ ID NO: 9165485 - DNA, 22 bp, Homo sapiens
aagctgtcaatgtatctagtct

SEQ ID NO: 9165486 - DNA, 20 bp, Homo sapiens
aagctgggtaggagaggagc

SEQ ID NO: 9165487 - DNA, 20 bp, Homo sapiens
aagctgggtaggagaggagc

SEQ ID NO: 9165488 - DNA, 22 bp, Homo sapiens
aagctgggagggagcccagagt

SEQ ID NO: 9165489 - DNA, 22 bp, Homo sapiens
aagctgggacttagcgcagata

SEQ ID NO: 9165490 - DNA, 22 bp, Homo sapiens
aagcttttctcagtgtccttgg

SEQ ID NO: 9165491 - DNA, 21 bp, Homo sapiens
aaggaaaagcttggtctctga

SEQ ID NO: 9165492 - DNA, 21 bp, Homo sapiens
aaggaaaagcttggtctctga

SEQ ID NO: 9165493 - DNA, 22 bp, Homo sapiens
aagctttggaagggcagggttg

SEQ ID NO: 9165494 - DNA, 22 bp, Homo sapiens
aagctttgcaatgcttcattat

SEQ ID NO: 9165495 - DNA, 22 bp, Homo sapiens
aagctttgactactgcctcttg

SEQ ID NO: 9165496 - DNA, 22 bp, Homo sapiens
aagctttgactactgcctcttg

SEQ ID NO: 9165497 - DNA, 18 bp, Homo sapiens
aagctgggaaggagacag

SEQ ID NO: 9165498 - DNA, 18 bp, Homo sapiens
aagctgggaaggagacag

SEQ ID NO: 9165499 - DNA, 22 bp, Homo sapiens
aagctggcatgtcacctgagaa

SEQ ID NO: 9165500 - DNA, 22 bp, Homo sapiens
aagcccagaatcaagtctactg

SEQ ID NO: 9165501 - DNA, 16 bp, Homo sapiens
aagccagttcagcatt

SEQ ID NO: 9165502 - DNA, 22 bp, Homo sapiens
aagccagtgtttttgagagttg

SEQ ID NO: 9165503 - DNA, 22 bp, Homo sapiens
aagccagtgtgacaggaaactt

SEQ ID NO: 9165504 - DNA, 22 bp, Homo sapiens
aagccagcattttcccattcct

SEQ ID NO: 9165505 - DNA, 22 bp, Homo sapiens
aagccagccagtgccagtctta

SEQ ID NO: 9165506 - DNA, 22 bp, Homo sapiens
aagccagtgtccagaatgggca

SEQ ID NO: 9165507 - DNA, 22 bp, Homo sapiens
aagccagtgggcatagcagttg

SEQ ID NO: 9165508 - DNA, 22 bp, Homo sapiens
aagccagtcctctactgggcac

SEQ ID NO: 9165509 - DNA, 22 bp, Homo sapiens
aagcacatctcctgtgcagaac

SEQ ID NO: 9165510 - DNA, 22 bp, Homo sapiens
aagcacatcatgttgttcagac

SEQ ID NO: 9165511 - DNA, 22 bp, Homo sapiens
aagcacattaaggaacattgaa

SEQ ID NO: 9165512 - DNA, 22 bp, Homo sapiens
aagcacatttggaaaacatgga

SEQ ID NO: 9165513 - DNA, 20 bp, Homo sapiens
aagcacatttctacaataat

SEQ ID NO: 9165514 - DNA, 22 bp, Homo sapiens
acagatgagaaggctgaccagt

SEQ ID NO: 9165515 - DNA, 23 bp, Homo sapiens
acagatgaaagtgtggctcagag

SEQ ID NO: 9165516 - DNA, 22 bp, Homo sapiens
acagatgaaacccagctagttg

SEQ ID NO: 9165517 - DNA, 22 bp, Homo sapiens
acagatctacattgtctgaccc

SEQ ID NO: 9165518 - DNA, 22 bp, Homo sapiens
aagcacatcatgttgttcagac

SEQ ID NO: 9165519 - DNA, 22 bp, Homo sapiens
aagcacagtgggcagagcagcc

SEQ ID NO: 9165520 - DNA, 18 bp, Homo sapiens
acagaggcagacatgtat

SEQ ID NO: 9165521 - DNA, 18 bp, Homo sapiens
acagaggcagacatgtat

SEQ ID NO: 9165522 - DNA, 22 bp, Homo sapiens
acagaggaaggctgagctgccc

SEQ ID NO: 9165523 - DNA, 22 bp, Homo sapiens
acagaggacaactaggcgctca

SEQ ID NO: 9165524 - DNA, 22 bp, Homo sapiens
acagaggaaggctgagctgccc

SEQ ID NO: 9165525 - DNA, 22 bp, Homo sapiens
acagaggaaggctgagctgccc

SEQ ID NO: 9165526 - DNA, 22 bp, Homo sapiens
acagaggaaggctgagctgccc

SEQ ID NO: 9165527 - DNA, 22 bp, Homo sapiens
acagaggaaggctgagctgccc

SEQ ID NO: 9165528 - DNA, 22 bp, Homo sapiens
acagaggaagcatatagcacaa

SEQ ID NO: 9165529 - DNA, 22 bp, Homo sapiens
acagaggaaggctgagctgccc

SEQ ID NO: 9165530 - DNA, 22 bp, Homo sapiens
acagagcttaattcaggagctt

SEQ ID NO: 9165531 - DNA, 22 bp, Homo sapiens
acagagctgtactacttactga

SEQ ID NO: 9165532 - DNA, 22 bp, Homo sapiens
acagagctgtactacttactga

SEQ ID NO: 9165533 - DNA, 22 bp, Homo sapiens
acagaggaagcatatagcacaa

SEQ ID NO: 9165534 - DNA, 22 bp, Homo sapiens
acagagcttaggatgactccca

SEQ ID NO: 9165535 - DNA, 22 bp, Homo sapiens
acagagcttaggatgactccca

SEQ ID NO: 9165536 - DNA, 22 bp, Homo sapiens
acagagctgtacatgtgccatg

SEQ ID NO: 9165537 - DNA, 22 bp, Homo sapiens
aagcaaagacagtttgagtgga

SEQ ID NO: 9165538 - DNA, 22 bp, Homo sapiens
aagcaaaaggttacacttctgg

SEQ ID NO: 9165539 - DNA, 22 bp, Homo sapiens
acagaagacagagtgttcatct

SEQ ID NO: 9165540 - DNA, 22 bp, Homo sapiens
acagaagaccaagaaagcttcc

SEQ ID NO: 9165541 - DNA, 22 bp, Homo sapiens
acagaagaagttcaaggtgaag

SEQ ID NO: 9165542 - DNA, 22 bp, Homo sapiens
acagaagaaagggaggttttgc

SEQ ID NO: 9165543 - DNA, 19 bp, Homo sapiens
acagaaatgtaagtgagac

SEQ ID NO: 9165544 - DNA, 22 bp, Homo sapiens
aagatactgatgatgtaggcta

SEQ ID NO: 9165545 - DNA, 22 bp, Homo sapiens
aagatacatcattcaggagtga

SEQ ID NO: 9165546 - DNA, 22 bp, Homo sapiens
aagatacatcattcaggagtga

SEQ ID NO: 9165547 - DNA, 22 bp, Homo sapiens
acagaagcagccgtcacagata

SEQ ID NO: 9165548 - DNA, 22 bp, Homo sapiens
aagatttgactctgattagcat

SEQ ID NO: 9165549 - DNA, 22 bp, Homo sapiens
acagaagataatgctgccttgg

SEQ ID NO: 9165550 - DNA, 22 bp, Homo sapiens
acagaagagcacatttagtatg

SEQ ID NO: 9165551 - DNA, 22 bp, Homo sapiens
aagatttttttccacagactca

SEQ ID NO: 9165552 - DNA, 22 bp, Homo sapiens
aagcaaaacgtgctctaggagg

SEQ ID NO: 9165553 - DNA, 22 bp, Homo sapiens
aagcaaaacgtgctctaggagg

SEQ ID NO: 9165554 - DNA, 22 bp, Homo sapiens
aagcaaaaggttacacttctgg

SEQ ID NO: 9165555 - DNA, 22 bp, Homo sapiens
aagcaaaaggttacacttctgg

SEQ ID NO: 9165556 - DNA, 22 bp, Homo sapiens
aagattttctcaactgtatttg

SEQ ID NO: 9165557 - DNA, 22 bp, Homo sapiens
aagatttgtggatttaaggata

SEQ ID NO: 9165558 - DNA, 22 bp, Homo sapiens
aagatttggtatcagaagacct

SEQ ID NO: 9165559 - DNA, 19 bp, Homo sapiens
aagatttggtcattgataa

SEQ ID NO: 9165560 - DNA, 22 bp, Homo sapiens
aagatttgtggatttaaggata

SEQ ID NO: 9165561 - DNA, 22 bp, Homo sapiens
aagattttcagctaatggtgca

SEQ ID NO: 9165562 - DNA, 22 bp, Homo sapiens
aagattttcagtgcctaaaaca

SEQ ID NO: 9165563 - DNA, 22 bp, Homo sapiens
acacggcactttaggaaggggc

SEQ ID NO: 9165564 - DNA, 22 bp, Homo sapiens
acacggcactttaggaaggggc

SEQ ID NO: 9165565 - DNA, 22 bp, Homo sapiens
acacggcactttaggaaggggc

SEQ ID NO: 9165566 - DNA, 22 bp, Homo sapiens
acacggcactttaggaaggggc

SEQ ID NO: 9165567 - DNA, 22 bp, Homo sapiens
acactaatgagaaaggaattaa

SEQ ID NO: 9165568 - DNA, 22 bp, Homo sapiens
acactaaggttggagtcacagt

SEQ ID NO: 9165569 - DNA, 23 bp, Homo sapiens
acactaaatgtgaaggagcaaag

SEQ ID NO: 9165570 - DNA, 23 bp, Homo sapiens
acacctgtgctgtagtcactaca

SEQ ID NO: 9165571 - DNA, 23 bp, Homo sapiens
aagagtttagagtcttgcagagt

SEQ ID NO: 9165572 - DNA, 22 bp, Homo sapiens
aagagtttatgatataacatgt

SEQ ID NO: 9165573 - DNA, 22 bp, Homo sapiens
aagagtttatgatataacatgt

SEQ ID NO: 9165574 - DNA, 22 bp, Homo sapiens
acacatttctctttttgtaagt

SEQ ID NO: 9165575 - DNA, 22 bp, Homo sapiens
acaccccaccagtaactgaggg

SEQ ID NO: 9165576 - DNA, 20 bp, Homo sapiens
aagagtctttactgagctaa

SEQ ID NO: 9165577 - DNA, 22 bp, Homo sapiens
aagagtgagtatttcctgatta

SEQ ID NO: 9165578 - DNA, 22 bp, Homo sapiens
aagagttatacctatttctaac

SEQ ID NO: 9165579 - DNA, 22 bp, Homo sapiens
aagagttagctcaataacttga

SEQ ID NO: 9165580 - DNA, 22 bp, Homo sapiens
aagagtttaattttgtctagac

SEQ ID NO: 9165581 - DNA, 22 bp, Homo sapiens
aagagtttaattttgtctagac

SEQ ID NO: 9165582 - DNA, 22 bp, Homo sapiens
aagagtttaccagtgctgcttc

SEQ ID NO: 9165583 - DNA, 22 bp, Homo sapiens
aagaggttgtctgtgatgagtt

SEQ ID NO: 9165584 - DNA, 22 bp, Homo sapiens
aagagtaaagcaaagcacttgt

SEQ ID NO: 9165585 - DNA, 19 bp, Homo sapiens
aagagtcacaggcagccct

SEQ ID NO: 9165586 - DNA, 22 bp, Homo sapiens
aagagtaaatgtctaattagga

SEQ ID NO: 9165587 - DNA, 22 bp, Homo sapiens
aagagtcatagagacattgatt

SEQ ID NO: 9165588 - DNA, 22 bp, Homo sapiens
aagaggagggcagattcaaggc

SEQ ID NO: 9165589 - DNA, 22 bp, Homo sapiens
aagaggagtagatgtggttggt

SEQ ID NO: 9165590 - DNA, 22 bp, Homo sapiens
aagaggagtagatgtggttggt

SEQ ID NO: 9165591 - DNA, 22 bp, Homo sapiens
aagaggagggcagattcaaggc

SEQ ID NO: 9165592 - DNA, 22 bp, Homo sapiens
aagaggagggcagattcaaggc

SEQ ID NO: 9165593 - DNA, 22 bp, Homo sapiens
aagaggagggcagattcaaggc

SEQ ID NO: 9165594 - DNA, 23 bp, Homo sapiens
aagaggaggccctgctcccgtcc

SEQ ID NO: 9165595 - DNA, 22 bp, Homo sapiens
aagaggcagtggtgatgaatgg

SEQ ID NO: 9165596 - DNA, 22 bp, Homo sapiens
aagaggcataaaatttatatgg

SEQ ID NO: 9165597 - DNA, 22 bp, Homo sapiens
aagaggcagaaatatcgctgaa

SEQ ID NO: 9165598 - DNA, 19 bp, Homo sapiens
aagaggcaaccctcgagcc

SEQ ID NO: 9165599 - DNA, 22 bp, Homo sapiens
aagaggcagcccgctgaggctg

SEQ ID NO: 9165600 - DNA, 22 bp, Homo sapiens
aagaggaggattgatgtgggag

SEQ ID NO: 9165601 - DNA, 22 bp, Homo sapiens
aagaggaggattgatgtgggag

SEQ ID NO: 9165602 - DNA, 22 bp, Homo sapiens
aagacatttatttgaatcaatt

SEQ ID NO: 9165603 - DNA, 22 bp, Homo sapiens
aagacatttatgaaaagtgctg

SEQ ID NO: 9165604 - DNA, 22 bp, Homo sapiens
aagacatttatgaaaagtgctg

SEQ ID NO: 9165605 - DNA, 22 bp, Homo sapiens
aagacattgtggagatgttgct

SEQ ID NO: 9165606 - DNA, 22 bp, Homo sapiens
aagacattttgaaattggaagc

SEQ ID NO: 9165607 - DNA, 22 bp, Homo sapiens
acacacagaaggaagccccact

SEQ ID NO: 9165608 - DNA, 21 bp, Homo sapiens
aagaggcatcactatttgtgt

SEQ ID NO: 9165609 - DNA, 20 bp, Homo sapiens
acacacagagacatgcgcat

SEQ ID NO: 9165610 - DNA, 22 bp, Homo sapiens
acacacagagtttatacaggca

SEQ ID NO: 9165611 - DNA, 22 bp, Homo sapiens
acacacagagtttatacaggca

SEQ ID NO: 9165612 - DNA, 22 bp, Homo sapiens
acacacagcgcctaccatgtgc

SEQ ID NO: 9165613 - DNA, 22 bp, Homo sapiens
acacacaggtaaaggagcctgg

SEQ ID NO: 9165614 - DNA, 20 bp, Homo sapiens
aagaggtgataacaggtgag

SEQ ID NO: 9165615 - DNA, 22 bp, Homo sapiens
aagaggtgccaggggttttgta

SEQ ID NO: 9165616 - DNA, 19 bp, Homo sapiens
aagagggaaagtgctatgc

SEQ ID NO: 9165617 - DNA, 19 bp, Homo sapiens
aagagggaaagtgctatgc

SEQ ID NO: 9165618 - DNA, 22 bp, Homo sapiens
aagaggctttcagtgaacttgt

SEQ ID NO: 9165619 - DNA, 22 bp, Homo sapiens
aagaggctttcagtgaacttgt

SEQ ID NO: 9165620 - DNA, 22 bp, Homo sapiens
acacacaggtaaaggagcctgg

SEQ ID NO: 9165621 - DNA, 22 bp, Homo sapiens
acacacatgcatgcttgccatt

SEQ ID NO: 9165622 - DNA, 22 bp, Homo sapiens
aatgtattttgggagtttcttt

SEQ ID NO: 9165623 - DNA, 22 bp, Homo sapiens
aatgtattttgggagtttcttt

SEQ ID NO: 9165624 - DNA, 20 bp, Homo sapiens
aatgtattgttttgtttcag

SEQ ID NO: 9165625 - DNA, 20 bp, Homo sapiens
aatgtattgttttgtttcag

SEQ ID NO: 9165626 - DNA, 22 bp, Homo sapiens
aatgtcaaaggctatacattca

SEQ ID NO: 9165627 - DNA, 22 bp, Homo sapiens
aatgtcaataactttatccctc

SEQ ID NO: 9165628 - DNA, 22 bp, Homo sapiens
aatgtcaacacaagagaaatgc

SEQ ID NO: 9165629 - DNA, 22 bp, Homo sapiens
aatgtcaagggaagcaggaaat

SEQ ID NO: 9165630 - DNA, 22 bp, Homo sapiens
aatgtcttcttcagctgaataa

SEQ ID NO: 9165631 - DNA, 22 bp, Homo sapiens
aatgtcttctcttgttgaattt

SEQ ID NO: 9165632 - DNA, 20 bp, Homo sapiens
aatgtcttgagacatttcag

SEQ ID NO: 9165633 - DNA, 22 bp, Homo sapiens
aatgtctttctcataacagata

SEQ ID NO: 9165634 - DNA, 22 bp, Homo sapiens
aatgtctttacttttgtgggca

SEQ ID NO: 9165635 - DNA, 22 bp, Homo sapiens
aatgtctttctcataacagata

SEQ ID NO: 9165636 - DNA, 22 bp, Homo sapiens
aatgtctttatttcaggtttac

SEQ ID NO: 9165637 - DNA, 22 bp, Homo sapiens
aatgtctttaaagtgcaataga

SEQ ID NO: 9165638 - DNA, 22 bp, Homo sapiens
aatgtcttggatacagaggttg

SEQ ID NO: 9165639 - DNA, 22 bp, Homo sapiens
aatgtcttgagaagagaaatct

SEQ ID NO: 9165640 - DNA, 22 bp, Homo sapiens
aactctgcaacctatgtagacc

SEQ ID NO: 9165641 - DNA, 22 bp, Homo sapiens
aactctgccaggtttcaggagc

SEQ ID NO: 9165642 - DNA, 23 bp, Homo sapiens
aactctggctagcatagaataga

SEQ ID NO: 9165643 - DNA, 20 bp, Homo sapiens
aactcctagcctcaagtgat

SEQ ID NO: 9165644 - DNA, 20 bp, Homo sapiens
aactcctagcctcaagtgat

SEQ ID NO: 9165645 - DNA, 20 bp, Homo sapiens
aactcctagcctcaagtgat

SEQ ID NO: 9165646 - DNA, 22 bp, Homo sapiens
aactctatttaccctactaaac

SEQ ID NO: 9165647 - DNA, 22 bp, Homo sapiens
aatgtattctgggaaaatgtta

SEQ ID NO: 9165648 - DNA, 22 bp, Homo sapiens
aactctggtttcagactcactt

SEQ ID NO: 9165649 - DNA, 22 bp, Homo sapiens
aactgaaaccaaacactttagg

SEQ ID NO: 9165650 - DNA, 20 bp, Homo sapiens
aactttagacataatctctt

SEQ ID NO: 9165651 - DNA, 22 bp, Homo sapiens
aactttagctatttaatctgat

SEQ ID NO: 9165652 - DNA, 22 bp, Homo sapiens
aatgttattacacttgtgaaat

SEQ ID NO: 9165653 - DNA, 21 bp, Homo sapiens
aactttagaaagactgggaag

SEQ ID NO: 9165654 - DNA, 22 bp, Homo sapiens
aactttcaggcaatgaatattt

SEQ ID NO: 9165655 - DNA, 22 bp, Homo sapiens
aactttctaattttggctgagc

SEQ ID NO: 9165656 - DNA, 22 bp, Homo sapiens
aactttctagagatgagttcgg

SEQ ID NO: 9165657 - DNA, 22 bp, Homo sapiens
aactttcagaatcctatgcatt

SEQ ID NO: 9165658 - DNA, 22 bp, Homo sapiens
aactttcagcaagtaattctgg

SEQ ID NO: 9165659 - DNA, 22 bp, Homo sapiens
aactttctgaaaagcttgatca

SEQ ID NO: 9165660 - DNA, 22 bp, Homo sapiens
aactttctgaaaagcttgatca

SEQ ID NO: 9165661 - DNA, 20 bp, Homo sapiens
aactttctcccattggactg

SEQ ID NO: 9165662 - DNA, 22 bp, Homo sapiens
aactttctccagtgccaactat

SEQ ID NO: 9165663 - DNA, 22 bp, Homo sapiens
aactttctataggttgggattt

SEQ ID NO: 9165664 - DNA, 22 bp, Homo sapiens
aatgttttttggtctgatgaat

SEQ ID NO: 9165665 - DNA, 22 bp, Homo sapiens
aatgttttgtatgcctctgagc

SEQ ID NO: 9165666 - DNA, 22 bp, Homo sapiens
aattacttaagagaaactttga

SEQ ID NO: 9165667 - DNA, 22 bp, Homo sapiens
aattacttaagagaaactttga

SEQ ID NO: 9165668 - DNA, 22 bp, Homo sapiens
aatgttacgatcaacaacacat

SEQ ID NO: 9165669 - DNA, 22 bp, Homo sapiens
aatgttaattcacagccaaata

SEQ ID NO: 9165670 - DNA, 22 bp, Homo sapiens
aatgtgaaaccgcacagaataa

SEQ ID NO: 9165671 - DNA, 22 bp, Homo sapiens
aatgtgtttatttagtgattta

SEQ ID NO: 9165672 - DNA, 22 bp, Homo sapiens
aatgtcttttgcagttcaagat

SEQ ID NO: 9165673 - DNA, 22 bp, Homo sapiens
aatgtgttttatgagagaatat

SEQ ID NO: 9165674 - DNA, 22 bp, Homo sapiens
aatgtgttttatgagagaatat

SEQ ID NO: 9165675 - DNA, 22 bp, Homo sapiens
aatgtgttttcactgaagattc

SEQ ID NO: 9165676 - DNA, 22 bp, Homo sapiens
aatgtcttttcccttactttcc

SEQ ID NO: 9165677 - DNA, 22 bp, Homo sapiens
aatgtcttttaacctctggact

SEQ ID NO: 9165678 - DNA, 22 bp, Homo sapiens
aatgtcttttgatacaagttac

SEQ ID NO: 9165679 - DNA, 22 bp, Homo sapiens
aatgtcttttgatacaagttac

SEQ ID NO: 9165680 - DNA, 22 bp, Homo sapiens
aatgtcttttgatacaagttac

SEQ ID NO: 9165681 - DNA, 22 bp, Homo sapiens
aatgtcttttaaatgttgaggt

SEQ ID NO: 9165682 - DNA, 21 bp, Homo sapiens
aatgtctttgtccatgctctg

SEQ ID NO: 9165683 - DNA, 22 bp, Homo sapiens
aatgtctttctgttctatgaga

SEQ ID NO: 9165684 - DNA, 22 bp, Homo sapiens
aatgtctttgccagggtcgggc

SEQ ID NO: 9165685 - DNA, 21 bp, Homo sapiens
aatgtctttgtccatgctctg

SEQ ID NO: 9165686 - DNA, 22 bp, Homo sapiens
aatgtctttcttggttctggtt

SEQ ID NO: 9165687 - DNA, 22 bp, Homo sapiens
aatgtctttgcaggagggattg

SEQ ID NO: 9165688 - DNA, 22 bp, Homo sapiens
aagacaatgcattactaagaag

SEQ ID NO: 9165689 - DNA, 22 bp, Homo sapiens
aagacaatttgatactagttgc

SEQ ID NO: 9165690 - DNA, 22 bp, Homo sapiens
aagacaatttgatactagttgc

SEQ ID NO: 9165691 - DNA, 22 bp, Homo sapiens
acaactccttcttgggtcctgg

SEQ ID NO: 9165692 - DNA, 23 bp, Homo sapiens
acaactttacagatacattttgt

SEQ ID NO: 9165693 - DNA, 22 bp, Homo sapiens
acaacttggctgtaaagaagaa

SEQ ID NO: 9165694 - DNA, 22 bp, Homo sapiens
aagacattagaatcagcctgtt

SEQ ID NO: 9165695 - DNA, 22 bp, Homo sapiens
aagacattcatgaagaagggat

SEQ ID NO: 9165696 - DNA, 22 bp, Homo sapiens
aagacattggacaatccagagg

SEQ ID NO: 9165697 - DNA, 22 bp, Homo sapiens
aagacattgctgcttttaattg

SEQ ID NO: 9165698 - DNA, 22 bp, Homo sapiens
aagacattggcattgactgtaa

SEQ ID NO: 9165699 - DNA, 22 bp, Homo sapiens
aagacattggacaatccagagg

SEQ ID NO: 9165700 - DNA, 22 bp, Homo sapiens
aagaattattgcaatactagat

SEQ ID NO: 9165701 - DNA, 22 bp, Homo sapiens
aagaattattgcaatactagat

SEQ ID NO: 9165702 - DNA, 22 bp, Homo sapiens
aagaatgaaggatttagctgtt

SEQ ID NO: 9165703 - DNA, 22 bp, Homo sapiens
aagaattggtcacatgctacaa

SEQ ID NO: 9165704 - DNA, 22 bp, Homo sapiens
aagaattgcctttcaattgttt

SEQ ID NO: 9165705 - DNA, 22 bp, Homo sapiens
aagaattgatgtgaattgcagc

SEQ ID NO: 9165706 - DNA, 22 bp, Homo sapiens
aagaatcttaatccagaaacct

SEQ ID NO: 9165707 - DNA, 22 bp, Homo sapiens
aagaatctgttgattccccact

SEQ ID NO: 9165708 - DNA, 22 bp, Homo sapiens
aagaattttccagcatgtcagt

SEQ ID NO: 9165709 - DNA, 22 bp, Homo sapiens
aagaattttccagcatgtcagt

SEQ ID NO: 9165710 - DNA, 22 bp, Homo sapiens
aagacaaaggggtccttggatg

SEQ ID NO: 9165711 - DNA, 22 bp, Homo sapiens
aagacaaaggggtccttggatg

SEQ ID NO: 9165712 - DNA, 22 bp, Homo sapiens
aagacaatcctggacagtcagc

SEQ ID NO: 9165713 - DNA, 22 bp, Homo sapiens
aagacaatcctggacagtcagc

SEQ ID NO: 9165714 - DNA, 22 bp, Homo sapiens
aagacaagccttgtttttctgc

SEQ ID NO: 9165715 - DNA, 22 bp, Homo sapiens
aagacaatattgctgtgaacgt

SEQ ID NO: 9165716 - DNA, 22 bp, Homo sapiens
aattagaagggagttattgata

SEQ ID NO: 9165717 - DNA, 22 bp, Homo sapiens
aattagagtggcgagtgattta

SEQ ID NO: 9165718 - DNA, 22 bp, Homo sapiens
aattatttaactcctttggaga

SEQ ID NO: 9165719 - DNA, 23 bp, Homo sapiens
agcattctctccaacatttaaca

SEQ ID NO: 9165720 - DNA, 22 bp, Homo sapiens
agcattctgtggtcttctatgg

SEQ ID NO: 9165721 - DNA, 22 bp, Homo sapiens
agcatgaaaacatgaaacagca

SEQ ID NO: 9165722 - DNA, 22 bp, Homo sapiens
agcattcattgctagaatgtaa

SEQ ID NO: 9165723 - DNA, 22 bp, Homo sapiens
agcatctgcataatgccttccc

SEQ ID NO: 9165724 - DNA, 22 bp, Homo sapiens
agcatcccatgactctggagga

SEQ ID NO: 9165725 - DNA, 22 bp, Homo sapiens
agcatctgttaagtgccttcaa

SEQ ID NO: 9165726 - DNA, 22 bp, Homo sapiens
agccaggctcaaggcctgctcc

SEQ ID NO: 9165727 - DNA, 20 bp, Homo sapiens
agccaggctcaagctccccc

SEQ ID NO: 9165728 - DNA, 22 bp, Homo sapiens
agccaggctactccttgctgac

SEQ ID NO: 9165729 - DNA, 22 bp, Homo sapiens
agccaggctaaatgagccatga

SEQ ID NO: 9165730 - DNA, 22 bp, Homo sapiens
agccaggcgggtctttgctcct

SEQ ID NO: 9165731 - DNA, 22 bp, Homo sapiens
agcatttaatcctacatagatc

SEQ ID NO: 9165732 - DNA, 22 bp, Homo sapiens
agccaggacagggcagctcgct

SEQ ID NO: 9165733 - DNA, 22 bp, Homo sapiens
agccaggcgcagtggcttatgc

SEQ ID NO: 9165734 - DNA, 22 bp, Homo sapiens
agccaggcggggcaggtttcct

SEQ ID NO: 9165735 - DNA, 22 bp, Homo sapiens
agccaggacagggcagctcgct

SEQ ID NO: 9165736 - DNA, 22 bp, Homo sapiens
agccaggacagggcagctcgct

SEQ ID NO: 9165737 - DNA, 22 bp, Homo sapiens
agcccagctttcacccctctgg

SEQ ID NO: 9165738 - DNA, 22 bp, Homo sapiens
acagaactgggggcacagatag

SEQ ID NO: 9165739 - DNA, 21 bp, Homo sapiens
acagaactgtatagtgataaa

SEQ ID NO: 9165740 - DNA, 22 bp, Homo sapiens
agcccagggagttgattagcat

SEQ ID NO: 9165741 - DNA, 22 bp, Homo sapiens
acagaacatattgcttctctca

SEQ ID NO: 9165742 - DNA, 22 bp, Homo sapiens
acagaacaggctgagaaaaaca

SEQ ID NO: 9165743 - DNA, 22 bp, Homo sapiens
acagaactgagaattctctatc

SEQ ID NO: 9165744 - DNA, 22 bp, Homo sapiens
acagaactgcaggaggaaaagc

SEQ ID NO: 9165745 - DNA, 22 bp, Homo sapiens
acagaactggaattggaactca

SEQ ID NO: 9165746 - DNA, 22 bp, Homo sapiens
acagacatcatcaacatcttcc

SEQ ID NO: 9165747 - DNA, 22 bp, Homo sapiens
acagacatctatccatttaatt

SEQ ID NO: 9165748 - DNA, 22 bp, Homo sapiens
acagacatatttggcccatagc

SEQ ID NO: 9165749 - DNA, 22 bp, Homo sapiens
acagacagtaaatagtgtggct

SEQ ID NO: 9165750 - DNA, 22 bp, Homo sapiens
agcccaggtgaggggttcgaaa

SEQ ID NO: 9165751 - DNA, 22 bp, Homo sapiens
agcccaggtgactcatacaccc

SEQ ID NO: 9165752 - DNA, 22 bp, Homo sapiens
agcccaggtgaggggttcgaaa

SEQ ID NO: 9165753 - DNA, 22 bp, Homo sapiens
agcccaggtggagtgtgtgggg

SEQ ID NO: 9165754 - DNA, 22 bp, Homo sapiens
agcccaggtctcaaagtacagg

SEQ ID NO: 9165755 - DNA, 22 bp, Homo sapiens
agcccaggtctcaaagtacagg

SEQ ID NO: 9165756 - DNA, 22 bp, Homo sapiens
agcccaggtctggcccagcctg

SEQ ID NO: 9165757 - DNA, 22 bp, Homo sapiens
agcccaggtctggcccagcctg

SEQ ID NO: 9165758 - DNA, 22 bp, Homo sapiens
agcccaggtctggcccagcctg

SEQ ID NO: 9165759 - DNA, 22 bp, Homo sapiens
agccttacataaacagccttat

SEQ ID NO: 9165760 - DNA, 21 bp, Homo sapiens
agcctgttggtttactgctca

SEQ ID NO: 9165761 - DNA, 22 bp, Homo sapiens
agcctgtgggagccgctcccgt

SEQ ID NO: 9165762 - DNA, 22 bp, Homo sapiens
agcctgtggatccctgcactgg

SEQ ID NO: 9165763 - DNA, 22 bp, Homo sapiens
agcctgtgtgaagccctcagag

SEQ ID NO: 9165764 - DNA, 22 bp, Homo sapiens
agcctgtgtgaagccctcagag

SEQ ID NO: 9165765 - DNA, 22 bp, Homo sapiens
agcctgtgggagccgctcccgt

SEQ ID NO: 9165766 - DNA, 22 bp, Homo sapiens
agcctgtgctgtgtttgctcca

SEQ ID NO: 9165767 - DNA, 22 bp, Homo sapiens
agcctgtctgtctccaaagctg

SEQ ID NO: 9165768 - DNA, 22 bp, Homo sapiens
agcctggctgtaacctcatggt

SEQ ID NO: 9165769 - DNA, 22 bp, Homo sapiens
agcctggcggtcgtcggtcagg

SEQ ID NO: 9165770 - DNA, 22 bp, Homo sapiens
agctcaggccggagctacaggc

SEQ ID NO: 9165771 - DNA, 22 bp, Homo sapiens
agctcaggccggagctacaggc

SEQ ID NO: 9165772 - DNA, 22 bp, Homo sapiens
agctcaggctctgcagggacta

SEQ ID NO: 9165773 - DNA, 22 bp, Homo sapiens
agctcagggcgatctgtctcgg

SEQ ID NO: 9165774 - DNA, 22 bp, Homo sapiens
agctcagggctccaggaccgct

SEQ ID NO: 9165775 - DNA, 22 bp, Homo sapiens
agctcaggtcattccagggatg

SEQ ID NO: 9165776 - DNA, 22 bp, Homo sapiens
agctcaggtctcaggaggtgtc

SEQ ID NO: 9165777 - DNA, 22 bp, Homo sapiens
agctcaggtctcaggaggtgtc

SEQ ID NO: 9165778 - DNA, 22 bp, Homo sapiens
agctcaggtctcaggaggtgtc

SEQ ID NO: 9165779 - DNA, 22 bp, Homo sapiens
agctcaggtctcaggaggtgtc

SEQ ID NO: 9165780 - DNA, 22 bp, Homo sapiens
agctcaggtctcaggaggtgtc

SEQ ID NO: 9165781 - DNA, 22 bp, Homo sapiens
agctcagtggctcagtgggtat

SEQ ID NO: 9165782 - DNA, 22 bp, Homo sapiens
agctcattgaagtcatgacctg

SEQ ID NO: 9165783 - DNA, 22 bp, Homo sapiens
agctcatggtgctatctcaggg

SEQ ID NO: 9165784 - DNA, 22 bp, Homo sapiens
agctccactccctgcctgtttc

SEQ ID NO: 9165785 - DNA, 23 bp, Homo sapiens
agctccagggaacaggcagtagg

SEQ ID NO: 9165786 - DNA, 23 bp, Homo sapiens
agctccagggaacaggcagtagg

SEQ ID NO: 9165787 - DNA, 22 bp, Homo sapiens
agctccaggtcagtgcacccct

SEQ ID NO: 9165788 - DNA, 22 bp, Homo sapiens
acagacatgggccgctcttgag

SEQ ID NO: 9165789 - DNA, 22 bp, Homo sapiens
acagacatggaccaagcactgt

SEQ ID NO: 9165790 - DNA, 22 bp, Homo sapiens
agccctgcacaggtctgtggct

SEQ ID NO: 9165791 - DNA, 22 bp, Homo sapiens
agcccctgtcctctctgatgac

SEQ ID NO: 9165792 - DNA, 22 bp, Homo sapiens
agccctgcaggatgagggaggt

SEQ ID NO: 9165793 - DNA, 22 bp, Homo sapiens
agccctgcaggaggtgggagag

SEQ ID NO: 9165794 - DNA, 22 bp, Homo sapiens
agccctgcatagaagggaacac

SEQ ID NO: 9165795 - DNA, 22 bp, Homo sapiens
agccctgccattctctggagct

SEQ ID NO: 9165796 - DNA, 22 bp, Homo sapiens
agccctgcctctccaatgccca

SEQ ID NO: 9165797 - DNA, 22 bp, Homo sapiens
agccctggggctggtcttggaa

SEQ ID NO: 9165798 - DNA, 22 bp, Homo sapiens
agccctggtagcctgctgccat

SEQ ID NO: 9165799 - DNA, 22 bp, Homo sapiens
agccctggtagcctgctgccat

SEQ ID NO: 9165800 - DNA, 22 bp, Homo sapiens
agccctggtagcctgctgccat

SEQ ID NO: 9165801 - DNA, 22 bp, Homo sapiens
agccctgtgtgcttgtgttcct

SEQ ID NO: 9165802 - DNA, 22 bp, Homo sapiens
agccctgtctctcactccaggt

SEQ ID NO: 9165803 - DNA, 17 bp, Homo sapiens
agccctgtgctcttttt

SEQ ID NO: 9165804 - DNA, 22 bp, Homo sapiens
agccctgtgggccttgtggcac

SEQ ID NO: 9165805 - DNA, 22 bp, Homo sapiens
agccctgtagatttaggagagt

SEQ ID NO: 9165806 - DNA, 20 bp, Homo sapiens
agccctgtaaatcccctgga

SEQ ID NO: 9165807 - DNA, 22 bp, Homo sapiens
agccctgggttagggtgggagc

SEQ ID NO: 9165808 - DNA, 22 bp, Homo sapiens
agccctgggttagggtgggagc

SEQ ID NO: 9165809 - DNA, 22 bp, Homo sapiens
agccctgggttagggtgggagc

SEQ ID NO: 9165810 - DNA, 22 bp, Homo sapiens
agccctgggttagggtgggagc

SEQ ID NO: 9165811 - DNA, 22 bp, Homo sapiens
agccctggggtgcagaaccatg

SEQ ID NO: 9165812 - DNA, 22 bp, Homo sapiens
agccctggggtgcagaaccatg

SEQ ID NO: 9165813 - DNA, 22 bp, Homo sapiens
agccctgggtcccagtcctggc

SEQ ID NO: 9165814 - DNA, 22 bp, Homo sapiens
agccctgggtcccagtcctggc

SEQ ID NO: 9165815 - DNA, 22 bp, Homo sapiens
agcctggccctgctgaactctg

SEQ ID NO: 9165816 - DNA, 22 bp, Homo sapiens
agcctgctgggaagggaggctt

SEQ ID NO: 9165817 - DNA, 22 bp, Homo sapiens
agcctgctgggaagggaggctt

SEQ ID NO: 9165818 - DNA, 22 bp, Homo sapiens
agcctggccactcagggcctga

SEQ ID NO: 9165819 - DNA, 22 bp, Homo sapiens
agcctggccaggcctgcccagg

SEQ ID NO: 9165820 - DNA, 22 bp, Homo sapiens
agcctggccaggcctgcccagg

SEQ ID NO: 9165821 - DNA, 22 bp, Homo sapiens
agatttgtcagctcagtcttta

SEQ ID NO: 9165822 - DNA, 18 bp, Homo sapiens
acacacacacctgtgtat

SEQ ID NO: 9165823 - DNA, 18 bp, Homo sapiens
agattttgagaaatacaa

SEQ ID NO: 9165824 - DNA, 22 bp, Homo sapiens
acacacagaaggaagccccact

SEQ ID NO: 9165825 - DNA, 22 bp, Homo sapiens
acacacatgcctttcctaagta

SEQ ID NO: 9165826 - DNA, 22 bp, Homo sapiens
agatttgtatgtctaaatgtaa

SEQ ID NO: 9165827 - DNA, 22 bp, Homo sapiens
agatttggtgtctggttgatat

SEQ ID NO: 9165828 - DNA, 22 bp, Homo sapiens
agatttggtgtctggttgatat

SEQ ID NO: 9165829 - DNA, 22 bp, Homo sapiens
agatttgggggctagggctggt

SEQ ID NO: 9165830 - DNA, 22 bp, Homo sapiens
agatttgatatcatgcaacaaa

SEQ ID NO: 9165831 - DNA, 22 bp, Homo sapiens
agatttgataaaagtagcagtt

SEQ ID NO: 9165832 - DNA, 22 bp, Homo sapiens
agatttgatatcatgcaacaaa

SEQ ID NO: 9165833 - DNA, 22 bp, Homo sapiens
agatttgagttttctatccttg

SEQ ID NO: 9165834 - DNA, 22 bp, Homo sapiens
agatttgaaacttgcttcataa

SEQ ID NO: 9165835 - DNA, 22 bp, Homo sapiens
agcagaaatagaagtcaatgat

SEQ ID NO: 9165836 - DNA, 22 bp, Homo sapiens
agcagaaaactttcatgctctg

SEQ ID NO: 9165837 - DNA, 22 bp, Homo sapiens
agcactttagaatttagagttg

SEQ ID NO: 9165838 - DNA, 22 bp, Homo sapiens
agcactttgtgcatttctgaag

SEQ ID NO: 9165839 - DNA, 22 bp, Homo sapiens
agcactttgagcagatgaagga

SEQ ID NO: 9165840 - DNA, 21 bp, Homo sapiens
acacactctgagtcttctatt

SEQ ID NO: 9165841 - DNA, 22 bp, Homo sapiens
acacactcaattgcataagcac

SEQ ID NO: 9165842 - DNA, 22 bp, Homo sapiens
acacacatggtattgttcagaa

SEQ ID NO: 9165843 - DNA, 22 bp, Homo sapiens
acacaccatgatttatttaccc

SEQ ID NO: 9165844 - DNA, 21 bp, Homo sapiens
acacactgagttttccactgt

SEQ ID NO: 9165845 - DNA, 22 bp, Homo sapiens
acacactgctcgctcagattaa

SEQ ID NO: 9165846 - DNA, 22 bp, Homo sapiens
agcacttctcatgggatcaggt

SEQ ID NO: 9165847 - DNA, 19 bp, Homo sapiens
agcagcagctaccacttgt

SEQ ID NO: 9165848 - DNA, 22 bp, Homo sapiens
agcagcagccgtagccttatta

SEQ ID NO: 9165849 - DNA, 22 bp, Homo sapiens
agcagcagcattgagcgcttgt

SEQ ID NO: 9165850 - DNA, 22 bp, Homo sapiens
agcagcagcattgagcgcttgt

SEQ ID NO: 9165851 - DNA, 22 bp, Homo sapiens
agcagcagcattgagcgcttgt

SEQ ID NO: 9165852 - DNA, 21 bp, Homo sapiens
agcagcagcagtggggcttct

SEQ ID NO: 9165853 - DNA, 21 bp, Homo sapiens
agcagcagcagtggggcttct

SEQ ID NO: 9165854 - DNA, 19 bp, Homo sapiens
agcagcagcaccagggatt

SEQ ID NO: 9165855 - DNA, 19 bp, Homo sapiens
agcagcagcaccagggatt

SEQ ID NO: 9165856 - DNA, 23 bp, Homo sapiens
agcagcagcaattaagtggatat

SEQ ID NO: 9165857 - DNA, 23 bp, Homo sapiens
agcagcagcaattaagtggatat

SEQ ID NO: 9165858 - DNA, 23 bp, Homo sapiens
agcagcagcaattaagtggatat

SEQ ID NO: 9165859 - DNA, 21 bp, Homo sapiens
agcagaacagtcgagcactgc

SEQ ID NO: 9165860 - DNA, 22 bp, Homo sapiens
agcagcaaagtattgggcaaga

SEQ ID NO: 9165861 - DNA, 22 bp, Homo sapiens
agcagcagattatggtctacat

SEQ ID NO: 9165862 - DNA, 22 bp, Homo sapiens
agcagcagattatggtctacat

SEQ ID NO: 9165863 - DNA, 22 bp, Homo sapiens
agcagcagattcagcaggaatg

SEQ ID NO: 9165864 - DNA, 22 bp, Homo sapiens
agcagcagattcagcaggaatg

SEQ ID NO: 9165865 - DNA, 22 bp, Homo sapiens
acacactgtaaggactatcact

SEQ ID NO: 9165866 - DNA, 22 bp, Homo sapiens
acacactgttgctcatccaggc

SEQ ID NO: 9165867 - DNA, 22 bp, Homo sapiens
acacacttcacccttgagctaa

SEQ ID NO: 9165868 - DNA, 22 bp, Homo sapiens
acacactgttgctcatccaggc

SEQ ID NO: 9165869 - DNA, 20 bp, Homo sapiens
acacactttgatcttgagcc

SEQ ID NO: 9165870 - DNA, 22 bp, Homo sapiens
acacacttgcagagaggaggga

SEQ ID NO: 9165871 - DNA, 22 bp, Homo sapiens
acacactttaaattaaacctct

SEQ ID NO: 9165872 - DNA, 22 bp, Homo sapiens
acacactgggcatggtttatgc

SEQ ID NO: 9165873 - DNA, 22 bp, Homo sapiens
acacactggcccccagtactga

SEQ ID NO: 9165874 - DNA, 22 bp, Homo sapiens
acacactggcccccagtactga

SEQ ID NO: 9165875 - DNA, 22 bp, Homo sapiens
acacactggcaggagctataaa

SEQ ID NO: 9165876 - DNA, 22 bp, Homo sapiens
agcagcagctcattcttcctgt

SEQ ID NO: 9165877 - DNA, 22 bp, Homo sapiens
agcagcagctcagttctcagct

SEQ ID NO: 9165878 - DNA, 22 bp, Homo sapiens
agcagcagttgctgacgttcta

SEQ ID NO: 9165879 - DNA, 22 bp, Homo sapiens
agcagcatacacatcatgttga

SEQ ID NO: 9165880 - DNA, 22 bp, Homo sapiens
agcagccaggaatctgcagagc

SEQ ID NO: 9165881 - DNA, 22 bp, Homo sapiens
agcagccaggaatctgcagagc

SEQ ID NO: 9165882 - DNA, 22 bp, Homo sapiens
agcagccaggaatctgcagagc

SEQ ID NO: 9165883 - DNA, 16 bp, Homo sapiens
agcagccagcactgga

SEQ ID NO: 9165884 - DNA, 22 bp, Homo sapiens
agcagccaggaatctgcagagc

SEQ ID NO: 9165885 - DNA, 22 bp, Homo sapiens
agcagccagagaatgatgcagt

SEQ ID NO: 9165886 - DNA, 22 bp, Homo sapiens
agcagccagagaatgatgcagt

SEQ ID NO: 9165887 - DNA, 22 bp, Homo sapiens
agcagccagagtctgaacatta

SEQ ID NO: 9165888 - DNA, 23 bp, Homo sapiens
agcagccagagatcctcggccct

SEQ ID NO: 9165889 - DNA, 23 bp, Homo sapiens
agcagccagagatcctcggccct

SEQ ID NO: 9165890 - DNA, 23 bp, Homo sapiens
agcaggcatctgtggcacaaggc

SEQ ID NO: 9165891 - DNA, 23 bp, Homo sapiens
agcaggcatctgtggcacaaggc

SEQ ID NO: 9165892 - DNA, 21 bp, Homo sapiens
agcaggcagtgggctggattt

SEQ ID NO: 9165893 - DNA, 22 bp, Homo sapiens
agcagggctgtgtaggtaatga

SEQ ID NO: 9165894 - DNA, 22 bp, Homo sapiens
agcagggctgtgtaggtaatga

SEQ ID NO: 9165895 - DNA, 22 bp, Homo sapiens
agcagggctttgcagacttggg

SEQ ID NO: 9165896 - DNA, 22 bp, Homo sapiens
agcagggctttggctggctttc

SEQ ID NO: 9165897 - DNA, 22 bp, Homo sapiens
agcatccagaaaactctcagaa

SEQ ID NO: 9165898 - DNA, 22 bp, Homo sapiens
agcatcagtactaatctggcca

SEQ ID NO: 9165899 - DNA, 22 bp, Homo sapiens
agcatccagaaaactctcagaa

SEQ ID NO: 9165900 - DNA, 22 bp, Homo sapiens
agcagttactagttaaatgcat

SEQ ID NO: 9165901 - DNA, 22 bp, Homo sapiens
agcaggtgagcacagccaggct

SEQ ID NO: 9165902 - DNA, 22 bp, Homo sapiens
agcagctgagatggtaagattc

SEQ ID NO: 9165903 - DNA, 22 bp, Homo sapiens
agcagctgagccccagctgtga

SEQ ID NO: 9165904 - DNA, 22 bp, Homo sapiens
agcaggagcccttatcaccagg

SEQ ID NO: 9165905 - DNA, 22 bp, Homo sapiens
agcaggaacgagttcatgggga

SEQ ID NO: 9165906 - DNA, 22 bp, Homo sapiens
agcaggaggagagcctggcggt

SEQ ID NO: 9165907 - DNA, 21 bp, Homo sapiens
agcaggaggcagtcacagctc

SEQ ID NO: 9165908 - DNA, 22 bp, Homo sapiens
agcaggaggagagcctggcggt

SEQ ID NO: 9165909 - DNA, 22 bp, Homo sapiens
agcaggaggagagcctggcggt

SEQ ID NO: 9165910 - DNA, 21 bp, Homo sapiens
agcaggaggcagtcacagctc

SEQ ID NO: 9165911 - DNA, 22 bp, Homo sapiens
agcaggagggttttgtagagtc

SEQ ID NO: 9165912 - DNA, 22 bp, Homo sapiens
agcaggagggttttgtagagtc

SEQ ID NO: 9165913 - DNA, 22 bp, Homo sapiens
agcaggagggttttgtagagtc

SEQ ID NO: 9165914 - DNA, 22 bp, Homo sapiens
agcaggagggttttgtagagtc

SEQ ID NO: 9165915 - DNA, 22 bp, Homo sapiens
agcaggagggttttgtagagtc

SEQ ID NO: 9165916 - DNA, 22 bp, Homo sapiens
agcaggagtgtcccctggctgt

SEQ ID NO: 9165917 - DNA, 22 bp, Homo sapiens
agcagccatagatagcatgcaa

SEQ ID NO: 9165918 - DNA, 22 bp, Homo sapiens
agcagccatagatagcatgcaa

SEQ ID NO: 9165919 - DNA, 23 bp, Homo sapiens
agcagccatagggaagcaataca

SEQ ID NO: 9165920 - DNA, 22 bp, Homo sapiens
agcagccatccttagagaaaga

SEQ ID NO: 9165921 - DNA, 22 bp, Homo sapiens
agcagccatccttagagaaaga

SEQ ID NO: 9165922 - DNA, 22 bp, Homo sapiens
agcagccatagatagcatgcaa

SEQ ID NO: 9165923 - DNA, 19 bp, Homo sapiens
agcagccatagacaatatg

SEQ ID NO: 9165924 - DNA, 22 bp, Homo sapiens
agcagccagtgggagtgataca

SEQ ID NO: 9165925 - DNA, 22 bp, Homo sapiens
agcagccagtgggagtgataca

SEQ ID NO: 9165926 - DNA, 22 bp, Homo sapiens
agcagccagttctctgtggtag

SEQ ID NO: 9165927 - DNA, 22 bp, Homo sapiens
agcagctcctctaggaacggat

SEQ ID NO: 9165928 - DNA, 21 bp, Homo sapiens
agcagccatttcacagagact

SEQ ID NO: 9165929 - DNA, 21 bp, Homo sapiens
agcagccatttcacagagact

SEQ ID NO: 9165930 - DNA, 21 bp, Homo sapiens
agcagccatttcacagagact

SEQ ID NO: 9165931 - DNA, 19 bp, Homo sapiens
agcagccatcgaccatgga

SEQ ID NO: 9165932 - DNA, 19 bp, Homo sapiens
agcagccatcgaccatgga

SEQ ID NO: 9165933 - DNA, 22 bp, Homo sapiens
agcagccatttaaaatgaattg

SEQ ID NO: 9165934 - DNA, 21 bp, Homo sapiens
agcagccatggatggtatgta

SEQ ID NO: 9165935 - DNA, 22 bp, Homo sapiens
agcagctgaccagtgagtcctg

SEQ ID NO: 9165936 - DNA, 17 bp, Homo sapiens
agcagctgaagcagcca

SEQ ID NO: 9165937 - DNA, 17 bp, Homo sapiens
agcagctgaagcagcca

SEQ ID NO: 9165938 - DNA, 17 bp, Homo sapiens
agcagctgaagcagcca

SEQ ID NO: 9165939 - DNA, 17 bp, Homo sapiens
agcagctgaagcagcca

SEQ ID NO: 9165940 - DNA, 17 bp, Homo sapiens
agcagctgaagcagcca

SEQ ID NO: 9165941 - DNA, 22 bp, Homo sapiens
agcagctcggccagtcaccagg

SEQ ID NO: 9165942 - DNA, 22 bp, Homo sapiens
agcagctctgagaggccagcac

SEQ ID NO: 9165943 - DNA, 22 bp, Homo sapiens
agcagctctgtttacctggagg

SEQ ID NO: 9165944 - DNA, 22 bp, Homo sapiens
agcagctcttaacaaagcatgg

SEQ ID NO: 9165945 - DNA, 22 bp, Homo sapiens
agagggctggacgcaggttgga

SEQ ID NO: 9165946 - DNA, 22 bp, Homo sapiens
agagggctgctgcacagtgctc

SEQ ID NO: 9165947 - DNA, 22 bp, Homo sapiens
agagggctgcctcagtcagcta

SEQ ID NO: 9165948 - DNA, 22 bp, Homo sapiens
agagggcataaaatagagcacg

SEQ ID NO: 9165949 - DNA, 22 bp, Homo sapiens
agagggcataaaatagagcacg

SEQ ID NO: 9165950 - DNA, 22 bp, Homo sapiens
agagggcataaaatagagcacg

SEQ ID NO: 9165951 - DNA, 22 bp, Homo sapiens
agagggccataggtgcatagtt

SEQ ID NO: 9165952 - DNA, 22 bp, Homo sapiens
agagggccccagctgatctgag

SEQ ID NO: 9165953 - DNA, 22 bp, Homo sapiens
agagggccccagctgatctgag

SEQ ID NO: 9165954 - DNA, 22 bp, Homo sapiens
aatttatctttagtaagcttct

SEQ ID NO: 9165955 - DNA, 22 bp, Homo sapiens
aatttatttcctgccagtacac

SEQ ID NO: 9165956 - DNA, 22 bp, Homo sapiens
aatttattatatcctaggggaa

SEQ ID NO: 9165957 - DNA, 22 bp, Homo sapiens
aatttattcccgtctctgggct

SEQ ID NO: 9165958 - DNA, 22 bp, Homo sapiens
agaggcttttctggtctttggc

SEQ ID NO: 9165959 - DNA, 22 bp, Homo sapiens
agaggcttttctggtctttggc

SEQ ID NO: 9165960 - DNA, 20 bp, Homo sapiens
agaggctttcttgtagtcag

SEQ ID NO: 9165961 - DNA, 22 bp, Homo sapiens
agaggcttggcctcagttctgt

SEQ ID NO: 9165962 - DNA, 22 bp, Homo sapiens
agaggctttctctgcttaggca

SEQ ID NO: 9165963 - DNA, 22 bp, Homo sapiens
agaggctttctctgcttaggca

SEQ ID NO: 9165964 - DNA, 20 bp, Homo sapiens
agaggctttcttgtagtcag

SEQ ID NO: 9165965 - DNA, 22 bp, Homo sapiens
agaggcttggaggtgcaaggtt

SEQ ID NO: 9165966 - DNA, 22 bp, Homo sapiens
aatttcaagtggcatctttgat

SEQ ID NO: 9165967 - DNA, 22 bp, Homo sapiens
aatttatttcctgccagtacac

SEQ ID NO: 9165968 - DNA, 22 bp, Homo sapiens
aattcactgaacttctctgaga

SEQ ID NO: 9165969 - DNA, 22 bp, Homo sapiens
aattcactgttccttctgcttt

SEQ ID NO: 9165970 - DNA, 22 bp, Homo sapiens
aattcacatatacattattcct

SEQ ID NO: 9165971 - DNA, 22 bp, Homo sapiens
aattcacaggaggtatttgtcc

SEQ ID NO: 9165972 - DNA, 22 bp, Homo sapiens
agagcagctgcattcagcacct

SEQ ID NO: 9165973 - DNA, 22 bp, Homo sapiens
agagcagctcgctacctctcta

SEQ ID NO: 9165974 - DNA, 22 bp, Homo sapiens
agagcagctgacagcctgccat

SEQ ID NO: 9165975 - DNA, 18 bp, Homo sapiens
agagcagcggcatcacac

SEQ ID NO: 9165976 - DNA, 22 bp, Homo sapiens
agagcagcgtttgtggaacact

SEQ ID NO: 9165977 - DNA, 22 bp, Homo sapiens
agagcagcgtttgtggaacact

SEQ ID NO: 9165978 - DNA, 22 bp, Homo sapiens
agagcagcgtttgtggaacact

SEQ ID NO: 9165979 - DNA, 19 bp, Homo sapiens
agaggcagtctccaacagg

SEQ ID NO: 9165980 - DNA, 21 bp, Homo sapiens
agaggcaggcattaagtacac

SEQ ID NO: 9165981 - DNA, 21 bp, Homo sapiens
agaggcaggcattaagtacac

SEQ ID NO: 9165982 - DNA, 22 bp, Homo sapiens
agagcagcttttcggaaccact

SEQ ID NO: 9165983 - DNA, 22 bp, Homo sapiens
agagcagcttttcggaaccact

SEQ ID NO: 9165984 - DNA, 22 bp, Homo sapiens
agagcagcttttcggaaccact

SEQ ID NO: 9165985 - DNA, 22 bp, Homo sapiens
agagcagctgtgacatggacag

SEQ ID NO: 9165986 - DNA, 22 bp, Homo sapiens
agagcagctgtgacatggacag

SEQ ID NO: 9165987 - DNA, 22 bp, Homo sapiens
agagcagctgtgacatggacag

SEQ ID NO: 9165988 - DNA, 22 bp, Homo sapiens
agagcagctggctgcatctaga

SEQ ID NO: 9165989 - DNA, 22 bp, Homo sapiens
agagcagctggctgcatctaga

SEQ ID NO: 9165990 - DNA, 22 bp, Homo sapiens
agagcagctggggcagagacca

SEQ ID NO: 9165991 - DNA, 22 bp, Homo sapiens
agagcagctggggcagagacca

SEQ ID NO: 9165992 - DNA, 22 bp, Homo sapiens
agagcagctggggcagagacca

SEQ ID NO: 9165993 - DNA, 22 bp, Homo sapiens
agagcaggtggcaactctggga

SEQ ID NO: 9165994 - DNA, 22 bp, Homo sapiens
agaggcaacatggggaacagat

SEQ ID NO: 9165995 - DNA, 22 bp, Homo sapiens
agaggcaacatggggaacagat

SEQ ID NO: 9165996 - DNA, 22 bp, Homo sapiens
agagcaggggcaatgtgttgca

SEQ ID NO: 9165997 - DNA, 22 bp, Homo sapiens
agagtgaaaagctagagcagta

SEQ ID NO: 9165998 - DNA, 22 bp, Homo sapiens
agagtctgttacttgtccccta

SEQ ID NO: 9165999 - DNA, 22 bp, Homo sapiens
agagtctgtgctttcatcagga

SEQ ID NO: 9166000 - DNA, 22 bp, Homo sapiens
agagtctgtgctggggccagct

SEQ ID NO: 9166001 - DNA, 22 bp, Homo sapiens
agagtctgtgctggggccagct

SEQ ID NO: 9166002 - DNA, 22 bp, Homo sapiens
agagtctgttacttgtccccta

SEQ ID NO: 9166003 - DNA, 22 bp, Homo sapiens
agatatacacccatatcacata

SEQ ID NO: 9166004 - DNA, 22 bp, Homo sapiens
agatataataatttacaagtgt

SEQ ID NO: 9166005 - DNA, 22 bp, Homo sapiens
agataatgttctgatccatttc

SEQ ID NO: 9166006 - DNA, 22 bp, Homo sapiens
agagtgaaggttgacacttcac

SEQ ID NO: 9166007 - DNA, 23 bp, Homo sapiens
agagtacagtggcgccatctcag

SEQ ID NO: 9166008 - DNA, 22 bp, Homo sapiens
agagtacattcagagctaccta

SEQ ID NO: 9166009 - DNA, 21 bp, Homo sapiens
agagtctgcatttctgacaag

SEQ ID NO: 9166010 - DNA, 22 bp, Homo sapiens
agagtctgcatttctacaagct

SEQ ID NO: 9166011 - DNA, 22 bp, Homo sapiens
agagtctgatttggtaagacca

SEQ ID NO: 9166012 - DNA, 22 bp, Homo sapiens
agagtctgatgtcaacagttct

SEQ ID NO: 9166013 - DNA, 22 bp, Homo sapiens
agagtctgcattgtaacaagat

SEQ ID NO: 9166014 - DNA, 22 bp, Homo sapiens
agagtctgcctttttctcctgc

SEQ ID NO: 9166015 - DNA, 21 bp, Homo sapiens
agagtctgcatttctgacaag

SEQ ID NO: 9166016 - DNA, 21 bp, Homo sapiens
agagtctgcatttctgacaag

SEQ ID NO: 9166017 - DNA, 22 bp, Homo sapiens
agagtctggcgctgagatgaca

SEQ ID NO: 9166018 - DNA, 22 bp, Homo sapiens
agagtctgcctttttctcctgc

SEQ ID NO: 9166019 - DNA, 19 bp, Homo sapiens
agagtctgtgctcttccta

SEQ ID NO: 9166020 - DNA, 22 bp, Homo sapiens
agagtctgtgagtccctgagca

SEQ ID NO: 9166021 - DNA, 19 bp, Homo sapiens
agagtctgtgctcttccta

SEQ ID NO: 9166022 - DNA, 22 bp, Homo sapiens
agagtctgggcactgggaatgc

SEQ ID NO: 9166023 - DNA, 22 bp, Homo sapiens
agagtctggcgctgagatgaca

SEQ ID NO: 9166024 - DNA, 22 bp, Homo sapiens
agagtctggtgcatgataagca

SEQ ID NO: 9166025 - DNA, 22 bp, Homo sapiens
agaggtggagctcttggcatca

SEQ ID NO: 9166026 - DNA, 22 bp, Homo sapiens
agagtaaagtacttggaatacc

SEQ ID NO: 9166027 - DNA, 22 bp, Homo sapiens
agaggttgggtctgaggtgaga

SEQ ID NO: 9166028 - DNA, 22 bp, Homo sapiens
agagtaaataggagatgacagc

SEQ ID NO: 9166029 - DNA, 20 bp, Homo sapiens
agagtaactggcacataggg

SEQ ID NO: 9166030 - DNA, 22 bp, Homo sapiens
acaaaaaccgtggattcagcat

SEQ ID NO: 9166031 - DNA, 22 bp, Homo sapiens
acaaaaaccgtggattcagcat

SEQ ID NO: 9166032 - DNA, 22 bp, Homo sapiens
agaggggttaagtgctagtccg

SEQ ID NO: 9166033 - DNA, 22 bp, Homo sapiens
agatgttttgtgtatttcatca

SEQ ID NO: 9166034 - DNA, 21 bp, Homo sapiens
agattaaaatctgtgagaagg

SEQ ID NO: 9166035 - DNA, 22 bp, Homo sapiens
agatgggtgccttctttcttta

SEQ ID NO: 9166036 - DNA, 20 bp, Homo sapiens
agatgggttaaagctatggg

SEQ ID NO: 9166037 - DNA, 22 bp, Homo sapiens
agatctggaaaatcacaggtgc

SEQ ID NO: 9166038 - DNA, 22 bp, Homo sapiens
agatctggttggagtcctgaca

SEQ ID NO: 9166039 - DNA, 22 bp, Homo sapiens
agatctggaactgaggtttatt

SEQ ID NO: 9166040 - DNA, 22 bp, Homo sapiens
agatctggccctcagcttgatt

SEQ ID NO: 9166041 - DNA, 22 bp, Homo sapiens
agattaggtatggtttaagtag

SEQ ID NO: 9166042 - DNA, 21 bp, Homo sapiens
agattacaggtgtgatccacc

SEQ ID NO: 9166043 - DNA, 22 bp, Homo sapiens
agattagcctaaaaatgtatag

SEQ ID NO: 9166044 - DNA, 22 bp, Homo sapiens
agattacagaagaataagtaga

SEQ ID NO: 9166045 - DNA, 19 bp, Homo sapiens
agattattgcacattcatg

SEQ ID NO: 9166046 - DNA, 19 bp, Homo sapiens
agattattgcacattcatg

SEQ ID NO: 9166047 - DNA, 22 bp, Homo sapiens
agattatgctggctgctacaag

SEQ ID NO: 9166048 - DNA, 20 bp, Homo sapiens
agattcactgaaggatttta

SEQ ID NO: 9166049 - DNA, 22 bp, Homo sapiens
agattatttccagactaatgaa

SEQ ID NO: 9166050 - DNA, 22 bp, Homo sapiens
agattatttccagactaatgaa

SEQ ID NO: 9166051 - DNA, 22 bp, Homo sapiens
agattatttccagactaatgaa

SEQ ID NO: 9166052 - DNA, 22 bp, Homo sapiens
agatatatttcctgcccaaggc

SEQ ID NO: 9166053 - DNA, 22 bp, Homo sapiens
agatatatttaaggtaataagt

SEQ ID NO: 9166054 - DNA, 22 bp, Homo sapiens
agatatggcctcatacagacat

SEQ ID NO: 9166055 - DNA, 22 bp, Homo sapiens
agatatgatgcatgtaaacatt

SEQ ID NO: 9166056 - DNA, 22 bp, Homo sapiens
agatatgactagaagctcattt

SEQ ID NO: 9166057 - DNA, 22 bp, Homo sapiens
agatatcttacactttgaagtt

SEQ ID NO: 9166058 - DNA, 22 bp, Homo sapiens
agatatgttactgcatcatggg

SEQ ID NO: 9166059 - DNA, 21 bp, Homo sapiens
agatccagtgccataaggccc

SEQ ID NO: 9166060 - DNA, 22 bp, Homo sapiens
agatccagttaatagcttcatt

SEQ ID NO: 9166061 - DNA, 22 bp, Homo sapiens
agatccgtggattataatttag

SEQ ID NO: 9166062 - DNA, 22 bp, Homo sapiens
agatcctgccaatggaagcagg

SEQ ID NO: 9166063 - DNA, 22 bp, Homo sapiens
agatcggctttgcagacctcat

SEQ ID NO: 9166064 - DNA, 22 bp, Homo sapiens
agatcggctttgcagacctcat

SEQ ID NO: 9166065 - DNA, 22 bp, Homo sapiens
aatggactcataaacagagtga

SEQ ID NO: 9166066 - DNA, 22 bp, Homo sapiens
aatggagaccctaaggaagagg

SEQ ID NO: 9166067 - DNA, 21 bp, Homo sapiens
aatggaagtttaaaggtatcc

SEQ ID NO: 9166068 - DNA, 22 bp, Homo sapiens
aatggaatacctaggtggccca

SEQ ID NO: 9166069 - DNA, 22 bp, Homo sapiens
aatgctttttgcgaaatgtgca

SEQ ID NO: 9166070 - DNA, 22 bp, Homo sapiens
aatgctttgactatatctataa

SEQ ID NO: 9166071 - DNA, 22 bp, Homo sapiens
aatgctttgagggaagatgaaa

SEQ ID NO: 9166072 - DNA, 22 bp, Homo sapiens
aatgctttgccaacagctattg

SEQ ID NO: 9166073 - DNA, 22 bp, Homo sapiens
aatgaaaattggaccctagaac

SEQ ID NO: 9166074 - DNA, 22 bp, Homo sapiens
aatgaaacaattagctgtaata

SEQ ID NO: 9166075 - DNA, 22 bp, Homo sapiens
aatgctgtaaagatgctatctg

SEQ ID NO: 9166076 - DNA, 22 bp, Homo sapiens
aatgctgtaaagatgctatctg

SEQ ID NO: 9166077 - DNA, 22 bp, Homo sapiens
agaagttttgttgaatgtgtga

SEQ ID NO: 9166078 - DNA, 22 bp, Homo sapiens
agaagttttgggaaatactgat

SEQ ID NO: 9166079 - DNA, 22 bp, Homo sapiens
agaagttttgggaaatactgat

SEQ ID NO: 9166080 - DNA, 22 bp, Homo sapiens
agaagttttcattacctataca

SEQ ID NO: 9166081 - DNA, 22 bp, Homo sapiens
agaagtttgttatgtaaacaaa

SEQ ID NO: 9166082 - DNA, 22 bp, Homo sapiens
agaataaactgctttagggcag

SEQ ID NO: 9166083 - DNA, 22 bp, Homo sapiens
agaataaatcaaatgtcctgag

SEQ ID NO: 9166084 - DNA, 22 bp, Homo sapiens
agaataaatcaaatgtcctgag

SEQ ID NO: 9166085 - DNA, 22 bp, Homo sapiens
agaataaatcaaatgtcctgag

SEQ ID NO: 9166086 - DNA, 22 bp, Homo sapiens
agaataatcactgaagttcaaa

SEQ ID NO: 9166087 - DNA, 22 bp, Homo sapiens
agaataatcactgaagttcaaa

SEQ ID NO: 9166088 - DNA, 22 bp, Homo sapiens
agaataaccagtgtttcacagt

SEQ ID NO: 9166089 - DNA, 22 bp, Homo sapiens
agaataatactgaaatgctgaa

SEQ ID NO: 9166090 - DNA, 22 bp, Homo sapiens
agaataaatgttggacttagga

SEQ ID NO: 9166091 - DNA, 22 bp, Homo sapiens
agaataaatgttggacttagga

SEQ ID NO: 9166092 - DNA, 19 bp, Homo sapiens
agaatcaggtcaggtgaca

SEQ ID NO: 9166093 - DNA, 22 bp, Homo sapiens
agaatcagtgagcagttgtgat

SEQ ID NO: 9166094 - DNA, 22 bp, Homo sapiens
agaatcaggacctgtggctgtc

SEQ ID NO: 9166095 - DNA, 22 bp, Homo sapiens
agaatttgagtgctttctgtgt

SEQ ID NO: 9166096 - DNA, 23 bp, Homo sapiens
agacaaaagcctcagtcttaggc

SEQ ID NO: 9166097 - DNA, 22 bp, Homo sapiens
aatgtacactgaaagcctatca

SEQ ID NO: 9166098 - DNA, 22 bp, Homo sapiens
aatgtacaccgtgggtttttta

SEQ ID NO: 9166099 - DNA, 20 bp, Homo sapiens
aatgtactgtttgtgggggc

SEQ ID NO: 9166100 - DNA, 22 bp, Homo sapiens
aatgtataaagtgttaataact

SEQ ID NO: 9166101 - DNA, 22 bp, Homo sapiens
aatgtacatctcagtgtagtac

SEQ ID NO: 9166102 - DNA, 22 bp, Homo sapiens
aatgtacagctgtctttcctcc

SEQ ID NO: 9166103 - DNA, 22 bp, Homo sapiens
agaatttaggatgcatgtgaat

SEQ ID NO: 9166104 - DNA, 22 bp, Homo sapiens
agaatttaggatgcatgtgaat

SEQ ID NO: 9166105 - DNA, 22 bp, Homo sapiens
agaatttagctccttggtcata

SEQ ID NO: 9166106 - DNA, 22 bp, Homo sapiens
agaatttaggcttgtctgctgt

SEQ ID NO: 9166107 - DNA, 22 bp, Homo sapiens
agaatctgaaggcacctctggt

SEQ ID NO: 9166108 - DNA, 22 bp, Homo sapiens
agaatccgcttgactttgaagt

SEQ ID NO: 9166109 - DNA, 21 bp, Homo sapiens
agaatccattcagaccttctc

SEQ ID NO: 9166110 - DNA, 22 bp, Homo sapiens
agactgcagcaaccccttcagc

SEQ ID NO: 9166111 - DNA, 22 bp, Homo sapiens
agactgatattaactttagtgt

SEQ ID NO: 9166112 - DNA, 17 bp, Homo sapiens
agactgaggacacagga

SEQ ID NO: 9166113 - DNA, 22 bp, Homo sapiens
agactgggattctccctgatca

SEQ ID NO: 9166114 - DNA, 22 bp, Homo sapiens
agactgggccatttccccagct

SEQ ID NO: 9166115 - DNA, 19 bp, Homo sapiens
agactctgtgtgagacttt

SEQ ID NO: 9166116 - DNA, 22 bp, Homo sapiens
agactgaataacaagcaaataa

SEQ ID NO: 9166117 - DNA, 22 bp, Homo sapiens
agactgaagcaattcaaccagt

SEQ ID NO: 9166118 - DNA, 18 bp, Homo sapiens
agagaaagaccaaagcat

SEQ ID NO: 9166119 - DNA, 23 bp, Homo sapiens
agagaaagggataacacgttgaa

SEQ ID NO: 9166120 - DNA, 22 bp, Homo sapiens
agagaaacccttcagtgttttg

SEQ ID NO: 9166121 - DNA, 22 bp, Homo sapiens
agagaaactgatgtcctttgaa

SEQ ID NO: 9166122 - DNA, 22 bp, Homo sapiens
agagaaacaggtcagctgggag

SEQ ID NO: 9166123 - DNA, 22 bp, Homo sapiens
agagaaacaggtcagctgggag

SEQ ID NO: 9166124 - DNA, 23 bp, Homo sapiens
agactggggcataagaagatggc

SEQ ID NO: 9166125 - DNA, 22 bp, Homo sapiens
agagaaacaggtcagctgggag

SEQ ID NO: 9166126 - DNA, 19 bp, Homo sapiens
agactctgccactcttctc

SEQ ID NO: 9166127 - DNA, 22 bp, Homo sapiens
agacactggtgaagaaatcagg

SEQ ID NO: 9166128 - DNA, 19 bp, Homo sapiens
agacactggatggaaaatg

SEQ ID NO: 9166129 - DNA, 22 bp, Homo sapiens
agacactggtgaagaaatcagg

SEQ ID NO: 9166130 - DNA, 22 bp, Homo sapiens
agacactggtgaagaaatcagg

SEQ ID NO: 9166131 - DNA, 22 bp, Homo sapiens
agactctggagtcagctaggat

SEQ ID NO: 9166132 - DNA, 22 bp, Homo sapiens
agactctggaggggctggtcct

SEQ ID NO: 9166133 - DNA, 23 bp, Homo sapiens
agagagagtttgtgtcaggtacc

SEQ ID NO: 9166134 - DNA, 22 bp, Homo sapiens
agagagcagtctggaagaaaca

SEQ ID NO: 9166135 - DNA, 22 bp, Homo sapiens
agagatatgagtagttgtgaca

SEQ ID NO: 9166136 - DNA, 22 bp, Homo sapiens
agagatcaaagcttgccaagta

SEQ ID NO: 9166137 - DNA, 22 bp, Homo sapiens
aattatgtggaagaggattaaa

SEQ ID NO: 9166138 - DNA, 21 bp, Homo sapiens
agagaaagtcatggctgtggc

SEQ ID NO: 9166139 - DNA, 21 bp, Homo sapiens
agagaaagtcatggctgtggc

SEQ ID NO: 9166140 - DNA, 22 bp, Homo sapiens
agagaaagtcctgatctctcta

SEQ ID NO: 9166141 - DNA, 22 bp, Homo sapiens
agagaaagtcctgatctctcta

SEQ ID NO: 9166142 - DNA, 22 bp, Homo sapiens
agagaaatatttaggaaaggag

SEQ ID NO: 9166143 - DNA, 22 bp, Homo sapiens
agagaaatagattggtccagaa

SEQ ID NO: 9166144 - DNA, 20 bp, Homo sapiens
agagagaggtaaattgagca

SEQ ID NO: 9166145 - DNA, 22 bp, Homo sapiens
agagagagggaaactgctaaac

SEQ ID NO: 9166146 - DNA, 22 bp, Homo sapiens
agagagaggcagcagtgctcac

SEQ ID NO: 9166147 - DNA, 22 bp, Homo sapiens
agagagaggcagcagtgctcac

SEQ ID NO: 9166148 - DNA, 22 bp, Homo sapiens
agagagagaaatgaaatgtgct

SEQ ID NO: 9166149 - DNA, 22 bp, Homo sapiens
acaggcttcattacttcagcgt

SEQ ID NO: 9166150 - DNA, 22 bp, Homo sapiens
acaggcttggcagctatcattt

SEQ ID NO: 9166151 - DNA, 22 bp, Homo sapiens
acaggcttggggctcagacaga

SEQ ID NO: 9166152 - DNA, 22 bp, Homo sapiens
acaggcttcttttgaaatcaga

SEQ ID NO: 9166153 - DNA, 22 bp, Homo sapiens
acaggctgccacttgcatccaa

SEQ ID NO: 9166154 - DNA, 22 bp, Homo sapiens
acaggctgccacttgcatccaa

SEQ ID NO: 9166155 - DNA, 22 bp, Homo sapiens
acaggctgttggggtccagggt

SEQ ID NO: 9166156 - DNA, 22 bp, Homo sapiens
acaggctgatagaccataaata

SEQ ID NO: 9166157 - DNA, 22 bp, Homo sapiens
acaggctgaggatgattgcatc

SEQ ID NO: 9166158 - DNA, 22 bp, Homo sapiens
acaggctgagcgtccatcttca

SEQ ID NO: 9166159 - DNA, 22 bp, Homo sapiens
acaggctgacttcctgccatgt

SEQ ID NO: 9166160 - DNA, 22 bp, Homo sapiens
acaggctgacttcctgccatgt

SEQ ID NO: 9166161 - DNA, 22 bp, Homo sapiens
acaggcttttacggatatcttt

SEQ ID NO: 9166162 - DNA, 21 bp, Homo sapiens
acaggctttagaaaatgactc

SEQ ID NO: 9166163 - DNA, 22 bp, Homo sapiens
acaggtctgtgtgcacagtgct

SEQ ID NO: 9166164 - DNA, 22 bp, Homo sapiens
acaggtctggtctgggtgggac

SEQ ID NO: 9166165 - DNA, 22 bp, Homo sapiens
acaggtgagggagctttgtgcc

SEQ ID NO: 9166166 - DNA, 22 bp, Homo sapiens
acaggtctactggcaagcagtg

SEQ ID NO: 9166167 - DNA, 22 bp, Homo sapiens
acaggtctgcagtaactgggaa

SEQ ID NO: 9166168 - DNA, 22 bp, Homo sapiens
acaggtctccagagtgagagga

SEQ ID NO: 9166169 - DNA, 22 bp, Homo sapiens
acaggtcctcaagtcagctggg

SEQ ID NO: 9166170 - DNA, 22 bp, Homo sapiens
acagtgcagtgtgatgagtatt

SEQ ID NO: 9166171 - DNA, 22 bp, Homo sapiens
acagtgcataaaaacaactttt

SEQ ID NO: 9166172 - DNA, 22 bp, Homo sapiens
acagtgcagtgtgatgagtatt

SEQ ID NO: 9166173 - DNA, 22 bp, Homo sapiens
acagtgcaggtctcaacaatta

SEQ ID NO: 9166174 - DNA, 22 bp, Homo sapiens
acagtgcaggtctcaacaatta

SEQ ID NO: 9166175 - DNA, 22 bp, Homo sapiens
acagtctttgcaaagtcctggt

SEQ ID NO: 9166176 - DNA, 22 bp, Homo sapiens
acagtctttgcagaagcaatat

SEQ ID NO: 9166177 - DNA, 19 bp, Homo sapiens
acagtgcatgggacctggt

SEQ ID NO: 9166178 - DNA, 19 bp, Homo sapiens
acagtgcatgggacctggt

SEQ ID NO: 9166179 - DNA, 20 bp, Homo sapiens
acagtgcatggggggacagc

SEQ ID NO: 9166180 - DNA, 22 bp, Homo sapiens
acagtgcattattgctgaatgc

SEQ ID NO: 9166181 - DNA, 22 bp, Homo sapiens
acagtgctaaacacttcttgaa

SEQ ID NO: 9166182 - DNA, 22 bp, Homo sapiens
acaggtgtctaaggcagacagc

SEQ ID NO: 9166183 - DNA, 22 bp, Homo sapiens
acaggtgtacaatgcatgacag

SEQ ID NO: 9166184 - DNA, 22 bp, Homo sapiens
acaggtgattcaggctctggga

SEQ ID NO: 9166185 - DNA, 22 bp, Homo sapiens
acagtgctgtcaaatatgtttt

SEQ ID NO: 9166186 - DNA, 22 bp, Homo sapiens
acagtgctggctacaaccctgg

SEQ ID NO: 9166187 - DNA, 20 bp, Homo sapiens
acagtgggtggggagcactg

SEQ ID NO: 9166188 - DNA, 18 bp, Homo sapiens
acagtgctgtcactgctt

SEQ ID NO: 9166189 - DNA, 22 bp, Homo sapiens
acagtttactggccttgccgtt

SEQ ID NO: 9166190 - DNA, 22 bp, Homo sapiens
acagtttagaatgccacatagt

SEQ ID NO: 9166191 - DNA, 22 bp, Homo sapiens
acataacaatcataggacatag

SEQ ID NO: 9166192 - DNA, 22 bp, Homo sapiens
acagtgtagtgtgatgtcaaaa

SEQ ID NO: 9166193 - DNA, 22 bp, Homo sapiens
acagtgtactaaatagtaagag

SEQ ID NO: 9166194 - DNA, 22 bp, Homo sapiens
acaggaaccaggcaggtcgatt

SEQ ID NO: 9166195 - DNA, 22 bp, Homo sapiens
acaggaacagcttgatggcatc

SEQ ID NO: 9166196 - DNA, 20 bp, Homo sapiens
acaggagatctgaggaaagg

SEQ ID NO: 9166197 - DNA, 22 bp, Homo sapiens
acagctttttactaatagattg

SEQ ID NO: 9166198 - DNA, 22 bp, Homo sapiens
acagcttgtagaggccctggca

SEQ ID NO: 9166199 - DNA, 22 bp, Homo sapiens
acagcttggggaggccctggga

SEQ ID NO: 9166200 - DNA, 22 bp, Homo sapiens
acagattttaaatttgtagttg

SEQ ID NO: 9166201 - DNA, 22 bp, Homo sapiens
acagatttttggtaaataattt

SEQ ID NO: 9166202 - DNA, 22 bp, Homo sapiens
acagatttgttcttttgggcta

SEQ ID NO: 9166203 - DNA, 22 bp, Homo sapiens
acagatttggcccagccaatgc

SEQ ID NO: 9166204 - DNA, 22 bp, Homo sapiens
acagatgaggaagagtcagcca

SEQ ID NO: 9166205 - DNA, 22 bp, Homo sapiens
acagatgaggaagagtcagcca

SEQ ID NO: 9166206 - DNA, 22 bp, Homo sapiens
acagatgagactccaggacctt

SEQ ID NO: 9166207 - DNA, 22 bp, Homo sapiens
acaggaggagcagctgtgtgcc

SEQ ID NO: 9166208 - DNA, 22 bp, Homo sapiens
acaggaggagctgtttcaggga

SEQ ID NO: 9166209 - DNA, 22 bp, Homo sapiens
acaggaggagcagctgtgtgcc

SEQ ID NO: 9166210 - DNA, 22 bp, Homo sapiens
acaggaggagcagctgtgtgcc

SEQ ID NO: 9166211 - DNA, 22 bp, Homo sapiens
acaggaggagcagctgtgtgcc

SEQ ID NO: 9166212 - DNA, 22 bp, Homo sapiens
acaggagcaacagactaagaca

SEQ ID NO: 9166213 - DNA, 22 bp, Homo sapiens
acaggagcaacagactaagaca

SEQ ID NO: 9166214 - DNA, 20 bp, Homo sapiens
acaggagatctgaggaaagg

SEQ ID NO: 9166215 - DNA, 22 bp, Homo sapiens
acaggcactgtcaagtcatgaa

SEQ ID NO: 9166216 - DNA, 22 bp, Homo sapiens
acaggcactttgacatgccatc

SEQ ID NO: 9166217 - DNA, 19 bp, Homo sapiens
acaggcagaattgggtgtg

SEQ ID NO: 9166218 - DNA, 19 bp, Homo sapiens
acaggcagaattgggtgtg

SEQ ID NO: 9166219 - DNA, 22 bp, Homo sapiens
aagccctggacggcccttcccc

SEQ ID NO: 9166220 - DNA, 22 bp, Homo sapiens
aagccctggaactttcctagcc

SEQ ID NO: 9166221 - DNA, 22 bp, Homo sapiens
aagccctggaactttcctagcc

SEQ ID NO: 9166222 - DNA, 22 bp, Homo sapiens
aagccctgccacccattcactg

SEQ ID NO: 9166223 - DNA, 22 bp, Homo sapiens
aagccctgccacccattcactg

SEQ ID NO: 9166224 - DNA, 22 bp, Homo sapiens
aagccctggatagagagaactg

SEQ ID NO: 9166225 - DNA, 22 bp, Homo sapiens
aagccctggattaaagatgcca

SEQ ID NO: 9166226 - DNA, 22 bp, Homo sapiens
aagccctggattaaagatgcca

SEQ ID NO: 9166227 - DNA, 22 bp, Homo sapiens
aagccctggcaatgtcagatga

SEQ ID NO: 9166228 - DNA, 22 bp, Homo sapiens
aagccctggcccaaccttgatt

SEQ ID NO: 9166229 - DNA, 22 bp, Homo sapiens
aagccctggcccaaccttgatt

SEQ ID NO: 9166230 - DNA, 22 bp, Homo sapiens
aagccctggcgggtggagggcc

SEQ ID NO: 9166231 - DNA, 22 bp, Homo sapiens
aagccctggcaatgtcagatga

SEQ ID NO: 9166232 - DNA, 22 bp, Homo sapiens
aagccctggcgggtggagggcc

SEQ ID NO: 9166233 - DNA, 22 bp, Homo sapiens
aagccctggcgggtggagggcc

SEQ ID NO: 9166234 - DNA, 22 bp, Homo sapiens
aagccctggctcagctcaccag

SEQ ID NO: 9166235 - DNA, 22 bp, Homo sapiens
acaggccagcctggggtaaggt

SEQ ID NO: 9166236 - DNA, 22 bp, Homo sapiens
aagccctgataggaaaatgctg

SEQ ID NO: 9166237 - DNA, 22 bp, Homo sapiens
aagccctgagcactgcagagaa

SEQ ID NO: 9166238 - DNA, 22 bp, Homo sapiens
aagccctgcagtctctgccaca

SEQ ID NO: 9166239 - DNA, 22 bp, Homo sapiens
aagccctgcagtctctgccaca

SEQ ID NO: 9166240 - DNA, 22 bp, Homo sapiens
aagccctgcagtctctgccaca

SEQ ID NO: 9166241 - DNA, 22 bp, Homo sapiens
aagccctgactatgaagacata

SEQ ID NO: 9166242 - DNA, 22 bp, Homo sapiens
aagccctgacctgagagtccgt

SEQ ID NO: 9166243 - DNA, 22 bp, Homo sapiens
aagccctgagcactgcagagaa

SEQ ID NO: 9166244 - DNA, 22 bp, Homo sapiens
aagccctgagcactgcagagaa

SEQ ID NO: 9166245 - DNA, 22 bp, Homo sapiens
acaggcagagtcaggttgggtt

SEQ ID NO: 9166246 - DNA, 22 bp, Homo sapiens
acaggcagagaactcagccaga

SEQ ID NO: 9166247 - DNA, 22 bp, Homo sapiens
acaggcagagagtggcggactc

SEQ ID NO: 9166248 - DNA, 22 bp, Homo sapiens
acatagaaatttatttcttaca

SEQ ID NO: 9166249 - DNA, 23 bp, Homo sapiens
acatagaacagaatatatttgtg

SEQ ID NO: 9166250 - DNA, 23 bp, Homo sapiens
acatagaacagaatatatttgtg

SEQ ID NO: 9166251 - DNA, 22 bp, Homo sapiens
acatgcattaaaaatacttgtg

SEQ ID NO: 9166252 - DNA, 22 bp, Homo sapiens
acatgcattctctaaaagcaaa

SEQ ID NO: 9166253 - DNA, 22 bp, Homo sapiens
acatacttaacattaaagtcat

SEQ ID NO: 9166254 - DNA, 22 bp, Homo sapiens
acatacttatgctaaaaatata

SEQ ID NO: 9166255 - DNA, 22 bp, Homo sapiens
acatacttatgctaaaaatata

SEQ ID NO: 9166256 - DNA, 19 bp, Homo sapiens
acatggctctccagtctgg

SEQ ID NO: 9166257 - DNA, 23 bp, Homo sapiens
acatgggagggacatggaggctg

SEQ ID NO: 9166258 - DNA, 22 bp, Homo sapiens
acatggggcccaaagagaggtc

SEQ ID NO: 9166259 - DNA, 22 bp, Homo sapiens
acatgggggctgctgccagcga

SEQ ID NO: 9166260 - DNA, 22 bp, Homo sapiens
acatggtatgtattttaagaga

SEQ ID NO: 9166261 - DNA, 22 bp, Homo sapiens
acatggtaaattggtaaaggac

SEQ ID NO: 9166262 - DNA, 22 bp, Homo sapiens
acatgggatcaatgaggcaggc

SEQ ID NO: 9166263 - DNA, 17 bp, Homo sapiens
acatgggctgagactcc

SEQ ID NO: 9166264 - DNA, 22 bp, Homo sapiens
acatggggcccaaagagaggtc

SEQ ID NO: 9166265 - DNA, 22 bp, Homo sapiens
acataagttatggataaaatgt

SEQ ID NO: 9166266 - DNA, 22 bp, Homo sapiens
acataataaaaataacagctca

SEQ ID NO: 9166267 - DNA, 22 bp, Homo sapiens
acataataaaaataacagctca

SEQ ID NO: 9166268 - DNA, 22 bp, Homo sapiens
acataataaaaataacagctca

SEQ ID NO: 9166269 - DNA, 21 bp, Homo sapiens
acataactgtcaagtaacgtt

SEQ ID NO: 9166270 - DNA, 22 bp, Homo sapiens
acataataggtacctgaataat

SEQ ID NO: 9166271 - DNA, 22 bp, Homo sapiens
acataataggtacctgaataat

SEQ ID NO: 9166272 - DNA, 22 bp, Homo sapiens
acataacatagttgacattttt

SEQ ID NO: 9166273 - DNA, 22 bp, Homo sapiens
acataagtgcacaataaatatt

SEQ ID NO: 9166274 - DNA, 21 bp, Homo sapiens
acataactgtcaagtaacgtt

SEQ ID NO: 9166275 - DNA, 22 bp, Homo sapiens
acatacattgcctcattggtaa

SEQ ID NO: 9166276 - DNA, 18 bp, Homo sapiens
acatacattctgtctgca

SEQ ID NO: 9166277 - DNA, 22 bp, Homo sapiens
acataataggtgcctgaatatt

SEQ ID NO: 9166278 - DNA, 22 bp, Homo sapiens
acataataggtgcctgaatatt

SEQ ID NO: 9166279 - DNA, 22 bp, Homo sapiens
acataatgaaatgcagaaatca

SEQ ID NO: 9166280 - DNA, 22 bp, Homo sapiens
acataatgagctctttataaat

SEQ ID NO: 9166281 - DNA, 22 bp, Homo sapiens
acataatggacaataatgcatc

SEQ ID NO: 9166282 - DNA, 22 bp, Homo sapiens
acattacctggcatttgatctt

SEQ ID NO: 9166283 - DNA, 22 bp, Homo sapiens
acattacttaccttgggttcta

SEQ ID NO: 9166284 - DNA, 22 bp, Homo sapiens
acattagaacattaatattggg

SEQ ID NO: 9166285 - DNA, 21 bp, Homo sapiens
acattataattcatattccac

SEQ ID NO: 9166286 - DNA, 22 bp, Homo sapiens
acattctcttttagaaagctgt

SEQ ID NO: 9166287 - DNA, 22 bp, Homo sapiens
acattctctccatgtcttcttt

SEQ ID NO: 9166288 - DNA, 22 bp, Homo sapiens
acattctcatttggtgatcatt

SEQ ID NO: 9166289 - DNA, 22 bp, Homo sapiens
acattctctccatgtcttcttt

SEQ ID NO: 9166290 - DNA, 22 bp, Homo sapiens
acattctcttcctaaatatact

SEQ ID NO: 9166291 - DNA, 22 bp, Homo sapiens
acattctcttcctaaatatact

SEQ ID NO: 9166292 - DNA, 22 bp, Homo sapiens
acattctattctgcaggacaag

SEQ ID NO: 9166293 - DNA, 22 bp, Homo sapiens
acattctcaaatatttgtggaa

SEQ ID NO: 9166294 - DNA, 22 bp, Homo sapiens
aaggccaggccagatgacagtc

SEQ ID NO: 9166295 - DNA, 22 bp, Homo sapiens
aaggccaggccagatgacagtc

SEQ ID NO: 9166296 - DNA, 22 bp, Homo sapiens
aaggccaggccagatgacagtc

SEQ ID NO: 9166297 - DNA, 22 bp, Homo sapiens
aaggccaggcagggagctgtga

SEQ ID NO: 9166298 - DNA, 22 bp, Homo sapiens
aaggccaggacaccaggggact

SEQ ID NO: 9166299 - DNA, 22 bp, Homo sapiens
acatgtaaaaattaaggtaaga

SEQ ID NO: 9166300 - DNA, 22 bp, Homo sapiens
acatggtatttctattataatt

SEQ ID NO: 9166301 - DNA, 22 bp, Homo sapiens
acatggtatttctattataatt

SEQ ID NO: 9166302 - DNA, 22 bp, Homo sapiens
acatgtaaaaattaaggtaaga

SEQ ID NO: 9166303 - DNA, 22 bp, Homo sapiens
aaggccagcttgtagggctggt

SEQ ID NO: 9166304 - DNA, 22 bp, Homo sapiens
accacccccttgggtgtggaag

SEQ ID NO: 9166305 - DNA, 22 bp, Homo sapiens
accaccctcagcagagctgaaa

SEQ ID NO: 9166306 - DNA, 22 bp, Homo sapiens
accacaggggaggaatgatgcc

SEQ ID NO: 9166307 - DNA, 22 bp, Homo sapiens
accacagggtaaagttagatat

SEQ ID NO: 9166308 - DNA, 22 bp, Homo sapiens
accacagtatgaaatctgaaat

SEQ ID NO: 9166309 - DNA, 18 bp, Homo sapiens
accacatgatatcttgcc

SEQ ID NO: 9166310 - DNA, 18 bp, Homo sapiens
accacagtgcttaatatg

SEQ ID NO: 9166311 - DNA, 22 bp, Homo sapiens
acattcttaacagttaaaaact

SEQ ID NO: 9166312 - DNA, 22 bp, Homo sapiens
acattcttaacagttaaaaact

SEQ ID NO: 9166313 - DNA, 22 bp, Homo sapiens
acattcttaacagttaaaaact

SEQ ID NO: 9166314 - DNA, 22 bp, Homo sapiens
accacaggaggatggctgctgg

SEQ ID NO: 9166315 - DNA, 22 bp, Homo sapiens
acattttgcccttatttgctga

SEQ ID NO: 9166316 - DNA, 22 bp, Homo sapiens
aagggcagctattatcgtcatc

SEQ ID NO: 9166317 - DNA, 22 bp, Homo sapiens
aagggcagctgacagatgctta

SEQ ID NO: 9166318 - DNA, 22 bp, Homo sapiens
aagggcagctattatcgtcatc

SEQ ID NO: 9166319 - DNA, 22 bp, Homo sapiens
aagggcagcctgactcacggtc

SEQ ID NO: 9166320 - DNA, 22 bp, Homo sapiens
aagggcagcctgactcacggtc

SEQ ID NO: 9166321 - DNA, 22 bp, Homo sapiens
aagggcagagggaatcccacat

SEQ ID NO: 9166322 - DNA, 22 bp, Homo sapiens
aagggcagagggaatcccacat

SEQ ID NO: 9166323 - DNA, 22 bp, Homo sapiens
accactgcactccagtctgggc

SEQ ID NO: 9166324 - DNA, 22 bp, Homo sapiens
aagggcagcttaaattggtagc

SEQ ID NO: 9166325 - DNA, 22 bp, Homo sapiens
aagggcagcttaaattggtagc

SEQ ID NO: 9166326 - DNA, 22 bp, Homo sapiens
aagggcagctgacagatgctta

SEQ ID NO: 9166327 - DNA, 22 bp, Homo sapiens
aagggcagctgacagatgctta

SEQ ID NO: 9166328 - DNA, 23 bp, Homo sapiens
accagctgccctgaactttgtgc

SEQ ID NO: 9166329 - DNA, 22 bp, Homo sapiens
accagctgatttaagaataaag

SEQ ID NO: 9166330 - DNA, 22 bp, Homo sapiens
aaggttctaagggaagccatgc

SEQ ID NO: 9166331 - DNA, 22 bp, Homo sapiens
aaggttctaagggaagccatgc

SEQ ID NO: 9166332 - DNA, 22 bp, Homo sapiens
aaggtgtcactgggacaggaaa

SEQ ID NO: 9166333 - DNA, 21 bp, Homo sapiens
accaggccaggaggctggcac

SEQ ID NO: 9166334 - DNA, 22 bp, Homo sapiens
aagtaaaagctttaccatgcgc

SEQ ID NO: 9166335 - DNA, 22 bp, Homo sapiens
aagtaaaatgtttcctttatta

SEQ ID NO: 9166336 - DNA, 22 bp, Homo sapiens
aagtaaaacacacagtccaccg

SEQ ID NO: 9166337 - DNA, 22 bp, Homo sapiens
aagtaaaagcaggtgtgctggg

SEQ ID NO: 9166338 - DNA, 22 bp, Homo sapiens
aaggtttttttccagtatctct

SEQ ID NO: 9166339 - DNA, 22 bp, Homo sapiens
aaggtttttttccagtatctct

SEQ ID NO: 9166340 - DNA, 22 bp, Homo sapiens
aaggtttctccgaggctatttt

SEQ ID NO: 9166341 - DNA, 22 bp, Homo sapiens
aaggtttccagtgatattgtgg

SEQ ID NO: 9166342 - DNA, 22 bp, Homo sapiens
accagctggtcagttgaagatt

SEQ ID NO: 9166343 - DNA, 22 bp, Homo sapiens
accagctggtcacctgggcact

SEQ ID NO: 9166344 - DNA, 22 bp, Homo sapiens
accagctggcccatgagcacgt

SEQ ID NO: 9166345 - DNA, 22 bp, Homo sapiens
accagctggcccatgagcacgt

SEQ ID NO: 9166346 - DNA, 22 bp, Homo sapiens
accagctggcccatgagcacgt

SEQ ID NO: 9166347 - DNA, 22 bp, Homo sapiens
accagctggtcacctgggcact

SEQ ID NO: 9166348 - DNA, 22 bp, Homo sapiens
accaggcactcctgaggtctga

SEQ ID NO: 9166349 - DNA, 22 bp, Homo sapiens
accaggcagtatggtgctgcaa

SEQ ID NO: 9166350 - DNA, 22 bp, Homo sapiens
aataaatgttaagattgtctca

SEQ ID NO: 9166351 - DNA, 22 bp, Homo sapiens
aataaatgtttgttggatgttt

SEQ ID NO: 9166352 - DNA, 22 bp, Homo sapiens
aataaatgaacaaagcaggttg

SEQ ID NO: 9166353 - DNA, 22 bp, Homo sapiens
aataaatgaacaaagcaggttg

SEQ ID NO: 9166354 - DNA, 22 bp, Homo sapiens
aataaatgtttgttggatgttt

SEQ ID NO: 9166355 - DNA, 22 bp, Homo sapiens
aataacagaaacttgagcatca

SEQ ID NO: 9166356 - DNA, 22 bp, Homo sapiens
aataaagactcagaggcccagg

SEQ ID NO: 9166357 - DNA, 22 bp, Homo sapiens
aataaagacaaacaggggagcc

SEQ ID NO: 9166358 - DNA, 22 bp, Homo sapiens
aataaagtagcgtttaaggtgc

SEQ ID NO: 9166359 - DNA, 22 bp, Homo sapiens
aataaagtgtattctttgtcat

SEQ ID NO: 9166360 - DNA, 22 bp, Homo sapiens
aataaaggcaccataaggcaaa

SEQ ID NO: 9166361 - DNA, 22 bp, Homo sapiens
aataaaatggtcagttttctca

SEQ ID NO: 9166362 - DNA, 22 bp, Homo sapiens
actgactttggaatatttctag

SEQ ID NO: 9166363 - DNA, 22 bp, Homo sapiens
actgaccttctcagctaactca

SEQ ID NO: 9166364 - DNA, 21 bp, Homo sapiens
actgaccacttctgcctgtct

SEQ ID NO: 9166365 - DNA, 22 bp, Homo sapiens
aagttttattggctatagcact

SEQ ID NO: 9166366 - DNA, 22 bp, Homo sapiens
aagttttattggctatagcact

SEQ ID NO: 9166367 - DNA, 22 bp, Homo sapiens
aagttttattggctatagcact

SEQ ID NO: 9166368 - DNA, 22 bp, Homo sapiens
actcatgtaagcggaatgtagt

SEQ ID NO: 9166369 - DNA, 22 bp, Homo sapiens
aagtggagtccctacaaccagc

SEQ ID NO: 9166370 - DNA, 22 bp, Homo sapiens
aagtggagtccctacaaccagc

SEQ ID NO: 9166371 - DNA, 22 bp, Homo sapiens
aagtggagctataggctcagat

SEQ ID NO: 9166372 - DNA, 22 bp, Homo sapiens
aagtggaggccgagttcacgca

SEQ ID NO: 9166373 - DNA, 22 bp, Homo sapiens
aagtggagtccctacaaccagc

SEQ ID NO: 9166374 - DNA, 22 bp, Homo sapiens
aagtggaggccgagttcacgca

SEQ ID NO: 9166375 - DNA, 22 bp, Homo sapiens
actcagttccatattggtaagt

SEQ ID NO: 9166376 - DNA, 22 bp, Homo sapiens
actcagtacatctggagttggc

SEQ ID NO: 9166377 - DNA, 22 bp, Homo sapiens
aagtgcagtggcgtgatcttgg

SEQ ID NO: 9166378 - DNA, 22 bp, Homo sapiens
aagtgcagtggcgtgatcttgg

SEQ ID NO: 9166379 - DNA, 22 bp, Homo sapiens
aagtttgtctcatttgatcttc

SEQ ID NO: 9166380 - DNA, 22 bp, Homo sapiens
aagtttgtggtcatttattata

SEQ ID NO: 9166381 - DNA, 22 bp, Homo sapiens
aagtggcagaatagtggcagga

SEQ ID NO: 9166382 - DNA, 22 bp, Homo sapiens
aagtggctaacagtccttgcct

SEQ ID NO: 9166383 - DNA, 22 bp, Homo sapiens
aagtggctcatgtggcttctgc

SEQ ID NO: 9166384 - DNA, 22 bp, Homo sapiens
aagtggcagttcaggaagcaga

SEQ ID NO: 9166385 - DNA, 22 bp, Homo sapiens
aagtttctgaatttgaaaggat

SEQ ID NO: 9166386 - DNA, 22 bp, Homo sapiens
aagtttggggagaatttcattt

SEQ ID NO: 9166387 - DNA, 21 bp, Homo sapiens
aagtttctccctaattgttgc

SEQ ID NO: 9166388 - DNA, 21 bp, Homo sapiens
aagtttctccctaattgttgc

SEQ ID NO: 9166389 - DNA, 22 bp, Homo sapiens
aagtttctcaatggcaactggg

SEQ ID NO: 9166390 - DNA, 22 bp, Homo sapiens
aagtttctcagggttgattggg

SEQ ID NO: 9166391 - DNA, 22 bp, Homo sapiens
aagtggctttgagcttctgcca

SEQ ID NO: 9166392 - DNA, 22 bp, Homo sapiens
aagtggggcctggtggtacagt

SEQ ID NO: 9166393 - DNA, 22 bp, Homo sapiens
aagtgaatgtagcaaacttgaa

SEQ ID NO: 9166394 - DNA, 22 bp, Homo sapiens
aagtgaatctcctttctttatt

SEQ ID NO: 9166395 - DNA, 22 bp, Homo sapiens
aagtgaataaaattgtgttctt

SEQ ID NO: 9166396 - DNA, 22 bp, Homo sapiens
aagtgacctcatggtttctcct

SEQ ID NO: 9166397 - DNA, 22 bp, Homo sapiens
aagtgacacctcttccctttcc

SEQ ID NO: 9166398 - DNA, 22 bp, Homo sapiens
aagtgacagtttacaattctta

SEQ ID NO: 9166399 - DNA, 22 bp, Homo sapiens
aagtgacacatggcacttctat

SEQ ID NO: 9166400 - DNA, 22 bp, Homo sapiens
aagtgacacatttgtgatgaat

SEQ ID NO: 9166401 - DNA, 22 bp, Homo sapiens
accttggggtgatgctgaaaga

SEQ ID NO: 9166402 - DNA, 22 bp, Homo sapiens
accttgtgaggttacataatgt

SEQ ID NO: 9166403 - DNA, 22 bp, Homo sapiens
aagtgaaattgccattcttata

SEQ ID NO: 9166404 - DNA, 22 bp, Homo sapiens
aagtgaaattgccattcttata

SEQ ID NO: 9166405 - DNA, 22 bp, Homo sapiens
aagtgagttcagcattcactcg

SEQ ID NO: 9166406 - DNA, 22 bp, Homo sapiens
aagtgatacatctagtctataa

SEQ ID NO: 9166407 - DNA, 22 bp, Homo sapiens
aagtgacttaatctcctctcag

SEQ ID NO: 9166408 - DNA, 22 bp, Homo sapiens
aagtgcaagcaggacttagttt

SEQ ID NO: 9166409 - DNA, 22 bp, Homo sapiens
aagtgcagagagctgacgaact

SEQ ID NO: 9166410 - DNA, 22 bp, Homo sapiens
aagtgcagagagctgacgaact

SEQ ID NO: 9166411 - DNA, 22 bp, Homo sapiens
aagtgcaggagtggggaaagta

SEQ ID NO: 9166412 - DNA, 22 bp, Homo sapiens
aagtgcaggagtggggaaagta

SEQ ID NO: 9166413 - DNA, 22 bp, Homo sapiens
aagtgcaggtctcagctactct

SEQ ID NO: 9166414 - DNA, 22 bp, Homo sapiens
aagtgatacgtgtttatttcca

SEQ ID NO: 9166415 - DNA, 22 bp, Homo sapiens
aagtaaatgttggagctcaaat

SEQ ID NO: 9166416 - DNA, 22 bp, Homo sapiens
acctggctgttctcatttctag

SEQ ID NO: 9166417 - DNA, 22 bp, Homo sapiens
acctggcttcaaccatcatttg

SEQ ID NO: 9166418 - DNA, 22 bp, Homo sapiens
acctggcttcaaccatcatttg

SEQ ID NO: 9166419 - DNA, 22 bp, Homo sapiens
acctgcctctaagcagcaggtg

SEQ ID NO: 9166420 - DNA, 22 bp, Homo sapiens
acctggctggttgtgattccca

SEQ ID NO: 9166421 - DNA, 22 bp, Homo sapiens
acctgcctctaagcagcaggtg

SEQ ID NO: 9166422 - DNA, 22 bp, Homo sapiens
acctggctgttctcatttctag

SEQ ID NO: 9166423 - DNA, 22 bp, Homo sapiens
aagtaaatatctgtttatagca

SEQ ID NO: 9166424 - DNA, 21 bp, Homo sapiens
aagtaaatcagagaaataacc

SEQ ID NO: 9166425 - DNA, 21 bp, Homo sapiens
aagtaaatcagagaaataacc

SEQ ID NO: 9166426 - DNA, 22 bp, Homo sapiens
aagtaaatcttatgtcagggag

SEQ ID NO: 9166427 - DNA, 21 bp, Homo sapiens
aagtaaatcagagaaataacc

SEQ ID NO: 9166428 - DNA, 22 bp, Homo sapiens
aagtaaaattcaatcttcactg

SEQ ID NO: 9166429 - DNA, 22 bp, Homo sapiens
acctgggagtatgcagtggtga

SEQ ID NO: 9166430 - DNA, 22 bp, Homo sapiens
acctgggatggggccaggttta

SEQ ID NO: 9166431 - DNA, 22 bp, Homo sapiens
acctgggaggcggaggttgcag

SEQ ID NO: 9166432 - DNA, 22 bp, Homo sapiens
acctgggaggcagaggttgcag

SEQ ID NO: 9166433 - DNA, 20 bp, Homo sapiens
acctgggaaaaccttttcct

SEQ ID NO: 9166434 - DNA, 22 bp, Homo sapiens
acctggctttggggataggctt

SEQ ID NO: 9166435 - DNA, 22 bp, Homo sapiens
acctggcttctaatcatggctc

SEQ ID NO: 9166436 - DNA, 22 bp, Homo sapiens
acctggcttgtttctacctcct

SEQ ID NO: 9166437 - DNA, 22 bp, Homo sapiens
acctgggaaagccgtggaaagg

SEQ ID NO: 9166438 - DNA, 22 bp, Homo sapiens
acctgggagagaggagccggcg

SEQ ID NO: 9166439 - DNA, 22 bp, Homo sapiens
accttctgaccagttatcttga

SEQ ID NO: 9166440 - DNA, 23 bp, Homo sapiens
accttggacttcccagcttccag

SEQ ID NO: 9166441 - DNA, 22 bp, Homo sapiens
accttgggcaacctgctcctgc

SEQ ID NO: 9166442 - DNA, 22 bp, Homo sapiens
accttgggcaagttggaaactg

SEQ ID NO: 9166443 - DNA, 22 bp, Homo sapiens
accttgatggggctgttggagt

SEQ ID NO: 9166444 - DNA, 22 bp, Homo sapiens
accttggaactgaagtgttttt

SEQ ID NO: 9166445 - DNA, 22 bp, Homo sapiens
accttggaaatgcccattgcct

SEQ ID NO: 9166446 - DNA, 22 bp, Homo sapiens
accttggaaagtttaattgagg

SEQ ID NO: 9166447 - DNA, 22 bp, Homo sapiens
aatatcagctctgtcacttact

SEQ ID NO: 9166448 - DNA, 22 bp, Homo sapiens
aatatcaggatgcaaagctgtg

SEQ ID NO: 9166449 - DNA, 22 bp, Homo sapiens
aatatcagtatattgtatcagt

SEQ ID NO: 9166450 - DNA, 22 bp, Homo sapiens
aatatgaattattgttacaagt

SEQ ID NO: 9166451 - DNA, 22 bp, Homo sapiens
aatatcttggcccaactccaga

SEQ ID NO: 9166452 - DNA, 22 bp, Homo sapiens
acttccgggtgctagatgattc

SEQ ID NO: 9166453 - DNA, 22 bp, Homo sapiens
acttatttcatggatcataatg

SEQ ID NO: 9166454 - DNA, 22 bp, Homo sapiens
acttatttattcattcagctca

SEQ ID NO: 9166455 - DNA, 22 bp, Homo sapiens
acttatttattcattcagctca

SEQ ID NO: 9166456 - DNA, 22 bp, Homo sapiens
acttatatttgctttatgcttc

SEQ ID NO: 9166457 - DNA, 22 bp, Homo sapiens
acttagcacgaacatttacttt

SEQ ID NO: 9166458 - DNA, 22 bp, Homo sapiens
acttagcaatttgattaaaaga

SEQ ID NO: 9166459 - DNA, 22 bp, Homo sapiens
aatagaaaggaggggctcttgt

SEQ ID NO: 9166460 - DNA, 22 bp, Homo sapiens
acttagtgccctggcccttaca

SEQ ID NO: 9166461 - DNA, 22 bp, Homo sapiens
acttagtggctatgtgacctta

SEQ ID NO: 9166462 - DNA, 20 bp, Homo sapiens
acttagtgtagggttcctag

SEQ ID NO: 9166463 - DNA, 22 bp, Homo sapiens
acttataagagtgctatgggga

SEQ ID NO: 9166464 - DNA, 22 bp, Homo sapiens
aatacttgtgaattcaaagtct

SEQ ID NO: 9166465 - DNA, 22 bp, Homo sapiens
aatacttgggctgagatttttg

SEQ ID NO: 9166466 - DNA, 22 bp, Homo sapiens
aatacttgggctgagatttttg

SEQ ID NO: 9166467 - DNA, 22 bp, Homo sapiens
aatacttatgtgacctcatttt

SEQ ID NO: 9166468 - DNA, 22 bp, Homo sapiens
aatactgtgatatcgagcgatt

SEQ ID NO: 9166469 - DNA, 22 bp, Homo sapiens
aatactgtgggatgcagtagga

SEQ ID NO: 9166470 - DNA, 22 bp, Homo sapiens
aatactttcctatataaggtgc

SEQ ID NO: 9166471 - DNA, 22 bp, Homo sapiens
aatactttcctatataaggtgc

SEQ ID NO: 9166472 - DNA, 22 bp, Homo sapiens
aatacttttgaactgaaaggca

SEQ ID NO: 9166473 - DNA, 22 bp, Homo sapiens
actgtgggagcgcagtggcagc

SEQ ID NO: 9166474 - DNA, 22 bp, Homo sapiens
aatactggctgtcaaagatgga

SEQ ID NO: 9166475 - DNA, 22 bp, Homo sapiens
aatactgtatgagctatggtag

SEQ ID NO: 9166476 - DNA, 22 bp, Homo sapiens
aatactgtaaatggagcagcca

SEQ ID NO: 9166477 - DNA, 22 bp, Homo sapiens
aatactgtctttcacagatatt

SEQ ID NO: 9166478 - DNA, 22 bp, Homo sapiens
aatactgtctttcacagatatt

SEQ ID NO: 9166479 - DNA, 22 bp, Homo sapiens
actgtggccaaagcctctggga

SEQ ID NO: 9166480 - DNA, 22 bp, Homo sapiens
actgtggctcagggaatgcatg

SEQ ID NO: 9166481 - DNA, 22 bp, Homo sapiens
actgtgctgctctccgcagccc

SEQ ID NO: 9166482 - DNA, 23 bp, Homo sapiens
actgtctgatatgttttccatca

SEQ ID NO: 9166483 - DNA, 22 bp, Homo sapiens
aataaccttacttattacatgg

SEQ ID NO: 9166484 - DNA, 22 bp, Homo sapiens
aataacagggttgatttgcaat

SEQ ID NO: 9166485 - DNA, 22 bp, Homo sapiens
aataacaggctcatcagatgct

SEQ ID NO: 9166486 - DNA, 18 bp, Homo sapiens
aatatgtctagttacagc

SEQ ID NO: 9166487 - DNA, 22 bp, Homo sapiens
aatatgtctctggctagacatt

SEQ ID NO: 9166488 - DNA, 22 bp, Homo sapiens
aatatgtctctgtggttaagta

SEQ ID NO: 9166489 - DNA, 22 bp, Homo sapiens
aatatgtctgctaattgtttct

SEQ ID NO: 9166490 - DNA, 22 bp, Homo sapiens
aatatgtgaggtatgttcagtg

SEQ ID NO: 9166491 - DNA, 22 bp, Homo sapiens
aatatgcctgctgtcttcaatt

SEQ ID NO: 9166492 - DNA, 22 bp, Homo sapiens
aatatgcattaactgtgtacat

SEQ ID NO: 9166493 - DNA, 22 bp, Homo sapiens
aatatgcagcatgatgaagtaa

SEQ ID NO: 9166494 - DNA, 22 bp, Homo sapiens
aatatgcagcttatcttctagg

SEQ ID NO: 9166495 - DNA, 22 bp, Homo sapiens
aatatgcaagcttccaggtaga

SEQ ID NO: 9166496 - DNA, 22 bp, Homo sapiens
aatatgcactctgatttagcag

SEQ ID NO: 9166497 - DNA, 22 bp, Homo sapiens
aatatgcaaagcgtgttatctg

SEQ ID NO: 9166498 - DNA, 22 bp, Homo sapiens
aatatgtttataagatatcttc

SEQ ID NO: 9166499 - DNA, 22 bp, Homo sapiens
aatattaatagaaggggttcta

SEQ ID NO: 9166500 - DNA, 22 bp, Homo sapiens
aatattatcaaaagctttttca

SEQ ID NO: 9166501 - DNA, 22 bp, Homo sapiens
aatattatacagtcaacctctt

SEQ ID NO: 9166502 - DNA, 22 bp, Homo sapiens
aatattcatttgcagaagaagt

SEQ ID NO: 9166503 - DNA, 22 bp, Homo sapiens
aatattcatttgcagaagaagt

SEQ ID NO: 9166504 - DNA, 22 bp, Homo sapiens
agaaaactgggaggagagcttc

SEQ ID NO: 9166505 - DNA, 22 bp, Homo sapiens
agaaaatattcattgagaggct

SEQ ID NO: 9166506 - DNA, 22 bp, Homo sapiens
agaaaataatttcttggctggt

SEQ ID NO: 9166507 - DNA, 22 bp, Homo sapiens
agaaaataatttcttggctggt

SEQ ID NO: 9166508 - DNA, 20 bp, Homo sapiens
agaaaatgttttcagctgga

SEQ ID NO: 9166509 - DNA, 22 bp, Homo sapiens
agaaaattactccagagacaag

SEQ ID NO: 9166510 - DNA, 21 bp, Homo sapiens
agaaaatggcgttttagattt

SEQ ID NO: 9166511 - DNA, 20 bp, Homo sapiens
agaaaatgttttcagctgga

SEQ ID NO: 9166512 - DNA, 22 bp, Homo sapiens
aatcttcattttgacaagattc

SEQ ID NO: 9166513 - DNA, 22 bp, Homo sapiens
aatcttcactaaaatggacaag

SEQ ID NO: 9166514 - DNA, 22 bp, Homo sapiens
aatcttacaccgaatttaaact

SEQ ID NO: 9166515 - DNA, 22 bp, Homo sapiens
aatcttcaaaaacaattgaggg

SEQ ID NO: 9166516 - DNA, 22 bp, Homo sapiens
aatcttacaccgaatttaaact

SEQ ID NO: 9166517 - DNA, 22 bp, Homo sapiens
aatcttcactcattcagagttg

SEQ ID NO: 9166518 - DNA, 22 bp, Homo sapiens
aatcttcagtgtctaaaaagca

SEQ ID NO: 9166519 - DNA, 22 bp, Homo sapiens
aatcttcatgtcctctctaatt

SEQ ID NO: 9166520 - DNA, 22 bp, Homo sapiens
aatctgtttgtttacacctttt

SEQ ID NO: 9166521 - DNA, 22 bp, Homo sapiens
aatctgtttccaatacttgcta

SEQ ID NO: 9166522 - DNA, 22 bp, Homo sapiens
aatctgtttttgaaactttgta

SEQ ID NO: 9166523 - DNA, 22 bp, Homo sapiens
aatctgtcagaatttctaagtt

SEQ ID NO: 9166524 - DNA, 22 bp, Homo sapiens
aatctgtcgtgttgatagttct

SEQ ID NO: 9166525 - DNA, 22 bp, Homo sapiens
aatctgtattgttaacaagtaa

SEQ ID NO: 9166526 - DNA, 22 bp, Homo sapiens
aatctgttgatgcaaacctccc

SEQ ID NO: 9166527 - DNA, 22 bp, Homo sapiens
agaaacctccatttattcactc

SEQ ID NO: 9166528 - DNA, 22 bp, Homo sapiens
agaaactatcctgagtagcaaa

SEQ ID NO: 9166529 - DNA, 22 bp, Homo sapiens
agaaactcatcctggagatgac

SEQ ID NO: 9166530 - DNA, 22 bp, Homo sapiens
agaaactattatggtaaacaaa

SEQ ID NO: 9166531 - DNA, 22 bp, Homo sapiens
aatctatatgcttttcacatac

SEQ ID NO: 9166532 - DNA, 22 bp, Homo sapiens
gcatttggaaaatgtttggctt

SEQ ID NO: 9166533 - DNA, 22 bp, Homo sapiens
gcatttgaaatgcaagaaagtg

SEQ ID NO: 9166534 - DNA, 21 bp, Homo sapiens
gcatttggtgccctgtctgct

SEQ ID NO: 9166535 - DNA, 22 bp, Homo sapiens
gcatgcaactcccagttctgcc

SEQ ID NO: 9166536 - DNA, 22 bp, Homo sapiens
gcatttcctgtgcttggcatat

SEQ ID NO: 9166537 - DNA, 19 bp, Homo sapiens
gcatttctctttacagcca

SEQ ID NO: 9166538 - DNA, 22 bp, Homo sapiens
gcatttctgtgcatacacatga

SEQ ID NO: 9166539 - DNA, 22 bp, Homo sapiens
gcatgacatggcctgacttagg

SEQ ID NO: 9166540 - DNA, 22 bp, Homo sapiens
gcatgacattcctaatcacagt

SEQ ID NO: 9166541 - DNA, 22 bp, Homo sapiens
gcatgacagtcgaaaggttaac

SEQ ID NO: 9166542 - DNA, 22 bp, Homo sapiens
gcatgaggggggttaggaagtt

SEQ ID NO: 9166543 - DNA, 22 bp, Homo sapiens
gcatgaggtttgggctctgtga

SEQ ID NO: 9166544 - DNA, 22 bp, Homo sapiens
gcataacaacagactctgtgtt

SEQ ID NO: 9166545 - DNA, 22 bp, Homo sapiens
gcatccagaggtagccactgtg

SEQ ID NO: 9166546 - DNA, 22 bp, Homo sapiens
gcatccttgggcccagctcctg

SEQ ID NO: 9166547 - DNA, 22 bp, Homo sapiens
gcatccttgggcccagctcctg

SEQ ID NO: 9166548 - DNA, 22 bp, Homo sapiens
gcatccagtcttggctcctgga

SEQ ID NO: 9166549 - DNA, 22 bp, Homo sapiens
gcatcctctgagagctctagat

SEQ ID NO: 9166550 - DNA, 22 bp, Homo sapiens
gcagtatctatgtgatgggttg

SEQ ID NO: 9166551 - DNA, 22 bp, Homo sapiens
gcagtcagacaggaggagctcc

SEQ ID NO: 9166552 - DNA, 22 bp, Homo sapiens
gcagtcagtaaggcagccagaa

SEQ ID NO: 9166553 - DNA, 22 bp, Homo sapiens
gcagggctcattgccaggcatt

SEQ ID NO: 9166554 - DNA, 22 bp, Homo sapiens
gcagggctcattgccaggcatt

SEQ ID NO: 9166555 - DNA, 22 bp, Homo sapiens
gcagggctcagccgctcccacc

SEQ ID NO: 9166556 - DNA, 22 bp, Homo sapiens
gcagggctcagccgctcccacc

SEQ ID NO: 9166557 - DNA, 22 bp, Homo sapiens
gcagggctcagccgctcccacc

SEQ ID NO: 9166558 - DNA, 22 bp, Homo sapiens
gcagggctcaacaggacacccc

SEQ ID NO: 9166559 - DNA, 20 bp, Homo sapiens
gcagtctgcctctgtgtggt

SEQ ID NO: 9166560 - DNA, 20 bp, Homo sapiens
gcagtctgcctctgtgtggt

SEQ ID NO: 9166561 - DNA, 22 bp, Homo sapiens
gcagtcttgccacagggtttca

SEQ ID NO: 9166562 - DNA, 22 bp, Homo sapiens
gcagtcttgccacagggtttca

SEQ ID NO: 9166563 - DNA, 22 bp, Homo sapiens
gcagtgaaacaataggatcaaa

SEQ ID NO: 9166564 - DNA, 22 bp, Homo sapiens
gcagtgaacataacacagaagg

SEQ ID NO: 9166565 - DNA, 18 bp, Homo sapiens
gcagtgaagaaagagctt

SEQ ID NO: 9166566 - DNA, 22 bp, Homo sapiens
gcagtgaaaaagtgcaccctgt

SEQ ID NO: 9166567 - DNA, 22 bp, Homo sapiens
gcagtctttgagtatcttcaaa

SEQ ID NO: 9166568 - DNA, 22 bp, Homo sapiens
gcagtctttttcttctagctaa

SEQ ID NO: 9166569 - DNA, 21 bp, Homo sapiens
gcagtcatcatcaagctttgg

SEQ ID NO: 9166570 - DNA, 22 bp, Homo sapiens
gccagcccctccatcctgttca

SEQ ID NO: 9166571 - DNA, 22 bp, Homo sapiens
gccagccccttagggctctccc

SEQ ID NO: 9166572 - DNA, 22 bp, Homo sapiens
gccagccccagacatcctatcg

SEQ ID NO: 9166573 - DNA, 22 bp, Homo sapiens
gccagcccattaacccctgtcc

SEQ ID NO: 9166574 - DNA, 22 bp, Homo sapiens
gccagcccagctccaggggaaa

SEQ ID NO: 9166575 - DNA, 22 bp, Homo sapiens
gccagccataggccagcactgg

SEQ ID NO: 9166576 - DNA, 21 bp, Homo sapiens
gccagccatgcttgcctaggc

SEQ ID NO: 9166577 - DNA, 21 bp, Homo sapiens
gccagccatgcttgcctaggc

SEQ ID NO: 9166578 - DNA, 22 bp, Homo sapiens
gccagcagtatgtcctggcagt

SEQ ID NO: 9166579 - DNA, 22 bp, Homo sapiens
gccagcagtccagtccttagtg

SEQ ID NO: 9166580 - DNA, 22 bp, Homo sapiens
gccagcagtccagtccttagtg

SEQ ID NO: 9166581 - DNA, 22 bp, Homo sapiens
gccagcagtcctgctgtgtgcc

SEQ ID NO: 9166582 - DNA, 22 bp, Homo sapiens
gccagcagtcctgctgtgtgcc

SEQ ID NO: 9166583 - DNA, 22 bp, Homo sapiens
gccagcagtcctgctgtgtgcc

SEQ ID NO: 9166584 - DNA, 22 bp, Homo sapiens
gccagcagtcctgctgtgtgcc

SEQ ID NO: 9166585 - DNA, 23 bp, Homo sapiens
gccagcatagatcattctgagta

SEQ ID NO: 9166586 - DNA, 22 bp, Homo sapiens
gccagcagtggccaccaccagg

SEQ ID NO: 9166587 - DNA, 22 bp, Homo sapiens
gccagcagtcctgctgtgtgcc

SEQ ID NO: 9166588 - DNA, 22 bp, Homo sapiens
gccagcatcctgcattagggtg

SEQ ID NO: 9166589 - DNA, 22 bp, Homo sapiens
gccagcatagtaagcagtcatc

SEQ ID NO: 9166590 - DNA, 22 bp, Homo sapiens
gccagcatagtaagcagtcatc

SEQ ID NO: 9166591 - DNA, 22 bp, Homo sapiens
gccagcattccttggctcctgg

SEQ ID NO: 9166592 - DNA, 22 bp, Homo sapiens
gccagcagggcccaaatgctgg

SEQ ID NO: 9166593 - DNA, 22 bp, Homo sapiens
gccagaggcccaaggacagctg

SEQ ID NO: 9166594 - DNA, 22 bp, Homo sapiens
gccagcagggcggagccatcta

SEQ ID NO: 9166595 - DNA, 22 bp, Homo sapiens
gccagcaggttgtcaaggagct

SEQ ID NO: 9166596 - DNA, 22 bp, Homo sapiens
gccagcaggttgtcaaggagct

SEQ ID NO: 9166597 - DNA, 22 bp, Homo sapiens
gccagcaggttgtcaaggagct

SEQ ID NO: 9166598 - DNA, 22 bp, Homo sapiens
gccagcaggttgtcaaggagct

SEQ ID NO: 9166599 - DNA, 22 bp, Homo sapiens
gccagcaggtggagagatcaag

SEQ ID NO: 9166600 - DNA, 22 bp, Homo sapiens
gccagcaggtggagagatcaag

SEQ ID NO: 9166601 - DNA, 22 bp, Homo sapiens
gccagcaggtggagagatcaag

SEQ ID NO: 9166602 - DNA, 23 bp, Homo sapiens
gccagaggaacgcagagctttct

SEQ ID NO: 9166603 - DNA, 22 bp, Homo sapiens
gccagagctgagacacgagtcc

SEQ ID NO: 9166604 - DNA, 22 bp, Homo sapiens
gccagagctgagtgaggttctt

SEQ ID NO: 9166605 - DNA, 22 bp, Homo sapiens
gccagagctgagtgaggttctt

SEQ ID NO: 9166606 - DNA, 22 bp, Homo sapiens
gccagagcttcccccgagtgtg

SEQ ID NO: 9166607 - DNA, 23 bp, Homo sapiens
gccagagctgcctgcccttgctg

SEQ ID NO: 9166608 - DNA, 22 bp, Homo sapiens
gccagagcacaggctggtagta

SEQ ID NO: 9166609 - DNA, 22 bp, Homo sapiens
gccagagcacaggctggtagta

SEQ ID NO: 9166610 - DNA, 22 bp, Homo sapiens
gccagagagagtccctgggcct

SEQ ID NO: 9166611 - DNA, 22 bp, Homo sapiens
gccagagcagaatagagtggcc

SEQ ID NO: 9166612 - DNA, 22 bp, Homo sapiens
gccagagcatcgcaccctccat

SEQ ID NO: 9166613 - DNA, 21 bp, Homo sapiens
gccagagcagtacaatgaggt

SEQ ID NO: 9166614 - DNA, 21 bp, Homo sapiens
gccagagcagtacaatgaggt

SEQ ID NO: 9166615 - DNA, 22 bp, Homo sapiens
gccagagccacttttgggtgat

SEQ ID NO: 9166616 - DNA, 22 bp, Homo sapiens
gccagagccggcttcacaggat

SEQ ID NO: 9166617 - DNA, 22 bp, Homo sapiens
gccagagcatgcactgcctgca

SEQ ID NO: 9166618 - DNA, 22 bp, Homo sapiens
gccaaggataccagctgtgaga

SEQ ID NO: 9166619 - DNA, 22 bp, Homo sapiens
gcatttttgatcccactaggat

SEQ ID NO: 9166620 - DNA, 22 bp, Homo sapiens
gcatttttgatcccactaggat

SEQ ID NO: 9166621 - DNA, 22 bp, Homo sapiens
gccaagctctttaaaggccaaa

SEQ ID NO: 9166622 - DNA, 22 bp, Homo sapiens
gcattttaatgaggtttatgag

SEQ ID NO: 9166623 - DNA, 22 bp, Homo sapiens
gcattttataaagagttatttg

SEQ ID NO: 9166624 - DNA, 22 bp, Homo sapiens
gcattttataaagagttatttg

SEQ ID NO: 9166625 - DNA, 22 bp, Homo sapiens
gcattttgaggctgggggagca

SEQ ID NO: 9166626 - DNA, 22 bp, Homo sapiens
gcatttttcatccctcttgggt

SEQ ID NO: 9166627 - DNA, 22 bp, Homo sapiens
gcatttttcatccctcttgggt

SEQ ID NO: 9166628 - DNA, 22 bp, Homo sapiens
gcatttttctctcctataggag

SEQ ID NO: 9166629 - DNA, 22 bp, Homo sapiens
gcatttttctctcctataggag

SEQ ID NO: 9166630 - DNA, 22 bp, Homo sapiens
gcatttgtgtggcggaaggatt

SEQ ID NO: 9166631 - DNA, 18 bp, Homo sapiens
gcattttaatctgaggca

SEQ ID NO: 9166632 - DNA, 22 bp, Homo sapiens
gcattttaataagattcatagg

SEQ ID NO: 9166633 - DNA, 22 bp, Homo sapiens
gcattttaataagattcatagg

SEQ ID NO: 9166634 - DNA, 22 bp, Homo sapiens
gcccaggctggagtgcagtggt

SEQ ID NO: 9166635 - DNA, 22 bp, Homo sapiens
gcccaggctggagtgcagtggt

SEQ ID NO: 9166636 - DNA, 22 bp, Homo sapiens
gcccagcaaggaccaagggccg

SEQ ID NO: 9166637 - DNA, 22 bp, Homo sapiens
gcccagagttcaaggctgcagt

SEQ ID NO: 9166638 - DNA, 22 bp, Homo sapiens
gcccagagtttgaagatacagt

SEQ ID NO: 9166639 - DNA, 22 bp, Homo sapiens
gcccagagttcaaggctgcagt

SEQ ID NO: 9166640 - DNA, 21 bp, Homo sapiens
gcccagagttaagcccaccca

SEQ ID NO: 9166641 - DNA, 22 bp, Homo sapiens
gcccagagtggccacttggctc

SEQ ID NO: 9166642 - DNA, 22 bp, Homo sapiens
gcccagggcgatggtcggggcc

SEQ ID NO: 9166643 - DNA, 22 bp, Homo sapiens
gcccagggcgatggtcggggcc

SEQ ID NO: 9166644 - DNA, 22 bp, Homo sapiens
gcccagggcgatggtcggggcc

SEQ ID NO: 9166645 - DNA, 22 bp, Homo sapiens
gcccagggctgcaagtggacgc

SEQ ID NO: 9166646 - DNA, 22 bp, Homo sapiens
gcccagggctgcaagtggacgc

SEQ ID NO: 9166647 - DNA, 22 bp, Homo sapiens
gcccaggctggagttcagtggt

SEQ ID NO: 9166648 - DNA, 23 bp, Homo sapiens
gcccagggactgggaatcagtgg

SEQ ID NO: 9166649 - DNA, 22 bp, Homo sapiens
gcccagggcagggcaagagtga

SEQ ID NO: 9166650 - DNA, 22 bp, Homo sapiens
gcccagggcagggcaagagtga

SEQ ID NO: 9166651 - DNA, 22 bp, Homo sapiens
gcccatcttctagcagctgtta

SEQ ID NO: 9166652 - DNA, 22 bp, Homo sapiens
gcccagtggtaaaagcaggcct

SEQ ID NO: 9166653 - DNA, 19 bp, Homo sapiens
gcccaggggcccgatgctg

SEQ ID NO: 9166654 - DNA, 22 bp, Homo sapiens
gcccagggcttcaaagagagaa

SEQ ID NO: 9166655 - DNA, 22 bp, Homo sapiens
gcccagggcttcaaagagagaa

SEQ ID NO: 9166656 - DNA, 22 bp, Homo sapiens
gcccagggcttcaaagagagaa

SEQ ID NO: 9166657 - DNA, 22 bp, Homo sapiens
gcccaggggagtagtcaattta

SEQ ID NO: 9166658 - DNA, 22 bp, Homo sapiens
gcccagggcttcaaagagagaa

SEQ ID NO: 9166659 - DNA, 22 bp, Homo sapiens
gcccaggggcagcgcatagtgg

SEQ ID NO: 9166660 - DNA, 22 bp, Homo sapiens
gcccaggggcagcgcatagtgg

SEQ ID NO: 9166661 - DNA, 22 bp, Homo sapiens
gccctctggtgggtgagccccg

SEQ ID NO: 9166662 - DNA, 18 bp, Homo sapiens
gccctctggctgctgatg

SEQ ID NO: 9166663 - DNA, 22 bp, Homo sapiens
gccctctggcagccttggctgg

SEQ ID NO: 9166664 - DNA, 23 bp, Homo sapiens
gcccatggagtctggatctggcc

SEQ ID NO: 9166665 - DNA, 22 bp, Homo sapiens
gcccatggcagaactgtgagca

SEQ ID NO: 9166666 - DNA, 22 bp, Homo sapiens
gcccatggacacccaagtgcca

SEQ ID NO: 9166667 - DNA, 22 bp, Homo sapiens
gcccatggacacccaagtgcca

SEQ ID NO: 9166668 - DNA, 22 bp, Homo sapiens
gcccatgctctcaggcgggcct

SEQ ID NO: 9166669 - DNA, 22 bp, Homo sapiens
gcctcagctcccagcccaggct

SEQ ID NO: 9166670 - DNA, 22 bp, Homo sapiens
gcctcagctgttgcaggggccc

SEQ ID NO: 9166671 - DNA, 22 bp, Homo sapiens
gcctcagctcccagcccaggct

SEQ ID NO: 9166672 - DNA, 22 bp, Homo sapiens
gcctcaggactggcatactcat

SEQ ID NO: 9166673 - DNA, 22 bp, Homo sapiens
gcctcagctgttgcaggggccc

SEQ ID NO: 9166674 - DNA, 20 bp, Homo sapiens
gcctcagccaacccatgggg

SEQ ID NO: 9166675 - DNA, 20 bp, Homo sapiens
gcctcagccaacccatgggg

SEQ ID NO: 9166676 - DNA, 22 bp, Homo sapiens
gcctcagctcccagcccaggct

SEQ ID NO: 9166677 - DNA, 22 bp, Homo sapiens
gcctcagctcccagcccaggct

SEQ ID NO: 9166678 - DNA, 20 bp, Homo sapiens
gcctcagccaacccatgggg

SEQ ID NO: 9166679 - DNA, 23 bp, Homo sapiens
gcctcagagaaacagctgcacac

SEQ ID NO: 9166680 - DNA, 22 bp, Homo sapiens
gcctcagaaagcttttattcat

SEQ ID NO: 9166681 - DNA, 22 bp, Homo sapiens
gcctagagaaaaagcctctgca

SEQ ID NO: 9166682 - DNA, 22 bp, Homo sapiens
gcctcagaaagcttttattcat

SEQ ID NO: 9166683 - DNA, 22 bp, Homo sapiens
gccctgaggggtggtgtctgta

SEQ ID NO: 9166684 - DNA, 22 bp, Homo sapiens
gccctgaggggtggtgtctgta

SEQ ID NO: 9166685 - DNA, 22 bp, Homo sapiens
gccctgagggtctgggttccca

SEQ ID NO: 9166686 - DNA, 20 bp, Homo sapiens
gcctaagagctagctgtcac

SEQ ID NO: 9166687 - DNA, 22 bp, Homo sapiens
gcctaaggatatgctttgcttg

SEQ ID NO: 9166688 - DNA, 22 bp, Homo sapiens
gccctgagccaccaatgccatt

SEQ ID NO: 9166689 - DNA, 22 bp, Homo sapiens
gccctgagcacacagtagcaaa

SEQ ID NO: 9166690 - DNA, 22 bp, Homo sapiens
gccctgagcctatgagcctctc

SEQ ID NO: 9166691 - DNA, 22 bp, Homo sapiens
gccctgagcctatgagcctctc

SEQ ID NO: 9166692 - DNA, 22 bp, Homo sapiens
gccctgagcctatgagcctctc

SEQ ID NO: 9166693 - DNA, 22 bp, Homo sapiens
gccctgaggcaaaagaacagtc

SEQ ID NO: 9166694 - DNA, 22 bp, Homo sapiens
gccctgagctagtgtgggcagg

SEQ ID NO: 9166695 - DNA, 22 bp, Homo sapiens
gccctgaattcctcaggctgtg

SEQ ID NO: 9166696 - DNA, 22 bp, Homo sapiens
gccctgaccttcactgactctc

SEQ ID NO: 9166697 - DNA, 22 bp, Homo sapiens
gccctgaataatagagtgggga

SEQ ID NO: 9166698 - DNA, 22 bp, Homo sapiens
gccctgaaggcagaggtggagc

SEQ ID NO: 9166699 - DNA, 22 bp, Homo sapiens
gccctgaacgaggggtctggag

SEQ ID NO: 9166700 - DNA, 22 bp, Homo sapiens
gccctgaacgaggggtctggag

SEQ ID NO: 9166701 - DNA, 22 bp, Homo sapiens
gccctgaagctgagggtgttaa

SEQ ID NO: 9166702 - DNA, 22 bp, Homo sapiens
gccctgagactgagcatgggtt

SEQ ID NO: 9166703 - DNA, 22 bp, Homo sapiens
gccctgagactgagcatgggtt

SEQ ID NO: 9166704 - DNA, 22 bp, Homo sapiens
gccctgagaatgtgtgtgtcta

SEQ ID NO: 9166705 - DNA, 22 bp, Homo sapiens
gcccagagagatgaagtgatgg

SEQ ID NO: 9166706 - DNA, 22 bp, Homo sapiens
gcccagagagatgctgtagacc

SEQ ID NO: 9166707 - DNA, 22 bp, Homo sapiens
gcccagaagtgactcagcactg

SEQ ID NO: 9166708 - DNA, 22 bp, Homo sapiens
gcccagaagttgaggctgcagt

SEQ ID NO: 9166709 - DNA, 22 bp, Homo sapiens
gcccagaacagtgtcacatgtc

SEQ ID NO: 9166710 - DNA, 21 bp, Homo sapiens
gcccagaagactggctctgcc

SEQ ID NO: 9166711 - DNA, 22 bp, Homo sapiens
gcccagaaagactgcctaacag

SEQ ID NO: 9166712 - DNA, 22 bp, Homo sapiens
gcccagaaatgaacttgctgtg

SEQ ID NO: 9166713 - DNA, 22 bp, Homo sapiens
gcccagagggaagaggtgtcat

SEQ ID NO: 9166714 - DNA, 21 bp, Homo sapiens
gcccagagggagccaagccca

SEQ ID NO: 9166715 - DNA, 21 bp, Homo sapiens
gcccagagggagccaagccca

SEQ ID NO: 9166716 - DNA, 23 bp, Homo sapiens
gcccagagaggctcaccaggaat

SEQ ID NO: 9166717 - DNA, 23 bp, Homo sapiens
gcccagagaggctcaccaggaat

SEQ ID NO: 9166718 - DNA, 18 bp, Homo sapiens
gcccagagccctcttatt

SEQ ID NO: 9166719 - DNA, 21 bp, Homo sapiens
gcccagagtcctcccactcca

SEQ ID NO: 9166720 - DNA, 18 bp, Homo sapiens
gcccagaggtctgggccc

SEQ ID NO: 9166721 - DNA, 21 bp, Homo sapiens
gcccagagtcctcccactcca

SEQ ID NO: 9166722 - DNA, 22 bp, Homo sapiens
gcccagagtgagtcctgggccc

SEQ ID NO: 9166723 - DNA, 22 bp, Homo sapiens
gccagtcagctggccaggctgg

SEQ ID NO: 9166724 - DNA, 22 bp, Homo sapiens
gccagtctccctcagtcctctg

SEQ ID NO: 9166725 - DNA, 22 bp, Homo sapiens
gccagtctgataggggagaagt

SEQ ID NO: 9166726 - DNA, 22 bp, Homo sapiens
gccagtctgctcccacaagttc

SEQ ID NO: 9166727 - DNA, 22 bp, Homo sapiens
gccagtctgctcccacaagttc

SEQ ID NO: 9166728 - DNA, 22 bp, Homo sapiens
gccaggttgctgacgacgatct

SEQ ID NO: 9166729 - DNA, 22 bp, Homo sapiens
gccaggttgctgacgacgatct

SEQ ID NO: 9166730 - DNA, 22 bp, Homo sapiens
gccagtgcttgtggagctggca

SEQ ID NO: 9166731 - DNA, 22 bp, Homo sapiens
gccagtgcttgtggagctggca

SEQ ID NO: 9166732 - DNA, 22 bp, Homo sapiens
gccagtggagactgaaacccat

SEQ ID NO: 9166733 - DNA, 18 bp, Homo sapiens
gccagtgccctggctcac

SEQ ID NO: 9166734 - DNA, 22 bp, Homo sapiens
gccagtgcctcgccgcgctcct

SEQ ID NO: 9166735 - DNA, 22 bp, Homo sapiens
gccagtgcctgctgctcagggc

SEQ ID NO: 9166736 - DNA, 21 bp, Homo sapiens
gccagtgctgtctgtgtgatc

SEQ ID NO: 9166737 - DNA, 22 bp, Homo sapiens
gccagtgcctgctgctcagggc

SEQ ID NO: 9166738 - DNA, 22 bp, Homo sapiens
gcccacaggtcctacctctttc

SEQ ID NO: 9166739 - DNA, 22 bp, Homo sapiens
gcccacaggtcctacctctttc

SEQ ID NO: 9166740 - DNA, 22 bp, Homo sapiens
gccagtggcatgcggcagggac

SEQ ID NO: 9166741 - DNA, 22 bp, Homo sapiens
gccagtggccctctggagaagg

SEQ ID NO: 9166742 - DNA, 22 bp, Homo sapiens
gccagtggcttgccaggcagga

SEQ ID NO: 9166743 - DNA, 22 bp, Homo sapiens
gccaggaatggagaggtggcct

SEQ ID NO: 9166744 - DNA, 22 bp, Homo sapiens
gccaggaatggagaggtggcct

SEQ ID NO: 9166745 - DNA, 22 bp, Homo sapiens
gccaggaatttcaagagccact

SEQ ID NO: 9166746 - DNA, 22 bp, Homo sapiens
gccaggacctcagatgcagggc

SEQ ID NO: 9166747 - DNA, 22 bp, Homo sapiens
gccaggaggctgctgtgtaggc

SEQ ID NO: 9166748 - DNA, 22 bp, Homo sapiens
gccaggagccagcttcttagca

SEQ ID NO: 9166749 - DNA, 22 bp, Homo sapiens
gccaggagagctccttcaggtt

SEQ ID NO: 9166750 - DNA, 22 bp, Homo sapiens
gccaggagaatgctagcagagg

SEQ ID NO: 9166751 - DNA, 22 bp, Homo sapiens
gccaggttctggggaggtacaa

SEQ ID NO: 9166752 - DNA, 22 bp, Homo sapiens
gccaggtgtcctcacagtgagg

SEQ ID NO: 9166753 - DNA, 22 bp, Homo sapiens
gccaggtgtagtggccacacct

SEQ ID NO: 9166754 - DNA, 22 bp, Homo sapiens
gccaggtcccctcatggctcct

SEQ ID NO: 9166755 - DNA, 22 bp, Homo sapiens
gccaggtgggagacagacagca

SEQ ID NO: 9166756 - DNA, 22 bp, Homo sapiens
gcacagccttgccctgtgccct

SEQ ID NO: 9166757 - DNA, 22 bp, Homo sapiens
gcacagccttgccctgtgccct

SEQ ID NO: 9166758 - DNA, 22 bp, Homo sapiens
gcacagccttgccctgtgccct

SEQ ID NO: 9166759 - DNA, 22 bp, Homo sapiens
gcacagcctgtccctgtcctgg

SEQ ID NO: 9166760 - DNA, 22 bp, Homo sapiens
gcacagccctgagcgcatgtct

SEQ ID NO: 9166761 - DNA, 22 bp, Homo sapiens
gcacagccagcatctgagggat

SEQ ID NO: 9166762 - DNA, 22 bp, Homo sapiens
gcacagccctggtcggggcccc

SEQ ID NO: 9166763 - DNA, 22 bp, Homo sapiens
gcacagccggaccgaggaaaag

SEQ ID NO: 9166764 - DNA, 22 bp, Homo sapiens
gcacagctatgagctgaattgt

SEQ ID NO: 9166765 - DNA, 18 bp, Homo sapiens
gcacagctaggagggtcc

SEQ ID NO: 9166766 - DNA, 22 bp, Homo sapiens
gcacagctatgagctgaattgt

SEQ ID NO: 9166767 - DNA, 18 bp, Homo sapiens
gcacagctaggagggtcc

SEQ ID NO: 9166768 - DNA, 22 bp, Homo sapiens
gcacagctagacggtagccaaa

SEQ ID NO: 9166769 - DNA, 22 bp, Homo sapiens
gcacagctccgcttcctcacac

SEQ ID NO: 9166770 - DNA, 22 bp, Homo sapiens
gcacagctcgagctcaggaggg

SEQ ID NO: 9166771 - DNA, 22 bp, Homo sapiens
gcacagctcctggtaagctggg

SEQ ID NO: 9166772 - DNA, 22 bp, Homo sapiens
gcacagctccgcttcctcacac

SEQ ID NO: 9166773 - DNA, 22 bp, Homo sapiens
gcacagctcagtactccctctg

SEQ ID NO: 9166774 - DNA, 22 bp, Homo sapiens
gcacagctcagcatgggaggac

SEQ ID NO: 9166775 - DNA, 22 bp, Homo sapiens
gcacagctcgagctcaggaggg

SEQ ID NO: 9166776 - DNA, 22 bp, Homo sapiens
gcacagctcgagctcaggaggg

SEQ ID NO: 9166777 - DNA, 22 bp, Homo sapiens
gcacagctctccccaagacgaa

SEQ ID NO: 9166778 - DNA, 22 bp, Homo sapiens
gcacagctctccccaagacgaa

SEQ ID NO: 9166779 - DNA, 20 bp, Homo sapiens
gcacagctgagttcagggtc

SEQ ID NO: 9166780 - DNA, 22 bp, Homo sapiens
gcacagctggactctgcctggc

SEQ ID NO: 9166781 - DNA, 22 bp, Homo sapiens
gcacagctggactctgcctggc

SEQ ID NO: 9166782 - DNA, 22 bp, Homo sapiens
gcacagctggggtatgatgcca

SEQ ID NO: 9166783 - DNA, 22 bp, Homo sapiens
gcacagcttcctctttctctga

SEQ ID NO: 9166784 - DNA, 22 bp, Homo sapiens
gcacaggcaatagatacagcta

SEQ ID NO: 9166785 - DNA, 22 bp, Homo sapiens
gcacaggcacagagggccactg

SEQ ID NO: 9166786 - DNA, 22 bp, Homo sapiens
gcacaggatgatgggttgaggg

SEQ ID NO: 9166787 - DNA, 22 bp, Homo sapiens
gcaagcttcatatggcattttc

SEQ ID NO: 9166788 - DNA, 22 bp, Homo sapiens
gcacagccactgagtgagaacc

SEQ ID NO: 9166789 - DNA, 22 bp, Homo sapiens
gcacagccacgtaatgtggtca

SEQ ID NO: 9166790 - DNA, 21 bp, Homo sapiens
gcacagcatgagtgttggcat

SEQ ID NO: 9166791 - DNA, 21 bp, Homo sapiens
gcacagcatgagtgttggcat

SEQ ID NO: 9166792 - DNA, 21 bp, Homo sapiens
gcacagcatgagtgttggcat

SEQ ID NO: 9166793 - DNA, 22 bp, Homo sapiens
gcacagcatgaagagaggaagc

SEQ ID NO: 9166794 - DNA, 22 bp, Homo sapiens
gcaagcagactgggcccctgtg

SEQ ID NO: 9166795 - DNA, 22 bp, Homo sapiens
gcaagcagactgggcccctgtg

SEQ ID NO: 9166796 - DNA, 22 bp, Homo sapiens
gcaagcagacattcaggtaggt

SEQ ID NO: 9166797 - DNA, 22 bp, Homo sapiens
gcaagctgctcttatgtggagg

SEQ ID NO: 9166798 - DNA, 22 bp, Homo sapiens
gcaagctgatgtgatagtgaaa

SEQ ID NO: 9166799 - DNA, 21 bp, Homo sapiens
gcaagccaccactgctgccac

SEQ ID NO: 9166800 - DNA, 22 bp, Homo sapiens
gagggtccctgctcagggccag

SEQ ID NO: 9166801 - DNA, 22 bp, Homo sapiens
gagggtccctgctcagggccag

SEQ ID NO: 9166802 - DNA, 22 bp, Homo sapiens
gagggtccccatgcagagctca

SEQ ID NO: 9166803 - DNA, 22 bp, Homo sapiens
gagggtccccatgcagagctca

SEQ ID NO: 9166804 - DNA, 22 bp, Homo sapiens
gagggtcccgagccctgtcaga

SEQ ID NO: 9166805 - DNA, 22 bp, Homo sapiens
gagggtcccgagccctgtcaga

SEQ ID NO: 9166806 - DNA, 21 bp, Homo sapiens
gcaaatgagttaactaactca

SEQ ID NO: 9166807 - DNA, 22 bp, Homo sapiens
gcaaatgagttgtaacataaaa

SEQ ID NO: 9166808 - DNA, 22 bp, Homo sapiens
gcaagaaaagagccttcagtgg

SEQ ID NO: 9166809 - DNA, 22 bp, Homo sapiens
gcaagatagagttgcaaatatt

SEQ ID NO: 9166810 - DNA, 22 bp, Homo sapiens
gcaagatggttataaaaaatgt

SEQ ID NO: 9166811 - DNA, 22 bp, Homo sapiens
gcaagacctatctagttgctgt

SEQ ID NO: 9166812 - DNA, 22 bp, Homo sapiens
gcaagacctatctagttgctgt

SEQ ID NO: 9166813 - DNA, 22 bp, Homo sapiens
gcaagacctatctagttgctgt

SEQ ID NO: 9166814 - DNA, 22 bp, Homo sapiens
gcaagattagaatcaactgtga

SEQ ID NO: 9166815 - DNA, 22 bp, Homo sapiens
gcaagatttacagacaacttcg

SEQ ID NO: 9166816 - DNA, 22 bp, Homo sapiens
gaggggctgggtagggcaaccc

SEQ ID NO: 9166817 - DNA, 22 bp, Homo sapiens
gaggggctgtggagctctctgg

SEQ ID NO: 9166818 - DNA, 22 bp, Homo sapiens
gagggggaaagtccctggagtc

SEQ ID NO: 9166819 - DNA, 22 bp, Homo sapiens
gagggggacgtatcctggtatg

SEQ ID NO: 9166820 - DNA, 22 bp, Homo sapiens
gagggggaaagtccctggagtc

SEQ ID NO: 9166821 - DNA, 22 bp, Homo sapiens
gagggggacgtatcctggtatg

SEQ ID NO: 9166822 - DNA, 22 bp, Homo sapiens
gagggggagatgtgcacacact

SEQ ID NO: 9166823 - DNA, 22 bp, Homo sapiens
gaggggtgtggagccatcagtt

SEQ ID NO: 9166824 - DNA, 22 bp, Homo sapiens
gaggggtggccctggcgtgtac

SEQ ID NO: 9166825 - DNA, 22 bp, Homo sapiens
gaggggtggcgttggcatttag

SEQ ID NO: 9166826 - DNA, 22 bp, Homo sapiens
gaggggtgggctggaagttata

SEQ ID NO: 9166827 - DNA, 22 bp, Homo sapiens
gaggggtccaggaggcacttac

SEQ ID NO: 9166828 - DNA, 22 bp, Homo sapiens
gaggggtccaggaggcacttac

SEQ ID NO: 9166829 - DNA, 22 bp, Homo sapiens
gagggggcgaacagaagcaagg

SEQ ID NO: 9166830 - DNA, 22 bp, Homo sapiens
gagggggagatgtgcacacact

SEQ ID NO: 9166831 - DNA, 22 bp, Homo sapiens
gcagaggacacaggagggcaag

SEQ ID NO: 9166832 - DNA, 22 bp, Homo sapiens
gcagaggacacaggagggcaag

SEQ ID NO: 9166833 - DNA, 22 bp, Homo sapiens
gcagaggacacaggagggcaag

SEQ ID NO: 9166834 - DNA, 22 bp, Homo sapiens
gcagaggacacaggagggcaag

SEQ ID NO: 9166835 - DNA, 21 bp, Homo sapiens
gcagaggaatggtatacataa

SEQ ID NO: 9166836 - DNA, 22 bp, Homo sapiens
gcagagctgcagcgaggcctgg

SEQ ID NO: 9166837 - DNA, 22 bp, Homo sapiens
gcagagctctgttcttatctcc

SEQ ID NO: 9166838 - DNA, 22 bp, Homo sapiens
gcagagctgagcggctgcccgg

SEQ ID NO: 9166839 - DNA, 22 bp, Homo sapiens
gcagagctccccaagacaccaa

SEQ ID NO: 9166840 - DNA, 22 bp, Homo sapiens
gcacttggagggagggttcaag

SEQ ID NO: 9166841 - DNA, 22 bp, Homo sapiens
gcagaggagcaagctggacacc

SEQ ID NO: 9166842 - DNA, 22 bp, Homo sapiens
gcagaggagcaagctggacacc

SEQ ID NO: 9166843 - DNA, 22 bp, Homo sapiens
gcagaggagatgaagatacttt

SEQ ID NO: 9166844 - DNA, 22 bp, Homo sapiens
gcagaggagatgaagatacttt

SEQ ID NO: 9166845 - DNA, 22 bp, Homo sapiens
gcagaggacagggatttagatt

SEQ ID NO: 9166846 - DNA, 22 bp, Homo sapiens
gcagaggacagggatttagatt

SEQ ID NO: 9166847 - DNA, 22 bp, Homo sapiens
gcactgggctccaggaaggagg

SEQ ID NO: 9166848 - DNA, 23 bp, Homo sapiens
gcactgggctctcagcaaggtgt

SEQ ID NO: 9166849 - DNA, 22 bp, Homo sapiens
gcactgggctccaggaaggagg

SEQ ID NO: 9166850 - DNA, 22 bp, Homo sapiens
gcactgggaatgtgagcagctg

SEQ ID NO: 9166851 - DNA, 22 bp, Homo sapiens
gcactgggaatgtgagcagctg

SEQ ID NO: 9166852 - DNA, 22 bp, Homo sapiens
gcactgggagctgcctgccggt

SEQ ID NO: 9166853 - DNA, 22 bp, Homo sapiens
gcactgggagctgcctgccggt

SEQ ID NO: 9166854 - DNA, 22 bp, Homo sapiens
gcactgggaatgctgatgggct

SEQ ID NO: 9166855 - DNA, 22 bp, Homo sapiens
gcactgggaatgctgatgggct

SEQ ID NO: 9166856 - DNA, 22 bp, Homo sapiens
gcacttccatctgtcaccaggt

SEQ ID NO: 9166857 - DNA, 21 bp, Homo sapiens
gcacttctgcagggctgctgg

SEQ ID NO: 9166858 - DNA, 22 bp, Homo sapiens
gcactgtgctagaagccagggg

SEQ ID NO: 9166859 - DNA, 22 bp, Homo sapiens
gcacttagggtatgtactgggc

SEQ ID NO: 9166860 - DNA, 22 bp, Homo sapiens
gcactgagagctttattctaga

SEQ ID NO: 9166861 - DNA, 22 bp, Homo sapiens
gcacctgggacccagaggcacc

SEQ ID NO: 9166862 - DNA, 22 bp, Homo sapiens
gcacctgggcaaggattcagag

SEQ ID NO: 9166863 - DNA, 22 bp, Homo sapiens
gcacaggccatgggaggacagc

SEQ ID NO: 9166864 - DNA, 22 bp, Homo sapiens
gcacaggccatgggaggacagc

SEQ ID NO: 9166865 - DNA, 22 bp, Homo sapiens
gcactggacaggagtgaaatta

SEQ ID NO: 9166866 - DNA, 22 bp, Homo sapiens
gcactggaaggagggaatctta

SEQ ID NO: 9166867 - DNA, 22 bp, Homo sapiens
gcactggaaatacctagatgaa

SEQ ID NO: 9166868 - DNA, 23 bp, Homo sapiens
gcactggaaaaatgaagattact

SEQ ID NO: 9166869 - DNA, 22 bp, Homo sapiens
gcactgctccaggtgtggcttg

SEQ ID NO: 9166870 - DNA, 22 bp, Homo sapiens
gcactggaccccaggatatgga

SEQ ID NO: 9166871 - DNA, 22 bp, Homo sapiens
gcactggagaatggctgtattc

SEQ ID NO: 9166872 - DNA, 22 bp, Homo sapiens
gcactggagatacagagatgaa

SEQ ID NO: 9166873 - DNA, 22 bp, Homo sapiens
gcactggagatacagagatgaa

SEQ ID NO: 9166874 - DNA, 22 bp, Homo sapiens
gcactggagggtgtagttgctg

SEQ ID NO: 9166875 - DNA, 22 bp, Homo sapiens
gcactggagatggggttgtcgg

SEQ ID NO: 9166876 - DNA, 22 bp, Homo sapiens
gcactggatcttgggagacgtg

SEQ ID NO: 9166877 - DNA, 22 bp, Homo sapiens
gcactggattttgatctgcaag

SEQ ID NO: 9166878 - DNA, 22 bp, Homo sapiens
gcactggccgcacgcgtagggc

SEQ ID NO: 9166879 - DNA, 22 bp, Homo sapiens
gcactgggaatgagggcagctt

SEQ ID NO: 9166880 - DNA, 22 bp, Homo sapiens
gcactgggaagaatgagcctgt

SEQ ID NO: 9166881 - DNA, 22 bp, Homo sapiens
gcactgagtctgtcatgctgca

SEQ ID NO: 9166882 - DNA, 22 bp, Homo sapiens
gcactgctatttagctccatca

SEQ ID NO: 9166883 - DNA, 22 bp, Homo sapiens
gcagggctagatatttgcaagt

SEQ ID NO: 9166884 - DNA, 22 bp, Homo sapiens
gcagggccttagcagcggctgc

SEQ ID NO: 9166885 - DNA, 22 bp, Homo sapiens
gcagggccttagcagcggctgc

SEQ ID NO: 9166886 - DNA, 20 bp, Homo sapiens
gcagggcgacacgggggagg

SEQ ID NO: 9166887 - DNA, 22 bp, Homo sapiens
gcagggccttagcagcggctgc

SEQ ID NO: 9166888 - DNA, 22 bp, Homo sapiens
gcagggccttagcagcggctgc

SEQ ID NO: 9166889 - DNA, 22 bp, Homo sapiens
gcaggctcttctttctgcccag

SEQ ID NO: 9166890 - DNA, 22 bp, Homo sapiens
gcaggctgagagtccaagaagg

SEQ ID NO: 9166891 - DNA, 22 bp, Homo sapiens
gcaggctgaaactcggggtcta

SEQ ID NO: 9166892 - DNA, 22 bp, Homo sapiens
gcaggctgagagtccaagaagg

SEQ ID NO: 9166893 - DNA, 22 bp, Homo sapiens
gcaggctgagtattaccctagt

SEQ ID NO: 9166894 - DNA, 22 bp, Homo sapiens
gcaggctgagttgggaaaccaa

SEQ ID NO: 9166895 - DNA, 22 bp, Homo sapiens
gcaggctccaggccggcccctt

SEQ ID NO: 9166896 - DNA, 20 bp, Homo sapiens
gcaggctccgggcttgggag

SEQ ID NO: 9166897 - DNA, 22 bp, Homo sapiens
gcaggctcaaaagctggtagga

SEQ ID NO: 9166898 - DNA, 22 bp, Homo sapiens
gcaggaggttgagccaggactg

SEQ ID NO: 9166899 - DNA, 22 bp, Homo sapiens
gcaggagtatgcagctatggtt

SEQ ID NO: 9166900 - DNA, 22 bp, Homo sapiens
gcaggagtcccagaaggttttg

SEQ ID NO: 9166901 - DNA, 22 bp, Homo sapiens
gcaggagtgacatggatgtgga

SEQ ID NO: 9166902 - DNA, 22 bp, Homo sapiens
gcaggcctctgttgagggcctt

SEQ ID NO: 9166903 - DNA, 22 bp, Homo sapiens
gcaggcctctaattcaccgcag

SEQ ID NO: 9166904 - DNA, 22 bp, Homo sapiens
gcaggagtgtatttgcatgtaa

SEQ ID NO: 9166905 - DNA, 22 bp, Homo sapiens
gcaggaggatcacttgagccca

SEQ ID NO: 9166906 - DNA, 22 bp, Homo sapiens
gcaggaggccaggtatgcttta

SEQ ID NO: 9166907 - DNA, 22 bp, Homo sapiens
gcaggaggagcattaactgagc

SEQ ID NO: 9166908 - DNA, 22 bp, Homo sapiens
gcagctggcccctttccttgtt

SEQ ID NO: 9166909 - DNA, 22 bp, Homo sapiens
gcagctggcccctttccttgtt

SEQ ID NO: 9166910 - DNA, 22 bp, Homo sapiens
gcagctggcccctttccttgtt

SEQ ID NO: 9166911 - DNA, 22 bp, Homo sapiens
gcagctggacccacacggctta

SEQ ID NO: 9166912 - DNA, 22 bp, Homo sapiens
gcagctggagcatcttctcatc

SEQ ID NO: 9166913 - DNA, 22 bp, Homo sapiens
gcagctggagcatcttctcatc

SEQ ID NO: 9166914 - DNA, 22 bp, Homo sapiens
gcagctggagccagccagacac

SEQ ID NO: 9166915 - DNA, 22 bp, Homo sapiens
gcagctggagccagccagacac

SEQ ID NO: 9166916 - DNA, 22 bp, Homo sapiens
gcagctggagcatcttctcatc

SEQ ID NO: 9166917 - DNA, 22 bp, Homo sapiens
gcagctggatttcaagagggag

SEQ ID NO: 9166918 - DNA, 22 bp, Homo sapiens
gcagctggatttcaagagggag

SEQ ID NO: 9166919 - DNA, 22 bp, Homo sapiens
gcagcatattgtactggcctgc

SEQ ID NO: 9166920 - DNA, 22 bp, Homo sapiens
gcagcatcaatccatgcttctc

SEQ ID NO: 9166921 - DNA, 22 bp, Homo sapiens
gcagcatcaggttcactgcgtg

SEQ ID NO: 9166922 - DNA, 22 bp, Homo sapiens
gcagcatccccaggcagcaggg

SEQ ID NO: 9166923 - DNA, 22 bp, Homo sapiens
gcagcatcaggttcactgcgtg

SEQ ID NO: 9166924 - DNA, 22 bp, Homo sapiens
gcagcatcctgggccacagtcc

SEQ ID NO: 9166925 - DNA, 22 bp, Homo sapiens
gcagcatcctgggccacagtcc

SEQ ID NO: 9166926 - DNA, 22 bp, Homo sapiens
gcagcatccttggcctccaccc

SEQ ID NO: 9166927 - DNA, 22 bp, Homo sapiens
gcagcatctagggcactggcct

SEQ ID NO: 9166928 - DNA, 22 bp, Homo sapiens
gcagcatctgtacatagacgct

SEQ ID NO: 9166929 - DNA, 22 bp, Homo sapiens
gcagcatctagggcactggcct

SEQ ID NO: 9166930 - DNA, 22 bp, Homo sapiens
gcagcatgttgaaagggccaca

SEQ ID NO: 9166931 - DNA, 22 bp, Homo sapiens
gcagcattgcacttttgttctt

SEQ ID NO: 9166932 - DNA, 22 bp, Homo sapiens
gcagcattaccaagacatggca

SEQ ID NO: 9166933 - DNA, 22 bp, Homo sapiens
gcagcagtggtctgtagaagga

SEQ ID NO: 9166934 - DNA, 22 bp, Homo sapiens
gcagcagtggctgcaggtccca

SEQ ID NO: 9166935 - DNA, 22 bp, Homo sapiens
gcagcagtactcaatatcctgg

SEQ ID NO: 9166936 - DNA, 22 bp, Homo sapiens
gcagcaggtgtgcttttaatga

SEQ ID NO: 9166937 - DNA, 20 bp, Homo sapiens
gcagcagtgcaagtcctctt

SEQ ID NO: 9166938 - DNA, 22 bp, Homo sapiens
gcagctgcagagaccgggtggg

SEQ ID NO: 9166939 - DNA, 22 bp, Homo sapiens
gcagctgcaggcaggcttgctg

SEQ ID NO: 9166940 - DNA, 22 bp, Homo sapiens
gcagctgccgtgagctcacgcc

SEQ ID NO: 9166941 - DNA, 22 bp, Homo sapiens
gcagctgccgtgagctcacgcc

SEQ ID NO: 9166942 - DNA, 22 bp, Homo sapiens
gcagctgccccgactgtgagtc

SEQ ID NO: 9166943 - DNA, 22 bp, Homo sapiens
gcagctgccccgactgtgagtc

SEQ ID NO: 9166944 - DNA, 22 bp, Homo sapiens
gcagcattgtgaggtcctgccc

SEQ ID NO: 9166945 - DNA, 22 bp, Homo sapiens
gcagcatttctcaaagggtggt

SEQ ID NO: 9166946 - DNA, 22 bp, Homo sapiens
gcagcattgtgaggtcctgccc

SEQ ID NO: 9166947 - DNA, 22 bp, Homo sapiens
gcagcatttgtggaatgggccc

SEQ ID NO: 9166948 - DNA, 22 bp, Homo sapiens
gcagccaagaccccaagaactg

SEQ ID NO: 9166949 - DNA, 22 bp, Homo sapiens
gcagccaagccatgaggactac

SEQ ID NO: 9166950 - DNA, 23 bp, Homo sapiens
gcagccaagagaccagggcaggc

SEQ ID NO: 9166951 - DNA, 22 bp, Homo sapiens
gcagccacagaggagggatgca

SEQ ID NO: 9166952 - DNA, 22 bp, Homo sapiens
gcagctgcaagcacttctggca

SEQ ID NO: 9166953 - DNA, 22 bp, Homo sapiens
gcagctgcaagcacttctggca

SEQ ID NO: 9166954 - DNA, 22 bp, Homo sapiens
gcagctgcaataggcatcaagc

SEQ ID NO: 9166955 - DNA, 22 bp, Homo sapiens
gcagcagctcagttctgggagg

SEQ ID NO: 9166956 - DNA, 22 bp, Homo sapiens
gcagcagctccctatccaggct

SEQ ID NO: 9166957 - DNA, 22 bp, Homo sapiens
gcagcagctcagttctgggagg

SEQ ID NO: 9166958 - DNA, 22 bp, Homo sapiens
gcagcagctcagttctgggagg

SEQ ID NO: 9166959 - DNA, 22 bp, Homo sapiens
gcagcagctcagccgggcactg

SEQ ID NO: 9166960 - DNA, 22 bp, Homo sapiens
gcagcagctcagccgggcactg

SEQ ID NO: 9166961 - DNA, 22 bp, Homo sapiens
gcagcagctcagccgggcactg

SEQ ID NO: 9166962 - DNA, 22 bp, Homo sapiens
gcagcagctcagttctgggagg

SEQ ID NO: 9166963 - DNA, 22 bp, Homo sapiens
gcagcagctctgaatgggcccc

SEQ ID NO: 9166964 - DNA, 22 bp, Homo sapiens
gcagcagctctcaaagtggtct

SEQ ID NO: 9166965 - DNA, 22 bp, Homo sapiens
gcagcagctctcaaagtggtct

SEQ ID NO: 9166966 - DNA, 22 bp, Homo sapiens
gcagcagctccctatccaggct

SEQ ID NO: 9166967 - DNA, 23 bp, Homo sapiens
gcagaggagcaagctggacacca

SEQ ID NO: 9166968 - DNA, 23 bp, Homo sapiens
gcagaggagcaagctggacacca

SEQ ID NO: 9166969 - DNA, 23 bp, Homo sapiens
gcagaggagcaagctggacacca

SEQ ID NO: 9166970 - DNA, 22 bp, Homo sapiens
gcagaggaggacccaggaatta

SEQ ID NO: 9166971 - DNA, 22 bp, Homo sapiens
gcagaggagcaagttgctacag

SEQ ID NO: 9166972 - DNA, 22 bp, Homo sapiens
gcagcagcggggcccctgcgcg

SEQ ID NO: 9166973 - DNA, 22 bp, Homo sapiens
gcagcagccgacatggattgca

SEQ ID NO: 9166974 - DNA, 22 bp, Homo sapiens
gcagcagcccagggctctcaga

SEQ ID NO: 9166975 - DNA, 22 bp, Homo sapiens
gcagaggaggacccaggaatta

SEQ ID NO: 9166976 - DNA, 22 bp, Homo sapiens
gcagcaggaataggataagcaa

SEQ ID NO: 9166977 - DNA, 22 bp, Homo sapiens
gcagcaggaatttaaatttata

SEQ ID NO: 9166978 - DNA, 22 bp, Homo sapiens
gcagcaggaatttaaatttata

SEQ ID NO: 9166979 - DNA, 22 bp, Homo sapiens
gcagcagctgacagtgggtgcc

SEQ ID NO: 9166980 - DNA, 22 bp, Homo sapiens
gcagcaggagagtaatagcggt

SEQ ID NO: 9166981 - DNA, 22 bp, Homo sapiens
gcagcaggagagtaatagcggt

SEQ ID NO: 9166982 - DNA, 22 bp, Homo sapiens
gcagcaggactgccgttaaagt

SEQ ID NO: 9166983 - DNA, 22 bp, Homo sapiens
gcagcaggcacggtctcgacat

SEQ ID NO: 9166984 - DNA, 22 bp, Homo sapiens
gcagcaggtctgtcaatgtcat

SEQ ID NO: 9166985 - DNA, 22 bp, Homo sapiens
gcagcaggtctgtcaatgtcat

SEQ ID NO: 9166986 - DNA, 22 bp, Homo sapiens
gcagcaggtctgtcaatgtcat

SEQ ID NO: 9166987 - DNA, 22 bp, Homo sapiens
gcagcaggagagtttgtcctgc

SEQ ID NO: 9166988 - DNA, 22 bp, Homo sapiens
gcagcaggatggccaattgcca

SEQ ID NO: 9166989 - DNA, 22 bp, Homo sapiens
gcggggggaggaacatcttgca

SEQ ID NO: 9166990 - DNA, 22 bp, Homo sapiens
gcggggggaggaacatcttgca

SEQ ID NO: 9166991 - DNA, 22 bp, Homo sapiens
gctatcccaccaaggtcccagt

SEQ ID NO: 9166992 - DNA, 22 bp, Homo sapiens
gctatcttcatggaaatacagg

SEQ ID NO: 9166993 - DNA, 22 bp, Homo sapiens
gctatctttctgcaccataatt

SEQ ID NO: 9166994 - DNA, 22 bp, Homo sapiens
gcgggggcagactgggcagttc

SEQ ID NO: 9166995 - DNA, 22 bp, Homo sapiens
gcggggccatgtccaacggcct

SEQ ID NO: 9166996 - DNA, 22 bp, Homo sapiens
gctcaagggatgggagtgggtg

SEQ ID NO: 9166997 - DNA, 22 bp, Homo sapiens
gctcaagccttctgcccacctc

SEQ ID NO: 9166998 - DNA, 22 bp, Homo sapiens
gctcaagccttctgcccacctc

SEQ ID NO: 9166999 - DNA, 22 bp, Homo sapiens
gctcacagtacagtgctggctc

SEQ ID NO: 9167000 - DNA, 22 bp, Homo sapiens
gctcacagccggctggcagggg

SEQ ID NO: 9167001 - DNA, 22 bp, Homo sapiens
gctcacaggcagtgttgggaga

SEQ ID NO: 9167002 - DNA, 22 bp, Homo sapiens
gctcacagccggctggcagggg

SEQ ID NO: 9167003 - DNA, 22 bp, Homo sapiens
gctcaggcccagcggctggtgt

SEQ ID NO: 9167004 - DNA, 22 bp, Homo sapiens
gctcagctgggaccaatgtgtt

SEQ ID NO: 9167005 - DNA, 22 bp, Homo sapiens
gctcaccactgctagagtctat

SEQ ID NO: 9167006 - DNA, 22 bp, Homo sapiens
gcggcaggaagagcgcagcccc

SEQ ID NO: 9167007 - DNA, 18 bp, Homo sapiens
gcgctggctgtcctgtcc

SEQ ID NO: 9167008 - DNA, 22 bp, Homo sapiens
gcgctgcctctgctctccccac

SEQ ID NO: 9167009 - DNA, 22 bp, Homo sapiens
gcggggacagaaggcggttctc

SEQ ID NO: 9167010 - DNA, 18 bp, Homo sapiens
gcgggcggtgcagtgggc

SEQ ID NO: 9167011 - DNA, 22 bp, Homo sapiens
gcgggccaccttggagagcgct

SEQ ID NO: 9167012 - DNA, 22 bp, Homo sapiens
gcgggccaccttggagagcgct

SEQ ID NO: 9167013 - DNA, 22 bp, Homo sapiens
gcgggccaccttggagagcgct

SEQ ID NO: 9167014 - DNA, 22 bp, Homo sapiens
gcggccttgtggcggagcaggc

SEQ ID NO: 9167015 - DNA, 22 bp, Homo sapiens
gcggctgccgagacaagccggt

SEQ ID NO: 9167016 - DNA, 22 bp, Homo sapiens
gcgggaagaacgaccaggctcg

SEQ ID NO: 9167017 - DNA, 22 bp, Homo sapiens
gcggcggcggtcattgagcatg

SEQ ID NO: 9167018 - DNA, 22 bp, Homo sapiens
gcggcggagacagcaggaagcc

SEQ ID NO: 9167019 - DNA, 22 bp, Homo sapiens
gcgccccatctacagtactttt

SEQ ID NO: 9167020 - DNA, 22 bp, Homo sapiens
gcgccctccacccacagcggct

SEQ ID NO: 9167021 - DNA, 22 bp, Homo sapiens
gcgactgtacagaattgcccct

SEQ ID NO: 9167022 - DNA, 22 bp, Homo sapiens
gcgcgcggggcatcagtggccg

SEQ ID NO: 9167023 - DNA, 22 bp, Homo sapiens
gcgcctgccaccatgccaggct

SEQ ID NO: 9167024 - DNA, 22 bp, Homo sapiens
gcgaaaaatgtgtaaatatgtt

SEQ ID NO: 9167025 - DNA, 22 bp, Homo sapiens
gcgaagggtcctcactagatgc

SEQ ID NO: 9167026 - DNA, 22 bp, Homo sapiens
gcgaatctcagctggtgctgcg

SEQ ID NO: 9167027 - DNA, 22 bp, Homo sapiens
gccttctgtgctcctggccttt

SEQ ID NO: 9167028 - DNA, 22 bp, Homo sapiens
gccttcttcttgcaagggaatg

SEQ ID NO: 9167029 - DNA, 22 bp, Homo sapiens
gccttccacctaggcctctgct

SEQ ID NO: 9167030 - DNA, 22 bp, Homo sapiens
gccttctctgtgagctcctagg

SEQ ID NO: 9167031 - DNA, 22 bp, Homo sapiens
gccttattacctgcactttgaa

SEQ ID NO: 9167032 - DNA, 22 bp, Homo sapiens
gcctggtgctatgagggccagc

SEQ ID NO: 9167033 - DNA, 22 bp, Homo sapiens
gcctggggggcatgtcataata

SEQ ID NO: 9167034 - DNA, 22 bp, Homo sapiens
gcctggggtctctgactcacag

SEQ ID NO: 9167035 - DNA, 22 bp, Homo sapiens
gcctggggcatgcagctgatac

SEQ ID NO: 9167036 - DNA, 21 bp, Homo sapiens
gcctggcttcacaggcactga

SEQ ID NO: 9167037 - DNA, 21 bp, Homo sapiens
gcctggcttcacaggcactga

SEQ ID NO: 9167038 - DNA, 23 bp, Homo sapiens
gcctggcttccaaggtaggggag

SEQ ID NO: 9167039 - DNA, 21 bp, Homo sapiens
gcctggcttcacaggcactga

SEQ ID NO: 9167040 - DNA, 22 bp, Homo sapiens
gcctggcttcccttggagcatt

SEQ ID NO: 9167041 - DNA, 22 bp, Homo sapiens
gcctggcttgccagccctggcg

SEQ ID NO: 9167042 - DNA, 22 bp, Homo sapiens
gcctggcttgccagccctggcg

SEQ ID NO: 9167043 - DNA, 22 bp, Homo sapiens
gcctggcttgccagccctggcg

SEQ ID NO: 9167044 - DNA, 22 bp, Homo sapiens
gcctggcttggggctcagtggt

SEQ ID NO: 9167045 - DNA, 22 bp, Homo sapiens
gcctggggaacttgatcctgtc

SEQ ID NO: 9167046 - DNA, 22 bp, Homo sapiens
gcctggcttggggctcagtggt

SEQ ID NO: 9167047 - DNA, 22 bp, Homo sapiens
gcctggctgtctggcaaggttc

SEQ ID NO: 9167048 - DNA, 22 bp, Homo sapiens
gcctggctgtcaaacccagaag

SEQ ID NO: 9167049 - DNA, 22 bp, Homo sapiens
gcctggctgtctggcaaggttc

SEQ ID NO: 9167050 - DNA, 22 bp, Homo sapiens
gcctggctggtcactgcctggc

SEQ ID NO: 9167051 - DNA, 22 bp, Homo sapiens
gcctggctggtcactgcctggc

SEQ ID NO: 9167052 - DNA, 22 bp, Homo sapiens
gcctggctggtcactgcctggc

SEQ ID NO: 9167053 - DNA, 22 bp, Homo sapiens
gcctggctggtcactgcctggc

SEQ ID NO: 9167054 - DNA, 19 bp, Homo sapiens
gcctggctgggatgagccc

SEQ ID NO: 9167055 - DNA, 22 bp, Homo sapiens
gcctggctgcttagcctacttc

SEQ ID NO: 9167056 - DNA, 22 bp, Homo sapiens
gcctggctgcttagcctacttc

SEQ ID NO: 9167057 - DNA, 19 bp, Homo sapiens
gcctggctgggatgagccc

SEQ ID NO: 9167058 - DNA, 22 bp, Homo sapiens
gcctggctgggcaccaggggag

SEQ ID NO: 9167059 - DNA, 22 bp, Homo sapiens
gcctggctgggctgaatgctta

SEQ ID NO: 9167060 - DNA, 22 bp, Homo sapiens
gcctggctggtagagggggctc

SEQ ID NO: 9167061 - DNA, 22 bp, Homo sapiens
gcctggctgggctgaatgctta

SEQ ID NO: 9167062 - DNA, 22 bp, Homo sapiens
gcctggctagttagtgtcaggt

SEQ ID NO: 9167063 - DNA, 21 bp, Homo sapiens
gcctggctagaagctcctagc

SEQ ID NO: 9167064 - DNA, 22 bp, Homo sapiens
gcctggctatggcctcccccat

SEQ ID NO: 9167065 - DNA, 22 bp, Homo sapiens
gcctggctagttagtgtcaggt

SEQ ID NO: 9167066 - DNA, 22 bp, Homo sapiens
gcctggctagttagtgtcaggt

SEQ ID NO: 9167067 - DNA, 18 bp, Homo sapiens
gcctggctgccaacccag

SEQ ID NO: 9167068 - DNA, 22 bp, Homo sapiens
gcctggctgccggccttggcaa

SEQ ID NO: 9167069 - DNA, 22 bp, Homo sapiens
gcctggctgctagccagaggca

SEQ ID NO: 9167070 - DNA, 22 bp, Homo sapiens
gcctggctgccggccttggcaa

SEQ ID NO: 9167071 - DNA, 22 bp, Homo sapiens
gcctggctgctcagccactcac

SEQ ID NO: 9167072 - DNA, 22 bp, Homo sapiens
gcctggctgctagccagaggca

SEQ ID NO: 9167073 - DNA, 22 bp, Homo sapiens
gcctggctgctggttctgagga

SEQ ID NO: 9167074 - DNA, 22 bp, Homo sapiens
gcctggctgctggttctgagga

SEQ ID NO: 9167075 - DNA, 22 bp, Homo sapiens
gcctggctgctggttctgagga

SEQ ID NO: 9167076 - DNA, 22 bp, Homo sapiens
gcctggctgctcagccactcac

SEQ ID NO: 9167077 - DNA, 22 bp, Homo sapiens
gcctggctgctcagccactcac

SEQ ID NO: 9167078 - DNA, 22 bp, Homo sapiens
gcctcaggcctatagctgctgt

SEQ ID NO: 9167079 - DNA, 22 bp, Homo sapiens
gcctcaggcctatagctgctgt

SEQ ID NO: 9167080 - DNA, 22 bp, Homo sapiens
gcctcagggataggatgagcat

SEQ ID NO: 9167081 - DNA, 21 bp, Homo sapiens
gcctggctagaagctcctagc

SEQ ID NO: 9167082 - DNA, 22 bp, Homo sapiens
gcctggctacccactgaaatat

SEQ ID NO: 9167083 - DNA, 22 bp, Homo sapiens
gcctggctacccactgaaatat

SEQ ID NO: 9167084 - DNA, 22 bp, Homo sapiens
gcctggctaattttggtatttt

SEQ ID NO: 9167085 - DNA, 22 bp, Homo sapiens
gctccttcaggtggtagctgtt

SEQ ID NO: 9167086 - DNA, 22 bp, Homo sapiens
gctccttcaggtggtagctgtt

SEQ ID NO: 9167087 - DNA, 22 bp, Homo sapiens
gctctcagaagagccaggctac

SEQ ID NO: 9167088 - DNA, 22 bp, Homo sapiens
gctctcaagtccttttgctcag

SEQ ID NO: 9167089 - DNA, 22 bp, Homo sapiens
gctctcactttaggttggaccg

SEQ ID NO: 9167090 - DNA, 22 bp, Homo sapiens
gctcctggtgctgtagagattt

SEQ ID NO: 9167091 - DNA, 21 bp, Homo sapiens
gctcctggtgctgcgtggcgc

SEQ ID NO: 9167092 - DNA, 21 bp, Homo sapiens
gctcctggtgctgcgtggcgc

SEQ ID NO: 9167093 - DNA, 21 bp, Homo sapiens
gctcctggtgctgcgtggcgc

SEQ ID NO: 9167094 - DNA, 22 bp, Homo sapiens
gctcctgtcttggggcactggc

SEQ ID NO: 9167095 - DNA, 22 bp, Homo sapiens
gctcaggctctcccaggggaat

SEQ ID NO: 9167096 - DNA, 21 bp, Homo sapiens
gctcaggctcttgacagagca

SEQ ID NO: 9167097 - DNA, 22 bp, Homo sapiens
gctcaggctctcccaggggaat

SEQ ID NO: 9167098 - DNA, 22 bp, Homo sapiens
gctcaggctctcccaggggaat

SEQ ID NO: 9167099 - DNA, 21 bp, Homo sapiens
gctcaggctcaggttcaggtt

SEQ ID NO: 9167100 - DNA, 22 bp, Homo sapiens
gctcaggcctccagaggggcaa

SEQ ID NO: 9167101 - DNA, 22 bp, Homo sapiens
gctcaggcctggcccatgggac

SEQ ID NO: 9167102 - DNA, 22 bp, Homo sapiens
gctcaggcctggcccatgggac

SEQ ID NO: 9167103 - DNA, 22 bp, Homo sapiens
gctcaggcctccagaggggcaa

SEQ ID NO: 9167104 - DNA, 22 bp, Homo sapiens
gctcaggcttcttctataaaga

SEQ ID NO: 9167105 - DNA, 22 bp, Homo sapiens
gctcagggaaagagctcctgtc

SEQ ID NO: 9167106 - DNA, 22 bp, Homo sapiens
gctcagggaaagagctcctgtc

SEQ ID NO: 9167107 - DNA, 19 bp, Homo sapiens
gctcaggctgtgtgtgggg

SEQ ID NO: 9167108 - DNA, 22 bp, Homo sapiens
gctcaggctggattgcagtggc

SEQ ID NO: 9167109 - DNA, 22 bp, Homo sapiens
gctcaggctggattgcagtggc

SEQ ID NO: 9167110 - DNA, 22 bp, Homo sapiens
gctcctggtctggagcttcaag

SEQ ID NO: 9167111 - DNA, 22 bp, Homo sapiens
gctcctggtgcaaagtttcttc

SEQ ID NO: 9167112 - DNA, 22 bp, Homo sapiens
gctcctggtctggagcttcaag

SEQ ID NO: 9167113 - DNA, 22 bp, Homo sapiens
gctctccaaaccctgtggcttt

SEQ ID NO: 9167114 - DNA, 21 bp, Homo sapiens
gctctcagctgcctgctggtt

SEQ ID NO: 9167115 - DNA, 22 bp, Homo sapiens
gctctgctctaacattcctgac

SEQ ID NO: 9167116 - DNA, 22 bp, Homo sapiens
gctctgctccctcaaatgacat

SEQ ID NO: 9167117 - DNA, 22 bp, Homo sapiens
gctctgcctttgtcttacacgg

SEQ ID NO: 9167118 - DNA, 22 bp, Homo sapiens
gctctggcagctgatattagga

SEQ ID NO: 9167119 - DNA, 22 bp, Homo sapiens
gctctggcactggcgcgggatg

SEQ ID NO: 9167120 - DNA, 22 bp, Homo sapiens
gctctggcactggcgcgggatg

SEQ ID NO: 9167121 - DNA, 23 bp, Homo sapiens
gctctggcagcttgtgtcagcac

SEQ ID NO: 9167122 - DNA, 22 bp, Homo sapiens
gctctgctgcttactagatggt

SEQ ID NO: 9167123 - DNA, 22 bp, Homo sapiens
gctctgctgatccgcagccatc

SEQ ID NO: 9167124 - DNA, 22 bp, Homo sapiens
gctctgctgaagccccttgcat

SEQ ID NO: 9167125 - DNA, 22 bp, Homo sapiens
gctctggctactccaccctgtt

SEQ ID NO: 9167126 - DNA, 22 bp, Homo sapiens
gctctggccagaccctcagtgg

SEQ ID NO: 9167127 - DNA, 21 bp, Homo sapiens
gctctggcctactgttccctc

SEQ ID NO: 9167128 - DNA, 22 bp, Homo sapiens
gctctggcccaaaccctttcta

SEQ ID NO: 9167129 - DNA, 22 bp, Homo sapiens
gctctggctactgtggctaccg

SEQ ID NO: 9167130 - DNA, 22 bp, Homo sapiens
gctgaagagacttctgttcgaa

SEQ ID NO: 9167131 - DNA, 22 bp, Homo sapiens
gctgatggaaggacaggcgccg

SEQ ID NO: 9167132 - DNA, 22 bp, Homo sapiens
gctgatgtaagacttttggttt

SEQ ID NO: 9167133 - DNA, 22 bp, Homo sapiens
gctgatgggagctggctcaccc

SEQ ID NO: 9167134 - DNA, 22 bp, Homo sapiens
gctgatgtttagttgatgttac

SEQ ID NO: 9167135 - DNA, 22 bp, Homo sapiens
gctgaataggcacagagggcat

SEQ ID NO: 9167136 - DNA, 22 bp, Homo sapiens
gctgatagactgaatgttggga

SEQ ID NO: 9167137 - DNA, 22 bp, Homo sapiens
gctgatagactgaatgttggga

SEQ ID NO: 9167138 - DNA, 19 bp, Homo sapiens
gctgcacacccagcaactg

SEQ ID NO: 9167139 - DNA, 22 bp, Homo sapiens
gctgcaagttagtatacattct

SEQ ID NO: 9167140 - DNA, 22 bp, Homo sapiens
gctgcacttgagcctgggagaa

SEQ ID NO: 9167141 - DNA, 22 bp, Homo sapiens
gctgcaaacctgccacctggtg

SEQ ID NO: 9167142 - DNA, 21 bp, Homo sapiens
gctgcaaattctaacaattat

SEQ ID NO: 9167143 - DNA, 22 bp, Homo sapiens
gctgaagttttgcagagagtaa

SEQ ID NO: 9167144 - DNA, 22 bp, Homo sapiens
gctgaagtttatgtcttctttt

SEQ ID NO: 9167145 - DNA, 22 bp, Homo sapiens
gctgaagttgcctattttaata

SEQ ID NO: 9167146 - DNA, 22 bp, Homo sapiens
gctgaagttgaatattctggga

SEQ ID NO: 9167147 - DNA, 22 bp, Homo sapiens
gctgaagtcctaatcccaagta

SEQ ID NO: 9167148 - DNA, 16 bp, Homo sapiens
gctgaagtgagtatag

SEQ ID NO: 9167149 - DNA, 22 bp, Homo sapiens
gctgaagtctgagaatttgcaa

SEQ ID NO: 9167150 - DNA, 22 bp, Homo sapiens
gctgaagtgtggagtgacagtt

SEQ ID NO: 9167151 - DNA, 22 bp, Homo sapiens
gctgaagtgcttttgaatttgg

SEQ ID NO: 9167152 - DNA, 22 bp, Homo sapiens
gctgaagtggcgtgatcagaat

SEQ ID NO: 9167153 - DNA, 22 bp, Homo sapiens
gctgaagtaactcacatcgtta

SEQ ID NO: 9167154 - DNA, 22 bp, Homo sapiens
gctgaaggtctctggagaggtc

SEQ ID NO: 9167155 - DNA, 22 bp, Homo sapiens
gctgaaggcccggaggacaggg

SEQ ID NO: 9167156 - DNA, 22 bp, Homo sapiens
gctgaaggcccggaggacaggg

SEQ ID NO: 9167157 - DNA, 19 bp, Homo sapiens
gctgaaggcgctcagaagc

SEQ ID NO: 9167158 - DNA, 22 bp, Homo sapiens
gctgaagggagtgctgagtctg

SEQ ID NO: 9167159 - DNA, 20 bp, Homo sapiens
gctgaagattcccatgcaag

SEQ ID NO: 9167160 - DNA, 22 bp, Homo sapiens
gctgccagttccttcttactcc

SEQ ID NO: 9167161 - DNA, 22 bp, Homo sapiens
gctgccagttccttcttactcc

SEQ ID NO: 9167162 - DNA, 22 bp, Homo sapiens
gctgccatcagagttcaggaat

SEQ ID NO: 9167163 - DNA, 22 bp, Homo sapiens
gctgccagtgtggcatgatgca

SEQ ID NO: 9167164 - DNA, 22 bp, Homo sapiens
gctgccagtgtggcatgatgca

SEQ ID NO: 9167165 - DNA, 22 bp, Homo sapiens
gctgccagtgtggcatgatgca

SEQ ID NO: 9167166 - DNA, 20 bp, Homo sapiens
gctgccagtgcctgatgctt

SEQ ID NO: 9167167 - DNA, 20 bp, Homo sapiens
gctgccagtgcctgatgctt

SEQ ID NO: 9167168 - DNA, 22 bp, Homo sapiens
gctgccagtagttggagctcca

SEQ ID NO: 9167169 - DNA, 22 bp, Homo sapiens
gctgccagtagttggagctcca

SEQ ID NO: 9167170 - DNA, 22 bp, Homo sapiens
gctgccagtagttggagctcca

SEQ ID NO: 9167171 - DNA, 20 bp, Homo sapiens
gctgccagggcggagacatc

SEQ ID NO: 9167172 - DNA, 22 bp, Homo sapiens
gctgccagggaggtggtggagg

SEQ ID NO: 9167173 - DNA, 22 bp, Homo sapiens
gctgccaggggcagctgtctca

SEQ ID NO: 9167174 - DNA, 22 bp, Homo sapiens
gctgccagcgtcagacctgggg

SEQ ID NO: 9167175 - DNA, 22 bp, Homo sapiens
gctgccagctcactctcctgag

SEQ ID NO: 9167176 - DNA, 22 bp, Homo sapiens
gctgccagctcactctcctgag

SEQ ID NO: 9167177 - DNA, 22 bp, Homo sapiens
gctgccagctgcggcccacgcg

SEQ ID NO: 9167178 - DNA, 22 bp, Homo sapiens
gctgccagccagggtgggatcc

SEQ ID NO: 9167179 - DNA, 22 bp, Homo sapiens
gctgccagcccagcaaggtgtg

SEQ ID NO: 9167180 - DNA, 22 bp, Homo sapiens
gctgccagccagggtgggatcc

SEQ ID NO: 9167181 - DNA, 22 bp, Homo sapiens
gctgccagcgtcagacctgggg

SEQ ID NO: 9167182 - DNA, 22 bp, Homo sapiens
gctgccagctttccttggctga

SEQ ID NO: 9167183 - DNA, 22 bp, Homo sapiens
gctgccagctttccttggctga

SEQ ID NO: 9167184 - DNA, 22 bp, Homo sapiens
gctgccaggacggagaggagcg

SEQ ID NO: 9167185 - DNA, 22 bp, Homo sapiens
gctgccaggacggagaggagcg

SEQ ID NO: 9167186 - DNA, 19 bp, Homo sapiens
gctgccaggacagttactg

SEQ ID NO: 9167187 - DNA, 22 bp, Homo sapiens
gctgccagggaggtggtggagg

SEQ ID NO: 9167188 - DNA, 22 bp, Homo sapiens
gctgccaggacggagaggagcg

SEQ ID NO: 9167189 - DNA, 21 bp, Homo sapiens
gctgccaggattttgcaggaa

SEQ ID NO: 9167190 - DNA, 22 bp, Homo sapiens
gctgcagactgggaggcaggtg

SEQ ID NO: 9167191 - DNA, 22 bp, Homo sapiens
gctgcagaatttccttctcatt

SEQ ID NO: 9167192 - DNA, 22 bp, Homo sapiens
gctgcagactgggaggcaggtg

SEQ ID NO: 9167193 - DNA, 22 bp, Homo sapiens
gctgcaggagctggagctgtgg

SEQ ID NO: 9167194 - DNA, 22 bp, Homo sapiens
gctgcagctttaggatccagtg

SEQ ID NO: 9167195 - DNA, 22 bp, Homo sapiens
gctgcagctttaggatccagtg

SEQ ID NO: 9167196 - DNA, 22 bp, Homo sapiens
gctgcagctttaggatccagtg

SEQ ID NO: 9167197 - DNA, 22 bp, Homo sapiens
gctgccactctgagcttgcttc

SEQ ID NO: 9167198 - DNA, 22 bp, Homo sapiens
gctgccagaagaggaggggtta

SEQ ID NO: 9167199 - DNA, 22 bp, Homo sapiens
gctgccagcacacaggtgttag

SEQ ID NO: 9167200 - DNA, 22 bp, Homo sapiens
gctgccagcacagttcagctgt

SEQ ID NO: 9167201 - DNA, 22 bp, Homo sapiens
gctgccacgatctctgctgtag

SEQ ID NO: 9167202 - DNA, 22 bp, Homo sapiens
gctgccagccaacttgctgtgc

SEQ ID NO: 9167203 - DNA, 22 bp, Homo sapiens
gctgccagccaacttgctgtgc

SEQ ID NO: 9167204 - DNA, 22 bp, Homo sapiens
gctgccagcacagttcagctgt

SEQ ID NO: 9167205 - DNA, 22 bp, Homo sapiens
gctgccagcacagttcagctgt

SEQ ID NO: 9167206 - DNA, 22 bp, Homo sapiens
gctgcaggatgaggctctgctc

SEQ ID NO: 9167207 - DNA, 22 bp, Homo sapiens
gctgcagggggtgggcgtctcc

SEQ ID NO: 9167208 - DNA, 22 bp, Homo sapiens
gctgcagggggtgggcgtctcc

SEQ ID NO: 9167209 - DNA, 22 bp, Homo sapiens
gctgcaggttgggcaacagagt

SEQ ID NO: 9167210 - DNA, 22 bp, Homo sapiens
gctgcagggggtgggcgtctcc

SEQ ID NO: 9167211 - DNA, 22 bp, Homo sapiens
gctgcaggttgggcaacagagt

SEQ ID NO: 9167212 - DNA, 22 bp, Homo sapiens
gctgtcttggaaaaggcaaaga

SEQ ID NO: 9167213 - DNA, 22 bp, Homo sapiens
gctgtcttgctcactcttgcag

SEQ ID NO: 9167214 - DNA, 22 bp, Homo sapiens
gctgtcttgggtagaaagaggt

SEQ ID NO: 9167215 - DNA, 22 bp, Homo sapiens
gctgtcttgggtagaaagaggt

SEQ ID NO: 9167216 - DNA, 22 bp, Homo sapiens
gctgtcttgatgattggatgct

SEQ ID NO: 9167217 - DNA, 22 bp, Homo sapiens
gctgtcttgatgattggatgct

SEQ ID NO: 9167218 - DNA, 22 bp, Homo sapiens
gctgtcttgctcactcttgcag

SEQ ID NO: 9167219 - DNA, 22 bp, Homo sapiens
gctgtcttgctcactcttgcag

SEQ ID NO: 9167220 - DNA, 22 bp, Homo sapiens
gctgtctttcccctgctccaga

SEQ ID NO: 9167221 - DNA, 22 bp, Homo sapiens
gctgtcttttcctggcagtaaa

SEQ ID NO: 9167222 - DNA, 22 bp, Homo sapiens
gctgtcttttcctggcagtaaa

SEQ ID NO: 9167223 - DNA, 22 bp, Homo sapiens
gctgtcttgtatgttgtaggac

SEQ ID NO: 9167224 - DNA, 22 bp, Homo sapiens
gctgtctttcccctgctccaga

SEQ ID NO: 9167225 - DNA, 22 bp, Homo sapiens
gctgtgagcactgctgggtgga

SEQ ID NO: 9167226 - DNA, 22 bp, Homo sapiens
gctgtgagaaacagggagtgtc

SEQ ID NO: 9167227 - DNA, 22 bp, Homo sapiens
gctgtgagccgctgctgagcat

SEQ ID NO: 9167228 - DNA, 22 bp, Homo sapiens
gctgtgagcactgctgggtgga

SEQ ID NO: 9167229 - DNA, 22 bp, Homo sapiens
gctgtgagccgctgctgagcat

SEQ ID NO: 9167230 - DNA, 22 bp, Homo sapiens
gctgtgagctgcctgtgtcaca

SEQ ID NO: 9167231 - DNA, 21 bp, Homo sapiens
gctgtgcacatagtagaagtg

SEQ ID NO: 9167232 - DNA, 23 bp, Homo sapiens
gctgtgcacgagccactgcctgt

SEQ ID NO: 9167233 - DNA, 22 bp, Homo sapiens
gctgtgagggtctagtgaggtg

SEQ ID NO: 9167234 - DNA, 22 bp, Homo sapiens
gctgtgagtggaggaggctgag

SEQ ID NO: 9167235 - DNA, 22 bp, Homo sapiens
gctgtgagtggaggaggctgag

SEQ ID NO: 9167236 - DNA, 22 bp, Homo sapiens
gctgtgagtggaggaggctgag

SEQ ID NO: 9167237 - DNA, 22 bp, Homo sapiens
gctgtgcagccaagtgcctctg

SEQ ID NO: 9167238 - DNA, 21 bp, Homo sapiens
gctgtgcaggattgaaagcag

SEQ ID NO: 9167239 - DNA, 22 bp, Homo sapiens
gctgtgcagtagtaggtacagt

SEQ ID NO: 9167240 - DNA, 22 bp, Homo sapiens
gctgtgcaggtccccactgcct

SEQ ID NO: 9167241 - DNA, 22 bp, Homo sapiens
gctgtgcatggagggccgttca

SEQ ID NO: 9167242 - DNA, 22 bp, Homo sapiens
gctgtgcattgagcctgagagt

SEQ ID NO: 9167243 - DNA, 22 bp, Homo sapiens
gcttccagtcctcagaggctgg

SEQ ID NO: 9167244 - DNA, 22 bp, Homo sapiens
gcttccagtcctcagaggctgg

SEQ ID NO: 9167245 - DNA, 22 bp, Homo sapiens
gcttccagtcctcagaggctgg

SEQ ID NO: 9167246 - DNA, 22 bp, Homo sapiens
gcttccagtaagttgctgccat

SEQ ID NO: 9167247 - DNA, 22 bp, Homo sapiens
gcttcccaaacttgtggataga

SEQ ID NO: 9167248 - DNA, 22 bp, Homo sapiens
gcttccagtaagttgctgccat

SEQ ID NO: 9167249 - DNA, 21 bp, Homo sapiens
gcttccaagatggcaccttga

SEQ ID NO: 9167250 - DNA, 22 bp, Homo sapiens
gcttcatttgagaacctctgtg

SEQ ID NO: 9167251 - DNA, 22 bp, Homo sapiens
gctgggttttcttccgggccta

SEQ ID NO: 9167252 - DNA, 22 bp, Homo sapiens
gctgggttttcttccgggccta

SEQ ID NO: 9167253 - DNA, 22 bp, Homo sapiens
gctgggtgtcacggggctcgtg

SEQ ID NO: 9167254 - DNA, 22 bp, Homo sapiens
gctgggtgtcacggggctcgtg

SEQ ID NO: 9167255 - DNA, 22 bp, Homo sapiens
gctgggtgtcacggggctcgtg

SEQ ID NO: 9167256 - DNA, 22 bp, Homo sapiens
gctgggtttccagcaggcagga

SEQ ID NO: 9167257 - DNA, 22 bp, Homo sapiens
gctggtagacctcactgcactc

SEQ ID NO: 9167258 - DNA, 22 bp, Homo sapiens
gctggtagacctcactgcactc

SEQ ID NO: 9167259 - DNA, 22 bp, Homo sapiens
gctgtcttcacttcctggtttc

SEQ ID NO: 9167260 - DNA, 22 bp, Homo sapiens
gctgtcttccttgctccaaggg

SEQ ID NO: 9167261 - DNA, 22 bp, Homo sapiens
gctgtcttccttgctccaaggg

SEQ ID NO: 9167262 - DNA, 22 bp, Homo sapiens
gctgtcttgatgattggatgct

SEQ ID NO: 9167263 - DNA, 22 bp, Homo sapiens
gctggtcactctgggagctgct

SEQ ID NO: 9167264 - DNA, 22 bp, Homo sapiens
gctgggtcctatgctggtagag

SEQ ID NO: 9167265 - DNA, 22 bp, Homo sapiens
gctgggtctctccctggtcctg

SEQ ID NO: 9167266 - DNA, 22 bp, Homo sapiens
gctgggtctctccctggtcctg

SEQ ID NO: 9167267 - DNA, 22 bp, Homo sapiens
gctgggtctggctgtgagccgg

SEQ ID NO: 9167268 - DNA, 22 bp, Homo sapiens
gctgggtgtcacggggctcgtg

SEQ ID NO: 9167269 - DNA, 19 bp, Homo sapiens
gctgggtggggtccacagc

SEQ ID NO: 9167270 - DNA, 22 bp, Homo sapiens
gctgggtggatcggaggctctg

SEQ ID NO: 9167271 - DNA, 22 bp, Homo sapiens
gctgggtggatcggaggctctg

SEQ ID NO: 9167272 - DNA, 22 bp, Homo sapiens
gctgggtggatcggaggctctg

SEQ ID NO: 9167273 - DNA, 22 bp, Homo sapiens
gctgggtggatcggaggctctg

SEQ ID NO: 9167274 - DNA, 22 bp, Homo sapiens
gctgggtggatcggaggctctg

SEQ ID NO: 9167275 - DNA, 22 bp, Homo sapiens
gctggggtctgtgaggagggct

SEQ ID NO: 9167276 - DNA, 22 bp, Homo sapiens
gctggggtctgtgaggagggct

SEQ ID NO: 9167277 - DNA, 22 bp, Homo sapiens
gctggggtctgtgaggagggct

SEQ ID NO: 9167278 - DNA, 22 bp, Homo sapiens
gctggggtctgtgaggagggct

SEQ ID NO: 9167279 - DNA, 22 bp, Homo sapiens
gctggggtgtggtggataagct

SEQ ID NO: 9167280 - DNA, 18 bp, Homo sapiens
gctggggttgagctctcc

SEQ ID NO: 9167281 - DNA, 22 bp, Homo sapiens
gctgggtcagaatctccctgtg

SEQ ID NO: 9167282 - DNA, 22 bp, Homo sapiens
gctgggtcagaatctccctgtg

SEQ ID NO: 9167283 - DNA, 21 bp, Homo sapiens
gctgggtcagcaggtcctctg

SEQ ID NO: 9167284 - DNA, 18 bp, Homo sapiens
gctggggttgagctctcc

SEQ ID NO: 9167285 - DNA, 22 bp, Homo sapiens
gctgggtcagaatctccctgtg

SEQ ID NO: 9167286 - DNA, 21 bp, Homo sapiens
gctgggtcagcaggtcctctg

SEQ ID NO: 9167287 - DNA, 21 bp, Homo sapiens
gctgggtcagcaggtcctctg

SEQ ID NO: 9167288 - DNA, 22 bp, Homo sapiens
gctgggtccatggtcctcgggt

SEQ ID NO: 9167289 - DNA, 22 bp, Homo sapiens
gctgggtcccaagcctggggag

SEQ ID NO: 9167290 - DNA, 22 bp, Homo sapiens
gctgggtccatggtcctcgggt

SEQ ID NO: 9167291 - DNA, 16 bp, Homo sapiens
gctgggagggagaggt

SEQ ID NO: 9167292 - DNA, 22 bp, Homo sapiens
gctgggagtcgcgtctgtggcc

SEQ ID NO: 9167293 - DNA, 22 bp, Homo sapiens
gctgggaggcagcacctttagc

SEQ ID NO: 9167294 - DNA, 22 bp, Homo sapiens
gctgggaggatctctccctgtc

SEQ ID NO: 9167295 - DNA, 16 bp, Homo sapiens
gctgggagggagaggt

SEQ ID NO: 9167296 - DNA, 22 bp, Homo sapiens
gctgggagtcgcgtctgtggcc

SEQ ID NO: 9167297 - DNA, 22 bp, Homo sapiens
gctggggctgggctgaggaaga

SEQ ID NO: 9167298 - DNA, 20 bp, Homo sapiens
gctgggggtgtgctgagtga

SEQ ID NO: 9167299 - DNA, 22 bp, Homo sapiens
gctgggacaacaggtgagcacc

SEQ ID NO: 9167300 - DNA, 22 bp, Homo sapiens
gctgggactgagacagtgacct

SEQ ID NO: 9167301 - DNA, 22 bp, Homo sapiens
gctgggacggctcagtaagaag

SEQ ID NO: 9167302 - DNA, 22 bp, Homo sapiens
gctgggacaggcttggccctgt

SEQ ID NO: 9167303 - DNA, 20 bp, Homo sapiens
gctgggacgcccggtccgga

SEQ ID NO: 9167304 - DNA, 22 bp, Homo sapiens
gctgggaagagatgcacatgat

SEQ ID NO: 9167305 - DNA, 22 bp, Homo sapiens
gctgggaagagatgcacatgat

SEQ ID NO: 9167306 - DNA, 22 bp, Homo sapiens
gctgggagaggcagctttcgga

SEQ ID NO: 9167307 - DNA, 22 bp, Homo sapiens
gctgggagaggccctgaagtga

SEQ ID NO: 9167308 - DNA, 22 bp, Homo sapiens
gctgggagacagacttggaacc

SEQ ID NO: 9167309 - DNA, 22 bp, Homo sapiens
gctgggagacagacttggaacc

SEQ ID NO: 9167310 - DNA, 22 bp, Homo sapiens
gctgggagaggccctgaagtga

SEQ ID NO: 9167311 - DNA, 22 bp, Homo sapiens
gctgggagaggccctgaagtga

SEQ ID NO: 9167312 - DNA, 22 bp, Homo sapiens
gctgggagcaaagccatgcata

SEQ ID NO: 9167313 - DNA, 22 bp, Homo sapiens
gctgggaggatctctccctgtc

SEQ ID NO: 9167314 - DNA, 22 bp, Homo sapiens
gctgggaggatctctccctgtc

SEQ ID NO: 9167315 - DNA, 18 bp, Homo sapiens
gctggctgcacttctgct

SEQ ID NO: 9167316 - DNA, 22 bp, Homo sapiens
gctggctgcacaggggctcact

SEQ ID NO: 9167317 - DNA, 22 bp, Homo sapiens
gctggctgagttctgtcgtctg

SEQ ID NO: 9167318 - DNA, 22 bp, Homo sapiens
gctggctgcagattttagaggt

SEQ ID NO: 9167319 - DNA, 18 bp, Homo sapiens
gctggctgcacttctgct

SEQ ID NO: 9167320 - DNA, 22 bp, Homo sapiens
gctggctgccaatttcagagct

SEQ ID NO: 9167321 - DNA, 22 bp, Homo sapiens
gctggctctgcacccaggcctc

SEQ ID NO: 9167322 - DNA, 22 bp, Homo sapiens
gctggctctgatgggctccagg

SEQ ID NO: 9167323 - DNA, 22 bp, Homo sapiens
gctggctctgatgggctccagg

SEQ ID NO: 9167324 - DNA, 22 bp, Homo sapiens
gctggctctgccccacctgttc

SEQ ID NO: 9167325 - DNA, 22 bp, Homo sapiens
gctggctctgcacccaggcctc

SEQ ID NO: 9167326 - DNA, 22 bp, Homo sapiens
gctggctctgcacccaggcctc

SEQ ID NO: 9167327 - DNA, 22 bp, Homo sapiens
gctggctctgtggtagttggca

SEQ ID NO: 9167328 - DNA, 22 bp, Homo sapiens
gctggctctgccccacctgttc

SEQ ID NO: 9167329 - DNA, 22 bp, Homo sapiens
gctggctcctctgtcctcacgg

SEQ ID NO: 9167330 - DNA, 22 bp, Homo sapiens
gctggctcctctgtcctcacgg

SEQ ID NO: 9167331 - DNA, 22 bp, Homo sapiens
gctggctcggatttgaacagga

SEQ ID NO: 9167332 - DNA, 22 bp, Homo sapiens
gctggctcccattggtccttcc

SEQ ID NO: 9167333 - DNA, 22 bp, Homo sapiens
gctggctctacatttgaggtca

SEQ ID NO: 9167334 - DNA, 22 bp, Homo sapiens
gctggctctacatttgaggtca

SEQ ID NO: 9167335 - DNA, 22 bp, Homo sapiens
gctggctcgggaagcaggggat

SEQ ID NO: 9167336 - DNA, 22 bp, Homo sapiens
gctggcacacagtacacgcctt

SEQ ID NO: 9167337 - DNA, 22 bp, Homo sapiens
gctggcacatggctcagggcct

SEQ ID NO: 9167338 - DNA, 22 bp, Homo sapiens
gctggcactgggaaggactgag

SEQ ID NO: 9167339 - DNA, 22 bp, Homo sapiens
gctgccatggcctcctgcaagg

SEQ ID NO: 9167340 - DNA, 22 bp, Homo sapiens
gctgccatgccacagcactcac

SEQ ID NO: 9167341 - DNA, 22 bp, Homo sapiens
gctggattggagcaatagagtc

SEQ ID NO: 9167342 - DNA, 22 bp, Homo sapiens
gctggatttagggttccctcct

SEQ ID NO: 9167343 - DNA, 22 bp, Homo sapiens
gctggcagactgggggcagaac

SEQ ID NO: 9167344 - DNA, 22 bp, Homo sapiens
gctggcagactgggggcagaac

SEQ ID NO: 9167345 - DNA, 22 bp, Homo sapiens
gctggcagacttcctctggaac

SEQ ID NO: 9167346 - DNA, 22 bp, Homo sapiens
gctggctcccagaggccccagc

SEQ ID NO: 9167347 - DNA, 22 bp, Homo sapiens
gctggctcccagaggccccagc

SEQ ID NO: 9167348 - DNA, 22 bp, Homo sapiens
gctggctcccagaggccccagc

SEQ ID NO: 9167349 - DNA, 22 bp, Homo sapiens
gctggctccaaaagcaggggct

SEQ ID NO: 9167350 - DNA, 22 bp, Homo sapiens
gctggctcagggactagagttt

SEQ ID NO: 9167351 - DNA, 22 bp, Homo sapiens
gctggctcaagtgtgcttccca

SEQ ID NO: 9167352 - DNA, 22 bp, Homo sapiens
gctggctcaagtgtgcttccca

SEQ ID NO: 9167353 - DNA, 22 bp, Homo sapiens
gctggcagggacagctgcgtgt

SEQ ID NO: 9167354 - DNA, 22 bp, Homo sapiens
gctggcagggacagctgcgtgt

SEQ ID NO: 9167355 - DNA, 21 bp, Homo sapiens
gctggctcaaatgcttgtgtc

SEQ ID NO: 9167356 - DNA, 22 bp, Homo sapiens
gctggctcaagaggtccagagg

SEQ ID NO: 9167357 - DNA, 22 bp, Homo sapiens
gctggctcaagaggtccagagg

SEQ ID NO: 9167358 - DNA, 22 bp, Homo sapiens
gctggcaggagcctttcccttt

SEQ ID NO: 9167359 - DNA, 22 bp, Homo sapiens
gctggcaggagaaacggggtgc

SEQ ID NO: 9167360 - DNA, 20 bp, Homo sapiens
ggaagctgtgggtccccagg

SEQ ID NO: 9167361 - DNA, 22 bp, Homo sapiens
ggaagcttcatacctttattta

SEQ ID NO: 9167362 - DNA, 22 bp, Homo sapiens
ggaagcccagctgtctcctgtc

SEQ ID NO: 9167363 - DNA, 22 bp, Homo sapiens
ggaagccatgagggacagttct

SEQ ID NO: 9167364 - DNA, 22 bp, Homo sapiens
ggaagccataccctgatttctg

SEQ ID NO: 9167365 - DNA, 22 bp, Homo sapiens
ggaagccatgagggacagttct

SEQ ID NO: 9167366 - DNA, 22 bp, Homo sapiens
ggaagccagttgcttggtgtgg

SEQ ID NO: 9167367 - DNA, 22 bp, Homo sapiens
ggaagccagttgcttggtgtgg

SEQ ID NO: 9167368 - DNA, 22 bp, Homo sapiens
ggaagccaggttactgttcaga

SEQ ID NO: 9167369 - DNA, 19 bp, Homo sapiens
ggaagccctaaaggaccta

SEQ ID NO: 9167370 - DNA, 19 bp, Homo sapiens
ggaagccctgggtcagagc

SEQ ID NO: 9167371 - DNA, 17 bp, Homo sapiens
ggaagcccttctgcctg

SEQ ID NO: 9167372 - DNA, 22 bp, Homo sapiens
ggaagccccagcatggccttgg

SEQ ID NO: 9167373 - DNA, 22 bp, Homo sapiens
ggaagccccagctgtgggatcc

SEQ ID NO: 9167374 - DNA, 22 bp, Homo sapiens
ggaagccccagacccagagtct

SEQ ID NO: 9167375 - DNA, 22 bp, Homo sapiens
ggaaggaacaaaccctgtgtgg

SEQ ID NO: 9167376 - DNA, 18 bp, Homo sapiens
ggaaggaagaatgcattt

SEQ ID NO: 9167377 - DNA, 18 bp, Homo sapiens
ggaaggaagaatgcattt

SEQ ID NO: 9167378 - DNA, 22 bp, Homo sapiens
ggaaggaaattggggcagttgt

SEQ ID NO: 9167379 - DNA, 22 bp, Homo sapiens
ggaaggaaagcagcttggccct

SEQ ID NO: 9167380 - DNA, 22 bp, Homo sapiens
ggaaggaaagcagcttggccct

SEQ ID NO: 9167381 - DNA, 22 bp, Homo sapiens
ggaagctttctctgtttcctta

SEQ ID NO: 9167382 - DNA, 22 bp, Homo sapiens
ggaaggaagaggaccgagctgg

SEQ ID NO: 9167383 - DNA, 22 bp, Homo sapiens
ggaaggaagattctaactggag

SEQ ID NO: 9167384 - DNA, 22 bp, Homo sapiens
ggaaggaagattctaactggag

SEQ ID NO: 9167385 - DNA, 22 bp, Homo sapiens
ggaaggaagtaaatgatgctat

SEQ ID NO: 9167386 - DNA, 22 bp, Homo sapiens
ggaaggaagtaaatgatgctat

SEQ ID NO: 9167387 - DNA, 22 bp, Homo sapiens
ggaaggaagtgaccaggatatc

SEQ ID NO: 9167388 - DNA, 22 bp, Homo sapiens
ggaaggaagtgaccaggatatc

SEQ ID NO: 9167389 - DNA, 23 bp, Homo sapiens
ggacacatttatttcagaattca

SEQ ID NO: 9167390 - DNA, 21 bp, Homo sapiens
ggacaccagtcacactggatt

SEQ ID NO: 9167391 - DNA, 22 bp, Homo sapiens
ggaagccaggcccagagatgct

SEQ ID NO: 9167392 - DNA, 22 bp, Homo sapiens
ggaagccaggccaatgagaaca

SEQ ID NO: 9167393 - DNA, 20 bp, Homo sapiens
ggaagccagcatccttgagg

SEQ ID NO: 9167394 - DNA, 20 bp, Homo sapiens
ggaagccagcatccttgagg

SEQ ID NO: 9167395 - DNA, 22 bp, Homo sapiens
ggaagccaggccaatgagaaca

SEQ ID NO: 9167396 - DNA, 22 bp, Homo sapiens
ggaagccagagtgctgggcagg

SEQ ID NO: 9167397 - DNA, 20 bp, Homo sapiens
ggaagccagcatccttgagg

SEQ ID NO: 9167398 - DNA, 22 bp, Homo sapiens
ggaagccaggctgggggatctg

SEQ ID NO: 9167399 - DNA, 20 bp, Homo sapiens
ggaagccagggtgcagggga

SEQ ID NO: 9167400 - DNA, 19 bp, Homo sapiens
ggaagccaggtcagcccac

SEQ ID NO: 9167401 - DNA, 20 bp, Homo sapiens
ggaagccagggtgcagggga

SEQ ID NO: 9167402 - DNA, 22 bp, Homo sapiens
ggaagccaggctgggggatctg

SEQ ID NO: 9167403 - DNA, 22 bp, Homo sapiens
ggaagccagagtgctgggcagg

SEQ ID NO: 9167404 - DNA, 22 bp, Homo sapiens
ggaagccacccagctttgatag

SEQ ID NO: 9167405 - DNA, 22 bp, Homo sapiens
ggaagccagaaagtgagaatat

SEQ ID NO: 9167406 - DNA, 22 bp, Homo sapiens
ggaagccagaaagtgagaatat

SEQ ID NO: 9167407 - DNA, 22 bp, Homo sapiens
ggaagccaaggtggcctctatt

SEQ ID NO: 9167408 - DNA, 22 bp, Homo sapiens
ggaagccacccagctttgatag

SEQ ID NO: 9167409 - DNA, 22 bp, Homo sapiens
ggaaccacagcccccagcaggc

SEQ ID NO: 9167410 - DNA, 22 bp, Homo sapiens
ggaaccagtaactggtcattgc

SEQ ID NO: 9167411 - DNA, 22 bp, Homo sapiens
ggaaaggagatattggagagtg

SEQ ID NO: 9167412 - DNA, 22 bp, Homo sapiens
gcttcctgatattcatactgtt

SEQ ID NO: 9167413 - DNA, 22 bp, Homo sapiens
ggaaaggagatgaataggatta

SEQ ID NO: 9167414 - DNA, 22 bp, Homo sapiens
ggaaaggctaacagtcatggaa

SEQ ID NO: 9167415 - DNA, 22 bp, Homo sapiens
ggaaaggctaacagtcatggaa

SEQ ID NO: 9167416 - DNA, 22 bp, Homo sapiens
ggaaaggcctgggtgtcctggg

SEQ ID NO: 9167417 - DNA, 22 bp, Homo sapiens
ggaaagggagttttgcttatga

SEQ ID NO: 9167418 - DNA, 22 bp, Homo sapiens
ggaaagggagttttgcttatga

SEQ ID NO: 9167419 - DNA, 22 bp, Homo sapiens
ggaaatatcttgtactatgtga

SEQ ID NO: 9167420 - DNA, 20 bp, Homo sapiens
ggaaatcaccaggctccacc

SEQ ID NO: 9167421 - DNA, 22 bp, Homo sapiens
ggaaagtggtggtggaaagagg

SEQ ID NO: 9167422 - DNA, 22 bp, Homo sapiens
ggaaatacaaagatacaccact

SEQ ID NO: 9167423 - DNA, 22 bp, Homo sapiens
ggaaaggggcctggatcttttg

SEQ ID NO: 9167424 - DNA, 22 bp, Homo sapiens
ggaaagggcagaggccttggag

SEQ ID NO: 9167425 - DNA, 22 bp, Homo sapiens
ggaaagggcagaggccttggag

SEQ ID NO: 9167426 - DNA, 22 bp, Homo sapiens
ggaaagggcatggccttttcac

SEQ ID NO: 9167427 - DNA, 22 bp, Homo sapiens
gcttcccacagctggactgggg

SEQ ID NO: 9167428 - DNA, 22 bp, Homo sapiens
gcttcccacagctggactgggg

SEQ ID NO: 9167429 - DNA, 22 bp, Homo sapiens
gcttcctcaccttctcttgcat

SEQ ID NO: 9167430 - DNA, 17 bp, Homo sapiens
gcttcctcatgcagttc

SEQ ID NO: 9167431 - DNA, 22 bp, Homo sapiens
gcttcctccctgctgctcacta

SEQ ID NO: 9167432 - DNA, 22 bp, Homo sapiens
gcttcctgagaaacaatctgat

SEQ ID NO: 9167433 - DNA, 22 bp, Homo sapiens
gcttcctgagagagacagttcc

SEQ ID NO: 9167434 - DNA, 22 bp, Homo sapiens
gcttcctgagagagacagttcc

SEQ ID NO: 9167435 - DNA, 21 bp, Homo sapiens
ggacagaggagaaggcaccct

SEQ ID NO: 9167436 - DNA, 22 bp, Homo sapiens
ggacagagggcaggagcccaga

SEQ ID NO: 9167437 - DNA, 22 bp, Homo sapiens
ggacagagggcaggagcccaga

SEQ ID NO: 9167438 - DNA, 22 bp, Homo sapiens
ggacccagctctgagaccctgc

SEQ ID NO: 9167439 - DNA, 22 bp, Homo sapiens
ggaccctgggcttgctcctggg

SEQ ID NO: 9167440 - DNA, 22 bp, Homo sapiens
ggaccctgggctctgggcctat

SEQ ID NO: 9167441 - DNA, 22 bp, Homo sapiens
ggaccctgggcagctggctgct

SEQ ID NO: 9167442 - DNA, 23 bp, Homo sapiens
ggaccctgtggagggtgagagtc

SEQ ID NO: 9167443 - DNA, 22 bp, Homo sapiens
ggacccttggcttctgcagatt

SEQ ID NO: 9167444 - DNA, 22 bp, Homo sapiens
ggaccctgtaaagtcgtgtcca

SEQ ID NO: 9167445 - DNA, 22 bp, Homo sapiens
ggacctgaacataaaacgaggc

SEQ ID NO: 9167446 - DNA, 22 bp, Homo sapiens
ggaccggtggcttcctcgggtc

SEQ ID NO: 9167447 - DNA, 22 bp, Homo sapiens
ggacagagcagacgagcagcgg

SEQ ID NO: 9167448 - DNA, 22 bp, Homo sapiens
ggacagagagtgaatatgacat

SEQ ID NO: 9167449 - DNA, 22 bp, Homo sapiens
ggacagagcagacgagcagcgg

SEQ ID NO: 9167450 - DNA, 22 bp, Homo sapiens
ggacagacaaaaatagtaagca

SEQ ID NO: 9167451 - DNA, 22 bp, Homo sapiens
ggacactgtataagttagagta

SEQ ID NO: 9167452 - DNA, 22 bp, Homo sapiens
ggagaggaaatgccagcacttc

SEQ ID NO: 9167453 - DNA, 22 bp, Homo sapiens
ggagaggaaatgccagcacttc

SEQ ID NO: 9167454 - DNA, 22 bp, Homo sapiens
ggagagcttggagtgcgatttt

SEQ ID NO: 9167455 - DNA, 22 bp, Homo sapiens
ggagagctggtatatgaagaca

SEQ ID NO: 9167456 - DNA, 22 bp, Homo sapiens
ggagagctggtatatgaagaca

SEQ ID NO: 9167457 - DNA, 22 bp, Homo sapiens
ggagaggagattgtggcatttt

SEQ ID NO: 9167458 - DNA, 22 bp, Homo sapiens
ggagaggagattgtggcatttt

SEQ ID NO: 9167459 - DNA, 22 bp, Homo sapiens
ggagaggacatggctcccacag

SEQ ID NO: 9167460 - DNA, 22 bp, Homo sapiens
ggagaggaaatgccagcacttc

SEQ ID NO: 9167461 - DNA, 22 bp, Homo sapiens
ggagaggatgttttagtaactt

SEQ ID NO: 9167462 - DNA, 22 bp, Homo sapiens
ggagaggatgttttagtaactt

SEQ ID NO: 9167463 - DNA, 22 bp, Homo sapiens
ggagaggagctattgggggctc

SEQ ID NO: 9167464 - DNA, 22 bp, Homo sapiens
ggagaggcgatgagtcacagcc

SEQ ID NO: 9167465 - DNA, 22 bp, Homo sapiens
ggagaggcgatgagtcacagcc

SEQ ID NO: 9167466 - DNA, 22 bp, Homo sapiens
ggagaggcgatgagtcacagcc

SEQ ID NO: 9167467 - DNA, 19 bp, Homo sapiens
ggagaggctggagggatgc

SEQ ID NO: 9167468 - DNA, 19 bp, Homo sapiens
ggagaggctggagggatgc

SEQ ID NO: 9167469 - DNA, 22 bp, Homo sapiens
ggagagagatgccgccttgctc

SEQ ID NO: 9167470 - DNA, 22 bp, Homo sapiens
ggactgaaggacaatctggttc

SEQ ID NO: 9167471 - DNA, 22 bp, Homo sapiens
ggactgaacacttaaatgtcca

SEQ ID NO: 9167472 - DNA, 22 bp, Homo sapiens
ggactgaaatctttccatgtca

SEQ ID NO: 9167473 - DNA, 20 bp, Homo sapiens
ggactgaaaacacaaacctg

SEQ ID NO: 9167474 - DNA, 20 bp, Homo sapiens
ggactgaaaacacaaacctg

SEQ ID NO: 9167475 - DNA, 22 bp, Homo sapiens
ggactgaatggaagatatatgg

SEQ ID NO: 9167476 - DNA, 22 bp, Homo sapiens
ggacggctctctggcactgtgg

SEQ ID NO: 9167477 - DNA, 22 bp, Homo sapiens
ggacctggcaatttgcatctct

SEQ ID NO: 9167478 - DNA, 22 bp, Homo sapiens
ggacctgctctcccagttctct

SEQ ID NO: 9167479 - DNA, 22 bp, Homo sapiens
ggaccttcctggctcctggggt

SEQ ID NO: 9167480 - DNA, 22 bp, Homo sapiens
ggactatgcagaatatgacagt

SEQ ID NO: 9167481 - DNA, 22 bp, Homo sapiens
ggcggtggttgagaggacggcg

SEQ ID NO: 9167482 - DNA, 22 bp, Homo sapiens
ggcggtggttgagaggacggcg

SEQ ID NO: 9167483 - DNA, 22 bp, Homo sapiens
ggctaatatacccagctctgta

SEQ ID NO: 9167484 - DNA, 22 bp, Homo sapiens
ggctacactggctatgctggct

SEQ ID NO: 9167485 - DNA, 22 bp, Homo sapiens
ggctagcttagagtcatgctag

SEQ ID NO: 9167486 - DNA, 22 bp, Homo sapiens
ggctagcttagagtcatgctag

SEQ ID NO: 9167487 - DNA, 22 bp, Homo sapiens
ggctagctcctccgcgcatcca

SEQ ID NO: 9167488 - DNA, 22 bp, Homo sapiens
ggctagcaaggtagcagaatgc

SEQ ID NO: 9167489 - DNA, 22 bp, Homo sapiens
ggctactagactttgatactag

SEQ ID NO: 9167490 - DNA, 22 bp, Homo sapiens
ggctacagtggcactgggcttt

SEQ ID NO: 9167491 - DNA, 22 bp, Homo sapiens
ggctacagtggctcagtgctgg

SEQ ID NO: 9167492 - DNA, 22 bp, Homo sapiens
ggctactgtgatggtctgcaag

SEQ ID NO: 9167493 - DNA, 22 bp, Homo sapiens
ggctactaggtaccatttagaa

SEQ ID NO: 9167494 - DNA, 22 bp, Homo sapiens
ggctagagtggaactggagcgg

SEQ ID NO: 9167495 - DNA, 22 bp, Homo sapiens
ggctaggcgggcacatggtgga

SEQ ID NO: 9167496 - DNA, 22 bp, Homo sapiens
ggctaggcctcaggcctgcctg

SEQ ID NO: 9167497 - DNA, 22 bp, Homo sapiens
ggctccagtttgtgccttcagc

SEQ ID NO: 9167498 - DNA, 22 bp, Homo sapiens
ggctccagggagtggagagaag

SEQ ID NO: 9167499 - DNA, 22 bp, Homo sapiens
ggctccatgcctagagcaggct

SEQ ID NO: 9167500 - DNA, 22 bp, Homo sapiens
ggctcccacccatagggcgagt

SEQ ID NO: 9167501 - DNA, 22 bp, Homo sapiens
ggctcccaggagggcctggagg

SEQ ID NO: 9167502 - DNA, 22 bp, Homo sapiens
ggctccctggaaatcccgaggc

SEQ ID NO: 9167503 - DNA, 22 bp, Homo sapiens
ggctccctgggggtcggagagt

SEQ ID NO: 9167504 - DNA, 21 bp, Homo sapiens
ggctccctggcaggggtctgg

SEQ ID NO: 9167505 - DNA, 17 bp, Homo sapiens
ggctccctgactatgga

SEQ ID NO: 9167506 - DNA, 22 bp, Homo sapiens
ggctccctgcaacctccgcctc

SEQ ID NO: 9167507 - DNA, 22 bp, Homo sapiens
ggctccctagggagagtgggag

SEQ ID NO: 9167508 - DNA, 22 bp, Homo sapiens
ggctctgggcctccaaggtctg

SEQ ID NO: 9167509 - DNA, 22 bp, Homo sapiens
ggctctggggcctcctcccttg

SEQ ID NO: 9167510 - DNA, 22 bp, Homo sapiens
ggctctggggaagctctcttca

SEQ ID NO: 9167511 - DNA, 22 bp, Homo sapiens
ggctctgggtctgtggggagcg

SEQ ID NO: 9167512 - DNA, 22 bp, Homo sapiens
ggctctggggggaagtctgttg

SEQ ID NO: 9167513 - DNA, 22 bp, Homo sapiens
ggctctggggggaagtctgttg

SEQ ID NO: 9167514 - DNA, 22 bp, Homo sapiens
ggctcctgaggaccaggcacag

SEQ ID NO: 9167515 - DNA, 22 bp, Homo sapiens
ggctcctgagaatgggccatca

SEQ ID NO: 9167516 - DNA, 22 bp, Homo sapiens
ggctcctgagaatgggccatca

SEQ ID NO: 9167517 - DNA, 22 bp, Homo sapiens
ggctcctgataggagaatgcgg

SEQ ID NO: 9167518 - DNA, 22 bp, Homo sapiens
ggctcctgaggaccaggcacag

SEQ ID NO: 9167519 - DNA, 22 bp, Homo sapiens
ggctcctgaaagactatgggaa

SEQ ID NO: 9167520 - DNA, 22 bp, Homo sapiens
ggctcctctctggccgctcccg

SEQ ID NO: 9167521 - DNA, 22 bp, Homo sapiens
ggctccctgggtgctcctgctc

SEQ ID NO: 9167522 - DNA, 22 bp, Homo sapiens
ggctctgggtctgtggggagcg

SEQ ID NO: 9167523 - DNA, 22 bp, Homo sapiens
ggctctgggtctgtggggagcg

SEQ ID NO: 9167524 - DNA, 17 bp, Homo sapiens
ggctctgggtgtcacat

SEQ ID NO: 9167525 - DNA, 22 bp, Homo sapiens
ggctctgggtgtgaccttgggt

SEQ ID NO: 9167526 - DNA, 17 bp, Homo sapiens
ggctctgggtgtcacat

SEQ ID NO: 9167527 - DNA, 22 bp, Homo sapiens
ggctctggtgtgaagcagcctc

SEQ ID NO: 9167528 - DNA, 22 bp, Homo sapiens
ggctctggtgtgaagcagcctc

SEQ ID NO: 9167529 - DNA, 22 bp, Homo sapiens
ggctctggtgtgaagcagcctc

SEQ ID NO: 9167530 - DNA, 22 bp, Homo sapiens
ggctctgtggctggccatgatg

SEQ ID NO: 9167531 - DNA, 22 bp, Homo sapiens
ggctgagccatgggcactgcag

SEQ ID NO: 9167532 - DNA, 22 bp, Homo sapiens
ggctgagccatgggcactgcag

SEQ ID NO: 9167533 - DNA, 19 bp, Homo sapiens
ggctgggtctggcaggttc

SEQ ID NO: 9167534 - DNA, 19 bp, Homo sapiens
ggctgggtctggcaggttc

SEQ ID NO: 9167535 - DNA, 21 bp, Homo sapiens
ggctgggtcatgcagctggcc

SEQ ID NO: 9167536 - DNA, 21 bp, Homo sapiens
ggctgggtcatgcagctggcc

SEQ ID NO: 9167537 - DNA, 21 bp, Homo sapiens
ggctgggtcatgcagctggcc

SEQ ID NO: 9167538 - DNA, 21 bp, Homo sapiens
ggctgggtcatgcagctggcc

SEQ ID NO: 9167539 - DNA, 22 bp, Homo sapiens
ggctgggtacagggcagtgtgc

SEQ ID NO: 9167540 - DNA, 19 bp, Homo sapiens
ggctggagaaaggaatcag

SEQ ID NO: 9167541 - DNA, 19 bp, Homo sapiens
ggctggagaaaggaatcag

SEQ ID NO: 9167542 - DNA, 22 bp, Homo sapiens
ggctggagaagggtggttgaca

SEQ ID NO: 9167543 - DNA, 21 bp, Homo sapiens
ggctggactgtgctttccttc

SEQ ID NO: 9167544 - DNA, 22 bp, Homo sapiens
ggctggactttctgctgggctc

SEQ ID NO: 9167545 - DNA, 22 bp, Homo sapiens
ggctggactgcctcccagagtc

SEQ ID NO: 9167546 - DNA, 22 bp, Homo sapiens
ggctggactctgggcctctcca

SEQ ID NO: 9167547 - DNA, 22 bp, Homo sapiens
ggctggacatgagcttggcagt

SEQ ID NO: 9167548 - DNA, 22 bp, Homo sapiens
ggctgtgcagggcagagtctca

SEQ ID NO: 9167549 - DNA, 22 bp, Homo sapiens
ggctgtgattggtggatgtgaa

SEQ ID NO: 9167550 - DNA, 22 bp, Homo sapiens
ggctgtgagcaggcagaatgct

SEQ ID NO: 9167551 - DNA, 22 bp, Homo sapiens
ggctggtggggaaagaggacca

SEQ ID NO: 9167552 - DNA, 22 bp, Homo sapiens
ggctggtggggaaagaggacca

SEQ ID NO: 9167553 - DNA, 22 bp, Homo sapiens
ggctgggtttgactcctggctt

SEQ ID NO: 9167554 - DNA, 22 bp, Homo sapiens
ggctgggtttgactcctggctt

SEQ ID NO: 9167555 - DNA, 22 bp, Homo sapiens
ggctggtcccgggtcctccggc

SEQ ID NO: 9167556 - DNA, 22 bp, Homo sapiens
ggctggtgagttcagagaaccc

SEQ ID NO: 9167557 - DNA, 23 bp, Homo sapiens
ggctggtgcccttggccagtcgg

SEQ ID NO: 9167558 - DNA, 22 bp, Homo sapiens
ggctgagggtatagctgtccca

SEQ ID NO: 9167559 - DNA, 22 bp, Homo sapiens
ggctgagggtatagctgtccca

SEQ ID NO: 9167560 - DNA, 22 bp, Homo sapiens
ggctgagggtatagctgtccca

SEQ ID NO: 9167561 - DNA, 22 bp, Homo sapiens
ggctgagggtatagctgtccca

SEQ ID NO: 9167562 - DNA, 22 bp, Homo sapiens
ggctgaggggcccagaggaaca

SEQ ID NO: 9167563 - DNA, 22 bp, Homo sapiens
ggctgaggggcccagaggaaca

SEQ ID NO: 9167564 - DNA, 22 bp, Homo sapiens
ggctgagggccagggctagtct

SEQ ID NO: 9167565 - DNA, 22 bp, Homo sapiens
ggctgagggttaagatcagaca

SEQ ID NO: 9167566 - DNA, 22 bp, Homo sapiens
ggctgagggttaagatcagaca

SEQ ID NO: 9167567 - DNA, 18 bp, Homo sapiens
ggctgaggttgactagaa

SEQ ID NO: 9167568 - DNA, 22 bp, Homo sapiens
ggctgagtctgtgacccatgcg

SEQ ID NO: 9167569 - DNA, 22 bp, Homo sapiens
ggctgctggggacgtgggagag

SEQ ID NO: 9167570 - DNA, 22 bp, Homo sapiens
ggctgctgtttcagagactgtt

SEQ ID NO: 9167571 - DNA, 20 bp, Homo sapiens
ggctgctgtgggcagagagg

SEQ ID NO: 9167572 - DNA, 22 bp, Homo sapiens
ggctggacatagacatagccat

SEQ ID NO: 9167573 - DNA, 21 bp, Homo sapiens
ggctggacatcccaggagact

SEQ ID NO: 9167574 - DNA, 22 bp, Homo sapiens
gggaatgagagtcagcccagga

SEQ ID NO: 9167575 - DNA, 19 bp, Homo sapiens
gggaatgatggaagacttc

SEQ ID NO: 9167576 - DNA, 21 bp, Homo sapiens
gggaatgagattcttggagat

SEQ ID NO: 9167577 - DNA, 23 bp, Homo sapiens
gggaagtgaggagcccctctgcc

SEQ ID NO: 9167578 - DNA, 22 bp, Homo sapiens
gggaagtgatggagccaggatt

SEQ ID NO: 9167579 - DNA, 23 bp, Homo sapiens
gggaagtgaggagcccctcagcc

SEQ ID NO: 9167580 - DNA, 22 bp, Homo sapiens
gggaagggtgttgtcttatctt

SEQ ID NO: 9167581 - DNA, 22 bp, Homo sapiens
gggaagggctccttttattgca

SEQ ID NO: 9167582 - DNA, 22 bp, Homo sapiens
gggaagggagggcctccagtca

SEQ ID NO: 9167583 - DNA, 22 bp, Homo sapiens
gggaagggagggcctccagtca

SEQ ID NO: 9167584 - DNA, 19 bp, Homo sapiens
gggagctgaggtctttggt

SEQ ID NO: 9167585 - DNA, 21 bp, Homo sapiens
gggagctgacagcagcacggc

SEQ ID NO: 9167586 - DNA, 22 bp, Homo sapiens
gggagctgagctctgagccacg

SEQ ID NO: 9167587 - DNA, 22 bp, Homo sapiens
gggagctgagctctgagccacg

SEQ ID NO: 9167588 - DNA, 22 bp, Homo sapiens
gggagctgagctggaagagaat

SEQ ID NO: 9167589 - DNA, 22 bp, Homo sapiens
gggagctgagctggaagagaat

SEQ ID NO: 9167590 - DNA, 22 bp, Homo sapiens
gggagctgagctggaagagaat

SEQ ID NO: 9167591 - DNA, 22 bp, Homo sapiens
gggaaggctgcctgagggatgg

SEQ ID NO: 9167592 - DNA, 22 bp, Homo sapiens
gggaaggctgcctgagggatgg

SEQ ID NO: 9167593 - DNA, 22 bp, Homo sapiens
gggaagggacttgtttaaggtc

SEQ ID NO: 9167594 - DNA, 22 bp, Homo sapiens
gggaagggacttgtttaaggtc

SEQ ID NO: 9167595 - DNA, 22 bp, Homo sapiens
gggaagggagggacctcagtct

SEQ ID NO: 9167596 - DNA, 22 bp, Homo sapiens
gggaagggagggacctcagtct

SEQ ID NO: 9167597 - DNA, 22 bp, Homo sapiens
gggaagggagctgggtatttag

SEQ ID NO: 9167598 - DNA, 22 bp, Homo sapiens
gggaagggagctgggtatttag

SEQ ID NO: 9167599 - DNA, 22 bp, Homo sapiens
ggctttgcctggaatttccttg

SEQ ID NO: 9167600 - DNA, 22 bp, Homo sapiens
ggctttgcagcctcattgctct

SEQ ID NO: 9167601 - DNA, 22 bp, Homo sapiens
ggctttgaggatacagaggaaa

SEQ ID NO: 9167602 - DNA, 22 bp, Homo sapiens
ggctttgaggatacagaggaaa

SEQ ID NO: 9167603 - DNA, 22 bp, Homo sapiens
ggctttctccttgccttagtct

SEQ ID NO: 9167604 - DNA, 22 bp, Homo sapiens
ggctttctatgaactcaaaggc

SEQ ID NO: 9167605 - DNA, 22 bp, Homo sapiens
ggctttctcacagcatggcagc

SEQ ID NO: 9167606 - DNA, 22 bp, Homo sapiens
ggctgtgcctcaaggctactca

SEQ ID NO: 9167607 - DNA, 22 bp, Homo sapiens
ggctttatagggtagaggatca

SEQ ID NO: 9167608 - DNA, 22 bp, Homo sapiens
ggctttatattgtttgagcaga

SEQ ID NO: 9167609 - DNA, 22 bp, Homo sapiens
ggctttatgcagggatagaaat

SEQ ID NO: 9167610 - DNA, 22 bp, Homo sapiens
gggagggatctgctaggcaatg

SEQ ID NO: 9167611 - DNA, 22 bp, Homo sapiens
gggagggatctgctaggcaatg

SEQ ID NO: 9167612 - DNA, 22 bp, Homo sapiens
gggagggatctgctaggcaatg

SEQ ID NO: 9167613 - DNA, 22 bp, Homo sapiens
gggagggaggtgctggttcacg

SEQ ID NO: 9167614 - DNA, 22 bp, Homo sapiens
gggagggaggtgatgcttggct

SEQ ID NO: 9167615 - DNA, 22 bp, Homo sapiens
gggagggaggtgctggttcacg

SEQ ID NO: 9167616 - DNA, 22 bp, Homo sapiens
gggagggaggtgatgcttggct

SEQ ID NO: 9167617 - DNA, 22 bp, Homo sapiens
gggagggaggtgatgcttggct

SEQ ID NO: 9167618 - DNA, 22 bp, Homo sapiens
gggagctggagctggaagactc

SEQ ID NO: 9167619 - DNA, 22 bp, Homo sapiens
gggagctggagctggaagactc

SEQ ID NO: 9167620 - DNA, 22 bp, Homo sapiens
gggagctggagctggaagactc

SEQ ID NO: 9167621 - DNA, 22 bp, Homo sapiens
gggagctggagctggaagactc

SEQ ID NO: 9167622 - DNA, 22 bp, Homo sapiens
gggagctggagttgtgttgcct

SEQ ID NO: 9167623 - DNA, 22 bp, Homo sapiens
gggagctggcggattccccagg

SEQ ID NO: 9167624 - DNA, 22 bp, Homo sapiens
gggagggagaggacagttctat

SEQ ID NO: 9167625 - DNA, 22 bp, Homo sapiens
gggagggacacaaagagttccc

SEQ ID NO: 9167626 - DNA, 22 bp, Homo sapiens
gggaggttgaggctgcagtgag

SEQ ID NO: 9167627 - DNA, 22 bp, Homo sapiens
gggaggttctgttcgcacttga

SEQ ID NO: 9167628 - DNA, 22 bp, Homo sapiens
gggaggttgaggctgcagtgag

SEQ ID NO: 9167629 - DNA, 22 bp, Homo sapiens
gggcacaggagaaggatctggc

SEQ ID NO: 9167630 - DNA, 22 bp, Homo sapiens
gggcacaggagaaggatctggc

SEQ ID NO: 9167631 - DNA, 22 bp, Homo sapiens
gggcacaggagaaggatctggc

SEQ ID NO: 9167632 - DNA, 22 bp, Homo sapiens
gggcacagtactccaatcaact

SEQ ID NO: 9167633 - DNA, 22 bp, Homo sapiens
gggaggtgttccagtgttggta

SEQ ID NO: 9167634 - DNA, 22 bp, Homo sapiens
gggaggtgttccagtgttggta

SEQ ID NO: 9167635 - DNA, 22 bp, Homo sapiens
gggaggtgttccagtgttggta

SEQ ID NO: 9167636 - DNA, 22 bp, Homo sapiens
gggaggtgatggcaagcagcgg

SEQ ID NO: 9167637 - DNA, 21 bp, Homo sapiens
gggagggatggaaatgatgtt

SEQ ID NO: 9167638 - DNA, 21 bp, Homo sapiens
gggagggatggaaatgatgtt

SEQ ID NO: 9167639 - DNA, 21 bp, Homo sapiens
gggagggatggaaatgatgtt

SEQ ID NO: 9167640 - DNA, 22 bp, Homo sapiens
gggcagtgaatattggtgggaa

SEQ ID NO: 9167641 - DNA, 22 bp, Homo sapiens
gggcagtgaatattggtgggaa

SEQ ID NO: 9167642 - DNA, 22 bp, Homo sapiens
gggcagtgacaaaggggatgaa

SEQ ID NO: 9167643 - DNA, 22 bp, Homo sapiens
gggcagtcacagtgctggagca

SEQ ID NO: 9167644 - DNA, 22 bp, Homo sapiens
gggcagtcacagtgctggagca

SEQ ID NO: 9167645 - DNA, 19 bp, Homo sapiens
gggcagtggcactagggag

SEQ ID NO: 9167646 - DNA, 22 bp, Homo sapiens
gggcagtgattttccttagagg

SEQ ID NO: 9167647 - DNA, 22 bp, Homo sapiens
gggcagtgacaaaggggatgaa

SEQ ID NO: 9167648 - DNA, 22 bp, Homo sapiens
gggcaggttattggagtaggga

SEQ ID NO: 9167649 - DNA, 22 bp, Homo sapiens
gggcactggcgttttgttaaac

SEQ ID NO: 9167650 - DNA, 22 bp, Homo sapiens
gggcactgaatgccaagctagg

SEQ ID NO: 9167651 - DNA, 22 bp, Homo sapiens
gggcactgctggaggctccctg

SEQ ID NO: 9167652 - DNA, 22 bp, Homo sapiens
gggcactggcaccaaagacttg

SEQ ID NO: 9167653 - DNA, 22 bp, Homo sapiens
gggcactggaggccaaggagct

SEQ ID NO: 9167654 - DNA, 22 bp, Homo sapiens
gggcacagtctgcagcccccca

SEQ ID NO: 9167655 - DNA, 22 bp, Homo sapiens
gggcacagtctgcagcccccca

SEQ ID NO: 9167656 - DNA, 22 bp, Homo sapiens
gggcacagtctaaagttgggcc

SEQ ID NO: 9167657 - DNA, 22 bp, Homo sapiens
gggcacctggctagtgacagtg

SEQ ID NO: 9167658 - DNA, 22 bp, Homo sapiens
gggcactctgctcccagtgttt

SEQ ID NO: 9167659 - DNA, 22 bp, Homo sapiens
gggcactcctctggtccagccc

SEQ ID NO: 9167660 - DNA, 18 bp, Homo sapiens
ggcaggggtgaaccacag

SEQ ID NO: 9167661 - DNA, 18 bp, Homo sapiens
ggcaggggtgaaccacag

SEQ ID NO: 9167662 - DNA, 22 bp, Homo sapiens
ggcaggagctctccagtttgcc

SEQ ID NO: 9167663 - DNA, 22 bp, Homo sapiens
ggcagggtaaaccgaggtaagt

SEQ ID NO: 9167664 - DNA, 22 bp, Homo sapiens
ggcaggggttcattttgtctta

SEQ ID NO: 9167665 - DNA, 22 bp, Homo sapiens
ggcagggtaaaccgaggtaagt

SEQ ID NO: 9167666 - DNA, 22 bp, Homo sapiens
ggcaggggtgaggccactctga

SEQ ID NO: 9167667 - DNA, 18 bp, Homo sapiens
ggcaggggtgaaccacag

SEQ ID NO: 9167668 - DNA, 22 bp, Homo sapiens
ggcaggggtgaggccactctga

SEQ ID NO: 9167669 - DNA, 17 bp, Homo sapiens
ggcaggtgacagacacc

SEQ ID NO: 9167670 - DNA, 22 bp, Homo sapiens
ggcaggtgacggggatgagtat

SEQ ID NO: 9167671 - DNA, 22 bp, Homo sapiens
ggcagggtggcagaggctcaga

SEQ ID NO: 9167672 - DNA, 22 bp, Homo sapiens
ggccagcttctctgctgcctgt

SEQ ID NO: 9167673 - DNA, 19 bp, Homo sapiens
ggccagctgtctcctgcta

SEQ ID NO: 9167674 - DNA, 19 bp, Homo sapiens
ggccagctgtctcctgcta

SEQ ID NO: 9167675 - DNA, 22 bp, Homo sapiens
ggccaggaacttttgggatggg

SEQ ID NO: 9167676 - DNA, 22 bp, Homo sapiens
ggccagctttgagctgcaggaa

SEQ ID NO: 9167677 - DNA, 22 bp, Homo sapiens
ggccagctttctgtcttctagg

SEQ ID NO: 9167678 - DNA, 22 bp, Homo sapiens
ggccagctgtaagctgctgaat

SEQ ID NO: 9167679 - DNA, 22 bp, Homo sapiens
ggcatgctgcgtacagatgaac

SEQ ID NO: 9167680 - DNA, 22 bp, Homo sapiens
ggcatgagaggtcctggggatt

SEQ ID NO: 9167681 - DNA, 22 bp, Homo sapiens
ggcatgagaggtcctggggatt

SEQ ID NO: 9167682 - DNA, 22 bp, Homo sapiens
ggcatcagggtaggaaggtatc

SEQ ID NO: 9167683 - DNA, 22 bp, Homo sapiens
ggcatccaaataccaagatgta

SEQ ID NO: 9167684 - DNA, 21 bp, Homo sapiens
ggcatcccaggccagtgactg

SEQ ID NO: 9167685 - DNA, 22 bp, Homo sapiens
ggcatccctagaatagccaggt

SEQ ID NO: 9167686 - DNA, 22 bp, Homo sapiens
ggcatcccttcttccagtgtca

SEQ ID NO: 9167687 - DNA, 22 bp, Homo sapiens
ggcatcctgggactggcttctt

SEQ ID NO: 9167688 - DNA, 22 bp, Homo sapiens
ggcatcctggccacagtacctg

SEQ ID NO: 9167689 - DNA, 22 bp, Homo sapiens
ggcatcctgggactggcttctt

SEQ ID NO: 9167690 - DNA, 22 bp, Homo sapiens
ggccaggagaggagggcactga

SEQ ID NO: 9167691 - DNA, 19 bp, Homo sapiens
ggccaggctgactgtggtc

SEQ ID NO: 9167692 - DNA, 22 bp, Homo sapiens
ggccctggcagccacgaaagcc

SEQ ID NO: 9167693 - DNA, 22 bp, Homo sapiens
ggccaggcactgtgtgagatat

SEQ ID NO: 9167694 - DNA, 22 bp, Homo sapiens
ggccaggccaagagggttggaa

SEQ ID NO: 9167695 - DNA, 22 bp, Homo sapiens
ggccaggcgatgacccctccac

SEQ ID NO: 9167696 - DNA, 22 bp, Homo sapiens
ggccaggcgatgacccctccac

SEQ ID NO: 9167697 - DNA, 22 bp, Homo sapiens
ggccaggcactgtgtgagatat

SEQ ID NO: 9167698 - DNA, 22 bp, Homo sapiens
ggccaggccaagagggttggaa

SEQ ID NO: 9167699 - DNA, 22 bp, Homo sapiens
ggccgtgctccaaagtcatcgt

SEQ ID NO: 9167700 - DNA, 22 bp, Homo sapiens
ggccgtgctccaaagtcatcgt

SEQ ID NO: 9167701 - DNA, 21 bp, Homo sapiens
ggccctggttacgcctcctct

SEQ ID NO: 9167702 - DNA, 21 bp, Homo sapiens
ggcctaggggcagatggtgct

SEQ ID NO: 9167703 - DNA, 22 bp, Homo sapiens
ggcctagggcttggtcatggca

SEQ ID NO: 9167704 - DNA, 22 bp, Homo sapiens
ggcctcacccatcggtgccttt

SEQ ID NO: 9167705 - DNA, 22 bp, Homo sapiens
ggcctatgttcctgggctaggg

SEQ ID NO: 9167706 - DNA, 22 bp, Homo sapiens
ggccctgggacacaacaccgaa

SEQ ID NO: 9167707 - DNA, 22 bp, Homo sapiens
ggccctggcagccacgaaagcc

SEQ ID NO: 9167708 - DNA, 22 bp, Homo sapiens
ggccctgggccctctagcttgt

SEQ ID NO: 9167709 - DNA, 22 bp, Homo sapiens
ggccctgggcagaggagtgggc

SEQ ID NO: 9167710 - DNA, 22 bp, Homo sapiens
ggccctggtcctaggggtggaa

SEQ ID NO: 9167711 - DNA, 22 bp, Homo sapiens
ggccctggtcctaggggtggaa

SEQ ID NO: 9167712 - DNA, 22 bp, Homo sapiens
ggcctgctggggcctcagacac

SEQ ID NO: 9167713 - DNA, 22 bp, Homo sapiens
ggcctgctgggccccacagtcc

SEQ ID NO: 9167714 - DNA, 22 bp, Homo sapiens
ggcctgctgctggttagatggg

SEQ ID NO: 9167715 - DNA, 22 bp, Homo sapiens
ggcctgctggctccagcgcccg

SEQ ID NO: 9167716 - DNA, 22 bp, Homo sapiens
ggcctgctggggcctcagacac

SEQ ID NO: 9167717 - DNA, 22 bp, Homo sapiens
ggcctgcttactgattgttgtt

SEQ ID NO: 9167718 - DNA, 22 bp, Homo sapiens
ggcctgctgtgtactgatgtca

SEQ ID NO: 9167719 - DNA, 22 bp, Homo sapiens
ggcctgctgtagcttttgttct

SEQ ID NO: 9167720 - DNA, 22 bp, Homo sapiens
ggcctgcttctcagtgagcttg

SEQ ID NO: 9167721 - DNA, 22 bp, Homo sapiens
ggcctgcttctctgggctttct

SEQ ID NO: 9167722 - DNA, 22 bp, Homo sapiens
ggcctgctttacaggatcaact

SEQ ID NO: 9167723 - DNA, 22 bp, Homo sapiens
ggcctgctttccgagcctgcag

SEQ ID NO: 9167724 - DNA, 22 bp, Homo sapiens
ggcctgctctgcagcctctaca

SEQ ID NO: 9167725 - DNA, 22 bp, Homo sapiens
ggcctgctctgcagcctctaca

SEQ ID NO: 9167726 - DNA, 22 bp, Homo sapiens
ggcctgctccgggggctgagct

SEQ ID NO: 9167727 - DNA, 22 bp, Homo sapiens
ggcctgctgcagtgtgacagtt

SEQ ID NO: 9167728 - DNA, 22 bp, Homo sapiens
ggcctgctgcagtgtgacagtt

SEQ ID NO: 9167729 - DNA, 22 bp, Homo sapiens
ggcctgctgctatgacttcctg

SEQ ID NO: 9167730 - DNA, 22 bp, Homo sapiens
ggcctgctctggctgtggtcag

SEQ ID NO: 9167731 - DNA, 22 bp, Homo sapiens
ggcctgctctgtttagaggggg

SEQ ID NO: 9167732 - DNA, 22 bp, Homo sapiens
ggcctgctgacccaagtcctgt

SEQ ID NO: 9167733 - DNA, 19 bp, Homo sapiens
ggcctgcccaatgtctgct

SEQ ID NO: 9167734 - DNA, 19 bp, Homo sapiens
ggcctgcccaatgtctgct

SEQ ID NO: 9167735 - DNA, 22 bp, Homo sapiens
ggcctcagaaatagagtaaaat

SEQ ID NO: 9167736 - DNA, 22 bp, Homo sapiens
ggcctcagaaatagagtaaaat

SEQ ID NO: 9167737 - DNA, 22 bp, Homo sapiens
ggcctgctcaaacagattcctg

SEQ ID NO: 9167738 - DNA, 22 bp, Homo sapiens
ggcctgctcagtcctctttctt

SEQ ID NO: 9167739 - DNA, 22 bp, Homo sapiens
ggcctgctattggtgggcagac

SEQ ID NO: 9167740 - DNA, 22 bp, Homo sapiens
ggcctgctaacctgaaacggag

SEQ ID NO: 9167741 - DNA, 19 bp, Homo sapiens
ggcgggtggactggagccc

SEQ ID NO: 9167742 - DNA, 22 bp, Homo sapiens
ggcgggtgtaagtaggacagcg

SEQ ID NO: 9167743 - DNA, 18 bp, Homo sapiens
ggcgggtgttttattcac

SEQ ID NO: 9167744 - DNA, 22 bp, Homo sapiens
ggcgggggtccaggagcctgca

SEQ ID NO: 9167745 - DNA, 22 bp, Homo sapiens
ggcctggctcttgcccagcctg

SEQ ID NO: 9167746 - DNA, 19 bp, Homo sapiens
ggcctggctatccctgctg

SEQ ID NO: 9167747 - DNA, 19 bp, Homo sapiens
ggcctggctatccctgctg

SEQ ID NO: 9167748 - DNA, 22 bp, Homo sapiens
ggcctggagtcagggaaagcaa

SEQ ID NO: 9167749 - DNA, 22 bp, Homo sapiens
ggcctggacacctgaggtctta

SEQ ID NO: 9167750 - DNA, 22 bp, Homo sapiens
ggcctggagcagagactaggga

SEQ ID NO: 9167751 - DNA, 22 bp, Homo sapiens
ggcctggcctccagatgtgggc

SEQ ID NO: 9167752 - DNA, 22 bp, Homo sapiens
ggcctggcctccagatgtgggc

SEQ ID NO: 9167753 - DNA, 22 bp, Homo sapiens
ggagatggctggcaggtagatg

SEQ ID NO: 9167754 - DNA, 22 bp, Homo sapiens
ggagatggctggcaggtagatg

SEQ ID NO: 9167755 - DNA, 22 bp, Homo sapiens
ggagatgggggattttacagcg

SEQ ID NO: 9167756 - DNA, 22 bp, Homo sapiens
ggagatggtggaagctggtgca

SEQ ID NO: 9167757 - DNA, 21 bp, Homo sapiens
ggagatgggtatcgcctgggc

SEQ ID NO: 9167758 - DNA, 21 bp, Homo sapiens
ggagatgggtatcgcctgggc

SEQ ID NO: 9167759 - DNA, 22 bp, Homo sapiens
ggagatggcaagaagttattag

SEQ ID NO: 9167760 - DNA, 22 bp, Homo sapiens
ggagatggagtggattcagcag

SEQ ID NO: 9167761 - DNA, 22 bp, Homo sapiens
ggagaggcttccagagtcgtgc

SEQ ID NO: 9167762 - DNA, 22 bp, Homo sapiens
ggagatggctctgcaaggtcta

SEQ ID NO: 9167763 - DNA, 22 bp, Homo sapiens
ggagatggccacgtcactcagt

SEQ ID NO: 9167764 - DNA, 22 bp, Homo sapiens
ggagatggctctgcaaggtcta

SEQ ID NO: 9167765 - DNA, 22 bp, Homo sapiens
ggagatggtggaagctggtgca

SEQ ID NO: 9167766 - DNA, 22 bp, Homo sapiens
ggagatggtggaagctggtgca

SEQ ID NO: 9167767 - DNA, 22 bp, Homo sapiens
ggagcacagccttgccagtacc

SEQ ID NO: 9167768 - DNA, 22 bp, Homo sapiens
ggagcaccctgctcagccaagc

SEQ ID NO: 9167769 - DNA, 22 bp, Homo sapiens
ggagcagagcatttcacagcct

SEQ ID NO: 9167770 - DNA, 22 bp, Homo sapiens
ggagcagagcatttcacagcct

SEQ ID NO: 9167771 - DNA, 22 bp, Homo sapiens
ggagcagagcatttcacagcct

SEQ ID NO: 9167772 - DNA, 22 bp, Homo sapiens
ggagcactttctaggagaagcc

SEQ ID NO: 9167773 - DNA, 22 bp, Homo sapiens
ggagcagagctgggcttggctg

SEQ ID NO: 9167774 - DNA, 22 bp, Homo sapiens
ggagcagagctgggcttggctg

SEQ ID NO: 9167775 - DNA, 17 bp, Homo sapiens
ggagcagatccaccatt

SEQ ID NO: 9167776 - DNA, 17 bp, Homo sapiens
ggagcagatccaccatt

SEQ ID NO: 9167777 - DNA, 22 bp, Homo sapiens
ggatctggggctctgctgctca

SEQ ID NO: 9167778 - DNA, 22 bp, Homo sapiens
ggatctgttttgcctctgaggg

SEQ ID NO: 9167779 - DNA, 22 bp, Homo sapiens
ggatctggggtagagcagtggg

SEQ ID NO: 9167780 - DNA, 22 bp, Homo sapiens
ggatgaggaagattactgagaa

SEQ ID NO: 9167781 - DNA, 22 bp, Homo sapiens
ggatgacccgagtctggggaac

SEQ ID NO: 9167782 - DNA, 22 bp, Homo sapiens
ggatgacacagttagaaagaga

SEQ ID NO: 9167783 - DNA, 22 bp, Homo sapiens
ggatgctgactttggagcatgg

SEQ ID NO: 9167784 - DNA, 22 bp, Homo sapiens
ggatgctgattccagtctccag

SEQ ID NO: 9167785 - DNA, 22 bp, Homo sapiens
ggatgctgatatagagcattct

SEQ ID NO: 9167786 - DNA, 22 bp, Homo sapiens
ggatgctgactttggagcatgg

SEQ ID NO: 9167787 - DNA, 22 bp, Homo sapiens
ggatgctgggagacagcaggca

SEQ ID NO: 9167788 - DNA, 22 bp, Homo sapiens
ggatgctgctatcaggcttcga

SEQ ID NO: 9167789 - DNA, 23 bp, Homo sapiens
ggatggacgtgatgccttagcca

SEQ ID NO: 9167790 - DNA, 22 bp, Homo sapiens
ggatgcttaggttgttttatta

SEQ ID NO: 9167791 - DNA, 18 bp, Homo sapiens
ggatgctgtgtgctcctt

SEQ ID NO: 9167792 - DNA, 23 bp, Homo sapiens
ggatggacgtgatgccttagcca

SEQ ID NO: 9167793 - DNA, 22 bp, Homo sapiens
ggatgctgtctaagctgaggac

SEQ ID NO: 9167794 - DNA, 22 bp, Homo sapiens
ggatgcaggaggtcggggagca

SEQ ID NO: 9167795 - DNA, 22 bp, Homo sapiens
ggatgccatttgggtctggctt

SEQ ID NO: 9167796 - DNA, 21 bp, Homo sapiens
ggatgccacgaagcaccagga

SEQ ID NO: 9167797 - DNA, 22 bp, Homo sapiens
ggatgcaggacggcatggatgt

SEQ ID NO: 9167798 - DNA, 22 bp, Homo sapiens
ggatgcacgaaggcgcctcgga

SEQ ID NO: 9167799 - DNA, 22 bp, Homo sapiens
ggatgcacgaaggcgcctcgga

SEQ ID NO: 9167800 - DNA, 19 bp, Homo sapiens
ggatgagggtcaggcatag

SEQ ID NO: 9167801 - DNA, 22 bp, Homo sapiens
ggatgaggtagatgaacaaggg

SEQ ID NO: 9167802 - DNA, 22 bp, Homo sapiens
ggattgaaggcccttaactgat

SEQ ID NO: 9167803 - DNA, 20 bp, Homo sapiens
ggattctgactgtgaagagg

SEQ ID NO: 9167804 - DNA, 22 bp, Homo sapiens
ggatgttgattgaatggccatt

SEQ ID NO: 9167805 - DNA, 22 bp, Homo sapiens
ggatgtttggcgtttgaattgc

SEQ ID NO: 9167806 - DNA, 22 bp, Homo sapiens
ggatgggaacttggtagggcat

SEQ ID NO: 9167807 - DNA, 22 bp, Homo sapiens
ggatgggaacttggtagggcat

SEQ ID NO: 9167808 - DNA, 22 bp, Homo sapiens
ggatggaggttctcagatgctc

SEQ ID NO: 9167809 - DNA, 22 bp, Homo sapiens
ggatggaggttctcagatgctc

SEQ ID NO: 9167810 - DNA, 22 bp, Homo sapiens
ggatggcaggacaaggacccag

SEQ ID NO: 9167811 - DNA, 22 bp, Homo sapiens
ggatggcaggacaaggacccag

SEQ ID NO: 9167812 - DNA, 22 bp, Homo sapiens
ggatggcagacagtgagtggct

SEQ ID NO: 9167813 - DNA, 22 bp, Homo sapiens
ggatggcaggacaaggacccag

SEQ ID NO: 9167814 - DNA, 22 bp, Homo sapiens
ggatggcagacagtgagtggct

SEQ ID NO: 9167815 - DNA, 22 bp, Homo sapiens
ggatggcagtctgcatgagaaa

SEQ ID NO: 9167816 - DNA, 22 bp, Homo sapiens
ggcagaaggcctcccagctcct

SEQ ID NO: 9167817 - DNA, 22 bp, Homo sapiens
ggcagaaggcaattagagactg

SEQ ID NO: 9167818 - DNA, 22 bp, Homo sapiens
ggcagaaggcaattagagactg

SEQ ID NO: 9167819 - DNA, 19 bp, Homo sapiens
ggcagaaggtgtaggggga

SEQ ID NO: 9167820 - DNA, 22 bp, Homo sapiens
ggcagaagataggacagggaat

SEQ ID NO: 9167821 - DNA, 22 bp, Homo sapiens
ggcagaagataggacagggaat

SEQ ID NO: 9167822 - DNA, 22 bp, Homo sapiens
ggcagaagataggacagggaat

SEQ ID NO: 9167823 - DNA, 22 bp, Homo sapiens
ggcagaagacaggcaaatcatg

SEQ ID NO: 9167824 - DNA, 22 bp, Homo sapiens
ggcagaagaaaggctaagtctc

SEQ ID NO: 9167825 - DNA, 22 bp, Homo sapiens
ggcagaagaaaggctaagtctc

SEQ ID NO: 9167826 - DNA, 21 bp, Homo sapiens
ggcagaagtagcatggacggg

SEQ ID NO: 9167827 - DNA, 22 bp, Homo sapiens
ggcagcagacccctaagtctac

SEQ ID NO: 9167828 - DNA, 16 bp, Homo sapiens
ggcagcagctccgtgc

SEQ ID NO: 9167829 - DNA, 22 bp, Homo sapiens
ggcagcaggagccatctggtag

SEQ ID NO: 9167830 - DNA, 22 bp, Homo sapiens
ggcagcaggagccatctggtag

SEQ ID NO: 9167831 - DNA, 22 bp, Homo sapiens
ggcagcaggagccatctggtag

SEQ ID NO: 9167832 - DNA, 22 bp, Homo sapiens
ggcagcagcaaggttggagctg

SEQ ID NO: 9167833 - DNA, 22 bp, Homo sapiens
ggcagcagcaaggttggagctg

SEQ ID NO: 9167834 - DNA, 23 bp, Homo sapiens
ggatttagtggatgagctgagtg

SEQ ID NO: 9167835 - DNA, 22 bp, Homo sapiens
ggatttgaattgttgaaatgat

SEQ ID NO: 9167836 - DNA, 22 bp, Homo sapiens
ggatttgaactagagccctgcc

SEQ ID NO: 9167837 - DNA, 22 bp, Homo sapiens
ggatttgggcttgcagcagagc

SEQ ID NO: 9167838 - DNA, 22 bp, Homo sapiens
ggattgaagggaacctcagaat

SEQ ID NO: 9167839 - DNA, 22 bp, Homo sapiens
ggcactgattccattcatgaag

SEQ ID NO: 9167840 - DNA, 22 bp, Homo sapiens
ggcactgcaggtaagtgctgtc

SEQ ID NO: 9167841 - DNA, 22 bp, Homo sapiens
ggcactgcaggtaagtgctgtc

SEQ ID NO: 9167842 - DNA, 22 bp, Homo sapiens
ggcactgcccaccctcacaggg

SEQ ID NO: 9167843 - DNA, 22 bp, Homo sapiens
ggcactgggcaccggctgaggg

SEQ ID NO: 9167844 - DNA, 19 bp, Homo sapiens
ggcactggggccaggacca

SEQ ID NO: 9167845 - DNA, 19 bp, Homo sapiens
ggcactggggccaggacca

SEQ ID NO: 9167846 - DNA, 19 bp, Homo sapiens
ggcactggggccaggacca

SEQ ID NO: 9167847 - DNA, 22 bp, Homo sapiens
ggcactgggtgagggtcactgg

SEQ ID NO: 9167848 - DNA, 22 bp, Homo sapiens
ggcactgggttgtaggaattaa

SEQ ID NO: 9167849 - DNA, 18 bp, Homo sapiens
ggcactggtgatgcagag

SEQ ID NO: 9167850 - DNA, 22 bp, Homo sapiens
ggcactttgattttgagatgca

SEQ ID NO: 9167851 - DNA, 22 bp, Homo sapiens
ggcacttgcttgctgcctttat

SEQ ID NO: 9167852 - DNA, 22 bp, Homo sapiens
ggcagccatactcagacctggg

SEQ ID NO: 9167853 - DNA, 22 bp, Homo sapiens
ggcagccatactcagacctggg

SEQ ID NO: 9167854 - DNA, 22 bp, Homo sapiens
ggcagccatgcacgctgcctgg

SEQ ID NO: 9167855 - DNA, 22 bp, Homo sapiens
ggcagccatactcagacctggg

SEQ ID NO: 9167856 - DNA, 22 bp, Homo sapiens
ggcagccatgctccaggtgcag

SEQ ID NO: 9167857 - DNA, 22 bp, Homo sapiens
ggcagccatggacactggctag

SEQ ID NO: 9167858 - DNA, 22 bp, Homo sapiens
ggcagccatgcacgctgcctgg

SEQ ID NO: 9167859 - DNA, 22 bp, Homo sapiens
ggcagcagtccatggcccaagg

SEQ ID NO: 9167860 - DNA, 22 bp, Homo sapiens
ggcagcagtccatggcccaagg

SEQ ID NO: 9167861 - DNA, 22 bp, Homo sapiens
ggcagcagtccatggcccaagg

SEQ ID NO: 9167862 - DNA, 22 bp, Homo sapiens
ggcagccagcaatgagaagttt

SEQ ID NO: 9167863 - DNA, 22 bp, Homo sapiens
ggcagccagtagggccagcctg

SEQ ID NO: 9167864 - DNA, 22 bp, Homo sapiens
ggcagccagcgggtggacgcgc

SEQ ID NO: 9167865 - DNA, 22 bp, Homo sapiens
ggcagccagcacgcagttgatg

SEQ ID NO: 9167866 - DNA, 22 bp, Homo sapiens
ggcagccagcaatgagaagttt

SEQ ID NO: 9167867 - DNA, 22 bp, Homo sapiens
ggcagcagggctgtctccctac

SEQ ID NO: 9167868 - DNA, 20 bp, Homo sapiens
ggcagcaggagtttcctctt

SEQ ID NO: 9167869 - DNA, 22 bp, Homo sapiens
ggcagcaggcgacttccctatt

SEQ ID NO: 9167870 - DNA, 22 bp, Homo sapiens
ggcagcaggcgacttccctatt

SEQ ID NO: 9167871 - DNA, 22 bp, Homo sapiens
ggcagcaggcgacttccctatt

SEQ ID NO: 9167872 - DNA, 22 bp, Homo sapiens
ggcagcagggtctagattgatg

SEQ ID NO: 9167873 - DNA, 22 bp, Homo sapiens
ggcagcagggtctagattgatg

SEQ ID NO: 9167874 - DNA, 22 bp, Homo sapiens
ggcagcagggtagccatttctc

SEQ ID NO: 9167875 - DNA, 22 bp, Homo sapiens
ggcagcagtaggagctaatctt

SEQ ID NO: 9167876 - DNA, 22 bp, Homo sapiens
ggcagcagtaggagctaatctt

SEQ ID NO: 9167877 - DNA, 22 bp, Homo sapiens
ggcagcttgtcctggaggatgg

SEQ ID NO: 9167878 - DNA, 22 bp, Homo sapiens
ggcagcttgtccttcaggagag

SEQ ID NO: 9167879 - DNA, 22 bp, Homo sapiens
ggcagcttcctaggagagggca

SEQ ID NO: 9167880 - DNA, 22 bp, Homo sapiens
ggcagctgtggacgtcgtcatt

SEQ ID NO: 9167881 - DNA, 22 bp, Homo sapiens
ggcagctgtggacgtcgtcatt

SEQ ID NO: 9167882 - DNA, 21 bp, Homo sapiens
ggcagctgtggttaattgaac

SEQ ID NO: 9167883 - DNA, 17 bp, Homo sapiens
ggcagctgtgtgcatgc

SEQ ID NO: 9167884 - DNA, 17 bp, Homo sapiens
ggcagctgtgtgcatgc

SEQ ID NO: 9167885 - DNA, 17 bp, Homo sapiens
ggcagctgtgtgcatgc

SEQ ID NO: 9167886 - DNA, 17 bp, Homo sapiens
ggcagctgtgtgcatgc

SEQ ID NO: 9167887 - DNA, 22 bp, Homo sapiens
ggcagctgttggctctctagga

SEQ ID NO: 9167888 - DNA, 22 bp, Homo sapiens
ggcagctgtttgtcctcctgtt

SEQ ID NO: 9167889 - DNA, 22 bp, Homo sapiens
ggcagctgttggctctctagga

SEQ ID NO: 9167890 - DNA, 22 bp, Homo sapiens
ggcagctgttggctctctagga

SEQ ID NO: 9167891 - DNA, 22 bp, Homo sapiens
ggcagctgttggctctctagga

SEQ ID NO: 9167892 - DNA, 22 bp, Homo sapiens
ggcagctgttggctctctagga

SEQ ID NO: 9167893 - DNA, 22 bp, Homo sapiens
ggcagctgttggctctctagga

SEQ ID NO: 9167894 - DNA, 22 bp, Homo sapiens
ggtaattctagtcattgcatca

SEQ ID NO: 9167895 - DNA, 23 bp, Homo sapiens
ggtaccagcacagagtggagagg

SEQ ID NO: 9167896 - DNA, 19 bp, Homo sapiens
ggtagaagggaagtgtttt

SEQ ID NO: 9167897 - DNA, 22 bp, Homo sapiens
ggtaacagtatgtagagtaaga

SEQ ID NO: 9167898 - DNA, 22 bp, Homo sapiens
ggtaagattcttcaaacaagag

SEQ ID NO: 9167899 - DNA, 22 bp, Homo sapiens
ggtaagattactttcttagcca

SEQ ID NO: 9167900 - DNA, 22 bp, Homo sapiens
ggtaacttagctcatggctgtg

SEQ ID NO: 9167901 - DNA, 22 bp, Homo sapiens
gggtccagatggtgagagttaa

SEQ ID NO: 9167902 - DNA, 22 bp, Homo sapiens
ggtaaaatgcagattcttagcc

SEQ ID NO: 9167903 - DNA, 22 bp, Homo sapiens
gggtccagcgacagcaggctca

SEQ ID NO: 9167904 - DNA, 22 bp, Homo sapiens
ggtaaaaatcacaaatacttta

SEQ ID NO: 9167905 - DNA, 22 bp, Homo sapiens
gggtcaggctcagcagggcagc

SEQ ID NO: 9167906 - DNA, 22 bp, Homo sapiens
gggtcagggctgcctgggctca

SEQ ID NO: 9167907 - DNA, 22 bp, Homo sapiens
gggtcaggcctcaaggtgggct

SEQ ID NO: 9167908 - DNA, 22 bp, Homo sapiens
gggtcaggaagaattctgccaa

SEQ ID NO: 9167909 - DNA, 22 bp, Homo sapiens
gggtcaggcctcaaggtgggct

SEQ ID NO: 9167910 - DNA, 22 bp, Homo sapiens
gggtcagggctggctgtcgtca

SEQ ID NO: 9167911 - DNA, 22 bp, Homo sapiens
gggtcagggctgcctgggctca

SEQ ID NO: 9167912 - DNA, 22 bp, Homo sapiens
gggtcagggctgcctgggctca

SEQ ID NO: 9167913 - DNA, 23 bp, Homo sapiens
gggtccagagacaggcatgggtg

SEQ ID NO: 9167914 - DNA, 22 bp, Homo sapiens
ggtcaggggctgctctacagag

SEQ ID NO: 9167915 - DNA, 22 bp, Homo sapiens
ggtcagggggatctgtgaggta

SEQ ID NO: 9167916 - DNA, 22 bp, Homo sapiens
ggtccaggtatgtggtgtgaat

SEQ ID NO: 9167917 - DNA, 22 bp, Homo sapiens
ggtccaggtttgctctacttgt

SEQ ID NO: 9167918 - DNA, 22 bp, Homo sapiens
ggtccaggtcctgtgacagcag

SEQ ID NO: 9167919 - DNA, 22 bp, Homo sapiens
ggtccagggggtagatatgtga

SEQ ID NO: 9167920 - DNA, 22 bp, Homo sapiens
ggtccagggaactttgaaggat

SEQ ID NO: 9167921 - DNA, 22 bp, Homo sapiens
ggtccaggatcaaggcatcacc

SEQ ID NO: 9167922 - DNA, 23 bp, Homo sapiens
ggtccaggaaaggcagcagcacc

SEQ ID NO: 9167923 - DNA, 22 bp, Homo sapiens
ggtcagctctttgggctggtgg

SEQ ID NO: 9167924 - DNA, 20 bp, Homo sapiens
ggtcagcctggggctccagg

SEQ ID NO: 9167925 - DNA, 22 bp, Homo sapiens
ggtcagccttggatttggtagc

SEQ ID NO: 9167926 - DNA, 22 bp, Homo sapiens
ggtcagccttggatttggtagc

SEQ ID NO: 9167927 - DNA, 19 bp, Homo sapiens
ggtcaggaatttgacaata

SEQ ID NO: 9167928 - DNA, 22 bp, Homo sapiens
ggtcaggagcccttggccccct

SEQ ID NO: 9167929 - DNA, 22 bp, Homo sapiens
ggtcagcccctgctcaaggccg

SEQ ID NO: 9167930 - DNA, 21 bp, Homo sapiens
ggtagggaaggttcgctggtg

SEQ ID NO: 9167931 - DNA, 22 bp, Homo sapiens
ggtaggagtgaagacttaagat

SEQ ID NO: 9167932 - DNA, 18 bp, Homo sapiens
ggtaggagccaggaatgt

SEQ ID NO: 9167933 - DNA, 22 bp, Homo sapiens
ggtagcagggctgtgagtcaga

SEQ ID NO: 9167934 - DNA, 22 bp, Homo sapiens
ggtagcagggctgtgagtcaga

SEQ ID NO: 9167935 - DNA, 20 bp, Homo sapiens
ggtagcagctgctgtcatcc

SEQ ID NO: 9167936 - DNA, 22 bp, Homo sapiens
ggtgaaatgtagtcttgtgaga

SEQ ID NO: 9167937 - DNA, 22 bp, Homo sapiens
ggtgaagcctctagttacattt

SEQ ID NO: 9167938 - DNA, 22 bp, Homo sapiens
ggtgaaattccttgtggaaagt

SEQ ID NO: 9167939 - DNA, 22 bp, Homo sapiens
ggtgaagccagggcatcaatat

SEQ ID NO: 9167940 - DNA, 22 bp, Homo sapiens
ggtctttctactgcacttggct

SEQ ID NO: 9167941 - DNA, 22 bp, Homo sapiens
ggtctttctactgcacttggct

SEQ ID NO: 9167942 - DNA, 22 bp, Homo sapiens
ggtctttcattacatgggttaa

SEQ ID NO: 9167943 - DNA, 22 bp, Homo sapiens
ggtctttcattacatgggttaa

SEQ ID NO: 9167944 - DNA, 18 bp, Homo sapiens
ggtctttaggtcagtgtc

SEQ ID NO: 9167945 - DNA, 22 bp, Homo sapiens
ggtctgtgtgctttgggaagtg

SEQ ID NO: 9167946 - DNA, 17 bp, Homo sapiens
ggtctgtgtctagggaa

SEQ ID NO: 9167947 - DNA, 22 bp, Homo sapiens
ggtcttgaaggacatccagtcc

SEQ ID NO: 9167948 - DNA, 17 bp, Homo sapiens
ggtctggggccattggc

SEQ ID NO: 9167949 - DNA, 17 bp, Homo sapiens
ggtctggggccattggc

SEQ ID NO: 9167950 - DNA, 22 bp, Homo sapiens
ggtctgtgctctggagcctctg

SEQ ID NO: 9167951 - DNA, 22 bp, Homo sapiens
ggtctgtgctctggagcctctg

SEQ ID NO: 9167952 - DNA, 22 bp, Homo sapiens
ggtctggcctggcattctatgg

SEQ ID NO: 9167953 - DNA, 22 bp, Homo sapiens
ggtctgggcttgagtccttttg

SEQ ID NO: 9167954 - DNA, 22 bp, Homo sapiens
ggtctggcctcgggcaccccca

SEQ ID NO: 9167955 - DNA, 22 bp, Homo sapiens
ggtcccaatctaatcacatgag

SEQ ID NO: 9167956 - DNA, 22 bp, Homo sapiens
ggtccatctcttgagcccacat

SEQ ID NO: 9167957 - DNA, 22 bp, Homo sapiens
ggtgaaggtctactgtgtgcca

SEQ ID NO: 9167958 - DNA, 22 bp, Homo sapiens
ggtgaaggtggaacgcagagca

SEQ ID NO: 9167959 - DNA, 22 bp, Homo sapiens
ggtgaaggtctactgtgtgcca

SEQ ID NO: 9167960 - DNA, 22 bp, Homo sapiens
ggtgaaggtctactgtgtgcca

SEQ ID NO: 9167961 - DNA, 22 bp, Homo sapiens
ggtgaaggtcagagcaggaaaa

SEQ ID NO: 9167962 - DNA, 22 bp, Homo sapiens
ggtgaaggcacaagagggcaag

SEQ ID NO: 9167963 - DNA, 22 bp, Homo sapiens
ggtgaaggcacaagagggcaag

SEQ ID NO: 9167964 - DNA, 22 bp, Homo sapiens
ggtgaaggcacaagagggcaag

SEQ ID NO: 9167965 - DNA, 22 bp, Homo sapiens
ggtgaagggccttaggagacag

SEQ ID NO: 9167966 - DNA, 22 bp, Homo sapiens
ggtgcagggagaggcaggcccc

SEQ ID NO: 9167967 - DNA, 22 bp, Homo sapiens
ggtgcagggagaggcaggcccc

SEQ ID NO: 9167968 - DNA, 22 bp, Homo sapiens
ggtgggagtggaacgtggaaga

SEQ ID NO: 9167969 - DNA, 22 bp, Homo sapiens
ggtgggagtgggcacagttacg

SEQ ID NO: 9167970 - DNA, 22 bp, Homo sapiens
ggtgggagtggaacgtggaaga

SEQ ID NO: 9167971 - DNA, 16 bp, Homo sapiens
ggtgggaggtgaggtg

SEQ ID NO: 9167972 - DNA, 22 bp, Homo sapiens
ggtgggatcaaagagtcattcg

SEQ ID NO: 9167973 - DNA, 21 bp, Homo sapiens
ggtgggcacaggagagcagag

SEQ ID NO: 9167974 - DNA, 22 bp, Homo sapiens
ggtggctgaatcaaatcaggcc

SEQ ID NO: 9167975 - DNA, 22 bp, Homo sapiens
ggtggctgcaatggctaacttc

SEQ ID NO: 9167976 - DNA, 22 bp, Homo sapiens
ggtggctgcaccctggctaact

SEQ ID NO: 9167977 - DNA, 22 bp, Homo sapiens
ggtggctgcaatggctaacttc

SEQ ID NO: 9167978 - DNA, 23 bp, Homo sapiens
ggtgggagattatccagaattat

SEQ ID NO: 9167979 - DNA, 23 bp, Homo sapiens
ggtgggagattatccagaattat

SEQ ID NO: 9167980 - DNA, 22 bp, Homo sapiens
ggtgggagagcttgctttgatg

SEQ ID NO: 9167981 - DNA, 22 bp, Homo sapiens
ggtgggaggcaggctgctccca

SEQ ID NO: 9167982 - DNA, 22 bp, Homo sapiens
ggtgggagggctgcgttcctct

SEQ ID NO: 9167983 - DNA, 22 bp, Homo sapiens
ggtgggaggactgtttgaggca

SEQ ID NO: 9167984 - DNA, 22 bp, Homo sapiens
ggtgggaggactgtttgaggca

SEQ ID NO: 9167985 - DNA, 22 bp, Homo sapiens
ggtgcccacctgtcttcctgga

SEQ ID NO: 9167986 - DNA, 22 bp, Homo sapiens
ggtgccctggaagctgctgcat

SEQ ID NO: 9167987 - DNA, 22 bp, Homo sapiens
ggtgcctgtatttggggcacag

SEQ ID NO: 9167988 - DNA, 22 bp, Homo sapiens
ggtggctgaagcagtcttcggg

SEQ ID NO: 9167989 - DNA, 22 bp, Homo sapiens
ggtggctgaagcagtcttcggg

SEQ ID NO: 9167990 - DNA, 22 bp, Homo sapiens
ggtggctctgttgtcaactgat

SEQ ID NO: 9167991 - DNA, 22 bp, Homo sapiens
ggtgctcaagagggcatcctct

SEQ ID NO: 9167992 - DNA, 22 bp, Homo sapiens
ggtgccaggctgtagtcagggt

SEQ ID NO: 9167993 - DNA, 22 bp, Homo sapiens
ggtgccaggctcccagctcagg

SEQ ID NO: 9167994 - DNA, 22 bp, Homo sapiens
ggtgccaggctcccagctcagg

SEQ ID NO: 9167995 - DNA, 22 bp, Homo sapiens
ggtgccactgcactctggcctg

SEQ ID NO: 9167996 - DNA, 22 bp, Homo sapiens
ggtgccagcctagtgcagtggt

SEQ ID NO: 9167997 - DNA, 22 bp, Homo sapiens
gggcctcagctggagtctgcct

SEQ ID NO: 9167998 - DNA, 22 bp, Homo sapiens
gggcctcagctgccaacaggat

SEQ ID NO: 9167999 - DNA, 22 bp, Homo sapiens
gggcctccgtgtgctggtgctc

SEQ ID NO: 9168000 - DNA, 22 bp, Homo sapiens
gggcctctgtgcagaggggcct

SEQ ID NO: 9168001 - DNA, 22 bp, Homo sapiens
gggcctgaaaccttcagggctt

SEQ ID NO: 9168002 - DNA, 22 bp, Homo sapiens
gggcctctgtgcagaggggcct

SEQ ID NO: 9168003 - DNA, 22 bp, Homo sapiens
gggcctccgtgtgctggtgctc

SEQ ID NO: 9168004 - DNA, 22 bp, Homo sapiens
gggcatgcctgagcctgccact

SEQ ID NO: 9168005 - DNA, 22 bp, Homo sapiens
gggcatgagagggcagctggca

SEQ ID NO: 9168006 - DNA, 22 bp, Homo sapiens
gggcatgagcacatagtgtcta

SEQ ID NO: 9168007 - DNA, 20 bp, Homo sapiens
gggcatctttgctcctgttt

SEQ ID NO: 9168008 - DNA, 22 bp, Homo sapiens
gggcagtgttgtggttctctat

SEQ ID NO: 9168009 - DNA, 22 bp, Homo sapiens
gggcagtttattctagatggtt

SEQ ID NO: 9168010 - DNA, 20 bp, Homo sapiens
gggcagttcaatgccactct

SEQ ID NO: 9168011 - DNA, 22 bp, Homo sapiens
gggcatccagagggatgcctgg

SEQ ID NO: 9168012 - DNA, 21 bp, Homo sapiens
gggcctggctgcgcaggacgg

SEQ ID NO: 9168013 - DNA, 21 bp, Homo sapiens
gggcctggctgcgcaggacgg

SEQ ID NO: 9168014 - DNA, 22 bp, Homo sapiens
gggcctgggaacttgcatttag

SEQ ID NO: 9168015 - DNA, 22 bp, Homo sapiens
gggcctgggaacttgcatttag

SEQ ID NO: 9168016 - DNA, 22 bp, Homo sapiens
gggcctggggacaccaccatga

SEQ ID NO: 9168017 - DNA, 22 bp, Homo sapiens
gggcctggggacaccaccatga

SEQ ID NO: 9168018 - DNA, 22 bp, Homo sapiens
gggcctggggacaccaccatga

SEQ ID NO: 9168019 - DNA, 22 bp, Homo sapiens
gggcctgctggtgcttccattg

SEQ ID NO: 9168020 - DNA, 22 bp, Homo sapiens
gggcctggcatgcagccccgtt

SEQ ID NO: 9168021 - DNA, 22 bp, Homo sapiens
gggcctggcatgcagccccgtt

SEQ ID NO: 9168022 - DNA, 22 bp, Homo sapiens
gggcctgccattgctgccccag

SEQ ID NO: 9168023 - DNA, 22 bp, Homo sapiens
gggcctgctccccatcgctgct

SEQ ID NO: 9168024 - DNA, 22 bp, Homo sapiens
gggcctgctgcaggttcaggat

SEQ ID NO: 9168025 - DNA, 22 bp, Homo sapiens
gggcctgctccccatcgctgct

SEQ ID NO: 9168026 - DNA, 22 bp, Homo sapiens
gggcctgaggcccagacactgg

SEQ ID NO: 9168027 - DNA, 22 bp, Homo sapiens
gggcctgccaggctttcagcat

SEQ ID NO: 9168028 - DNA, 22 bp, Homo sapiens
gggcctgcaggttctgagaggc

SEQ ID NO: 9168029 - DNA, 22 bp, Homo sapiens
gggcctgccaggctttcagcat

SEQ ID NO: 9168030 - DNA, 22 bp, Homo sapiens
gggcctgccaggctttcagcat

SEQ ID NO: 9168031 - DNA, 22 bp, Homo sapiens
gggctggctaagacttttctgt

SEQ ID NO: 9168032 - DNA, 22 bp, Homo sapiens
gggctggctaagacttttctgt

SEQ ID NO: 9168033 - DNA, 22 bp, Homo sapiens
gggctcctcctctgactgtggc

SEQ ID NO: 9168034 - DNA, 19 bp, Homo sapiens
gggctccttgggcctctct

SEQ ID NO: 9168035 - DNA, 19 bp, Homo sapiens
gggctccttgggcctctct

SEQ ID NO: 9168036 - DNA, 22 bp, Homo sapiens
gggctcctggcagtcatgctca

SEQ ID NO: 9168037 - DNA, 22 bp, Homo sapiens
gggctcctggcagtcatgctca

SEQ ID NO: 9168038 - DNA, 19 bp, Homo sapiens
gggctccttgggcctctct

SEQ ID NO: 9168039 - DNA, 22 bp, Homo sapiens
gggctcctggcagtcatgctca

SEQ ID NO: 9168040 - DNA, 19 bp, Homo sapiens
gggctccttgggcctctct

SEQ ID NO: 9168041 - DNA, 21 bp, Homo sapiens
gggctctcctgaggccatgaa

SEQ ID NO: 9168042 - DNA, 22 bp, Homo sapiens
gggctctcatgagtgtgtggta

SEQ ID NO: 9168043 - DNA, 22 bp, Homo sapiens
gggctccagccactggctgagg

SEQ ID NO: 9168044 - DNA, 22 bp, Homo sapiens
gggctccagcccgggaccaggt

SEQ ID NO: 9168045 - DNA, 22 bp, Homo sapiens
gggctccagagtccatgttctt

SEQ ID NO: 9168046 - DNA, 22 bp, Homo sapiens
gggctccagattgcagcgatca

SEQ ID NO: 9168047 - DNA, 23 bp, Homo sapiens
gggctccagtctctgctcagttg

SEQ ID NO: 9168048 - DNA, 22 bp, Homo sapiens
gggctccagtttggccaggaag

SEQ ID NO: 9168049 - DNA, 22 bp, Homo sapiens
gggctccatcacaggctccatc

SEQ ID NO: 9168050 - DNA, 22 bp, Homo sapiens
gggctcctcctctgactgtggc

SEQ ID NO: 9168051 - DNA, 22 bp, Homo sapiens
gggctccatcacaggctccatc

SEQ ID NO: 9168052 - DNA, 22 bp, Homo sapiens
gggggcgggagacagcagtgac

SEQ ID NO: 9168053 - DNA, 22 bp, Homo sapiens
gggggcgggagacagcagtgac

SEQ ID NO: 9168054 - DNA, 23 bp, Homo sapiens
gggggcgtgtcatggagggccac

SEQ ID NO: 9168055 - DNA, 22 bp, Homo sapiens
gggggcgggagacagcagtgac

SEQ ID NO: 9168056 - DNA, 22 bp, Homo sapiens
gggtcagagcaagactggggtc

SEQ ID NO: 9168057 - DNA, 22 bp, Homo sapiens
gggtattaaaatgaaggagaaa

SEQ ID NO: 9168058 - DNA, 22 bp, Homo sapiens
gggtcagagttcaggtcgaggg

SEQ ID NO: 9168059 - DNA, 22 bp, Homo sapiens
gggggcgccccatggaggtgag

SEQ ID NO: 9168060 - DNA, 22 bp, Homo sapiens
ggggctgttgaagttagttgag

SEQ ID NO: 9168061 - DNA, 22 bp, Homo sapiens
ggggcaggaggtgttctctttt

SEQ ID NO: 9168062 - DNA, 22 bp, Homo sapiens
ggggcttttgcacgtgggaggc

SEQ ID NO: 9168063 - DNA, 22 bp, Homo sapiens
ggggcagctcccgagggcagga

SEQ ID NO: 9168064 - DNA, 22 bp, Homo sapiens
ggggcagctcccgagggcagga

SEQ ID NO: 9168065 - DNA, 22 bp, Homo sapiens
ggggcaggagcccttcttcagc

SEQ ID NO: 9168066 - DNA, 22 bp, Homo sapiens
ggggcaggagcccttcttcagc

SEQ ID NO: 9168067 - DNA, 22 bp, Homo sapiens
gggggaagactgggctagtgat

SEQ ID NO: 9168068 - DNA, 22 bp, Homo sapiens
gggggaagactgggctagtgat

SEQ ID NO: 9168069 - DNA, 22 bp, Homo sapiens
gggggaagaaagaacatggcat

SEQ ID NO: 9168070 - DNA, 22 bp, Homo sapiens
gggggaagaaagaacatggcat

SEQ ID NO: 9168071 - DNA, 22 bp, Homo sapiens
gggggaagaaagaacatggcat

SEQ ID NO: 9168072 - DNA, 21 bp, Homo sapiens
gggggaagaggagttgctagt

SEQ ID NO: 9168073 - DNA, 22 bp, Homo sapiens
gggctgggatggcttgaagatt

SEQ ID NO: 9168074 - DNA, 22 bp, Homo sapiens
gggctgggatggcttgaagatt

SEQ ID NO: 9168075 - DNA, 22 bp, Homo sapiens
gggctgggatggcttgaagatt

SEQ ID NO: 9168076 - DNA, 22 bp, Homo sapiens
gggctgggaatggctaagtatg

SEQ ID NO: 9168077 - DNA, 22 bp, Homo sapiens
gggctggctgattttcctctct

SEQ ID NO: 9168078 - DNA, 22 bp, Homo sapiens
gggctggggctcaataatttgt

SEQ ID NO: 9168079 - DNA, 22 bp, Homo sapiens
gggctgggcatggtgttccctc

SEQ ID NO: 9168080 - DNA, 22 bp, Homo sapiens
gggctgggattgcttgctgtga

SEQ ID NO: 9168081 - DNA, 22 bp, Homo sapiens
gggctgggattgcttgctgtga

SEQ ID NO: 9168082 - DNA, 22 bp, Homo sapiens
gggctgggattgcttgctgtga

SEQ ID NO: 9168083 - DNA, 22 bp, Homo sapiens
gggctgggattgcttgctgtga

SEQ ID NO: 9168084 - DNA, 22 bp, Homo sapiens
gggctgggattgcttgctgtga

SEQ ID NO: 9168085 - DNA, 22 bp, Homo sapiens
ggggatggaatgtagtagtgat

SEQ ID NO: 9168086 - DNA, 22 bp, Homo sapiens
ggggatggattccgggtccctg

SEQ ID NO: 9168087 - DNA, 22 bp, Homo sapiens
ggggatggtagaccggtgacgt

SEQ ID NO: 9168088 - DNA, 22 bp, Homo sapiens
ggggatggtggcatttgtaaaa

SEQ ID NO: 9168089 - DNA, 22 bp, Homo sapiens
ggggatggtgggaaggcaatct

SEQ ID NO: 9168090 - DNA, 22 bp, Homo sapiens
ggggcagctcccgagggcagga

SEQ ID NO: 9168091 - DNA, 22 bp, Homo sapiens
ggggcagctaccggaagtaggg

SEQ ID NO: 9168092 - DNA, 22 bp, Homo sapiens
ggggcagaaagcccacagagtg

SEQ ID NO: 9168093 - DNA, 22 bp, Homo sapiens
gtcatttatcttcagaatttct

SEQ ID NO: 9168094 - DNA, 22 bp, Homo sapiens
gtcatttatcttcagaatttct

SEQ ID NO: 9168095 - DNA, 22 bp, Homo sapiens
gtcatttaaagaccattgtggg

SEQ ID NO: 9168096 - DNA, 22 bp, Homo sapiens
gtcattgagtcgtcagagtctt

SEQ ID NO: 9168097 - DNA, 22 bp, Homo sapiens
gtccctggagctgagcagtgct

SEQ ID NO: 9168098 - DNA, 22 bp, Homo sapiens
gtccctggatctgggacagctg

SEQ ID NO: 9168099 - DNA, 22 bp, Homo sapiens
gtcatttctgtttcttcagtgc

SEQ ID NO: 9168100 - DNA, 22 bp, Homo sapiens
gtcatttctgtttcttcagtgc

SEQ ID NO: 9168101 - DNA, 22 bp, Homo sapiens
gtcctcaggaaggctttctgac

SEQ ID NO: 9168102 - DNA, 22 bp, Homo sapiens
gtcctcaggaaggctttctgac

SEQ ID NO: 9168103 - DNA, 21 bp, Homo sapiens
gtcctcagctgatgggagctg

SEQ ID NO: 9168104 - DNA, 22 bp, Homo sapiens
gtcctcagggaatgtggcgggt

SEQ ID NO: 9168105 - DNA, 22 bp, Homo sapiens
gtcctcagggaatgtggcgggt

SEQ ID NO: 9168106 - DNA, 22 bp, Homo sapiens
gtcctcagaagcctgcttagct

SEQ ID NO: 9168107 - DNA, 22 bp, Homo sapiens
gtcctcagagtgggcaggtcct

SEQ ID NO: 9168108 - DNA, 21 bp, Homo sapiens
gtcctcagctgatgggagctg

SEQ ID NO: 9168109 - DNA, 22 bp, Homo sapiens
gtcctcagcaccagaactaggg

SEQ ID NO: 9168110 - DNA, 21 bp, Homo sapiens
gtcctcagctgatgggagctg

SEQ ID NO: 9168111 - DNA, 22 bp, Homo sapiens
gtctcccgcccaacaagcaagg

SEQ ID NO: 9168112 - DNA, 22 bp, Homo sapiens
gtctcccatgtccctgtccagt

SEQ ID NO: 9168113 - DNA, 22 bp, Homo sapiens
gtctcccatgtccctgtccagt

SEQ ID NO: 9168114 - DNA, 20 bp, Homo sapiens
gtctcctctttgcattccta

SEQ ID NO: 9168115 - DNA, 22 bp, Homo sapiens
gtctcctccagtaggaagtggc

SEQ ID NO: 9168116 - DNA, 23 bp, Homo sapiens
gtctcccatagcgctcccaggct

SEQ ID NO: 9168117 - DNA, 22 bp, Homo sapiens
gtctcccagcctacatctttct

SEQ ID NO: 9168118 - DNA, 22 bp, Homo sapiens
gtctcccatcgtttgtgaggaa

SEQ ID NO: 9168119 - DNA, 22 bp, Homo sapiens
gtctcccatcgtttgtgaggaa

SEQ ID NO: 9168120 - DNA, 22 bp, Homo sapiens
gtctcccactttctggcctctt

SEQ ID NO: 9168121 - DNA, 22 bp, Homo sapiens
gtcctcagtcagtttggtgggg

SEQ ID NO: 9168122 - DNA, 22 bp, Homo sapiens
gtcctctgaaagatgaaccatg

SEQ ID NO: 9168123 - DNA, 22 bp, Homo sapiens
gtcctctccaggaggctctgat

SEQ ID NO: 9168124 - DNA, 22 bp, Homo sapiens
gtcctctgaagttgtgcaatgc

SEQ ID NO: 9168125 - DNA, 22 bp, Homo sapiens
gtcctctgactcagccttggga

SEQ ID NO: 9168126 - DNA, 22 bp, Homo sapiens
gtcctctgagggggctgcacgc

SEQ ID NO: 9168127 - DNA, 22 bp, Homo sapiens
gtcctctgatttctaggtatat

SEQ ID NO: 9168128 - DNA, 22 bp, Homo sapiens
gtcctctgcccaggtcaaggtt

SEQ ID NO: 9168129 - DNA, 22 bp, Homo sapiens
gtcaccagcaccaatgccacat

SEQ ID NO: 9168130 - DNA, 22 bp, Homo sapiens
gtcacatgccagtgcacacagg

SEQ ID NO: 9168131 - DNA, 21 bp, Homo sapiens
gtcagggattcaagtgctcac

SEQ ID NO: 9168132 - DNA, 22 bp, Homo sapiens
gtcagggatccactgctcttct

SEQ ID NO: 9168133 - DNA, 19 bp, Homo sapiens
gtcacatttgtctcccagg

SEQ ID NO: 9168134 - DNA, 22 bp, Homo sapiens
gtcaatatattctgtctctttg

SEQ ID NO: 9168135 - DNA, 22 bp, Homo sapiens
gtcaatatcgccaagtgtctct

SEQ ID NO: 9168136 - DNA, 22 bp, Homo sapiens
gtcacagggtccccatatggag

SEQ ID NO: 9168137 - DNA, 22 bp, Homo sapiens
gtcacaggtgtggaggtgctgg

SEQ ID NO: 9168138 - DNA, 22 bp, Homo sapiens
gtcacaaaggtgagggacatga

SEQ ID NO: 9168139 - DNA, 18 bp, Homo sapiens
gtcagttttgaagccaga

SEQ ID NO: 9168140 - DNA, 22 bp, Homo sapiens
gtcagtttgactcagtgttata

SEQ ID NO: 9168141 - DNA, 22 bp, Homo sapiens
gtcagttcactaccactccatt

SEQ ID NO: 9168142 - DNA, 22 bp, Homo sapiens
gtcattcctatccatttgatac

SEQ ID NO: 9168143 - DNA, 17 bp, Homo sapiens
gtcattctcagaaaatg

SEQ ID NO: 9168144 - DNA, 22 bp, Homo sapiens
gtcagtaggaacctagggtcaa

SEQ ID NO: 9168145 - DNA, 22 bp, Homo sapiens
gtcagtaaatcttgttatgaag

SEQ ID NO: 9168146 - DNA, 22 bp, Homo sapiens
gtcaggtcttggaagataggct

SEQ ID NO: 9168147 - DNA, 22 bp, Homo sapiens
gtcagtgcttgaagggcagaga

SEQ ID NO: 9168148 - DNA, 22 bp, Homo sapiens
gtaatacttgaagaattcagag

SEQ ID NO: 9168149 - DNA, 23 bp, Homo sapiens
gtaatactagtcatagtagcagg

SEQ ID NO: 9168150 - DNA, 22 bp, Homo sapiens
gtaataatttgctacctggtgg

SEQ ID NO: 9168151 - DNA, 22 bp, Homo sapiens
gtaataatttgctacctggtgg

SEQ ID NO: 9168152 - DNA, 22 bp, Homo sapiens
gtaataatggtccccaaacact

SEQ ID NO: 9168153 - DNA, 22 bp, Homo sapiens
gtaataatactagtcagccttg

SEQ ID NO: 9168154 - DNA, 22 bp, Homo sapiens
gtaataatactagtcagccttg

SEQ ID NO: 9168155 - DNA, 22 bp, Homo sapiens
gtaatctcagctacttgggagg

SEQ ID NO: 9168156 - DNA, 22 bp, Homo sapiens
gtaatcgtggtggttaattcca

SEQ ID NO: 9168157 - DNA, 22 bp, Homo sapiens
gtaatgataagcagccattcac

SEQ ID NO: 9168158 - DNA, 22 bp, Homo sapiens
gtaatgaatcaacattaatgat

SEQ ID NO: 9168159 - DNA, 22 bp, Homo sapiens
gtaatctcagctacttgggagg

SEQ ID NO: 9168160 - DNA, 22 bp, Homo sapiens
gtaacagcgtgtatgttatcag

SEQ ID NO: 9168161 - DNA, 22 bp, Homo sapiens
gtaaggttaccaggttttgaga

SEQ ID NO: 9168162 - DNA, 22 bp, Homo sapiens
gtaacattattcatgagataca

SEQ ID NO: 9168163 - DNA, 17 bp, Homo sapiens
gtaaggcttgcagatgc

SEQ ID NO: 9168164 - DNA, 22 bp, Homo sapiens
gtaagttatattaaaatttcag

SEQ ID NO: 9168165 - DNA, 17 bp, Homo sapiens
gtaaggcttgcagatgc

SEQ ID NO: 9168166 - DNA, 22 bp, Homo sapiens
gtaaatgtcctgctacagagtg

SEQ ID NO: 9168167 - DNA, 22 bp, Homo sapiens
gtaaatcatggtcagaataaat

SEQ ID NO: 9168168 - DNA, 22 bp, Homo sapiens
gtaaatttcccgggccatttaa

SEQ ID NO: 9168169 - DNA, 22 bp, Homo sapiens
ggtgggcagctcttggcaggca

SEQ ID NO: 9168170 - DNA, 22 bp, Homo sapiens
gtaaatattccctcggttccta

SEQ ID NO: 9168171 - DNA, 22 bp, Homo sapiens
gtagaggacatttgacatgatg

SEQ ID NO: 9168172 - DNA, 22 bp, Homo sapiens
gtagagcagggagcaggaagct

SEQ ID NO: 9168173 - DNA, 22 bp, Homo sapiens
gtagaggacatttgacatgatg

SEQ ID NO: 9168174 - DNA, 22 bp, Homo sapiens
gtagaccatttatctggggagt

SEQ ID NO: 9168175 - DNA, 22 bp, Homo sapiens
gtagacatctagatttatgtgt

SEQ ID NO: 9168176 - DNA, 22 bp, Homo sapiens
gtagaggggtgattctgtgaga

SEQ ID NO: 9168177 - DNA, 22 bp, Homo sapiens
gtagataaggattgatttttat

SEQ ID NO: 9168178 - DNA, 22 bp, Homo sapiens
gtagcatctgttggctgctcct

SEQ ID NO: 9168179 - DNA, 22 bp, Homo sapiens
gtagcagctctgagcatgctgc

SEQ ID NO: 9168180 - DNA, 22 bp, Homo sapiens
gtagcagcttcagcccaaatta

SEQ ID NO: 9168181 - DNA, 22 bp, Homo sapiens
gtagcaaagggacggctctaga

SEQ ID NO: 9168182 - DNA, 22 bp, Homo sapiens
gtagcaatgttgaacactgcgt

SEQ ID NO: 9168183 - DNA, 22 bp, Homo sapiens
gtagcaccagtgctcttctcaa

SEQ ID NO: 9168184 - DNA, 22 bp, Homo sapiens
gtagcacccactacttttcgct

SEQ ID NO: 9168185 - DNA, 22 bp, Homo sapiens
gtagcaccgcgagacttggggc

SEQ ID NO: 9168186 - DNA, 17 bp, Homo sapiens
gtagcaaaccttttagg

SEQ ID NO: 9168187 - DNA, 22 bp, Homo sapiens
gtcaagatgagaattcttttta

SEQ ID NO: 9168188 - DNA, 22 bp, Homo sapiens
gtcaactttttcatagctctgc

SEQ ID NO: 9168189 - DNA, 22 bp, Homo sapiens
gtcaactttaagatgatctttt

SEQ ID NO: 9168190 - DNA, 22 bp, Homo sapiens
gtcaacttgacaggcagagtgg

SEQ ID NO: 9168191 - DNA, 22 bp, Homo sapiens
gtcaacttatctctttatctgt

SEQ ID NO: 9168192 - DNA, 22 bp, Homo sapiens
gtcaacttgcaagatgctgggc

SEQ ID NO: 9168193 - DNA, 22 bp, Homo sapiens
gtcaactgtacctaaagaaagt

SEQ ID NO: 9168194 - DNA, 22 bp, Homo sapiens
gtagctatttatgatactcatg

SEQ ID NO: 9168195 - DNA, 22 bp, Homo sapiens
gtagctctgtttaaagttcttt

SEQ ID NO: 9168196 - DNA, 22 bp, Homo sapiens
gtagcttattagggataatagt

SEQ ID NO: 9168197 - DNA, 22 bp, Homo sapiens
gtagctgatcctgaggacaggg

SEQ ID NO: 9168198 - DNA, 22 bp, Homo sapiens
gtagctctgtttaaagttcttt

SEQ ID NO: 9168199 - DNA, 22 bp, Homo sapiens
gtaggaaagtaaatgaaataca

SEQ ID NO: 9168200 - DNA, 22 bp, Homo sapiens
gtaggaaagggagtgaagggaa

SEQ ID NO: 9168201 - DNA, 22 bp, Homo sapiens
gtaggaaagggagtgaagggaa

SEQ ID NO: 9168202 - DNA, 22 bp, Homo sapiens
gtaggaaagggagtgaagggaa

SEQ ID NO: 9168203 - DNA, 22 bp, Homo sapiens
gtaggaaagtaaatgaaataca

SEQ ID NO: 9168204 - DNA, 22 bp, Homo sapiens
gtcttcaattgcatttgatggg

SEQ ID NO: 9168205 - DNA, 22 bp, Homo sapiens
gtcttcaggacccggaattttg

SEQ ID NO: 9168206 - DNA, 22 bp, Homo sapiens
gtcttcaggacctggaattttg

SEQ ID NO: 9168207 - DNA, 22 bp, Homo sapiens
gtcttattttctgtctactaaa

SEQ ID NO: 9168208 - DNA, 22 bp, Homo sapiens
gtcttattttctgtctactaaa

SEQ ID NO: 9168209 - DNA, 22 bp, Homo sapiens
gtcttatttaaggacaagaaga

SEQ ID NO: 9168210 - DNA, 22 bp, Homo sapiens
gtcttatttaaggcttatacaa

SEQ ID NO: 9168211 - DNA, 22 bp, Homo sapiens
gtcttatttaaggacaagaaga

SEQ ID NO: 9168212 - DNA, 20 bp, Homo sapiens
gtcttatttaacacatgact

SEQ ID NO: 9168213 - DNA, 22 bp, Homo sapiens
gtcttatttaacctaaatttct

SEQ ID NO: 9168214 - DNA, 22 bp, Homo sapiens
gtctggtgggattccaagtggc

SEQ ID NO: 9168215 - DNA, 22 bp, Homo sapiens
gtcttatagtacaatttgaagt

SEQ ID NO: 9168216 - DNA, 22 bp, Homo sapiens
gtctggtttatgaagatcccgt

SEQ ID NO: 9168217 - DNA, 22 bp, Homo sapiens
gtcttattaaattgaaccctca

SEQ ID NO: 9168218 - DNA, 22 bp, Homo sapiens
gtcttattaggttaaccctgct

SEQ ID NO: 9168219 - DNA, 22 bp, Homo sapiens
gtcttattatgaggttagactt

SEQ ID NO: 9168220 - DNA, 22 bp, Homo sapiens
gtcttattaaaaatctaatccc

SEQ ID NO: 9168221 - DNA, 22 bp, Homo sapiens
gtcttattaaaaatctaatccc

SEQ ID NO: 9168222 - DNA, 22 bp, Homo sapiens
gtcttattaaaatgcagtttct

SEQ ID NO: 9168223 - DNA, 22 bp, Homo sapiens
gtcttattaaaatgcagtttct

SEQ ID NO: 9168224 - DNA, 22 bp, Homo sapiens
gtcttatttaaagagatcatac

SEQ ID NO: 9168225 - DNA, 22 bp, Homo sapiens
gtcttattgcgtatgtatacaa

SEQ ID NO: 9168226 - DNA, 22 bp, Homo sapiens
gtcttattgggtccaaggtggc

SEQ ID NO: 9168227 - DNA, 22 bp, Homo sapiens
gtcttattgggtccaaggtggc

SEQ ID NO: 9168228 - DNA, 22 bp, Homo sapiens
gtctggggtactttcatctgat

SEQ ID NO: 9168229 - DNA, 22 bp, Homo sapiens
gtctggggtccttttggcttta

SEQ ID NO: 9168230 - DNA, 22 bp, Homo sapiens
gtctggggtactttcatctgat

SEQ ID NO: 9168231 - DNA, 22 bp, Homo sapiens
gtctggggtccttttggcttta

SEQ ID NO: 9168232 - DNA, 22 bp, Homo sapiens
gtctggggtccttttggcttta

SEQ ID NO: 9168233 - DNA, 22 bp, Homo sapiens
gtctggggtactttcatctgat

SEQ ID NO: 9168234 - DNA, 22 bp, Homo sapiens
gtctctctcccaagattggcta

SEQ ID NO: 9168235 - DNA, 22 bp, Homo sapiens
gtctctatcatagctgaaccct

SEQ ID NO: 9168236 - DNA, 22 bp, Homo sapiens
gtctcctggcttttgtcccagt

SEQ ID NO: 9168237 - DNA, 22 bp, Homo sapiens
gtctcctgtcctgcaggatgga

SEQ ID NO: 9168238 - DNA, 22 bp, Homo sapiens
gtctcgctgagcccccattcta

SEQ ID NO: 9168239 - DNA, 22 bp, Homo sapiens
gtctctatcatagctgaaccct

SEQ ID NO: 9168240 - DNA, 22 bp, Homo sapiens
gtctcctggctgcagctaagac

SEQ ID NO: 9168241 - DNA, 22 bp, Homo sapiens
gtctcctggcttttgtcccagt

SEQ ID NO: 9168242 - DNA, 22 bp, Homo sapiens
gtctcctggctgcagctaagac

SEQ ID NO: 9168243 - DNA, 22 bp, Homo sapiens
gtctcctggctgcagctaagac

SEQ ID NO: 9168244 - DNA, 22 bp, Homo sapiens
gtctcctggcctccagtttctc

SEQ ID NO: 9168245 - DNA, 22 bp, Homo sapiens
gtctcctggcctccagtttctc

SEQ ID NO: 9168246 - DNA, 22 bp, Homo sapiens
gtctcctgcccccggtgcttgg

SEQ ID NO: 9168247 - DNA, 22 bp, Homo sapiens
gtctcctgctagcaagcaccac

SEQ ID NO: 9168248 - DNA, 22 bp, Homo sapiens
gtctcctgagccttgactgcaa

SEQ ID NO: 9168249 - DNA, 22 bp, Homo sapiens
gtctcctgagactgcagtcacc

SEQ ID NO: 9168250 - DNA, 22 bp, Homo sapiens
gtctcctgaggcatccattgaa

SEQ ID NO: 9168251 - DNA, 22 bp, Homo sapiens
gtctcctgaggcatccattgaa

SEQ ID NO: 9168252 - DNA, 22 bp, Homo sapiens
gtctcctgccacactcagtccc

SEQ ID NO: 9168253 - DNA, 22 bp, Homo sapiens
gtctcctgccacactcagtccc

SEQ ID NO: 9168254 - DNA, 22 bp, Homo sapiens
gtgaggtggtacaatattaact

SEQ ID NO: 9168255 - DNA, 23 bp, Homo sapiens
gtgagtcttgcctttgctgtgga

SEQ ID NO: 9168256 - DNA, 22 bp, Homo sapiens
gtgataaagacgtgtcataatt

SEQ ID NO: 9168257 - DNA, 22 bp, Homo sapiens
gtgataaaattcaaatagctct

SEQ ID NO: 9168258 - DNA, 22 bp, Homo sapiens
gtgatgtcagcaagaataggaa

SEQ ID NO: 9168259 - DNA, 22 bp, Homo sapiens
gtgatgcacaactaatatttca

SEQ ID NO: 9168260 - DNA, 22 bp, Homo sapiens
gtgataagacagtaggcacaag

SEQ ID NO: 9168261 - DNA, 22 bp, Homo sapiens
gtgataggtttacacctgagca

SEQ ID NO: 9168262 - DNA, 22 bp, Homo sapiens
gtgatagccacctgaattctga

SEQ ID NO: 9168263 - DNA, 22 bp, Homo sapiens
gtgatagctattcaattaatat

SEQ ID NO: 9168264 - DNA, 22 bp, Homo sapiens
gtgataggcatttaactctaag

SEQ ID NO: 9168265 - DNA, 22 bp, Homo sapiens
gtgaggcagggaaagaggataa

SEQ ID NO: 9168266 - DNA, 22 bp, Homo sapiens
gtcttctgcaactgcacctgcc

SEQ ID NO: 9168267 - DNA, 22 bp, Homo sapiens
gtcttctgatctggttagccat

SEQ ID NO: 9168268 - DNA, 22 bp, Homo sapiens
gtcttctgcccaggcagacgga

SEQ ID NO: 9168269 - DNA, 22 bp, Homo sapiens
gtcttctggaagagagccagct

SEQ ID NO: 9168270 - DNA, 22 bp, Homo sapiens
gtcttcttttcagtctgcttgt

SEQ ID NO: 9168271 - DNA, 22 bp, Homo sapiens
gtcttgaaaagtggccagtttg

SEQ ID NO: 9168272 - DNA, 22 bp, Homo sapiens
gtcttctgttctgtgaggcttc

SEQ ID NO: 9168273 - DNA, 22 bp, Homo sapiens
gtcttcttgtgttgcctgtctt

SEQ ID NO: 9168274 - DNA, 22 bp, Homo sapiens
gtcttcttgtgttgcctgtctt

SEQ ID NO: 9168275 - DNA, 22 bp, Homo sapiens
gtcttctttgtcatcttaggtt

SEQ ID NO: 9168276 - DNA, 22 bp, Homo sapiens
gtcttctttaacctactaaagc

SEQ ID NO: 9168277 - DNA, 22 bp, Homo sapiens
gtcttcttgttttgaaggaaat

SEQ ID NO: 9168278 - DNA, 22 bp, Homo sapiens
gtgcacagaaattggtaagact

SEQ ID NO: 9168279 - DNA, 22 bp, Homo sapiens
gtgcccaggggccagctgccgg

SEQ ID NO: 9168280 - DNA, 22 bp, Homo sapiens
gtgcccaggggccagctgccgg

SEQ ID NO: 9168281 - DNA, 22 bp, Homo sapiens
gtgcaagacttcctaagcaata

SEQ ID NO: 9168282 - DNA, 22 bp, Homo sapiens
gtgcaattcactgttatgtctg

SEQ ID NO: 9168283 - DNA, 22 bp, Homo sapiens
gtgcaattctagtgtccctaaa

SEQ ID NO: 9168284 - DNA, 22 bp, Homo sapiens
gtgcaattttgcatctgtatgc

SEQ ID NO: 9168285 - DNA, 22 bp, Homo sapiens
gtgattttgagacctatatagt

SEQ ID NO: 9168286 - DNA, 22 bp, Homo sapiens
gtgattttctcctcctagaagt

SEQ ID NO: 9168287 - DNA, 22 bp, Homo sapiens
gtgattttgagacctatatagt

SEQ ID NO: 9168288 - DNA, 22 bp, Homo sapiens
gtgattttgagacctatatagt

SEQ ID NO: 9168289 - DNA, 22 bp, Homo sapiens
gtgattgtgaaaacattaagaa

SEQ ID NO: 9168290 - DNA, 22 bp, Homo sapiens
gtgattcattcgattagtattt

SEQ ID NO: 9168291 - DNA, 22 bp, Homo sapiens
gtgcctctcagctgttcacaat

SEQ ID NO: 9168292 - DNA, 22 bp, Homo sapiens
gtgcctctgaccggagaccagg

SEQ ID NO: 9168293 - DNA, 22 bp, Homo sapiens
gtgcctcttcacctatgtggtt

SEQ ID NO: 9168294 - DNA, 22 bp, Homo sapiens
gtgcctctgatctggaagtctg

SEQ ID NO: 9168295 - DNA, 22 bp, Homo sapiens
gtgctgggattacaggtgtgag

SEQ ID NO: 9168296 - DNA, 22 bp, Homo sapiens
gtgcctcagcaccgcctgcagc

SEQ ID NO: 9168297 - DNA, 22 bp, Homo sapiens
gtgccctggctcacagtgtctc

SEQ ID NO: 9168298 - DNA, 22 bp, Homo sapiens
gtgccctggtccccagcatata

SEQ ID NO: 9168299 - DNA, 21 bp, Homo sapiens
gtgccctgttcccacatgccc

SEQ ID NO: 9168300 - DNA, 21 bp, Homo sapiens
gtgccctgttcccacatgccc

SEQ ID NO: 9168301 - DNA, 22 bp, Homo sapiens
gtgccctgtctcttgtctccag

SEQ ID NO: 9168302 - DNA, 22 bp, Homo sapiens
gtgctgggctccaccccagagg

SEQ ID NO: 9168303 - DNA, 22 bp, Homo sapiens
gtgctgggctccaccccagagg

SEQ ID NO: 9168304 - DNA, 22 bp, Homo sapiens
gtgctgggccctgagaccaggg

SEQ ID NO: 9168305 - DNA, 22 bp, Homo sapiens
gtgctgggccctgagaccaggg

SEQ ID NO: 9168306 - DNA, 22 bp, Homo sapiens
gtgctgggattacaggtgtgag

SEQ ID NO: 9168307 - DNA, 22 bp, Homo sapiens
gtgctgggattacaggtgtgag

SEQ ID NO: 9168308 - DNA, 22 bp, Homo sapiens
gtgctgggattacaggtgtgag

SEQ ID NO: 9168309 - DNA, 22 bp, Homo sapiens
gtgctggggagataggaagaga

SEQ ID NO: 9168310 - DNA, 23 bp, Homo sapiens
gtgctgtgagccccttggcctcc

SEQ ID NO: 9168311 - DNA, 22 bp, Homo sapiens
gtgcttgggggaagtaacagac

SEQ ID NO: 9168312 - DNA, 22 bp, Homo sapiens
gtgctgtatcagaatctgctct

SEQ ID NO: 9168313 - DNA, 22 bp, Homo sapiens
gtgctgggtgctgcagacaggt

SEQ ID NO: 9168314 - DNA, 22 bp, Homo sapiens
gtgctgggggtttctgtaggtc

SEQ ID NO: 9168315 - DNA, 22 bp, Homo sapiens
gtgctgggggtttctgtaggtc

SEQ ID NO: 9168316 - DNA, 22 bp, Homo sapiens
gtgctgggtgctgcagacaggt

SEQ ID NO: 9168317 - DNA, 22 bp, Homo sapiens
tcatccctctgccaggcccagg

SEQ ID NO: 9168318 - DNA, 22 bp, Homo sapiens
tcatccgtgaagccaaagaaat

SEQ ID NO: 9168319 - DNA, 22 bp, Homo sapiens
tcatccctctgccaggcccagg

SEQ ID NO: 9168320 - DNA, 22 bp, Homo sapiens
tcatcctgcactggctcctcct

SEQ ID NO: 9168321 - DNA, 22 bp, Homo sapiens
tcatccagttcacatggtgagt

SEQ ID NO: 9168322 - DNA, 22 bp, Homo sapiens
tcatccagtatgactggtgtct

SEQ ID NO: 9168323 - DNA, 22 bp, Homo sapiens
tcatctaagagtcttacattta

SEQ ID NO: 9168324 - DNA, 22 bp, Homo sapiens
tcatctaagagtcttacattta

SEQ ID NO: 9168325 - DNA, 22 bp, Homo sapiens
tcatcctgcactggctcctcct

SEQ ID NO: 9168326 - DNA, 22 bp, Homo sapiens
tcatcctgcactggctcctcct

SEQ ID NO: 9168327 - DNA, 22 bp, Homo sapiens
tcatctatttatgtagaacaag

SEQ ID NO: 9168328 - DNA, 22 bp, Homo sapiens
tcataaaagtactcatgttcat

SEQ ID NO: 9168329 - DNA, 22 bp, Homo sapiens
tcataaaagtactcatgttcat

SEQ ID NO: 9168330 - DNA, 22 bp, Homo sapiens
tcataaaatgctcctgatattg

SEQ ID NO: 9168331 - DNA, 22 bp, Homo sapiens
tcatcaaagcgcttggagtagg

SEQ ID NO: 9168332 - DNA, 21 bp, Homo sapiens
tcatccaggtcctgcttcttc

SEQ ID NO: 9168333 - DNA, 20 bp, Homo sapiens
tcatccaggacaggagtggc

SEQ ID NO: 9168334 - DNA, 20 bp, Homo sapiens
tcatccaggacaggagtggc

SEQ ID NO: 9168335 - DNA, 22 bp, Homo sapiens
tcatccagaaaaatgtcttagc

SEQ ID NO: 9168336 - DNA, 22 bp, Homo sapiens
tcatccagcctcatcaggagct

SEQ ID NO: 9168337 - DNA, 22 bp, Homo sapiens
tcatccagcctcatcaggagct

SEQ ID NO: 9168338 - DNA, 22 bp, Homo sapiens
tcagtttttaaatgatataatt

SEQ ID NO: 9168339 - DNA, 22 bp, Homo sapiens
tcagtttttacggtcacaggga

SEQ ID NO: 9168340 - DNA, 22 bp, Homo sapiens
tcagtttttaagagttatgcga

SEQ ID NO: 9168341 - DNA, 22 bp, Homo sapiens
tcagttttctcatttatgagat

SEQ ID NO: 9168342 - DNA, 22 bp, Homo sapiens
tcagttttgaaaacattgaatg

SEQ ID NO: 9168343 - DNA, 22 bp, Homo sapiens
tcagttttgaaaacattgaatg

SEQ ID NO: 9168344 - DNA, 22 bp, Homo sapiens
tcagttttctcatctgtaattt

SEQ ID NO: 9168345 - DNA, 22 bp, Homo sapiens
tcagttttctcatctgtgaaat

SEQ ID NO: 9168346 - DNA, 22 bp, Homo sapiens
tcataaaaatagactctaaagt

SEQ ID NO: 9168347 - DNA, 22 bp, Homo sapiens
tcataaaaatagactctaaagt

SEQ ID NO: 9168348 - DNA, 22 bp, Homo sapiens
tcataaaaatagactctaaagt

SEQ ID NO: 9168349 - DNA, 19 bp, Homo sapiens
tcagttttagtcatcagtt

SEQ ID NO: 9168350 - DNA, 19 bp, Homo sapiens
tcagttttagtcatcagtt

SEQ ID NO: 9168351 - DNA, 22 bp, Homo sapiens
tcagttttcaatttcatcagag

SEQ ID NO: 9168352 - DNA, 22 bp, Homo sapiens
tcagttttcaatttcatcagag

SEQ ID NO: 9168353 - DNA, 23 bp, Homo sapiens
tcagtttgtataatccatatgca

SEQ ID NO: 9168354 - DNA, 22 bp, Homo sapiens
tcagtttctttactcatagaat

SEQ ID NO: 9168355 - DNA, 22 bp, Homo sapiens
tcagtttcttctttagataaaa

SEQ ID NO: 9168356 - DNA, 22 bp, Homo sapiens
tcagttctaacagtttagaaca

SEQ ID NO: 9168357 - DNA, 22 bp, Homo sapiens
tcagtttcttctttagataaaa

SEQ ID NO: 9168358 - DNA, 22 bp, Homo sapiens
tcagtttctccatcgctccagt

SEQ ID NO: 9168359 - DNA, 22 bp, Homo sapiens
tcagtttctccatcgctccagt

SEQ ID NO: 9168360 - DNA, 22 bp, Homo sapiens
tcagtttcttcatctccctaac

SEQ ID NO: 9168361 - DNA, 22 bp, Homo sapiens
tcagtttcttcatctccctaac

SEQ ID NO: 9168362 - DNA, 22 bp, Homo sapiens
tcagtttcctggttttgacatt

SEQ ID NO: 9168363 - DNA, 22 bp, Homo sapiens
tcagtttctaaatcttaccaat

SEQ ID NO: 9168364 - DNA, 22 bp, Homo sapiens
tcagtttctacctactatgtgt

SEQ ID NO: 9168365 - DNA, 22 bp, Homo sapiens
tcagtttctaaatcttaccaat

SEQ ID NO: 9168366 - DNA, 22 bp, Homo sapiens
tcagttagggcctcagaagaca

SEQ ID NO: 9168367 - DNA, 22 bp, Homo sapiens
tcagttatcattgctgtaaatt

SEQ ID NO: 9168368 - DNA, 23 bp, Homo sapiens
tcagttattggtgataaagctgg

SEQ ID NO: 9168369 - DNA, 22 bp, Homo sapiens
tcagttagcgtaatcactgggg

SEQ ID NO: 9168370 - DNA, 20 bp, Homo sapiens
tcagttaggaagaggcactc

SEQ ID NO: 9168371 - DNA, 22 bp, Homo sapiens
tcagttagattgcctccttaga

SEQ ID NO: 9168372 - DNA, 22 bp, Homo sapiens
tcagttactcctttccttaggt

SEQ ID NO: 9168373 - DNA, 22 bp, Homo sapiens
tcagtggagctaagcatgagat

SEQ ID NO: 9168374 - DNA, 22 bp, Homo sapiens
tcagtggagtatggatgaagtc

SEQ ID NO: 9168375 - DNA, 22 bp, Homo sapiens
tcagtggagtatggatgaagtc

SEQ ID NO: 9168376 - DNA, 22 bp, Homo sapiens
tcagtggagctaagcatgagat

SEQ ID NO: 9168377 - DNA, 19 bp, Homo sapiens
tcagtggatgaacatgttt

SEQ ID NO: 9168378 - DNA, 22 bp, Homo sapiens
tcagtggattgacatgaaaaag

SEQ ID NO: 9168379 - DNA, 22 bp, Homo sapiens
tcagtggatatttctgtggctg

SEQ ID NO: 9168380 - DNA, 22 bp, Homo sapiens
tcagtggagtatggatgaagtc

SEQ ID NO: 9168381 - DNA, 22 bp, Homo sapiens
tcagtggattgtagaaggctta

SEQ ID NO: 9168382 - DNA, 22 bp, Homo sapiens
tcagtggattgtagaaggctta

SEQ ID NO: 9168383 - DNA, 22 bp, Homo sapiens
tcagtggattgacatgaaaaag

SEQ ID NO: 9168384 - DNA, 22 bp, Homo sapiens
tcagtggattggatgagatctg

SEQ ID NO: 9168385 - DNA, 22 bp, Homo sapiens
tcagtggatatttctgtggctg

SEQ ID NO: 9168386 - DNA, 22 bp, Homo sapiens
tcagtgcttgcctctggaggag

SEQ ID NO: 9168387 - DNA, 22 bp, Homo sapiens
tcagtgcttcctggaggaagcc

SEQ ID NO: 9168388 - DNA, 22 bp, Homo sapiens
tcagtggaactgtctgggtgag

SEQ ID NO: 9168389 - DNA, 22 bp, Homo sapiens
tcagtggaactgtctgggtgag

SEQ ID NO: 9168390 - DNA, 22 bp, Homo sapiens
tcagtggagagcttccaggatt

SEQ ID NO: 9168391 - DNA, 19 bp, Homo sapiens
tcagtggagaaaggggaag

SEQ ID NO: 9168392 - DNA, 19 bp, Homo sapiens
tcagtggagaaaggggaag

SEQ ID NO: 9168393 - DNA, 19 bp, Homo sapiens
tcagtggagaaaggggaag

SEQ ID NO: 9168394 - DNA, 22 bp, Homo sapiens
tcagtgcttttgtcacatggtc

SEQ ID NO: 9168395 - DNA, 22 bp, Homo sapiens
tcaggctcaggttaggggccaa

SEQ ID NO: 9168396 - DNA, 22 bp, Homo sapiens
tcaggctccctgctgggctctg

SEQ ID NO: 9168397 - DNA, 22 bp, Homo sapiens
tcaggcctttgaacttggagtg

SEQ ID NO: 9168398 - DNA, 22 bp, Homo sapiens
tcaggcctttcttcagagcttc

SEQ ID NO: 9168399 - DNA, 22 bp, Homo sapiens
tcaggctgaatcatcctagctt

SEQ ID NO: 9168400 - DNA, 22 bp, Homo sapiens
tcaggctgaatcatcctagctt

SEQ ID NO: 9168401 - DNA, 22 bp, Homo sapiens
tcaggctgaaaggactccagtt

SEQ ID NO: 9168402 - DNA, 22 bp, Homo sapiens
tcagggcacattctgcagtggc

SEQ ID NO: 9168403 - DNA, 22 bp, Homo sapiens
tcagggactgcagagggaagct

SEQ ID NO: 9168404 - DNA, 22 bp, Homo sapiens
tcagggagagcctgtctgacgt

SEQ ID NO: 9168405 - DNA, 22 bp, Homo sapiens
tcagggagagcctgtctgacgt

SEQ ID NO: 9168406 - DNA, 22 bp, Homo sapiens
tcagggtcaggacccagctgtt

SEQ ID NO: 9168407 - DNA, 22 bp, Homo sapiens
tcagggtgaaccaggcaggaat

SEQ ID NO: 9168408 - DNA, 22 bp, Homo sapiens
tcaggtccagctcctgtgcctc

SEQ ID NO: 9168409 - DNA, 20 bp, Homo sapiens
tcaggtagatctttgaggtc

SEQ ID NO: 9168410 - DNA, 22 bp, Homo sapiens
tcagtgcattaataatatcagt

SEQ ID NO: 9168411 - DNA, 22 bp, Homo sapiens
tcagtgcattcatgggtggctg

SEQ ID NO: 9168412 - DNA, 22 bp, Homo sapiens
tcagtgcatggacagatttaga

SEQ ID NO: 9168413 - DNA, 22 bp, Homo sapiens
tcagtgcatggacagatttaga

SEQ ID NO: 9168414 - DNA, 22 bp, Homo sapiens
tcagtgcatcacagaactttgt

SEQ ID NO: 9168415 - DNA, 22 bp, Homo sapiens
tcagtgcagtgaaaggtttact

SEQ ID NO: 9168416 - DNA, 22 bp, Homo sapiens
tcagtgcagtgaaaggtttact

SEQ ID NO: 9168417 - DNA, 20 bp, Homo sapiens
tcaggtgacacacgtggcac

SEQ ID NO: 9168418 - DNA, 22 bp, Homo sapiens
tcaggtctatactatgagaggc

SEQ ID NO: 9168419 - DNA, 22 bp, Homo sapiens
tcaggtctatagaagaggaggg

SEQ ID NO: 9168420 - DNA, 22 bp, Homo sapiens
tcaggtctgtactattgtcttg

SEQ ID NO: 9168421 - DNA, 22 bp, Homo sapiens
tcaggtctgatgcctcatccat

SEQ ID NO: 9168422 - DNA, 22 bp, Homo sapiens
tcaggtctgtactattgtcttg

SEQ ID NO: 9168423 - DNA, 22 bp, Homo sapiens
tcaggtctgatgcctcatccat

SEQ ID NO: 9168424 - DNA, 22 bp, Homo sapiens
tcaggtctgggcacatggtaca

SEQ ID NO: 9168425 - DNA, 22 bp, Homo sapiens
tcaggtcttgagccatcaggat

SEQ ID NO: 9168426 - DNA, 22 bp, Homo sapiens
tcaggtcttttgtctcctagaa

SEQ ID NO: 9168427 - DNA, 22 bp, Homo sapiens
tcagggctgccgggcagaccgt

SEQ ID NO: 9168428 - DNA, 22 bp, Homo sapiens
tcagggctggcttttgcagagc

SEQ ID NO: 9168429 - DNA, 22 bp, Homo sapiens
tcagggctgccgggcagaccgt

SEQ ID NO: 9168430 - DNA, 22 bp, Homo sapiens
tcagggctggcttttgcagagc

SEQ ID NO: 9168431 - DNA, 22 bp, Homo sapiens
tcagggctgtggttccttttct

SEQ ID NO: 9168432 - DNA, 22 bp, Homo sapiens
tcagggcacgtttctgcaatgc

SEQ ID NO: 9168433 - DNA, 21 bp, Homo sapiens
tcaggggctgtgttttccatc

SEQ ID NO: 9168434 - DNA, 21 bp, Homo sapiens
tcagcttgcttcattattatg

SEQ ID NO: 9168435 - DNA, 20 bp, Homo sapiens
tcagcttgggtgaagttcat

SEQ ID NO: 9168436 - DNA, 22 bp, Homo sapiens
tcagcttctccaagtgacatgg

SEQ ID NO: 9168437 - DNA, 22 bp, Homo sapiens
tcagcttctccaagtgacatgg

SEQ ID NO: 9168438 - DNA, 22 bp, Homo sapiens
tcagcttctccaagtgacatgg

SEQ ID NO: 9168439 - DNA, 19 bp, Homo sapiens
tcagcttctgtgtattgta

SEQ ID NO: 9168440 - DNA, 22 bp, Homo sapiens
tcagcttctttcacttaacatg

SEQ ID NO: 9168441 - DNA, 22 bp, Homo sapiens
tcagcttctcaaaatggcttag

SEQ ID NO: 9168442 - DNA, 18 bp, Homo sapiens
tcagcttccagcatgttt

SEQ ID NO: 9168443 - DNA, 23 bp, Homo sapiens
tcagcttcattgtcttctatggc

SEQ ID NO: 9168444 - DNA, 22 bp, Homo sapiens
tcagcttcaaatttggtgaagt

SEQ ID NO: 9168445 - DNA, 22 bp, Homo sapiens
tcagctgtgtatcccagggcct

SEQ ID NO: 9168446 - DNA, 22 bp, Homo sapiens
tcagctgtgtatcccagggcct

SEQ ID NO: 9168447 - DNA, 22 bp, Homo sapiens
tcagctgtatcttgctgcactt

SEQ ID NO: 9168448 - DNA, 22 bp, Homo sapiens
tcagctgtccgcagcccacttc

SEQ ID NO: 9168449 - DNA, 22 bp, Homo sapiens
tcagcccagcccagcaagtgca

SEQ ID NO: 9168450 - DNA, 22 bp, Homo sapiens
tcagcccagcccagcaagtgca

SEQ ID NO: 9168451 - DNA, 18 bp, Homo sapiens
tcagcccagagcccagtt

SEQ ID NO: 9168452 - DNA, 22 bp, Homo sapiens
tcagcctctctgagtccagacc

SEQ ID NO: 9168453 - DNA, 22 bp, Homo sapiens
tcagcctcattttctgctctgt

SEQ ID NO: 9168454 - DNA, 22 bp, Homo sapiens
tcagccagttgccccagttagt

SEQ ID NO: 9168455 - DNA, 22 bp, Homo sapiens
tcagccagttgccccagttagt

SEQ ID NO: 9168456 - DNA, 22 bp, Homo sapiens
tcagccagtgtgcacctggagt

SEQ ID NO: 9168457 - DNA, 22 bp, Homo sapiens
tcagccagttaaggcttagaca

SEQ ID NO: 9168458 - DNA, 22 bp, Homo sapiens
tcagccagttaaggcttagaca

SEQ ID NO: 9168459 - DNA, 20 bp, Homo sapiens
tcagccattccttacctttc

SEQ ID NO: 9168460 - DNA, 23 bp, Homo sapiens
tcagcccacatctagtcattagc

SEQ ID NO: 9168461 - DNA, 22 bp, Homo sapiens
tcagcccaaccctgcacaagga

SEQ ID NO: 9168462 - DNA, 22 bp, Homo sapiens
tcagcccaaccctgcacaagga

SEQ ID NO: 9168463 - DNA, 22 bp, Homo sapiens
tcagcccaccttcaggggagtt

SEQ ID NO: 9168464 - DNA, 22 bp, Homo sapiens
tcagcccagaccacctcattgc

SEQ ID NO: 9168465 - DNA, 22 bp, Homo sapiens
tcagcccacctggtgtggggct

SEQ ID NO: 9168466 - DNA, 22 bp, Homo sapiens
tcagaggtggtaaaggacagca

SEQ ID NO: 9168467 - DNA, 22 bp, Homo sapiens
tcagagtctcccccagtttggg

SEQ ID NO: 9168468 - DNA, 22 bp, Homo sapiens
tcagccagggctctggcctcag

SEQ ID NO: 9168469 - DNA, 22 bp, Homo sapiens
tcagccagggggagagaatgga

SEQ ID NO: 9168470 - DNA, 22 bp, Homo sapiens
tcagccagtatttgagtgctca

SEQ ID NO: 9168471 - DNA, 22 bp, Homo sapiens
tcagccaggtaatgtggagatg

SEQ ID NO: 9168472 - DNA, 22 bp, Homo sapiens
tcagaggctggaagagcctcct

SEQ ID NO: 9168473 - DNA, 22 bp, Homo sapiens
tcagaggcttgaagcccaagcc

SEQ ID NO: 9168474 - DNA, 22 bp, Homo sapiens
tcagaggcttgaagcccaagcc

SEQ ID NO: 9168475 - DNA, 22 bp, Homo sapiens
tcagaggtagtagcagagttga

SEQ ID NO: 9168476 - DNA, 22 bp, Homo sapiens
tcaggcaggctcagaggaaaac

SEQ ID NO: 9168477 - DNA, 22 bp, Homo sapiens
tcaggcaggtggctggctatgg

SEQ ID NO: 9168478 - DNA, 22 bp, Homo sapiens
tcaggcaggtggctggctatgg

SEQ ID NO: 9168479 - DNA, 22 bp, Homo sapiens
tcaggcaggctcagaggaaaac

SEQ ID NO: 9168480 - DNA, 22 bp, Homo sapiens
tcaggcaggttggctgcaggtc

SEQ ID NO: 9168481 - DNA, 22 bp, Homo sapiens
tcaggccttgtcctgacctcct

SEQ ID NO: 9168482 - DNA, 22 bp, Homo sapiens
tcaggcaggtggctggctatgg

SEQ ID NO: 9168483 - DNA, 22 bp, Homo sapiens
tcaggcaggtggctggctatgg

SEQ ID NO: 9168484 - DNA, 22 bp, Homo sapiens
tcaggcaggttggctgcaggtc

SEQ ID NO: 9168485 - DNA, 22 bp, Homo sapiens
tcaggcaggtggctggctatgg

SEQ ID NO: 9168486 - DNA, 21 bp, Homo sapiens
tcaggcaggcgcagagggaag

SEQ ID NO: 9168487 - DNA, 22 bp, Homo sapiens
tcaggcaggcagagggcaaatg

SEQ ID NO: 9168488 - DNA, 22 bp, Homo sapiens
tcaggcaggacaattatttagg

SEQ ID NO: 9168489 - DNA, 22 bp, Homo sapiens
tcaggcaggaagggaggacttg

SEQ ID NO: 9168490 - DNA, 22 bp, Homo sapiens
tcaggcaggaagggaggacttg

SEQ ID NO: 9168491 - DNA, 22 bp, Homo sapiens
tcaggaggtgtaacgaatacag

SEQ ID NO: 9168492 - DNA, 22 bp, Homo sapiens
tcaggaggtctgctgcggggtg

SEQ ID NO: 9168493 - DNA, 22 bp, Homo sapiens
tcaggaggtctgctgcggggtg

SEQ ID NO: 9168494 - DNA, 22 bp, Homo sapiens
tcaggcaccccttgagtagggg

SEQ ID NO: 9168495 - DNA, 22 bp, Homo sapiens
tcaggcaccccttgagtagggg

SEQ ID NO: 9168496 - DNA, 22 bp, Homo sapiens
tcaggcaatctgacagctggag

SEQ ID NO: 9168497 - DNA, 22 bp, Homo sapiens
tcaggatgttaatatagcatta

SEQ ID NO: 9168498 - DNA, 22 bp, Homo sapiens
tcaggaggtaaggtaaaacaga

SEQ ID NO: 9168499 - DNA, 22 bp, Homo sapiens
tcaggaggtccgcccgggaggg

SEQ ID NO: 9168500 - DNA, 22 bp, Homo sapiens
tcaggaggtaggacatactggt

SEQ ID NO: 9168501 - DNA, 22 bp, Homo sapiens
tcaggaggtccgcccgggaggg

SEQ ID NO: 9168502 - DNA, 19 bp, Homo sapiens
tcaggaggtcgacctggca

SEQ ID NO: 9168503 - DNA, 23 bp, Homo sapiens
tcaggcagctggggtagttggag

SEQ ID NO: 9168504 - DNA, 22 bp, Homo sapiens
tcaggcagcattaaacttcagc

SEQ ID NO: 9168505 - DNA, 22 bp, Homo sapiens
tcaggcagatgcagggatggat

SEQ ID NO: 9168506 - DNA, 22 bp, Homo sapiens
tcaggcagagttaatttgctcc

SEQ ID NO: 9168507 - DNA, 22 bp, Homo sapiens
tcaggaaaggcagagtgtctgt

SEQ ID NO: 9168508 - DNA, 22 bp, Homo sapiens
tcaggaaagagttagatgatta

SEQ ID NO: 9168509 - DNA, 22 bp, Homo sapiens
tcaggaaagagtgtatccatca

SEQ ID NO: 9168510 - DNA, 22 bp, Homo sapiens
tcaggaaagagtaatgtataca

SEQ ID NO: 9168511 - DNA, 22 bp, Homo sapiens
tcaggagcagccttggagagcg

SEQ ID NO: 9168512 - DNA, 22 bp, Homo sapiens
tcaggagcagcatgggtgagag

SEQ ID NO: 9168513 - DNA, 22 bp, Homo sapiens
tcaggagatgtaaccttagctg

SEQ ID NO: 9168514 - DNA, 22 bp, Homo sapiens
tcaggagggattgttgcctatt

SEQ ID NO: 9168515 - DNA, 22 bp, Homo sapiens
tcaggagggagtgtggatagag

SEQ ID NO: 9168516 - DNA, 22 bp, Homo sapiens
tcaggagggctaagactgtagc

SEQ ID NO: 9168517 - DNA, 22 bp, Homo sapiens
tcaggagggattgttgcctatt

SEQ ID NO: 9168518 - DNA, 22 bp, Homo sapiens
tcaggagggtgacaggccctgg

SEQ ID NO: 9168519 - DNA, 22 bp, Homo sapiens
tcaggagggctaagactgtagc

SEQ ID NO: 9168520 - DNA, 22 bp, Homo sapiens
tcaggagggtctctattttcct

SEQ ID NO: 9168521 - DNA, 22 bp, Homo sapiens
tcaggaggagctcataagtttg

SEQ ID NO: 9168522 - DNA, 22 bp, Homo sapiens
tcaggaggacagataaggatag

SEQ ID NO: 9168523 - DNA, 22 bp, Homo sapiens
tcaggagcttggtagtgtgatt

SEQ ID NO: 9168524 - DNA, 22 bp, Homo sapiens
tcaggaggcaagtaggtattga

SEQ ID NO: 9168525 - DNA, 22 bp, Homo sapiens
tcaggaggatgtcggcaaattt

SEQ ID NO: 9168526 - DNA, 22 bp, Homo sapiens
tcaggagcctgaaagaggtcta

SEQ ID NO: 9168527 - DNA, 22 bp, Homo sapiens
tcaggagcaggttgtttggttt

SEQ ID NO: 9168528 - DNA, 22 bp, Homo sapiens
tcaggagcatatattgatgtct

SEQ ID NO: 9168529 - DNA, 22 bp, Homo sapiens
tcaggagctcaggctgatggaa

SEQ ID NO: 9168530 - DNA, 22 bp, Homo sapiens
tcaggagctgcactgggcccac

SEQ ID NO: 9168531 - DNA, 22 bp, Homo sapiens
tcagaacatggcatgttccatc

SEQ ID NO: 9168532 - DNA, 22 bp, Homo sapiens
tcagaacattacattttgagct

SEQ ID NO: 9168533 - DNA, 22 bp, Homo sapiens
tcagaacattctcattgactgc

SEQ ID NO: 9168534 - DNA, 22 bp, Homo sapiens
tcagaacattctcattgactgc

SEQ ID NO: 9168535 - DNA, 22 bp, Homo sapiens
tcagaacattgacattcttatt

SEQ ID NO: 9168536 - DNA, 22 bp, Homo sapiens
tcagaacatttaaaaagtggtt

SEQ ID NO: 9168537 - DNA, 21 bp, Homo sapiens
tcagaactggtgcagatgaat

SEQ ID NO: 9168538 - DNA, 22 bp, Homo sapiens
tcagaagaaggtatatttatac

SEQ ID NO: 9168539 - DNA, 22 bp, Homo sapiens
tcagaagaaagatgttattact

SEQ ID NO: 9168540 - DNA, 22 bp, Homo sapiens
tcagaagaaaagacttttagag

SEQ ID NO: 9168541 - DNA, 22 bp, Homo sapiens
tcagaagcaaacatcactctag

SEQ ID NO: 9168542 - DNA, 22 bp, Homo sapiens
tcagaagcaagcttctacttct

SEQ ID NO: 9168543 - DNA, 22 bp, Homo sapiens
tcagaagactactaggacacat

SEQ ID NO: 9168544 - DNA, 21 bp, Homo sapiens
tcagaagagctgcctcttggt

SEQ ID NO: 9168545 - DNA, 22 bp, Homo sapiens
tcagaagataaagctttttgtt

SEQ ID NO: 9168546 - DNA, 22 bp, Homo sapiens
tcagaagcagatatttcaaaat

SEQ ID NO: 9168547 - DNA, 22 bp, Homo sapiens
tcagaagcaggagtgtgcacaa

SEQ ID NO: 9168548 - DNA, 22 bp, Homo sapiens
tcagagaagtaggctaatggtg

SEQ ID NO: 9168549 - DNA, 22 bp, Homo sapiens
tcagagaaggtaagtgacctgc

SEQ ID NO: 9168550 - DNA, 22 bp, Homo sapiens
tcagagaatctctccttagttt

SEQ ID NO: 9168551 - DNA, 21 bp, Homo sapiens
tcagagaatggcctactctca

SEQ ID NO: 9168552 - DNA, 22 bp, Homo sapiens
tcagaggattggacttttatgt

SEQ ID NO: 9168553 - DNA, 22 bp, Homo sapiens
tcagaggattggacttttatgt

SEQ ID NO: 9168554 - DNA, 19 bp, Homo sapiens
tcagaggatttggctatga

SEQ ID NO: 9168555 - DNA, 22 bp, Homo sapiens
tcagaggattgcctcagcgagc

SEQ ID NO: 9168556 - DNA, 18 bp, Homo sapiens
tcagaggagatacctaaa

SEQ ID NO: 9168557 - DNA, 22 bp, Homo sapiens
tcagaggagaccaaggggaata

SEQ ID NO: 9168558 - DNA, 22 bp, Homo sapiens
tcagaggactaccttctccagt

SEQ ID NO: 9168559 - DNA, 22 bp, Homo sapiens
tcagaggagaagttgggaaaat

SEQ ID NO: 9168560 - DNA, 22 bp, Homo sapiens
tcagaggagaagttgggaaaat

SEQ ID NO: 9168561 - DNA, 22 bp, Homo sapiens
tcagaggactaccttctccagt

SEQ ID NO: 9168562 - DNA, 22 bp, Homo sapiens
tcagaggcctatgtctacaact

SEQ ID NO: 9168563 - DNA, 19 bp, Homo sapiens
tcagaggatttggctatga

SEQ ID NO: 9168564 - DNA, 21 bp, Homo sapiens
tcagaggcactgagagcaatg

SEQ ID NO: 9168565 - DNA, 22 bp, Homo sapiens
tcagaggcagctgatgttctgt

SEQ ID NO: 9168566 - DNA, 22 bp, Homo sapiens
tcagaggccaaactgagcaggg

SEQ ID NO: 9168567 - DNA, 22 bp, Homo sapiens
tcagagagcctcaggcactgcc

SEQ ID NO: 9168568 - DNA, 22 bp, Homo sapiens
tcagagagctggtgggcagagg

SEQ ID NO: 9168569 - DNA, 22 bp, Homo sapiens
tcagagacagttctggggcagg

SEQ ID NO: 9168570 - DNA, 22 bp, Homo sapiens
tcagagactgtaggagcagcct

SEQ ID NO: 9168571 - DNA, 22 bp, Homo sapiens
tcagaggacagcagctaaataa

SEQ ID NO: 9168572 - DNA, 22 bp, Homo sapiens
tcagaggacagcagctaaataa

SEQ ID NO: 9168573 - DNA, 22 bp, Homo sapiens
tcagaggacagcagctaaataa

SEQ ID NO: 9168574 - DNA, 22 bp, Homo sapiens
tcagaggaccttactgagaacc

SEQ ID NO: 9168575 - DNA, 22 bp, Homo sapiens
tcagaggaccttactgagaacc

SEQ ID NO: 9168576 - DNA, 22 bp, Homo sapiens
tcagaggacaagctccctggtg

SEQ ID NO: 9168577 - DNA, 22 bp, Homo sapiens
tcagaggaatttgcttttcatg

SEQ ID NO: 9168578 - DNA, 22 bp, Homo sapiens
tcagaggacaagctccctggtg

SEQ ID NO: 9168579 - DNA, 22 bp, Homo sapiens
tcagaggaatttgcttttcatg

SEQ ID NO: 9168580 - DNA, 22 bp, Homo sapiens
tcagaggaataatgctgcattt

SEQ ID NO: 9168581 - DNA, 23 bp, Homo sapiens
tcagagagctgttgagagctgcc

SEQ ID NO: 9168582 - DNA, 22 bp, Homo sapiens
tcacatctgcctccatagcacc

SEQ ID NO: 9168583 - DNA, 22 bp, Homo sapiens
tcacatctgtgtgattgtcatt

SEQ ID NO: 9168584 - DNA, 22 bp, Homo sapiens
tcacatctgtgtgattgtcatt

SEQ ID NO: 9168585 - DNA, 22 bp, Homo sapiens
tcacatcttattagagtatctc

SEQ ID NO: 9168586 - DNA, 22 bp, Homo sapiens
tcacatgaaatgctgtaaagaa

SEQ ID NO: 9168587 - DNA, 22 bp, Homo sapiens
tcacatgaggttatgacaaagc

SEQ ID NO: 9168588 - DNA, 22 bp, Homo sapiens
tcaccggtgaccctcggctcgc

SEQ ID NO: 9168589 - DNA, 22 bp, Homo sapiens
tcaccggcagacgtggcctgat

SEQ ID NO: 9168590 - DNA, 22 bp, Homo sapiens
tcacccttgataatgttcttct

SEQ ID NO: 9168591 - DNA, 22 bp, Homo sapiens
tcacccatgtgtctcccttata

SEQ ID NO: 9168592 - DNA, 22 bp, Homo sapiens
tcacccctccattctctcatgt

SEQ ID NO: 9168593 - DNA, 22 bp, Homo sapiens
tcaccttgtgatccgcccacct

SEQ ID NO: 9168594 - DNA, 22 bp, Homo sapiens
tcaccttgtgatctccctgcct

SEQ ID NO: 9168595 - DNA, 22 bp, Homo sapiens
tcacgcatggacggtcaacatc

SEQ ID NO: 9168596 - DNA, 22 bp, Homo sapiens
tcacctcttttttaacaggctt

SEQ ID NO: 9168597 - DNA, 22 bp, Homo sapiens
tcacctctactcagcctagttc

SEQ ID NO: 9168598 - DNA, 22 bp, Homo sapiens
tcagaacagttcttaatattgc

SEQ ID NO: 9168599 - DNA, 22 bp, Homo sapiens
tcagaacagtgcctggcactaa

SEQ ID NO: 9168600 - DNA, 22 bp, Homo sapiens
tcagaacatatattttgtgatg

SEQ ID NO: 9168601 - DNA, 22 bp, Homo sapiens
tcactgtatttgctgatgcata

SEQ ID NO: 9168602 - DNA, 22 bp, Homo sapiens
tcactgtatttggaagggatgg

SEQ ID NO: 9168603 - DNA, 22 bp, Homo sapiens
tcactgtcactaggcaccaaac

SEQ ID NO: 9168604 - DNA, 21 bp, Homo sapiens
tcactgtgcaaatgttgatgg

SEQ ID NO: 9168605 - DNA, 23 bp, Homo sapiens
tcactgtcctgctcctggaacgc

SEQ ID NO: 9168606 - DNA, 22 bp, Homo sapiens
tcactgggtaggacatgctgat

SEQ ID NO: 9168607 - DNA, 22 bp, Homo sapiens
tcactggggcctttggtcagga

SEQ ID NO: 9168608 - DNA, 22 bp, Homo sapiens
tcactgtaccttccatttcatt

SEQ ID NO: 9168609 - DNA, 22 bp, Homo sapiens
tcactgtagtgagcagaatata

SEQ ID NO: 9168610 - DNA, 20 bp, Homo sapiens
tcactgtaattgcctacatt

SEQ ID NO: 9168611 - DNA, 22 bp, Homo sapiens
tcactgtaaagtaatactgtca

SEQ ID NO: 9168612 - DNA, 22 bp, Homo sapiens
tcactgggagagctgacaagga

SEQ ID NO: 9168613 - DNA, 22 bp, Homo sapiens
tcactgggagatgtgggaaggg

SEQ ID NO: 9168614 - DNA, 22 bp, Homo sapiens
tcactgggagatgtgggaaggg

SEQ ID NO: 9168615 - DNA, 22 bp, Homo sapiens
tcactgggagagctgacaagga

SEQ ID NO: 9168616 - DNA, 22 bp, Homo sapiens
tcactgggagagctgacaagga

SEQ ID NO: 9168617 - DNA, 18 bp, Homo sapiens
tcactgggagaagatatt

SEQ ID NO: 9168618 - DNA, 22 bp, Homo sapiens
tcactggattaagcattgacat

SEQ ID NO: 9168619 - DNA, 22 bp, Homo sapiens
tcactggagaaaagtaatgtat

SEQ ID NO: 9168620 - DNA, 22 bp, Homo sapiens
tcactggactcactgtggccag

SEQ ID NO: 9168621 - DNA, 22 bp, Homo sapiens
tcactggatcctagctgagcct

SEQ ID NO: 9168622 - DNA, 22 bp, Homo sapiens
tcactggattctcttttgttcc

SEQ ID NO: 9168623 - DNA, 22 bp, Homo sapiens
tcactggattagtttgaactgt

SEQ ID NO: 9168624 - DNA, 22 bp, Homo sapiens
tcactgggagatgtgggaaggg

SEQ ID NO: 9168625 - DNA, 22 bp, Homo sapiens
tcactgggccctgaggtgggac

SEQ ID NO: 9168626 - DNA, 22 bp, Homo sapiens
tcactaatagggggagcatagg

SEQ ID NO: 9168627 - DNA, 21 bp, Homo sapiens
tcacgtggtcacatgagcttt

SEQ ID NO: 9168628 - DNA, 22 bp, Homo sapiens
tcacgttaatatttgtcaggta

SEQ ID NO: 9168629 - DNA, 22 bp, Homo sapiens
tcacgttttactgagtgagata

SEQ ID NO: 9168630 - DNA, 21 bp, Homo sapiens
tcactggacgtgagccagggg

SEQ ID NO: 9168631 - DNA, 21 bp, Homo sapiens
tcactggaatacaattgattt

SEQ ID NO: 9168632 - DNA, 22 bp, Homo sapiens
tcactggaaatgcacagctgta

SEQ ID NO: 9168633 - DNA, 22 bp, Homo sapiens
tcactggaaagacagcactctt

SEQ ID NO: 9168634 - DNA, 22 bp, Homo sapiens
tcactgcttcttggagaatgtc

SEQ ID NO: 9168635 - DNA, 22 bp, Homo sapiens
tcaatgattagagtttagtgtg

SEQ ID NO: 9168636 - DNA, 22 bp, Homo sapiens
tcaatgatagtacaatcagcct

SEQ ID NO: 9168637 - DNA, 22 bp, Homo sapiens
tcaatgcaatcattggacaagt

SEQ ID NO: 9168638 - DNA, 22 bp, Homo sapiens
tcaatgcaatcattggacaagt

SEQ ID NO: 9168639 - DNA, 22 bp, Homo sapiens
tcaaactagcctgactggtatt

SEQ ID NO: 9168640 - DNA, 22 bp, Homo sapiens
tcaatacatacaatgtatagtg

SEQ ID NO: 9168641 - DNA, 22 bp, Homo sapiens
tcaaacagaggaacaattgttt

SEQ ID NO: 9168642 - DNA, 22 bp, Homo sapiens
tcaaacaggactacattctcat

SEQ ID NO: 9168643 - DNA, 22 bp, Homo sapiens
tcaaacagcaggtctttcatag

SEQ ID NO: 9168644 - DNA, 23 bp, Homo sapiens
tcaaacatattgtgagacacagg

SEQ ID NO: 9168645 - DNA, 22 bp, Homo sapiens
tcaaacatgaaagcttgatttt

SEQ ID NO: 9168646 - DNA, 22 bp, Homo sapiens
tcaaaccaccttgttactgggg

SEQ ID NO: 9168647 - DNA, 22 bp, Homo sapiens
tcaaaccagccttgcatcccag

SEQ ID NO: 9168648 - DNA, 22 bp, Homo sapiens
tcaaaccatataatcggttaca

SEQ ID NO: 9168649 - DNA, 22 bp, Homo sapiens
tcaaacatgaaagcttgatttt

SEQ ID NO: 9168650 - DNA, 22 bp, Homo sapiens
tcaaaatttcagcactagccct

SEQ ID NO: 9168651 - DNA, 22 bp, Homo sapiens
tcaaaattttatttctcaagga

SEQ ID NO: 9168652 - DNA, 22 bp, Homo sapiens
tcaaacagaaattgttcatgct

SEQ ID NO: 9168653 - DNA, 22 bp, Homo sapiens
tcaaacactgtaacatggaaaa

SEQ ID NO: 9168654 - DNA, 18 bp, Homo sapiens
tcaaaatatttctgtgga

SEQ ID NO: 9168655 - DNA, 22 bp, Homo sapiens
tcaaaattagtgaccaaaggca

SEQ ID NO: 9168656 - DNA, 22 bp, Homo sapiens
tcaaaattaaaccaacgtccag

SEQ ID NO: 9168657 - DNA, 22 bp, Homo sapiens
tcaaaaatggtctttgagctgc

SEQ ID NO: 9168658 - DNA, 22 bp, Homo sapiens
tcaaaagtttcacatagagata

SEQ ID NO: 9168659 - DNA, 22 bp, Homo sapiens
tcaaaagtctgcattcttcaca

SEQ ID NO: 9168660 - DNA, 22 bp, Homo sapiens
tcaaaagtttcacatagagata

SEQ ID NO: 9168661 - DNA, 22 bp, Homo sapiens
tcaaaagtttcacatagagata

SEQ ID NO: 9168662 - DNA, 22 bp, Homo sapiens
tcaatgtctgcggctagctgga

SEQ ID NO: 9168663 - DNA, 22 bp, Homo sapiens
tcaatgtcagctggtaggaaat

SEQ ID NO: 9168664 - DNA, 22 bp, Homo sapiens
tcaatgcatgtgacaaagagta

SEQ ID NO: 9168665 - DNA, 22 bp, Homo sapiens
tcaatgctgccaaatcttctag

SEQ ID NO: 9168666 - DNA, 19 bp, Homo sapiens
tcaatgcatgaaatcagcc

SEQ ID NO: 9168667 - DNA, 22 bp, Homo sapiens
tcaatgcatgtgacaaagagta

SEQ ID NO: 9168668 - DNA, 22 bp, Homo sapiens
tcaatgtaataaaatactctat

SEQ ID NO: 9168669 - DNA, 22 bp, Homo sapiens
tcaatgtcttctcaagtctttt

SEQ ID NO: 9168670 - DNA, 22 bp, Homo sapiens
tcaattatgccattgcaatatt

SEQ ID NO: 9168671 - DNA, 22 bp, Homo sapiens
tcaattacagcaatgactgtac

SEQ ID NO: 9168672 - DNA, 22 bp, Homo sapiens
tcaattacagcaatgactgtac

SEQ ID NO: 9168673 - DNA, 22 bp, Homo sapiens
tcaattcaattgcatttctgtg

SEQ ID NO: 9168674 - DNA, 22 bp, Homo sapiens
tcaattatttgatatgaaaggg

SEQ ID NO: 9168675 - DNA, 22 bp, Homo sapiens
tcaattatttgatatgaaaggg

SEQ ID NO: 9168676 - DNA, 22 bp, Homo sapiens
tcaattctagagccttacattg

SEQ ID NO: 9168677 - DNA, 22 bp, Homo sapiens
tcaattcagtccaacagtaatt

SEQ ID NO: 9168678 - DNA, 22 bp, Homo sapiens
tcaattctagagccttacattg

SEQ ID NO: 9168679 - DNA, 22 bp, Homo sapiens
tcaattctagtggagagagttt

SEQ ID NO: 9168680 - DNA, 22 bp, Homo sapiens
tcaattctagtggagagagttt

SEQ ID NO: 9168681 - DNA, 22 bp, Homo sapiens
tcaattctgcatacatttcact

SEQ ID NO: 9168682 - DNA, 22 bp, Homo sapiens
tcaattctggtcctcaggaact

SEQ ID NO: 9168683 - DNA, 22 bp, Homo sapiens
tcacacacatggatagtatttt

SEQ ID NO: 9168684 - DNA, 22 bp, Homo sapiens
tcacacacatggatagtatttt

SEQ ID NO: 9168685 - DNA, 22 bp, Homo sapiens
tcacacacatttgctgtctgat

SEQ ID NO: 9168686 - DNA, 22 bp, Homo sapiens
tcacacacatttgctgtctgat

SEQ ID NO: 9168687 - DNA, 21 bp, Homo sapiens
tcacacacgtttccaagggca

SEQ ID NO: 9168688 - DNA, 22 bp, Homo sapiens
tcacacacataatctaagatta

SEQ ID NO: 9168689 - DNA, 22 bp, Homo sapiens
tcacaattgtttttaggatcaa

SEQ ID NO: 9168690 - DNA, 23 bp, Homo sapiens
tcacacagctggtcaggtacaga

SEQ ID NO: 9168691 - DNA, 22 bp, Homo sapiens
tcacacagggtcggaaagagtg

SEQ ID NO: 9168692 - DNA, 22 bp, Homo sapiens
tcacacagcttggagttatggt

SEQ ID NO: 9168693 - DNA, 22 bp, Homo sapiens
tcacacagctgacagagccttt

SEQ ID NO: 9168694 - DNA, 22 bp, Homo sapiens
tcacacagctcctttccttagt

SEQ ID NO: 9168695 - DNA, 22 bp, Homo sapiens
tcacacagattggtagagctga

SEQ ID NO: 9168696 - DNA, 22 bp, Homo sapiens
tcacagaatgtctagcataatt

SEQ ID NO: 9168697 - DNA, 22 bp, Homo sapiens
tcacacagggttctggtctcat

SEQ ID NO: 9168698 - DNA, 22 bp, Homo sapiens
tcacacataaaaagaagactag

SEQ ID NO: 9168699 - DNA, 20 bp, Homo sapiens
tcacacataagtgaacgcac

SEQ ID NO: 9168700 - DNA, 22 bp, Homo sapiens
tcacagagctcacagtttagca

SEQ ID NO: 9168701 - DNA, 20 bp, Homo sapiens
tcacagagtagccttgtctg

SEQ ID NO: 9168702 - DNA, 22 bp, Homo sapiens
tcacagagttaaaagtttcttt

SEQ ID NO: 9168703 - DNA, 22 bp, Homo sapiens
tcacagcaaaagtgtgcagagc

SEQ ID NO: 9168704 - DNA, 22 bp, Homo sapiens
tcacatctaattccatttctgc

SEQ ID NO: 9168705 - DNA, 22 bp, Homo sapiens
tcacatctatacccaataattt

SEQ ID NO: 9168706 - DNA, 22 bp, Homo sapiens
tcacatctatacccaataattt

SEQ ID NO: 9168707 - DNA, 22 bp, Homo sapiens
tcacatctctgttttctaaatc

SEQ ID NO: 9168708 - DNA, 22 bp, Homo sapiens
tcacatcaacattatagcatga

SEQ ID NO: 9168709 - DNA, 22 bp, Homo sapiens
tcacatcaacattatagcatga

SEQ ID NO: 9168710 - DNA, 22 bp, Homo sapiens
tcacatcacatgacagtaggcc

SEQ ID NO: 9168711 - DNA, 22 bp, Homo sapiens
tcacatcacatgagtgcaagga

SEQ ID NO: 9168712 - DNA, 22 bp, Homo sapiens
tcacagcctggtcactctgccc

SEQ ID NO: 9168713 - DNA, 22 bp, Homo sapiens
tcacagcctggacagttgcctg

SEQ ID NO: 9168714 - DNA, 16 bp, Homo sapiens
tcacatacttccttgc

SEQ ID NO: 9168715 - DNA, 22 bp, Homo sapiens
tcacagctaagcttggtcactg

SEQ ID NO: 9168716 - DNA, 19 bp, Homo sapiens
tcacagcatctgtctgaac

SEQ ID NO: 9168717 - DNA, 22 bp, Homo sapiens
tcacagcagggtaacaggaaga

SEQ ID NO: 9168718 - DNA, 22 bp, Homo sapiens
tcacagcagggtaacaggaaga

SEQ ID NO: 9168719 - DNA, 22 bp, Homo sapiens
tcacagcattgtcacaaggctg

SEQ ID NO: 9168720 - DNA, 22 bp, Homo sapiens
tcacagcattgagtgtactaga

SEQ ID NO: 9168721 - DNA, 22 bp, Homo sapiens
tcacagcattgagtgtactaga

SEQ ID NO: 9168722 - DNA, 22 bp, Homo sapiens
tcacagcattcgcaatggacag

SEQ ID NO: 9168723 - DNA, 22 bp, Homo sapiens
tcacagcattcgcaatggacag

SEQ ID NO: 9168724 - DNA, 19 bp, Homo sapiens
tcacagcatctgtctgaac

SEQ ID NO: 9168725 - DNA, 22 bp, Homo sapiens
tcacagcaccctgaggtgctgg

SEQ ID NO: 9168726 - DNA, 22 bp, Homo sapiens
tcacagcaccctgaggtgctgg

SEQ ID NO: 9168727 - DNA, 22 bp, Homo sapiens
tcacagcaccctgaggtgctgg

SEQ ID NO: 9168728 - DNA, 22 bp, Homo sapiens
tcacagcaacactggggcagac

SEQ ID NO: 9168729 - DNA, 22 bp, Homo sapiens
tcatgtttttgccatatgactc

SEQ ID NO: 9168730 - DNA, 22 bp, Homo sapiens
tcatgtttttgccatatgactc

SEQ ID NO: 9168731 - DNA, 22 bp, Homo sapiens
tcatgttttagtaaagtgaagg

SEQ ID NO: 9168732 - DNA, 22 bp, Homo sapiens
tcatgttttagtaaagtgaagg

SEQ ID NO: 9168733 - DNA, 22 bp, Homo sapiens
tcatgttttagctgcaaaatga

SEQ ID NO: 9168734 - DNA, 22 bp, Homo sapiens
tcatgtttgttggaaatgtggc

SEQ ID NO: 9168735 - DNA, 22 bp, Homo sapiens
tcatgtttgccctaagaaaaag

SEQ ID NO: 9168736 - DNA, 22 bp, Homo sapiens
tcatgtttgttggaaatgtggc

SEQ ID NO: 9168737 - DNA, 22 bp, Homo sapiens
tcatgtttggagtttgctcact

SEQ ID NO: 9168738 - DNA, 22 bp, Homo sapiens
tcatgtgtcctagttcatataa

SEQ ID NO: 9168739 - DNA, 22 bp, Homo sapiens
tcatgttatcttggctctggga

SEQ ID NO: 9168740 - DNA, 22 bp, Homo sapiens
tcatggctggaagctcagttag

SEQ ID NO: 9168741 - DNA, 22 bp, Homo sapiens
tccacaggaaagcacctcccat

SEQ ID NO: 9168742 - DNA, 22 bp, Homo sapiens
tccacagactattaagtgatct

SEQ ID NO: 9168743 - DNA, 22 bp, Homo sapiens
tccacagactattaagtgatct

SEQ ID NO: 9168744 - DNA, 22 bp, Homo sapiens
tccacagataaaaacagaggtt

SEQ ID NO: 9168745 - DNA, 22 bp, Homo sapiens
tccacaggctgaggcccttctg

SEQ ID NO: 9168746 - DNA, 22 bp, Homo sapiens
tccacaggctgaggcccttctg

SEQ ID NO: 9168747 - DNA, 22 bp, Homo sapiens
tccacaggcaagtctcttggca

SEQ ID NO: 9168748 - DNA, 22 bp, Homo sapiens
tccacaggcaagtctcttggca

SEQ ID NO: 9168749 - DNA, 22 bp, Homo sapiens
tccacagggatgcctgcggctt

SEQ ID NO: 9168750 - DNA, 22 bp, Homo sapiens
tccacagggatgcctgcggctt

SEQ ID NO: 9168751 - DNA, 22 bp, Homo sapiens
tccacagggatgttgagttctt

SEQ ID NO: 9168752 - DNA, 22 bp, Homo sapiens
tccacagaccagtatctgcagc

SEQ ID NO: 9168753 - DNA, 22 bp, Homo sapiens
tccacagaatggaattctccgc

SEQ ID NO: 9168754 - DNA, 22 bp, Homo sapiens
tccacagaatgtaagatccaca

SEQ ID NO: 9168755 - DNA, 22 bp, Homo sapiens
tccacagaatgtaagatccaca

SEQ ID NO: 9168756 - DNA, 22 bp, Homo sapiens
tccacacacatttctatgtgca

SEQ ID NO: 9168757 - DNA, 22 bp, Homo sapiens
tcattaagattacgtgccagaa

SEQ ID NO: 9168758 - DNA, 22 bp, Homo sapiens
tcattaagattcctatggcatt

SEQ ID NO: 9168759 - DNA, 22 bp, Homo sapiens
tcattaagtaaggcaggtggtt

SEQ ID NO: 9168760 - DNA, 22 bp, Homo sapiens
tccaccagggtttcatctccct

SEQ ID NO: 9168761 - DNA, 22 bp, Homo sapiens
tccaccaggctccatgttcagt

SEQ ID NO: 9168762 - DNA, 22 bp, Homo sapiens
tccaccagcagcctgtcagcct

SEQ ID NO: 9168763 - DNA, 22 bp, Homo sapiens
tccaccagcagcctgtcagcct

SEQ ID NO: 9168764 - DNA, 22 bp, Homo sapiens
tccaccagccaggcccaggctg

SEQ ID NO: 9168765 - DNA, 21 bp, Homo sapiens
tccaccagctcttcctcttca

SEQ ID NO: 9168766 - DNA, 22 bp, Homo sapiens
tccaccagagccctctttgcgg

SEQ ID NO: 9168767 - DNA, 22 bp, Homo sapiens
tccaccagagccttcccatgct

SEQ ID NO: 9168768 - DNA, 22 bp, Homo sapiens
tccaccagagccctctttgcgg

SEQ ID NO: 9168769 - DNA, 22 bp, Homo sapiens
tccaccagcagcctgtcagcct

SEQ ID NO: 9168770 - DNA, 22 bp, Homo sapiens
tccaccacttcctgcagccatt

SEQ ID NO: 9168771 - DNA, 22 bp, Homo sapiens
tccacagggattcacccaaaag

SEQ ID NO: 9168772 - DNA, 22 bp, Homo sapiens
tccacagggattcacccaaaag

SEQ ID NO: 9168773 - DNA, 22 bp, Homo sapiens
tccacagggatgttgagttctt

SEQ ID NO: 9168774 - DNA, 18 bp, Homo sapiens
tccaccagtcaatctgtc

SEQ ID NO: 9168775 - DNA, 18 bp, Homo sapiens
tccaccagtcaatctgtc

SEQ ID NO: 9168776 - DNA, 22 bp, Homo sapiens
tccaccatgatttagcactggc

SEQ ID NO: 9168777 - DNA, 22 bp, Homo sapiens
tccaccatgtaacaagctctgt

SEQ ID NO: 9168778 - DNA, 22 bp, Homo sapiens
tccaccatgtaacaagctctgt

SEQ ID NO: 9168779 - DNA, 22 bp, Homo sapiens
tccacccccagacagctggtga

SEQ ID NO: 9168780 - DNA, 19 bp, Homo sapiens
tccaccccagccagctctg

SEQ ID NO: 9168781 - DNA, 22 bp, Homo sapiens
tccactccttatgccagacggt

SEQ ID NO: 9168782 - DNA, 22 bp, Homo sapiens
tccactgacaggtgaatggata

SEQ ID NO: 9168783 - DNA, 22 bp, Homo sapiens
tccacgtgacctttgtggtgga

SEQ ID NO: 9168784 - DNA, 22 bp, Homo sapiens
tccacgttgcatcaccagtcta

SEQ ID NO: 9168785 - DNA, 22 bp, Homo sapiens
tccacgttttcaacacagccaa

SEQ ID NO: 9168786 - DNA, 22 bp, Homo sapiens
tccacctgagtttcagttattt

SEQ ID NO: 9168787 - DNA, 19 bp, Homo sapiens
tccacctttcttcatttgg

SEQ ID NO: 9168788 - DNA, 21 bp, Homo sapiens
tccaccctctctgctcccagt

SEQ ID NO: 9168789 - DNA, 20 bp, Homo sapiens
tccactgccggaccggggtt

SEQ ID NO: 9168790 - DNA, 22 bp, Homo sapiens
tccactggaacaactctgaggc

SEQ ID NO: 9168791 - DNA, 22 bp, Homo sapiens
tccactggcccacctcctcagt

SEQ ID NO: 9168792 - DNA, 22 bp, Homo sapiens
tccactggcccacctcctcagt

SEQ ID NO: 9168793 - DNA, 22 bp, Homo sapiens
tccactgctcattccacaggca

SEQ ID NO: 9168794 - DNA, 22 bp, Homo sapiens
tccactggaacaactctgaggc

SEQ ID NO: 9168795 - DNA, 22 bp, Homo sapiens
tccactggcctctgtctttcag

SEQ ID NO: 9168796 - DNA, 22 bp, Homo sapiens
tccactggcccacctcctcagt

SEQ ID NO: 9168797 - DNA, 22 bp, Homo sapiens
tccactggtatccacagtgggg

SEQ ID NO: 9168798 - DNA, 22 bp, Homo sapiens
tccactggtaatacctagatcc

SEQ ID NO: 9168799 - DNA, 22 bp, Homo sapiens
tccactggcttggaaaatcatt

SEQ ID NO: 9168800 - DNA, 22 bp, Homo sapiens
tccactgtgcagctctgctgat

SEQ ID NO: 9168801 - DNA, 22 bp, Homo sapiens
tccactgtggtcccttgctgcc

SEQ ID NO: 9168802 - DNA, 22 bp, Homo sapiens
tccactgtggtcccttgctgcc

SEQ ID NO: 9168803 - DNA, 21 bp, Homo sapiens
tccagaaaagaggtcattagc

SEQ ID NO: 9168804 - DNA, 22 bp, Homo sapiens
tccagaaaaagtaatttatttg

SEQ ID NO: 9168805 - DNA, 22 bp, Homo sapiens
tccagaaaaagtaatttatttg

SEQ ID NO: 9168806 - DNA, 21 bp, Homo sapiens
tccagaaaagaggtcattagc

SEQ ID NO: 9168807 - DNA, 22 bp, Homo sapiens
tccacttgccctcttctgtgct

SEQ ID NO: 9168808 - DNA, 20 bp, Homo sapiens
tccagccacttccgctggtc

SEQ ID NO: 9168809 - DNA, 22 bp, Homo sapiens
tccagccactcagcagggattg

SEQ ID NO: 9168810 - DNA, 22 bp, Homo sapiens
tccagccactcagcagggattg

SEQ ID NO: 9168811 - DNA, 20 bp, Homo sapiens
tccagcccaggtcctgcctg

SEQ ID NO: 9168812 - DNA, 20 bp, Homo sapiens
tccagcccaggtcctgcctg

SEQ ID NO: 9168813 - DNA, 22 bp, Homo sapiens
tccagcccaggctggagtgtag

SEQ ID NO: 9168814 - DNA, 22 bp, Homo sapiens
tccagccacgtattatctcact

SEQ ID NO: 9168815 - DNA, 22 bp, Homo sapiens
tccagaaagtacatgggattca

SEQ ID NO: 9168816 - DNA, 22 bp, Homo sapiens
tccagaaagtacatgggattca

SEQ ID NO: 9168817 - DNA, 22 bp, Homo sapiens
tccagaaacttttccagtctca

SEQ ID NO: 9168818 - DNA, 22 bp, Homo sapiens
tccagaaactgctgagataaga

SEQ ID NO: 9168819 - DNA, 22 bp, Homo sapiens
tccagaaacttcatttgcaagc

SEQ ID NO: 9168820 - DNA, 22 bp, Homo sapiens
tccagaaaattcagaaattgtt

SEQ ID NO: 9168821 - DNA, 22 bp, Homo sapiens
tccagaaaattttacagtgcct

SEQ ID NO: 9168822 - DNA, 22 bp, Homo sapiens
tccagaaaattttacagtgcct

SEQ ID NO: 9168823 - DNA, 22 bp, Homo sapiens
tccagcccagtttggtgaattg

SEQ ID NO: 9168824 - DNA, 20 bp, Homo sapiens
tccagcccaggtcctgcctg

SEQ ID NO: 9168825 - DNA, 22 bp, Homo sapiens
tccagccccgaggccggcgacg

SEQ ID NO: 9168826 - DNA, 22 bp, Homo sapiens
tccagcccatccctagcctggg

SEQ ID NO: 9168827 - DNA, 22 bp, Homo sapiens
tccagcccatccctagcctggg

SEQ ID NO: 9168828 - DNA, 22 bp, Homo sapiens
tccagccccggcttccttacag

SEQ ID NO: 9168829 - DNA, 22 bp, Homo sapiens
tccagccccggcttccttacag

SEQ ID NO: 9168830 - DNA, 22 bp, Homo sapiens
tccagccccgggatgttcttca

SEQ ID NO: 9168831 - DNA, 19 bp, Homo sapiens
tccagcccctctgtgtgtg

SEQ ID NO: 9168832 - DNA, 22 bp, Homo sapiens
tccagcccctcctgagccaagc

SEQ ID NO: 9168833 - DNA, 22 bp, Homo sapiens
tccagcccctcctgagccaagc

SEQ ID NO: 9168834 - DNA, 22 bp, Homo sapiens
tccagcccgagggcgctgatga

SEQ ID NO: 9168835 - DNA, 22 bp, Homo sapiens
tccagcccgactgggcctgccg

SEQ ID NO: 9168836 - DNA, 22 bp, Homo sapiens
tccagcccgggggcaggtgacc

SEQ ID NO: 9168837 - DNA, 22 bp, Homo sapiens
tccagccctcagccaagtggaa

SEQ ID NO: 9168838 - DNA, 19 bp, Homo sapiens
tccagcccctctgtgtgtg

SEQ ID NO: 9168839 - DNA, 20 bp, Homo sapiens
tccagcccctgcatgttgct

SEQ ID NO: 9168840 - DNA, 22 bp, Homo sapiens
tccagccccttttactcattca

SEQ ID NO: 9168841 - DNA, 22 bp, Homo sapiens
tccagccctgcttcctgcctca

SEQ ID NO: 9168842 - DNA, 17 bp, Homo sapiens
tccagccctgcccgacg

SEQ ID NO: 9168843 - DNA, 22 bp, Homo sapiens
tccagccctgcccattctctcg

SEQ ID NO: 9168844 - DNA, 22 bp, Homo sapiens
tccagccctctggcccgcggtg

SEQ ID NO: 9168845 - DNA, 22 bp, Homo sapiens
tccagccctgcactgattagat

SEQ ID NO: 9168846 - DNA, 22 bp, Homo sapiens
tccagccctcctgggatcacag

SEQ ID NO: 9168847 - DNA, 20 bp, Homo sapiens
tccagccctcatgtcgctca

SEQ ID NO: 9168848 - DNA, 20 bp, Homo sapiens
tccagccctcatgtcgctca

SEQ ID NO: 9168849 - DNA, 20 bp, Homo sapiens
tccagccctgcttctctctt

SEQ ID NO: 9168850 - DNA, 20 bp, Homo sapiens
tccagccctgcttctctctt

SEQ ID NO: 9168851 - DNA, 22 bp, Homo sapiens
tccagccctgcttcctgcctca

SEQ ID NO: 9168852 - DNA, 20 bp, Homo sapiens
tccagccctgcttctctctt

SEQ ID NO: 9168853 - DNA, 20 bp, Homo sapiens
tccagccctgcttctctctt

SEQ ID NO: 9168854 - DNA, 22 bp, Homo sapiens
tccaggaacgagaggctgggca

SEQ ID NO: 9168855 - DNA, 22 bp, Homo sapiens
tccaggagctcatccacgtcaa

SEQ ID NO: 9168856 - DNA, 23 bp, Homo sapiens
tccaggagcatgctggctggcga

SEQ ID NO: 9168857 - DNA, 22 bp, Homo sapiens
tccaggactagcatttctgata

SEQ ID NO: 9168858 - DNA, 22 bp, Homo sapiens
tccaggaatgtgtgtgggctag

SEQ ID NO: 9168859 - DNA, 21 bp, Homo sapiens
tccaggaatgtctgttcatct

SEQ ID NO: 9168860 - DNA, 22 bp, Homo sapiens
tccaggacagcggcaggcagat

SEQ ID NO: 9168861 - DNA, 22 bp, Homo sapiens
tcccagagtgtgggcatcaagg

SEQ ID NO: 9168862 - DNA, 22 bp, Homo sapiens
tcccagagtgtgggcatcaagg

SEQ ID NO: 9168863 - DNA, 22 bp, Homo sapiens
tcccagagtgtgggcatcaagg

SEQ ID NO: 9168864 - DNA, 22 bp, Homo sapiens
tcccagagtgagccaggggcag

SEQ ID NO: 9168865 - DNA, 21 bp, Homo sapiens
tcccagagtgcttgggactgc

SEQ ID NO: 9168866 - DNA, 22 bp, Homo sapiens
tcccagagtcttctcctgtaat

SEQ ID NO: 9168867 - DNA, 22 bp, Homo sapiens
tcccagagtcttctcctgtaat

SEQ ID NO: 9168868 - DNA, 22 bp, Homo sapiens
tcccagagtcttctcctgtaat

SEQ ID NO: 9168869 - DNA, 19 bp, Homo sapiens
tcccagagtctagaggttg

SEQ ID NO: 9168870 - DNA, 19 bp, Homo sapiens
tcccagagtctagaggttg

SEQ ID NO: 9168871 - DNA, 22 bp, Homo sapiens
tcccagagtcagaggtggggcc

SEQ ID NO: 9168872 - DNA, 22 bp, Homo sapiens
tcccagagtattagcaattgct

SEQ ID NO: 9168873 - DNA, 22 bp, Homo sapiens
tcccagagaaagtcaaggtctt

SEQ ID NO: 9168874 - DNA, 22 bp, Homo sapiens
tcccacatatgcaatcctgaat

SEQ ID NO: 9168875 - DNA, 22 bp, Homo sapiens
tccagttagtgggcaaaattta

SEQ ID NO: 9168876 - DNA, 20 bp, Homo sapiens
tccagttacatagaggaaag

SEQ ID NO: 9168877 - DNA, 23 bp, Homo sapiens
tccagttaatggttcccagtctg

SEQ ID NO: 9168878 - DNA, 22 bp, Homo sapiens
tccagttctaggtcactctctg

SEQ ID NO: 9168879 - DNA, 22 bp, Homo sapiens
tccagttagtgggcaaaattta

SEQ ID NO: 9168880 - DNA, 22 bp, Homo sapiens
tccagtgtgtgtccagctgctg

SEQ ID NO: 9168881 - DNA, 22 bp, Homo sapiens
tccagtgtctgagcccttagct

SEQ ID NO: 9168882 - DNA, 22 bp, Homo sapiens
tccagtgtggacccctgcagtc

SEQ ID NO: 9168883 - DNA, 22 bp, Homo sapiens
tcccactgtgcctgttgtaatc

SEQ ID NO: 9168884 - DNA, 22 bp, Homo sapiens
tcccactgctttgctctgctca

SEQ ID NO: 9168885 - DNA, 21 bp, Homo sapiens
tcccactgccacagcttcagg

SEQ ID NO: 9168886 - DNA, 22 bp, Homo sapiens
tcccactggacgtctgtgctgg

SEQ ID NO: 9168887 - DNA, 20 bp, Homo sapiens
tcccactgggcctcagtttc

SEQ ID NO: 9168888 - DNA, 22 bp, Homo sapiens
tcccagctactctagaggctga

SEQ ID NO: 9168889 - DNA, 21 bp, Homo sapiens
tcccagctgggtcagtgctgc

SEQ ID NO: 9168890 - DNA, 22 bp, Homo sapiens
tcccaggaaaacactcgaggac

SEQ ID NO: 9168891 - DNA, 22 bp, Homo sapiens
tcccaggatgaagacagtgttg

SEQ ID NO: 9168892 - DNA, 22 bp, Homo sapiens
tcccaggaaggattcggcattt

SEQ ID NO: 9168893 - DNA, 22 bp, Homo sapiens
tcccaggaaggattcggcattt

SEQ ID NO: 9168894 - DNA, 22 bp, Homo sapiens
tcccaggaagatcccagggacc

SEQ ID NO: 9168895 - DNA, 17 bp, Homo sapiens
tcccaggaacagggaat

SEQ ID NO: 9168896 - DNA, 17 bp, Homo sapiens
tcccaggaacagggaat

SEQ ID NO: 9168897 - DNA, 22 bp, Homo sapiens
tcccagcctttcttttctgctg

SEQ ID NO: 9168898 - DNA, 22 bp, Homo sapiens
tcccagcagtcagagctatgtg

SEQ ID NO: 9168899 - DNA, 22 bp, Homo sapiens
tcccagcagcatagctcagaat

SEQ ID NO: 9168900 - DNA, 22 bp, Homo sapiens
tcccagcaggagtccagttccc

SEQ ID NO: 9168901 - DNA, 22 bp, Homo sapiens
tcccagcagatgagctgaccta

SEQ ID NO: 9168902 - DNA, 22 bp, Homo sapiens
tcccagcagagccagcaagccg

SEQ ID NO: 9168903 - DNA, 22 bp, Homo sapiens
tcccagcacagggcagatgtga

SEQ ID NO: 9168904 - DNA, 22 bp, Homo sapiens
tcccagcacgtctgctgtttct

SEQ ID NO: 9168905 - DNA, 22 bp, Homo sapiens
tcccagcacgtctgctgtttct

SEQ ID NO: 9168906 - DNA, 22 bp, Homo sapiens
tcccagattcctgctcttatat

SEQ ID NO: 9168907 - DNA, 22 bp, Homo sapiens
tcccagattcctgctcttatat

SEQ ID NO: 9168908 - DNA, 22 bp, Homo sapiens
tcccagagtttcctgtgtccca

SEQ ID NO: 9168909 - DNA, 22 bp, Homo sapiens
tcccagagtttcctgtgtccca

SEQ ID NO: 9168910 - DNA, 22 bp, Homo sapiens
tcccagagttcaatgggaaggt

SEQ ID NO: 9168911 - DNA, 22 bp, Homo sapiens
tcccagagttcaatgggaaggt

SEQ ID NO: 9168912 - DNA, 22 bp, Homo sapiens
tcccagagttcaatgggaaggt

SEQ ID NO: 9168913 - DNA, 22 bp, Homo sapiens
tcccagagtttcctgtgtccca

SEQ ID NO: 9168914 - DNA, 22 bp, Homo sapiens
tccagggcaccagcgtccccct

SEQ ID NO: 9168915 - DNA, 20 bp, Homo sapiens
tccagggcaaactcatcacc

SEQ ID NO: 9168916 - DNA, 20 bp, Homo sapiens
tccagggcaactagagtgtg

SEQ ID NO: 9168917 - DNA, 20 bp, Homo sapiens
tccagggcaactagagtgtg

SEQ ID NO: 9168918 - DNA, 20 bp, Homo sapiens
tccagggcaactagagtgtg

SEQ ID NO: 9168919 - DNA, 22 bp, Homo sapiens
tccagggagttggctggatagt

SEQ ID NO: 9168920 - DNA, 22 bp, Homo sapiens
tccagggagcaagtcaggccgg

SEQ ID NO: 9168921 - DNA, 22 bp, Homo sapiens
tccagggatgccagccatgttg

SEQ ID NO: 9168922 - DNA, 22 bp, Homo sapiens
tccagggatgccagccatgttg

SEQ ID NO: 9168923 - DNA, 22 bp, Homo sapiens
tccagggatggtaatgagcagt

SEQ ID NO: 9168924 - DNA, 22 bp, Homo sapiens
tccagggatggtaatgagcagt

SEQ ID NO: 9168925 - DNA, 22 bp, Homo sapiens
tccagggatggtaatgagcagt

SEQ ID NO: 9168926 - DNA, 22 bp, Homo sapiens
tccagggatgtcctgtagcact

SEQ ID NO: 9168927 - DNA, 23 bp, Homo sapiens
tccagggattaatgaagtcagtc

SEQ ID NO: 9168928 - DNA, 23 bp, Homo sapiens
tccagggattaatgaagtcagtc

SEQ ID NO: 9168929 - DNA, 23 bp, Homo sapiens
tccagggattaatgaagtcagtc

SEQ ID NO: 9168930 - DNA, 23 bp, Homo sapiens
tccagggattaatgaagtcagtc

SEQ ID NO: 9168931 - DNA, 22 bp, Homo sapiens
tccagtctctactctgagataa

SEQ ID NO: 9168932 - DNA, 22 bp, Homo sapiens
tccagtctctggctgtttgtga

SEQ ID NO: 9168933 - DNA, 22 bp, Homo sapiens
tccagtgatgctgcaagagtga

SEQ ID NO: 9168934 - DNA, 22 bp, Homo sapiens
tccagtcctagaaactggagag

SEQ ID NO: 9168935 - DNA, 23 bp, Homo sapiens
tccagtcccctaaatctcactgt

SEQ ID NO: 9168936 - DNA, 22 bp, Homo sapiens
tccagtctaatgagtcagagtg

SEQ ID NO: 9168937 - DNA, 22 bp, Homo sapiens
tccagtgctggaccagagcacc

SEQ ID NO: 9168938 - DNA, 22 bp, Homo sapiens
tccagtgcctcactgaggattc

SEQ ID NO: 9168939 - DNA, 20 bp, Homo sapiens
tccagtggcctgaatctgga

SEQ ID NO: 9168940 - DNA, 21 bp, Homo sapiens
tccagtggtgtctagaatgtg

SEQ ID NO: 9168941 - DNA, 22 bp, Homo sapiens
tccagtggtagtaaagaggtct

SEQ ID NO: 9168942 - DNA, 21 bp, Homo sapiens
tccaggccatggtggggaggc

SEQ ID NO: 9168943 - DNA, 19 bp, Homo sapiens
tccaggccattcccagagc

SEQ ID NO: 9168944 - DNA, 22 bp, Homo sapiens
tccaggccagggtaagaggaga

SEQ ID NO: 9168945 - DNA, 22 bp, Homo sapiens
tccaggcccactcagctgaaat

SEQ ID NO: 9168946 - DNA, 22 bp, Homo sapiens
tccaggcccactcggtggggct

SEQ ID NO: 9168947 - DNA, 20 bp, Homo sapiens
tccaggcccactcagctgaa

SEQ ID NO: 9168948 - DNA, 20 bp, Homo sapiens
tccaggcccactcagctgaa

SEQ ID NO: 9168949 - DNA, 20 bp, Homo sapiens
tccaggcccactcagctgaa

SEQ ID NO: 9168950 - DNA, 22 bp, Homo sapiens
tccaggccattgactgcatcct

SEQ ID NO: 9168951 - DNA, 22 bp, Homo sapiens
tccaggccattgactgcatcct

SEQ ID NO: 9168952 - DNA, 22 bp, Homo sapiens
tccaggccctgggatgggagca

SEQ ID NO: 9168953 - DNA, 22 bp, Homo sapiens
tccaggccgcaggggcagcccc

SEQ ID NO: 9168954 - DNA, 22 bp, Homo sapiens
tccaggccgcatagttactctg

SEQ ID NO: 9168955 - DNA, 22 bp, Homo sapiens
tccagggagatactggctgcca

SEQ ID NO: 9168956 - DNA, 22 bp, Homo sapiens
tccagggagatactggctgcca

SEQ ID NO: 9168957 - DNA, 22 bp, Homo sapiens
tccagggagatactggctgcca

SEQ ID NO: 9168958 - DNA, 22 bp, Homo sapiens
tccagggagagccgctgctcca

SEQ ID NO: 9168959 - DNA, 22 bp, Homo sapiens
tccagggacctccctgagagct

SEQ ID NO: 9168960 - DNA, 22 bp, Homo sapiens
tccagggagagccgctgctcca

SEQ ID NO: 9168961 - DNA, 22 bp, Homo sapiens
tccagggagagccgctgctcca

SEQ ID NO: 9168962 - DNA, 22 bp, Homo sapiens
tccagggagatggcagaggctg

SEQ ID NO: 9168963 - DNA, 22 bp, Homo sapiens
tccagggagatggcagaggctg

SEQ ID NO: 9168964 - DNA, 22 bp, Homo sapiens
tccagggagatactggctgcca

SEQ ID NO: 9168965 - DNA, 22 bp, Homo sapiens
tccagggacagcgctggagcta

SEQ ID NO: 9168966 - DNA, 22 bp, Homo sapiens
tccagggacagcgctggagcta

SEQ ID NO: 9168967 - DNA, 22 bp, Homo sapiens
tccagggacctccctgagagct

SEQ ID NO: 9168968 - DNA, 22 bp, Homo sapiens
tccagggacagtatagaggatc

SEQ ID NO: 9168969 - DNA, 22 bp, Homo sapiens
tccctgtgggcagaggctgcct

SEQ ID NO: 9168970 - DNA, 22 bp, Homo sapiens
tccctgtgtccatgccaggagg

SEQ ID NO: 9168971 - DNA, 22 bp, Homo sapiens
tcccttcaagatttggggaaat

SEQ ID NO: 9168972 - DNA, 22 bp, Homo sapiens
tcccttaaaactcatgtgttgt

SEQ ID NO: 9168973 - DNA, 22 bp, Homo sapiens
tcccttcacagatgcgatgttt

SEQ ID NO: 9168974 - DNA, 22 bp, Homo sapiens
tcccttcacagatgcgatgttt

SEQ ID NO: 9168975 - DNA, 22 bp, Homo sapiens
tcccttcatcagtgagcaagcc

SEQ ID NO: 9168976 - DNA, 22 bp, Homo sapiens
tcccttggaaagtagcctcaca

SEQ ID NO: 9168977 - DNA, 22 bp, Homo sapiens
tcccttgagagttggccaattg

SEQ ID NO: 9168978 - DNA, 22 bp, Homo sapiens
tcccttctggcagcagtgtgag

SEQ ID NO: 9168979 - DNA, 22 bp, Homo sapiens
tccctttcactactgtgttggt

SEQ ID NO: 9168980 - DNA, 18 bp, Homo sapiens
tcccttctcccttgcctc

SEQ ID NO: 9168981 - DNA, 19 bp, Homo sapiens
tcccttcctgtcgggctcc

SEQ ID NO: 9168982 - DNA, 22 bp, Homo sapiens
tcccttcctcataggcagaagg

SEQ ID NO: 9168983 - DNA, 18 bp, Homo sapiens
tcccttctcccttgcctc

SEQ ID NO: 9168984 - DNA, 22 bp, Homo sapiens
tcccttctggcagcagtgtgag

SEQ ID NO: 9168985 - DNA, 18 bp, Homo sapiens
tcccttctcccttgcctc

SEQ ID NO: 9168986 - DNA, 22 bp, Homo sapiens
tccctgtctaatatgccatgaa

SEQ ID NO: 9168987 - DNA, 22 bp, Homo sapiens
tccctgtgaatcagaagcaggt

SEQ ID NO: 9168988 - DNA, 22 bp, Homo sapiens
tccctgtattcgaaagtgatcg

SEQ ID NO: 9168989 - DNA, 22 bp, Homo sapiens
tccctggttacgtataaagatg

SEQ ID NO: 9168990 - DNA, 22 bp, Homo sapiens
tccctgtaaggttctgagattt

SEQ ID NO: 9168991 - DNA, 22 bp, Homo sapiens
tccctgtggatatctgcagctg

SEQ ID NO: 9168992 - DNA, 22 bp, Homo sapiens
tccctgtggaagactgccagag

SEQ ID NO: 9168993 - DNA, 22 bp, Homo sapiens
tccctgtggcacacccaagccc

SEQ ID NO: 9168994 - DNA, 22 bp, Homo sapiens
tccctggggatgttggcctgcc

SEQ ID NO: 9168995 - DNA, 22 bp, Homo sapiens
tccctgggcctatcttagctcc

SEQ ID NO: 9168996 - DNA, 22 bp, Homo sapiens
tccctgggcctatcttagctcc

SEQ ID NO: 9168997 - DNA, 22 bp, Homo sapiens
tccctgggcctatcttagctcc

SEQ ID NO: 9168998 - DNA, 21 bp, Homo sapiens
tccctgagttctctgagcatc

SEQ ID NO: 9168999 - DNA, 22 bp, Homo sapiens
tccctgagttttctttctgact

SEQ ID NO: 9169000 - DNA, 22 bp, Homo sapiens
tccctgcacagccgagccatgc

SEQ ID NO: 9169001 - DNA, 22 bp, Homo sapiens
tccctgcagacgtcctgcgggt

SEQ ID NO: 9169002 - DNA, 22 bp, Homo sapiens
tccctgcagtaggcagccctcc

SEQ ID NO: 9169003 - DNA, 22 bp, Homo sapiens
tccctgcagtagtggctaagat

SEQ ID NO: 9169004 - DNA, 22 bp, Homo sapiens
tccctgcagacgtcctgcgggt

SEQ ID NO: 9169005 - DNA, 22 bp, Homo sapiens
tccctgcagacgtcctgcgggt

SEQ ID NO: 9169006 - DNA, 22 bp, Homo sapiens
tccctgggcaagtttactcttc

SEQ ID NO: 9169007 - DNA, 22 bp, Homo sapiens
tccctgggcaagtttactcttc

SEQ ID NO: 9169008 - DNA, 22 bp, Homo sapiens
tccctgccctcagtgcacccgg

SEQ ID NO: 9169009 - DNA, 22 bp, Homo sapiens
tccctgcatttgggagagtgtc

SEQ ID NO: 9169010 - DNA, 22 bp, Homo sapiens
tccctgagtgtatgtggtgaac

SEQ ID NO: 9169011 - DNA, 19 bp, Homo sapiens
tccctgagttccagcccag

SEQ ID NO: 9169012 - DNA, 16 bp, Homo sapiens
tccctgaggttttgga

SEQ ID NO: 9169013 - DNA, 22 bp, Homo sapiens
tccctgagtgggctggtagtat

SEQ ID NO: 9169014 - DNA, 22 bp, Homo sapiens
tccctgagggcagctcaagtcc

SEQ ID NO: 9169015 - DNA, 22 bp, Homo sapiens
tccctgaggatgaggctgatca

SEQ ID NO: 9169016 - DNA, 22 bp, Homo sapiens
tccctgaggaaggggtgtggtg

SEQ ID NO: 9169017 - DNA, 22 bp, Homo sapiens
tccctgaggatggttgtattta

SEQ ID NO: 9169018 - DNA, 22 bp, Homo sapiens
tccctgaggatgaggctgatca

SEQ ID NO: 9169019 - DNA, 22 bp, Homo sapiens
tccctgagctcacatggcagga

SEQ ID NO: 9169020 - DNA, 23 bp, Homo sapiens
tccctgagctggagagactgcac

SEQ ID NO: 9169021 - DNA, 22 bp, Homo sapiens
tccctgagctgagctcaacagc

SEQ ID NO: 9169022 - DNA, 22 bp, Homo sapiens
tccctgaggaaggggtgtggtg

SEQ ID NO: 9169023 - DNA, 22 bp, Homo sapiens
tccctgagcttctctgaaatgg

SEQ ID NO: 9169024 - DNA, 22 bp, Homo sapiens
tccctgagcttcatcaggcttt

SEQ ID NO: 9169025 - DNA, 22 bp, Homo sapiens
tccctgagcttcatcaggcttt

SEQ ID NO: 9169026 - DNA, 23 bp, Homo sapiens
tccctgagctggagagactgcac

SEQ ID NO: 9169027 - DNA, 23 bp, Homo sapiens
tccctgagatgctgctctgtccc

SEQ ID NO: 9169028 - DNA, 23 bp, Homo sapiens
tccctgagatgctgctctgtccc

SEQ ID NO: 9169029 - DNA, 22 bp, Homo sapiens
tccctgagctcacatggcagga

SEQ ID NO: 9169030 - DNA, 21 bp, Homo sapiens
tccctgagcccaaggggctcc

SEQ ID NO: 9169031 - DNA, 21 bp, Homo sapiens
tccctgagcccaaggggctcc

SEQ ID NO: 9169032 - DNA, 22 bp, Homo sapiens
tcccaggcagcttctttcatca

SEQ ID NO: 9169033 - DNA, 22 bp, Homo sapiens
tccctgagagcactggggagcc

SEQ ID NO: 9169034 - DNA, 19 bp, Homo sapiens
tcccaggcaaaggcttctc

SEQ ID NO: 9169035 - DNA, 19 bp, Homo sapiens
tcccaggcaaaggcttctc

SEQ ID NO: 9169036 - DNA, 22 bp, Homo sapiens
tcccaggcaaaggcagctcatt

SEQ ID NO: 9169037 - DNA, 22 bp, Homo sapiens
tcccaggcaaaggcagctcatt

SEQ ID NO: 9169038 - DNA, 22 bp, Homo sapiens
tcccaggatgttggcggcaggt

SEQ ID NO: 9169039 - DNA, 22 bp, Homo sapiens
tcccaggatgtttatggctggt

SEQ ID NO: 9169040 - DNA, 22 bp, Homo sapiens
tcccaggatgtttatggctggt

SEQ ID NO: 9169041 - DNA, 22 bp, Homo sapiens
tcccaggatgtttatggctggt

SEQ ID NO: 9169042 - DNA, 22 bp, Homo sapiens
tcctccagtggcccagtccttc

SEQ ID NO: 9169043 - DNA, 22 bp, Homo sapiens
tcctccagtggcccagtccttc

SEQ ID NO: 9169044 - DNA, 22 bp, Homo sapiens
tcctccagtggcccagtccttc

SEQ ID NO: 9169045 - DNA, 22 bp, Homo sapiens
tcctccaggtctagggtggctt

SEQ ID NO: 9169046 - DNA, 22 bp, Homo sapiens
tcctccagggggatcttcagcc

SEQ ID NO: 9169047 - DNA, 22 bp, Homo sapiens
tcctccagtcttggtgaggttg

SEQ ID NO: 9169048 - DNA, 22 bp, Homo sapiens
tcctccaggtctagggtggctt

SEQ ID NO: 9169049 - DNA, 22 bp, Homo sapiens
tcctcccctgcccatgaggagg

SEQ ID NO: 9169050 - DNA, 22 bp, Homo sapiens
tcctccagttccttggtttcag

SEQ ID NO: 9169051 - DNA, 22 bp, Homo sapiens
tcctccagtgtctggggccttg

SEQ ID NO: 9169052 - DNA, 22 bp, Homo sapiens
tcctccagtggtactggccaat

SEQ ID NO: 9169053 - DNA, 22 bp, Homo sapiens
tcctccagtggtactggccaat

SEQ ID NO: 9169054 - DNA, 22 bp, Homo sapiens
tcctccagtggtactggccaat

SEQ ID NO: 9169055 - DNA, 22 bp, Homo sapiens
tcctccagtggtactggccaat

SEQ ID NO: 9169056 - DNA, 22 bp, Homo sapiens
tcctccctgtaccattcctctg

SEQ ID NO: 9169057 - DNA, 22 bp, Homo sapiens
tcctcccttctcactgggaagg

SEQ ID NO: 9169058 - DNA, 22 bp, Homo sapiens
tcctccctgagtggggacagct

SEQ ID NO: 9169059 - DNA, 22 bp, Homo sapiens
tcctccctaactcatgatgagt

SEQ ID NO: 9169060 - DNA, 22 bp, Homo sapiens
tcctccctaaatcctagactgt

SEQ ID NO: 9169061 - DNA, 22 bp, Homo sapiens
tcctcctcctcacagtcacctg

SEQ ID NO: 9169062 - DNA, 22 bp, Homo sapiens
tcctcctctatcagacagtgcc

SEQ ID NO: 9169063 - DNA, 23 bp, Homo sapiens
tcctcctgacacagcctgagtga

SEQ ID NO: 9169064 - DNA, 21 bp, Homo sapiens
tcctcctccactaggctagcc

SEQ ID NO: 9169065 - DNA, 22 bp, Homo sapiens
tcctcctcacgctgttgcttgt

SEQ ID NO: 9169066 - DNA, 19 bp, Homo sapiens
tcctccctttggtgtcctg

SEQ ID NO: 9169067 - DNA, 23 bp, Homo sapiens
tcctcctgagtgagagtgccagc

SEQ ID NO: 9169068 - DNA, 22 bp, Homo sapiens
tcctccagcaggactgaggccc

SEQ ID NO: 9169069 - DNA, 22 bp, Homo sapiens
tcctccagcaggactgaggccc

SEQ ID NO: 9169070 - DNA, 22 bp, Homo sapiens
tcctccagcaggactgaggccc

SEQ ID NO: 9169071 - DNA, 22 bp, Homo sapiens
tcctccagaccacttctgtgcg

SEQ ID NO: 9169072 - DNA, 22 bp, Homo sapiens
tcctccagaccacttctgtgcg

SEQ ID NO: 9169073 - DNA, 22 bp, Homo sapiens
tcctccagctgtatcctgcctg

SEQ ID NO: 9169074 - DNA, 22 bp, Homo sapiens
tcctccagctgtatcctgcctg

SEQ ID NO: 9169075 - DNA, 22 bp, Homo sapiens
tcctccagctgtatcctgcctg

SEQ ID NO: 9169076 - DNA, 22 bp, Homo sapiens
tcctccaggataaaatgtgttg

SEQ ID NO: 9169077 - DNA, 22 bp, Homo sapiens
tcctccagggggatcttcagcc

SEQ ID NO: 9169078 - DNA, 22 bp, Homo sapiens
tcctccaggcacctcactggct

SEQ ID NO: 9169079 - DNA, 22 bp, Homo sapiens
tcctccagaaactgaggcagaa

SEQ ID NO: 9169080 - DNA, 22 bp, Homo sapiens
tcctccagaaactgaggcagaa

SEQ ID NO: 9169081 - DNA, 20 bp, Homo sapiens
tcctccagaagggcagggtg

SEQ ID NO: 9169082 - DNA, 20 bp, Homo sapiens
tcctccagaagggcagggtg

SEQ ID NO: 9169083 - DNA, 22 bp, Homo sapiens
tcctcattcttggtgcatcaaa

SEQ ID NO: 9169084 - DNA, 22 bp, Homo sapiens
tccctttggatccaagcttatg

SEQ ID NO: 9169085 - DNA, 22 bp, Homo sapiens
tccctttcacttaactagccca

SEQ ID NO: 9169086 - DNA, 22 bp, Homo sapiens
tccgccaggactgagggcccat

SEQ ID NO: 9169087 - DNA, 22 bp, Homo sapiens
tccgccaggactgagggcccat

SEQ ID NO: 9169088 - DNA, 22 bp, Homo sapiens
tccgccaggactgagggcccat

SEQ ID NO: 9169089 - DNA, 22 bp, Homo sapiens
tccgattagctctttataaaac

SEQ ID NO: 9169090 - DNA, 22 bp, Homo sapiens
tccgggaggcagaggttgcagt

SEQ ID NO: 9169091 - DNA, 22 bp, Homo sapiens
tccgggagctgaacgtcttgcg

SEQ ID NO: 9169092 - DNA, 22 bp, Homo sapiens
tccgggagctgaacgtcttgcg

SEQ ID NO: 9169093 - DNA, 22 bp, Homo sapiens
tcctcatcaccattgcaatgta

SEQ ID NO: 9169094 - DNA, 22 bp, Homo sapiens
tcctcagtgctagccaactgcc

SEQ ID NO: 9169095 - DNA, 22 bp, Homo sapiens
tcctcagtcacggtagcacatt

SEQ ID NO: 9169096 - DNA, 22 bp, Homo sapiens
tcctcagtcgtttgagccaaaa

SEQ ID NO: 9169097 - DNA, 22 bp, Homo sapiens
tcctcagtcgtttgagccaaaa

SEQ ID NO: 9169098 - DNA, 22 bp, Homo sapiens
tcctcagtctctaaggcctcag

SEQ ID NO: 9169099 - DNA, 22 bp, Homo sapiens
tccggggcttccccgcagtgcc

SEQ ID NO: 9169100 - DNA, 22 bp, Homo sapiens
taccattttgaaacatttcatc

SEQ ID NO: 9169101 - DNA, 22 bp, Homo sapiens
tacattccacaagcattgcttt

SEQ ID NO: 9169102 - DNA, 19 bp, Homo sapiens
tacattccacacaatctct

SEQ ID NO: 9169103 - DNA, 22 bp, Homo sapiens
taccttgattttgaatccatga

SEQ ID NO: 9169104 - DNA, 22 bp, Homo sapiens
tacctggatgtttagattggca

SEQ ID NO: 9169105 - DNA, 22 bp, Homo sapiens
tacctggatcctggtagacatc

SEQ ID NO: 9169106 - DNA, 22 bp, Homo sapiens
tacctggatatcattcattctc

SEQ ID NO: 9169107 - DNA, 22 bp, Homo sapiens
tacctggagcaggaggcagaat

SEQ ID NO: 9169108 - DNA, 22 bp, Homo sapiens
tacctggacatcagagagacac

SEQ ID NO: 9169109 - DNA, 22 bp, Homo sapiens
tacctggaatttatatagctat

SEQ ID NO: 9169110 - DNA, 22 bp, Homo sapiens
tacctggaatcacagaggctga

SEQ ID NO: 9169111 - DNA, 22 bp, Homo sapiens
tacctggaatagagtctctcca

SEQ ID NO: 9169112 - DNA, 22 bp, Homo sapiens
tacctggaaatggctttagtta

SEQ ID NO: 9169113 - DNA, 22 bp, Homo sapiens
tacctggaaaagttatatgtgt

SEQ ID NO: 9169114 - DNA, 22 bp, Homo sapiens
tactgacacaaagccaatccct

SEQ ID NO: 9169115 - DNA, 22 bp, Homo sapiens
tactgaaatggcagatatataa

SEQ ID NO: 9169116 - DNA, 22 bp, Homo sapiens
tactgaaagactgaatatttag

SEQ ID NO: 9169117 - DNA, 22 bp, Homo sapiens
tactaattgttcacacttgttt

SEQ ID NO: 9169118 - DNA, 22 bp, Homo sapiens
tacgcctgtaatcccagcactt

SEQ ID NO: 9169119 - DNA, 22 bp, Homo sapiens
tacgcctgtaatcccagcactt

SEQ ID NO: 9169120 - DNA, 22 bp, Homo sapiens
tacctttgatctggaattttaa

SEQ ID NO: 9169121 - DNA, 22 bp, Homo sapiens
taccttgtgagctttctaacat

SEQ ID NO: 9169122 - DNA, 22 bp, Homo sapiens
tacgggcacgcaccacgatgcc

SEQ ID NO: 9169123 - DNA, 22 bp, Homo sapiens
tactaaatgattaagcaggaat

SEQ ID NO: 9169124 - DNA, 22 bp, Homo sapiens
tacttcatgggacagagagctg

SEQ ID NO: 9169125 - DNA, 22 bp, Homo sapiens
tacttcattcaagttcgctata

SEQ ID NO: 9169126 - DNA, 22 bp, Homo sapiens
tacttccatgtccttagagtcc

SEQ ID NO: 9169127 - DNA, 22 bp, Homo sapiens
tacttctctgcgatcacttgat

SEQ ID NO: 9169128 - DNA, 22 bp, Homo sapiens
tacttgaattggtttctgcaga

SEQ ID NO: 9169129 - DNA, 22 bp, Homo sapiens
tacttgagaatagtgaataatg

SEQ ID NO: 9169130 - DNA, 20 bp, Homo sapiens
tacttgaatgttgcagcagt

SEQ ID NO: 9169131 - DNA, 22 bp, Homo sapiens
tacttgagtatagtcgcttcac

SEQ ID NO: 9169132 - DNA, 22 bp, Homo sapiens
tacttgataggtctaatatgca

SEQ ID NO: 9169133 - DNA, 22 bp, Homo sapiens
tacttcaaccttctctattaga

SEQ ID NO: 9169134 - DNA, 22 bp, Homo sapiens
tacttcaaccttctctattaga

SEQ ID NO: 9169135 - DNA, 22 bp, Homo sapiens
tacttcaatttgtatatgtgaa

SEQ ID NO: 9169136 - DNA, 22 bp, Homo sapiens
tacttcatacctgctagaatgg

SEQ ID NO: 9169137 - DNA, 22 bp, Homo sapiens
tacttattggttcagaagttta

SEQ ID NO: 9169138 - DNA, 22 bp, Homo sapiens
tactgtaagtcaaatgaaacat

SEQ ID NO: 9169139 - DNA, 22 bp, Homo sapiens
tactgtaaactgtaacttcctt

SEQ ID NO: 9169140 - DNA, 22 bp, Homo sapiens
tactggcatttagtgggcagaa

SEQ ID NO: 9169141 - DNA, 22 bp, Homo sapiens
tactgtaaaagacaggcttcct

SEQ ID NO: 9169142 - DNA, 20 bp, Homo sapiens
tactgggtctgggtcctgga

SEQ ID NO: 9169143 - DNA, 22 bp, Homo sapiens
tactgggtatacaaagatgaat

SEQ ID NO: 9169144 - DNA, 22 bp, Homo sapiens
tacttagagcgataatttatac

SEQ ID NO: 9169145 - DNA, 22 bp, Homo sapiens
tactgtaatgagattagcttcc

SEQ ID NO: 9169146 - DNA, 22 bp, Homo sapiens
tactgtaatgagattagcttcc

SEQ ID NO: 9169147 - DNA, 22 bp, Homo sapiens
tactgagctggtccactgaggt

SEQ ID NO: 9169148 - DNA, 21 bp, Homo sapiens
tactgagacctcacagtgtgc

SEQ ID NO: 9169149 - DNA, 22 bp, Homo sapiens
tactgcagatggccttgttctt

SEQ ID NO: 9169150 - DNA, 20 bp, Homo sapiens
tactggattagggctcaccc

SEQ ID NO: 9169151 - DNA, 20 bp, Homo sapiens
tactggagtgagcctgtagc

SEQ ID NO: 9169152 - DNA, 22 bp, Homo sapiens
tactggatgtaaatctggaagc

SEQ ID NO: 9169153 - DNA, 20 bp, Homo sapiens
tactggaaatttctccacct

SEQ ID NO: 9169154 - DNA, 22 bp, Homo sapiens
tactggaagttagagatctttt

SEQ ID NO: 9169155 - DNA, 22 bp, Homo sapiens
tactggagagccttgtccacat

SEQ ID NO: 9169156 - DNA, 22 bp, Homo sapiens
tactgctgaatggtgctgggca

SEQ ID NO: 9169157 - DNA, 22 bp, Homo sapiens
tactgcgccttcaccaagcggc

SEQ ID NO: 9169158 - DNA, 22 bp, Homo sapiens
tacagcactctggggagcatga

SEQ ID NO: 9169159 - DNA, 22 bp, Homo sapiens
tacaggaagcactcaagaaatg

SEQ ID NO: 9169160 - DNA, 22 bp, Homo sapiens
tacaggaagcactcaagaaatg

SEQ ID NO: 9169161 - DNA, 22 bp, Homo sapiens
tacaggaagcactcaagaaatg

SEQ ID NO: 9169162 - DNA, 22 bp, Homo sapiens
tacaggaagtaagtaatgaaat

SEQ ID NO: 9169163 - DNA, 22 bp, Homo sapiens
tacagtttttcactgaagatgt

SEQ ID NO: 9169164 - DNA, 22 bp, Homo sapiens
tacagtttttcactgaagatgt

SEQ ID NO: 9169165 - DNA, 22 bp, Homo sapiens
tacagtttttattcatgacaag

SEQ ID NO: 9169166 - DNA, 22 bp, Homo sapiens
tacagttttggtgatgatgatg

SEQ ID NO: 9169167 - DNA, 22 bp, Homo sapiens
tacataattaatctttaagttc

SEQ ID NO: 9169168 - DNA, 22 bp, Homo sapiens
tacataatgagctagttaagtt

SEQ ID NO: 9169169 - DNA, 22 bp, Homo sapiens
tacatacatattcatacaggtg

SEQ ID NO: 9169170 - DNA, 22 bp, Homo sapiens
tacatacagccaagtatgaagt

SEQ ID NO: 9169171 - DNA, 22 bp, Homo sapiens
tacatacagagatgctagttaa

SEQ ID NO: 9169172 - DNA, 22 bp, Homo sapiens
tacattatttcatcagtcatct

SEQ ID NO: 9169173 - DNA, 22 bp, Homo sapiens
tacattacaggaaagataaaga

SEQ ID NO: 9169174 - DNA, 22 bp, Homo sapiens
tacaatcaggataataatagtg

SEQ ID NO: 9169175 - DNA, 22 bp, Homo sapiens
tacaatgagctgtacatctcca

SEQ ID NO: 9169176 - DNA, 22 bp, Homo sapiens
tacaatgcaaaatactgtctgc

SEQ ID NO: 9169177 - DNA, 22 bp, Homo sapiens
taatttttccacgtacactggg

SEQ ID NO: 9169178 - DNA, 22 bp, Homo sapiens
taatttttccacgtacactggg

SEQ ID NO: 9169179 - DNA, 20 bp, Homo sapiens
tacaatattcccactttgct

SEQ ID NO: 9169180 - DNA, 20 bp, Homo sapiens
tacaatattcccactttgct

SEQ ID NO: 9169181 - DNA, 22 bp, Homo sapiens
taattttacttcctgagcacct

SEQ ID NO: 9169182 - DNA, 22 bp, Homo sapiens
taattttacttcctgagcacct

SEQ ID NO: 9169183 - DNA, 22 bp, Homo sapiens
taattttaatagtatgtggcat

SEQ ID NO: 9169184 - DNA, 18 bp, Homo sapiens
taatttgcacagttgcaa

SEQ ID NO: 9169185 - DNA, 22 bp, Homo sapiens
taattttaactgtgctgtttgg

SEQ ID NO: 9169186 - DNA, 22 bp, Homo sapiens
taatttctggagggagaaagag

SEQ ID NO: 9169187 - DNA, 22 bp, Homo sapiens
taattttatgacagtgtatttt

SEQ ID NO: 9169188 - DNA, 23 bp, Homo sapiens
taattttagccttacaggaccct

SEQ ID NO: 9169189 - DNA, 22 bp, Homo sapiens
taattttccactctgtttatct

SEQ ID NO: 9169190 - DNA, 22 bp, Homo sapiens
tacaccagtatcttaagcatga

SEQ ID NO: 9169191 - DNA, 22 bp, Homo sapiens
tacacattttgcgggtacatgt

SEQ ID NO: 9169192 - DNA, 22 bp, Homo sapiens
tacactaaatcttcatctttta

SEQ ID NO: 9169193 - DNA, 22 bp, Homo sapiens
tacactaaatcttcatctttta

SEQ ID NO: 9169194 - DNA, 22 bp, Homo sapiens
tacactaagaacaaagatctgt

SEQ ID NO: 9169195 - DNA, 22 bp, Homo sapiens
tacactaatagccacactaatg

SEQ ID NO: 9169196 - DNA, 22 bp, Homo sapiens
tacactacacgaaggcattgca

SEQ ID NO: 9169197 - DNA, 22 bp, Homo sapiens
tacacatctggtgtgactgcca

SEQ ID NO: 9169198 - DNA, 22 bp, Homo sapiens
tacacattacataatactatct

SEQ ID NO: 9169199 - DNA, 22 bp, Homo sapiens
tacacattctagggcacagtta

SEQ ID NO: 9169200 - DNA, 22 bp, Homo sapiens
tacacattctagggcacagtta

SEQ ID NO: 9169201 - DNA, 22 bp, Homo sapiens
tacacatcccagactcccagga

SEQ ID NO: 9169202 - DNA, 22 bp, Homo sapiens
tacacatccatgttttgacttt

SEQ ID NO: 9169203 - DNA, 22 bp, Homo sapiens
tacacatctctgtcagtagtga

SEQ ID NO: 9169204 - DNA, 22 bp, Homo sapiens
tacacatcactgtatctttcag

SEQ ID NO: 9169205 - DNA, 22 bp, Homo sapiens
tacacatcaacctggctttggc

SEQ ID NO: 9169206 - DNA, 22 bp, Homo sapiens
tacacatatgtccattaatcag

SEQ ID NO: 9169207 - DNA, 22 bp, Homo sapiens
tacaattactcagctctgctgt

SEQ ID NO: 9169208 - DNA, 22 bp, Homo sapiens
taataaatgaaagtgctggcat

SEQ ID NO: 9169209 - DNA, 22 bp, Homo sapiens
taataaatgaaagtgctggcat

SEQ ID NO: 9169210 - DNA, 22 bp, Homo sapiens
taataaatgaaagtgctggcat

SEQ ID NO: 9169211 - DNA, 22 bp, Homo sapiens
taataaatgaaagtgctggcat

SEQ ID NO: 9169212 - DNA, 22 bp, Homo sapiens
taataacaattgtaggacatga

SEQ ID NO: 9169213 - DNA, 22 bp, Homo sapiens
taataacaattgtaggacatga

SEQ ID NO: 9169214 - DNA, 22 bp, Homo sapiens
taataacaattgtaggacatga

SEQ ID NO: 9169215 - DNA, 22 bp, Homo sapiens
taataacaattgtaggacatga

SEQ ID NO: 9169216 - DNA, 22 bp, Homo sapiens
taagttttaagcaatctgataa

SEQ ID NO: 9169217 - DNA, 22 bp, Homo sapiens
taagttttctggaataacttgg

SEQ ID NO: 9169218 - DNA, 22 bp, Homo sapiens
taataaatgaaagtgctggcat

SEQ ID NO: 9169219 - DNA, 22 bp, Homo sapiens
taataaatgaaagtgctggcat

SEQ ID NO: 9169220 - DNA, 22 bp, Homo sapiens
taataaatgaaagtgctggcat

SEQ ID NO: 9169221 - DNA, 22 bp, Homo sapiens
taagtttaccactttcagaatt

SEQ ID NO: 9169222 - DNA, 22 bp, Homo sapiens
taagtttagagagaatggggac

SEQ ID NO: 9169223 - DNA, 22 bp, Homo sapiens
taagtttaaatgtacatgaagc

SEQ ID NO: 9169224 - DNA, 22 bp, Homo sapiens
taagtttctccaaagcacagaa

SEQ ID NO: 9169225 - DNA, 22 bp, Homo sapiens
taagtttctacttgtcgggtct

SEQ ID NO: 9169226 - DNA, 22 bp, Homo sapiens
taagtttccagattgtaagtcc

SEQ ID NO: 9169227 - DNA, 22 bp, Homo sapiens
taagttgattataaccactgga

SEQ ID NO: 9169228 - DNA, 22 bp, Homo sapiens
taagtttaaatgtacatgaagc

SEQ ID NO: 9169229 - DNA, 22 bp, Homo sapiens
taagttcctagcctttacatag

SEQ ID NO: 9169230 - DNA, 22 bp, Homo sapiens
taagttcattagactacagata

SEQ ID NO: 9169231 - DNA, 22 bp, Homo sapiens
taagttcaaatcatcccaactt

SEQ ID NO: 9169232 - DNA, 17 bp, Homo sapiens
taagttatagcagaaga

SEQ ID NO: 9169233 - DNA, 22 bp, Homo sapiens
taagtgtttctccagtgtcttt

SEQ ID NO: 9169234 - DNA, 22 bp, Homo sapiens
taagttacctgttttgtcatca

SEQ ID NO: 9169235 - DNA, 22 bp, Homo sapiens
taagtgttgctctctctcagct

SEQ ID NO: 9169236 - DNA, 22 bp, Homo sapiens
taagttaaccctgttaatagat

SEQ ID NO: 9169237 - DNA, 22 bp, Homo sapiens
taagttaaccctgttaatagat

SEQ ID NO: 9169238 - DNA, 22 bp, Homo sapiens
taagtgttgttttcaagagata

SEQ ID NO: 9169239 - DNA, 19 bp, Homo sapiens
taagtgttggtgaatttct

SEQ ID NO: 9169240 - DNA, 22 bp, Homo sapiens
taagcagcgtaaaagccaggga

SEQ ID NO: 9169241 - DNA, 22 bp, Homo sapiens
taagcataactaaaaatgattt

SEQ ID NO: 9169242 - DNA, 22 bp, Homo sapiens
taagcaatgagataatcatggg

SEQ ID NO: 9169243 - DNA, 22 bp, Homo sapiens
taagcaatgagataatcatggg

SEQ ID NO: 9169244 - DNA, 22 bp, Homo sapiens
taagcaatgctgtagttcagtc

SEQ ID NO: 9169245 - DNA, 18 bp, Homo sapiens
taagcaatgacattgcaa

SEQ ID NO: 9169246 - DNA, 22 bp, Homo sapiens
taatttcaccgttgctagaaat

SEQ ID NO: 9169247 - DNA, 22 bp, Homo sapiens
taatttcactgatatgaagtca

SEQ ID NO: 9169248 - DNA, 22 bp, Homo sapiens
taatttcacagttcaacgcaca

SEQ ID NO: 9169249 - DNA, 22 bp, Homo sapiens
taatttcaatagcttgcataat

SEQ ID NO: 9169250 - DNA, 22 bp, Homo sapiens
taatgctggattctttcttgtc

SEQ ID NO: 9169251 - DNA, 22 bp, Homo sapiens
taatgctgccaagccatgcaga

SEQ ID NO: 9169252 - DNA, 22 bp, Homo sapiens
taatgctgtggtctaatgggga

SEQ ID NO: 9169253 - DNA, 22 bp, Homo sapiens
taatgccgtctctacaagactc

SEQ ID NO: 9169254 - DNA, 20 bp, Homo sapiens
taatgcctcatgatactaga

SEQ ID NO: 9169255 - DNA, 22 bp, Homo sapiens
taatgcttaacagctggctttt

SEQ ID NO: 9169256 - DNA, 22 bp, Homo sapiens
taatgctttgttttgatctaac

SEQ ID NO: 9169257 - DNA, 22 bp, Homo sapiens
taatgcttcaatttccttgatt

SEQ ID NO: 9169258 - DNA, 22 bp, Homo sapiens
taatgactaagcaatcatgaat

SEQ ID NO: 9169259 - DNA, 22 bp, Homo sapiens
taatgactaagcatcattaaac

SEQ ID NO: 9169260 - DNA, 22 bp, Homo sapiens
taatgaatgagaatataacaga

SEQ ID NO: 9169261 - DNA, 22 bp, Homo sapiens
taacaatttgcttcatttgttt

SEQ ID NO: 9169262 - DNA, 22 bp, Homo sapiens
taacaatttgcttcatttgttt

SEQ ID NO: 9169263 - DNA, 22 bp, Homo sapiens
taacaatttgcttcatttgttt

SEQ ID NO: 9169264 - DNA, 22 bp, Homo sapiens
taacaatttgcttcatttgttt

SEQ ID NO: 9169265 - DNA, 22 bp, Homo sapiens
taacaatttgcttcatttgttt

SEQ ID NO: 9169266 - DNA, 22 bp, Homo sapiens
taacacagagttttaaatgtgg

SEQ ID NO: 9169267 - DNA, 22 bp, Homo sapiens
taacaatagtgtttgctagtca

SEQ ID NO: 9169268 - DNA, 21 bp, Homo sapiens
taacaatctctacttctcatt

SEQ ID NO: 9169269 - DNA, 23 bp, Homo sapiens
taacaatggactcctcttagcta

SEQ ID NO: 9169270 - DNA, 22 bp, Homo sapiens
taacaattctcaaaagagggga

SEQ ID NO: 9169271 - DNA, 22 bp, Homo sapiens
taacaattctcaaaagagggga

SEQ ID NO: 9169272 - DNA, 22 bp, Homo sapiens
taacaatacccattctaattac

SEQ ID NO: 9169273 - DNA, 22 bp, Homo sapiens
taacaaactggaaattgacatt

SEQ ID NO: 9169274 - DNA, 22 bp, Homo sapiens
taacaaactggaaattgacatt

SEQ ID NO: 9169275 - DNA, 22 bp, Homo sapiens
taaatactgagttggagttggc

SEQ ID NO: 9169276 - DNA, 22 bp, Homo sapiens
taaatacagtcatttgagccat

SEQ ID NO: 9169277 - DNA, 22 bp, Homo sapiens
taaatacagtcatttgagccat

SEQ ID NO: 9169278 - DNA, 22 bp, Homo sapiens
taaatacagtcatttgagccat

SEQ ID NO: 9169279 - DNA, 22 bp, Homo sapiens
taaatacttagttttgtgtcta

SEQ ID NO: 9169280 - DNA, 22 bp, Homo sapiens
taaatacttagttttgtgtcta

SEQ ID NO: 9169281 - DNA, 22 bp, Homo sapiens
taaatacttagttttgtgtcta

SEQ ID NO: 9169282 - DNA, 22 bp, Homo sapiens
taaatacttagttttgtgtcta

SEQ ID NO: 9169283 - DNA, 22 bp, Homo sapiens
taacacatggttagtacacaat

SEQ ID NO: 9169284 - DNA, 22 bp, Homo sapiens
taacacatatctacaacatgtg

SEQ ID NO: 9169285 - DNA, 22 bp, Homo sapiens
taacacatatttcaagagtagt

SEQ ID NO: 9169286 - DNA, 22 bp, Homo sapiens
taacacataagctgagaccatg

SEQ ID NO: 9169287 - DNA, 22 bp, Homo sapiens
taacacatagatattttaactt

SEQ ID NO: 9169288 - DNA, 22 bp, Homo sapiens
taacacatatctacaacatgtg

SEQ ID NO: 9169289 - DNA, 22 bp, Homo sapiens
taacacagttctctgttgcaca

SEQ ID NO: 9169290 - DNA, 22 bp, Homo sapiens
taacacagtgtcctcagaaaca

SEQ ID NO: 9169291 - DNA, 22 bp, Homo sapiens
taactgtaatataaatatgagt

SEQ ID NO: 9169292 - DNA, 22 bp, Homo sapiens
taactggtttggctcagggtct

SEQ ID NO: 9169293 - DNA, 19 bp, Homo sapiens
taactggttaaaaagcttg

SEQ ID NO: 9169294 - DNA, 22 bp, Homo sapiens
taactggttaagggtgaaatcc

SEQ ID NO: 9169295 - DNA, 22 bp, Homo sapiens
taactggtttcatatcatttcc

SEQ ID NO: 9169296 - DNA, 18 bp, Homo sapiens
taactggtttcttcccat

SEQ ID NO: 9169297 - DNA, 22 bp, Homo sapiens
taactggtcctgaacagcccag

SEQ ID NO: 9169298 - DNA, 22 bp, Homo sapiens
taactggtgagtaggatttata

SEQ ID NO: 9169299 - DNA, 22 bp, Homo sapiens
taactggtgagttggttgagtg

SEQ ID NO: 9169300 - DNA, 19 bp, Homo sapiens
taactggtgccttcagtca

SEQ ID NO: 9169301 - DNA, 22 bp, Homo sapiens
taactggtcctcggatgttgtg

SEQ ID NO: 9169302 - DNA, 22 bp, Homo sapiens
taactggtatatcagtgtacac

SEQ ID NO: 9169303 - DNA, 22 bp, Homo sapiens
taactggtagattttaaatcgg

SEQ ID NO: 9169304 - DNA, 22 bp, Homo sapiens
taacttcaagtctgtggatcag

SEQ ID NO: 9169305 - DNA, 22 bp, Homo sapiens
taactgtacctagataacgaac

SEQ ID NO: 9169306 - DNA, 22 bp, Homo sapiens
taactgtacaactggttagtca

SEQ ID NO: 9169307 - DNA, 22 bp, Homo sapiens
taactgtagctaaccgatgaga

SEQ ID NO: 9169308 - DNA, 22 bp, Homo sapiens
taactgtagttataaagctatc

SEQ ID NO: 9169309 - DNA, 22 bp, Homo sapiens
taactgtatagcttggactaaa

SEQ ID NO: 9169310 - DNA, 22 bp, Homo sapiens
taactgtatattaaggtggccc

SEQ ID NO: 9169311 - DNA, 22 bp, Homo sapiens
taactgtatttttctgagattc

SEQ ID NO: 9169312 - DNA, 22 bp, Homo sapiens
taagaaactatggagaagaact

SEQ ID NO: 9169313 - DNA, 22 bp, Homo sapiens
taagaaactaatgcaataagag

SEQ ID NO: 9169314 - DNA, 22 bp, Homo sapiens
taagatgaggtaggtaagactt

SEQ ID NO: 9169315 - DNA, 22 bp, Homo sapiens
taagatgatcaccaaatgctgg

SEQ ID NO: 9169316 - DNA, 22 bp, Homo sapiens
taagatatggtaggaagtttgg

SEQ ID NO: 9169317 - DNA, 22 bp, Homo sapiens
taagatattgagtggtaatttg

SEQ ID NO: 9169318 - DNA, 22 bp, Homo sapiens
taagataatccattataatgtt

SEQ ID NO: 9169319 - DNA, 22 bp, Homo sapiens
taagatgactacttaccactga

SEQ ID NO: 9169320 - DNA, 20 bp, Homo sapiens
taagatgagctataagaagt

SEQ ID NO: 9169321 - DNA, 22 bp, Homo sapiens
taagatcagttcaaacatgtgt

SEQ ID NO: 9169322 - DNA, 22 bp, Homo sapiens
taagatgaagcagaagagttat

SEQ ID NO: 9169323 - DNA, 22 bp, Homo sapiens
taagatgaaggctcacctagaa

SEQ ID NO: 9169324 - DNA, 22 bp, Homo sapiens
taagatgaccttataaagagca

SEQ ID NO: 9169325 - DNA, 22 bp, Homo sapiens
taagaaatttagttatagaatg

SEQ ID NO: 9169326 - DNA, 22 bp, Homo sapiens
taagagttagggctagcaatat

SEQ ID NO: 9169327 - DNA, 23 bp, Homo sapiens
taagagtgaggtcataaattttc

SEQ ID NO: 9169328 - DNA, 22 bp, Homo sapiens
taagagttactggtttagaacc

SEQ ID NO: 9169329 - DNA, 22 bp, Homo sapiens
taagataagtgggttgagatgg

SEQ ID NO: 9169330 - DNA, 22 bp, Homo sapiens
taagataagtgggttgagatgg

SEQ ID NO: 9169331 - DNA, 22 bp, Homo sapiens
taagataatccattataatgtt

SEQ ID NO: 9169332 - DNA, 22 bp, Homo sapiens
taaacagagagtgcagttatag

SEQ ID NO: 9169333 - DNA, 22 bp, Homo sapiens
taaacagagaagactttgagca

SEQ ID NO: 9169334 - DNA, 22 bp, Homo sapiens
taaacagagatgcctgggtctg

SEQ ID NO: 9169335 - DNA, 22 bp, Homo sapiens
taaacagagatgcctgggtctg

SEQ ID NO: 9169336 - DNA, 22 bp, Homo sapiens
taaacagagtgctagttcacgg

SEQ ID NO: 9169337 - DNA, 22 bp, Homo sapiens
taaacagaattcaggcaagata

SEQ ID NO: 9169338 - DNA, 23 bp, Homo sapiens
gttttcaacacaataaatgtaac

SEQ ID NO: 9169339 - DNA, 22 bp, Homo sapiens
gttttcaaggggatttaactga

SEQ ID NO: 9169340 - DNA, 22 bp, Homo sapiens
gttttcaattataagatggctt

SEQ ID NO: 9169341 - DNA, 21 bp, Homo sapiens
taaacataaccttgtatggct

SEQ ID NO: 9169342 - DNA, 22 bp, Homo sapiens
taaacagctactgtgtcaaagg

SEQ ID NO: 9169343 - DNA, 22 bp, Homo sapiens
taaacaggagttgaagcagtaa

SEQ ID NO: 9169344 - DNA, 22 bp, Homo sapiens
taaacaggccccagggaggttg

SEQ ID NO: 9169345 - DNA, 22 bp, Homo sapiens
taaacatggattctgatcacag

SEQ ID NO: 9169346 - DNA, 22 bp, Homo sapiens
taaacatgtgagtgtgcatata

SEQ ID NO: 9169347 - DNA, 22 bp, Homo sapiens
taaacatggattctgatcacag

SEQ ID NO: 9169348 - DNA, 22 bp, Homo sapiens
taaacatgcccagtgacaggga

SEQ ID NO: 9169349 - DNA, 22 bp, Homo sapiens
gttttagtgggtggccactgat

SEQ ID NO: 9169350 - DNA, 22 bp, Homo sapiens
gttttattggaacacagccatg

SEQ ID NO: 9169351 - DNA, 22 bp, Homo sapiens
gttttattggaacacagccatg

SEQ ID NO: 9169352 - DNA, 22 bp, Homo sapiens
gttttatttccatgagagaccg

SEQ ID NO: 9169353 - DNA, 22 bp, Homo sapiens
gttttatttccatgagagaccg

SEQ ID NO: 9169354 - DNA, 22 bp, Homo sapiens
gttttatttccatgagagaccg

SEQ ID NO: 9169355 - DNA, 22 bp, Homo sapiens
taaagtttggcagacaataaca

SEQ ID NO: 9169356 - DNA, 22 bp, Homo sapiens
taaagtttatttgaacatctct

SEQ ID NO: 9169357 - DNA, 22 bp, Homo sapiens
taaagtttgtagcaattgatat

SEQ ID NO: 9169358 - DNA, 22 bp, Homo sapiens
taaataagtcactgaccattta

SEQ ID NO: 9169359 - DNA, 21 bp, Homo sapiens
taaataataagttgctgagat

SEQ ID NO: 9169360 - DNA, 21 bp, Homo sapiens
taaataataagttgctgagat

SEQ ID NO: 9169361 - DNA, 22 bp, Homo sapiens
taaataagttcttcattgtttg

SEQ ID NO: 9169362 - DNA, 21 bp, Homo sapiens
taaataataagttgctgagat

SEQ ID NO: 9169363 - DNA, 17 bp, Homo sapiens
taaatacacaagggtat

SEQ ID NO: 9169364 - DNA, 17 bp, Homo sapiens
taaatacacaagggtat

SEQ ID NO: 9169365 - DNA, 17 bp, Homo sapiens
taaatacacaagggtat

SEQ ID NO: 9169366 - DNA, 17 bp, Homo sapiens
taaatacacaagggtat

SEQ ID NO: 9169367 - DNA, 17 bp, Homo sapiens
taaatacacaagggtat

SEQ ID NO: 9169368 - DNA, 22 bp, Homo sapiens
taaatacagtcatttgagccat

SEQ ID NO: 9169369 - DNA, 21 bp, Homo sapiens
taaagaagatgaatgtgatca

SEQ ID NO: 9169370 - DNA, 21 bp, Homo sapiens
taaagaagatgaatgtgatca

SEQ ID NO: 9169371 - DNA, 22 bp, Homo sapiens
taaacatgttgacatcttacct

SEQ ID NO: 9169372 - DNA, 22 bp, Homo sapiens
taaacatgttgacatcttacct

SEQ ID NO: 9169373 - DNA, 22 bp, Homo sapiens
taaacatgttgacatcttacct

SEQ ID NO: 9169374 - DNA, 22 bp, Homo sapiens
taaactgcttctctcagtctgt

SEQ ID NO: 9169375 - DNA, 22 bp, Homo sapiens
taaagacaaatgacattacggc

SEQ ID NO: 9169376 - DNA, 21 bp, Homo sapiens
taaagaagatgaatgtgatca

SEQ ID NO: 9169377 - DNA, 22 bp, Homo sapiens
gtgtgtccttgggcctctgcag

SEQ ID NO: 9169378 - DNA, 22 bp, Homo sapiens
gtgtgtcctcttaactattatg

SEQ ID NO: 9169379 - DNA, 22 bp, Homo sapiens
gtgtgtcctgttttaaaatagt

SEQ ID NO: 9169380 - DNA, 22 bp, Homo sapiens
gtgtgtcctcataagatggagg

SEQ ID NO: 9169381 - DNA, 22 bp, Homo sapiens
gtgctttagttcttgcaactgg

SEQ ID NO: 9169382 - DNA, 21 bp, Homo sapiens
gtgcttttccttaatgttctt

SEQ ID NO: 9169383 - DNA, 22 bp, Homo sapiens
gtgcttttaaaggcaattagta

SEQ ID NO: 9169384 - DNA, 22 bp, Homo sapiens
gtgctttgttaagtctgaaatt

SEQ ID NO: 9169385 - DNA, 22 bp, Homo sapiens
gtgtgtttagcattagcagggg

SEQ ID NO: 9169386 - DNA, 22 bp, Homo sapiens
gtgtgtttcagaagccaggtgt

SEQ ID NO: 9169387 - DNA, 22 bp, Homo sapiens
gtgttaaatgcaatcacatgca

SEQ ID NO: 9169388 - DNA, 22 bp, Homo sapiens
gtgttaatggtagaatctgagt

SEQ ID NO: 9169389 - DNA, 22 bp, Homo sapiens
gtgttaatgaaaaacaactcat

SEQ ID NO: 9169390 - DNA, 22 bp, Homo sapiens
gtgttaattattggtgaataga

SEQ ID NO: 9169391 - DNA, 22 bp, Homo sapiens
gttcattttactgtaaatagca

SEQ ID NO: 9169392 - DNA, 22 bp, Homo sapiens
gttcattttactgtaaatagca

SEQ ID NO: 9169393 - DNA, 22 bp, Homo sapiens
gttataaaatgcacagttgttt

SEQ ID NO: 9169394 - DNA, 22 bp, Homo sapiens
gttcatttttccctaatgagta

SEQ ID NO: 9169395 - DNA, 22 bp, Homo sapiens
gttcatttttccctaatgagta

SEQ ID NO: 9169396 - DNA, 22 bp, Homo sapiens
gttcatttttagaatgctagta

SEQ ID NO: 9169397 - DNA, 22 bp, Homo sapiens
gttcatttttagaatgctagta

SEQ ID NO: 9169398 - DNA, 23 bp, Homo sapiens
gttcattttattgtctgattgct

SEQ ID NO: 9169399 - DNA, 22 bp, Homo sapiens
gttcatttttactttgatctac

SEQ ID NO: 9169400 - DNA, 19 bp, Homo sapiens
gttccaaaggccagacctt

SEQ ID NO: 9169401 - DNA, 22 bp, Homo sapiens
gttccaaagtctctgagctgag

SEQ ID NO: 9169402 - DNA, 22 bp, Homo sapiens
gttccaaagcaaaggaggtgag

SEQ ID NO: 9169403 - DNA, 22 bp, Homo sapiens
gttccaaacaagtcataaagta

SEQ ID NO: 9169404 - DNA, 22 bp, Homo sapiens
gttccaaatttggatctttagg

SEQ ID NO: 9169405 - DNA, 22 bp, Homo sapiens
gttccaaagttagagtgtattg

SEQ ID NO: 9169406 - DNA, 22 bp, Homo sapiens
gttacaaaggtcataaaagtgt

SEQ ID NO: 9169407 - DNA, 22 bp, Homo sapiens
gttacaaaggtcataaaagtgt

SEQ ID NO: 9169408 - DNA, 22 bp, Homo sapiens
gttacaaaggtcataaaagtgt

SEQ ID NO: 9169409 - DNA, 22 bp, Homo sapiens
gttacaaaggtcataaaagtgt

SEQ ID NO: 9169410 - DNA, 22 bp, Homo sapiens
gttagagcacatactttgcatg

SEQ ID NO: 9169411 - DNA, 22 bp, Homo sapiens
gttactcttgagaggctgaggt

SEQ ID NO: 9169412 - DNA, 22 bp, Homo sapiens
gttagaaacacattcttattga

SEQ ID NO: 9169413 - DNA, 22 bp, Homo sapiens
gttagaaacacattcttattga

SEQ ID NO: 9169414 - DNA, 22 bp, Homo sapiens
gttagcatgattcctgctcatt

SEQ ID NO: 9169415 - DNA, 22 bp, Homo sapiens
gttagcatttgtttaatatcag

SEQ ID NO: 9169416 - DNA, 22 bp, Homo sapiens
gttagcaatgcccaggaatgca

SEQ ID NO: 9169417 - DNA, 22 bp, Homo sapiens
gttagcaatgaaatctggatgc

SEQ ID NO: 9169418 - DNA, 22 bp, Homo sapiens
gttagcaacaagtctcaatgac

SEQ ID NO: 9169419 - DNA, 22 bp, Homo sapiens
gttagcacaaccaagaaatgcg

SEQ ID NO: 9169420 - DNA, 22 bp, Homo sapiens
gttagcaattgcttaagactag

SEQ ID NO: 9169421 - DNA, 22 bp, Homo sapiens
gttagcaccagtgctcataaca

SEQ ID NO: 9169422 - DNA, 22 bp, Homo sapiens
gttaggaatttgttactgtgta

SEQ ID NO: 9169423 - DNA, 22 bp, Homo sapiens
gttaggcaatacctcttacacc

SEQ ID NO: 9169424 - DNA, 22 bp, Homo sapiens
gtttagatttcatgaagacact

SEQ ID NO: 9169425 - DNA, 22 bp, Homo sapiens
gtttagatgagattttagaaca

SEQ ID NO: 9169426 - DNA, 22 bp, Homo sapiens
gtttagaattctaactttaagg

SEQ ID NO: 9169427 - DNA, 22 bp, Homo sapiens
gtttagaattctaactttaagg

SEQ ID NO: 9169428 - DNA, 22 bp, Homo sapiens
gtttagaattctaactttaagg

SEQ ID NO: 9169429 - DNA, 22 bp, Homo sapiens
gtttagaatggcaaaattaagt

SEQ ID NO: 9169430 - DNA, 22 bp, Homo sapiens
gtttagaatggcaaaattaagt

SEQ ID NO: 9169431 - DNA, 22 bp, Homo sapiens
gtttagaatggcaaaattaagt

SEQ ID NO: 9169432 - DNA, 20 bp, Homo sapiens
gtttagcatggcagtgaaag

SEQ ID NO: 9169433 - DNA, 22 bp, Homo sapiens
gtttagcaataaaaacacatga

SEQ ID NO: 9169434 - DNA, 22 bp, Homo sapiens
gtttataaggcccaatatttct

SEQ ID NO: 9169435 - DNA, 22 bp, Homo sapiens
gtttagaagccaagatttgggt

SEQ ID NO: 9169436 - DNA, 22 bp, Homo sapiens
gtttagaacacggaaatactga

SEQ ID NO: 9169437 - DNA, 22 bp, Homo sapiens
gtttagaatgaaacttttgagc

SEQ ID NO: 9169438 - DNA, 22 bp, Homo sapiens
gtttacttgtgccttggcttaa

SEQ ID NO: 9169439 - DNA, 22 bp, Homo sapiens
gtttacttttcatggagcatat

SEQ ID NO: 9169440 - DNA, 22 bp, Homo sapiens
gtttagaaaatagtgaagcaag

SEQ ID NO: 9169441 - DNA, 22 bp, Homo sapiens
gtttagaacacggaaatactga

SEQ ID NO: 9169442 - DNA, 22 bp, Homo sapiens
gtttacttagatgctcatgcag

SEQ ID NO: 9169443 - DNA, 22 bp, Homo sapiens
gtttacttagatgctcatgcag

SEQ ID NO: 9169444 - DNA, 22 bp, Homo sapiens
gtttactgtcttgcacagtgca

SEQ ID NO: 9169445 - DNA, 22 bp, Homo sapiens
gtttactgctctaggttgcaca

SEQ ID NO: 9169446 - DNA, 22 bp, Homo sapiens
gtttacaaatattttaaatggt

SEQ ID NO: 9169447 - DNA, 22 bp, Homo sapiens
gtttacaaatattttaaatggt

SEQ ID NO: 9169448 - DNA, 22 bp, Homo sapiens
gtttacaaatattttaaatggt

SEQ ID NO: 9169449 - DNA, 22 bp, Homo sapiens
gtttacattgctgtttgtgtct

SEQ ID NO: 9169450 - DNA, 22 bp, Homo sapiens
gtttaattttaggttgtcaagc

SEQ ID NO: 9169451 - DNA, 22 bp, Homo sapiens
gttccacataacacatctacaa

SEQ ID NO: 9169452 - DNA, 22 bp, Homo sapiens
gttccaggaccctggcctctga

SEQ ID NO: 9169453 - DNA, 22 bp, Homo sapiens
gttccacatcacactacttgat

SEQ ID NO: 9169454 - DNA, 22 bp, Homo sapiens
gttccacataacacatctacaa

SEQ ID NO: 9169455 - DNA, 22 bp, Homo sapiens
gttccacagagtctcactatga

SEQ ID NO: 9169456 - DNA, 22 bp, Homo sapiens
gttccacaaaaggtctagttta

SEQ ID NO: 9169457 - DNA, 22 bp, Homo sapiens
gttccacaaaatgtacccagtt

SEQ ID NO: 9169458 - DNA, 22 bp, Homo sapiens
gttccacaaaatgtacccagtt

SEQ ID NO: 9169459 - DNA, 20 bp, Homo sapiens
gttcccaggaattgaagacc

SEQ ID NO: 9169460 - DNA, 18 bp, Homo sapiens
gttcccagatggtgctga

SEQ ID NO: 9169461 - DNA, 22 bp, Homo sapiens
gttttacacacctatgaaagac

SEQ ID NO: 9169462 - DNA, 22 bp, Homo sapiens
gtttctgttgctcagataatgc

SEQ ID NO: 9169463 - DNA, 22 bp, Homo sapiens
gtttctgttgctcagataatgc

SEQ ID NO: 9169464 - DNA, 22 bp, Homo sapiens
gtttcttaaatgtagcaggacc

SEQ ID NO: 9169465 - DNA, 22 bp, Homo sapiens
gtttcttaagttacaaaatctt

SEQ ID NO: 9169466 - DNA, 22 bp, Homo sapiens
gtttcttaagttacaaaatctt

SEQ ID NO: 9169467 - DNA, 22 bp, Homo sapiens
gtttctcctctgtgtcttgttt

SEQ ID NO: 9169468 - DNA, 22 bp, Homo sapiens
gtttctctgtacctctgtccca

SEQ ID NO: 9169469 - DNA, 22 bp, Homo sapiens
gtttctctgtctgttacattgg

SEQ ID NO: 9169470 - DNA, 22 bp, Homo sapiens
gtttctctgtctgttacattgg

SEQ ID NO: 9169471 - DNA, 22 bp, Homo sapiens
gtttctgtaagactgaattgac

SEQ ID NO: 9169472 - DNA, 22 bp, Homo sapiens
gtttctgtgttagatgagtctt

SEQ ID NO: 9169473 - DNA, 22 bp, Homo sapiens
gtttctgctgcgtgctccagga

SEQ ID NO: 9169474 - DNA, 22 bp, Homo sapiens
gtttctctttgaagcctggctg

SEQ ID NO: 9169475 - DNA, 22 bp, Homo sapiens
gtttctcttaacacataaagta

SEQ ID NO: 9169476 - DNA, 22 bp, Homo sapiens
gtttatatgtgtgccactctta

SEQ ID NO: 9169477 - DNA, 22 bp, Homo sapiens
gtttatatgaacttcataccca

SEQ ID NO: 9169478 - DNA, 22 bp, Homo sapiens
gtttataaggcccaatatttct

SEQ ID NO: 9169479 - DNA, 22 bp, Homo sapiens
gtttataaggtaaaggagagag

SEQ ID NO: 9169480 - DNA, 22 bp, Homo sapiens
gtttataatccaactctgctcc

SEQ ID NO: 9169481 - DNA, 22 bp, Homo sapiens
gtttcctttctattgccttgat

SEQ ID NO: 9169482 - DNA, 22 bp, Homo sapiens
gtttcctttgccagtaaatggg

SEQ ID NO: 9169483 - DNA, 22 bp, Homo sapiens
gtttccttttggaattagagct

SEQ ID NO: 9169484 - DNA, 22 bp, Homo sapiens
gtttctcaagcttgaatgcaca

SEQ ID NO: 9169485 - DNA, 23 bp, Homo sapiens
gtttctatgtcttgtgccttcat

SEQ ID NO: 9169486 - DNA, 22 bp, Homo sapiens
tagcaccaatatgtgcttttca

SEQ ID NO: 9169487 - DNA, 22 bp, Homo sapiens
tagcacattgttgaccagaagg

SEQ ID NO: 9169488 - DNA, 22 bp, Homo sapiens
tagcacatcttcttggcctgca

SEQ ID NO: 9169489 - DNA, 22 bp, Homo sapiens
tagcacatctggcgcttatagg

SEQ ID NO: 9169490 - DNA, 22 bp, Homo sapiens
tagcacagtgttcacaacagtg

SEQ ID NO: 9169491 - DNA, 22 bp, Homo sapiens
tagcacatacataatagataga

SEQ ID NO: 9169492 - DNA, 22 bp, Homo sapiens
tagcaccggatggcaagcaaca

SEQ ID NO: 9169493 - DNA, 22 bp, Homo sapiens
tagcacctagagtattttatca

SEQ ID NO: 9169494 - DNA, 22 bp, Homo sapiens
tagcacctgatacctagtatgt

SEQ ID NO: 9169495 - DNA, 22 bp, Homo sapiens
tagcacctgtgcacaccaggca

SEQ ID NO: 9169496 - DNA, 22 bp, Homo sapiens
tagcacctggtcaattcagtca

SEQ ID NO: 9169497 - DNA, 22 bp, Homo sapiens
tagcacctgcaggatgtgcaca

SEQ ID NO: 9169498 - DNA, 22 bp, Homo sapiens
tagcagtgccaggattttgctg

SEQ ID NO: 9169499 - DNA, 22 bp, Homo sapiens
tagcagtgcacagtaggacacc

SEQ ID NO: 9169500 - DNA, 22 bp, Homo sapiens
tagcagtcatcggcagagaaaa

SEQ ID NO: 9169501 - DNA, 22 bp, Homo sapiens
tagcagaaccagcagtcaattt

SEQ ID NO: 9169502 - DNA, 22 bp, Homo sapiens
tagcagaacaatagtcaatgat

SEQ ID NO: 9169503 - DNA, 22 bp, Homo sapiens
tagcagggttttgaagagggtt

SEQ ID NO: 9169504 - DNA, 21 bp, Homo sapiens
tagcagaaacagttcaggcca

SEQ ID NO: 9169505 - DNA, 22 bp, Homo sapiens
tagccaaagaaggtatatttgt

SEQ ID NO: 9169506 - DNA, 22 bp, Homo sapiens
tagccactacctataccataag

SEQ ID NO: 9169507 - DNA, 22 bp, Homo sapiens
tagccaccagaaaggttttcag

SEQ ID NO: 9169508 - DNA, 22 bp, Homo sapiens
tagccaatctgaccagtctttt

SEQ ID NO: 9169509 - DNA, 22 bp, Homo sapiens
tagccaatctccagcataaatc

SEQ ID NO: 9169510 - DNA, 22 bp, Homo sapiens
tagcagtggaatcttttgtcca

SEQ ID NO: 9169511 - DNA, 22 bp, Homo sapiens
tagcagtgccctgtggaataag

SEQ ID NO: 9169512 - DNA, 22 bp, Homo sapiens
tagcagtgccctgtggaataag

SEQ ID NO: 9169513 - DNA, 23 bp, Homo sapiens
tagccaggcccagcatggacacc

SEQ ID NO: 9169514 - DNA, 22 bp, Homo sapiens
tagccaggcgaggtcagtgtcg

SEQ ID NO: 9169515 - DNA, 22 bp, Homo sapiens
tagccaggcaattatgggtgat

SEQ ID NO: 9169516 - DNA, 22 bp, Homo sapiens
tagccagctggataatgtgggg

SEQ ID NO: 9169517 - DNA, 22 bp, Homo sapiens
tagccactattcctgagctaga

SEQ ID NO: 9169518 - DNA, 22 bp, Homo sapiens
tagccagggagacactgtggag

SEQ ID NO: 9169519 - DNA, 22 bp, Homo sapiens
tagccagggagacactgtggag

SEQ ID NO: 9169520 - DNA, 22 bp, Homo sapiens
tagccaggtcacactgtgtgtt

SEQ ID NO: 9169521 - DNA, 22 bp, Homo sapiens
tagattttaggagattttactg

SEQ ID NO: 9169522 - DNA, 18 bp, Homo sapiens
tagattaaaattgaattc

SEQ ID NO: 9169523 - DNA, 17 bp, Homo sapiens
tagattaaacacggcca

SEQ ID NO: 9169524 - DNA, 22 bp, Homo sapiens
tagatttgtttccttctctcca

SEQ ID NO: 9169525 - DNA, 22 bp, Homo sapiens
tagatttgtttccttctctcca

SEQ ID NO: 9169526 - DNA, 22 bp, Homo sapiens
tagatgtgtagggctccagcta

SEQ ID NO: 9169527 - DNA, 22 bp, Homo sapiens
tagatgtgtgatattctcagat

SEQ ID NO: 9169528 - DNA, 22 bp, Homo sapiens
tagatgtgagcccaggctgctt

SEQ ID NO: 9169529 - DNA, 22 bp, Homo sapiens
tagatgttaagcttctagaagg

SEQ ID NO: 9169530 - DNA, 22 bp, Homo sapiens
tagatgtgttgcctggagttgt

SEQ ID NO: 9169531 - DNA, 23 bp, Homo sapiens
tagatgtattaagtgcattttca

SEQ ID NO: 9169532 - DNA, 22 bp, Homo sapiens
tagatggctttctgaggtattt

SEQ ID NO: 9169533 - DNA, 22 bp, Homo sapiens
tagatggcaccttctgtgtgtc

SEQ ID NO: 9169534 - DNA, 18 bp, Homo sapiens
tagatggcagtctgcaga

SEQ ID NO: 9169535 - DNA, 22 bp, Homo sapiens
tagatggcgtccatggccgcag

SEQ ID NO: 9169536 - DNA, 22 bp, Homo sapiens
tagatggctggtgttctgagct

SEQ ID NO: 9169537 - DNA, 22 bp, Homo sapiens
tagcacacactgcatctacaaa

SEQ ID NO: 9169538 - DNA, 21 bp, Homo sapiens
tagcacagctgtagacagttt

SEQ ID NO: 9169539 - DNA, 18 bp, Homo sapiens
tagcacagagcaggatgt

SEQ ID NO: 9169540 - DNA, 22 bp, Homo sapiens
tagcacaggtcttgttgccatt

SEQ ID NO: 9169541 - DNA, 22 bp, Homo sapiens
tagcacagcttcttgatgtcac

SEQ ID NO: 9169542 - DNA, 22 bp, Homo sapiens
tagcaagacaacttttctcagt

SEQ ID NO: 9169543 - DNA, 22 bp, Homo sapiens
tagcaagaggaaacaaggggcc

SEQ ID NO: 9169544 - DNA, 22 bp, Homo sapiens
tagcaagaccaatatgtagata

SEQ ID NO: 9169545 - DNA, 22 bp, Homo sapiens
tagcaaaaaaactggcatctcc

SEQ ID NO: 9169546 - DNA, 22 bp, Homo sapiens
tagcaaaaactgcagttacttt

SEQ ID NO: 9169547 - DNA, 22 bp, Homo sapiens
tagcaagaagtagctctggatt

SEQ ID NO: 9169548 - DNA, 22 bp, Homo sapiens
tagcaagaagggagatggggtt

SEQ ID NO: 9169549 - DNA, 22 bp, Homo sapiens
tagcaaaagccacgattacttt

SEQ ID NO: 9169550 - DNA, 22 bp, Homo sapiens
tagcaaaagccacgattacttt

SEQ ID NO: 9169551 - DNA, 22 bp, Homo sapiens
tacttggattaataatttgttt

SEQ ID NO: 9169552 - DNA, 22 bp, Homo sapiens
tacttggattaataatttgttt

SEQ ID NO: 9169553 - DNA, 22 bp, Homo sapiens
tacttggagttcataatctggt

SEQ ID NO: 9169554 - DNA, 22 bp, Homo sapiens
tacttgtatctttaccaatttt

SEQ ID NO: 9169555 - DNA, 22 bp, Homo sapiens
tacttgtatctttaccaatttt

SEQ ID NO: 9169556 - DNA, 22 bp, Homo sapiens
tacttgtgttctactagagaaa

SEQ ID NO: 9169557 - DNA, 22 bp, Homo sapiens
tactttctaagacatacaactt

SEQ ID NO: 9169558 - DNA, 22 bp, Homo sapiens
tactttctagctctccccagtt

SEQ ID NO: 9169559 - DNA, 22 bp, Homo sapiens
tagaagcagcaggagtaaaggc

SEQ ID NO: 9169560 - DNA, 22 bp, Homo sapiens
tagaagcagcaggagtaaaggc

SEQ ID NO: 9169561 - DNA, 22 bp, Homo sapiens
tagaagcagcaggactcatggt

SEQ ID NO: 9169562 - DNA, 19 bp, Homo sapiens
tagaagcactaggcaaact

SEQ ID NO: 9169563 - DNA, 19 bp, Homo sapiens
tagaagcactaggcaaact

SEQ ID NO: 9169564 - DNA, 22 bp, Homo sapiens
tagaagcactgacagagtttga

SEQ ID NO: 9169565 - DNA, 22 bp, Homo sapiens
tagaagcagaaggaaggtggct

SEQ ID NO: 9169566 - DNA, 22 bp, Homo sapiens
tagaagcaccactcatcacgtg

SEQ ID NO: 9169567 - DNA, 22 bp, Homo sapiens
tactttgaagacaatatctgga

SEQ ID NO: 9169568 - DNA, 22 bp, Homo sapiens
tactttctttctgatccttatg

SEQ ID NO: 9169569 - DNA, 22 bp, Homo sapiens
tactttctgtccttctgttaaa

SEQ ID NO: 9169570 - DNA, 22 bp, Homo sapiens
tactttcttgttcctttcataa

SEQ ID NO: 9169571 - DNA, 22 bp, Homo sapiens
tactttctttcccaagaggtgg

SEQ ID NO: 9169572 - DNA, 22 bp, Homo sapiens
tagaagcagtaatagaaatagg

SEQ ID NO: 9169573 - DNA, 22 bp, Homo sapiens
tagaaggaggactggcagtgtt

SEQ ID NO: 9169574 - DNA, 22 bp, Homo sapiens
tagaaggtaatgaaatgctgat

SEQ ID NO: 9169575 - DNA, 22 bp, Homo sapiens
tagaaggtagcaatctgggaag

SEQ ID NO: 9169576 - DNA, 22 bp, Homo sapiens
tagaagttgaactaaaaatatt

SEQ ID NO: 9169577 - DNA, 22 bp, Homo sapiens
tagaagttatgataataatagt

SEQ ID NO: 9169578 - DNA, 22 bp, Homo sapiens
tagaagttaaaggaatacagaa

SEQ ID NO: 9169579 - DNA, 22 bp, Homo sapiens
tagaagttgctcaataaatgtt

SEQ ID NO: 9169580 - DNA, 22 bp, Homo sapiens
tagaataagttgatgatatatg

SEQ ID NO: 9169581 - DNA, 22 bp, Homo sapiens
tagaataagttgatgatatatg

SEQ ID NO: 9169582 - DNA, 22 bp, Homo sapiens
tagaataagttgatgatatatg

SEQ ID NO: 9169583 - DNA, 22 bp, Homo sapiens
tagaatctagttcattcatttg

SEQ ID NO: 9169584 - DNA, 22 bp, Homo sapiens
tagaggagggctgttcttcagt

SEQ ID NO: 9169585 - DNA, 22 bp, Homo sapiens
tagaggaggtgattcttgagct

SEQ ID NO: 9169586 - DNA, 22 bp, Homo sapiens
tagaggaggtgattcttgagct

SEQ ID NO: 9169587 - DNA, 22 bp, Homo sapiens
tagaggagggctgttcttcagt

SEQ ID NO: 9169588 - DNA, 22 bp, Homo sapiens
tagaggaggcaaggccctccct

SEQ ID NO: 9169589 - DNA, 22 bp, Homo sapiens
tagaggcacagtctatgtagag

SEQ ID NO: 9169590 - DNA, 22 bp, Homo sapiens
tagaggcaaccagtgttgagaa

SEQ ID NO: 9169591 - DNA, 23 bp, Homo sapiens
tagaggaggatgtgatgcatatt

SEQ ID NO: 9169592 - DNA, 23 bp, Homo sapiens
tagaggaggatgtgatgcatatt

SEQ ID NO: 9169593 - DNA, 22 bp, Homo sapiens
tagaggagcggcgagctgagct

SEQ ID NO: 9169594 - DNA, 22 bp, Homo sapiens
tagaggagcggcgagctgagct

SEQ ID NO: 9169595 - DNA, 22 bp, Homo sapiens
tagaggagagttgctggatgga

SEQ ID NO: 9169596 - DNA, 22 bp, Homo sapiens
tagaggagagttgctggatgga

SEQ ID NO: 9169597 - DNA, 22 bp, Homo sapiens
tagagctgctggactgtaacag

SEQ ID NO: 9169598 - DNA, 22 bp, Homo sapiens
tagagctgataatgaggccaag

SEQ ID NO: 9169599 - DNA, 22 bp, Homo sapiens
tagagctgataatgaggccaag

SEQ ID NO: 9169600 - DNA, 22 bp, Homo sapiens
tagatgctcatgagtcagccag

SEQ ID NO: 9169601 - DNA, 22 bp, Homo sapiens
tagaggcaccctggaggagact

SEQ ID NO: 9169602 - DNA, 22 bp, Homo sapiens
tagaggcaccctggaggagact

SEQ ID NO: 9169603 - DNA, 22 bp, Homo sapiens
tagatgatagggccagaatttg

SEQ ID NO: 9169604 - DNA, 22 bp, Homo sapiens
tagatgaccttgtgttaggcaa

SEQ ID NO: 9169605 - DNA, 23 bp, Homo sapiens
tagagcagggaaatctgtcagag

SEQ ID NO: 9169606 - DNA, 23 bp, Homo sapiens
tagagcagggaaatctgtcagag

SEQ ID NO: 9169607 - DNA, 22 bp, Homo sapiens
tagagcagccttcagagcagtt

SEQ ID NO: 9169608 - DNA, 23 bp, Homo sapiens
tagagcagccccgaggtgctgtc

SEQ ID NO: 9169609 - DNA, 23 bp, Homo sapiens
tagagcagccccgaggtgctgtc

SEQ ID NO: 9169610 - DNA, 22 bp, Homo sapiens
tagagcagaacttgttaacacc

SEQ ID NO: 9169611 - DNA, 22 bp, Homo sapiens
tagagcagatagtgaaacagaa

SEQ ID NO: 9169612 - DNA, 22 bp, Homo sapiens
tagagatgtgatatagcagagt

SEQ ID NO: 9169613 - DNA, 22 bp, Homo sapiens
tagaatctgcctgcagcaaaga

SEQ ID NO: 9169614 - DNA, 22 bp, Homo sapiens
tagagatgccctagctgaagta

SEQ ID NO: 9169615 - DNA, 22 bp, Homo sapiens
tagagcagtgttgtccatcaga

SEQ ID NO: 9169616 - DNA, 22 bp, Homo sapiens
tagagcagtgggtaccatggca

SEQ ID NO: 9169617 - DNA, 22 bp, Homo sapiens
tagagcagtgggtaccatggca

SEQ ID NO: 9169618 - DNA, 23 bp, Homo sapiens
tagagcagtagatcaccatggga

SEQ ID NO: 9169619 - DNA, 23 bp, Homo sapiens
tagagcagtagatcaccatggga

SEQ ID NO: 9169620 - DNA, 22 bp, Homo sapiens
tagagctgagttgactccattt

SEQ ID NO: 9169621 - DNA, 22 bp, Homo sapiens
tagagctgagttgactccattt

SEQ ID NO: 9169622 - DNA, 22 bp, Homo sapiens
tagagctgagttgactccattt

SEQ ID NO: 9169623 - DNA, 22 bp, Homo sapiens
tagagctactggcagcctcttc

SEQ ID NO: 9169624 - DNA, 22 bp, Homo sapiens
tagtataattgttctggaatca

SEQ ID NO: 9169625 - DNA, 22 bp, Homo sapiens
tagtatagattgaagcagatca

SEQ ID NO: 9169626 - DNA, 22 bp, Homo sapiens
tagtatattttgttgcaattca

SEQ ID NO: 9169627 - DNA, 22 bp, Homo sapiens
tagtagcaggaatctgaaggta

SEQ ID NO: 9169628 - DNA, 22 bp, Homo sapiens
tagtagcaaaactcatctcttt

SEQ ID NO: 9169629 - DNA, 22 bp, Homo sapiens
tagtagtaattgttatcttatt

SEQ ID NO: 9169630 - DNA, 22 bp, Homo sapiens
tagtactacgttttctactatc

SEQ ID NO: 9169631 - DNA, 22 bp, Homo sapiens
taggtttcagaggtgccgggaa

SEQ ID NO: 9169632 - DNA, 22 bp, Homo sapiens
taggttttcctaaaattctggt

SEQ ID NO: 9169633 - DNA, 22 bp, Homo sapiens
tagtaaaaggtcttcctttgtt

SEQ ID NO: 9169634 - DNA, 22 bp, Homo sapiens
tagtacagtttaaatattaata

SEQ ID NO: 9169635 - DNA, 22 bp, Homo sapiens
taggctgacttgtttcataaag

SEQ ID NO: 9169636 - DNA, 22 bp, Homo sapiens
taggctgagctaagagagctta

SEQ ID NO: 9169637 - DNA, 22 bp, Homo sapiens
taggctgaaaggagaggtgaag

SEQ ID NO: 9169638 - DNA, 22 bp, Homo sapiens
taggctgagcttgtagatcgta

SEQ ID NO: 9169639 - DNA, 22 bp, Homo sapiens
taggctgagcttgtagatcgta

SEQ ID NO: 9169640 - DNA, 22 bp, Homo sapiens
taggctgaggttgatgccaggg

SEQ ID NO: 9169641 - DNA, 22 bp, Homo sapiens
taggctgaggttgatgccaggg

SEQ ID NO: 9169642 - DNA, 22 bp, Homo sapiens
taggctgcaagcatagaacaaa

SEQ ID NO: 9169643 - DNA, 22 bp, Homo sapiens
taggctggaacttaggcagagg

SEQ ID NO: 9169644 - DNA, 22 bp, Homo sapiens
taggctggaggaagcagtgcct

SEQ ID NO: 9169645 - DNA, 22 bp, Homo sapiens
taggctgggaagaaagattctc

SEQ ID NO: 9169646 - DNA, 22 bp, Homo sapiens
taggtgtgggctcaggaatgtg

SEQ ID NO: 9169647 - DNA, 22 bp, Homo sapiens
taggtgtgattcgaagagcaaa

SEQ ID NO: 9169648 - DNA, 22 bp, Homo sapiens
taggtgtgggctcaggaatgtg

SEQ ID NO: 9169649 - DNA, 22 bp, Homo sapiens
taggttctctattgcccccaaa

SEQ ID NO: 9169650 - DNA, 19 bp, Homo sapiens
taggttggacagtatcccc

SEQ ID NO: 9169651 - DNA, 22 bp, Homo sapiens
taggttctccacaggttctcca

SEQ ID NO: 9169652 - DNA, 22 bp, Homo sapiens
tagtatttcctgtaagctatag

SEQ ID NO: 9169653 - DNA, 22 bp, Homo sapiens
tagtcaaacctcagaatacccc

SEQ ID NO: 9169654 - DNA, 22 bp, Homo sapiens
tagtcagttgggtctagtggca

SEQ ID NO: 9169655 - DNA, 22 bp, Homo sapiens
tagtcctgaccttgccaccagc

SEQ ID NO: 9169656 - DNA, 22 bp, Homo sapiens
tagtcctgaccttgccaccagc

SEQ ID NO: 9169657 - DNA, 22 bp, Homo sapiens
tagtccttgctgggcacagagt

SEQ ID NO: 9169658 - DNA, 22 bp, Homo sapiens
tagtccagccttgggtgtagcc

SEQ ID NO: 9169659 - DNA, 22 bp, Homo sapiens
tagtccaggaaggtggggcaga

SEQ ID NO: 9169660 - DNA, 22 bp, Homo sapiens
tagtccaggttaatccctgcct

SEQ ID NO: 9169661 - DNA, 22 bp, Homo sapiens
tagtccaggacaatcttcatat

SEQ ID NO: 9169662 - DNA, 20 bp, Homo sapiens
tagtccagtaggggggcttt

SEQ ID NO: 9169663 - DNA, 22 bp, Homo sapiens
tagtcattctccttacaaagcc

SEQ ID NO: 9169664 - DNA, 23 bp, Homo sapiens
tagtgtatatcaacatttgtccc

SEQ ID NO: 9169665 - DNA, 22 bp, Homo sapiens
tagtggatgggtaaagtatttt

SEQ ID NO: 9169666 - DNA, 19 bp, Homo sapiens
tagtggagtgacaagttct

SEQ ID NO: 9169667 - DNA, 19 bp, Homo sapiens
tagtggagtgacaagttct

SEQ ID NO: 9169668 - DNA, 22 bp, Homo sapiens
tagtggctgcagggctgtttga

SEQ ID NO: 9169669 - DNA, 22 bp, Homo sapiens
taggaaggtgtttttaaggagc

SEQ ID NO: 9169670 - DNA, 22 bp, Homo sapiens
taggaagggctcagggctcggt

SEQ ID NO: 9169671 - DNA, 22 bp, Homo sapiens
taggaaggtccatgtcttatct

SEQ ID NO: 9169672 - DNA, 22 bp, Homo sapiens
taggaaggaggccatcttggcg

SEQ ID NO: 9169673 - DNA, 22 bp, Homo sapiens
taggaaggcctgtcactacttg

SEQ ID NO: 9169674 - DNA, 22 bp, Homo sapiens
taggaagggaaaggcttcaact

SEQ ID NO: 9169675 - DNA, 22 bp, Homo sapiens
taggaatgataatagtaaagag

SEQ ID NO: 9169676 - DNA, 22 bp, Homo sapiens
taggaatgagagggtgaggatt

SEQ ID NO: 9169677 - DNA, 23 bp, Homo sapiens
taggacagaatgcagaaaaatac

SEQ ID NO: 9169678 - DNA, 22 bp, Homo sapiens
taggacagagatttgttttatg

SEQ ID NO: 9169679 - DNA, 22 bp, Homo sapiens
taggacagagctggttacaatg

SEQ ID NO: 9169680 - DNA, 22 bp, Homo sapiens
taggacagagttccctgatggc

SEQ ID NO: 9169681 - DNA, 22 bp, Homo sapiens
taggacagagttccctgatggc

SEQ ID NO: 9169682 - DNA, 21 bp, Homo sapiens
taggacagcccccctgccctc

SEQ ID NO: 9169683 - DNA, 22 bp, Homo sapiens
taggacaggatcatgatgctgg

SEQ ID NO: 9169684 - DNA, 22 bp, Homo sapiens
taggacaggatcatgatgctgg

SEQ ID NO: 9169685 - DNA, 22 bp, Homo sapiens
taggacaggctaaaagggataa

SEQ ID NO: 9169686 - DNA, 20 bp, Homo sapiens
taggacaggcagccgagggg

SEQ ID NO: 9169687 - DNA, 22 bp, Homo sapiens
taggacaggctaaaagggataa

SEQ ID NO: 9169688 - DNA, 22 bp, Homo sapiens
taggacagggacatctttttga

SEQ ID NO: 9169689 - DNA, 20 bp, Homo sapiens
taggacagggcctggcttct

SEQ ID NO: 9169690 - DNA, 22 bp, Homo sapiens
taggacaggtgaggggctgtgg

SEQ ID NO: 9169691 - DNA, 22 bp, Homo sapiens
taggctcctgagtccacagcac

SEQ ID NO: 9169692 - DNA, 22 bp, Homo sapiens
taggctgaaaggagaggtgaag

SEQ ID NO: 9169693 - DNA, 22 bp, Homo sapiens
taggctcctgaggactccatgc

SEQ ID NO: 9169694 - DNA, 23 bp, Homo sapiens
taggaagacagcaaaagaatgga

SEQ ID NO: 9169695 - DNA, 22 bp, Homo sapiens
taggaagataaacatttgtatg

SEQ ID NO: 9169696 - DNA, 22 bp, Homo sapiens
taggaagatcaagtttatctca

SEQ ID NO: 9169697 - DNA, 22 bp, Homo sapiens
taggaagataaacatttgtatg

SEQ ID NO: 9169698 - DNA, 22 bp, Homo sapiens
taggaagcattatcatcactga

SEQ ID NO: 9169699 - DNA, 22 bp, Homo sapiens
taggaaggaagagcctcagatt

SEQ ID NO: 9169700 - DNA, 22 bp, Homo sapiens
taggaaatgaggccaacatgtg

SEQ ID NO: 9169701 - DNA, 22 bp, Homo sapiens
taggaaatgctccattgcataa

SEQ ID NO: 9169702 - DNA, 22 bp, Homo sapiens
taggaagaagcagccttgctta

SEQ ID NO: 9169703 - DNA, 22 bp, Homo sapiens
taggaagaaactttccctgcag

SEQ ID NO: 9169704 - DNA, 22 bp, Homo sapiens
taggaagaagcagccttgctta

SEQ ID NO: 9169705 - DNA, 22 bp, Homo sapiens
tagcccagatgattgaaccatg

SEQ ID NO: 9169706 - DNA, 22 bp, Homo sapiens
taggaaactctcagctggtcat

SEQ ID NO: 9169707 - DNA, 22 bp, Homo sapiens
tagcccagatgattgaaccatg

SEQ ID NO: 9169708 - DNA, 22 bp, Homo sapiens
tagcccagaagagggaagcaac

SEQ ID NO: 9169709 - DNA, 22 bp, Homo sapiens
tagcccagaagagggaagcaac

SEQ ID NO: 9169710 - DNA, 22 bp, Homo sapiens
tagcccagaaagcaaatgtctc

SEQ ID NO: 9169711 - DNA, 22 bp, Homo sapiens
tagcccagaaagcaaatgtctc

SEQ ID NO: 9169712 - DNA, 22 bp, Homo sapiens
taggaaatatttgaacatagga

SEQ ID NO: 9169713 - DNA, 22 bp, Homo sapiens
taggaaatatttgaacatagga

SEQ ID NO: 9169714 - DNA, 22 bp, Homo sapiens
taggaaatatttgaacatagga

SEQ ID NO: 9169715 - DNA, 22 bp, Homo sapiens
taggaaagcagtagagccagga

SEQ ID NO: 9169716 - DNA, 22 bp, Homo sapiens
tatttcagcacatgggataggt

SEQ ID NO: 9169717 - DNA, 22 bp, Homo sapiens
tatttcagccctactacttggc

SEQ ID NO: 9169718 - DNA, 22 bp, Homo sapiens
tatttcagagttgttttctgtc

SEQ ID NO: 9169719 - DNA, 22 bp, Homo sapiens
tatttcagcaagaagaatgtgg

SEQ ID NO: 9169720 - DNA, 22 bp, Homo sapiens
tatttcagctctttggattatc

SEQ ID NO: 9169721 - DNA, 22 bp, Homo sapiens
tatttcaggctatatttcttgt

SEQ ID NO: 9169722 - DNA, 19 bp, Homo sapiens
tatttcaggctcagagtct

SEQ ID NO: 9169723 - DNA, 22 bp, Homo sapiens
tatttcagacactgatcttgca

SEQ ID NO: 9169724 - DNA, 21 bp, Homo sapiens
tatttcagaagagtctcagag

SEQ ID NO: 9169725 - DNA, 20 bp, Homo sapiens
tatttcactctccagatggc

SEQ ID NO: 9169726 - DNA, 22 bp, Homo sapiens
tatttcactcagtataccatag

SEQ ID NO: 9169727 - DNA, 22 bp, Homo sapiens
tatttcaccttactaagctgtg

SEQ ID NO: 9169728 - DNA, 22 bp, Homo sapiens
tattgtatcttaccacatgtat

SEQ ID NO: 9169729 - DNA, 22 bp, Homo sapiens
tatttcaacgtatgaaaagctg

SEQ ID NO: 9169730 - DNA, 22 bp, Homo sapiens
tatttcaagaacttctatccat

SEQ ID NO: 9169731 - DNA, 22 bp, Homo sapiens
tatttcacataccacagagtgt

SEQ ID NO: 9169732 - DNA, 22 bp, Homo sapiens
tatttcaccaccgctgatgaag

SEQ ID NO: 9169733 - DNA, 22 bp, Homo sapiens
tatttcacatgtgggaaacata

SEQ ID NO: 9169734 - DNA, 22 bp, Homo sapiens
tatttcacctaaaagtgtcaaa

SEQ ID NO: 9169735 - DNA, 22 bp, Homo sapiens
tattgcatctcttcatatctgt

SEQ ID NO: 9169736 - DNA, 22 bp, Homo sapiens
tattgcatattgtacttgaatg

SEQ ID NO: 9169737 - DNA, 22 bp, Homo sapiens
tattgcatattgtacttgaatg

SEQ ID NO: 9169738 - DNA, 21 bp, Homo sapiens
tattgcataacaaattaccct

SEQ ID NO: 9169739 - DNA, 21 bp, Homo sapiens
tattgcataccatgaatctga

SEQ ID NO: 9169740 - DNA, 22 bp, Homo sapiens
tattgcaagcaattccaaaagg

SEQ ID NO: 9169741 - DNA, 22 bp, Homo sapiens
tattgcaatttggctaaagaat

SEQ ID NO: 9169742 - DNA, 22 bp, Homo sapiens
tattgcaagtggcataaaattt

SEQ ID NO: 9169743 - DNA, 22 bp, Homo sapiens
tattgtacatttcaaagtagct

SEQ ID NO: 9169744 - DNA, 22 bp, Homo sapiens
tattgcattatggtaggaaagg

SEQ ID NO: 9169745 - DNA, 22 bp, Homo sapiens
tatttcagggagaataaatttg

SEQ ID NO: 9169746 - DNA, 22 bp, Homo sapiens
tatttccaggccccactctaga

SEQ ID NO: 9169747 - DNA, 22 bp, Homo sapiens
tatttccaggccccactctaga

SEQ ID NO: 9169748 - DNA, 22 bp, Homo sapiens
tatttctaagagatatctgtac

SEQ ID NO: 9169749 - DNA, 22 bp, Homo sapiens
tatttctaagctgtaagtctga

SEQ ID NO: 9169750 - DNA, 22 bp, Homo sapiens
tatttggtatcagtgacagctg

SEQ ID NO: 9169751 - DNA, 22 bp, Homo sapiens
tatttggttcttcttctgtgta

SEQ ID NO: 9169752 - DNA, 22 bp, Homo sapiens
tatttgtagaatggattaaggg

SEQ ID NO: 9169753 - DNA, 22 bp, Homo sapiens
tatttggtggctgattatcttt

SEQ ID NO: 9169754 - DNA, 22 bp, Homo sapiens
tatttgtatgtgtgtacatata

SEQ ID NO: 9169755 - DNA, 22 bp, Homo sapiens
tattttcaccttctctggatat

SEQ ID NO: 9169756 - DNA, 22 bp, Homo sapiens
tatttgttgcgggaattgctat

SEQ ID NO: 9169757 - DNA, 22 bp, Homo sapiens
tattttcattctgtgtgactgt

SEQ ID NO: 9169758 - DNA, 22 bp, Homo sapiens
tattttcattctgtgtgactgt

SEQ ID NO: 9169759 - DNA, 22 bp, Homo sapiens
tatttgttccagagataaaaat

SEQ ID NO: 9169760 - DNA, 22 bp, Homo sapiens
tatttgtgtgggtatctatata

SEQ ID NO: 9169761 - DNA, 22 bp, Homo sapiens
tatttgttgagttgttatgtct

SEQ ID NO: 9169762 - DNA, 22 bp, Homo sapiens
tatttgttgagttgttatgtct

SEQ ID NO: 9169763 - DNA, 22 bp, Homo sapiens
tatgccagactgtgagcttctt

SEQ ID NO: 9169764 - DNA, 22 bp, Homo sapiens
tatgcctgataactgtgtctct

SEQ ID NO: 9169765 - DNA, 22 bp, Homo sapiens
tatgctactagaaataaaatgg

SEQ ID NO: 9169766 - DNA, 22 bp, Homo sapiens
tatgctctgagacctttgtgca

SEQ ID NO: 9169767 - DNA, 22 bp, Homo sapiens
tatgctacatcctgggggatgt

SEQ ID NO: 9169768 - DNA, 22 bp, Homo sapiens
tatgctttaacattaaacaaca

SEQ ID NO: 9169769 - DNA, 22 bp, Homo sapiens
tatgctttaacattaaacaaca

SEQ ID NO: 9169770 - DNA, 23 bp, Homo sapiens
tatgtgtgggtctactagaagtc

SEQ ID NO: 9169771 - DNA, 22 bp, Homo sapiens
tatgtgtgtatgacagacagag

SEQ ID NO: 9169772 - DNA, 22 bp, Homo sapiens
tatgtgtttgacaccctgcaag

SEQ ID NO: 9169773 - DNA, 22 bp, Homo sapiens
tatgtgttttggatttagaatg

SEQ ID NO: 9169774 - DNA, 22 bp, Homo sapiens
tatgtgttgtatatgtgcagag

SEQ ID NO: 9169775 - DNA, 22 bp, Homo sapiens
tatgtgttgaatttgaacgtta

SEQ ID NO: 9169776 - DNA, 22 bp, Homo sapiens
tatgtgttatttggtatacatt

SEQ ID NO: 9169777 - DNA, 22 bp, Homo sapiens
tatgtttacgctggtagaatta

SEQ ID NO: 9169778 - DNA, 22 bp, Homo sapiens
tatgttgcaccaacctaataat

SEQ ID NO: 9169779 - DNA, 22 bp, Homo sapiens
tatgttgagtgaaagaagctag

SEQ ID NO: 9169780 - DNA, 22 bp, Homo sapiens
tatgtttatactttgatgtact

SEQ ID NO: 9169781 - DNA, 20 bp, Homo sapiens
tattcaactttaaaaactta

SEQ ID NO: 9169782 - DNA, 22 bp, Homo sapiens
tattcacatgtacatatgctca

SEQ ID NO: 9169783 - DNA, 22 bp, Homo sapiens
tattcacaggttctggggatca

SEQ ID NO: 9169784 - DNA, 17 bp, Homo sapiens
tattcagaggagtattt

SEQ ID NO: 9169785 - DNA, 17 bp, Homo sapiens
tattcagaggagtattt

SEQ ID NO: 9169786 - DNA, 22 bp, Homo sapiens
tattcagagggttgaattttta

SEQ ID NO: 9169787 - DNA, 22 bp, Homo sapiens
tattcagaaaataaattggatt

SEQ ID NO: 9169788 - DNA, 22 bp, Homo sapiens
tattcagaaaataaattggatt

SEQ ID NO: 9169789 - DNA, 22 bp, Homo sapiens
tattcaccagatcccatatctt

SEQ ID NO: 9169790 - DNA, 22 bp, Homo sapiens
tattcagagtgtagcaaataga

SEQ ID NO: 9169791 - DNA, 22 bp, Homo sapiens
tattcagagggttgaattttta

SEQ ID NO: 9169792 - DNA, 22 bp, Homo sapiens
tattgatatgcagaactgactt

SEQ ID NO: 9169793 - DNA, 22 bp, Homo sapiens
tattgataaaatgctcactatg

SEQ ID NO: 9169794 - DNA, 22 bp, Homo sapiens
tatcttgtgcagatgaaagaat

SEQ ID NO: 9169795 - DNA, 22 bp, Homo sapiens
tatcttgtaataggtccacttg

SEQ ID NO: 9169796 - DNA, 22 bp, Homo sapiens
tatctttagaggaagagaatct

SEQ ID NO: 9169797 - DNA, 22 bp, Homo sapiens
tatctttattatgtctatctgc

SEQ ID NO: 9169798 - DNA, 22 bp, Homo sapiens
tatctttattatgtctatctgc

SEQ ID NO: 9169799 - DNA, 22 bp, Homo sapiens
tatcttcacttatatctttctt

SEQ ID NO: 9169800 - DNA, 22 bp, Homo sapiens
tatctgtttgctcacaggtgtt

SEQ ID NO: 9169801 - DNA, 19 bp, Homo sapiens
tatctgtttcctgcttgtc

SEQ ID NO: 9169802 - DNA, 22 bp, Homo sapiens
tatctgttgtcttttacatgta

SEQ ID NO: 9169803 - DNA, 22 bp, Homo sapiens
tatctgttgtagtacagatgat

SEQ ID NO: 9169804 - DNA, 22 bp, Homo sapiens
tatctgttgtccatgcagaaag

SEQ ID NO: 9169805 - DNA, 22 bp, Homo sapiens
tatgcattatacattaatttct

SEQ ID NO: 9169806 - DNA, 22 bp, Homo sapiens
tatgccactgctctccatccta

SEQ ID NO: 9169807 - DNA, 22 bp, Homo sapiens
tatgccactgctctccatccta

SEQ ID NO: 9169808 - DNA, 22 bp, Homo sapiens
tatgcagagcatgactgtacca

SEQ ID NO: 9169809 - DNA, 22 bp, Homo sapiens
tatgcacattcacacaaaaatg

SEQ ID NO: 9169810 - DNA, 22 bp, Homo sapiens
tatatttgtgtgtgatttatga

SEQ ID NO: 9169811 - DNA, 18 bp, Homo sapiens
tatatttcacacatattc

SEQ ID NO: 9169812 - DNA, 22 bp, Homo sapiens
tatatttaatcctagagccatt

SEQ ID NO: 9169813 - DNA, 22 bp, Homo sapiens
tatatttaatcctagagccatt

SEQ ID NO: 9169814 - DNA, 22 bp, Homo sapiens
tatattttagacaccctcacgc

SEQ ID NO: 9169815 - DNA, 19 bp, Homo sapiens
tatatttgttgaataaaaa

SEQ ID NO: 9169816 - DNA, 19 bp, Homo sapiens
tatatttgttgaataaaaa

SEQ ID NO: 9169817 - DNA, 22 bp, Homo sapiens
tatcaatatctcagtgtgcttc

SEQ ID NO: 9169818 - DNA, 22 bp, Homo sapiens
tatcaatacatgttatcagtgt

SEQ ID NO: 9169819 - DNA, 22 bp, Homo sapiens
tatctataagtactaacatggt

SEQ ID NO: 9169820 - DNA, 17 bp, Homo sapiens
tatctgtgttcctggct

SEQ ID NO: 9169821 - DNA, 22 bp, Homo sapiens
tatctgttcaatggaagatgac

SEQ ID NO: 9169822 - DNA, 22 bp, Homo sapiens
tatctgttatgggctgaattgc

SEQ ID NO: 9169823 - DNA, 22 bp, Homo sapiens
tatctgttaggatcagagctgg

SEQ ID NO: 9169824 - DNA, 22 bp, Homo sapiens
tatctgttaggatcagagctgg

SEQ ID NO: 9169825 - DNA, 22 bp, Homo sapiens
tatctgttggctcctagttgta

SEQ ID NO: 9169826 - DNA, 22 bp, Homo sapiens
tatctgttccaggcactcagct

SEQ ID NO: 9169827 - DNA, 21 bp, Homo sapiens
tatacagaggggaacaggaga

SEQ ID NO: 9169828 - DNA, 22 bp, Homo sapiens
tagttaagaggccagtgtaata

SEQ ID NO: 9169829 - DNA, 22 bp, Homo sapiens
tagttaactcttggtaataggt

SEQ ID NO: 9169830 - DNA, 22 bp, Homo sapiens
tagttaaggccacttgcctaag

SEQ ID NO: 9169831 - DNA, 22 bp, Homo sapiens
tagttaatggaaatgatggaaa

SEQ ID NO: 9169832 - DNA, 22 bp, Homo sapiens
tagttaaagattctgttaagag

SEQ ID NO: 9169833 - DNA, 22 bp, Homo sapiens
tagttaaaataatggagatgtt

SEQ ID NO: 9169834 - DNA, 22 bp, Homo sapiens
tagttaactcttggtaataggt

SEQ ID NO: 9169835 - DNA, 22 bp, Homo sapiens
tagttaaagccctaaattgata

SEQ ID NO: 9169836 - DNA, 22 bp, Homo sapiens
tagttaaaataatggagatgtt

SEQ ID NO: 9169837 - DNA, 22 bp, Homo sapiens
tagtgtttgggaattgtagaga

SEQ ID NO: 9169838 - DNA, 22 bp, Homo sapiens
tagtgtttagtacatatgcata

SEQ ID NO: 9169839 - DNA, 22 bp, Homo sapiens
tagtgtctagtgagtttgatgc

SEQ ID NO: 9169840 - DNA, 22 bp, Homo sapiens
tagtgtcatttcagtggagttt

SEQ ID NO: 9169841 - DNA, 22 bp, Homo sapiens
tagtgtcatgaaaagtacacta

SEQ ID NO: 9169842 - DNA, 22 bp, Homo sapiens
tagtgtcatcgttgcagctgag

SEQ ID NO: 9169843 - DNA, 19 bp, Homo sapiens
tagtgtcaaggaggagggt

SEQ ID NO: 9169844 - DNA, 22 bp, Homo sapiens
tagtgtcaggagggaaatgcaa

SEQ ID NO: 9169845 - DNA, 22 bp, Homo sapiens
tagtgtatctgttcttttatct

SEQ ID NO: 9169846 - DNA, 22 bp, Homo sapiens
tagtgtcaaacagggattagaa

SEQ ID NO: 9169847 - DNA, 23 bp, Homo sapiens
tagtgtcaagagggagtgtaatt

SEQ ID NO: 9169848 - DNA, 22 bp, Homo sapiens
tagtgtatgttcagcttatatg

SEQ ID NO: 9169849 - DNA, 22 bp, Homo sapiens
tataccaaaatatcagaaaggg

SEQ ID NO: 9169850 - DNA, 22 bp, Homo sapiens
tatacatgttttacataagtga

SEQ ID NO: 9169851 - DNA, 22 bp, Homo sapiens
tatacatgttttacataagtga

SEQ ID NO: 9169852 - DNA, 22 bp, Homo sapiens
tatactattattgtcagtttat

SEQ ID NO: 9169853 - DNA, 22 bp, Homo sapiens
tatagaagtaagcattgtgatg

SEQ ID NO: 9169854 - DNA, 22 bp, Homo sapiens
tatagaagagacatgtgcatag

SEQ ID NO: 9169855 - DNA, 22 bp, Homo sapiens
tatactgatttgtctatactct

SEQ ID NO: 9169856 - DNA, 22 bp, Homo sapiens
tatactgtaggtgcagaaagaa

SEQ ID NO: 9169857 - DNA, 22 bp, Homo sapiens
tatactgtccctctgcactcca

SEQ ID NO: 9169858 - DNA, 22 bp, Homo sapiens
tatactgtccctctgcactcca

SEQ ID NO: 9169859 - DNA, 22 bp, Homo sapiens
tatactgtaggtgcagaaagaa

SEQ ID NO: 9169860 - DNA, 22 bp, Homo sapiens
tatactgtgttttcaccactgt

SEQ ID NO: 9169861 - DNA, 22 bp, Homo sapiens
tatactgtcgcattacactcac

SEQ ID NO: 9169862 - DNA, 22 bp, Homo sapiens
tatactgtcgcattacactcac

SEQ ID NO: 9169863 - DNA, 22 bp, Homo sapiens
tatactgtgttttcaccactgt

SEQ ID NO: 9169864 - DNA, 22 bp, Homo sapiens
tatactgagagcaaatacattc

SEQ ID NO: 9169865 - DNA, 22 bp, Homo sapiens
tatatgtagattgtaccaatgt

SEQ ID NO: 9169866 - DNA, 22 bp, Homo sapiens
tatatgtagtcagtcagagtaa

SEQ ID NO: 9169867 - DNA, 22 bp, Homo sapiens
tatatgtagtcagtcagagtaa

SEQ ID NO: 9169868 - DNA, 23 bp, Homo sapiens
tatatgtctgtatcttaggttgc

SEQ ID NO: 9169869 - DNA, 23 bp, Homo sapiens
tatatgtctgtatcttaggttgc

SEQ ID NO: 9169870 - DNA, 22 bp, Homo sapiens
tatatgtctgctactgtataaa

SEQ ID NO: 9169871 - DNA, 22 bp, Homo sapiens
tatatgcttgtgcatgtctttg

SEQ ID NO: 9169872 - DNA, 22 bp, Homo sapiens
tatatgcttgggaaatggtaga

SEQ ID NO: 9169873 - DNA, 22 bp, Homo sapiens
tatatgctaatggtgccattcc

SEQ ID NO: 9169874 - DNA, 22 bp, Homo sapiens
tatatgctctgggatcctgaaa

SEQ ID NO: 9169875 - DNA, 22 bp, Homo sapiens
tatagacaagcgtaacaagaag

SEQ ID NO: 9169876 - DNA, 22 bp, Homo sapiens
tatagaggccaccaacatgaaa

SEQ ID NO: 9169877 - DNA, 22 bp, Homo sapiens
tatagcaaaatagtttccacac

SEQ ID NO: 9169878 - DNA, 22 bp, Homo sapiens
tatagcaagctttgagctttca

SEQ ID NO: 9169879 - DNA, 22 bp, Homo sapiens
tatagcaagctctttgtaacca

SEQ ID NO: 9169880 - DNA, 22 bp, Homo sapiens
tatagcaaaatagtttccacac

SEQ ID NO: 9169881 - DNA, 22 bp, Homo sapiens
tatagcaaagtactaccaactc

SEQ ID NO: 9169882 - DNA, 22 bp, Homo sapiens
tatatgcaattttttagtgcaa

SEQ ID NO: 9169883 - DNA, 22 bp, Homo sapiens
tatattatcataaaaccattca

SEQ ID NO: 9169884 - DNA, 22 bp, Homo sapiens
tatattatcataaaaccattca

SEQ ID NO: 9169885 - DNA, 22 bp, Homo sapiens
tatattataagccctttcagaa

SEQ ID NO: 9169886 - DNA, 22 bp, Homo sapiens
tatattaaccatagggttctag

SEQ ID NO: 9169887 - DNA, 22 bp, Homo sapiens
tatattaacacccacttgcctc

SEQ ID NO: 9169888 - DNA, 22 bp, Homo sapiens
tatattaacttgtgatcctgga

SEQ ID NO: 9169889 - DNA, 22 bp, Homo sapiens
tatattaaaccctctctgtagg

SEQ ID NO: 9169890 - DNA, 22 bp, Homo sapiens
tatattaaaccctctctgtagg

SEQ ID NO: 9169891 - DNA, 22 bp, Homo sapiens
tatatgtttcttacaaaatatt

SEQ ID NO: 9169892 - DNA, 22 bp, Homo sapiens
tatatgttgatactaattctgg

SEQ ID NO: 9169893 - DNA, 20 bp, Homo sapiens
tatatgtgtacatacacaca

SEQ ID NO: 9169894 - DNA, 22 bp, Homo sapiens
tatattaaagtgctttgcagtg

SEQ ID NO: 9169895 - DNA, 22 bp, Homo sapiens
tatattaaagtgctttgcagtg

SEQ ID NO: 9169896 - DNA, 22 bp, Homo sapiens
tatattaaatgaccagttttaa

SEQ ID NO: 9169897 - DNA, 22 bp, Homo sapiens
tatattaaatgaccagttttaa

SEQ ID NO: 9169898 - DNA, 22 bp, Homo sapiens
tatattaaatgaccagttttaa

SEQ ID NO: 9169899 - DNA, 22 bp, Homo sapiens
ttcagtttcagtcttgcaaaaa

SEQ ID NO: 9169900 - DNA, 22 bp, Homo sapiens
ttcagtttccacttacatttaa

SEQ ID NO: 9169901 - DNA, 22 bp, Homo sapiens
ttcagtttccacttacatttaa

SEQ ID NO: 9169902 - DNA, 22 bp, Homo sapiens
ttcagtttccacttacatttaa

SEQ ID NO: 9169903 - DNA, 22 bp, Homo sapiens
ttcagtttcaaatcctgtgaag

SEQ ID NO: 9169904 - DNA, 23 bp, Homo sapiens
ttcagggcctcagaggtgaagct

SEQ ID NO: 9169905 - DNA, 20 bp, Homo sapiens
cgcagcagtggaagtggaat

SEQ ID NO: 9169906 - DNA, 22 bp, Homo sapiens
cgcagcagccccgtggtaggtg

SEQ ID NO: 9169907 - DNA, 22 bp, Homo sapiens
ttcagtttcttccctgtgaaat

SEQ ID NO: 9169908 - DNA, 18 bp, Homo sapiens
ttcagtttctagttcctt

SEQ ID NO: 9169909 - DNA, 18 bp, Homo sapiens
ttcagtttctagttcctt

SEQ ID NO: 9169910 - DNA, 21 bp, Homo sapiens
ttcagtttcttcctcatctat

SEQ ID NO: 9169911 - DNA, 21 bp, Homo sapiens
ttcagtttcttcctcatctat

SEQ ID NO: 9169912 - DNA, 22 bp, Homo sapiens
ttcagtttgaattctgtagaac

SEQ ID NO: 9169913 - DNA, 22 bp, Homo sapiens
ttcagtttgaattctgtagaac

SEQ ID NO: 9169914 - DNA, 22 bp, Homo sapiens
ttcagtttcgttatctatgaga

SEQ ID NO: 9169915 - DNA, 22 bp, Homo sapiens
ttcagtttctaaagatgttcct

SEQ ID NO: 9169916 - DNA, 22 bp, Homo sapiens
ttcagtttctaaagatgttcct

SEQ ID NO: 9169917 - DNA, 22 bp, Homo sapiens
ttcagtttcgttatctatgaga

SEQ ID NO: 9169918 - DNA, 22 bp, Homo sapiens
ttcagtttctaaagatgttcct

SEQ ID NO: 9169919 - DNA, 22 bp, Homo sapiens
ttcagtttccctaaagccaatt

SEQ ID NO: 9169920 - DNA, 22 bp, Homo sapiens
ttcagtttcgttatctatgaga

SEQ ID NO: 9169921 - DNA, 19 bp, Homo sapiens
ttcagtttcctcatctgga

SEQ ID NO: 9169922 - DNA, 19 bp, Homo sapiens
ttcagtttcctcatctgga

SEQ ID NO: 9169923 - DNA, 21 bp, Homo sapiens
cgggaaggaggttctgaccct

SEQ ID NO: 9169924 - DNA, 22 bp, Homo sapiens
cgggaaagttccacagatggat

SEQ ID NO: 9169925 - DNA, 22 bp, Homo sapiens
ttccaaattaaaatgtacaatg

SEQ ID NO: 9169926 - DNA, 19 bp, Homo sapiens
ttccaccatcactctgttt

SEQ ID NO: 9169927 - DNA, 22 bp, Homo sapiens
ttccaccaggagatatttcaaa

SEQ ID NO: 9169928 - DNA, 19 bp, Homo sapiens
ttccaccatcactctgttt

SEQ ID NO: 9169929 - DNA, 22 bp, Homo sapiens
ttccacattccttacattcata

SEQ ID NO: 9169930 - DNA, 22 bp, Homo sapiens
ttccaccaggagatatttcaaa

SEQ ID NO: 9169931 - DNA, 22 bp, Homo sapiens
ttccaccaattctcctccaagg

SEQ ID NO: 9169932 - DNA, 22 bp, Homo sapiens
ttccacggtggcaaaggctgga

SEQ ID NO: 9169933 - DNA, 22 bp, Homo sapiens
ttccactcatgcaaaggtccca

SEQ ID NO: 9169934 - DNA, 22 bp, Homo sapiens
ttccactctactctggccagtc

SEQ ID NO: 9169935 - DNA, 22 bp, Homo sapiens
ttccactctacacactgctggc

SEQ ID NO: 9169936 - DNA, 22 bp, Homo sapiens
ttccactcctcctggtggggtg

SEQ ID NO: 9169937 - DNA, 22 bp, Homo sapiens
cggctggtgtcgggcacagcaa

SEQ ID NO: 9169938 - DNA, 22 bp, Homo sapiens
cggctgggtagaggtgccgggt

SEQ ID NO: 9169939 - DNA, 22 bp, Homo sapiens
cggctgggtagaggtgccgggt

SEQ ID NO: 9169940 - DNA, 22 bp, Homo sapiens
cggctggtgtcgggcacagcaa

SEQ ID NO: 9169941 - DNA, 22 bp, Homo sapiens
cggctgggttcggctgcaggcc

SEQ ID NO: 9169942 - DNA, 22 bp, Homo sapiens
cgtcatcacggcaagcatctcc

SEQ ID NO: 9169943 - DNA, 22 bp, Homo sapiens
cgtcatcacggcaagcatctcc

SEQ ID NO: 9169944 - DNA, 22 bp, Homo sapiens
cgtccagggcgggctcccctca

SEQ ID NO: 9169945 - DNA, 22 bp, Homo sapiens
cgtccaggaagatcggccgatg

SEQ ID NO: 9169946 - DNA, 19 bp, Homo sapiens
cgtccaggtgctggaagat

SEQ ID NO: 9169947 - DNA, 22 bp, Homo sapiens
cgtctctccgcaggggccttca

SEQ ID NO: 9169948 - DNA, 22 bp, Homo sapiens
cgtcctttgaattgaggtcttt

SEQ ID NO: 9169949 - DNA, 22 bp, Homo sapiens
ttccagaaaacgctttatttag

SEQ ID NO: 9169950 - DNA, 22 bp, Homo sapiens
ttccagaaaacgctttatttag

SEQ ID NO: 9169951 - DNA, 22 bp, Homo sapiens
ttccagaaaactctgcctggta

SEQ ID NO: 9169952 - DNA, 22 bp, Homo sapiens
ttccagaaacctgaaagtttct

SEQ ID NO: 9169953 - DNA, 21 bp, Homo sapiens
ttccagaaatctctttcttca

SEQ ID NO: 9169954 - DNA, 21 bp, Homo sapiens
ttccagaaatctctttcttca

SEQ ID NO: 9169955 - DNA, 22 bp, Homo sapiens
ttccactcttctctggacttat

SEQ ID NO: 9169956 - DNA, 22 bp, Homo sapiens
ttccactctgtcccctgtggga

SEQ ID NO: 9169957 - DNA, 22 bp, Homo sapiens
ttccactctccagtcaatttca

SEQ ID NO: 9169958 - DNA, 22 bp, Homo sapiens
ttccactctatgatagaagggt

SEQ ID NO: 9169959 - DNA, 22 bp, Homo sapiens
ttccactctccagtcaatttca

SEQ ID NO: 9169960 - DNA, 22 bp, Homo sapiens
ttccactttgggtctgtgcagg

SEQ ID NO: 9169961 - DNA, 22 bp, Homo sapiens
ttcctccagcctggagcacttc

SEQ ID NO: 9169962 - DNA, 22 bp, Homo sapiens
cgtctggcttctccacggtaaa

SEQ ID NO: 9169963 - DNA, 22 bp, Homo sapiens
cgtctggacgggaaggagaagt

SEQ ID NO: 9169964 - DNA, 22 bp, Homo sapiens
ttcctctgaaatggcttggaaa

SEQ ID NO: 9169965 - DNA, 21 bp, Homo sapiens
ttcctctgcaactgatgctca

SEQ ID NO: 9169966 - DNA, 21 bp, Homo sapiens
ttcctctgcaactgatgctca

SEQ ID NO: 9169967 - DNA, 22 bp, Homo sapiens
ttcctctcaacatgcctgccgg

SEQ ID NO: 9169968 - DNA, 22 bp, Homo sapiens
ttcctctcaacatgcctgccgg

SEQ ID NO: 9169969 - DNA, 22 bp, Homo sapiens
ttcctccttcccattcctgggg

SEQ ID NO: 9169970 - DNA, 22 bp, Homo sapiens
ctagtttaaagcagctgaaagg

SEQ ID NO: 9169971 - DNA, 22 bp, Homo sapiens
ctagttctagatccctgaggaa

SEQ ID NO: 9169972 - DNA, 22 bp, Homo sapiens
ctagtggaaactaactggaatt

SEQ ID NO: 9169973 - DNA, 18 bp, Homo sapiens
ctagggctgtggctctca

SEQ ID NO: 9169974 - DNA, 22 bp, Homo sapiens
ctagggctcgcaagggctggag

SEQ ID NO: 9169975 - DNA, 22 bp, Homo sapiens
ttctccttgaaaagctgcatct

SEQ ID NO: 9169976 - DNA, 22 bp, Homo sapiens
ttctcctttcattccctgtaga

SEQ ID NO: 9169977 - DNA, 22 bp, Homo sapiens
ttctccttattcatagttgtct

SEQ ID NO: 9169978 - DNA, 22 bp, Homo sapiens
ttctccttcctggttttcaggc

SEQ ID NO: 9169979 - DNA, 21 bp, Homo sapiens
ttctcctgttttgcaccacag

SEQ ID NO: 9169980 - DNA, 21 bp, Homo sapiens
ttctcctgttttgcaccacag

SEQ ID NO: 9169981 - DNA, 22 bp, Homo sapiens
ttctcctgcccttggacttcca

SEQ ID NO: 9169982 - DNA, 22 bp, Homo sapiens
ttctcctgcgcaggcccaggga

SEQ ID NO: 9169983 - DNA, 19 bp, Homo sapiens
ttctcattcctttccactt

SEQ ID NO: 9169984 - DNA, 22 bp, Homo sapiens
ttctcattctgactcagtgtag

SEQ ID NO: 9169985 - DNA, 20 bp, Homo sapiens
ttctccaaaggagacactag

SEQ ID NO: 9169986 - DNA, 22 bp, Homo sapiens
ttctcaggtgaggctgaggctg

SEQ ID NO: 9169987 - DNA, 22 bp, Homo sapiens
ttctcaggtgaggctgaggctg

SEQ ID NO: 9169988 - DNA, 22 bp, Homo sapiens
ttctcagtttcactgataacag

SEQ ID NO: 9169989 - DNA, 22 bp, Homo sapiens
ctacattaaattggcttactta

SEQ ID NO: 9169990 - DNA, 22 bp, Homo sapiens
ctacattaaattggcttactta

SEQ ID NO: 9169991 - DNA, 22 bp, Homo sapiens
ctacattaaattggcttactta

SEQ ID NO: 9169992 - DNA, 22 bp, Homo sapiens
ctacatgtaggtttccttaatt

SEQ ID NO: 9169993 - DNA, 15 bp, Homo sapiens
ctacatgctggagca

SEQ ID NO: 9169994 - DNA, 22 bp, Homo sapiens
ctacataaatatttatgtgtct

SEQ ID NO: 9169995 - DNA, 22 bp, Homo sapiens
ctacataaatttatcacagact

SEQ ID NO: 9169996 - DNA, 22 bp, Homo sapiens
ttctacatcacttaacatgcta

SEQ ID NO: 9169997 - DNA, 22 bp, Homo sapiens
ctacagtgacagaattaaacag

SEQ ID NO: 9169998 - DNA, 22 bp, Homo sapiens
ttccttttgcaaggtcctctag

SEQ ID NO: 9169999 - DNA, 22 bp, Homo sapiens
ttctacagactataactgtgat

SEQ ID NO: 9170000 - DNA, 22 bp, Homo sapiens
ctaaatgtcatggagttgtaga

SEQ ID NO: 9170001 - DNA, 22 bp, Homo sapiens
ctaaatgtcatggagttgtaga

SEQ ID NO: 9170002 - DNA, 22 bp, Homo sapiens
ctaaatgtcagagtagcttgca

SEQ ID NO: 9170003 - DNA, 22 bp, Homo sapiens
ctaaatgtcagagtagcttgca

SEQ ID NO: 9170004 - DNA, 22 bp, Homo sapiens
ctaaattatcatgagaattatg

SEQ ID NO: 9170005 - DNA, 22 bp, Homo sapiens
ctaaatgttttatcttcctggc

SEQ ID NO: 9170006 - DNA, 22 bp, Homo sapiens
ctaaatgtgctaatagcatgaa

SEQ ID NO: 9170007 - DNA, 22 bp, Homo sapiens
ctaaattatttgcacattagag

SEQ ID NO: 9170008 - DNA, 22 bp, Homo sapiens
ctaaattatcatgagaattatg

SEQ ID NO: 9170009 - DNA, 22 bp, Homo sapiens
ctaacatttggaaggcttatga

SEQ ID NO: 9170010 - DNA, 22 bp, Homo sapiens
ctaacatttattgagcacttag

SEQ ID NO: 9170011 - DNA, 22 bp, Homo sapiens
ctaacatttattgagcacttag

SEQ ID NO: 9170012 - DNA, 22 bp, Homo sapiens
ttcttaagactgcaaatcaacc

SEQ ID NO: 9170013 - DNA, 22 bp, Homo sapiens
ttcttaagtatgatcttaacgg

SEQ ID NO: 9170014 - DNA, 22 bp, Homo sapiens
ttcttaagcgtatgataatgaa

SEQ ID NO: 9170015 - DNA, 22 bp, Homo sapiens
ttcttaagcacctaaaaagtgg

SEQ ID NO: 9170016 - DNA, 22 bp, Homo sapiens
ttcttaaagaggcaaaacacag

SEQ ID NO: 9170017 - DNA, 20 bp, Homo sapiens
ttcttaaagacctcactttg

SEQ ID NO: 9170018 - DNA, 22 bp, Homo sapiens
ttcttaagtttagcaacttgtg

SEQ ID NO: 9170019 - DNA, 21 bp, Homo sapiens
ttcttcaggccaatgctcatt

SEQ ID NO: 9170020 - DNA, 22 bp, Homo sapiens
ttctgaaaattgggtcatactt

SEQ ID NO: 9170021 - DNA, 22 bp, Homo sapiens
ttctgaaaattgggtcatactt

SEQ ID NO: 9170022 - DNA, 23 bp, Homo sapiens
ttctgaaaatagatagtggctcc

SEQ ID NO: 9170023 - DNA, 22 bp, Homo sapiens
ttctgaaaacacactttgcagc

SEQ ID NO: 9170024 - DNA, 22 bp, Homo sapiens
ttctgaaaccactgaccaacta

SEQ ID NO: 9170025 - DNA, 22 bp, Homo sapiens
ttctgaaaccttcagtatgaag

SEQ ID NO: 9170026 - DNA, 22 bp, Homo sapiens
ttctgaaaccttcagtatgaag

SEQ ID NO: 9170027 - DNA, 20 bp, Homo sapiens
ttctgaaagcagcagaggga

SEQ ID NO: 9170028 - DNA, 22 bp, Homo sapiens
ttctctttttgcatctcaacct

SEQ ID NO: 9170029 - DNA, 22 bp, Homo sapiens
ttctctttttgcatctcaacct

SEQ ID NO: 9170030 - DNA, 22 bp, Homo sapiens
ttctgaaaacacactttgcagc

SEQ ID NO: 9170031 - DNA, 22 bp, Homo sapiens
ctataaatctacccagcattgg

SEQ ID NO: 9170032 - DNA, 22 bp, Homo sapiens
ttctcttttgtgatgtgagatg

SEQ ID NO: 9170033 - DNA, 22 bp, Homo sapiens
ttctcttttgtgatgtgagatg

SEQ ID NO: 9170034 - DNA, 22 bp, Homo sapiens
ttctgaaataggagatagctgt

SEQ ID NO: 9170035 - DNA, 22 bp, Homo sapiens
ttctgaaagtctttttaagtta

SEQ ID NO: 9170036 - DNA, 22 bp, Homo sapiens
ttctgaaataggagatagctgt

SEQ ID NO: 9170037 - DNA, 22 bp, Homo sapiens
ttctgaaatgagatataaggta

SEQ ID NO: 9170038 - DNA, 22 bp, Homo sapiens
ttctgaaaggcatgtcaggtag

SEQ ID NO: 9170039 - DNA, 22 bp, Homo sapiens
ttctgaaagccaattcattgaa

SEQ ID NO: 9170040 - DNA, 22 bp, Homo sapiens
ttctgaaaggcaggttgtttgc

SEQ ID NO: 9170041 - DNA, 22 bp, Homo sapiens
ttctgtctccctgatgtagagc

SEQ ID NO: 9170042 - DNA, 22 bp, Homo sapiens
ttctgaaatttctgtagatctt

SEQ ID NO: 9170043 - DNA, 22 bp, Homo sapiens
ttctgaaatttctgtagatctt

SEQ ID NO: 9170044 - DNA, 22 bp, Homo sapiens
ttctgaaccattgagcactgcc

SEQ ID NO: 9170045 - DNA, 22 bp, Homo sapiens
ttctgaaatttcaactttacta

SEQ ID NO: 9170046 - DNA, 22 bp, Homo sapiens
ttctgaaattcgactatccaat

SEQ ID NO: 9170047 - DNA, 22 bp, Homo sapiens
ttcttcatgctgttgctgcttg

SEQ ID NO: 9170048 - DNA, 23 bp, Homo sapiens
ttcttccaaggtgctttgtggtt

SEQ ID NO: 9170049 - DNA, 22 bp, Homo sapiens
ttcttcatctgtaagataagca

SEQ ID NO: 9170050 - DNA, 22 bp, Homo sapiens
ttcttcagtttggtaaatgtaa

SEQ ID NO: 9170051 - DNA, 22 bp, Homo sapiens
ttgaaatatcaagttattagtg

SEQ ID NO: 9170052 - DNA, 22 bp, Homo sapiens
ttgaaatatggattgaccttga

SEQ ID NO: 9170053 - DNA, 22 bp, Homo sapiens
ttgaaatatcaagttattagtg

SEQ ID NO: 9170054 - DNA, 23 bp, Homo sapiens
ttgaagttctgctgtgttatagg

SEQ ID NO: 9170055 - DNA, 18 bp, Homo sapiens
ttgaagttatttacattc

SEQ ID NO: 9170056 - DNA, 22 bp, Homo sapiens
ttgaagtcagagttttcaagca

SEQ ID NO: 9170057 - DNA, 16 bp, Homo sapiens
ttgaatactcatagca

SEQ ID NO: 9170058 - DNA, 22 bp, Homo sapiens
ttgaatactcagaaaatgacat

SEQ ID NO: 9170059 - DNA, 22 bp, Homo sapiens
ttgaatactcagaaaatgacat

SEQ ID NO: 9170060 - DNA, 22 bp, Homo sapiens
ttgaatacaagtagagaagaca

SEQ ID NO: 9170061 - DNA, 22 bp, Homo sapiens
ttgaataattaattacactcag

SEQ ID NO: 9170062 - DNA, 22 bp, Homo sapiens
ttgaataatatgttcaggagga

SEQ ID NO: 9170063 - DNA, 22 bp, Homo sapiens
ttgaagttgtagttcagtgaag

SEQ ID NO: 9170064 - DNA, 22 bp, Homo sapiens
ttgaatctcatcccaatgttgt

SEQ ID NO: 9170065 - DNA, 19 bp, Homo sapiens
ttgaatatgcaaactgaag

SEQ ID NO: 9170066 - DNA, 22 bp, Homo sapiens
ctcactgtgacctcagcagaca

SEQ ID NO: 9170067 - DNA, 22 bp, Homo sapiens
ctcagcatggagggagaacaag

SEQ ID NO: 9170068 - DNA, 22 bp, Homo sapiens
ctcagccatggggtggatcagc

SEQ ID NO: 9170069 - DNA, 22 bp, Homo sapiens
ctcagccatgcaacatgctggg

SEQ ID NO: 9170070 - DNA, 22 bp, Homo sapiens
ctcagccccaattctccccatt

SEQ ID NO: 9170071 - DNA, 22 bp, Homo sapiens
ctcagcccagctcaggtctttc

SEQ ID NO: 9170072 - DNA, 22 bp, Homo sapiens
ctcagcccagcccaggaccagg

SEQ ID NO: 9170073 - DNA, 22 bp, Homo sapiens
ctcaggagtagttcagcagctg

SEQ ID NO: 9170074 - DNA, 22 bp, Homo sapiens
ctcaggccaataagctccagcc

SEQ ID NO: 9170075 - DNA, 22 bp, Homo sapiens
ctcaggccaataagctccagcc

SEQ ID NO: 9170076 - DNA, 22 bp, Homo sapiens
ctcaggccattcttccagctgc

SEQ ID NO: 9170077 - DNA, 22 bp, Homo sapiens
ctcaggcccacagcagacccac

SEQ ID NO: 9170078 - DNA, 23 bp, Homo sapiens
ttgcaaaatgcaattgagttaga

SEQ ID NO: 9170079 - DNA, 22 bp, Homo sapiens
ctcagcagtgacaagagagtat

SEQ ID NO: 9170080 - DNA, 22 bp, Homo sapiens
ctcagcagtgacaagagagtat

SEQ ID NO: 9170081 - DNA, 22 bp, Homo sapiens
ctcagcagtatactctgaagat

SEQ ID NO: 9170082 - DNA, 23 bp, Homo sapiens
ttgcaaaatgagtcttgagtgaa

SEQ ID NO: 9170083 - DNA, 23 bp, Homo sapiens
ttgcaaaatgagtcttgagtgaa

SEQ ID NO: 9170084 - DNA, 22 bp, Homo sapiens
ttgcaaaatcatttctcaggat

SEQ ID NO: 9170085 - DNA, 22 bp, Homo sapiens
ttgcaaaagccgaggcactcca

SEQ ID NO: 9170086 - DNA, 22 bp, Homo sapiens
ttgcaaaagcaattgcagtttt

SEQ ID NO: 9170087 - DNA, 22 bp, Homo sapiens
ttgcaaaagcaattgcagtttt

SEQ ID NO: 9170088 - DNA, 22 bp, Homo sapiens
ttgcaaaaactgcaattacttt

SEQ ID NO: 9170089 - DNA, 22 bp, Homo sapiens
ttgcaaaaactgcaattacttt

SEQ ID NO: 9170090 - DNA, 22 bp, Homo sapiens
ttgcaaaaccatcctaagtaaa

SEQ ID NO: 9170091 - DNA, 22 bp, Homo sapiens
ttgcaaaaaccacaattacttt

SEQ ID NO: 9170092 - DNA, 22 bp, Homo sapiens
ttgcaaaaactgcaattacttt

SEQ ID NO: 9170093 - DNA, 22 bp, Homo sapiens
ttgcaaaaaccacaattacttt

SEQ ID NO: 9170094 - DNA, 22 bp, Homo sapiens
ttgcaaaaaccacaattacttt

SEQ ID NO: 9170095 - DNA, 22 bp, Homo sapiens
ttgatcaaatcagctactgagg

SEQ ID NO: 9170096 - DNA, 22 bp, Homo sapiens
ttgatttttccagcttctagag

SEQ ID NO: 9170097 - DNA, 22 bp, Homo sapiens
ctcagaaacggagctgccattt

SEQ ID NO: 9170098 - DNA, 22 bp, Homo sapiens
ttgatattctgagaagctgaag

SEQ ID NO: 9170099 - DNA, 22 bp, Homo sapiens
ttgcccttggctgaaggcactg

SEQ ID NO: 9170100 - DNA, 16 bp, Homo sapiens
ttgccgcacaggtcgc

SEQ ID NO: 9170101 - DNA, 22 bp, Homo sapiens
ttgccgccgtctgctcgccccg

SEQ ID NO: 9170102 - DNA, 22 bp, Homo sapiens
ttgcactccagcccgagcaaca

SEQ ID NO: 9170103 - DNA, 22 bp, Homo sapiens
ttgcactccagcccgagcaaca

SEQ ID NO: 9170104 - DNA, 22 bp, Homo sapiens
ttgcacttaaggtaggtgtgaa

SEQ ID NO: 9170105 - DNA, 22 bp, Homo sapiens
ttgcacttaaggtaggtgtgaa

SEQ ID NO: 9170106 - DNA, 22 bp, Homo sapiens
ttgcactcaccacatttcaggt

SEQ ID NO: 9170107 - DNA, 22 bp, Homo sapiens
ttgcacagatgagggtgatgct

SEQ ID NO: 9170108 - DNA, 22 bp, Homo sapiens
ttgcacaggcagtaattgcttg

SEQ ID NO: 9170109 - DNA, 22 bp, Homo sapiens
ctcaggcctgagtggcagtccc

SEQ ID NO: 9170110 - DNA, 22 bp, Homo sapiens
ctcaggctaagaaggccaagtg

SEQ ID NO: 9170111 - DNA, 22 bp, Homo sapiens
ttgctgggtcagaagccaggag

SEQ ID NO: 9170112 - DNA, 22 bp, Homo sapiens
ttgctgtaagtatctttctacc

SEQ ID NO: 9170113 - DNA, 22 bp, Homo sapiens
ttgctgtagctcatttcactct

SEQ ID NO: 9170114 - DNA, 22 bp, Homo sapiens
ttgctgtaggctgattgctgaa

SEQ ID NO: 9170115 - DNA, 22 bp, Homo sapiens
ttgctgtagtgttctgatgtca

SEQ ID NO: 9170116 - DNA, 22 bp, Homo sapiens
ttgctgatctgtgaatcagcca

SEQ ID NO: 9170117 - DNA, 22 bp, Homo sapiens
ttgctgatgagtcattggttta

SEQ ID NO: 9170118 - DNA, 22 bp, Homo sapiens
ttgctgatctgaaacgttactg

SEQ ID NO: 9170119 - DNA, 22 bp, Homo sapiens
ttgctgattcatgatttgagaa

SEQ ID NO: 9170120 - DNA, 22 bp, Homo sapiens
ttgctgatggtattatgctagt

SEQ ID NO: 9170121 - DNA, 22 bp, Homo sapiens
ttgctgataccatgaatgttaa

SEQ ID NO: 9170122 - DNA, 22 bp, Homo sapiens
ttgctgataccatgaatgttaa

SEQ ID NO: 9170123 - DNA, 22 bp, Homo sapiens
ttgctgagtgaccaataaatat

SEQ ID NO: 9170124 - DNA, 22 bp, Homo sapiens
ttgctgatttgtttctattcca

SEQ ID NO: 9170125 - DNA, 22 bp, Homo sapiens
ttgctgatttgtttctattcca

SEQ ID NO: 9170126 - DNA, 22 bp, Homo sapiens
ttgctgccagcgccctgcaggg

SEQ ID NO: 9170127 - DNA, 22 bp, Homo sapiens
ttgctgattgtagcatgatgat

SEQ ID NO: 9170128 - DNA, 22 bp, Homo sapiens
ttgctgattctgtatttaaggt

SEQ ID NO: 9170129 - DNA, 22 bp, Homo sapiens
ttgctgatttccccttgagtgt

SEQ ID NO: 9170130 - DNA, 22 bp, Homo sapiens
ttgctgcctttgtactctgatg

SEQ ID NO: 9170131 - DNA, 22 bp, Homo sapiens
ttgctgcctgaggagcaacact

SEQ ID NO: 9170132 - DNA, 22 bp, Homo sapiens
ttaaaatagccagtgcccctct

SEQ ID NO: 9170133 - DNA, 22 bp, Homo sapiens
ttaaaatagccagtgcccctct

SEQ ID NO: 9170134 - DNA, 22 bp, Homo sapiens
ttaaaatagccagtgcccctct

SEQ ID NO: 9170135 - DNA, 22 bp, Homo sapiens
ttaaaatagccagtgcccctct

SEQ ID NO: 9170136 - DNA, 22 bp, Homo sapiens
ttaaaatgaatattgattagca

SEQ ID NO: 9170137 - DNA, 22 bp, Homo sapiens
ttaaaatgaatattgattagca

SEQ ID NO: 9170138 - DNA, 22 bp, Homo sapiens
ttaaaatgcagattatgactca

SEQ ID NO: 9170139 - DNA, 22 bp, Homo sapiens
ttaaaagagcagcccagcatat

SEQ ID NO: 9170140 - DNA, 22 bp, Homo sapiens
ttaaaagagcagcccagcatat

SEQ ID NO: 9170141 - DNA, 22 bp, Homo sapiens
ttaaaatagccagtgcccctct

SEQ ID NO: 9170142 - DNA, 22 bp, Homo sapiens
ttaaaatagccagtgcccctct

SEQ ID NO: 9170143 - DNA, 22 bp, Homo sapiens
ttaatagatttgattttaaagg

SEQ ID NO: 9170144 - DNA, 22 bp, Homo sapiens
ttaatactataatttgaagtac

SEQ ID NO: 9170145 - DNA, 22 bp, Homo sapiens
ttaatagatatgcctctagagt

SEQ ID NO: 9170146 - DNA, 22 bp, Homo sapiens
ttaatatacaattttacgggct

SEQ ID NO: 9170147 - DNA, 22 bp, Homo sapiens
ttaatatgctgcttcttgaaaa

SEQ ID NO: 9170148 - DNA, 22 bp, Homo sapiens
ttaatatgttgaaatttattag

SEQ ID NO: 9170149 - DNA, 19 bp, Homo sapiens
ttaagctaagatactagta

SEQ ID NO: 9170150 - DNA, 22 bp, Homo sapiens
ttaagcttcagaacgcaatgat

SEQ ID NO: 9170151 - DNA, 22 bp, Homo sapiens
cctgtacatggccatctttacc

SEQ ID NO: 9170152 - DNA, 22 bp, Homo sapiens
cctgtactagggtctcattgcc

SEQ ID NO: 9170153 - DNA, 22 bp, Homo sapiens
cctgtattaggtagacaactat

SEQ ID NO: 9170154 - DNA, 22 bp, Homo sapiens
cctgtggagctttcagcagctc

SEQ ID NO: 9170155 - DNA, 22 bp, Homo sapiens
cctgtggaggctgctcagctgg

SEQ ID NO: 9170156 - DNA, 20 bp, Homo sapiens
cctgtggagctgcctcctcc

SEQ ID NO: 9170157 - DNA, 21 bp, Homo sapiens
cctgtggattttaaaattgga

SEQ ID NO: 9170158 - DNA, 22 bp, Homo sapiens
cctgtggagttcccatctgaat

SEQ ID NO: 9170159 - DNA, 22 bp, Homo sapiens
cctgtgcttggccagagaggtt

SEQ ID NO: 9170160 - DNA, 20 bp, Homo sapiens
cctgtggagctgcctcctcc

SEQ ID NO: 9170161 - DNA, 22 bp, Homo sapiens
cctgtggaatagaatcttccct

SEQ ID NO: 9170162 - DNA, 22 bp, Homo sapiens
ttaatccatggcagttattaaa

SEQ ID NO: 9170163 - DNA, 22 bp, Homo sapiens
ttaatcctcacaacaactttat

SEQ ID NO: 9170164 - DNA, 22 bp, Homo sapiens
ttaatccggggtgaatttaatt

SEQ ID NO: 9170165 - DNA, 22 bp, Homo sapiens
ttaatctcttagcaaattaatg

SEQ ID NO: 9170166 - DNA, 22 bp, Homo sapiens
ttaatgatgaagtctggctgta

SEQ ID NO: 9170167 - DNA, 22 bp, Homo sapiens
ttaatgaatatgacaggagagg

SEQ ID NO: 9170168 - DNA, 22 bp, Homo sapiens
ttacaaagcgttgagacaagta

SEQ ID NO: 9170169 - DNA, 22 bp, Homo sapiens
ttacaagtatttaagatgctgt

SEQ ID NO: 9170170 - DNA, 22 bp, Homo sapiens
cctgtggcgggggccagtgcct

SEQ ID NO: 9170171 - DNA, 22 bp, Homo sapiens
cctgtggcgggggccagtgcct

SEQ ID NO: 9170172 - DNA, 22 bp, Homo sapiens
cctgtggcgggggccagtgcct

SEQ ID NO: 9170173 - DNA, 22 bp, Homo sapiens
ttacaatagttccttcttttgt

SEQ ID NO: 9170174 - DNA, 20 bp, Homo sapiens
ttacaagtttctaataacca

SEQ ID NO: 9170175 - DNA, 22 bp, Homo sapiens
ttacaagtgtcaggtactggca

SEQ ID NO: 9170176 - DNA, 22 bp, Homo sapiens
tgttttcatttgatgtaacaaa

SEQ ID NO: 9170177 - DNA, 22 bp, Homo sapiens
tgttttcatcacagaatgtaac

SEQ ID NO: 9170178 - DNA, 22 bp, Homo sapiens
tgttttcagtcatatagcaggt

SEQ ID NO: 9170179 - DNA, 22 bp, Homo sapiens
tgtttcttctcacacaaactca

SEQ ID NO: 9170180 - DNA, 22 bp, Homo sapiens
tgtttcttctcacacaaactca

SEQ ID NO: 9170181 - DNA, 22 bp, Homo sapiens
tgtttcttctcacacaaactca

SEQ ID NO: 9170182 - DNA, 20 bp, Homo sapiens
tgtttctgacggtaggagag

SEQ ID NO: 9170183 - DNA, 22 bp, Homo sapiens
tgtttctgtctgttttctacat

SEQ ID NO: 9170184 - DNA, 22 bp, Homo sapiens
tgtttcttatccaagtggtctg

SEQ ID NO: 9170185 - DNA, 23 bp, Homo sapiens
tgtttctagaatcattgatgtct

SEQ ID NO: 9170186 - DNA, 22 bp, Homo sapiens
tgtttctataacctctgaagca

SEQ ID NO: 9170187 - DNA, 22 bp, Homo sapiens
tgtttataatatgcagtgagca

SEQ ID NO: 9170188 - DNA, 22 bp, Homo sapiens
cctggggctcaagatggcgccg

SEQ ID NO: 9170189 - DNA, 22 bp, Homo sapiens
cctggggccccgagccagaagc

SEQ ID NO: 9170190 - DNA, 22 bp, Homo sapiens
cctggggccccgagccagaagc

SEQ ID NO: 9170191 - DNA, 22 bp, Homo sapiens
cctggggccccgagccagaagc

SEQ ID NO: 9170192 - DNA, 22 bp, Homo sapiens
cctggggccccgagccagaagc

SEQ ID NO: 9170193 - DNA, 23 bp, Homo sapiens
cctggggcacttgagtcctcatc

SEQ ID NO: 9170194 - DNA, 23 bp, Homo sapiens
cctggggcacttgagtcctcatc

SEQ ID NO: 9170195 - DNA, 23 bp, Homo sapiens
cctggggcacttgagtcctcatc

SEQ ID NO: 9170196 - DNA, 22 bp, Homo sapiens
cctggggattctgacacggagt

SEQ ID NO: 9170197 - DNA, 23 bp, Homo sapiens
cctggggagctgtatccagagtg

SEQ ID NO: 9170198 - DNA, 23 bp, Homo sapiens
cctggggagctgtatccagagtg

SEQ ID NO: 9170199 - DNA, 22 bp, Homo sapiens
cctggggagccgcctgagcccc

SEQ ID NO: 9170200 - DNA, 22 bp, Homo sapiens
cctggggagccgcctgagcccc

SEQ ID NO: 9170201 - DNA, 22 bp, Homo sapiens
cctggggagccgcctgagcccc

SEQ ID NO: 9170202 - DNA, 22 bp, Homo sapiens
cctggggagagaaagcccagcc

SEQ ID NO: 9170203 - DNA, 22 bp, Homo sapiens
cctggggagaagagcttccccc

SEQ ID NO: 9170204 - DNA, 22 bp, Homo sapiens
cctggggagagaaagcccagcc

SEQ ID NO: 9170205 - DNA, 22 bp, Homo sapiens
tgttggaaaagaattaactagg

SEQ ID NO: 9170206 - DNA, 22 bp, Homo sapiens
tgttggaaaggccaggctgtgg

SEQ ID NO: 9170207 - DNA, 19 bp, Homo sapiens
tgttggctgttctagctca

SEQ ID NO: 9170208 - DNA, 22 bp, Homo sapiens
tgttggctattattattactgc

SEQ ID NO: 9170209 - DNA, 20 bp, Homo sapiens
tgttggcaattgttgtttcc

SEQ ID NO: 9170210 - DNA, 22 bp, Homo sapiens
tgttgcctgactttaaaatgtg

SEQ ID NO: 9170211 - DNA, 22 bp, Homo sapiens
tgttgctcttttttaggtgagt

SEQ ID NO: 9170212 - DNA, 22 bp, Homo sapiens
tgttgcccaggttctctcctgc

SEQ ID NO: 9170213 - DNA, 22 bp, Homo sapiens
tgttgcccaggttctctcctgc

SEQ ID NO: 9170214 - DNA, 22 bp, Homo sapiens
tgttgcattgtactgaaaagcc

SEQ ID NO: 9170215 - DNA, 22 bp, Homo sapiens
tgttgatttgtgggctgcaaaa

SEQ ID NO: 9170216 - DNA, 20 bp, Homo sapiens
tgttgattggtgtcatctca

SEQ ID NO: 9170217 - DNA, 22 bp, Homo sapiens
tgttgattagtgtttagactta

SEQ ID NO: 9170218 - DNA, 22 bp, Homo sapiens
tgttgattagtgtttagactta

SEQ ID NO: 9170219 - DNA, 22 bp, Homo sapiens
cctgctccatgctcaccatcag

SEQ ID NO: 9170220 - DNA, 22 bp, Homo sapiens
cctgctcccgggacgcgttcac

SEQ ID NO: 9170221 - DNA, 17 bp, Homo sapiens
tggttccaaccatacgc

SEQ ID NO: 9170222 - DNA, 22 bp, Homo sapiens
tggttccaagatggctgccaca

SEQ ID NO: 9170223 - DNA, 22 bp, Homo sapiens
tggttcatagcctcacaggata

SEQ ID NO: 9170224 - DNA, 22 bp, Homo sapiens
tggttcagttgcacaggctgtt

SEQ ID NO: 9170225 - DNA, 22 bp, Homo sapiens
tggttcagatatggagctggga

SEQ ID NO: 9170226 - DNA, 22 bp, Homo sapiens
tggttcagagagttgctgacca

SEQ ID NO: 9170227 - DNA, 22 bp, Homo sapiens
tggttcctcaagcgctggcggc

SEQ ID NO: 9170228 - DNA, 22 bp, Homo sapiens
tggttcctcaagcgctggcggc

SEQ ID NO: 9170229 - DNA, 22 bp, Homo sapiens
tggttcctcaagcgctggcggc

SEQ ID NO: 9170230 - DNA, 22 bp, Homo sapiens
tggttccaatcgcactggctca

SEQ ID NO: 9170231 - DNA, 22 bp, Homo sapiens
tggttccactaacctgagagcc

SEQ ID NO: 9170232 - DNA, 22 bp, Homo sapiens
tggttccagttttcaatagagc

SEQ ID NO: 9170233 - DNA, 22 bp, Homo sapiens
cctgctcagctgtcctcacgct

SEQ ID NO: 9170234 - DNA, 22 bp, Homo sapiens
cctgctcacctgatgtggcaac

SEQ ID NO: 9170235 - DNA, 22 bp, Homo sapiens
cctgctcagagcgtcttgtgtg

SEQ ID NO: 9170236 - DNA, 22 bp, Homo sapiens
cctgccttctaaagcgcccgcc

SEQ ID NO: 9170237 - DNA, 22 bp, Homo sapiens
cctgcgtctggccttgctccaa

SEQ ID NO: 9170238 - DNA, 22 bp, Homo sapiens
cgcacagctgcaaggagttgca

SEQ ID NO: 9170239 - DNA, 22 bp, Homo sapiens
cgcaaagagctctaaatcagac

SEQ ID NO: 9170240 - DNA, 19 bp, Homo sapiens
cgcacagcctgccaggcgc

SEQ ID NO: 9170241 - DNA, 22 bp, Homo sapiens
cctttggcattttgaggatgcg

SEQ ID NO: 9170242 - DNA, 22 bp, Homo sapiens
cctttgccatgacatggcacaa

SEQ ID NO: 9170243 - DNA, 22 bp, Homo sapiens
cctttggccgctttatggagga

SEQ ID NO: 9170244 - DNA, 22 bp, Homo sapiens
cctttggccctgagagatgatt

SEQ ID NO: 9170245 - DNA, 22 bp, Homo sapiens
cctttggctgcatagggaaggg

SEQ ID NO: 9170246 - DNA, 22 bp, Homo sapiens
cctttggccgctttatggagga

SEQ ID NO: 9170247 - DNA, 22 bp, Homo sapiens
cctttggctgcatagggaaggg

SEQ ID NO: 9170248 - DNA, 22 bp, Homo sapiens
cgagcagaatggagggtgccga

SEQ ID NO: 9170249 - DNA, 22 bp, Homo sapiens
cctttgccatgacatggcacaa

SEQ ID NO: 9170250 - DNA, 22 bp, Homo sapiens
ttatggcttctgtgaagaattt

SEQ ID NO: 9170251 - DNA, 22 bp, Homo sapiens
ttatggcttgaaactctaagga

SEQ ID NO: 9170252 - DNA, 22 bp, Homo sapiens
ttatggcttttatcctctcttg

SEQ ID NO: 9170253 - DNA, 22 bp, Homo sapiens
ttatggtagcttaatttgcctg

SEQ ID NO: 9170254 - DNA, 22 bp, Homo sapiens
ttatgtacctgaattagtaaag

SEQ ID NO: 9170255 - DNA, 22 bp, Homo sapiens
ttcaaaaaggtatgttcaagtc

SEQ ID NO: 9170256 - DNA, 22 bp, Homo sapiens
ttcaaaacaatctgtttgcatt

SEQ ID NO: 9170257 - DNA, 22 bp, Homo sapiens
ttatttttaaaagttcacacag

SEQ ID NO: 9170258 - DNA, 17 bp, Homo sapiens
ttattttttgggctgag

SEQ ID NO: 9170259 - DNA, 22 bp, Homo sapiens
cgcactggagctggaacgagtc

SEQ ID NO: 9170260 - DNA, 22 bp, Homo sapiens
ttcaaaacagctagatattgga

SEQ ID NO: 9170261 - DNA, 22 bp, Homo sapiens
cgcaccactgaattccagcctg

SEQ ID NO: 9170262 - DNA, 22 bp, Homo sapiens
ttcaaaacagctagatattgga

SEQ ID NO: 9170263 - DNA, 21 bp, Homo sapiens
cgcagagcgaacttgcggcgc

SEQ ID NO: 9170264 - DNA, 22 bp, Homo sapiens
cgcagagacatggcgacagaga

SEQ ID NO: 9170265 - DNA, 22 bp, Homo sapiens
cgcagagaaatgccgggggtac

SEQ ID NO: 9170266 - DNA, 22 bp, Homo sapiens
cgcagagaaatgccgggggtac

SEQ ID NO: 9170267 - DNA, 22 bp, Homo sapiens
cgcactggagctggaacgagtc

SEQ ID NO: 9170268 - DNA, 22 bp, Homo sapiens
cgcagagggcaggcagtgctgg

SEQ ID NO: 9170269 - DNA, 22 bp, Homo sapiens
ttattattgtggttgcattatc

SEQ ID NO: 9170270 - DNA, 22 bp, Homo sapiens
ttattattggtgagttaaggaa

SEQ ID NO: 9170271 - DNA, 22 bp, Homo sapiens
ttattattgtgacctgagaatg

SEQ ID NO: 9170272 - DNA, 22 bp, Homo sapiens
ttattattttgtgtacagcaaa

SEQ ID NO: 9170273 - DNA, 22 bp, Homo sapiens
ttattcacaaatgttgccctgt

SEQ ID NO: 9170274 - DNA, 22 bp, Homo sapiens
ttattcacatgggctcattcta

SEQ ID NO: 9170275 - DNA, 22 bp, Homo sapiens
ttattcaccagtgtaaaacact

SEQ ID NO: 9170276 - DNA, 22 bp, Homo sapiens
ttattcaccgcaggtgcttccc

SEQ ID NO: 9170277 - DNA, 22 bp, Homo sapiens
ttattcaccagtgtaaaacact

SEQ ID NO: 9170278 - DNA, 22 bp, Homo sapiens
ttattcactcattaaagcagga

SEQ ID NO: 9170279 - DNA, 22 bp, Homo sapiens
ttattcactctgaagccatcct

SEQ ID NO: 9170280 - DNA, 22 bp, Homo sapiens
ttatttttaaaagttcacacag

SEQ ID NO: 9170281 - DNA, 22 bp, Homo sapiens
ttatttttaaaagttcacacag

SEQ ID NO: 9170282 - DNA, 22 bp, Homo sapiens
ttacagaactgtcttgaaattt

SEQ ID NO: 9170283 - DNA, 22 bp, Homo sapiens
ttacagaactgtcttgaaattt

SEQ ID NO: 9170284 - DNA, 21 bp, Homo sapiens
ccttctccacagggtctccgg

SEQ ID NO: 9170285 - DNA, 22 bp, Homo sapiens
ttacagaagagaaagaattcag

SEQ ID NO: 9170286 - DNA, 22 bp, Homo sapiens
ttacagaagagaaagaattcag

SEQ ID NO: 9170287 - DNA, 21 bp, Homo sapiens
ttaccaatggcttctctttcc

SEQ ID NO: 9170288 - DNA, 22 bp, Homo sapiens
ttacctaaaatagctcaattta

SEQ ID NO: 9170289 - DNA, 22 bp, Homo sapiens
ttacctaaaatagctcaattta

SEQ ID NO: 9170290 - DNA, 22 bp, Homo sapiens
ttacccagggaccaagagaaac

SEQ ID NO: 9170291 - DNA, 22 bp, Homo sapiens
ttacccagagcacttgagcttt

SEQ ID NO: 9170292 - DNA, 22 bp, Homo sapiens
ttacccactgagcttcagccct

SEQ ID NO: 9170293 - DNA, 22 bp, Homo sapiens
ttacccacatttgggagtatat

SEQ ID NO: 9170294 - DNA, 22 bp, Homo sapiens
ttacccaggaaagaaatggtat

SEQ ID NO: 9170295 - DNA, 22 bp, Homo sapiens
ttaccattttataagttaaagt

SEQ ID NO: 9170296 - DNA, 22 bp, Homo sapiens
ttacccacctttctcatgccaa

SEQ ID NO: 9170297 - DNA, 22 bp, Homo sapiens
ttacccacctttctcatgccaa

SEQ ID NO: 9170298 - DNA, 22 bp, Homo sapiens
ttacccactgagcttcagccct

SEQ ID NO: 9170299 - DNA, 22 bp, Homo sapiens
ttaccattccatgacatcagga

SEQ ID NO: 9170300 - DNA, 22 bp, Homo sapiens
ccttctggagggtgtacgagag

SEQ ID NO: 9170301 - DNA, 21 bp, Homo sapiens
ccttctcttgcttcagcttca

SEQ ID NO: 9170302 - DNA, 22 bp, Homo sapiens
ccttcttcaccagtttacctga

SEQ ID NO: 9170303 - DNA, 22 bp, Homo sapiens
ccttcttctgtgtggcccaaga

SEQ ID NO: 9170304 - DNA, 22 bp, Homo sapiens
ccttcttctgtgtggcccaaga

SEQ ID NO: 9170305 - DNA, 22 bp, Homo sapiens
ccttgtcttgcacagatgcagc

SEQ ID NO: 9170306 - DNA, 22 bp, Homo sapiens
cctttaaagactgcataacttc

SEQ ID NO: 9170307 - DNA, 22 bp, Homo sapiens
ccttgttttggaaccaaaggat

SEQ ID NO: 9170308 - DNA, 22 bp, Homo sapiens
ccttggtttccaggatgaggct

SEQ ID NO: 9170309 - DNA, 22 bp, Homo sapiens
ccttggtgatctgggctggaag

SEQ ID NO: 9170310 - DNA, 22 bp, Homo sapiens
ccttggggtgttggaggcagcc

SEQ ID NO: 9170311 - DNA, 22 bp, Homo sapiens
ccttgggagaaattgcagagtc

SEQ ID NO: 9170312 - DNA, 22 bp, Homo sapiens
ccttggggtgttggaggcagcc

SEQ ID NO: 9170313 - DNA, 22 bp, Homo sapiens
ttatccatttaaaccagttata

SEQ ID NO: 9170314 - DNA, 22 bp, Homo sapiens
cctttacaaagttcttcatggg

SEQ ID NO: 9170315 - DNA, 22 bp, Homo sapiens
cctttaaatggatgttcaactg

SEQ ID NO: 9170316 - DNA, 22 bp, Homo sapiens
ttatggctgaataaattatggt

SEQ ID NO: 9170317 - DNA, 20 bp, Homo sapiens
ttatggctcctaccttgtga

SEQ ID NO: 9170318 - DNA, 22 bp, Homo sapiens
ttatggctaggatatgtgtgta

SEQ ID NO: 9170319 - DNA, 19 bp, Homo sapiens
ccttggctttaactatgaa

SEQ ID NO: 9170320 - DNA, 22 bp, Homo sapiens
ccttggcttgtgggctgcagcc

SEQ ID NO: 9170321 - DNA, 22 bp, Homo sapiens
ccttggcttgtgggctgcagcc

SEQ ID NO: 9170322 - DNA, 22 bp, Homo sapiens
ccttggcttgtgggctgcagcc

SEQ ID NO: 9170323 - DNA, 22 bp, Homo sapiens
ccttggcttgtgggctgcagcc

SEQ ID NO: 9170324 - DNA, 22 bp, Homo sapiens
ccttggcttgcacacggccacc

SEQ ID NO: 9170325 - DNA, 22 bp, Homo sapiens
ccttgggagaaattgcagagtc

SEQ ID NO: 9170326 - DNA, 22 bp, Homo sapiens
ccttggggaactggacgtgctg

SEQ ID NO: 9170327 - DNA, 22 bp, Homo sapiens
ccttgggcttgggcatagcttt

SEQ ID NO: 9170328 - DNA, 22 bp, Homo sapiens
ccttgcctcattgtgcttctcc

SEQ ID NO: 9170329 - DNA, 21 bp, Homo sapiens
ttactaaacaaaacatgcagg

SEQ ID NO: 9170330 - DNA, 21 bp, Homo sapiens
ccttggctggcatctagcacc

SEQ ID NO: 9170331 - DNA, 21 bp, Homo sapiens
ccttggctggcatctagcacc

SEQ ID NO: 9170332 - DNA, 22 bp, Homo sapiens
ccttggctgtgctgccctttgc

SEQ ID NO: 9170333 - DNA, 20 bp, Homo sapiens
ccttggcttaataataggga

SEQ ID NO: 9170334 - DNA, 19 bp, Homo sapiens
ccttgcctgtccctgcagc

SEQ ID NO: 9170335 - DNA, 22 bp, Homo sapiens
ccttggctgaggagggagctga

SEQ ID NO: 9170336 - DNA, 23 bp, Homo sapiens
tttctctgagaagcagttctcta

SEQ ID NO: 9170337 - DNA, 22 bp, Homo sapiens
tttctctctgactgggagctga

SEQ ID NO: 9170338 - DNA, 22 bp, Homo sapiens
tttctctctatttagacaggta

SEQ ID NO: 9170339 - DNA, 22 bp, Homo sapiens
tttctctccccaagtggaattg

SEQ ID NO: 9170340 - DNA, 22 bp, Homo sapiens
tttctctcagcctgtagaaact

SEQ ID NO: 9170341 - DNA, 22 bp, Homo sapiens
tttctctcagcctgtagaaact

SEQ ID NO: 9170342 - DNA, 19 bp, Homo sapiens
tttctctccctcatcccga

SEQ ID NO: 9170343 - DNA, 19 bp, Homo sapiens
tttctctccctcatcccga

SEQ ID NO: 9170344 - DNA, 22 bp, Homo sapiens
ctctctggacttgagtatcagc

SEQ ID NO: 9170345 - DNA, 22 bp, Homo sapiens
ctctctggacctcaactatttt

SEQ ID NO: 9170346 - DNA, 20 bp, Homo sapiens
ctctctggaaggtgggagcc

SEQ ID NO: 9170347 - DNA, 20 bp, Homo sapiens
ctctctggaaggtgggagcc

SEQ ID NO: 9170348 - DNA, 22 bp, Homo sapiens
ctctctggaattaaagcccaat

SEQ ID NO: 9170349 - DNA, 22 bp, Homo sapiens
tttctctggcattaggtataaa

SEQ ID NO: 9170350 - DNA, 22 bp, Homo sapiens
tttctctggcattaggtataaa

SEQ ID NO: 9170351 - DNA, 23 bp, Homo sapiens
tttctctgagaagcagttctcta

SEQ ID NO: 9170352 - DNA, 22 bp, Homo sapiens
tttctctgaggctggcctccct

SEQ ID NO: 9170353 - DNA, 22 bp, Homo sapiens
tttctctgccagttattttcct

SEQ ID NO: 9170354 - DNA, 22 bp, Homo sapiens
tttctctgctgcctgtgtcgat

SEQ ID NO: 9170355 - DNA, 22 bp, Homo sapiens
tttctctgctgcctgtgtcgat

SEQ ID NO: 9170356 - DNA, 22 bp, Homo sapiens
ctctagagtacgggctggcatg

SEQ ID NO: 9170357 - DNA, 22 bp, Homo sapiens
ctctagagtacgggctggcatg

SEQ ID NO: 9170358 - DNA, 22 bp, Homo sapiens
ctctaggctgcccaggagctga

SEQ ID NO: 9170359 - DNA, 22 bp, Homo sapiens
ctctagtgtagtgcaggaagga

SEQ ID NO: 9170360 - DNA, 22 bp, Homo sapiens
ctctagggtgcaggccccagga

SEQ ID NO: 9170361 - DNA, 22 bp, Homo sapiens
ctctatattctgaaacagttag

SEQ ID NO: 9170362 - DNA, 22 bp, Homo sapiens
ctctatattctgaaacagttag

SEQ ID NO: 9170363 - DNA, 20 bp, Homo sapiens
ctctattattaatttcttaa

SEQ ID NO: 9170364 - DNA, 20 bp, Homo sapiens
ctctcacagctccctcagcc

SEQ ID NO: 9170365 - DNA, 22 bp, Homo sapiens
tttctgttgtatggcttctgca

SEQ ID NO: 9170366 - DNA, 22 bp, Homo sapiens
tttctgttgtatggcttctgca

SEQ ID NO: 9170367 - DNA, 22 bp, Homo sapiens
tttctgttgtacttaaactagg

SEQ ID NO: 9170368 - DNA, 22 bp, Homo sapiens
tttctgtttagcataaagtggc

SEQ ID NO: 9170369 - DNA, 22 bp, Homo sapiens
tttctgcaggtattgcataagt

SEQ ID NO: 9170370 - DNA, 22 bp, Homo sapiens
tttctgcaagtgtagataccca

SEQ ID NO: 9170371 - DNA, 22 bp, Homo sapiens
tttctgcaacgagtctttgact

SEQ ID NO: 9170372 - DNA, 23 bp, Homo sapiens
tttctgatgagggatgtggtatg

SEQ ID NO: 9170373 - DNA, 22 bp, Homo sapiens
ctctgagctgaaacatgagcat

SEQ ID NO: 9170374 - DNA, 22 bp, Homo sapiens
ctctctggatatttgtatgctg

SEQ ID NO: 9170375 - DNA, 22 bp, Homo sapiens
ctctctggcacttcattgctgt

SEQ ID NO: 9170376 - DNA, 22 bp, Homo sapiens
ctctctggcccatcctgttgcc

SEQ ID NO: 9170377 - DNA, 22 bp, Homo sapiens
ctctgagggctcgagggacgcg

SEQ ID NO: 9170378 - DNA, 22 bp, Homo sapiens
ctctgaggctccatgcaggctt

SEQ ID NO: 9170379 - DNA, 22 bp, Homo sapiens
ctctgaggctccatgcaggctt

SEQ ID NO: 9170380 - DNA, 20 bp, Homo sapiens
ctctgaggctgagaagggag

SEQ ID NO: 9170381 - DNA, 22 bp, Homo sapiens
tttgaataaacggttaatgttc

SEQ ID NO: 9170382 - DNA, 22 bp, Homo sapiens
tttgaagtgtatgaaaatacag

SEQ ID NO: 9170383 - DNA, 22 bp, Homo sapiens
tttgaagtgttatttctatcac

SEQ ID NO: 9170384 - DNA, 22 bp, Homo sapiens
tttgaagttcccccatatcaga

SEQ ID NO: 9170385 - DNA, 22 bp, Homo sapiens
tttgaagtgttatttctatcac

SEQ ID NO: 9170386 - DNA, 22 bp, Homo sapiens
tttgaagttcccccatatcaga

SEQ ID NO: 9170387 - DNA, 23 bp, Homo sapiens
tttgaagttgactgccttccaga

SEQ ID NO: 9170388 - DNA, 19 bp, Homo sapiens
ctctggagcagacactgga

SEQ ID NO: 9170389 - DNA, 19 bp, Homo sapiens
ctctggagcagacactgga

SEQ ID NO: 9170390 - DNA, 22 bp, Homo sapiens
ctctggagcatttcacctacat

SEQ ID NO: 9170391 - DNA, 22 bp, Homo sapiens
ctctggagcatttcacctacat

SEQ ID NO: 9170392 - DNA, 22 bp, Homo sapiens
ctctggagcatttcacctacat

SEQ ID NO: 9170393 - DNA, 22 bp, Homo sapiens
ctctggagcatttcacctacat

SEQ ID NO: 9170394 - DNA, 22 bp, Homo sapiens
ctctggagcgctgcttcccgcg

SEQ ID NO: 9170395 - DNA, 22 bp, Homo sapiens
tttgaagggcacgacaatagtt

SEQ ID NO: 9170396 - DNA, 22 bp, Homo sapiens
tttgaagggcacgacaatagtt

SEQ ID NO: 9170397 - DNA, 22 bp, Homo sapiens
tttgaagggcacgacaatagtt

SEQ ID NO: 9170398 - DNA, 22 bp, Homo sapiens
tttgaagtcaaagattgattcc

SEQ ID NO: 9170399 - DNA, 22 bp, Homo sapiens
tttgaagtacctggttctgact

SEQ ID NO: 9170400 - DNA, 22 bp, Homo sapiens
tttgaagtcaggctttctaccc

SEQ ID NO: 9170401 - DNA, 22 bp, Homo sapiens
tttgaagtcagatggtctgagt

SEQ ID NO: 9170402 - DNA, 22 bp, Homo sapiens
tttgaagtcagacactgctttg

SEQ ID NO: 9170403 - DNA, 22 bp, Homo sapiens
tttgaagtcagacactgctttg

SEQ ID NO: 9170404 - DNA, 22 bp, Homo sapiens
tttgaagtgcaatgaggattct

SEQ ID NO: 9170405 - DNA, 22 bp, Homo sapiens
tttgaagtgcctcttgtggatt

SEQ ID NO: 9170406 - DNA, 22 bp, Homo sapiens
tttgaagtcaggctttctaccc

SEQ ID NO: 9170407 - DNA, 22 bp, Homo sapiens
tttgaagtggaaaaggatttaa

SEQ ID NO: 9170408 - DNA, 22 bp, Homo sapiens
tttgaagtgctctggtgatctg

SEQ ID NO: 9170409 - DNA, 22 bp, Homo sapiens
tttgaagtggatcccttcagtg

SEQ ID NO: 9170410 - DNA, 22 bp, Homo sapiens
tttgaagtggaaaaggatttaa

SEQ ID NO: 9170411 - DNA, 22 bp, Homo sapiens
tttgaagtgggcattagaacct

SEQ ID NO: 9170412 - DNA, 22 bp, Homo sapiens
tttgaagtgggcattagaacct

SEQ ID NO: 9170413 - DNA, 22 bp, Homo sapiens
ctctggagggaggctgagctgg

SEQ ID NO: 9170414 - DNA, 22 bp, Homo sapiens
ctctggagggaggctgagctgg

SEQ ID NO: 9170415 - DNA, 19 bp, Homo sapiens
ctctggagggaccgccgtt

SEQ ID NO: 9170416 - DNA, 22 bp, Homo sapiens
ctctggaggcctaaggaagtgg

SEQ ID NO: 9170417 - DNA, 22 bp, Homo sapiens
ctctggaggccgttggccctta

SEQ ID NO: 9170418 - DNA, 22 bp, Homo sapiens
ctctggaggcctaaggaagtgg

SEQ ID NO: 9170419 - DNA, 19 bp, Homo sapiens
ctctggagggaccgccgtt

SEQ ID NO: 9170420 - DNA, 22 bp, Homo sapiens
ctctggaggcctaaggaagtgg

SEQ ID NO: 9170421 - DNA, 22 bp, Homo sapiens
ctctggaggcagcaccagccag

SEQ ID NO: 9170422 - DNA, 21 bp, Homo sapiens
ctctggaggcaagggagagtg

SEQ ID NO: 9170423 - DNA, 22 bp, Homo sapiens
ctctggagcgctgcttcccgcg

SEQ ID NO: 9170424 - DNA, 21 bp, Homo sapiens
ctctggaggcaagggagagtg

SEQ ID NO: 9170425 - DNA, 22 bp, Homo sapiens
ctctggaggccgttggccctta

SEQ ID NO: 9170426 - DNA, 22 bp, Homo sapiens
ctctggaggcagcaccagccag

SEQ ID NO: 9170427 - DNA, 22 bp, Homo sapiens
ctctggaggccgttggccctta

SEQ ID NO: 9170428 - DNA, 22 bp, Homo sapiens
ctctggaggccgttggccctta

SEQ ID NO: 9170429 - DNA, 22 bp, Homo sapiens
ctctggaggtcaggtgtggtgg

SEQ ID NO: 9170430 - DNA, 22 bp, Homo sapiens
ctctggaggtggaggttgcagt

SEQ ID NO: 9170431 - DNA, 22 bp, Homo sapiens
ctctggaggtcaggtgtggtgg

SEQ ID NO: 9170432 - DNA, 22 bp, Homo sapiens
ctctggagggaggctgagctgg

SEQ ID NO: 9170433 - DNA, 22 bp, Homo sapiens
ctctggaggttgagcccagcaa

SEQ ID NO: 9170434 - DNA, 22 bp, Homo sapiens
ctctggaggttgagcccagcaa

SEQ ID NO: 9170435 - DNA, 22 bp, Homo sapiens
ctctggaggtggaggttgcagt

SEQ ID NO: 9170436 - DNA, 22 bp, Homo sapiens
ctctggagtaagagctatgaaa

SEQ ID NO: 9170437 - DNA, 22 bp, Homo sapiens
ctctggagtaagagctatgaaa

SEQ ID NO: 9170438 - DNA, 21 bp, Homo sapiens
ctctggagtcaagagcttcca

SEQ ID NO: 9170439 - DNA, 19 bp, Homo sapiens
ctctggagtcattgctccc

SEQ ID NO: 9170440 - DNA, 22 bp, Homo sapiens
ctctggagtcaggcagccctgg

SEQ ID NO: 9170441 - DNA, 22 bp, Homo sapiens
ctctggagtcaggcagccctgg

SEQ ID NO: 9170442 - DNA, 21 bp, Homo sapiens
ctctggagtcaagagcttcca

SEQ ID NO: 9170443 - DNA, 22 bp, Homo sapiens
ctctggagtcaggcagccctgg

SEQ ID NO: 9170444 - DNA, 19 bp, Homo sapiens
tttcttaggcctttggcct

SEQ ID NO: 9170445 - DNA, 19 bp, Homo sapiens
tttctgtttgcttctggtt

SEQ ID NO: 9170446 - DNA, 22 bp, Homo sapiens
tttcttaaatatttgcaggaca

SEQ ID NO: 9170447 - DNA, 21 bp, Homo sapiens
tttcttaggctctaaaatgac

SEQ ID NO: 9170448 - DNA, 22 bp, Homo sapiens
tttcttagtcctagagtgattt

SEQ ID NO: 9170449 - DNA, 22 bp, Homo sapiens
tttcttatactatattgtcatc

SEQ ID NO: 9170450 - DNA, 22 bp, Homo sapiens
tttcttctttcccagtgatggg

SEQ ID NO: 9170451 - DNA, 22 bp, Homo sapiens
tttcttctttcccagtgatggg

SEQ ID NO: 9170452 - DNA, 22 bp, Homo sapiens
tttcttctttcccagtgatggg

SEQ ID NO: 9170453 - DNA, 22 bp, Homo sapiens
tttcttcttgatttaaacaggg

SEQ ID NO: 9170454 - DNA, 22 bp, Homo sapiens
tttcttcttgatttaaacaggg

SEQ ID NO: 9170455 - DNA, 22 bp, Homo sapiens
tttcttctgtttgtagttacac

SEQ ID NO: 9170456 - DNA, 22 bp, Homo sapiens
tttcttcttgagtaaccagatt

SEQ ID NO: 9170457 - DNA, 22 bp, Homo sapiens
tttcttcttgagtaaccagatt

SEQ ID NO: 9170458 - DNA, 22 bp, Homo sapiens
tttcttcttgagtaaccagatt

SEQ ID NO: 9170459 - DNA, 22 bp, Homo sapiens
tttcttcttaatactggctgct

SEQ ID NO: 9170460 - DNA, 19 bp, Homo sapiens
ctctgcctctggctgtggc

SEQ ID NO: 9170461 - DNA, 22 bp, Homo sapiens
tttcttgagcccaggaggtgga

SEQ ID NO: 9170462 - DNA, 20 bp, Homo sapiens
ctctgctgcccgccggctgc

SEQ ID NO: 9170463 - DNA, 20 bp, Homo sapiens
ctctgctgcgcatcccactt

SEQ ID NO: 9170464 - DNA, 22 bp, Homo sapiens
ctctgctggccatgaagagaga

SEQ ID NO: 9170465 - DNA, 22 bp, Homo sapiens
ctctgctggccatgaagagaga

SEQ ID NO: 9170466 - DNA, 22 bp, Homo sapiens
ctctgctgctttgccagtggaa

SEQ ID NO: 9170467 - DNA, 22 bp, Homo sapiens
ctctgctgtgccgccagggcct

SEQ ID NO: 9170468 - DNA, 22 bp, Homo sapiens
ctctgctgtgccgccagggcct

SEQ ID NO: 9170469 - DNA, 19 bp, Homo sapiens
ctctgcttggtccatatgc

SEQ ID NO: 9170470 - DNA, 22 bp, Homo sapiens
ctctgctgtctcagatgggcca

SEQ ID NO: 9170471 - DNA, 22 bp, Homo sapiens
ctctgctgtctcagatgggcca

SEQ ID NO: 9170472 - DNA, 22 bp, Homo sapiens
ctctgctgtctccagggcagtc

SEQ ID NO: 9170473 - DNA, 21 bp, Homo sapiens
ctctgctgtctaccagctgtt

SEQ ID NO: 9170474 - DNA, 21 bp, Homo sapiens
ctctgctgtctaccagctgtt

SEQ ID NO: 9170475 - DNA, 22 bp, Homo sapiens
ctctgctggtgaccactgggcc

SEQ ID NO: 9170476 - DNA, 22 bp, Homo sapiens
ctccccaggttcaggaggtggg

SEQ ID NO: 9170477 - DNA, 22 bp, Homo sapiens
ctccccagcattctgacttcct

SEQ ID NO: 9170478 - DNA, 22 bp, Homo sapiens
ctccccagcattctgacttcct

SEQ ID NO: 9170479 - DNA, 22 bp, Homo sapiens
ctccccagccctggtattctga

SEQ ID NO: 9170480 - DNA, 22 bp, Homo sapiens
ctccccagccctggtattctga

SEQ ID NO: 9170481 - DNA, 22 bp, Homo sapiens
ctccccagccctggtattctga

SEQ ID NO: 9170482 - DNA, 18 bp, Homo sapiens
ctccccagctgcccccag

SEQ ID NO: 9170483 - DNA, 18 bp, Homo sapiens
ctccccagctgcccccag

SEQ ID NO: 9170484 - DNA, 18 bp, Homo sapiens
ctccccagctgcccccag

SEQ ID NO: 9170485 - DNA, 18 bp, Homo sapiens
ctccccagctgcccccag

SEQ ID NO: 9170486 - DNA, 22 bp, Homo sapiens
ttgtttcagctgtatgctatgt

SEQ ID NO: 9170487 - DNA, 22 bp, Homo sapiens
ttgtttcaaggaagaattagga

SEQ ID NO: 9170488 - DNA, 22 bp, Homo sapiens
ttgtttatggattgtagaaact

SEQ ID NO: 9170489 - DNA, 22 bp, Homo sapiens
ttgtttatgtgttgtctatggc

SEQ ID NO: 9170490 - DNA, 22 bp, Homo sapiens
ctcaggctgtgatgtgatggca

SEQ ID NO: 9170491 - DNA, 22 bp, Homo sapiens
ctcaggctgtgccacctgtgtg

SEQ ID NO: 9170492 - DNA, 22 bp, Homo sapiens
ctcccagggccatcgagtcact

SEQ ID NO: 9170493 - DNA, 22 bp, Homo sapiens
ctcaggctctgtactccctttg

SEQ ID NO: 9170494 - DNA, 22 bp, Homo sapiens
ctcaggctccagacttccgtcc

SEQ ID NO: 9170495 - DNA, 22 bp, Homo sapiens
ctccccaagccttggcttctcc

SEQ ID NO: 9170496 - DNA, 22 bp, Homo sapiens
ctccctctgtcttgtccagaaa

SEQ ID NO: 9170497 - DNA, 22 bp, Homo sapiens
ctccctgacaggccatgggctt

SEQ ID NO: 9170498 - DNA, 22 bp, Homo sapiens
ctccctgaggacaggccctgtc

SEQ ID NO: 9170499 - DNA, 22 bp, Homo sapiens
ctccctggaggtgagctggcac

SEQ ID NO: 9170500 - DNA, 22 bp, Homo sapiens
ctccctggaggtgagctggcac

SEQ ID NO: 9170501 - DNA, 22 bp, Homo sapiens
ctccctggaggtgagctggcac

SEQ ID NO: 9170502 - DNA, 22 bp, Homo sapiens
ctccctgcttgtttcccttcag

SEQ ID NO: 9170503 - DNA, 22 bp, Homo sapiens
ctccctggaggcccagacctgg

SEQ ID NO: 9170504 - DNA, 22 bp, Homo sapiens
ctccctggctttgtcctgaggc

SEQ ID NO: 9170505 - DNA, 22 bp, Homo sapiens
ctccctgggcagatgtggctct

SEQ ID NO: 9170506 - DNA, 23 bp, Homo sapiens
ctccctggagtttctggaagatg

SEQ ID NO: 9170507 - DNA, 22 bp, Homo sapiens
ctccctggcacagcgagaggtt

SEQ ID NO: 9170508 - DNA, 21 bp, Homo sapiens
ctcctcaggaccagccacagg

SEQ ID NO: 9170509 - DNA, 21 bp, Homo sapiens
ctcctcaggaccagccacagg

SEQ ID NO: 9170510 - DNA, 22 bp, Homo sapiens
ctcctcagggctggttacatgg

SEQ ID NO: 9170511 - DNA, 22 bp, Homo sapiens
ctcctcaggaagtagcatgtgt

SEQ ID NO: 9170512 - DNA, 21 bp, Homo sapiens
ctcctcaggaccagccacagg

SEQ ID NO: 9170513 - DNA, 22 bp, Homo sapiens
ctcctcagtcaggtctagggtc

SEQ ID NO: 9170514 - DNA, 19 bp, Homo sapiens
ctcctcagtcccagaggtc

SEQ ID NO: 9170515 - DNA, 19 bp, Homo sapiens
ctcctcagtcccagaggtc

SEQ ID NO: 9170516 - DNA, 22 bp, Homo sapiens
ctcccttgcttctggcattttg

SEQ ID NO: 9170517 - DNA, 22 bp, Homo sapiens
ctcccttcaggagaggctcaca

SEQ ID NO: 9170518 - DNA, 22 bp, Homo sapiens
ctccctggtgtcccctccagga

SEQ ID NO: 9170519 - DNA, 22 bp, Homo sapiens
tttatatcttatgtcatttcaa

SEQ ID NO: 9170520 - DNA, 22 bp, Homo sapiens
tttatatctggagttgctagga

SEQ ID NO: 9170521 - DNA, 22 bp, Homo sapiens
tttatatccatctttgaagtaa

SEQ ID NO: 9170522 - DNA, 22 bp, Homo sapiens
tttatatctggagttgctagga

SEQ ID NO: 9170523 - DNA, 22 bp, Homo sapiens
tttatatccatctttgaagtaa

SEQ ID NO: 9170524 - DNA, 22 bp, Homo sapiens
tttatatgaaagtgaccagtgg

SEQ ID NO: 9170525 - DNA, 18 bp, Homo sapiens
tttatatggatagagacc

SEQ ID NO: 9170526 - DNA, 18 bp, Homo sapiens
tttatatggatagagacc

SEQ ID NO: 9170527 - DNA, 22 bp, Homo sapiens
tttatatgtattgactttgatg

SEQ ID NO: 9170528 - DNA, 22 bp, Homo sapiens
tttatatgtgaaggtttgcaga

SEQ ID NO: 9170529 - DNA, 22 bp, Homo sapiens
tttatatggttgactatgagtt

SEQ ID NO: 9170530 - DNA, 22 bp, Homo sapiens
tttatatgtttgtacaattaag

SEQ ID NO: 9170531 - DNA, 22 bp, Homo sapiens
tttatatgtttgtacaattaag

SEQ ID NO: 9170532 - DNA, 22 bp, Homo sapiens
tttatatgtttgtacaattaag

SEQ ID NO: 9170533 - DNA, 22 bp, Homo sapiens
ctcctggaggatagtgactggg

SEQ ID NO: 9170534 - DNA, 23 bp, Homo sapiens
ctcctggagggtccggccctgcc

SEQ ID NO: 9170535 - DNA, 23 bp, Homo sapiens
ctcctggagggtccggccctgcc

SEQ ID NO: 9170536 - DNA, 23 bp, Homo sapiens
ctcctggagggtccggccctgcc

SEQ ID NO: 9170537 - DNA, 22 bp, Homo sapiens
ctcctggagggccaaagaaata

SEQ ID NO: 9170538 - DNA, 22 bp, Homo sapiens
ctcctggaggatagtgactggg

SEQ ID NO: 9170539 - DNA, 22 bp, Homo sapiens
tttacacaaaagatagcacacc

SEQ ID NO: 9170540 - DNA, 20 bp, Homo sapiens
ctcctcagttccatgggagg

SEQ ID NO: 9170541 - DNA, 22 bp, Homo sapiens
ctcctcagttgtcccatggaga

SEQ ID NO: 9170542 - DNA, 22 bp, Homo sapiens
ctcctcagttgtcccatggaga

SEQ ID NO: 9170543 - DNA, 22 bp, Homo sapiens
tttacacagaggacactgggct

SEQ ID NO: 9170544 - DNA, 22 bp, Homo sapiens
ctcctgctgaatggccaggagc

SEQ ID NO: 9170545 - DNA, 22 bp, Homo sapiens
ctcctgcttcacgggcaccgcc

SEQ ID NO: 9170546 - DNA, 22 bp, Homo sapiens
ctcctgctgaatggccaggagc

SEQ ID NO: 9170547 - DNA, 22 bp, Homo sapiens
tttcaaataccataaacctaat

SEQ ID NO: 9170548 - DNA, 22 bp, Homo sapiens
tttcaaataccataaacctaat

SEQ ID NO: 9170549 - DNA, 22 bp, Homo sapiens
tttcaaatggagtcgtgaaatg

SEQ ID NO: 9170550 - DNA, 22 bp, Homo sapiens
tttcaaagttgggaattgtaat

SEQ ID NO: 9170551 - DNA, 22 bp, Homo sapiens
tttcaaataccataaacctaat

SEQ ID NO: 9170552 - DNA, 22 bp, Homo sapiens
tttcaaataccataaacctaat

SEQ ID NO: 9170553 - DNA, 22 bp, Homo sapiens
tttcaaagtggagaattagaca

SEQ ID NO: 9170554 - DNA, 22 bp, Homo sapiens
tttcaaagtggagaattagaca

SEQ ID NO: 9170555 - DNA, 22 bp, Homo sapiens
ctcgtgggggagccaaagaaga

SEQ ID NO: 9170556 - DNA, 22 bp, Homo sapiens
ctccttcctggttagcacctta

SEQ ID NO: 9170557 - DNA, 18 bp, Homo sapiens
ctcggggacaagggcggc

SEQ ID NO: 9170558 - DNA, 22 bp, Homo sapiens
tttcaaagtcaagaaggatact

SEQ ID NO: 9170559 - DNA, 22 bp, Homo sapiens
ctcctgtggtactcccagggcc

SEQ ID NO: 9170560 - DNA, 22 bp, Homo sapiens
ctcctgtgcacctccagcggca

SEQ ID NO: 9170561 - DNA, 22 bp, Homo sapiens
ctcctgtcaataggctcctggc

SEQ ID NO: 9170562 - DNA, 22 bp, Homo sapiens
ctcctgtatgttgggcttcaca

SEQ ID NO: 9170563 - DNA, 22 bp, Homo sapiens
tttatattacctggaatagctt

SEQ ID NO: 9170564 - DNA, 22 bp, Homo sapiens
tttatattacctggaatagctt

SEQ ID NO: 9170565 - DNA, 22 bp, Homo sapiens
tttatatgtttgtacaattaag

SEQ ID NO: 9170566 - DNA, 22 bp, Homo sapiens
tttttctgagcggtaatcatca

SEQ ID NO: 9170567 - DNA, 18 bp, Homo sapiens
tttttctgataaaacaag

SEQ ID NO: 9170568 - DNA, 22 bp, Homo sapiens
tttttctgccattcaaagagga

SEQ ID NO: 9170569 - DNA, 22 bp, Homo sapiens
tttttctgccattcaaagagga

SEQ ID NO: 9170570 - DNA, 22 bp, Homo sapiens
tttttctgagaatatgagagga

SEQ ID NO: 9170571 - DNA, 22 bp, Homo sapiens
tttttctgagaatatgagagga

SEQ ID NO: 9170572 - DNA, 22 bp, Homo sapiens
ttttctctccaggtggggtgat

SEQ ID NO: 9170573 - DNA, 21 bp, Homo sapiens
ttttctccagctgtgatttta

SEQ ID NO: 9170574 - DNA, 22 bp, Homo sapiens
ttttctcccgctggctgctctt

SEQ ID NO: 9170575 - DNA, 22 bp, Homo sapiens
ttttctctacaaaataaccagc

SEQ ID NO: 9170576 - DNA, 22 bp, Homo sapiens
ttttctctacaaaataaccagc

SEQ ID NO: 9170577 - DNA, 22 bp, Homo sapiens
ttttctctatattgtctgtgaa

SEQ ID NO: 9170578 - DNA, 22 bp, Homo sapiens
ttttctctatattgtctgtgaa

SEQ ID NO: 9170579 - DNA, 22 bp, Homo sapiens
ttttcctctgtatttgaaatgc

SEQ ID NO: 9170580 - DNA, 22 bp, Homo sapiens
ttttcctgcctgtctctagagg

SEQ ID NO: 9170581 - DNA, 22 bp, Homo sapiens
ctctggagtcctgtatcactcc

SEQ ID NO: 9170582 - DNA, 22 bp, Homo sapiens
ctctggagtcctgtatcactcc

SEQ ID NO: 9170583 - DNA, 22 bp, Homo sapiens
ctctggagtcctgtatcactcc

SEQ ID NO: 9170584 - DNA, 19 bp, Homo sapiens
ctctggagtcattgctccc

SEQ ID NO: 9170585 - DNA, 22 bp, Homo sapiens
ctctggagtgcagcctggtggc

SEQ ID NO: 9170586 - DNA, 23 bp, Homo sapiens
ttttcctgtggagacatgactgg

SEQ ID NO: 9170587 - DNA, 22 bp, Homo sapiens
ttttctcaggtgcttatctaag

SEQ ID NO: 9170588 - DNA, 22 bp, Homo sapiens
ctgaagatttggctgtaaagca

SEQ ID NO: 9170589 - DNA, 22 bp, Homo sapiens
ctgaaggaagcaggtggcctgt

SEQ ID NO: 9170590 - DNA, 18 bp, Homo sapiens
ctgaaggatccaggtgta

SEQ ID NO: 9170591 - DNA, 22 bp, Homo sapiens
ctgaaggacttggtgatagttg

SEQ ID NO: 9170592 - DNA, 22 bp, Homo sapiens
ctgaaggagcatagtcagtttt

SEQ ID NO: 9170593 - DNA, 22 bp, Homo sapiens
ctgaagttaacatcttgatgtc

SEQ ID NO: 9170594 - DNA, 22 bp, Homo sapiens
ctgaagttaaagtagtttttat

SEQ ID NO: 9170595 - DNA, 22 bp, Homo sapiens
ctgaagttaatcagaggtacaa

SEQ ID NO: 9170596 - DNA, 22 bp, Homo sapiens
ctgaagttaatcagaggtacaa

SEQ ID NO: 9170597 - DNA, 22 bp, Homo sapiens
ctgaagttagttatgcctaaaa

SEQ ID NO: 9170598 - DNA, 22 bp, Homo sapiens
ctgaagttattcagtgggctga

SEQ ID NO: 9170599 - DNA, 22 bp, Homo sapiens
ctgaagttattgtacaaatttg

SEQ ID NO: 9170600 - DNA, 22 bp, Homo sapiens
ctgaagttaacatcttgatgtc

SEQ ID NO: 9170601 - DNA, 22 bp, Homo sapiens
ctgaagggatgtgatttctaca

SEQ ID NO: 9170602 - DNA, 22 bp, Homo sapiens
ctgaaggattcaaaatggcagg

SEQ ID NO: 9170603 - DNA, 22 bp, Homo sapiens
ctgaaggatttagttctttgct

SEQ ID NO: 9170604 - DNA, 22 bp, Homo sapiens
ctgaaaaatatgttttggagaa

SEQ ID NO: 9170605 - DNA, 22 bp, Homo sapiens
ctgaaaaacgggatttggctgg

SEQ ID NO: 9170606 - DNA, 22 bp, Homo sapiens
ctgaaaaatatgttttggagaa

SEQ ID NO: 9170607 - DNA, 22 bp, Homo sapiens
ctgaaaagctttgaaccgttaa

SEQ ID NO: 9170608 - DNA, 22 bp, Homo sapiens
ctgaaaatgttagtgatacgaa

SEQ ID NO: 9170609 - DNA, 22 bp, Homo sapiens
ctgaaaagtgtctgttgagtta

SEQ ID NO: 9170610 - DNA, 22 bp, Homo sapiens
ctgaaaagtgtctgttgagtta

SEQ ID NO: 9170611 - DNA, 22 bp, Homo sapiens
ctgaaagaataagatgtttaca

SEQ ID NO: 9170612 - DNA, 22 bp, Homo sapiens
ctgaaagaataagatgtttaca

SEQ ID NO: 9170613 - DNA, 22 bp, Homo sapiens
ctgaaacattgcaataacaaag

SEQ ID NO: 9170614 - DNA, 22 bp, Homo sapiens
ttttttgttgggtagaacggaa

SEQ ID NO: 9170615 - DNA, 23 bp, Homo sapiens
ttttttgtcttgctaggctgccc

SEQ ID NO: 9170616 - DNA, 22 bp, Homo sapiens
tttttcttaaatgtgggttggc

SEQ ID NO: 9170617 - DNA, 22 bp, Homo sapiens
tttttctgtctcttacattgca

SEQ ID NO: 9170618 - DNA, 22 bp, Homo sapiens
tttttctggataactgtatctc

SEQ ID NO: 9170619 - DNA, 22 bp, Homo sapiens
tttttctggataactgtatctc

SEQ ID NO: 9170620 - DNA, 20 bp, Homo sapiens
tttttctgggcttccatagc

SEQ ID NO: 9170621 - DNA, 22 bp, Homo sapiens
tttttctgccattcaaagagga

SEQ ID NO: 9170622 - DNA, 20 bp, Homo sapiens
tttttctgggcttccatagc

SEQ ID NO: 9170623 - DNA, 22 bp, Homo sapiens
tttttctgtaaagggccagaga

SEQ ID NO: 9170624 - DNA, 22 bp, Homo sapiens
ctgagctggtggaagcatgcag

SEQ ID NO: 9170625 - DNA, 22 bp, Homo sapiens
ctgagctggtggaagcatgcag

SEQ ID NO: 9170626 - DNA, 21 bp, Homo sapiens
ctgagctggggtgaaggttgc

SEQ ID NO: 9170627 - DNA, 22 bp, Homo sapiens
ctgagctggtctatggacttgg

SEQ ID NO: 9170628 - DNA, 22 bp, Homo sapiens
ctgagctgggcaactcttagat

SEQ ID NO: 9170629 - DNA, 22 bp, Homo sapiens
ctgagctgggctctcttgaggg

SEQ ID NO: 9170630 - DNA, 22 bp, Homo sapiens
ctgagctgggctctcttgaggg

SEQ ID NO: 9170631 - DNA, 22 bp, Homo sapiens
ctgagctgttactctgtcctcg

SEQ ID NO: 9170632 - DNA, 22 bp, Homo sapiens
ctgagctgttactctgtcctcg

SEQ ID NO: 9170633 - DNA, 22 bp, Homo sapiens
ctgagctggttctcttgtgaaa

SEQ ID NO: 9170634 - DNA, 22 bp, Homo sapiens
ctgagctgtgctaagtgaaatg

SEQ ID NO: 9170635 - DNA, 22 bp, Homo sapiens
ctgaggaatgagtgaggagcca

SEQ ID NO: 9170636 - DNA, 22 bp, Homo sapiens
ctgaggaagacagcagctgtgt

SEQ ID NO: 9170637 - DNA, 22 bp, Homo sapiens
ctgagctgtttaatcccagata

SEQ ID NO: 9170638 - DNA, 22 bp, Homo sapiens
ctgagggcatgaacattccata

SEQ ID NO: 9170639 - DNA, 22 bp, Homo sapiens
ctgagggccctgaagcttggca

SEQ ID NO: 9170640 - DNA, 21 bp, Homo sapiens
ctgagggccgcagctgggctc

SEQ ID NO: 9170641 - DNA, 22 bp, Homo sapiens
ctgagggccctgaagcttggca

SEQ ID NO: 9170642 - DNA, 22 bp, Homo sapiens
ctgagggatgggctgggccgcc

SEQ ID NO: 9170643 - DNA, 22 bp, Homo sapiens
ctgagggagaagtcacgggcag

SEQ ID NO: 9170644 - DNA, 22 bp, Homo sapiens
ctgagggagagaatggggcaaa

SEQ ID NO: 9170645 - DNA, 22 bp, Homo sapiens
ctgagggagagaatggggcaaa

SEQ ID NO: 9170646 - DNA, 18 bp, Homo sapiens
ctgaggctggcaggagcc

SEQ ID NO: 9170647 - DNA, 22 bp, Homo sapiens
ctgagggaacttgggcaagtct

SEQ ID NO: 9170648 - DNA, 22 bp, Homo sapiens
ctgagagtgtggcttccaggcc

SEQ ID NO: 9170649 - DNA, 22 bp, Homo sapiens
ctgagagtgctctttgatgtca

SEQ ID NO: 9170650 - DNA, 20 bp, Homo sapiens
ctgagagtctgtgcttagtc

SEQ ID NO: 9170651 - DNA, 22 bp, Homo sapiens
ctgagccttgatgtcccttgtc

SEQ ID NO: 9170652 - DNA, 22 bp, Homo sapiens
ctgagccttattcaccagccct

SEQ ID NO: 9170653 - DNA, 22 bp, Homo sapiens
ctgagcaccccaggacctgcgc

SEQ ID NO: 9170654 - DNA, 22 bp, Homo sapiens
ctgagcaccccaggacctgcgc

SEQ ID NO: 9170655 - DNA, 22 bp, Homo sapiens
ctgagctgggagtagagactct

SEQ ID NO: 9170656 - DNA, 22 bp, Homo sapiens
ctgagctgggcaactcttagat

SEQ ID NO: 9170657 - DNA, 22 bp, Homo sapiens
ctgagctgggagtagagactct

SEQ ID NO: 9170658 - DNA, 22 bp, Homo sapiens
ctgagctgggagtagagactct

SEQ ID NO: 9170659 - DNA, 22 bp, Homo sapiens
ctgagaggtgctggtggctgca

SEQ ID NO: 9170660 - DNA, 22 bp, Homo sapiens
ctgagaggtgacagcgtgctgg

SEQ ID NO: 9170661 - DNA, 22 bp, Homo sapiens
ctgagaggtgctggtggctgca

SEQ ID NO: 9170662 - DNA, 22 bp, Homo sapiens
ctgagagtagctggagaacatt

SEQ ID NO: 9170663 - DNA, 22 bp, Homo sapiens
ctgagagtattggcaggcttgg

SEQ ID NO: 9170664 - DNA, 22 bp, Homo sapiens
ctgagaggggaccagggtgttt

SEQ ID NO: 9170665 - DNA, 22 bp, Homo sapiens
ctgagaggtaagcagcgcagtg

SEQ ID NO: 9170666 - DNA, 22 bp, Homo sapiens
ctgagaggtaagcagcgcagtg

SEQ ID NO: 9170667 - DNA, 22 bp, Homo sapiens
ctgagaggtaagcagcgcagtg

SEQ ID NO: 9170668 - DNA, 22 bp, Homo sapiens
ctgagaggtaagcagcgcagtg

SEQ ID NO: 9170669 - DNA, 22 bp, Homo sapiens
ctgaagtttttcaatttatgtt

SEQ ID NO: 9170670 - DNA, 22 bp, Homo sapiens
ctgaagtttttcaatttatgtt

SEQ ID NO: 9170671 - DNA, 22 bp, Homo sapiens
ctgaagttcatacaatggccat

SEQ ID NO: 9170672 - DNA, 22 bp, Homo sapiens
ctgaagttcgccagactcgggc

SEQ ID NO: 9170673 - DNA, 22 bp, Homo sapiens
ctgaagttttgacatctcattt

SEQ ID NO: 9170674 - DNA, 22 bp, Homo sapiens
ctgaagtttcgagatggatgtg

SEQ ID NO: 9170675 - DNA, 22 bp, Homo sapiens
ctgaagtttcgagatggatgtg

SEQ ID NO: 9170676 - DNA, 22 bp, Homo sapiens
ctgaagtttatgcttttcgggt

SEQ ID NO: 9170677 - DNA, 22 bp, Homo sapiens
ctgaagttctacaagcctcagg

SEQ ID NO: 9170678 - DNA, 22 bp, Homo sapiens
ctgaataattttctgttgtatg

SEQ ID NO: 9170679 - DNA, 19 bp, Homo sapiens
ctgagagatgcttcacaca

SEQ ID NO: 9170680 - DNA, 22 bp, Homo sapiens
ctgagagatcaagccacaggat

SEQ ID NO: 9170681 - DNA, 22 bp, Homo sapiens
ctgctgcccctgagctcagcct

SEQ ID NO: 9170682 - DNA, 22 bp, Homo sapiens
ctgctgcccctgagctcagcct

SEQ ID NO: 9170683 - DNA, 22 bp, Homo sapiens
ctgctgcccctgagctcagcct

SEQ ID NO: 9170684 - DNA, 22 bp, Homo sapiens
ctgctgagccctggcacaggtg

SEQ ID NO: 9170685 - DNA, 20 bp, Homo sapiens
ctgctgccctgtcagcctct

SEQ ID NO: 9170686 - DNA, 20 bp, Homo sapiens
ctgctgccctgtcagcctct

SEQ ID NO: 9170687 - DNA, 20 bp, Homo sapiens
ctgctgccctgtcagcctct

SEQ ID NO: 9170688 - DNA, 22 bp, Homo sapiens
ctgctgccggcgagcctccctt

SEQ ID NO: 9170689 - DNA, 22 bp, Homo sapiens
ctgctgagcatcagggctgccc

SEQ ID NO: 9170690 - DNA, 22 bp, Homo sapiens
ctgctctgaagccaggattctg

SEQ ID NO: 9170691 - DNA, 19 bp, Homo sapiens
ctgctctccttgacttgga

SEQ ID NO: 9170692 - DNA, 22 bp, Homo sapiens
ctgctctctgttcccctggatc

SEQ ID NO: 9170693 - DNA, 22 bp, Homo sapiens
ctgctctccccaggccagtctg

SEQ ID NO: 9170694 - DNA, 19 bp, Homo sapiens
ctgctctccttgacttgga

SEQ ID NO: 9170695 - DNA, 22 bp, Homo sapiens
ctgctctatgtcctcacccagg

SEQ ID NO: 9170696 - DNA, 22 bp, Homo sapiens
ctgctcggcgcgcatggctgcc

SEQ ID NO: 9170697 - DNA, 22 bp, Homo sapiens
ctgctgtgagtttggaggtcta

SEQ ID NO: 9170698 - DNA, 20 bp, Homo sapiens
ctgctgtgattccctcctcc

SEQ ID NO: 9170699 - DNA, 22 bp, Homo sapiens
ctgctggcctagcccatcctct

SEQ ID NO: 9170700 - DNA, 22 bp, Homo sapiens
ctgctggcctagcccatcctct

SEQ ID NO: 9170701 - DNA, 22 bp, Homo sapiens
ctgctggcctcggccatgcctg

SEQ ID NO: 9170702 - DNA, 22 bp, Homo sapiens
ctgctggcctcggccatgcctg

SEQ ID NO: 9170703 - DNA, 22 bp, Homo sapiens
ctgctggcaagcccagttggag

SEQ ID NO: 9170704 - DNA, 22 bp, Homo sapiens
ctgctggagggagctgatagtg

SEQ ID NO: 9170705 - DNA, 22 bp, Homo sapiens
ctgctggaggttggagcatgca

SEQ ID NO: 9170706 - DNA, 22 bp, Homo sapiens
ctgctggactacaggaagagtt

SEQ ID NO: 9170707 - DNA, 22 bp, Homo sapiens
ctgctgctcagtgtcatcatgt

SEQ ID NO: 9170708 - DNA, 22 bp, Homo sapiens
ctgctgctgagagctcagcctg

SEQ ID NO: 9170709 - DNA, 22 bp, Homo sapiens
ctgctgctgagaatgcctcagg

SEQ ID NO: 9170710 - DNA, 22 bp, Homo sapiens
ctgctgctgagaatgcctcagg

SEQ ID NO: 9170711 - DNA, 22 bp, Homo sapiens
ctgctgctgagagctcagcctg

SEQ ID NO: 9170712 - DNA, 22 bp, Homo sapiens
ctgcctcttaagtggatggagt

SEQ ID NO: 9170713 - DNA, 22 bp, Homo sapiens
ctgcctctgttgggcatggtct

SEQ ID NO: 9170714 - DNA, 22 bp, Homo sapiens
ctgcctgagtggaggtcgaggg

SEQ ID NO: 9170715 - DNA, 22 bp, Homo sapiens
ctgcctgcactgcctggctcca

SEQ ID NO: 9170716 - DNA, 20 bp, Homo sapiens
ctgcgggctcggccgacccc

SEQ ID NO: 9170717 - DNA, 22 bp, Homo sapiens
ctgctccaagccagccctgcag

SEQ ID NO: 9170718 - DNA, 22 bp, Homo sapiens
ctgctccaagccagccctgcag

SEQ ID NO: 9170719 - DNA, 22 bp, Homo sapiens
ctgctccacacctccatttcct

SEQ ID NO: 9170720 - DNA, 20 bp, Homo sapiens
ctgctccacccggctctcag

SEQ ID NO: 9170721 - DNA, 18 bp, Homo sapiens
ctgctccagtctggccag

SEQ ID NO: 9170722 - DNA, 18 bp, Homo sapiens
ctgctccagtctggccag

SEQ ID NO: 9170723 - DNA, 22 bp, Homo sapiens
ctgctccaggatttcaggccag

SEQ ID NO: 9170724 - DNA, 19 bp, Homo sapiens
ctgctccctccttctggca

SEQ ID NO: 9170725 - DNA, 19 bp, Homo sapiens
ctgctccctccttctggca

SEQ ID NO: 9170726 - DNA, 22 bp, Homo sapiens
ctgctccccagcctgcgccttt

SEQ ID NO: 9170727 - DNA, 19 bp, Homo sapiens
ctgctccctccttctggca

SEQ ID NO: 9170728 - DNA, 22 bp, Homo sapiens
ctgctcctctgaggtagccaca

SEQ ID NO: 9170729 - DNA, 22 bp, Homo sapiens
ctgctcctgtccagcagggcca

SEQ ID NO: 9170730 - DNA, 22 bp, Homo sapiens
ctgccctgggccaggaagcggc

SEQ ID NO: 9170731 - DNA, 22 bp, Homo sapiens
ctgcctctataggagtccacca

SEQ ID NO: 9170732 - DNA, 22 bp, Homo sapiens
ctgcctctggcctcaggcccag

SEQ ID NO: 9170733 - DNA, 22 bp, Homo sapiens
ctgccctgcttgatgacagcga

SEQ ID NO: 9170734 - DNA, 22 bp, Homo sapiens
ctgccctggcagcctaccatgg

SEQ ID NO: 9170735 - DNA, 22 bp, Homo sapiens
ctgcccctggctggtgaagcag

SEQ ID NO: 9170736 - DNA, 22 bp, Homo sapiens
ctgcccctggctggtgaagcag

SEQ ID NO: 9170737 - DNA, 22 bp, Homo sapiens
ctgcccctggtgatggacgcca

SEQ ID NO: 9170738 - DNA, 22 bp, Homo sapiens
ctgcccctggtgatggacgcca

SEQ ID NO: 9170739 - DNA, 18 bp, Homo sapiens
ctgccccttctctgagat

SEQ ID NO: 9170740 - DNA, 18 bp, Homo sapiens
ctgccccttctctgagat

SEQ ID NO: 9170741 - DNA, 22 bp, Homo sapiens
ctgccctgagtcatgccagatg

SEQ ID NO: 9170742 - DNA, 22 bp, Homo sapiens
ctgccctgagtcatgccagatg

SEQ ID NO: 9170743 - DNA, 23 bp, Homo sapiens
ctgccctgatcttgatctattgt

SEQ ID NO: 9170744 - DNA, 22 bp, Homo sapiens
ctgccctgcagctccacggact

SEQ ID NO: 9170745 - DNA, 22 bp, Homo sapiens
ctgccctgcttctgagggaagc

SEQ ID NO: 9170746 - DNA, 22 bp, Homo sapiens
ctgccctgcttgatgacagcga

SEQ ID NO: 9170747 - DNA, 22 bp, Homo sapiens
ctgccctgctctccgggatctt

SEQ ID NO: 9170748 - DNA, 22 bp, Homo sapiens
ctgccctgctggagatcacagt

SEQ ID NO: 9170749 - DNA, 22 bp, Homo sapiens
ctgccctgcctggccagtgtgg

SEQ ID NO: 9170750 - DNA, 22 bp, Homo sapiens
ctgccctgctaatgagttccaa

SEQ ID NO: 9170751 - DNA, 22 bp, Homo sapiens
ctgccctgctaatgagttccaa

SEQ ID NO: 9170752 - DNA, 22 bp, Homo sapiens
ctgcccctgctcatggctgtcc

SEQ ID NO: 9170753 - DNA, 22 bp, Homo sapiens
ctgcccctgctcatggctgtcc

SEQ ID NO: 9170754 - DNA, 22 bp, Homo sapiens
ctgcccctgctcatggctgtcc

SEQ ID NO: 9170755 - DNA, 23 bp, Homo sapiens
ctgcatatggaggttagcaactc

SEQ ID NO: 9170756 - DNA, 22 bp, Homo sapiens
ctgcagtttcagcctttctggc

SEQ ID NO: 9170757 - DNA, 22 bp, Homo sapiens
ctgcatatcaaattactcctgg

SEQ ID NO: 9170758 - DNA, 22 bp, Homo sapiens
ctgcagttctcaatttctattg

SEQ ID NO: 9170759 - DNA, 22 bp, Homo sapiens
ctgcagttcttctcctcaaggc

SEQ ID NO: 9170760 - DNA, 22 bp, Homo sapiens
ctgcagtgttctggaatgcatt

SEQ ID NO: 9170761 - DNA, 22 bp, Homo sapiens
ctgcagtctgacatacgaggac

SEQ ID NO: 9170762 - DNA, 22 bp, Homo sapiens
ctgcagtacaagaagcatctct

SEQ ID NO: 9170763 - DNA, 22 bp, Homo sapiens
ctgcagtcatctgaagattttg

SEQ ID NO: 9170764 - DNA, 22 bp, Homo sapiens
ctgcagtatgagctacccaggt

SEQ ID NO: 9170765 - DNA, 22 bp, Homo sapiens
ctgcagtgaaatcaggaagcaa

SEQ ID NO: 9170766 - DNA, 22 bp, Homo sapiens
ctgcagtgcaagcccagatgga

SEQ ID NO: 9170767 - DNA, 22 bp, Homo sapiens
ctgcagtgaggattcttaggtg

SEQ ID NO: 9170768 - DNA, 22 bp, Homo sapiens
ctgcagtgttctggaatgcatt

SEQ ID NO: 9170769 - DNA, 22 bp, Homo sapiens
ctgcagtgcctgccactgagcc

SEQ ID NO: 9170770 - DNA, 21 bp, Homo sapiens
ctgagggccgcagctgggctc

SEQ ID NO: 9170771 - DNA, 21 bp, Homo sapiens
ctgagggccgcagctgggctc

SEQ ID NO: 9170772 - DNA, 22 bp, Homo sapiens
ctgagggccgggacccagtttc

SEQ ID NO: 9170773 - DNA, 22 bp, Homo sapiens
ctgagggcctgaggacctagat

SEQ ID NO: 9170774 - DNA, 22 bp, Homo sapiens
ctgagggcctgaggacctagat

SEQ ID NO: 9170775 - DNA, 22 bp, Homo sapiens
ctgagggccttctatgctgagc

SEQ ID NO: 9170776 - DNA, 22 bp, Homo sapiens
ctgagggctggagctgaggcct

SEQ ID NO: 9170777 - DNA, 22 bp, Homo sapiens
ctgagggccttggctcctgccc

SEQ ID NO: 9170778 - DNA, 22 bp, Homo sapiens
ctgagggccttggctcctgccc

SEQ ID NO: 9170779 - DNA, 22 bp, Homo sapiens
ctgagggcttccttgtcccggg

SEQ ID NO: 9170780 - DNA, 22 bp, Homo sapiens
ctgcagggtttttcaaggacaa

SEQ ID NO: 9170781 - DNA, 23 bp, Homo sapiens
ctgaggggaaaagggcttcaggc

SEQ ID NO: 9170782 - DNA, 23 bp, Homo sapiens
ctgaggggaaaagggcttcaggc

SEQ ID NO: 9170783 - DNA, 21 bp, Homo sapiens
ctgagggctttgaatccagac

SEQ ID NO: 9170784 - DNA, 22 bp, Homo sapiens
ctgcaggggctggagttggctt

SEQ ID NO: 9170785 - DNA, 22 bp, Homo sapiens
ctgcaggggctggagttggctt

SEQ ID NO: 9170786 - DNA, 22 bp, Homo sapiens
ctgcaggggctggagttggctt

SEQ ID NO: 9170787 - DNA, 22 bp, Homo sapiens
ctgcaggggcctcgagcacagg

SEQ ID NO: 9170788 - DNA, 22 bp, Homo sapiens
ctgcaggggcctcgagcacagg

SEQ ID NO: 9170789 - DNA, 22 bp, Homo sapiens
gaagcaaaatgtctgcacatat

SEQ ID NO: 9170790 - DNA, 22 bp, Homo sapiens
gaagcaaagagctagtgccgct

SEQ ID NO: 9170791 - DNA, 22 bp, Homo sapiens
gaaaggcaggcagggtgtccat

SEQ ID NO: 9170792 - DNA, 22 bp, Homo sapiens
gaaaggcaggcagggtgtccat

SEQ ID NO: 9170793 - DNA, 22 bp, Homo sapiens
gaagcagctaggatcttcattt

SEQ ID NO: 9170794 - DNA, 22 bp, Homo sapiens
gaagcagctaggatcttcattt

SEQ ID NO: 9170795 - DNA, 22 bp, Homo sapiens
gaagcagctagcccactagtca

SEQ ID NO: 9170796 - DNA, 22 bp, Homo sapiens
gaagcagccacggggagacaga

SEQ ID NO: 9170797 - DNA, 22 bp, Homo sapiens
gaagccaagccagctgatggag

SEQ ID NO: 9170798 - DNA, 22 bp, Homo sapiens
gaagccaacattccaagtagaa

SEQ ID NO: 9170799 - DNA, 21 bp, Homo sapiens
gaagccaagacaggatcaagg

SEQ ID NO: 9170800 - DNA, 22 bp, Homo sapiens
gaaaggagggctcacaaaagtg

SEQ ID NO: 9170801 - DNA, 22 bp, Homo sapiens
gaaaggagagggttaaggagct

SEQ ID NO: 9170802 - DNA, 22 bp, Homo sapiens
gaaaggagagggttaaggagct

SEQ ID NO: 9170803 - DNA, 17 bp, Homo sapiens
gaaaggaggcaacactg

SEQ ID NO: 9170804 - DNA, 17 bp, Homo sapiens
gaaaggaggcaacactg

SEQ ID NO: 9170805 - DNA, 22 bp, Homo sapiens
gaaaggaagaaaggtcatttta

SEQ ID NO: 9170806 - DNA, 22 bp, Homo sapiens
gaaaggaacttgtgagtgggag

SEQ ID NO: 9170807 - DNA, 22 bp, Homo sapiens
gaaaggaaattgagggacgcat

SEQ ID NO: 9170808 - DNA, 22 bp, Homo sapiens
gaaaggaaattgagggacgcat

SEQ ID NO: 9170809 - DNA, 22 bp, Homo sapiens
gaaaggaaatattctaagcact

SEQ ID NO: 9170810 - DNA, 22 bp, Homo sapiens
gaaaggaaatattctaagcact

SEQ ID NO: 9170811 - DNA, 23 bp, Homo sapiens
gaagccacacaaaggtcgccaag

SEQ ID NO: 9170812 - DNA, 22 bp, Homo sapiens
gaagccacaactttttcttagc

SEQ ID NO: 9170813 - DNA, 23 bp, Homo sapiens
gaagccacacaaaggtcgccaag

SEQ ID NO: 9170814 - DNA, 22 bp, Homo sapiens
gaagccaagtgcaaatgcctta

SEQ ID NO: 9170815 - DNA, 22 bp, Homo sapiens
gaagccacaactttttcttagc

SEQ ID NO: 9170816 - DNA, 22 bp, Homo sapiens
gaagccacagagattgtggggg

SEQ ID NO: 9170817 - DNA, 22 bp, Homo sapiens
gaagccacagggaaggagaaca

SEQ ID NO: 9170818 - DNA, 22 bp, Homo sapiens
gaagccacagagattgtggggg

SEQ ID NO: 9170819 - DNA, 22 bp, Homo sapiens
gaagccactatagatattctaa

SEQ ID NO: 9170820 - DNA, 22 bp, Homo sapiens
gaagccactatagatattctaa

SEQ ID NO: 9170821 - DNA, 22 bp, Homo sapiens
gaagccacgttaaattggctgt

SEQ ID NO: 9170822 - DNA, 22 bp, Homo sapiens
gaagccaccctccttccagccc

SEQ ID NO: 9170823 - DNA, 22 bp, Homo sapiens
gaagccaccctccttccagccc

SEQ ID NO: 9170824 - DNA, 20 bp, Homo sapiens
gaagccaccctcagattcca

SEQ ID NO: 9170825 - DNA, 22 bp, Homo sapiens
gaaggagagggtcaaggataat

SEQ ID NO: 9170826 - DNA, 20 bp, Homo sapiens
gaagccagaggggaaaggag

SEQ ID NO: 9170827 - DNA, 22 bp, Homo sapiens
gaagccactgtgagtggttcca

SEQ ID NO: 9170828 - DNA, 22 bp, Homo sapiens
gaagccactatagatattctaa

SEQ ID NO: 9170829 - DNA, 22 bp, Homo sapiens
gaaggagctaccaagactgaat

SEQ ID NO: 9170830 - DNA, 22 bp, Homo sapiens
gaaggcaccctccatcactcac

SEQ ID NO: 9170831 - DNA, 22 bp, Homo sapiens
gaaggcactgaactccttctgg

SEQ ID NO: 9170832 - DNA, 22 bp, Homo sapiens
gaaggcacccggcgtgcggcgg

SEQ ID NO: 9170833 - DNA, 22 bp, Homo sapiens
gaaggcacccggcgtgcggcgg

SEQ ID NO: 9170834 - DNA, 22 bp, Homo sapiens
gaaggcacagatggcagtccac

SEQ ID NO: 9170835 - DNA, 22 bp, Homo sapiens
gaaggcacagatggcagtccac

SEQ ID NO: 9170836 - DNA, 22 bp, Homo sapiens
gaaggcaaggagggaagccacc

SEQ ID NO: 9170837 - DNA, 22 bp, Homo sapiens
gaaggcaggtttttcaaaactg

SEQ ID NO: 9170838 - DNA, 22 bp, Homo sapiens
gaaggcactgaactccttctgg

SEQ ID NO: 9170839 - DNA, 22 bp, Homo sapiens
gaaggcactgaactccttctgg

SEQ ID NO: 9170840 - DNA, 22 bp, Homo sapiens
gaagggagaaggttgggtgacg

SEQ ID NO: 9170841 - DNA, 22 bp, Homo sapiens
gaagggagaaggttgggtgacg

SEQ ID NO: 9170842 - DNA, 22 bp, Homo sapiens
gaaggccattagagcctgtgcc

SEQ ID NO: 9170843 - DNA, 22 bp, Homo sapiens
gaaggccacaagagaagttaag

SEQ ID NO: 9170844 - DNA, 22 bp, Homo sapiens
gaaggccaagaggctccaagat

SEQ ID NO: 9170845 - DNA, 22 bp, Homo sapiens
gaaggcatttaggaactgcaat

SEQ ID NO: 9170846 - DNA, 22 bp, Homo sapiens
gaaggcatcacagaggctgtga

SEQ ID NO: 9170847 - DNA, 22 bp, Homo sapiens
gaaggcatcacagaggctgtgg

SEQ ID NO: 9170848 - DNA, 18 bp, Homo sapiens
gaaggcattcagtggctt

SEQ ID NO: 9170849 - DNA, 22 bp, Homo sapiens
gaaggcatctatgtgacctgga

SEQ ID NO: 9170850 - DNA, 22 bp, Homo sapiens
gaaggcatcagcaggcaccgat

SEQ ID NO: 9170851 - DNA, 21 bp, Homo sapiens
gacacagtaatcttggggctt

SEQ ID NO: 9170852 - DNA, 22 bp, Homo sapiens
gacacagtcaagagtggaggaa

SEQ ID NO: 9170853 - DNA, 22 bp, Homo sapiens
gacacagtggttctgtgagtaa

SEQ ID NO: 9170854 - DNA, 22 bp, Homo sapiens
gacactgtgctagctgggctta

SEQ ID NO: 9170855 - DNA, 22 bp, Homo sapiens
gacacttcacctttcccagcct

SEQ ID NO: 9170856 - DNA, 22 bp, Homo sapiens
gacactgtgctagctgggctta

SEQ ID NO: 9170857 - DNA, 22 bp, Homo sapiens
gacactgttatggtgaggtaag

SEQ ID NO: 9170858 - DNA, 22 bp, Homo sapiens
gaatgaataggtgtccagatgg

SEQ ID NO: 9170859 - DNA, 22 bp, Homo sapiens
gaatgacattgaaaagacattg

SEQ ID NO: 9170860 - DNA, 22 bp, Homo sapiens
gaatgagggagatgttggtgca

SEQ ID NO: 9170861 - DNA, 22 bp, Homo sapiens
gaatgaggtcatcttgtaatct

SEQ ID NO: 9170862 - DNA, 22 bp, Homo sapiens
gacagacaggggttctcctgga

SEQ ID NO: 9170863 - DNA, 22 bp, Homo sapiens
gacagacaggaggccacctgct

SEQ ID NO: 9170864 - DNA, 22 bp, Homo sapiens
gacagacaggaggccacctgct

SEQ ID NO: 9170865 - DNA, 22 bp, Homo sapiens
gacagacaggaggcattcaggg

SEQ ID NO: 9170866 - DNA, 22 bp, Homo sapiens
gacagacaggagctcacaggca

SEQ ID NO: 9170867 - DNA, 22 bp, Homo sapiens
gacactttctcaggtaaagcat

SEQ ID NO: 9170868 - DNA, 22 bp, Homo sapiens
gacactttattaagctgttgtt

SEQ ID NO: 9170869 - DNA, 22 bp, Homo sapiens
gacactttggtgctttgtggtt

SEQ ID NO: 9170870 - DNA, 22 bp, Homo sapiens
gacagacacaattgatccatga

SEQ ID NO: 9170871 - DNA, 22 bp, Homo sapiens
gaatatttgtaattactgttga

SEQ ID NO: 9170872 - DNA, 22 bp, Homo sapiens
gaatattttcagtacagatggt

SEQ ID NO: 9170873 - DNA, 22 bp, Homo sapiens
gaatccgtgtgatgtggactag

SEQ ID NO: 9170874 - DNA, 22 bp, Homo sapiens
gaatctggaagtgggcagtagg

SEQ ID NO: 9170875 - DNA, 22 bp, Homo sapiens
gaatcttaaatcggaatcttaa

SEQ ID NO: 9170876 - DNA, 22 bp, Homo sapiens
gaaggtccagcgtggccaagtc

SEQ ID NO: 9170877 - DNA, 22 bp, Homo sapiens
gaaggtcacctcccctctctgg

SEQ ID NO: 9170878 - DNA, 22 bp, Homo sapiens
gaagggtgcatggagggaagtc

SEQ ID NO: 9170879 - DNA, 22 bp, Homo sapiens
gaagggtgtgatttgcctgaga

SEQ ID NO: 9170880 - DNA, 22 bp, Homo sapiens
gaagggtgtgtgtgagggacac

SEQ ID NO: 9170881 - DNA, 22 bp, Homo sapiens
gaagggggaaaatgacaacaga

SEQ ID NO: 9170882 - DNA, 22 bp, Homo sapiens
gaagggtgcatggagggaagtc

SEQ ID NO: 9170883 - DNA, 22 bp, Homo sapiens
gaaggggactggcagctgcaga

SEQ ID NO: 9170884 - DNA, 22 bp, Homo sapiens
gaagggggaaaatgacaacaga

SEQ ID NO: 9170885 - DNA, 22 bp, Homo sapiens
gaaggggactggcagctgcaga

SEQ ID NO: 9170886 - DNA, 22 bp, Homo sapiens
gaagggctgcaggtctgggccc

SEQ ID NO: 9170887 - DNA, 18 bp, Homo sapiens
gaagggagctggaatgca

SEQ ID NO: 9170888 - DNA, 20 bp, Homo sapiens
gaagggatcactgcatactt

SEQ ID NO: 9170889 - DNA, 22 bp, Homo sapiens
gaagggctgcaggtctgggccc

SEQ ID NO: 9170890 - DNA, 22 bp, Homo sapiens
gaccaggcccaggtgcaaggga

SEQ ID NO: 9170891 - DNA, 22 bp, Homo sapiens
gaccaggcccaggtgcaaggga

SEQ ID NO: 9170892 - DNA, 22 bp, Homo sapiens
gactccaggtgtccaggcctcc

SEQ ID NO: 9170893 - DNA, 22 bp, Homo sapiens
gactccagtgattgtcctgtct

SEQ ID NO: 9170894 - DNA, 22 bp, Homo sapiens
gactcccctgggccccatccag

SEQ ID NO: 9170895 - DNA, 22 bp, Homo sapiens
gaccagaaggaaatgtgagcag

SEQ ID NO: 9170896 - DNA, 22 bp, Homo sapiens
gaccagaaatgattctccagct

SEQ ID NO: 9170897 - DNA, 22 bp, Homo sapiens
gaccactggggtgagggccatc

SEQ ID NO: 9170898 - DNA, 22 bp, Homo sapiens
gaccactggcgctgcgagaccc

SEQ ID NO: 9170899 - DNA, 22 bp, Homo sapiens
gaccactgaatgcacttctaat

SEQ ID NO: 9170900 - DNA, 22 bp, Homo sapiens
gaccactgatgacatgaggaga

SEQ ID NO: 9170901 - DNA, 22 bp, Homo sapiens
gaccacaggtatgggcttggca

SEQ ID NO: 9170902 - DNA, 21 bp, Homo sapiens
gaccacagggaaggtcttgca

SEQ ID NO: 9170903 - DNA, 22 bp, Homo sapiens
gacatttagctgttttgcattt

SEQ ID NO: 9170904 - DNA, 22 bp, Homo sapiens
gacatttagctgttttgcattt

SEQ ID NO: 9170905 - DNA, 22 bp, Homo sapiens
gactgaaggtctcagcatgtga

SEQ ID NO: 9170906 - DNA, 22 bp, Homo sapiens
gactgagaatcatagaaggcaa

SEQ ID NO: 9170907 - DNA, 22 bp, Homo sapiens
gactctgtgggaggaggctcag

SEQ ID NO: 9170908 - DNA, 22 bp, Homo sapiens
gactctccattagtctttggta

SEQ ID NO: 9170909 - DNA, 22 bp, Homo sapiens
gactcctgggcctctgagaggc

SEQ ID NO: 9170910 - DNA, 22 bp, Homo sapiens
gacagaggagaagatgctgtgg

SEQ ID NO: 9170911 - DNA, 22 bp, Homo sapiens
gacagcagacaaaccatgtttt

SEQ ID NO: 9170912 - DNA, 22 bp, Homo sapiens
gacagagaggctgagcagtaca

SEQ ID NO: 9170913 - DNA, 22 bp, Homo sapiens
gacagagaggctgagcagtaca

SEQ ID NO: 9170914 - DNA, 22 bp, Homo sapiens
gacagagcagcacccagcccct

SEQ ID NO: 9170915 - DNA, 22 bp, Homo sapiens
gacagagattgaatcaggaaat

SEQ ID NO: 9170916 - DNA, 22 bp, Homo sapiens
gacattgaatttgaatgtatgt

SEQ ID NO: 9170917 - DNA, 22 bp, Homo sapiens
gacattgaaaataatgtgtaga

SEQ ID NO: 9170918 - DNA, 22 bp, Homo sapiens
gacattgaacaagtttcctgac

SEQ ID NO: 9170919 - DNA, 22 bp, Homo sapiens
gacatttaaggcagtcacttaa

SEQ ID NO: 9170920 - DNA, 23 bp, Homo sapiens
gacattggctgtctgatgcaggg

SEQ ID NO: 9170921 - DNA, 22 bp, Homo sapiens
gacattgtggttattaaatgtt

SEQ ID NO: 9170922 - DNA, 22 bp, Homo sapiens
gacatttactgaatactgatta

SEQ ID NO: 9170923 - DNA, 22 bp, Homo sapiens
gacatttagaagttagattcaa

SEQ ID NO: 9170924 - DNA, 22 bp, Homo sapiens
gacatttactgaatactgatta

SEQ ID NO: 9170925 - DNA, 22 bp, Homo sapiens
gacagcagcataatacatgaac

SEQ ID NO: 9170926 - DNA, 22 bp, Homo sapiens
gacagcagcataatacatgaac

SEQ ID NO: 9170927 - DNA, 22 bp, Homo sapiens
gacattcaagtttgcagttagg

SEQ ID NO: 9170928 - DNA, 22 bp, Homo sapiens
gagaaagattgtccttcagggg

SEQ ID NO: 9170929 - DNA, 22 bp, Homo sapiens
gagaaagatgtaggctgggagg

SEQ ID NO: 9170930 - DNA, 22 bp, Homo sapiens
gagaaagatgtaggctgggagg

SEQ ID NO: 9170931 - DNA, 22 bp, Homo sapiens
gagaaagatggaatcttacagg

SEQ ID NO: 9170932 - DNA, 22 bp, Homo sapiens
gagaaagatggaatcttacagg

SEQ ID NO: 9170933 - DNA, 22 bp, Homo sapiens
gagaaagatggaatcttacagg

SEQ ID NO: 9170934 - DNA, 22 bp, Homo sapiens
gagaaagatgtaggctgggagg

SEQ ID NO: 9170935 - DNA, 22 bp, Homo sapiens
gagaaagatgtaggctgggagg

SEQ ID NO: 9170936 - DNA, 22 bp, Homo sapiens
gagaaagatgtaggctgggagg

SEQ ID NO: 9170937 - DNA, 22 bp, Homo sapiens
gagaaagatgtaggctgggagg

SEQ ID NO: 9170938 - DNA, 19 bp, Homo sapiens
gagaaagcaggcacagcac

SEQ ID NO: 9170939 - DNA, 22 bp, Homo sapiens
gagaaagattgtccttcagggg

SEQ ID NO: 9170940 - DNA, 22 bp, Homo sapiens
gagaaagattgtccttcagggg

SEQ ID NO: 9170941 - DNA, 23 bp, Homo sapiens
gagaaagccggctatgatcctgg

SEQ ID NO: 9170942 - DNA, 22 bp, Homo sapiens
gagaaagctaataggaatccta

SEQ ID NO: 9170943 - DNA, 22 bp, Homo sapiens
gagaaagcttcagaaatggcct

SEQ ID NO: 9170944 - DNA, 22 bp, Homo sapiens
gagaaaggcattcctatgcaaa

SEQ ID NO: 9170945 - DNA, 22 bp, Homo sapiens
gagaaaggcattcctatgcaaa

SEQ ID NO: 9170946 - DNA, 22 bp, Homo sapiens
gagacagatgctgctggagcat

SEQ ID NO: 9170947 - DNA, 22 bp, Homo sapiens
gagacagatgctgctggagcat

SEQ ID NO: 9170948 - DNA, 20 bp, Homo sapiens
gagacagcaaaagcctctcc

SEQ ID NO: 9170949 - DNA, 23 bp, Homo sapiens
gagaccagggccagctgtgtcat

SEQ ID NO: 9170950 - DNA, 22 bp, Homo sapiens
gagaaagaaagggaagtttgtt

SEQ ID NO: 9170951 - DNA, 22 bp, Homo sapiens
gagaaagaaagggaagtttgtt

SEQ ID NO: 9170952 - DNA, 22 bp, Homo sapiens
gagaaagaaagggaagtttgtt

SEQ ID NO: 9170953 - DNA, 22 bp, Homo sapiens
gagaaacttggagttattctgg

SEQ ID NO: 9170954 - DNA, 22 bp, Homo sapiens
gagaaactaacatctgaaggtg

SEQ ID NO: 9170955 - DNA, 22 bp, Homo sapiens
gagaaactaacatctgaaggtg

SEQ ID NO: 9170956 - DNA, 22 bp, Homo sapiens
gagaaagatggaatcttacagg

SEQ ID NO: 9170957 - DNA, 22 bp, Homo sapiens
gagaaagatgaagagtggcgtt

SEQ ID NO: 9170958 - DNA, 22 bp, Homo sapiens
gagaaagatgaagagtggcgtt

SEQ ID NO: 9170959 - DNA, 22 bp, Homo sapiens
gagaaagatgaagagtggcgtt

SEQ ID NO: 9170960 - DNA, 22 bp, Homo sapiens
gagaaagatgaagagtggcgtt

SEQ ID NO: 9170961 - DNA, 22 bp, Homo sapiens
gagaaagacgtaggctgggagg

SEQ ID NO: 9170962 - DNA, 22 bp, Homo sapiens
gagaaagacgtaggctgggagg

SEQ ID NO: 9170963 - DNA, 22 bp, Homo sapiens
gagaaagacgtaggctgggagg

SEQ ID NO: 9170964 - DNA, 22 bp, Homo sapiens
gagaaagacgtaggctgggagg

SEQ ID NO: 9170965 - DNA, 22 bp, Homo sapiens
gagaaagacgtaggctgggagg

SEQ ID NO: 9170966 - DNA, 22 bp, Homo sapiens
gagaaagacgtaggctgggagg

SEQ ID NO: 9170967 - DNA, 22 bp, Homo sapiens
gactgcctcagtttccctgcag

SEQ ID NO: 9170968 - DNA, 22 bp, Homo sapiens
gactgcagtaagcctcatgact

SEQ ID NO: 9170969 - DNA, 22 bp, Homo sapiens
gagaaacctgtaaggaaggaag

SEQ ID NO: 9170970 - DNA, 22 bp, Homo sapiens
gagagaaatgtgcagtttgggc

SEQ ID NO: 9170971 - DNA, 22 bp, Homo sapiens
gagagaaatgtgcagtttgggc

SEQ ID NO: 9170972 - DNA, 22 bp, Homo sapiens
gagagaaatgtgcagtttgggc

SEQ ID NO: 9170973 - DNA, 22 bp, Homo sapiens
gagagaaaggcttgcaggctgt

SEQ ID NO: 9170974 - DNA, 22 bp, Homo sapiens
gagagaaaggcttgcaggctgt

SEQ ID NO: 9170975 - DNA, 22 bp, Homo sapiens
gagagaaatgtgcagtttgggc

SEQ ID NO: 9170976 - DNA, 22 bp, Homo sapiens
gagagaaaggcttgcaggctgt

SEQ ID NO: 9170977 - DNA, 22 bp, Homo sapiens
gagagggcaaacttgtagctaa

SEQ ID NO: 9170978 - DNA, 18 bp, Homo sapiens
gagagggatccctcagga

SEQ ID NO: 9170979 - DNA, 22 bp, Homo sapiens
gagagggccgggggccagctcc

SEQ ID NO: 9170980 - DNA, 22 bp, Homo sapiens
gagagggctctgtgtgggtact

SEQ ID NO: 9170981 - DNA, 22 bp, Homo sapiens
gagagggctgcctggtgtgagg

SEQ ID NO: 9170982 - DNA, 22 bp, Homo sapiens
gagagggctctgtgtgggtact

SEQ ID NO: 9170983 - DNA, 22 bp, Homo sapiens
gagagggctctgtgtgggtact

SEQ ID NO: 9170984 - DNA, 21 bp, Homo sapiens
gagagggcattataggaagtg

SEQ ID NO: 9170985 - DNA, 22 bp, Homo sapiens
gagagggccagggtgagaacta

SEQ ID NO: 9170986 - DNA, 21 bp, Homo sapiens
gagagggcattataggaagtg

SEQ ID NO: 9170987 - DNA, 21 bp, Homo sapiens
gagagggcattataggaagtg

SEQ ID NO: 9170988 - DNA, 22 bp, Homo sapiens
gagacccaggggtctgctgccc

SEQ ID NO: 9170989 - DNA, 17 bp, Homo sapiens
gagacccccactacacc

SEQ ID NO: 9170990 - DNA, 22 bp, Homo sapiens
gagacctcttggtatcgctagg

SEQ ID NO: 9170991 - DNA, 22 bp, Homo sapiens
gagacggggccctggccaggcg

SEQ ID NO: 9170992 - DNA, 22 bp, Homo sapiens
gagacctcttggtatcgctagg

SEQ ID NO: 9170993 - DNA, 22 bp, Homo sapiens
gagacctcttggtatcgctagg

SEQ ID NO: 9170994 - DNA, 22 bp, Homo sapiens
gagactgggggcttggcctttt

SEQ ID NO: 9170995 - DNA, 22 bp, Homo sapiens
gagactgctggtaaagatggga

SEQ ID NO: 9170996 - DNA, 22 bp, Homo sapiens
gagactgctggtaaagatggga

SEQ ID NO: 9170997 - DNA, 22 bp, Homo sapiens
gagactgcattgtccaagggtt

SEQ ID NO: 9170998 - DNA, 22 bp, Homo sapiens
gagactgcatagatggccacaa

SEQ ID NO: 9170999 - DNA, 22 bp, Homo sapiens
gagacgtggcctttgcctgagc

SEQ ID NO: 9171000 - DNA, 22 bp, Homo sapiens
gagagaaaagggggaattgatt

SEQ ID NO: 9171001 - DNA, 22 bp, Homo sapiens
gagagaaagcccctgcatccct

SEQ ID NO: 9171002 - DNA, 22 bp, Homo sapiens
gagagaaaggataacagctcaa

SEQ ID NO: 9171003 - DNA, 22 bp, Homo sapiens
gagactggtgtttgctgggctg

SEQ ID NO: 9171004 - DNA, 20 bp, Homo sapiens
gagactggatctggagagac

SEQ ID NO: 9171005 - DNA, 22 bp, Homo sapiens
gagactgggggcttggcctttt

SEQ ID NO: 9171006 - DNA, 22 bp, Homo sapiens
gagactggtgtttgctgggctg

SEQ ID NO: 9171007 - DNA, 22 bp, Homo sapiens
gagactggtgtttgctgggctg

SEQ ID NO: 9171008 - DNA, 22 bp, Homo sapiens
gaggctgccaatgtgtgcatgt

SEQ ID NO: 9171009 - DNA, 22 bp, Homo sapiens
gaggctgcagctatcagacatt

SEQ ID NO: 9171010 - DNA, 22 bp, Homo sapiens
gaggctgagtagctttgtgctc

SEQ ID NO: 9171011 - DNA, 22 bp, Homo sapiens
gaggctgatgctgcctcacaga

SEQ ID NO: 9171012 - DNA, 22 bp, Homo sapiens
gaggctgattcggggaacagca

SEQ ID NO: 9171013 - DNA, 22 bp, Homo sapiens
gaggctgattcggggaacagca

SEQ ID NO: 9171014 - DNA, 22 bp, Homo sapiens
gaggctgaggttgcagtgagcc

SEQ ID NO: 9171015 - DNA, 22 bp, Homo sapiens
gaggctgaggttgcagtgagcc

SEQ ID NO: 9171016 - DNA, 22 bp, Homo sapiens
gaggctgaggttgcagtgagcc

SEQ ID NO: 9171017 - DNA, 22 bp, Homo sapiens
gaggctgaggttgcagtgagct

SEQ ID NO: 9171018 - DNA, 22 bp, Homo sapiens
gaggctgaggttgcagtgagct

SEQ ID NO: 9171019 - DNA, 22 bp, Homo sapiens
gaggctgaggttgcagtgagct

SEQ ID NO: 9171020 - DNA, 22 bp, Homo sapiens
gaggctgagggttagagagtca

SEQ ID NO: 9171021 - DNA, 22 bp, Homo sapiens
gaggctgagggttagagagtca

SEQ ID NO: 9171022 - DNA, 22 bp, Homo sapiens
gaggctgaggcaggaggatcac

SEQ ID NO: 9171023 - DNA, 22 bp, Homo sapiens
gaggctgaggcggatggatcac

SEQ ID NO: 9171024 - DNA, 22 bp, Homo sapiens
gagggaggggagctccaccctc

SEQ ID NO: 9171025 - DNA, 22 bp, Homo sapiens
gagggagggccaggtcccaacc

SEQ ID NO: 9171026 - DNA, 22 bp, Homo sapiens
gagggagggccaggtcccaacc

SEQ ID NO: 9171027 - DNA, 22 bp, Homo sapiens
gagggagggaaagtttaacact

SEQ ID NO: 9171028 - DNA, 22 bp, Homo sapiens
gagggagggactagcattctct

SEQ ID NO: 9171029 - DNA, 22 bp, Homo sapiens
gagggaggcatcatgaatccag

SEQ ID NO: 9171030 - DNA, 22 bp, Homo sapiens
gagggagcttgatggatgtttg

SEQ ID NO: 9171031 - DNA, 22 bp, Homo sapiens
gagggagctggagcagacgccg

SEQ ID NO: 9171032 - DNA, 22 bp, Homo sapiens
gagggagctatgaatagaagaa

SEQ ID NO: 9171033 - DNA, 22 bp, Homo sapiens
gagggagctatgaatagaagaa

SEQ ID NO: 9171034 - DNA, 22 bp, Homo sapiens
gagggagccgccacagactggg

SEQ ID NO: 9171035 - DNA, 22 bp, Homo sapiens
gagggctgctggaaaaatgcag

SEQ ID NO: 9171036 - DNA, 22 bp, Homo sapiens
gagggctgctggaaaaatgcag

SEQ ID NO: 9171037 - DNA, 22 bp, Homo sapiens
gagggctggggcttaggcttag

SEQ ID NO: 9171038 - DNA, 22 bp, Homo sapiens
gagggctgtgaaggagcgggtt

SEQ ID NO: 9171039 - DNA, 22 bp, Homo sapiens
gagggctgtgaaggagcgggtt

SEQ ID NO: 9171040 - DNA, 22 bp, Homo sapiens
gagggctgtggggcatgaccag

SEQ ID NO: 9171041 - DNA, 22 bp, Homo sapiens
gagggctgtgaaggagcgggtt

SEQ ID NO: 9171042 - DNA, 22 bp, Homo sapiens
gagggctgtggggcatgaccag

SEQ ID NO: 9171043 - DNA, 22 bp, Homo sapiens
gagggcttccatggggagcccc

SEQ ID NO: 9171044 - DNA, 22 bp, Homo sapiens
gaggggctgccctggtgtcagg

SEQ ID NO: 9171045 - DNA, 19 bp, Homo sapiens
gagggcttgatggacccga

SEQ ID NO: 9171046 - DNA, 22 bp, Homo sapiens
gagggcttgtaagtgggtggag

SEQ ID NO: 9171047 - DNA, 22 bp, Homo sapiens
gaggggaaagtgtgaggctgcg

SEQ ID NO: 9171048 - DNA, 22 bp, Homo sapiens
gaggggctggcacgatggctgc

SEQ ID NO: 9171049 - DNA, 22 bp, Homo sapiens
gagggctgcaatgagacagaga

SEQ ID NO: 9171050 - DNA, 22 bp, Homo sapiens
gagggctgcaatgagacagaga

SEQ ID NO: 9171051 - DNA, 22 bp, Homo sapiens
gagggctgcaatgagacagaga

SEQ ID NO: 9171052 - DNA, 22 bp, Homo sapiens
gagggctgatgttgccacctca

SEQ ID NO: 9171053 - DNA, 22 bp, Homo sapiens
gagggctgccacgttgggcgag

SEQ ID NO: 9171054 - DNA, 22 bp, Homo sapiens
gagggctgctgccagatatgcc

SEQ ID NO: 9171055 - DNA, 22 bp, Homo sapiens
gagggctgctggaaaaatgcag

SEQ ID NO: 9171056 - DNA, 22 bp, Homo sapiens
gagggctgctgccagatatgcc

SEQ ID NO: 9171057 - DNA, 22 bp, Homo sapiens
gagggctgctgccagatatgcc

SEQ ID NO: 9171058 - DNA, 22 bp, Homo sapiens
gagggagtgagacacaaaagaa

SEQ ID NO: 9171059 - DNA, 22 bp, Homo sapiens
gagggagtctgtgcaaagaatt

SEQ ID NO: 9171060 - DNA, 18 bp, Homo sapiens
gagggagtagctgaggtt

SEQ ID NO: 9171061 - DNA, 22 bp, Homo sapiens
gagggagtgccagagggccagc

SEQ ID NO: 9171062 - DNA, 22 bp, Homo sapiens
gagggaggtgatactgaacgta

SEQ ID NO: 9171063 - DNA, 22 bp, Homo sapiens
gagggaggtgatactgaacgta

SEQ ID NO: 9171064 - DNA, 22 bp, Homo sapiens
gagggagtaacgtactacagtg

SEQ ID NO: 9171065 - DNA, 18 bp, Homo sapiens
gagggagtagctgaggtt

SEQ ID NO: 9171066 - DNA, 22 bp, Homo sapiens
gagggagtaacgtactacagtg

SEQ ID NO: 9171067 - DNA, 18 bp, Homo sapiens
gagggagtagctgaggtt

SEQ ID NO: 9171068 - DNA, 22 bp, Homo sapiens
gaggcaggcagattgcttgagg

SEQ ID NO: 9171069 - DNA, 22 bp, Homo sapiens
gaggcaggaggattgcttgagc

SEQ ID NO: 9171070 - DNA, 22 bp, Homo sapiens
gaggcaggcactgttatcagca

SEQ ID NO: 9171071 - DNA, 22 bp, Homo sapiens
gaggcaggcactgttatcagca

SEQ ID NO: 9171072 - DNA, 22 bp, Homo sapiens
gaggagcccagcaccatcactt

SEQ ID NO: 9171073 - DNA, 22 bp, Homo sapiens
gaggagcccagcaccatcactt

SEQ ID NO: 9171074 - DNA, 22 bp, Homo sapiens
gaggagccatagatagtgctgc

SEQ ID NO: 9171075 - DNA, 22 bp, Homo sapiens
gaggagccaggaggtctccctg

SEQ ID NO: 9171076 - DNA, 22 bp, Homo sapiens
gaggagccatagatagtgctgc

SEQ ID NO: 9171077 - DNA, 22 bp, Homo sapiens
gaggagcccccactgggctcac

SEQ ID NO: 9171078 - DNA, 16 bp, Homo sapiens
gaggagcccctctgcc

SEQ ID NO: 9171079 - DNA, 22 bp, Homo sapiens
gaggcagcttagggtactgact

SEQ ID NO: 9171080 - DNA, 22 bp, Homo sapiens
gaggcagcttggggctgtgggt

SEQ ID NO: 9171081 - DNA, 22 bp, Homo sapiens
gaggagaggggctcccaagagc

SEQ ID NO: 9171082 - DNA, 22 bp, Homo sapiens
gaggagcacatgaggctgaggg

SEQ ID NO: 9171083 - DNA, 22 bp, Homo sapiens
gaggagcacatgaggctgaggg

SEQ ID NO: 9171084 - DNA, 22 bp, Homo sapiens
gaggagcacatgaggctgaggg

SEQ ID NO: 9171085 - DNA, 20 bp, Homo sapiens
gaggagccaccttgagctgg

SEQ ID NO: 9171086 - DNA, 20 bp, Homo sapiens
gaggagccaccttgagctgg

SEQ ID NO: 9171087 - DNA, 22 bp, Homo sapiens
gaggagccaaggtatgtgtgtt

SEQ ID NO: 9171088 - DNA, 20 bp, Homo sapiens
gaggagccaccttgagctgg

SEQ ID NO: 9171089 - DNA, 22 bp, Homo sapiens
gaggagccaaggtatgtgtgtt

SEQ ID NO: 9171090 - DNA, 22 bp, Homo sapiens
gaggagccaaggtatgtgtgtt

SEQ ID NO: 9171091 - DNA, 22 bp, Homo sapiens
gaggagcacatgaggctgaggg

SEQ ID NO: 9171092 - DNA, 22 bp, Homo sapiens
gaggagcatgggaaggctctgg

SEQ ID NO: 9171093 - DNA, 22 bp, Homo sapiens
gaggagagatggtagattgggt

SEQ ID NO: 9171094 - DNA, 22 bp, Homo sapiens
gaggcaggccctgaatgagtca

SEQ ID NO: 9171095 - DNA, 22 bp, Homo sapiens
gaggcagggtgttgattacaga

SEQ ID NO: 9171096 - DNA, 19 bp, Homo sapiens
gaggcagtagtcaaagctt

SEQ ID NO: 9171097 - DNA, 19 bp, Homo sapiens
gaggcagtagtcaaagctt

SEQ ID NO: 9171098 - DNA, 22 bp, Homo sapiens
gaggcagtggtctgatgcaagg

SEQ ID NO: 9171099 - DNA, 22 bp, Homo sapiens
gaggcagtatagtcattaagta

SEQ ID NO: 9171100 - DNA, 22 bp, Homo sapiens
gaggcagttcctgagtgacaag

SEQ ID NO: 9171101 - DNA, 22 bp, Homo sapiens
gaggcagtttgccatgccagga

SEQ ID NO: 9171102 - DNA, 22 bp, Homo sapiens
gaggcataaatcacagtgttca

SEQ ID NO: 9171103 - DNA, 22 bp, Homo sapiens
gaggcataaatcacagtgttca

SEQ ID NO: 9171104 - DNA, 22 bp, Homo sapiens
gaggctcacctagggagcactg

SEQ ID NO: 9171105 - DNA, 22 bp, Homo sapiens
gaggctcagagaggtccacata

SEQ ID NO: 9171106 - DNA, 22 bp, Homo sapiens
gaggctcagagaggtccacata

SEQ ID NO: 9171107 - DNA, 22 bp, Homo sapiens
gaggctgaacaggttctcatga

SEQ ID NO: 9171108 - DNA, 22 bp, Homo sapiens
gaggctgagagtttgttctact

SEQ ID NO: 9171109 - DNA, 22 bp, Homo sapiens
gaggctgagactctgaattttt

SEQ ID NO: 9171110 - DNA, 22 bp, Homo sapiens
gaggctgacggcaccatcttct

SEQ ID NO: 9171111 - DNA, 22 bp, Homo sapiens
gaggctgaatggccagaagcca

SEQ ID NO: 9171112 - DNA, 22 bp, Homo sapiens
gaggctgaatggccagaagcca

SEQ ID NO: 9171113 - DNA, 22 bp, Homo sapiens
gaggctgaatggccagaagcca

SEQ ID NO: 9171114 - DNA, 22 bp, Homo sapiens
gaggctgaagtgtacatgggtg

SEQ ID NO: 9171115 - DNA, 20 bp, Homo sapiens
gaggctgaagtgtttttgct

SEQ ID NO: 9171116 - DNA, 18 bp, Homo sapiens
gagccctgggagatctct

SEQ ID NO: 9171117 - DNA, 22 bp, Homo sapiens
gagccctgtagcaagtcatgtc

SEQ ID NO: 9171118 - DNA, 22 bp, Homo sapiens
gagccctgtagcaagtcatgtc

SEQ ID NO: 9171119 - DNA, 22 bp, Homo sapiens
gagccctgtaggaatctctcaa

SEQ ID NO: 9171120 - DNA, 22 bp, Homo sapiens
gagccctgtagcaagtcatgtc

SEQ ID NO: 9171121 - DNA, 22 bp, Homo sapiens
gagccctgtagcaagtcatgtc

SEQ ID NO: 9171122 - DNA, 22 bp, Homo sapiens
gagccctgtgattctgttgtgt

SEQ ID NO: 9171123 - DNA, 22 bp, Homo sapiens
gagccctgttcaggcctcctca

SEQ ID NO: 9171124 - DNA, 22 bp, Homo sapiens
gagccctgtgattctgttgtgt

SEQ ID NO: 9171125 - DNA, 22 bp, Homo sapiens
gagccctgttcaggcctcctca

SEQ ID NO: 9171126 - DNA, 22 bp, Homo sapiens
gagctgagatcatgtacactag

SEQ ID NO: 9171127 - DNA, 22 bp, Homo sapiens
gagctgagatcgtgccattgca

SEQ ID NO: 9171128 - DNA, 22 bp, Homo sapiens
gagccctgcggagccccgaggc

SEQ ID NO: 9171129 - DNA, 22 bp, Homo sapiens
gagccctgagagttgtgaggcc

SEQ ID NO: 9171130 - DNA, 18 bp, Homo sapiens
gagccctgagtctgcaca

SEQ ID NO: 9171131 - DNA, 22 bp, Homo sapiens
gagccctggcagtctgggatgg

SEQ ID NO: 9171132 - DNA, 22 bp, Homo sapiens
gagccctgctgggccttgtctc

SEQ ID NO: 9171133 - DNA, 22 bp, Homo sapiens
gagccctgcggagccccgaggc

SEQ ID NO: 9171134 - DNA, 22 bp, Homo sapiens
gagccctgcgtgtctgggggca

SEQ ID NO: 9171135 - DNA, 22 bp, Homo sapiens
gagctgaggctcaggctggcgt

SEQ ID NO: 9171136 - DNA, 22 bp, Homo sapiens
gagctgaggctcaggctggcgt

SEQ ID NO: 9171137 - DNA, 22 bp, Homo sapiens
gagctgaggccagagtcttctg

SEQ ID NO: 9171138 - DNA, 22 bp, Homo sapiens
gagctgaggctgaggcctcact

SEQ ID NO: 9171139 - DNA, 22 bp, Homo sapiens
gagctgagcctgggtggaccgc

SEQ ID NO: 9171140 - DNA, 22 bp, Homo sapiens
gagctgagcttaactccttgaa

SEQ ID NO: 9171141 - DNA, 22 bp, Homo sapiens
gagctgaggatacatcagtgaa

SEQ ID NO: 9171142 - DNA, 22 bp, Homo sapiens
gagctgagatttgaagcaagtt

SEQ ID NO: 9171143 - DNA, 22 bp, Homo sapiens
gagctgagatttgaagcaagtt

SEQ ID NO: 9171144 - DNA, 22 bp, Homo sapiens
gagctgagcagggagcctcact

SEQ ID NO: 9171145 - DNA, 22 bp, Homo sapiens
gagctgcctgaacaagcagcag

SEQ ID NO: 9171146 - DNA, 22 bp, Homo sapiens
gagctgcctacattgccaagag

SEQ ID NO: 9171147 - DNA, 23 bp, Homo sapiens
gagctgagtgtagggagactagg

SEQ ID NO: 9171148 - DNA, 22 bp, Homo sapiens
gagctgagtatgaaggatgtga

SEQ ID NO: 9171149 - DNA, 22 bp, Homo sapiens
gagctgagtctgcagtcgccat

SEQ ID NO: 9171150 - DNA, 22 bp, Homo sapiens
gagctgagtatcccactgaagt

SEQ ID NO: 9171151 - DNA, 22 bp, Homo sapiens
gagctgagtagaggctgctccc

SEQ ID NO: 9171152 - DNA, 22 bp, Homo sapiens
gagctgagtagaggctgctccc

SEQ ID NO: 9171153 - DNA, 22 bp, Homo sapiens
gagctgaggtgatgtggtcgtt

SEQ ID NO: 9171154 - DNA, 22 bp, Homo sapiens
gagctgagggtctaggagggtt

SEQ ID NO: 9171155 - DNA, 18 bp, Homo sapiens
gaggaaacaggctctgtg

SEQ ID NO: 9171156 - DNA, 18 bp, Homo sapiens
gaggaaacaaggcagagg

SEQ ID NO: 9171157 - DNA, 18 bp, Homo sapiens
gaggaaacaaggcagagg

SEQ ID NO: 9171158 - DNA, 22 bp, Homo sapiens
gaggaaacattgtagaagcagt

SEQ ID NO: 9171159 - DNA, 22 bp, Homo sapiens
gaggaaagaaccccagtcaata

SEQ ID NO: 9171160 - DNA, 23 bp, Homo sapiens
gaggaaagaatatagatgcaatc

SEQ ID NO: 9171161 - DNA, 23 bp, Homo sapiens
gaggaaagaatatagatgcaatc

SEQ ID NO: 9171162 - DNA, 23 bp, Homo sapiens
gaggaaagaatatagatgcaatc

SEQ ID NO: 9171163 - DNA, 22 bp, Homo sapiens
gaggaaagctggtttaaagtat

SEQ ID NO: 9171164 - DNA, 22 bp, Homo sapiens
gagctgcctgtgtgccatgatg

SEQ ID NO: 9171165 - DNA, 22 bp, Homo sapiens
gagctgcctgttgcatagcaac

SEQ ID NO: 9171166 - DNA, 19 bp, Homo sapiens
gagctgccttttgaagacc

SEQ ID NO: 9171167 - DNA, 22 bp, Homo sapiens
gagctgctggatatgtggcctg

SEQ ID NO: 9171168 - DNA, 22 bp, Homo sapiens
gaggaaaatggagtgtaattaa

SEQ ID NO: 9171169 - DNA, 22 bp, Homo sapiens
gaggaaaatggagtgtaattaa

SEQ ID NO: 9171170 - DNA, 22 bp, Homo sapiens
gaggaaaatggagtgtaattaa

SEQ ID NO: 9171171 - DNA, 22 bp, Homo sapiens
gaggaaaatgggacaggctgta

SEQ ID NO: 9171172 - DNA, 22 bp, Homo sapiens
gaggaaaatgggacaggctgta

SEQ ID NO: 9171173 - DNA, 22 bp, Homo sapiens
gagctgctgtgaggggagcttc

SEQ ID NO: 9171174 - DNA, 22 bp, Homo sapiens
gaggaagaaagcataggtgggg

SEQ ID NO: 9171175 - DNA, 22 bp, Homo sapiens
gaggaaccactctgagaagcca

SEQ ID NO: 9171176 - DNA, 22 bp, Homo sapiens
gaggaacagcagccacatgtcc

SEQ ID NO: 9171177 - DNA, 22 bp, Homo sapiens
gaggaacatgaggtgacctggg

SEQ ID NO: 9171178 - DNA, 22 bp, Homo sapiens
gaggaaccaaatcagcttgcac

SEQ ID NO: 9171179 - DNA, 22 bp, Homo sapiens
gaggaaagagtcaaatctgaag

SEQ ID NO: 9171180 - DNA, 22 bp, Homo sapiens
gaggaacagagggcaaggccag

SEQ ID NO: 9171181 - DNA, 22 bp, Homo sapiens
gaggaagaatcagggtggtgag

SEQ ID NO: 9171182 - DNA, 22 bp, Homo sapiens
gaggaagaagcaaaccagctaa

SEQ ID NO: 9171183 - DNA, 22 bp, Homo sapiens
gaggaagaagcaaaccagctaa

SEQ ID NO: 9171184 - DNA, 22 bp, Homo sapiens
gaggaagaagcaaaccagctaa

SEQ ID NO: 9171185 - DNA, 22 bp, Homo sapiens
gaggaagaagcaaaccagctaa

SEQ ID NO: 9171186 - DNA, 22 bp, Homo sapiens
gaggaagaagggattagaactc

SEQ ID NO: 9171187 - DNA, 22 bp, Homo sapiens
gaggaagaagggattagaactc

SEQ ID NO: 9171188 - DNA, 22 bp, Homo sapiens
gaggaagaagcaaaccagctaa

SEQ ID NO: 9171189 - DNA, 22 bp, Homo sapiens
gagcccaggaagtggaggctga

SEQ ID NO: 9171190 - DNA, 22 bp, Homo sapiens
gagcccaggaagtggaggctga

SEQ ID NO: 9171191 - DNA, 22 bp, Homo sapiens
gagcccaggagtttgatgctgc

SEQ ID NO: 9171192 - DNA, 22 bp, Homo sapiens
gagcccagctgcggccctcagc

SEQ ID NO: 9171193 - DNA, 22 bp, Homo sapiens
gagcccagctgtccttggcaaa

SEQ ID NO: 9171194 - DNA, 22 bp, Homo sapiens
gagcccagcttgcacatggagc

SEQ ID NO: 9171195 - DNA, 22 bp, Homo sapiens
gagcccagctctacctcagact

SEQ ID NO: 9171196 - DNA, 22 bp, Homo sapiens
gagcccagctaaatttatataa

SEQ ID NO: 9171197 - DNA, 22 bp, Homo sapiens
gagcccagcccagagccatatg

SEQ ID NO: 9171198 - DNA, 22 bp, Homo sapiens
gagcccagattggaatttccca

SEQ ID NO: 9171199 - DNA, 22 bp, Homo sapiens
gagccaggtttgaatctcagtc

SEQ ID NO: 9171200 - DNA, 22 bp, Homo sapiens
gagcatggttccataggttggt

SEQ ID NO: 9171201 - DNA, 22 bp, Homo sapiens
gagcatggttccataggttggt

SEQ ID NO: 9171202 - DNA, 22 bp, Homo sapiens
gagcccagggtgaaatagcagc

SEQ ID NO: 9171203 - DNA, 22 bp, Homo sapiens
gagcccagtaggcaaagctgca

SEQ ID NO: 9171204 - DNA, 22 bp, Homo sapiens
gagcccaggttctgcttccagc

SEQ ID NO: 9171205 - DNA, 22 bp, Homo sapiens
gagcccagtaggcaaagctgca

SEQ ID NO: 9171206 - DNA, 22 bp, Homo sapiens
gagccctgagagttgtgaggcc

SEQ ID NO: 9171207 - DNA, 22 bp, Homo sapiens
gagccctgacactgagggagtt

SEQ ID NO: 9171208 - DNA, 22 bp, Homo sapiens
gagcccaggcagaggttgcagt

SEQ ID NO: 9171209 - DNA, 21 bp, Homo sapiens
gagcccaggcatctcattaat

SEQ ID NO: 9171210 - DNA, 22 bp, Homo sapiens
gagcccaggagtttgatgctgc

SEQ ID NO: 9171211 - DNA, 22 bp, Homo sapiens
gagcccaggcagaggttgcagt

SEQ ID NO: 9171212 - DNA, 22 bp, Homo sapiens
gagcccaggctggggttcagag

SEQ ID NO: 9171213 - DNA, 22 bp, Homo sapiens
gagcccaggctggggttcagag

SEQ ID NO: 9171214 - DNA, 22 bp, Homo sapiens
gagcccagggcaggcaaggcag

SEQ ID NO: 9171215 - DNA, 22 bp, Homo sapiens
gagcccagggtgaaatagcagc

SEQ ID NO: 9171216 - DNA, 22 bp, Homo sapiens
gagcagttgggctctaggaagt

SEQ ID NO: 9171217 - DNA, 22 bp, Homo sapiens
gagcagttctccttggtagggg

SEQ ID NO: 9171218 - DNA, 22 bp, Homo sapiens
gagcagtggttgaacagaggca

SEQ ID NO: 9171219 - DNA, 22 bp, Homo sapiens
gagcagtgtttgtggacctgga

SEQ ID NO: 9171220 - DNA, 22 bp, Homo sapiens
gagcagtggtcacagggaggga

SEQ ID NO: 9171221 - DNA, 22 bp, Homo sapiens
gagcagtgggaaggaacagggt

SEQ ID NO: 9171222 - DNA, 22 bp, Homo sapiens
gagcagtggtctgatcttctaa

SEQ ID NO: 9171223 - DNA, 22 bp, Homo sapiens
gagcagtggtcacagggaggga

SEQ ID NO: 9171224 - DNA, 22 bp, Homo sapiens
gagcatggatcatgtgctgggt

SEQ ID NO: 9171225 - DNA, 22 bp, Homo sapiens
gagcatggatagaaggtgggat

SEQ ID NO: 9171226 - DNA, 21 bp, Homo sapiens
gagcatggcttacatcagcag

SEQ ID NO: 9171227 - DNA, 22 bp, Homo sapiens
gagcatggctgcctccctgtgc

SEQ ID NO: 9171228 - DNA, 22 bp, Homo sapiens
gagcatggctgcctccctgtgc

SEQ ID NO: 9171229 - DNA, 22 bp, Homo sapiens
gagcatggcagctgagggcagg

SEQ ID NO: 9171230 - DNA, 22 bp, Homo sapiens
gagcatggtgcttcagtgaagg

SEQ ID NO: 9171231 - DNA, 16 bp, Homo sapiens
gagcatggtggcgggc

SEQ ID NO: 9171232 - DNA, 18 bp, Homo sapiens
gagcatgggcagtgggga

SEQ ID NO: 9171233 - DNA, 18 bp, Homo sapiens
gagcatgggcagtgggga

SEQ ID NO: 9171234 - DNA, 22 bp, Homo sapiens
gagaggggcccaagccacatag

SEQ ID NO: 9171235 - DNA, 22 bp, Homo sapiens
gagaggggcccaagccacatag

SEQ ID NO: 9171236 - DNA, 22 bp, Homo sapiens
gagaggggcgcgcagctcgcga

SEQ ID NO: 9171237 - DNA, 22 bp, Homo sapiens
gagaggggcgcgcagctcgcga

SEQ ID NO: 9171238 - DNA, 22 bp, Homo sapiens
gagagggctgcctggtgtgagg

SEQ ID NO: 9171239 - DNA, 22 bp, Homo sapiens
gagagggctgcctggtgtgagg

SEQ ID NO: 9171240 - DNA, 22 bp, Homo sapiens
gagagggtgcctggaagccagg

SEQ ID NO: 9171241 - DNA, 22 bp, Homo sapiens
gagcaggcttgcagagaagggg

SEQ ID NO: 9171242 - DNA, 22 bp, Homo sapiens
gagcaggcttgcagagaagggg

SEQ ID NO: 9171243 - DNA, 22 bp, Homo sapiens
gagcagtgatgggaggacgtca

SEQ ID NO: 9171244 - DNA, 22 bp, Homo sapiens
gagcagtgagtgaatgttgcct

SEQ ID NO: 9171245 - DNA, 20 bp, Homo sapiens
gagcagtgagccagggaaag

SEQ ID NO: 9171246 - DNA, 19 bp, Homo sapiens
gagcagtgaggaccaccag

SEQ ID NO: 9171247 - DNA, 20 bp, Homo sapiens
gagcagtgagccagggaaag

SEQ ID NO: 9171248 - DNA, 22 bp, Homo sapiens
gagcagggagacaactctggtg

SEQ ID NO: 9171249 - DNA, 22 bp, Homo sapiens
ctgctgtgtggtgaaactcagt

SEQ ID NO: 9171250 - DNA, 22 bp, Homo sapiens
ctgctgtgtggattcaatggct

SEQ ID NO: 9171251 - DNA, 22 bp, Homo sapiens
ctgctgtgcacccaggaaggct

SEQ ID NO: 9171252 - DNA, 22 bp, Homo sapiens
ctgctgtgcacccaggaaggct

SEQ ID NO: 9171253 - DNA, 22 bp, Homo sapiens
ctgctgtgcacccaggaaggct

SEQ ID NO: 9171254 - DNA, 22 bp, Homo sapiens
ctgctgtgcaacattgcaccta

SEQ ID NO: 9171255 - DNA, 22 bp, Homo sapiens
ctgctgtgattgggagaaaccg

SEQ ID NO: 9171256 - DNA, 22 bp, Homo sapiens
ctgctgtgttgccagtgtcacc

SEQ ID NO: 9171257 - DNA, 22 bp, Homo sapiens
ctgctgtgttcctcctgcatct

SEQ ID NO: 9171258 - DNA, 20 bp, Homo sapiens
ctgctgtgtgtgcctcagcc

SEQ ID NO: 9171259 - DNA, 20 bp, Homo sapiens
ctgctgtgtgtgcctcagcc

SEQ ID NO: 9171260 - DNA, 22 bp, Homo sapiens
ctgctgtgttagcaggtttagt

SEQ ID NO: 9171261 - DNA, 20 bp, Homo sapiens
ctgctgtgttattgtagaac

SEQ ID NO: 9171262 - DNA, 23 bp, Homo sapiens
ctgctgttttctgtacctgaagc

SEQ ID NO: 9171263 - DNA, 22 bp, Homo sapiens
ctgcttatggaattgtatactg

SEQ ID NO: 9171264 - DNA, 22 bp, Homo sapiens
ctgcttcaaggaaatgaatcgg

SEQ ID NO: 9171265 - DNA, 22 bp, Homo sapiens
ctgctgttctgaagcaacaagc

SEQ ID NO: 9171266 - DNA, 22 bp, Homo sapiens
ctgctgtgtttcacacctctgg

SEQ ID NO: 9171267 - DNA, 22 bp, Homo sapiens
ctgctgtgtttctgctagaaaa

SEQ ID NO: 9171268 - DNA, 22 bp, Homo sapiens
ctgctgtgttggcattggatag

SEQ ID NO: 9171269 - DNA, 23 bp, Homo sapiens
ctgctgtgttggtctcgatggga

SEQ ID NO: 9171270 - DNA, 22 bp, Homo sapiens
ctgggacagagcagcagtgggg

SEQ ID NO: 9171271 - DNA, 22 bp, Homo sapiens
ctgggacagagcagcagtgggg

SEQ ID NO: 9171272 - DNA, 22 bp, Homo sapiens
ctgggacacgttgtgctttaac

SEQ ID NO: 9171273 - DNA, 22 bp, Homo sapiens
ctgggacacgttgtgctttaac

SEQ ID NO: 9171274 - DNA, 22 bp, Homo sapiens
ctgggacacgttctattccaaa

SEQ ID NO: 9171275 - DNA, 22 bp, Homo sapiens
ctgggacagagcagcagtgggg

SEQ ID NO: 9171276 - DNA, 22 bp, Homo sapiens
ctgggacacccagagctgcaga

SEQ ID NO: 9171277 - DNA, 22 bp, Homo sapiens
ctgggacacccaaggaaagagc

SEQ ID NO: 9171278 - DNA, 22 bp, Homo sapiens
ctgggaagaatccaagggccct

SEQ ID NO: 9171279 - DNA, 22 bp, Homo sapiens
ctgggaagaagtgggctacatt

SEQ ID NO: 9171280 - DNA, 22 bp, Homo sapiens
ctgggaagaagtgggctacatt

SEQ ID NO: 9171281 - DNA, 22 bp, Homo sapiens
ctgggaagaaattgtgggaggc

SEQ ID NO: 9171282 - DNA, 22 bp, Homo sapiens
ctgggaagaagtgggctacatt

SEQ ID NO: 9171283 - DNA, 22 bp, Homo sapiens
ctgggaagaagggacaacagcg

SEQ ID NO: 9171284 - DNA, 22 bp, Homo sapiens
ctgcttcaccctgcctgagaac

SEQ ID NO: 9171285 - DNA, 22 bp, Homo sapiens
ctgcttcacgttgtgccttgtt

SEQ ID NO: 9171286 - DNA, 22 bp, Homo sapiens
ctgcttcatgtcctgggacctg

SEQ ID NO: 9171287 - DNA, 22 bp, Homo sapiens
ctgcttcatatttcatagtgat

SEQ ID NO: 9171288 - DNA, 20 bp, Homo sapiens
ctgcttccaggctcaccccc

SEQ ID NO: 9171289 - DNA, 22 bp, Homo sapiens
ctgggagattgaggccatggtg

SEQ ID NO: 9171290 - DNA, 22 bp, Homo sapiens
ctgggagattgaggccatggtg

SEQ ID NO: 9171291 - DNA, 22 bp, Homo sapiens
ctgggagattgaggccatggtg

SEQ ID NO: 9171292 - DNA, 22 bp, Homo sapiens
ctgggagatgactcagagcagg

SEQ ID NO: 9171293 - DNA, 22 bp, Homo sapiens
ctgggacagttcaggtagggca

SEQ ID NO: 9171294 - DNA, 22 bp, Homo sapiens
ctgggacagttcaggtagggca

SEQ ID NO: 9171295 - DNA, 22 bp, Homo sapiens
ctgggacatattgctagtgttg

SEQ ID NO: 9171296 - DNA, 22 bp, Homo sapiens
ctgggacatagatcagcctttt

SEQ ID NO: 9171297 - DNA, 22 bp, Homo sapiens
ctgggacagctgagacaggaga

SEQ ID NO: 9171298 - DNA, 22 bp, Homo sapiens
ctgggacatggtgctgtcttta

SEQ ID NO: 9171299 - DNA, 23 bp, Homo sapiens
ctgggacatggtaggggcacaac

SEQ ID NO: 9171300 - DNA, 22 bp, Homo sapiens
ctgggacattataagaaacatt

SEQ ID NO: 9171301 - DNA, 22 bp, Homo sapiens
ctgggacatgatagaaacagat

SEQ ID NO: 9171302 - DNA, 22 bp, Homo sapiens
ctgggacatattgctagtgttg

SEQ ID NO: 9171303 - DNA, 22 bp, Homo sapiens
ctgggaccctgccctgtggcct

SEQ ID NO: 9171304 - DNA, 22 bp, Homo sapiens
ctgggactcagaccagttctgt

SEQ ID NO: 9171305 - DNA, 22 bp, Homo sapiens
ctgggactcagaccagttctgt

SEQ ID NO: 9171306 - DNA, 22 bp, Homo sapiens
ctgggacctgtgtgcctgggcc

SEQ ID NO: 9171307 - DNA, 22 bp, Homo sapiens
ctgggcagctgtgcaaacaata

SEQ ID NO: 9171308 - DNA, 22 bp, Homo sapiens
ctgggcctccagctctgccagc

SEQ ID NO: 9171309 - DNA, 22 bp, Homo sapiens
ctgggcagctgtatcagggagt

SEQ ID NO: 9171310 - DNA, 22 bp, Homo sapiens
ctgggcacttgctcacagctct

SEQ ID NO: 9171311 - DNA, 22 bp, Homo sapiens
ctgggcactttggggagcctac

SEQ ID NO: 9171312 - DNA, 22 bp, Homo sapiens
ctgggcagcacatcatcgtatc

SEQ ID NO: 9171313 - DNA, 22 bp, Homo sapiens
ctgggcagagtccggaagatgg

SEQ ID NO: 9171314 - DNA, 22 bp, Homo sapiens
ctgggcagagctaacacctgag

SEQ ID NO: 9171315 - DNA, 22 bp, Homo sapiens
ctgggagattgctagagatgca

SEQ ID NO: 9171316 - DNA, 22 bp, Homo sapiens
ctgggagcctggcagttgctga

SEQ ID NO: 9171317 - DNA, 22 bp, Homo sapiens
ctgggagcgcagcaggcacaac

SEQ ID NO: 9171318 - DNA, 22 bp, Homo sapiens
ctgggcactgcagcaggcatca

SEQ ID NO: 9171319 - DNA, 22 bp, Homo sapiens
ctgggcactgcagcaggcatca

SEQ ID NO: 9171320 - DNA, 22 bp, Homo sapiens
ctgggcaaattgtgccagctat

SEQ ID NO: 9171321 - DNA, 22 bp, Homo sapiens
ctgggagcggctgtcactggtt

SEQ ID NO: 9171322 - DNA, 22 bp, Homo sapiens
ctgggccttgccttgcccacag

SEQ ID NO: 9171323 - DNA, 22 bp, Homo sapiens
ctgggccttatgagtacctgga

SEQ ID NO: 9171324 - DNA, 22 bp, Homo sapiens
ctgggccttatgagtacctgga

SEQ ID NO: 9171325 - DNA, 22 bp, Homo sapiens
ctgggccttcattgctctccca

SEQ ID NO: 9171326 - DNA, 22 bp, Homo sapiens
ctgggccttcattgctctccca

SEQ ID NO: 9171327 - DNA, 22 bp, Homo sapiens
ctgggccttgagaatcatgttt

SEQ ID NO: 9171328 - DNA, 22 bp, Homo sapiens
ctgggcctggtgtggcacctgc

SEQ ID NO: 9171329 - DNA, 22 bp, Homo sapiens
ctgggcctgtgactcccatcct

SEQ ID NO: 9171330 - DNA, 22 bp, Homo sapiens
ctgggcctgtgactcccatcct

SEQ ID NO: 9171331 - DNA, 22 bp, Homo sapiens
ctgggccttagggcactccctt

SEQ ID NO: 9171332 - DNA, 17 bp, Homo sapiens
ctgggcctcccctgtcc

SEQ ID NO: 9171333 - DNA, 17 bp, Homo sapiens
ctgggcctcccctgtcc

SEQ ID NO: 9171334 - DNA, 22 bp, Homo sapiens
ctgggcctcctctgcccaagct

SEQ ID NO: 9171335 - DNA, 17 bp, Homo sapiens
ctgggcctcccctgtcc

SEQ ID NO: 9171336 - DNA, 22 bp, Homo sapiens
ctgggcctcctctgcccaagct

SEQ ID NO: 9171337 - DNA, 22 bp, Homo sapiens
ctgggcctggtgtggcacctgc

SEQ ID NO: 9171338 - DNA, 22 bp, Homo sapiens
ctgggccttggattgacactgt

SEQ ID NO: 9171339 - DNA, 22 bp, Homo sapiens
ctgggctagaaggaccaggatg

SEQ ID NO: 9171340 - DNA, 22 bp, Homo sapiens
ctgggctcaaatcctatctcca

SEQ ID NO: 9171341 - DNA, 22 bp, Homo sapiens
ctgggctggataattctttgct

SEQ ID NO: 9171342 - DNA, 21 bp, Homo sapiens
ctgggctggcaggcattacct

SEQ ID NO: 9171343 - DNA, 22 bp, Homo sapiens
ctgggctggagtgcaatggcgc

SEQ ID NO: 9171344 - DNA, 22 bp, Homo sapiens
ctgggctggagtgcaatggcgc

SEQ ID NO: 9171345 - DNA, 22 bp, Homo sapiens
ctgggcttagcagctcctggtc

SEQ ID NO: 9171346 - DNA, 22 bp, Homo sapiens
ctgggcttagcagctcctggtc

SEQ ID NO: 9171347 - DNA, 22 bp, Homo sapiens
ctgggctgtttgttctggtctc

SEQ ID NO: 9171348 - DNA, 22 bp, Homo sapiens
ctgggctgttctgcccctgggt

SEQ ID NO: 9171349 - DNA, 22 bp, Homo sapiens
ctgggctgtttgttctggtctc

SEQ ID NO: 9171350 - DNA, 22 bp, Homo sapiens
ctgggctgtttgttctggtctc

SEQ ID NO: 9171351 - DNA, 22 bp, Homo sapiens
ctgtagagaaagcatggaagct

SEQ ID NO: 9171352 - DNA, 20 bp, Homo sapiens
ctgtagagcacaagtggagg

SEQ ID NO: 9171353 - DNA, 22 bp, Homo sapiens
ctgtagagaaagcatggaagct

SEQ ID NO: 9171354 - DNA, 22 bp, Homo sapiens
ctgtactaattgctttacatgt

SEQ ID NO: 9171355 - DNA, 22 bp, Homo sapiens
ctgtacctcagctttgctccca

SEQ ID NO: 9171356 - DNA, 18 bp, Homo sapiens
ctgtaccaccctgagggc

SEQ ID NO: 9171357 - DNA, 23 bp, Homo sapiens
ctgtacacaaactgcctgcctgt

SEQ ID NO: 9171358 - DNA, 22 bp, Homo sapiens
ctgtacaatgttacctatttat

SEQ ID NO: 9171359 - DNA, 22 bp, Homo sapiens
ctgtacaggtcaatgataagat

SEQ ID NO: 9171360 - DNA, 22 bp, Homo sapiens
ctgtaaaacactgtagtatctg

SEQ ID NO: 9171361 - DNA, 22 bp, Homo sapiens
ctgtaaaacactgtagtatctg

SEQ ID NO: 9171362 - DNA, 22 bp, Homo sapiens
ctgtaaaactgcttaagtatgc

SEQ ID NO: 9171363 - DNA, 22 bp, Homo sapiens
ctgtaaaactgcttaagtatgc

SEQ ID NO: 9171364 - DNA, 22 bp, Homo sapiens
ctgtaaaacactgtagtatctg

SEQ ID NO: 9171365 - DNA, 22 bp, Homo sapiens
ctggtgccctgtgtggcaggag

SEQ ID NO: 9171366 - DNA, 22 bp, Homo sapiens
ctgtacaaagtagctgctggga

SEQ ID NO: 9171367 - DNA, 22 bp, Homo sapiens
ctgtaaaactgcttaagtatgc

SEQ ID NO: 9171368 - DNA, 22 bp, Homo sapiens
ctgtaattctctagttcggagt

SEQ ID NO: 9171369 - DNA, 22 bp, Homo sapiens
ctgtaattgttctatgtgttca

SEQ ID NO: 9171370 - DNA, 22 bp, Homo sapiens
ctggtgcaggaaggagctggca

SEQ ID NO: 9171371 - DNA, 22 bp, Homo sapiens
ctggtgcatgtggccttgctct

SEQ ID NO: 9171372 - DNA, 22 bp, Homo sapiens
ctggtgcacattcgctctcata

SEQ ID NO: 9171373 - DNA, 22 bp, Homo sapiens
ctggtgcacgtggctgcagtcg

SEQ ID NO: 9171374 - DNA, 22 bp, Homo sapiens
ctggtgcactacagcctggaac

SEQ ID NO: 9171375 - DNA, 22 bp, Homo sapiens
ctggtgcactacagcctggaac

SEQ ID NO: 9171376 - DNA, 22 bp, Homo sapiens
ctggtgattacaatgatgacaa

SEQ ID NO: 9171377 - DNA, 22 bp, Homo sapiens
ctggtgatcttgggcaagtcac

SEQ ID NO: 9171378 - DNA, 22 bp, Homo sapiens
ctggtgagactcagggatgctt

SEQ ID NO: 9171379 - DNA, 22 bp, Homo sapiens
ctggtgcaagattccctgcttc

SEQ ID NO: 9171380 - DNA, 22 bp, Homo sapiens
ctggtgagactcagggatgctt

SEQ ID NO: 9171381 - DNA, 22 bp, Homo sapiens
ctggtgagacggttgacaggag

SEQ ID NO: 9171382 - DNA, 18 bp, Homo sapiens
ctggtctcccttcgcttt

SEQ ID NO: 9171383 - DNA, 22 bp, Homo sapiens
ctggtccttgctacccagcaag

SEQ ID NO: 9171384 - DNA, 20 bp, Homo sapiens
ctggggagcctcgcggtggc

SEQ ID NO: 9171385 - DNA, 20 bp, Homo sapiens
ctggggagcctcgcggtggc

SEQ ID NO: 9171386 - DNA, 20 bp, Homo sapiens
ctggggagcctcgcggtggc

SEQ ID NO: 9171387 - DNA, 20 bp, Homo sapiens
ctggggagctgctcccacga

SEQ ID NO: 9171388 - DNA, 22 bp, Homo sapiens
ctggtctggctacccagcgaat

SEQ ID NO: 9171389 - DNA, 22 bp, Homo sapiens
ctggtctggctacccagcgaat

SEQ ID NO: 9171390 - DNA, 19 bp, Homo sapiens
ctggtctgtcatgctcccc

SEQ ID NO: 9171391 - DNA, 19 bp, Homo sapiens
ctggtctgctgcttccagg

SEQ ID NO: 9171392 - DNA, 19 bp, Homo sapiens
ctggtctgctgcttccagg

SEQ ID NO: 9171393 - DNA, 22 bp, Homo sapiens
ctggtctgcaaggccatataga

SEQ ID NO: 9171394 - DNA, 20 bp, Homo sapiens
ctggtctgccactcacagtt

SEQ ID NO: 9171395 - DNA, 20 bp, Homo sapiens
ctggggacagcaatggctgt

SEQ ID NO: 9171396 - DNA, 22 bp, Homo sapiens
ctggggaaggcggtgactgcgc

SEQ ID NO: 9171397 - DNA, 22 bp, Homo sapiens
ctggggaccgagcaagctctgg

SEQ ID NO: 9171398 - DNA, 22 bp, Homo sapiens
ctggggagaagcgactcggctg

SEQ ID NO: 9171399 - DNA, 22 bp, Homo sapiens
ctggggaaggcggtgactgcgc

SEQ ID NO: 9171400 - DNA, 22 bp, Homo sapiens
ctggggaacaatttgccacact

SEQ ID NO: 9171401 - DNA, 21 bp, Homo sapiens
ctgggctttctctcaaagaca

SEQ ID NO: 9171402 - DNA, 21 bp, Homo sapiens
ctgggctttctctcaaagaca

SEQ ID NO: 9171403 - DNA, 22 bp, Homo sapiens
ctgggcttttgagtcacaaggg

SEQ ID NO: 9171404 - DNA, 22 bp, Homo sapiens
ctgggcttgagttcctgctcgt

SEQ ID NO: 9171405 - DNA, 22 bp, Homo sapiens
ctgggcttgtgttagctgacaa

SEQ ID NO: 9171406 - DNA, 19 bp, Homo sapiens
ctgggcttgatgttgagtt

SEQ ID NO: 9171407 - DNA, 22 bp, Homo sapiens
ctgggcttgtgttagctgacaa

SEQ ID NO: 9171408 - DNA, 22 bp, Homo sapiens
ctgggcttgcactgcagcgaga

SEQ ID NO: 9171409 - DNA, 22 bp, Homo sapiens
ctgtctctgttgcctgtaggtg

SEQ ID NO: 9171410 - DNA, 22 bp, Homo sapiens
ctgtctctgttgcctgtaggtg

SEQ ID NO: 9171411 - DNA, 22 bp, Homo sapiens
ctgtcctgtggtgacaggtaca

SEQ ID NO: 9171412 - DNA, 22 bp, Homo sapiens
ctgtcctgtggacctgaggacg

SEQ ID NO: 9171413 - DNA, 22 bp, Homo sapiens
ctgtcaggtttcccggctcacg

SEQ ID NO: 9171414 - DNA, 22 bp, Homo sapiens
ctgtcaggttggtctcagagct

SEQ ID NO: 9171415 - DNA, 19 bp, Homo sapiens
ctgtcaggggctggatgtt

SEQ ID NO: 9171416 - DNA, 22 bp, Homo sapiens
ctgtcaggggcgggtggagcgg

SEQ ID NO: 9171417 - DNA, 22 bp, Homo sapiens
ctgtcagcttctcctggccaga

SEQ ID NO: 9171418 - DNA, 22 bp, Homo sapiens
ctgtcactgatgctcctgccac

SEQ ID NO: 9171419 - DNA, 22 bp, Homo sapiens
ctgtattttcatgcctacgtac

SEQ ID NO: 9171420 - DNA, 22 bp, Homo sapiens
ctgtattttttaagaatatctc

SEQ ID NO: 9171421 - DNA, 22 bp, Homo sapiens
ctgtatttgtcctctatttatt

SEQ ID NO: 9171422 - DNA, 22 bp, Homo sapiens
ctgtattttttaagtgatctgg

SEQ ID NO: 9171423 - DNA, 22 bp, Homo sapiens
ctgtcacactaaaacaagaagt

SEQ ID NO: 9171424 - DNA, 19 bp, Homo sapiens
ctgtcaaccccatgggagt

SEQ ID NO: 9171425 - DNA, 22 bp, Homo sapiens
ctgtcaatgacagttatttggg

SEQ ID NO: 9171426 - DNA, 22 bp, Homo sapiens
ctgtcacagcccgcgtctcctc

SEQ ID NO: 9171427 - DNA, 22 bp, Homo sapiens
ctgtcacactgatatcaggctt

SEQ ID NO: 9171428 - DNA, 22 bp, Homo sapiens
ctgtcaccatttgagccctgga

SEQ ID NO: 9171429 - DNA, 22 bp, Homo sapiens
ctgtcacccacccagcctgtca

SEQ ID NO: 9171430 - DNA, 22 bp, Homo sapiens
ctgtaggtttgctctgacctgg

SEQ ID NO: 9171431 - DNA, 22 bp, Homo sapiens
ctgtagttgatgatttctgata

SEQ ID NO: 9171432 - DNA, 22 bp, Homo sapiens
ctgtatttgtcctctatttatt

SEQ ID NO: 9171433 - DNA, 23 bp, Homo sapiens
ctgtatttgacttgagcggaaat

SEQ ID NO: 9171434 - DNA, 22 bp, Homo sapiens
ctgtatttgaaagaaaagattt

SEQ ID NO: 9171435 - DNA, 22 bp, Homo sapiens
ctgtatttgaaagaaaagattt

SEQ ID NO: 9171436 - DNA, 22 bp, Homo sapiens
ctgtatatcatggttttgcagt

SEQ ID NO: 9171437 - DNA, 22 bp, Homo sapiens
ctgtatacatggtccatgttat

SEQ ID NO: 9171438 - DNA, 22 bp, Homo sapiens
ctgtctgtggagcttctgatgt

SEQ ID NO: 9171439 - DNA, 22 bp, Homo sapiens
ctgtgctgattcagcacaggcc

SEQ ID NO: 9171440 - DNA, 22 bp, Homo sapiens
ctgtgcttcagagtcagtgctg

SEQ ID NO: 9171441 - DNA, 22 bp, Homo sapiens
ctgtgctggtccagggagctgg

SEQ ID NO: 9171442 - DNA, 22 bp, Homo sapiens
ctgtgctgctagacctggattc

SEQ ID NO: 9171443 - DNA, 22 bp, Homo sapiens
ctgtgctggattctgaggctac

SEQ ID NO: 9171444 - DNA, 22 bp, Homo sapiens
ctgtgctggagatgggccagag

SEQ ID NO: 9171445 - DNA, 22 bp, Homo sapiens
ctgtctggtcaacaactgagtg

SEQ ID NO: 9171446 - DNA, 22 bp, Homo sapiens
ctgtctggtgtccctgtctaca

SEQ ID NO: 9171447 - DNA, 19 bp, Homo sapiens
ctgtctggttcatgtgttc

SEQ ID NO: 9171448 - DNA, 22 bp, Homo sapiens
ctgtctgtcaccaaaacagact

SEQ ID NO: 9171449 - DNA, 22 bp, Homo sapiens
ctgtctgtgacctctgcatgtc

SEQ ID NO: 9171450 - DNA, 22 bp, Homo sapiens
ctgtctgtgacctctgcatgtc

SEQ ID NO: 9171451 - DNA, 22 bp, Homo sapiens
ctgtctgtgacctctgcatgtc

SEQ ID NO: 9171452 - DNA, 22 bp, Homo sapiens
ctgtctggccggcccagcttcc

SEQ ID NO: 9171453 - DNA, 22 bp, Homo sapiens
ctgtctgggtctacatcctctg

SEQ ID NO: 9171454 - DNA, 22 bp, Homo sapiens
ctgtctgggtctacatcctctg

SEQ ID NO: 9171455 - DNA, 22 bp, Homo sapiens
ctgtctggtcaacaactgagtg

SEQ ID NO: 9171456 - DNA, 22 bp, Homo sapiens
ctgtctggccggcccagcttcc

SEQ ID NO: 9171457 - DNA, 22 bp, Homo sapiens
ctgtctggatgtgagtcaccta

SEQ ID NO: 9171458 - DNA, 21 bp, Homo sapiens
ctgtctggccgcgggctccgc

SEQ ID NO: 9171459 - DNA, 22 bp, Homo sapiens
ctgtctggatataccttggcca

SEQ ID NO: 9171460 - DNA, 22 bp, Homo sapiens
cttaaaatctggcagttagcta

SEQ ID NO: 9171461 - DNA, 22 bp, Homo sapiens
cttaaaatctggcagttagcta

SEQ ID NO: 9171462 - DNA, 22 bp, Homo sapiens
cttaaagaaattgaggagagga

SEQ ID NO: 9171463 - DNA, 20 bp, Homo sapiens
ctgtttgctatcatgagctg

SEQ ID NO: 9171464 - DNA, 22 bp, Homo sapiens
ctgtttgctggctatgaactcc

SEQ ID NO: 9171465 - DNA, 21 bp, Homo sapiens
ctgtttgcaagcctatgtgtc

SEQ ID NO: 9171466 - DNA, 22 bp, Homo sapiens
ctgtttgcattaaagtatatga

SEQ ID NO: 9171467 - DNA, 22 bp, Homo sapiens
ctgtttaatgcaatgaaatgag

SEQ ID NO: 9171468 - DNA, 22 bp, Homo sapiens
ctgtttaatgaggtgtaacaac

SEQ ID NO: 9171469 - DNA, 22 bp, Homo sapiens
ctgtttatcatgtacatttcca

SEQ ID NO: 9171470 - DNA, 19 bp, Homo sapiens
ctgtttctgagcttgcttt

SEQ ID NO: 9171471 - DNA, 22 bp, Homo sapiens
ctgtgcttgtgttcattgttaa

SEQ ID NO: 9171472 - DNA, 22 bp, Homo sapiens
ctgtgcttgcgggtgtggagcc

SEQ ID NO: 9171473 - DNA, 21 bp, Homo sapiens
ctgtgctttttaagtgtgatg

SEQ ID NO: 9171474 - DNA, 21 bp, Homo sapiens
ctgtgctttttaagtgtgatg

SEQ ID NO: 9171475 - DNA, 22 bp, Homo sapiens
ctgtgctttcgagatgtgatct

SEQ ID NO: 9171476 - DNA, 22 bp, Homo sapiens
cttacaaaggagaggagatagg

SEQ ID NO: 9171477 - DNA, 22 bp, Homo sapiens
cttacaaaggagaggagatagg

SEQ ID NO: 9171478 - DNA, 22 bp, Homo sapiens
cttacaaaggagaggagatagg

SEQ ID NO: 9171479 - DNA, 22 bp, Homo sapiens
cttacaaaggagaggagatagg

SEQ ID NO: 9171480 - DNA, 22 bp, Homo sapiens
cttacaaatacacttaggagag

SEQ ID NO: 9171481 - DNA, 22 bp, Homo sapiens
cttacaaatacacttaggagag

SEQ ID NO: 9171482 - DNA, 22 bp, Homo sapiens
cttacaaatacacttaggagag

SEQ ID NO: 9171483 - DNA, 22 bp, Homo sapiens
cttacaaatacacttaggagag

SEQ ID NO: 9171484 - DNA, 22 bp, Homo sapiens
cttaatttcaaactgctagtga

SEQ ID NO: 9171485 - DNA, 22 bp, Homo sapiens
cttacaaaggagaggagatagg

SEQ ID NO: 9171486 - DNA, 22 bp, Homo sapiens
cttaatttaagcctagaatgca

SEQ ID NO: 9171487 - DNA, 22 bp, Homo sapiens
cttaatgtggacctggtttcta

SEQ ID NO: 9171488 - DNA, 22 bp, Homo sapiens
cttaaattttcatctacaagaa

SEQ ID NO: 9171489 - DNA, 22 bp, Homo sapiens
cttaattggcttatttcctcaa

SEQ ID NO: 9171490 - DNA, 22 bp, Homo sapiens
cttaaattggatgagttaagtt

SEQ ID NO: 9171491 - DNA, 22 bp, Homo sapiens
cttaaattttcatctacaagaa

SEQ ID NO: 9171492 - DNA, 22 bp, Homo sapiens
cttaaagagtatttaatataat

SEQ ID NO: 9171493 - DNA, 22 bp, Homo sapiens
cttacaagaccaaagaaaggat

SEQ ID NO: 9171494 - DNA, 22 bp, Homo sapiens
cttacacagtctggcacttctt

SEQ ID NO: 9171495 - DNA, 22 bp, Homo sapiens
cttacaagcaaaacaactgtag

SEQ ID NO: 9171496 - DNA, 22 bp, Homo sapiens
cttacattgtctcttgctgagc

SEQ ID NO: 9171497 - DNA, 22 bp, Homo sapiens
cttacccaaattagagttacca

SEQ ID NO: 9171498 - DNA, 22 bp, Homo sapiens
cttacattgtgtgcatgagggg

SEQ ID NO: 9171499 - DNA, 22 bp, Homo sapiens
cttacattgtctcttgctgagc

SEQ ID NO: 9171500 - DNA, 22 bp, Homo sapiens
cttagaaatcgaactcaggtta

SEQ ID NO: 9171501 - DNA, 20 bp, Homo sapiens
cttagcaccagcaggacagg

SEQ ID NO: 9171502 - DNA, 22 bp, Homo sapiens
cttagcaataagagggaatata

SEQ ID NO: 9171503 - DNA, 22 bp, Homo sapiens
cttagcacatatcagaaaatag

SEQ ID NO: 9171504 - DNA, 22 bp, Homo sapiens
cttagaaatcgaactcaggtta

SEQ ID NO: 9171505 - DNA, 22 bp, Homo sapiens
cttcatttcaggctgaagaata

SEQ ID NO: 9171506 - DNA, 22 bp, Homo sapiens
cttcatttggcaggctggcctc

SEQ ID NO: 9171507 - DNA, 22 bp, Homo sapiens
cttcatttccatccaactggga

SEQ ID NO: 9171508 - DNA, 22 bp, Homo sapiens
cttcatttggagaactgtgctt

SEQ ID NO: 9171509 - DNA, 22 bp, Homo sapiens
cttcatttggagaactgtgctt

SEQ ID NO: 9171510 - DNA, 18 bp, Homo sapiens
cttcatttgtagagttcc

SEQ ID NO: 9171511 - DNA, 22 bp, Homo sapiens
cttccaaaatttatatgttgaa

SEQ ID NO: 9171512 - DNA, 22 bp, Homo sapiens
cttccaaatgtaaataagtttc

SEQ ID NO: 9171513 - DNA, 22 bp, Homo sapiens
cttccaaatgtaaataagtttc

SEQ ID NO: 9171514 - DNA, 22 bp, Homo sapiens
cttccaaagcactttatggacc

SEQ ID NO: 9171515 - DNA, 22 bp, Homo sapiens
cttccaaagcactttatggacc

SEQ ID NO: 9171516 - DNA, 22 bp, Homo sapiens
cttccaaacccagggtatgggc

SEQ ID NO: 9171517 - DNA, 22 bp, Homo sapiens
cttatagtatgatgttgagaat

SEQ ID NO: 9171518 - DNA, 22 bp, Homo sapiens
cttatatttgtcaactttacaa

SEQ ID NO: 9171519 - DNA, 22 bp, Homo sapiens
cttatatttgtcaactttacaa

SEQ ID NO: 9171520 - DNA, 22 bp, Homo sapiens
cttcagtgttgccagggcctag

SEQ ID NO: 9171521 - DNA, 22 bp, Homo sapiens
cttcagttagtttcatgtgagc

SEQ ID NO: 9171522 - DNA, 22 bp, Homo sapiens
cttcagttagccaattcaggtc

SEQ ID NO: 9171523 - DNA, 22 bp, Homo sapiens
cttagtgagaaggagcccatgc

SEQ ID NO: 9171524 - DNA, 22 bp, Homo sapiens
cttaggaacacttactggtact

SEQ ID NO: 9171525 - DNA, 22 bp, Homo sapiens
cttagctgcgggccctcctcgc

SEQ ID NO: 9171526 - DNA, 22 bp, Homo sapiens
cttagccctgagagttctgagc

SEQ ID NO: 9171527 - DNA, 22 bp, Homo sapiens
cttagcatgtggtgtccttgta

SEQ ID NO: 9171528 - DNA, 22 bp, Homo sapiens
cttctcaaacctgaaaggacaa

SEQ ID NO: 9171529 - DNA, 23 bp, Homo sapiens
cttctcagaagtctgtgccagga

SEQ ID NO: 9171530 - DNA, 22 bp, Homo sapiens
cttctcaactgcacttgccagg

SEQ ID NO: 9171531 - DNA, 22 bp, Homo sapiens
cttctcagaggccagaagctat

SEQ ID NO: 9171532 - DNA, 22 bp, Homo sapiens
cttctcagaggccagaagctat

SEQ ID NO: 9171533 - DNA, 22 bp, Homo sapiens
cttctcagaggccagaagctat

SEQ ID NO: 9171534 - DNA, 22 bp, Homo sapiens
cttctcagatctcagctttgag

SEQ ID NO: 9171535 - DNA, 22 bp, Homo sapiens
cttctcagcatggttactgtga

SEQ ID NO: 9171536 - DNA, 22 bp, Homo sapiens
cttctcagcattttgtcagtct

SEQ ID NO: 9171537 - DNA, 22 bp, Homo sapiens
cttctaattcttatgtaagctt

SEQ ID NO: 9171538 - DNA, 22 bp, Homo sapiens
cttctagagctggagcaaatgt

SEQ ID NO: 9171539 - DNA, 22 bp, Homo sapiens
cttccagaggaactctgcagtg

SEQ ID NO: 9171540 - DNA, 22 bp, Homo sapiens
cttccactactcttagatctgc

SEQ ID NO: 9171541 - DNA, 20 bp, Homo sapiens
cttccacacaagaagcacag

SEQ ID NO: 9171542 - DNA, 22 bp, Homo sapiens
cttccaatagcaacaaagatta

SEQ ID NO: 9171543 - DNA, 20 bp, Homo sapiens
cttccacacaagaagcacag

SEQ ID NO: 9171544 - DNA, 22 bp, Homo sapiens
cttcgtttttagtagcaatgtt

SEQ ID NO: 9171545 - DNA, 22 bp, Homo sapiens
cttcctgttgtcacagtctgcg

SEQ ID NO: 9171546 - DNA, 22 bp, Homo sapiens
cttccttccacaccttcagaat

SEQ ID NO: 9171547 - DNA, 22 bp, Homo sapiens
cttcctggtttgaagctcgccg

SEQ ID NO: 9171548 - DNA, 22 bp, Homo sapiens
cttcctgggtctggagactgga

SEQ ID NO: 9171549 - DNA, 22 bp, Homo sapiens
cttcctgggtctggagactgga

SEQ ID NO: 9171550 - DNA, 21 bp, Homo sapiens
ctttgcaagatgtctatgaaa

SEQ ID NO: 9171551 - DNA, 22 bp, Homo sapiens
ctttgattccaggcacatgttt

SEQ ID NO: 9171552 - DNA, 22 bp, Homo sapiens
cttttcattgtttgtacatgca

SEQ ID NO: 9171553 - DNA, 22 bp, Homo sapiens
cttttcttactcccgcaaggca

SEQ ID NO: 9171554 - DNA, 21 bp, Homo sapiens
cttttctgtgttcctccctgt

SEQ ID NO: 9171555 - DNA, 22 bp, Homo sapiens
cttttctgtgatgctgacagtc

SEQ ID NO: 9171556 - DNA, 22 bp, Homo sapiens
cttttctggccaggaacttgcc

SEQ ID NO: 9171557 - DNA, 22 bp, Homo sapiens
cttttctggaatcatctctaac

SEQ ID NO: 9171558 - DNA, 22 bp, Homo sapiens
cttttctgggccccacgctgga

SEQ ID NO: 9171559 - DNA, 22 bp, Homo sapiens
cttttctcttacattccactgg

SEQ ID NO: 9171560 - DNA, 22 bp, Homo sapiens
cttttctcttacattccactgg

SEQ ID NO: 9171561 - DNA, 22 bp, Homo sapiens
cttttctctgcaccatgtgtga

SEQ ID NO: 9171562 - DNA, 22 bp, Homo sapiens
cttttctctgcgggtctttcat

SEQ ID NO: 9171563 - DNA, 22 bp, Homo sapiens
cttttcctcaggaggagacgcg

SEQ ID NO: 9171564 - DNA, 22 bp, Homo sapiens
cttttcctattgattctgttac

SEQ ID NO: 9171565 - DNA, 22 bp, Homo sapiens
gaaagagaacctgggcctagat

SEQ ID NO: 9171566 - DNA, 22 bp, Homo sapiens
gaaagagaggggctgagatgca

SEQ ID NO: 9171567 - DNA, 22 bp, Homo sapiens
gaaagagaggggctgagatgca

SEQ ID NO: 9171568 - DNA, 18 bp, Homo sapiens
gaaagccatgcagcagtg

SEQ ID NO: 9171569 - DNA, 22 bp, Homo sapiens
gaaagccatctggctgctggga

SEQ ID NO: 9171570 - DNA, 22 bp, Homo sapiens
gaaagccatagcccagctttac

SEQ ID NO: 9171571 - DNA, 22 bp, Homo sapiens
gaaagccagagagaaagggctc

SEQ ID NO: 9171572 - DNA, 22 bp, Homo sapiens
gaaacagattaacagcatattt

SEQ ID NO: 9171573 - DNA, 22 bp, Homo sapiens
gaaacagattaacagcatattt

SEQ ID NO: 9171574 - DNA, 22 bp, Homo sapiens
gaaacagcacgtttggagagat

SEQ ID NO: 9171575 - DNA, 22 bp, Homo sapiens
gaaacagattaacagcatattt

SEQ ID NO: 9171576 - DNA, 22 bp, Homo sapiens
gaaacacatgcagctccataga

SEQ ID NO: 9171577 - DNA, 22 bp, Homo sapiens
gaaacacatatgaacagttgat

SEQ ID NO: 9171578 - DNA, 22 bp, Homo sapiens
gaaaattattgaaaatggctct

SEQ ID NO: 9171579 - DNA, 22 bp, Homo sapiens
gaaaatacttcagtgttctggc

SEQ ID NO: 9171580 - DNA, 22 bp, Homo sapiens
gaaaatacttcagtgttctggc

SEQ ID NO: 9171581 - DNA, 22 bp, Homo sapiens
gaaaatacttcagtgttctggc

SEQ ID NO: 9171582 - DNA, 22 bp, Homo sapiens
gaaaatacttcagtgttctggc

SEQ ID NO: 9171583 - DNA, 22 bp, Homo sapiens
gaaaatttctgccacatgtgtg

SEQ ID NO: 9171584 - DNA, 22 bp, Homo sapiens
gaaaatttctgccacatgtgtg

SEQ ID NO: 9171585 - DNA, 22 bp, Homo sapiens
gaaacaatcatcatgtgatttg

SEQ ID NO: 9171586 - DNA, 22 bp, Homo sapiens
gaaacaatcatcatgtgatttg

SEQ ID NO: 9171587 - DNA, 22 bp, Homo sapiens
gaaaatttagaactgaacttct

SEQ ID NO: 9171588 - DNA, 22 bp, Homo sapiens
gaaaatttagaactgaacttct

SEQ ID NO: 9171589 - DNA, 22 bp, Homo sapiens
gaaaatttagaactgaacttct

SEQ ID NO: 9171590 - DNA, 22 bp, Homo sapiens
gaaaatttaattctcttctgtg

SEQ ID NO: 9171591 - DNA, 22 bp, Homo sapiens
gaaaattattgaaaatggctct

SEQ ID NO: 9171592 - DNA, 22 bp, Homo sapiens
ctttaattgtagctcccataat

SEQ ID NO: 9171593 - DNA, 22 bp, Homo sapiens
ctttaattgtagctcccataat

SEQ ID NO: 9171594 - DNA, 22 bp, Homo sapiens
ctttacaaactataaagtgcgg

SEQ ID NO: 9171595 - DNA, 22 bp, Homo sapiens
ctttacaaagcaattttgtctc

SEQ ID NO: 9171596 - DNA, 22 bp, Homo sapiens
ctttacaaagcaattttgtctc

SEQ ID NO: 9171597 - DNA, 22 bp, Homo sapiens
ctttctcttcactgtcatgatc

SEQ ID NO: 9171598 - DNA, 22 bp, Homo sapiens
ctttctcttcactgtcatgatc

SEQ ID NO: 9171599 - DNA, 22 bp, Homo sapiens
ctttacaaagcaattttgtctc

SEQ ID NO: 9171600 - DNA, 22 bp, Homo sapiens
ctttaattctcaggtgcacata

SEQ ID NO: 9171601 - DNA, 22 bp, Homo sapiens
ctttaattcagatttgaaggga

SEQ ID NO: 9171602 - DNA, 22 bp, Homo sapiens
ctttaattaggaagtataatga

SEQ ID NO: 9171603 - DNA, 22 bp, Homo sapiens
ctttaattcagatttgaaggga

SEQ ID NO: 9171604 - DNA, 22 bp, Homo sapiens
ctttaatgagtctttctgctgt

SEQ ID NO: 9171605 - DNA, 22 bp, Homo sapiens
ctttaattaggaagtataatga

SEQ ID NO: 9171606 - DNA, 22 bp, Homo sapiens
ctttaacctgtgcattttatat

SEQ ID NO: 9171607 - DNA, 22 bp, Homo sapiens
ctttgaaaacttaaataacagc

SEQ ID NO: 9171608 - DNA, 22 bp, Homo sapiens
ctttgaaaatgtggttaagggt

SEQ ID NO: 9171609 - DNA, 22 bp, Homo sapiens
ctttgaaacctgctctgcagaa

SEQ ID NO: 9171610 - DNA, 22 bp, Homo sapiens
ctttgaaacctgctctgcagaa

SEQ ID NO: 9171611 - DNA, 22 bp, Homo sapiens
ctttgaaacctgctctgcagaa

SEQ ID NO: 9171612 - DNA, 22 bp, Homo sapiens
ctttgaagatcacatgttgctc

SEQ ID NO: 9171613 - DNA, 22 bp, Homo sapiens
ctttgaaattcttcagctgaag

SEQ ID NO: 9171614 - DNA, 22 bp, Homo sapiens
ctttgaagagattactgtgctc

SEQ ID NO: 9171615 - DNA, 22 bp, Homo sapiens
ctttgaaattcttcagctgaag

SEQ ID NO: 9171616 - DNA, 22 bp, Homo sapiens
ctttgaaagctcccaggactta

SEQ ID NO: 9171617 - DNA, 22 bp, Homo sapiens
ctttgaaaggaagccacacagc

SEQ ID NO: 9171618 - DNA, 22 bp, Homo sapiens
ctttgacctctctgtgcccctc

SEQ ID NO: 9171619 - DNA, 22 bp, Homo sapiens
ctttgacctcatatgacacatt

SEQ ID NO: 9171620 - DNA, 22 bp, Homo sapiens
ctttgaattgccgtttcatctg

SEQ ID NO: 9171621 - DNA, 22 bp, Homo sapiens
ctttgagcaattctgagatgca

SEQ ID NO: 9171622 - DNA, 22 bp, Homo sapiens
ctttgattcagactttgtcggc

SEQ ID NO: 9171623 - DNA, 22 bp, Homo sapiens
ctttgatgagcatgcaatattt

SEQ ID NO: 9171624 - DNA, 22 bp, Homo sapiens
ctttgatataagtatacatagt

SEQ ID NO: 9171625 - DNA, 22 bp, Homo sapiens
ctttgaaaaatggtttcctaga

SEQ ID NO: 9171626 - DNA, 22 bp, Homo sapiens
ctttctttgtccaccaacaatg

SEQ ID NO: 9171627 - DNA, 22 bp, Homo sapiens
ctttgaaaacttaaataacagc

SEQ ID NO: 9171628 - DNA, 22 bp, Homo sapiens
ctttgaaaaatggtttcctaga

SEQ ID NO: 9171629 - DNA, 22 bp, Homo sapiens
ctttgaaaacacacgaatagac

SEQ ID NO: 9171630 - DNA, 22 bp, Homo sapiens
ctttctttgtccaccaacaatg

SEQ ID NO: 9171631 - DNA, 22 bp, Homo sapiens
ctttctttgcagtgagccagag

SEQ ID NO: 9171632 - DNA, 22 bp, Homo sapiens
ctttctcttcagcacccagccc

SEQ ID NO: 9171633 - DNA, 22 bp, Homo sapiens
ctttctcttcagcacccagccc

SEQ ID NO: 9171634 - DNA, 22 bp, Homo sapiens
cttgtgaaatgccagataatct

SEQ ID NO: 9171635 - DNA, 22 bp, Homo sapiens
cttgtgcaaatcctcgagcaca

SEQ ID NO: 9171636 - DNA, 22 bp, Homo sapiens
cttgtgattgagaaagtctaaa

SEQ ID NO: 9171637 - DNA, 22 bp, Homo sapiens
cttgtgcaagaaacctggaatg

SEQ ID NO: 9171638 - DNA, 22 bp, Homo sapiens
cttgtctttatttcatattcca

SEQ ID NO: 9171639 - DNA, 22 bp, Homo sapiens
cttctgggtgtggagtgaggac

SEQ ID NO: 9171640 - DNA, 22 bp, Homo sapiens
cttctgggtattccagatacct

SEQ ID NO: 9171641 - DNA, 22 bp, Homo sapiens
cttgttttggaacagagtgaat

SEQ ID NO: 9171642 - DNA, 22 bp, Homo sapiens
cttgttttgaaagcagtggcca

SEQ ID NO: 9171643 - DNA, 21 bp, Homo sapiens
cttgttttgaaaggactggcc

SEQ ID NO: 9171644 - DNA, 22 bp, Homo sapiens
cttgttttctaaaacatcattt

SEQ ID NO: 9171645 - DNA, 22 bp, Homo sapiens
cttgttttctaaaacatcattt

SEQ ID NO: 9171646 - DNA, 22 bp, Homo sapiens
cttgttttctaaaacatcattt

SEQ ID NO: 9171647 - DNA, 22 bp, Homo sapiens
cttgttttcttctgcagtctat

SEQ ID NO: 9171648 - DNA, 22 bp, Homo sapiens
cttgttttcttctgcagtctat

SEQ ID NO: 9171649 - DNA, 22 bp, Homo sapiens
cttgtttttaagagatgtttac

SEQ ID NO: 9171650 - DNA, 22 bp, Homo sapiens
cttgtttttaagagatgtttac

SEQ ID NO: 9171651 - DNA, 22 bp, Homo sapiens
cttgtttttaagagatgtttac

SEQ ID NO: 9171652 - DNA, 22 bp, Homo sapiens
cttgttttggaacagagtgaat

SEQ ID NO: 9171653 - DNA, 22 bp, Homo sapiens
cttgttttggctagtatgatgt

SEQ ID NO: 9171654 - DNA, 22 bp, Homo sapiens
cttctcttggtagttcttgttg

SEQ ID NO: 9171655 - DNA, 22 bp, Homo sapiens
cttctcttggtagttcttgttg

SEQ ID NO: 9171656 - DNA, 22 bp, Homo sapiens
cttctcttggtagttcttgttg

SEQ ID NO: 9171657 - DNA, 22 bp, Homo sapiens
cttctgaagaggttatcataga

SEQ ID NO: 9171658 - DNA, 22 bp, Homo sapiens
cttctgaagtgtttgatgattg

SEQ ID NO: 9171659 - DNA, 22 bp, Homo sapiens
cttctgctgccgcctcggcaca

SEQ ID NO: 9171660 - DNA, 22 bp, Homo sapiens
cttctgctgctgttcatggttg

SEQ ID NO: 9171661 - DNA, 19 bp, Homo sapiens
cttctggatccgcagggcc

SEQ ID NO: 9171662 - DNA, 22 bp, Homo sapiens
cttctggaggctccagggaggt

SEQ ID NO: 9171663 - DNA, 22 bp, Homo sapiens
cttctgggcattcagctgcaca

SEQ ID NO: 9171664 - DNA, 22 bp, Homo sapiens
cttctgggcatggcagagcctg

SEQ ID NO: 9171665 - DNA, 22 bp, Homo sapiens
cttctggcgttggaggtctgag

SEQ ID NO: 9171666 - DNA, 22 bp, Homo sapiens
cttctggcgttggaggtctgag

SEQ ID NO: 9171667 - DNA, 19 bp, Homo sapiens
cttctggccctgagccacc

SEQ ID NO: 9171668 - DNA, 22 bp, Homo sapiens
tctggggagtgcctaagtggaa

SEQ ID NO: 9171669 - DNA, 22 bp, Homo sapiens
ccaggagcaacttgaaggcaag

SEQ ID NO: 9171670 - DNA, 22 bp, Homo sapiens
ccaggagcaaagatcactggga

SEQ ID NO: 9171671 - DNA, 22 bp, Homo sapiens
ccaggagcaaagatcactggga

SEQ ID NO: 9171672 - DNA, 22 bp, Homo sapiens
tctggggagggagccacaggtc

SEQ ID NO: 9171673 - DNA, 22 bp, Homo sapiens
tctgggcttttgcactggccat

SEQ ID NO: 9171674 - DNA, 22 bp, Homo sapiens
tctgggctctgtcagcacctct

SEQ ID NO: 9171675 - DNA, 22 bp, Homo sapiens
tctgggctctgtcagcacctct

SEQ ID NO: 9171676 - DNA, 22 bp, Homo sapiens
tctgggcttttgcactggccat

SEQ ID NO: 9171677 - DNA, 22 bp, Homo sapiens
tctgggccctgagatgttcttc

SEQ ID NO: 9171678 - DNA, 22 bp, Homo sapiens
tctgggccctgagatgttcttc

SEQ ID NO: 9171679 - DNA, 22 bp, Homo sapiens
tctgggaggctgggtcccgtcc

SEQ ID NO: 9171680 - DNA, 22 bp, Homo sapiens
tctgggaggctgggtcccgtcc

SEQ ID NO: 9171681 - DNA, 22 bp, Homo sapiens
ccagcactctattgaatattct

SEQ ID NO: 9171682 - DNA, 22 bp, Homo sapiens
ccagcaccttgatcttggagtt

SEQ ID NO: 9171683 - DNA, 22 bp, Homo sapiens
ccagcactcgctgattttagga

SEQ ID NO: 9171684 - DNA, 22 bp, Homo sapiens
tctgggcctgtctcagagctgg

SEQ ID NO: 9171685 - DNA, 22 bp, Homo sapiens
tctgggctatatggtctctgct

SEQ ID NO: 9171686 - DNA, 22 bp, Homo sapiens
tctgggctcacgagtctggaca

SEQ ID NO: 9171687 - DNA, 22 bp, Homo sapiens
tctgggctctgggaattaggga

SEQ ID NO: 9171688 - DNA, 22 bp, Homo sapiens
tctgggctctgcgaagcccttc

SEQ ID NO: 9171689 - DNA, 22 bp, Homo sapiens
ccaggagccactcaggcccaca

SEQ ID NO: 9171690 - DNA, 22 bp, Homo sapiens
ccaggagcattaagagaacata

SEQ ID NO: 9171691 - DNA, 22 bp, Homo sapiens
ccaggagcagggctggctgcac

SEQ ID NO: 9171692 - DNA, 19 bp, Homo sapiens
ccaggagcagtggtgagct

SEQ ID NO: 9171693 - DNA, 19 bp, Homo sapiens
ccaggagcagtggtgagct

SEQ ID NO: 9171694 - DNA, 22 bp, Homo sapiens
ccaggagcagggctggctgcac

SEQ ID NO: 9171695 - DNA, 22 bp, Homo sapiens
ccaggagcaggagctggacaga

SEQ ID NO: 9171696 - DNA, 22 bp, Homo sapiens
ccaggagcagggctggctgcac

SEQ ID NO: 9171697 - DNA, 22 bp, Homo sapiens
ccaggagcaggagctgcagctg

SEQ ID NO: 9171698 - DNA, 22 bp, Homo sapiens
ccaggagcaggagctggacaga

SEQ ID NO: 9171699 - DNA, 22 bp, Homo sapiens
ccaggagcagccggcccacctg

SEQ ID NO: 9171700 - DNA, 22 bp, Homo sapiens
ccaggagcagatatggacataa

SEQ ID NO: 9171701 - DNA, 22 bp, Homo sapiens
ccaggagcaggagctgcagctg

SEQ ID NO: 9171702 - DNA, 22 bp, Homo sapiens
ccaggagcaccaggcctgtgcc

SEQ ID NO: 9171703 - DNA, 22 bp, Homo sapiens
ccaggagcagatatggacataa

SEQ ID NO: 9171704 - DNA, 22 bp, Homo sapiens
tctgttattctgtctattgcca

SEQ ID NO: 9171705 - DNA, 20 bp, Homo sapiens
tctgttcaaatcttagttcc

SEQ ID NO: 9171706 - DNA, 22 bp, Homo sapiens
ccaggagcctgggccaggctgg

SEQ ID NO: 9171707 - DNA, 22 bp, Homo sapiens
ccaggagcctgggccaggctgg

SEQ ID NO: 9171708 - DNA, 22 bp, Homo sapiens
tctgttcatacagagtatagta

SEQ ID NO: 9171709 - DNA, 22 bp, Homo sapiens
tctgttcatagtagtgtatatg

SEQ ID NO: 9171710 - DNA, 22 bp, Homo sapiens
tctgttcatcatctggacacat

SEQ ID NO: 9171711 - DNA, 22 bp, Homo sapiens
tctgttcatctcatgggagaat

SEQ ID NO: 9171712 - DNA, 22 bp, Homo sapiens
tctgttcagttgattagacaga

SEQ ID NO: 9171713 - DNA, 22 bp, Homo sapiens
tctgttcagttgatgtagtttt

SEQ ID NO: 9171714 - DNA, 22 bp, Homo sapiens
tctgttcaagactgaggtgaca

SEQ ID NO: 9171715 - DNA, 21 bp, Homo sapiens
tctgttcaaggaactacggat

SEQ ID NO: 9171716 - DNA, 17 bp, Homo sapiens
tctgttcaagtgagagg

SEQ ID NO: 9171717 - DNA, 22 bp, Homo sapiens
tctgttcagaaatggaagtgcc

SEQ ID NO: 9171718 - DNA, 22 bp, Homo sapiens
tctgttcactgagcaatggcaa

SEQ ID NO: 9171719 - DNA, 22 bp, Homo sapiens
tctgttcagaagaggtgaaagt

SEQ ID NO: 9171720 - DNA, 22 bp, Homo sapiens
tctgttcagaattgtaacactc

SEQ ID NO: 9171721 - DNA, 22 bp, Homo sapiens
tctgttcagacactttacatgt

SEQ ID NO: 9171722 - DNA, 22 bp, Homo sapiens
tctgttcaggtttcagagaact

SEQ ID NO: 9171723 - DNA, 22 bp, Homo sapiens
tctgttcagctgcctcagggta

SEQ ID NO: 9171724 - DNA, 22 bp, Homo sapiens
tctgttcttcctacattcacat

SEQ ID NO: 9171725 - DNA, 22 bp, Homo sapiens
tctgttcttaaagcattcttgc

SEQ ID NO: 9171726 - DNA, 22 bp, Homo sapiens
ccaggaggcggaggttgcagcg

SEQ ID NO: 9171727 - DNA, 17 bp, Homo sapiens
tctgttcatgcatacct

SEQ ID NO: 9171728 - DNA, 22 bp, Homo sapiens
tctgttcatgttgggcttttcc

SEQ ID NO: 9171729 - DNA, 22 bp, Homo sapiens
tctgttcatgtctttttaagtg

SEQ ID NO: 9171730 - DNA, 22 bp, Homo sapiens
tctgttcctgcatagtacctca

SEQ ID NO: 9171731 - DNA, 22 bp, Homo sapiens
tctgttctaagcattctatgtg

SEQ ID NO: 9171732 - DNA, 22 bp, Homo sapiens
ccaggcacttgtttgccaggca

SEQ ID NO: 9171733 - DNA, 22 bp, Homo sapiens
ccaggcagaatgaaacccctgt

SEQ ID NO: 9171734 - DNA, 22 bp, Homo sapiens
ccaggaggcttcgtccgtggag

SEQ ID NO: 9171735 - DNA, 16 bp, Homo sapiens
ccaggaggctgacacc

SEQ ID NO: 9171736 - DNA, 16 bp, Homo sapiens
ccaggaggctgacacc

SEQ ID NO: 9171737 - DNA, 22 bp, Homo sapiens
ccaggaggctcttgtccctggt

SEQ ID NO: 9171738 - DNA, 22 bp, Homo sapiens
ccaggcaagtagaagctgtggt

SEQ ID NO: 9171739 - DNA, 22 bp, Homo sapiens
ccaggcaattctgaaagcattt

SEQ ID NO: 9171740 - DNA, 22 bp, Homo sapiens
ccaggcaagtagaagctgtggt

SEQ ID NO: 9171741 - DNA, 22 bp, Homo sapiens
ccaggcaattctgaaagcattt

SEQ ID NO: 9171742 - DNA, 22 bp, Homo sapiens
ccaggaggctcttgtccctggt

SEQ ID NO: 9171743 - DNA, 22 bp, Homo sapiens
ccaggaggctctgcccatccca

SEQ ID NO: 9171744 - DNA, 22 bp, Homo sapiens
ccaggaggctctgcccatccca

SEQ ID NO: 9171745 - DNA, 22 bp, Homo sapiens
ccaggaggcggaggttgcagtg

SEQ ID NO: 9171746 - DNA, 22 bp, Homo sapiens
ccaggaggctctgactggaccc

SEQ ID NO: 9171747 - DNA, 22 bp, Homo sapiens
ccaggaggcggaggttgcagtg

SEQ ID NO: 9171748 - DNA, 22 bp, Homo sapiens
tcttacaagaaataagccaatg

SEQ ID NO: 9171749 - DNA, 22 bp, Homo sapiens
tcttacaagaaggaaaagggag

SEQ ID NO: 9171750 - DNA, 22 bp, Homo sapiens
ccaggcagatgggccggcttca

SEQ ID NO: 9171751 - DNA, 22 bp, Homo sapiens
tcttacccggcaacgtgtgtcg

SEQ ID NO: 9171752 - DNA, 22 bp, Homo sapiens
tcttacccggcaacgtgtgtcg

SEQ ID NO: 9171753 - DNA, 22 bp, Homo sapiens
tcttacagaaaatagataacat

SEQ ID NO: 9171754 - DNA, 22 bp, Homo sapiens
tcttacaccattcaaatatttt

SEQ ID NO: 9171755 - DNA, 20 bp, Homo sapiens
tcttacaatcgttacatcca

SEQ ID NO: 9171756 - DNA, 22 bp, Homo sapiens
tcttacaagtcacccgctttct

SEQ ID NO: 9171757 - DNA, 20 bp, Homo sapiens
tcttacaatcgttacatcca

SEQ ID NO: 9171758 - DNA, 22 bp, Homo sapiens
ccaggcagagggatccccatcc

SEQ ID NO: 9171759 - DNA, 22 bp, Homo sapiens
ccaggcagagggaatagcaagt

SEQ ID NO: 9171760 - DNA, 21 bp, Homo sapiens
ccaggcagagctgtgagttct

SEQ ID NO: 9171761 - DNA, 22 bp, Homo sapiens
ccaggcagagtgctccagaaag

SEQ ID NO: 9171762 - DNA, 22 bp, Homo sapiens
ccaggcagagtgctccagaaag

SEQ ID NO: 9171763 - DNA, 22 bp, Homo sapiens
ccaggcagagtgctccagaaag

SEQ ID NO: 9171764 - DNA, 22 bp, Homo sapiens
ccaggcagatgggccggcttca

SEQ ID NO: 9171765 - DNA, 22 bp, Homo sapiens
ccaggcagatgggccggcttca

SEQ ID NO: 9171766 - DNA, 22 bp, Homo sapiens
ccaggcagagtgctccagaaag

SEQ ID NO: 9171767 - DNA, 22 bp, Homo sapiens
ccaggcctcccttttccagcca

SEQ ID NO: 9171768 - DNA, 22 bp, Homo sapiens
ccaggcctcccttttccagcca

SEQ ID NO: 9171769 - DNA, 22 bp, Homo sapiens
ccaggcaggcgatggtgcagtg

SEQ ID NO: 9171770 - DNA, 22 bp, Homo sapiens
ccaggcaggcgatggtgcagtg

SEQ ID NO: 9171771 - DNA, 22 bp, Homo sapiens
ccaggcaggcgatggtgcagtg

SEQ ID NO: 9171772 - DNA, 22 bp, Homo sapiens
ccaggcaggcgatggtgcagtg

SEQ ID NO: 9171773 - DNA, 22 bp, Homo sapiens
ccaggcaggcgatggtgcagtg

SEQ ID NO: 9171774 - DNA, 22 bp, Homo sapiens
ccaggcaggcgatggtgcagtg

SEQ ID NO: 9171775 - DNA, 22 bp, Homo sapiens
ccaggcctcccttttccagcca

SEQ ID NO: 9171776 - DNA, 19 bp, Homo sapiens
ccaggcctcctgggaggtc

SEQ ID NO: 9171777 - DNA, 19 bp, Homo sapiens
ccaggcctcctgggaggtc

SEQ ID NO: 9171778 - DNA, 22 bp, Homo sapiens
ccaggcctcctgtgagtggacc

SEQ ID NO: 9171779 - DNA, 22 bp, Homo sapiens
ccaggcctcctgtgagtggacc

SEQ ID NO: 9171780 - DNA, 22 bp, Homo sapiens
ccaggcaggcgatggtgcagtg

SEQ ID NO: 9171781 - DNA, 22 bp, Homo sapiens
ccaggcaggcgatggtgcagtg

SEQ ID NO: 9171782 - DNA, 22 bp, Homo sapiens
ccaggcaggcagcgttctcagg

SEQ ID NO: 9171783 - DNA, 22 bp, Homo sapiens
ccaggcaggcagcgttctcagg

SEQ ID NO: 9171784 - DNA, 22 bp, Homo sapiens
ccaggcaggcagcgttctcagg

SEQ ID NO: 9171785 - DNA, 22 bp, Homo sapiens
ccaggcaggcagcgttctcagg

SEQ ID NO: 9171786 - DNA, 17 bp, Homo sapiens
tcttctcttccagtctt

SEQ ID NO: 9171787 - DNA, 22 bp, Homo sapiens
ccaggcagcaaattttctgaat

SEQ ID NO: 9171788 - DNA, 22 bp, Homo sapiens
ccaggcagccaagtgtgtgtgt

SEQ ID NO: 9171789 - DNA, 22 bp, Homo sapiens
ccaggcagcctgctccattctg

SEQ ID NO: 9171790 - DNA, 22 bp, Homo sapiens
tcttctctcctgcttggcagaa

SEQ ID NO: 9171791 - DNA, 22 bp, Homo sapiens
tcttctctcctgcttggcagaa

SEQ ID NO: 9171792 - DNA, 22 bp, Homo sapiens
tcttctctcatgtaggagggaa

SEQ ID NO: 9171793 - DNA, 22 bp, Homo sapiens
tcttagaagttcatgttccagc

SEQ ID NO: 9171794 - DNA, 22 bp, Homo sapiens
tcttagaaattccccagtggct

SEQ ID NO: 9171795 - DNA, 22 bp, Homo sapiens
ccaggcagcaaattttctgaat

SEQ ID NO: 9171796 - DNA, 22 bp, Homo sapiens
ccaggcagcaaattttctgaat

SEQ ID NO: 9171797 - DNA, 22 bp, Homo sapiens
tcttctgatgccagtaaccatg

SEQ ID NO: 9171798 - DNA, 17 bp, Homo sapiens
tcttctcttccagtctt

SEQ ID NO: 9171799 - DNA, 17 bp, Homo sapiens
tcttctcttccagtctt

SEQ ID NO: 9171800 - DNA, 22 bp, Homo sapiens
tcttctctgtggcctggtggtg

SEQ ID NO: 9171801 - DNA, 22 bp, Homo sapiens
tcttctctgtggcctggtggtg

SEQ ID NO: 9171802 - DNA, 22 bp, Homo sapiens
tcttctctgtggcctggtggtg

SEQ ID NO: 9171803 - DNA, 22 bp, Homo sapiens
tgaaatgacaaaggtttttctt

SEQ ID NO: 9171804 - DNA, 22 bp, Homo sapiens
tgaaatgacaaaggtttttctt

SEQ ID NO: 9171805 - DNA, 22 bp, Homo sapiens
tgaaatgaatgtgattcgatag

SEQ ID NO: 9171806 - DNA, 22 bp, Homo sapiens
tgaaatgaagggcttgttctgg

SEQ ID NO: 9171807 - DNA, 22 bp, Homo sapiens
tgaaatgaagggcttgttctgg

SEQ ID NO: 9171808 - DNA, 22 bp, Homo sapiens
tgaaatgacagtcttaagctct

SEQ ID NO: 9171809 - DNA, 22 bp, Homo sapiens
tgaaatgacagtcttaagctct

SEQ ID NO: 9171810 - DNA, 21 bp, Homo sapiens
tgaaatgagaatgctgagcac

SEQ ID NO: 9171811 - DNA, 22 bp, Homo sapiens
tgaaatgagagcacagaataaa

SEQ ID NO: 9171812 - DNA, 22 bp, Homo sapiens
tgaaatgagagcacagaataaa

SEQ ID NO: 9171813 - DNA, 22 bp, Homo sapiens
ccaggcttctgattccaggcac

SEQ ID NO: 9171814 - DNA, 22 bp, Homo sapiens
ccaggcttcctaatgtgtgcag

SEQ ID NO: 9171815 - DNA, 22 bp, Homo sapiens
tgaaatgaaacagaacatatca

SEQ ID NO: 9171816 - DNA, 22 bp, Homo sapiens
tgaaatgaaacagaacatatca

SEQ ID NO: 9171817 - DNA, 22 bp, Homo sapiens
ccaggctgtgcttttcataaat

SEQ ID NO: 9171818 - DNA, 22 bp, Homo sapiens
ccaggctgtggtttagatagag

SEQ ID NO: 9171819 - DNA, 22 bp, Homo sapiens
ccaggctgtggtttagatagag

SEQ ID NO: 9171820 - DNA, 22 bp, Homo sapiens
tcttttgtgattctttagttac

SEQ ID NO: 9171821 - DNA, 22 bp, Homo sapiens
tcttttgtgattcttcagttac

SEQ ID NO: 9171822 - DNA, 22 bp, Homo sapiens
tcttttgtgccaagtaatgaat

SEQ ID NO: 9171823 - DNA, 22 bp, Homo sapiens
tcttttgtggatgaagaaatgg

SEQ ID NO: 9171824 - DNA, 22 bp, Homo sapiens
tcttttgtgccaagtaatgaat

SEQ ID NO: 9171825 - DNA, 22 bp, Homo sapiens
tcttttgtggatgaagaaatgg

SEQ ID NO: 9171826 - DNA, 18 bp, Homo sapiens
tgaaacaagaatggtgca

SEQ ID NO: 9171827 - DNA, 22 bp, Homo sapiens
tgaaacaagatccacagacttg

SEQ ID NO: 9171828 - DNA, 22 bp, Homo sapiens
tgaaacaagggaccgtcctttc

SEQ ID NO: 9171829 - DNA, 22 bp, Homo sapiens
tgaaacaagtttaagggatcta

SEQ ID NO: 9171830 - DNA, 22 bp, Homo sapiens
tgaaacactttcaattacatat

SEQ ID NO: 9171831 - DNA, 22 bp, Homo sapiens
tgaaacactttcaattacatat

SEQ ID NO: 9171832 - DNA, 21 bp, Homo sapiens
tgaaacactctttccatgaga

SEQ ID NO: 9171833 - DNA, 22 bp, Homo sapiens
tgaaacacaagcctggttagtg

SEQ ID NO: 9171834 - DNA, 22 bp, Homo sapiens
tgaaacaattagaatgtaatga

SEQ ID NO: 9171835 - DNA, 22 bp, Homo sapiens
tgaaacaattagaatgtaatga

SEQ ID NO: 9171836 - DNA, 22 bp, Homo sapiens
tgaaacaattagaatgtaatga

SEQ ID NO: 9171837 - DNA, 22 bp, Homo sapiens
tgaaacaattagaatgtaatga

SEQ ID NO: 9171838 - DNA, 22 bp, Homo sapiens
tcttttgtcggtgtatcatgga

SEQ ID NO: 9171839 - DNA, 22 bp, Homo sapiens
tcttttgtgaggacaaggtacg

SEQ ID NO: 9171840 - DNA, 22 bp, Homo sapiens
tcttttgtactcagtattgaca

SEQ ID NO: 9171841 - DNA, 22 bp, Homo sapiens
tcttttgtagctaacacattca

SEQ ID NO: 9171842 - DNA, 22 bp, Homo sapiens
tcttttgtagctaacacattca

SEQ ID NO: 9171843 - DNA, 22 bp, Homo sapiens
tcttttggaaatgatgtgcagg

SEQ ID NO: 9171844 - DNA, 21 bp, Homo sapiens
tcttttgtaactatttcagcc

SEQ ID NO: 9171845 - DNA, 22 bp, Homo sapiens
tcttttcttgcattattgcact

SEQ ID NO: 9171846 - DNA, 22 bp, Homo sapiens
tcttttcttcttaatggttaat

SEQ ID NO: 9171847 - DNA, 22 bp, Homo sapiens
tcttttcttcttaatggttaat

SEQ ID NO: 9171848 - DNA, 22 bp, Homo sapiens
tcttttgagggccagaggaaga

SEQ ID NO: 9171849 - DNA, 22 bp, Homo sapiens
tcttttcttgcattattgcact

SEQ ID NO: 9171850 - DNA, 22 bp, Homo sapiens
tcttttcttgcattattgcact

SEQ ID NO: 9171851 - DNA, 22 bp, Homo sapiens
tcttttcttgcattattgcact

SEQ ID NO: 9171852 - DNA, 22 bp, Homo sapiens
tcttttctgtaactcagtgtct

SEQ ID NO: 9171853 - DNA, 22 bp, Homo sapiens
tcttttctggactctgcatgga

SEQ ID NO: 9171854 - DNA, 22 bp, Homo sapiens
tcttgcatacactatatgtaca

SEQ ID NO: 9171855 - DNA, 22 bp, Homo sapiens
tcttgcataggtcttttatcag

SEQ ID NO: 9171856 - DNA, 22 bp, Homo sapiens
tcttgcatgatattctgtattt

SEQ ID NO: 9171857 - DNA, 22 bp, Homo sapiens
tcttgcagttgcgcagtgcatg

SEQ ID NO: 9171858 - DNA, 22 bp, Homo sapiens
tctttggttgcactgcaggtgt

SEQ ID NO: 9171859 - DNA, 22 bp, Homo sapiens
tctttggtttctgtctctgtaa

SEQ ID NO: 9171860 - DNA, 22 bp, Homo sapiens
tctttggtttctgtctctgtaa

SEQ ID NO: 9171861 - DNA, 22 bp, Homo sapiens
tcttgccacttcatcccctttc

SEQ ID NO: 9171862 - DNA, 22 bp, Homo sapiens
tcttgcagaagaagctgccaag

SEQ ID NO: 9171863 - DNA, 22 bp, Homo sapiens
tcttgcagaggcactgtgtcag

SEQ ID NO: 9171864 - DNA, 22 bp, Homo sapiens
tcttgcagaggcactgtgtcag

SEQ ID NO: 9171865 - DNA, 19 bp, Homo sapiens
tcttgcagccccagcaggc

SEQ ID NO: 9171866 - DNA, 22 bp, Homo sapiens
tcttgcacttcatgaatatgtt

SEQ ID NO: 9171867 - DNA, 22 bp, Homo sapiens
tcttgcacttcatgaatatgtt

SEQ ID NO: 9171868 - DNA, 22 bp, Homo sapiens
tcttgcacttcatgaatatgtt

SEQ ID NO: 9171869 - DNA, 21 bp, Homo sapiens
tcttgattttggacttcttcc

SEQ ID NO: 9171870 - DNA, 22 bp, Homo sapiens
tcttgattttgtgaataagttg

SEQ ID NO: 9171871 - DNA, 22 bp, Homo sapiens
tcttgatttgtaaaagaaggat

SEQ ID NO: 9171872 - DNA, 21 bp, Homo sapiens
tcttgattttggacttcttcc

SEQ ID NO: 9171873 - DNA, 22 bp, Homo sapiens
ccaggcctcctgtgagtggacc

SEQ ID NO: 9171874 - DNA, 22 bp, Homo sapiens
ccaggcctctggctgcttagtc

SEQ ID NO: 9171875 - DNA, 23 bp, Homo sapiens
ccaggcctctcagagggtgtgcc

SEQ ID NO: 9171876 - DNA, 22 bp, Homo sapiens
ccaggcctgattgggaatcttg

SEQ ID NO: 9171877 - DNA, 19 bp, Homo sapiens
ccaggcctctggggcctgt

SEQ ID NO: 9171878 - DNA, 22 bp, Homo sapiens
ccaggcctgcatctgctgcgca

SEQ ID NO: 9171879 - DNA, 22 bp, Homo sapiens
tcttgatttgaattgcagttgt

SEQ ID NO: 9171880 - DNA, 22 bp, Homo sapiens
tcttgatttgaattgcagttgt

SEQ ID NO: 9171881 - DNA, 22 bp, Homo sapiens
tcttgatttgaattgcagttgt

SEQ ID NO: 9171882 - DNA, 22 bp, Homo sapiens
tgaaatgagataatttaagtgc

SEQ ID NO: 9171883 - DNA, 22 bp, Homo sapiens
tgaaatgagataatttaagtgc

SEQ ID NO: 9171884 - DNA, 22 bp, Homo sapiens
tgaaatgagagcacagaataaa

SEQ ID NO: 9171885 - DNA, 22 bp, Homo sapiens
tgaaatgagagcacagaataaa

SEQ ID NO: 9171886 - DNA, 22 bp, Homo sapiens
tgaaatgagatagataatcagg

SEQ ID NO: 9171887 - DNA, 22 bp, Homo sapiens
tgaaatgagatagataatcagg

SEQ ID NO: 9171888 - DNA, 22 bp, Homo sapiens
tgaaatgagatagataatcagg

SEQ ID NO: 9171889 - DNA, 22 bp, Homo sapiens
tgaaatgagcatttattcttta

SEQ ID NO: 9171890 - DNA, 22 bp, Homo sapiens
tgaaatgagcatttattcttta

SEQ ID NO: 9171891 - DNA, 22 bp, Homo sapiens
ccagggaagctggtcacgcagg

SEQ ID NO: 9171892 - DNA, 22 bp, Homo sapiens
ccagggaagattagaagccact

SEQ ID NO: 9171893 - DNA, 22 bp, Homo sapiens
ccagggaagattagaagccact

SEQ ID NO: 9171894 - DNA, 22 bp, Homo sapiens
ccagggaaggactctctttccc

SEQ ID NO: 9171895 - DNA, 22 bp, Homo sapiens
tgaaatgatatctgataacaaa

SEQ ID NO: 9171896 - DNA, 22 bp, Homo sapiens
tgaaatgatatctgataacaaa

SEQ ID NO: 9171897 - DNA, 22 bp, Homo sapiens
tgaaatgatatctgataacaaa

SEQ ID NO: 9171898 - DNA, 22 bp, Homo sapiens
tgaaatgatgtacaagaaggca

SEQ ID NO: 9171899 - DNA, 22 bp, Homo sapiens
tgaaatgatcagtttggttact

SEQ ID NO: 9171900 - DNA, 22 bp, Homo sapiens
tgaaatgatcagtttggttact

SEQ ID NO: 9171901 - DNA, 22 bp, Homo sapiens
ccagggagtttccaatctgaga

SEQ ID NO: 9171902 - DNA, 23 bp, Homo sapiens
ccagggagtgctactatcaagcc

SEQ ID NO: 9171903 - DNA, 23 bp, Homo sapiens
ccagggagtgctactatcaagcc

SEQ ID NO: 9171904 - DNA, 22 bp, Homo sapiens
ccagggagtttccaatctgaga

SEQ ID NO: 9171905 - DNA, 22 bp, Homo sapiens
ccagggatgcagaggttgcagt

SEQ ID NO: 9171906 - DNA, 22 bp, Homo sapiens
ccagggagtttccaatctgaga

SEQ ID NO: 9171907 - DNA, 22 bp, Homo sapiens
ccagggatgccaagctttacca

SEQ ID NO: 9171908 - DNA, 22 bp, Homo sapiens
ccagggagggtcctgtggcttc

SEQ ID NO: 9171909 - DNA, 22 bp, Homo sapiens
ccagggagggtcctgtggcttc

SEQ ID NO: 9171910 - DNA, 23 bp, Homo sapiens
ccagggaggttgattggttaccc

SEQ ID NO: 9171911 - DNA, 22 bp, Homo sapiens
ccagggagggtcctgtggcttc

SEQ ID NO: 9171912 - DNA, 23 bp, Homo sapiens
ccagggaggttgattggttaccc

SEQ ID NO: 9171913 - DNA, 22 bp, Homo sapiens
ccagggagggtcctgtggcttc

SEQ ID NO: 9171914 - DNA, 17 bp, Homo sapiens
ccagggaggggccgcgc

SEQ ID NO: 9171915 - DNA, 17 bp, Homo sapiens
ccagggaggggccgcgc

SEQ ID NO: 9171916 - DNA, 17 bp, Homo sapiens
ccagggaggggccgcgc

SEQ ID NO: 9171917 - DNA, 22 bp, Homo sapiens
ccagggagggtcctgtggcttc

SEQ ID NO: 9171918 - DNA, 22 bp, Homo sapiens
ccagggagggtcctgtggcttc

SEQ ID NO: 9171919 - DNA, 22 bp, Homo sapiens
ccagggcaggggctggagttca

SEQ ID NO: 9171920 - DNA, 22 bp, Homo sapiens
ccagggcaggggctggagttca

SEQ ID NO: 9171921 - DNA, 22 bp, Homo sapiens
ccagggcaggagaaagactcac

SEQ ID NO: 9171922 - DNA, 22 bp, Homo sapiens
ccagggcagggaccacgtgtct

SEQ ID NO: 9171923 - DNA, 22 bp, Homo sapiens
ccagggcacgttgggacagtac

SEQ ID NO: 9171924 - DNA, 22 bp, Homo sapiens
ccagggcacgttgggacagtac

SEQ ID NO: 9171925 - DNA, 22 bp, Homo sapiens
ccagggcacgttgggacagtac

SEQ ID NO: 9171926 - DNA, 22 bp, Homo sapiens
ccagggcaacgctgtctcagag

SEQ ID NO: 9171927 - DNA, 22 bp, Homo sapiens
ccagggcaacgctgtctcagag

SEQ ID NO: 9171928 - DNA, 22 bp, Homo sapiens
ccagggcaattatttggagggt

SEQ ID NO: 9171929 - DNA, 22 bp, Homo sapiens
ccagggcaattatttggagggt

SEQ ID NO: 9171930 - DNA, 22 bp, Homo sapiens
ccagggcaattatttggagggt

SEQ ID NO: 9171931 - DNA, 22 bp, Homo sapiens
ccagggcaataggaacactttt

SEQ ID NO: 9171932 - DNA, 21 bp, Homo sapiens
ccagggatgttgaactgaaag

SEQ ID NO: 9171933 - DNA, 22 bp, Homo sapiens
ccagggcaaatgagatcatagc

SEQ ID NO: 9171934 - DNA, 22 bp, Homo sapiens
ccagggcaaatgagatcatagc

SEQ ID NO: 9171935 - DNA, 22 bp, Homo sapiens
tgaaggtgtctttgtgaacatc

SEQ ID NO: 9171936 - DNA, 22 bp, Homo sapiens
ccagggcatcctcacatcgcag

SEQ ID NO: 9171937 - DNA, 22 bp, Homo sapiens
ccagggcatcctcacatcgcag

SEQ ID NO: 9171938 - DNA, 22 bp, Homo sapiens
ccagggcagtgggagaaggtgc

SEQ ID NO: 9171939 - DNA, 22 bp, Homo sapiens
ccagggcaggggctggagttca

SEQ ID NO: 9171940 - DNA, 22 bp, Homo sapiens
ccagggcatcacatccagtgtt

SEQ ID NO: 9171941 - DNA, 22 bp, Homo sapiens
ccagggcatcacatccagtgtt

SEQ ID NO: 9171942 - DNA, 22 bp, Homo sapiens
ccagggcagtgggagaaggtgc

SEQ ID NO: 9171943 - DNA, 22 bp, Homo sapiens
tgaagtagcaggctgatggttt

SEQ ID NO: 9171944 - DNA, 22 bp, Homo sapiens
tgaagtatacaggctctgctaa

SEQ ID NO: 9171945 - DNA, 22 bp, Homo sapiens
tgaagtatctatggatataaga

SEQ ID NO: 9171946 - DNA, 23 bp, Homo sapiens
tgaagtgaaatttcacaagggac

SEQ ID NO: 9171947 - DNA, 22 bp, Homo sapiens
tgaagtggaccctggacagacc

SEQ ID NO: 9171948 - DNA, 22 bp, Homo sapiens
tgaagtgacctggggcagtgta

SEQ ID NO: 9171949 - DNA, 22 bp, Homo sapiens
tgaagttagaactatgaggata

SEQ ID NO: 9171950 - DNA, 22 bp, Homo sapiens
tgaagtgggggaacgagagttc

SEQ ID NO: 9171951 - DNA, 22 bp, Homo sapiens
tgaagttatatatgttgaaaat

SEQ ID NO: 9171952 - DNA, 22 bp, Homo sapiens
ccagggctccattgctcatcct

SEQ ID NO: 9171953 - DNA, 22 bp, Homo sapiens
ccagggctccattgctcatcct

SEQ ID NO: 9171954 - DNA, 22 bp, Homo sapiens
ccagggctccattgctcatcct

SEQ ID NO: 9171955 - DNA, 22 bp, Homo sapiens
ccagggctccccagaagtaccc

SEQ ID NO: 9171956 - DNA, 22 bp, Homo sapiens
ccagggctccattgctcatcct

SEQ ID NO: 9171957 - DNA, 22 bp, Homo sapiens
ccagggctcgggtgcttagtca

SEQ ID NO: 9171958 - DNA, 22 bp, Homo sapiens
ccagggctcgggtgcttagtca

SEQ ID NO: 9171959 - DNA, 22 bp, Homo sapiens
ccagggctgccgcatccctggt

SEQ ID NO: 9171960 - DNA, 22 bp, Homo sapiens
ccagggctgagctgtgaccatg

SEQ ID NO: 9171961 - DNA, 22 bp, Homo sapiens
ccagggctctatgagggtggag

SEQ ID NO: 9171962 - DNA, 22 bp, Homo sapiens
ccagggctctgcttctgccatg

SEQ ID NO: 9171963 - DNA, 22 bp, Homo sapiens
ccagggctgagactgtattggg

SEQ ID NO: 9171964 - DNA, 19 bp, Homo sapiens
tgcaagtgtcttggacaag

SEQ ID NO: 9171965 - DNA, 22 bp, Homo sapiens
tgcaataacccagtatctgtga

SEQ ID NO: 9171966 - DNA, 22 bp, Homo sapiens
tgcaataaagtgctataaatcc

SEQ ID NO: 9171967 - DNA, 22 bp, Homo sapiens
tgataagatgctgagtgcattg

SEQ ID NO: 9171968 - DNA, 22 bp, Homo sapiens
tgataatattttgaatcataag

SEQ ID NO: 9171969 - DNA, 22 bp, Homo sapiens
tgataacttgtaaattagattc

SEQ ID NO: 9171970 - DNA, 22 bp, Homo sapiens
tgcaataaggagtaatagtaaa

SEQ ID NO: 9171971 - DNA, 22 bp, Homo sapiens
tgcaatatgttgcattgtatgg

SEQ ID NO: 9171972 - DNA, 20 bp, Homo sapiens
tgcaatattcagttggttat

SEQ ID NO: 9171973 - DNA, 22 bp, Homo sapiens
tgcacagatgctaggaggtgaa

SEQ ID NO: 9171974 - DNA, 22 bp, Homo sapiens
cccaaggggtgttgatggagga

SEQ ID NO: 9171975 - DNA, 18 bp, Homo sapiens
tgcactagatgctggcag

SEQ ID NO: 9171976 - DNA, 22 bp, Homo sapiens
cccaaggacacgggcagggaca

SEQ ID NO: 9171977 - DNA, 22 bp, Homo sapiens
cccaaggacacgggcagggaca

SEQ ID NO: 9171978 - DNA, 22 bp, Homo sapiens
tgcagagaaaccagtggaggac

SEQ ID NO: 9171979 - DNA, 22 bp, Homo sapiens
tgcagagaaaccagtggaggac

SEQ ID NO: 9171980 - DNA, 22 bp, Homo sapiens
tgcagagaaagtgtagacaggc

SEQ ID NO: 9171981 - DNA, 22 bp, Homo sapiens
tgcagagaagaggacagttcta

SEQ ID NO: 9171982 - DNA, 22 bp, Homo sapiens
tgcagagaagaggacagttcta

SEQ ID NO: 9171983 - DNA, 22 bp, Homo sapiens
tgcagagaagaggacagttcta

SEQ ID NO: 9171984 - DNA, 22 bp, Homo sapiens
tgcagagaccactgtgccttcc

SEQ ID NO: 9171985 - DNA, 22 bp, Homo sapiens
tgcagagaccactgtgccttcc

SEQ ID NO: 9171986 - DNA, 22 bp, Homo sapiens
tgcagagagatcctcagggttt

SEQ ID NO: 9171987 - DNA, 22 bp, Homo sapiens
tgcagagagatatggcaagagg

SEQ ID NO: 9171988 - DNA, 22 bp, Homo sapiens
tgcagagagatatggcaagagg

SEQ ID NO: 9171989 - DNA, 22 bp, Homo sapiens
tgcagagacttgtgtgcatttg

SEQ ID NO: 9171990 - DNA, 22 bp, Homo sapiens
tgcagagagacccctgggccag

SEQ ID NO: 9171991 - DNA, 22 bp, Homo sapiens
tgcagagacttgtgtgcatttg

SEQ ID NO: 9171992 - DNA, 22 bp, Homo sapiens
tgcagagagacccctgggccag

SEQ ID NO: 9171993 - DNA, 19 bp, Homo sapiens
tgcagagagaggcaaagaa

SEQ ID NO: 9171994 - DNA, 22 bp, Homo sapiens
tgcactgaatagtagactgtac

SEQ ID NO: 9171995 - DNA, 22 bp, Homo sapiens
tgcacttgaggattttccacag

SEQ ID NO: 9171996 - DNA, 22 bp, Homo sapiens
tgcacttggctgtgatctctag

SEQ ID NO: 9171997 - DNA, 22 bp, Homo sapiens
tgcacttcattgtaaattgtac

SEQ ID NO: 9171998 - DNA, 21 bp, Homo sapiens
tgcacttcagtggctaaattc

SEQ ID NO: 9171999 - DNA, 22 bp, Homo sapiens
tgcacttcaaaaatgtcactga

SEQ ID NO: 9172000 - DNA, 22 bp, Homo sapiens
cccagagatgggaggtgatcgg

SEQ ID NO: 9172001 - DNA, 22 bp, Homo sapiens
cccagagcctcattctgttggg

SEQ ID NO: 9172002 - DNA, 22 bp, Homo sapiens
tgcagagagccctgccttcctc

SEQ ID NO: 9172003 - DNA, 22 bp, Homo sapiens
tgcagagagccagctctctcgg

SEQ ID NO: 9172004 - DNA, 22 bp, Homo sapiens
tgcagagagatcctcagggttt

SEQ ID NO: 9172005 - DNA, 16 bp, Homo sapiens
tgcagagagcatggtg

SEQ ID NO: 9172006 - DNA, 22 bp, Homo sapiens
cccagagctccggtcctgccca

SEQ ID NO: 9172007 - DNA, 22 bp, Homo sapiens
cccagagctcagtgtgcaaggt

SEQ ID NO: 9172008 - DNA, 22 bp, Homo sapiens
cccagagctccggtcctgccca

SEQ ID NO: 9172009 - DNA, 22 bp, Homo sapiens
cccagagcctcattctgttggg

SEQ ID NO: 9172010 - DNA, 22 bp, Homo sapiens
cccagagctcagtgtgcaaggt

SEQ ID NO: 9172011 - DNA, 19 bp, Homo sapiens
cccagaggaatgcctggaa

SEQ ID NO: 9172012 - DNA, 23 bp, Homo sapiens
cccagaggagcagggcgtgagat

SEQ ID NO: 9172013 - DNA, 18 bp, Homo sapiens
cccagaggaatgcctgga

SEQ ID NO: 9172014 - DNA, 22 bp, Homo sapiens
cccagagctgggtgggcagcgg

SEQ ID NO: 9172015 - DNA, 22 bp, Homo sapiens
cccagagctgggtgggcagcgg

SEQ ID NO: 9172016 - DNA, 22 bp, Homo sapiens
cccagagctgattgttggagcc

SEQ ID NO: 9172017 - DNA, 22 bp, Homo sapiens
cccagagctgattgttggagcc

SEQ ID NO: 9172018 - DNA, 22 bp, Homo sapiens
cccagagctgagtctgatatat

SEQ ID NO: 9172019 - DNA, 22 bp, Homo sapiens
tgcaggcattggtgagagaagc

SEQ ID NO: 9172020 - DNA, 22 bp, Homo sapiens
tgcaggcataaccgatgttgat

SEQ ID NO: 9172021 - DNA, 22 bp, Homo sapiens
tgcaggcataaccgatgttgat

SEQ ID NO: 9172022 - DNA, 22 bp, Homo sapiens
tgcaggcaggggatgagcagcc

SEQ ID NO: 9172023 - DNA, 22 bp, Homo sapiens
tgcaggcaggggatgagcagcc

SEQ ID NO: 9172024 - DNA, 22 bp, Homo sapiens
tgcaggcaggggatgagcagcc

SEQ ID NO: 9172025 - DNA, 22 bp, Homo sapiens
tgcaggcagtaggccagctcca

SEQ ID NO: 9172026 - DNA, 22 bp, Homo sapiens
tgcaggcagtaggccagctcca

SEQ ID NO: 9172027 - DNA, 21 bp, Homo sapiens
tgcaggcaggcagagatgctg

SEQ ID NO: 9172028 - DNA, 21 bp, Homo sapiens
tgcaggcaggcagagatgctg

SEQ ID NO: 9172029 - DNA, 22 bp, Homo sapiens
cccagcagccttgtcccttctc

SEQ ID NO: 9172030 - DNA, 22 bp, Homo sapiens
cccagcagcctggatgttcttt

SEQ ID NO: 9172031 - DNA, 22 bp, Homo sapiens
cccagcagcctggatgttcttt

SEQ ID NO: 9172032 - DNA, 22 bp, Homo sapiens
cccagcagcctggatgttcttt

SEQ ID NO: 9172033 - DNA, 22 bp, Homo sapiens
cccagcagccagaatgaggagc

SEQ ID NO: 9172034 - DNA, 22 bp, Homo sapiens
cccagcagcttgcacagtgctg

SEQ ID NO: 9172035 - DNA, 22 bp, Homo sapiens
cccagcagcttgcacagtgctg

SEQ ID NO: 9172036 - DNA, 22 bp, Homo sapiens
cccagcagcttgcacagtgctg

SEQ ID NO: 9172037 - DNA, 22 bp, Homo sapiens
cccagcagccttgtcccttctc

SEQ ID NO: 9172038 - DNA, 22 bp, Homo sapiens
cccagcagccttgtcccttctc

SEQ ID NO: 9172039 - DNA, 22 bp, Homo sapiens
tgcaggcccagtgtagaggctc

SEQ ID NO: 9172040 - DNA, 22 bp, Homo sapiens
tgcaggcccagtgtagaggctc

SEQ ID NO: 9172041 - DNA, 22 bp, Homo sapiens
tgcaggccagggtagggactag

SEQ ID NO: 9172042 - DNA, 22 bp, Homo sapiens
tgcaggcctatggtggggcccc

SEQ ID NO: 9172043 - DNA, 22 bp, Homo sapiens
tgcaggccggccctaggcctca

SEQ ID NO: 9172044 - DNA, 22 bp, Homo sapiens
tgcaggcctatggtggggcccc

SEQ ID NO: 9172045 - DNA, 22 bp, Homo sapiens
tgcaggcctcacacctggcacc

SEQ ID NO: 9172046 - DNA, 22 bp, Homo sapiens
cccagcaggtcggtgctgcctg

SEQ ID NO: 9172047 - DNA, 22 bp, Homo sapiens
cccagcaggtcggtgctgcctg

SEQ ID NO: 9172048 - DNA, 22 bp, Homo sapiens
cccagcaggtcggtgctgcctg

SEQ ID NO: 9172049 - DNA, 22 bp, Homo sapiens
cccagcagggtctctgtgtcta

SEQ ID NO: 9172050 - DNA, 22 bp, Homo sapiens
cccagcagggtctctgtgtcta

SEQ ID NO: 9172051 - DNA, 22 bp, Homo sapiens
cccagcagggtctctgtgtcta

SEQ ID NO: 9172052 - DNA, 22 bp, Homo sapiens
cccagcaggcatgttgggagga

SEQ ID NO: 9172053 - DNA, 22 bp, Homo sapiens
cccagcaggcatgttgggagga

SEQ ID NO: 9172054 - DNA, 22 bp, Homo sapiens
cccagcaggaggaggttgcagt

SEQ ID NO: 9172055 - DNA, 22 bp, Homo sapiens
tgcagggccttctagaccatgg

SEQ ID NO: 9172056 - DNA, 22 bp, Homo sapiens
tgcagggatcctagctgaagag

SEQ ID NO: 9172057 - DNA, 22 bp, Homo sapiens
tgcagctgattaaagggcagac

SEQ ID NO: 9172058 - DNA, 22 bp, Homo sapiens
tgcagccaccacctctgctgaa

SEQ ID NO: 9172059 - DNA, 22 bp, Homo sapiens
tgcagccaccacctctgctgaa

SEQ ID NO: 9172060 - DNA, 19 bp, Homo sapiens
tgcagccacgtgagagact

SEQ ID NO: 9172061 - DNA, 20 bp, Homo sapiens
tgcagctgcaggagggtggg

SEQ ID NO: 9172062 - DNA, 20 bp, Homo sapiens
tgcagctgcaggagggtggg

SEQ ID NO: 9172063 - DNA, 22 bp, Homo sapiens
tgcagctgattaaagggcagac

SEQ ID NO: 9172064 - DNA, 22 bp, Homo sapiens
tgcagctgcaagtccaggtcag

SEQ ID NO: 9172065 - DNA, 22 bp, Homo sapiens
tgcagctgcaagtccaggtcag

SEQ ID NO: 9172066 - DNA, 22 bp, Homo sapiens
cccagaggaggcaaagctctgt

SEQ ID NO: 9172067 - DNA, 22 bp, Homo sapiens
cccagaggaggatctcggcccg

SEQ ID NO: 9172068 - DNA, 22 bp, Homo sapiens
cccagaggctgagttgggagca

SEQ ID NO: 9172069 - DNA, 22 bp, Homo sapiens
cccagaggaggcaaagctctgt

SEQ ID NO: 9172070 - DNA, 22 bp, Homo sapiens
cccagaggggtcgtctgagggg

SEQ ID NO: 9172071 - DNA, 22 bp, Homo sapiens
cccagaggggtcgtctgagggg

SEQ ID NO: 9172072 - DNA, 22 bp, Homo sapiens
cccagagggaagggaatgaggt

SEQ ID NO: 9172073 - DNA, 22 bp, Homo sapiens
tgcaggaatagctacagagctg

SEQ ID NO: 9172074 - DNA, 22 bp, Homo sapiens
tgcaggaatagctacagagctg

SEQ ID NO: 9172075 - DNA, 22 bp, Homo sapiens
tgcaggaatagctacagagctg

SEQ ID NO: 9172076 - DNA, 22 bp, Homo sapiens
tgcaggaagtttcctgaacttt

SEQ ID NO: 9172077 - DNA, 22 bp, Homo sapiens
tgcagctgcctagggctggctt

SEQ ID NO: 9172078 - DNA, 23 bp, Homo sapiens
tgcagctgcctctggcgggccgg

SEQ ID NO: 9172079 - DNA, 23 bp, Homo sapiens
tgcagctgcctctggcgggccgg

SEQ ID NO: 9172080 - DNA, 22 bp, Homo sapiens
tgcagctgcctagggctggctt

SEQ ID NO: 9172081 - DNA, 22 bp, Homo sapiens
tgcagctgcctagggctggctt

SEQ ID NO: 9172082 - DNA, 22 bp, Homo sapiens
tgcagctgcaggagggtgggag

SEQ ID NO: 9172083 - DNA, 22 bp, Homo sapiens
tgcagctgcaggagggtgggag

SEQ ID NO: 9172084 - DNA, 22 bp, Homo sapiens
tgcaggaatattgatgaactta

SEQ ID NO: 9172085 - DNA, 22 bp, Homo sapiens
tgcaggaatcagaggggaagcg

SEQ ID NO: 9172086 - DNA, 22 bp, Homo sapiens
tgcaggaatcagaggggaagcg

SEQ ID NO: 9172087 - DNA, 22 bp, Homo sapiens
tgcaggaatgaggttctcagtt

SEQ ID NO: 9172088 - DNA, 22 bp, Homo sapiens
tgcaggaattttttgcagaaag

SEQ ID NO: 9172089 - DNA, 22 bp, Homo sapiens
tgcaggaattttttgcagaaag

SEQ ID NO: 9172090 - DNA, 20 bp, Homo sapiens
tgcaggaatttgcattcctt

SEQ ID NO: 9172091 - DNA, 17 bp, Homo sapiens
ccatactgacatattga

SEQ ID NO: 9172092 - DNA, 21 bp, Homo sapiens
ccatacctacctcacctggtt

SEQ ID NO: 9172093 - DNA, 22 bp, Homo sapiens
ccatacacacaccaaatttgta

SEQ ID NO: 9172094 - DNA, 18 bp, Homo sapiens
tgaggctgagggtagagg

SEQ ID NO: 9172095 - DNA, 22 bp, Homo sapiens
ccatatcagaagattgtcaccc

SEQ ID NO: 9172096 - DNA, 22 bp, Homo sapiens
ccatcacagtccccatcgtgat

SEQ ID NO: 9172097 - DNA, 22 bp, Homo sapiens
ccatcacagtccccatcgtgat

SEQ ID NO: 9172098 - DNA, 22 bp, Homo sapiens
ccatcagattagcaaaatccag

SEQ ID NO: 9172099 - DNA, 22 bp, Homo sapiens
ccatcagcatgggagcatgggc

SEQ ID NO: 9172100 - DNA, 22 bp, Homo sapiens
ccatcagacaattctttctctt

SEQ ID NO: 9172101 - DNA, 22 bp, Homo sapiens
ccatcactcatctagatattta

SEQ ID NO: 9172102 - DNA, 22 bp, Homo sapiens
ccatcagctccagtatcttctg

SEQ ID NO: 9172103 - DNA, 23 bp, Homo sapiens
ccatcaggcctccgtgtccagcc

SEQ ID NO: 9172104 - DNA, 22 bp, Homo sapiens
ccatccacagtcttgattattt

SEQ ID NO: 9172105 - DNA, 21 bp, Homo sapiens
ccatccactgagtggttccct

SEQ ID NO: 9172106 - DNA, 22 bp, Homo sapiens
tgaggccagggattccatcatt

SEQ ID NO: 9172107 - DNA, 22 bp, Homo sapiens
tgaggccagtctcatcacaggc

SEQ ID NO: 9172108 - DNA, 17 bp, Homo sapiens
tgaggccatggcaccat

SEQ ID NO: 9172109 - DNA, 22 bp, Homo sapiens
tgaggccatggtcttcccagtc

SEQ ID NO: 9172110 - DNA, 22 bp, Homo sapiens
tgaggccatggaactagcttgg

SEQ ID NO: 9172111 - DNA, 22 bp, Homo sapiens
tgagtctggcggagggaggagc

SEQ ID NO: 9172112 - DNA, 21 bp, Homo sapiens
tgagtttcagaggggaaggaa

SEQ ID NO: 9172113 - DNA, 22 bp, Homo sapiens
tgagtttaatgatatttatatg

SEQ ID NO: 9172114 - DNA, 22 bp, Homo sapiens
tgagttttttcaacatatgaag

SEQ ID NO: 9172115 - DNA, 22 bp, Homo sapiens
tgagttttgtcttgctagaagt

SEQ ID NO: 9172116 - DNA, 22 bp, Homo sapiens
tgataaacattttaggaactaa

SEQ ID NO: 9172117 - DNA, 22 bp, Homo sapiens
tgagtcctggctttgggatgta

SEQ ID NO: 9172118 - DNA, 22 bp, Homo sapiens
tgagtctgctcctggtagcaga

SEQ ID NO: 9172119 - DNA, 22 bp, Homo sapiens
tgagtctgctcctggtagcaga

SEQ ID NO: 9172120 - DNA, 22 bp, Homo sapiens
tgagtctgatttttctagcatt

SEQ ID NO: 9172121 - DNA, 22 bp, Homo sapiens
tgagtctgatttttctagcatt

SEQ ID NO: 9172122 - DNA, 22 bp, Homo sapiens
tgagtccaagagccagtgggaa

SEQ ID NO: 9172123 - DNA, 22 bp, Homo sapiens
tgagtccaccttagtatatggg

SEQ ID NO: 9172124 - DNA, 22 bp, Homo sapiens
ccatcccttctctggccagcag

SEQ ID NO: 9172125 - DNA, 22 bp, Homo sapiens
ccatcccttcaccacagcagta

SEQ ID NO: 9172126 - DNA, 22 bp, Homo sapiens
ccatccctgccattatagccca

SEQ ID NO: 9172127 - DNA, 22 bp, Homo sapiens
ccatccctgccattatagccca

SEQ ID NO: 9172128 - DNA, 22 bp, Homo sapiens
ccatccctcctccaccagctag

SEQ ID NO: 9172129 - DNA, 22 bp, Homo sapiens
ccatccctgagtcacaggaggg

SEQ ID NO: 9172130 - DNA, 22 bp, Homo sapiens
ccatccctgagtcacaggaggg

SEQ ID NO: 9172131 - DNA, 22 bp, Homo sapiens
ccatccctcctactcacagtca

SEQ ID NO: 9172132 - DNA, 22 bp, Homo sapiens
ccatccagaccagtccatgggt

SEQ ID NO: 9172133 - DNA, 22 bp, Homo sapiens
ccagtggagtttttatacccag

SEQ ID NO: 9172134 - DNA, 22 bp, Homo sapiens
ccagtggccatgcacgagcagc

SEQ ID NO: 9172135 - DNA, 22 bp, Homo sapiens
ccagtggaattaaaaataagtg

SEQ ID NO: 9172136 - DNA, 22 bp, Homo sapiens
ccagtggacaatttctgaggaa

SEQ ID NO: 9172137 - DNA, 22 bp, Homo sapiens
ccagtggaaatgtggtcaggat

SEQ ID NO: 9172138 - DNA, 22 bp, Homo sapiens
ccagtgcttctttgctagctgg

SEQ ID NO: 9172139 - DNA, 22 bp, Homo sapiens
ccagtggacttctccctgtggt

SEQ ID NO: 9172140 - DNA, 22 bp, Homo sapiens
ccagtggacaatttctgaggaa

SEQ ID NO: 9172141 - DNA, 22 bp, Homo sapiens
ccagtgctaaggtagcctctgc

SEQ ID NO: 9172142 - DNA, 22 bp, Homo sapiens
ccagtgctaaggtagcctctgc

SEQ ID NO: 9172143 - DNA, 21 bp, Homo sapiens
ccagtgctacagctgcctgac

SEQ ID NO: 9172144 - DNA, 22 bp, Homo sapiens
ccagtgcttccaggaatacggt

SEQ ID NO: 9172145 - DNA, 22 bp, Homo sapiens
ccagtgcccagctgcccaggca

SEQ ID NO: 9172146 - DNA, 22 bp, Homo sapiens
ccagtgcattgccgtgtctagg

SEQ ID NO: 9172147 - DNA, 22 bp, Homo sapiens
ccagtgcataatcaatacagcc

SEQ ID NO: 9172148 - DNA, 22 bp, Homo sapiens
ccagtgcccagtctccctggtc

SEQ ID NO: 9172149 - DNA, 19 bp, Homo sapiens
ccagtgccggcgctgggga

SEQ ID NO: 9172150 - DNA, 22 bp, Homo sapiens
ccagtgcccagtctccctggtc

SEQ ID NO: 9172151 - DNA, 22 bp, Homo sapiens
ccagtgcccagtctccctggtc

SEQ ID NO: 9172152 - DNA, 17 bp, Homo sapiens
ccagtgcctgtggcaac

SEQ ID NO: 9172153 - DNA, 22 bp, Homo sapiens
ccagtgcctatctcctctggga

SEQ ID NO: 9172154 - DNA, 22 bp, Homo sapiens
ccagtgcctatctcctctggga

SEQ ID NO: 9172155 - DNA, 22 bp, Homo sapiens
ccagtgcctgtgggcatggtgc

SEQ ID NO: 9172156 - DNA, 22 bp, Homo sapiens
ccagtgcctgtgggcatggtgc

SEQ ID NO: 9172157 - DNA, 22 bp, Homo sapiens
tgagccagtgtggtaaagctga

SEQ ID NO: 9172158 - DNA, 22 bp, Homo sapiens
ccagtcccagctctgccatgct

SEQ ID NO: 9172159 - DNA, 22 bp, Homo sapiens
ccagtcccaggcagaaatccag

SEQ ID NO: 9172160 - DNA, 19 bp, Homo sapiens
ccagtcccatacaggagat

SEQ ID NO: 9172161 - DNA, 22 bp, Homo sapiens
ccagtcccatctctgtcgctta

SEQ ID NO: 9172162 - DNA, 22 bp, Homo sapiens
tgagcccaggaggcagaggttg

SEQ ID NO: 9172163 - DNA, 22 bp, Homo sapiens
ccagtgcaggtgagcaccaggt

SEQ ID NO: 9172164 - DNA, 22 bp, Homo sapiens
ccagtgcagtccccctgaactg

SEQ ID NO: 9172165 - DNA, 22 bp, Homo sapiens
ccagtctgaggcctggtgaggg

SEQ ID NO: 9172166 - DNA, 22 bp, Homo sapiens
ccagtgcaggtgagcaccaggt

SEQ ID NO: 9172167 - DNA, 22 bp, Homo sapiens
tgagcccaggagttggagaccg

SEQ ID NO: 9172168 - DNA, 22 bp, Homo sapiens
ccagtctgaggcctggtgaggg

SEQ ID NO: 9172169 - DNA, 22 bp, Homo sapiens
tgagcagtaacagctcacaggg

SEQ ID NO: 9172170 - DNA, 22 bp, Homo sapiens
tgagcagtaacagctcacaggg

SEQ ID NO: 9172171 - DNA, 21 bp, Homo sapiens
tgagcaggtgctgcttttatg

SEQ ID NO: 9172172 - DNA, 21 bp, Homo sapiens
tgagcaggtgcagggaagtgg

SEQ ID NO: 9172173 - DNA, 22 bp, Homo sapiens
tgagcaggtcaagactccagct

SEQ ID NO: 9172174 - DNA, 22 bp, Homo sapiens
tgagcaggtcaggaagtacatt

SEQ ID NO: 9172175 - DNA, 22 bp, Homo sapiens
tgagcaggtgagtctagggcag

SEQ ID NO: 9172176 - DNA, 22 bp, Homo sapiens
tgagcaggtgagtctagggcag

SEQ ID NO: 9172177 - DNA, 22 bp, Homo sapiens
ccagggctgctcattggctggt

SEQ ID NO: 9172178 - DNA, 22 bp, Homo sapiens
ccagggctgcctggccgtgtgt

SEQ ID NO: 9172179 - DNA, 22 bp, Homo sapiens
ccagggctgctgggggagttga

SEQ ID NO: 9172180 - DNA, 22 bp, Homo sapiens
ccagggctgctcattggctggt

SEQ ID NO: 9172181 - DNA, 22 bp, Homo sapiens
ccagggctgctcattggctggt

SEQ ID NO: 9172182 - DNA, 22 bp, Homo sapiens
ccagggctgctcattggctggt

SEQ ID NO: 9172183 - DNA, 22 bp, Homo sapiens
tgagcagggagctgggctgagc

SEQ ID NO: 9172184 - DNA, 22 bp, Homo sapiens
ccagggctgctgtgggactcca

SEQ ID NO: 9172185 - DNA, 22 bp, Homo sapiens
ccagtcagagaaaatgtccact

SEQ ID NO: 9172186 - DNA, 22 bp, Homo sapiens
ccaggtgtgtcaccattgccca

SEQ ID NO: 9172187 - DNA, 22 bp, Homo sapiens
ccagtcagagcagcgctcgcat

SEQ ID NO: 9172188 - DNA, 22 bp, Homo sapiens
ccagtcagggcaggagcctggt

SEQ ID NO: 9172189 - DNA, 22 bp, Homo sapiens
ccagtcagggcaggagcctggt

SEQ ID NO: 9172190 - DNA, 22 bp, Homo sapiens
ccagtcagtcagttgctggcat

SEQ ID NO: 9172191 - DNA, 22 bp, Homo sapiens
ccagtcagccaagctgcagcgg

SEQ ID NO: 9172192 - DNA, 22 bp, Homo sapiens
ccagtcagccaagctgcagcgg

SEQ ID NO: 9172193 - DNA, 22 bp, Homo sapiens
ccagtcagtcagttgctggcat

SEQ ID NO: 9172194 - DNA, 22 bp, Homo sapiens
ccagtccacgtcaagaagaggt

SEQ ID NO: 9172195 - DNA, 22 bp, Homo sapiens
ccagtccacgtcaagaagaggt

SEQ ID NO: 9172196 - DNA, 22 bp, Homo sapiens
ccaggtgggaggaaagcagaga

SEQ ID NO: 9172197 - DNA, 22 bp, Homo sapiens
ccaggtggccctgccctactct

SEQ ID NO: 9172198 - DNA, 17 bp, Homo sapiens
ccaggtgggaggtgggg

SEQ ID NO: 9172199 - DNA, 22 bp, Homo sapiens
ccaggtggaggtgtgaggtcct

SEQ ID NO: 9172200 - DNA, 22 bp, Homo sapiens
tgggcactgaagctttgagcag

SEQ ID NO: 9172201 - DNA, 23 bp, Homo sapiens
tgggatagaatttcatggctgct

SEQ ID NO: 9172202 - DNA, 21 bp, Homo sapiens
tgggatagaaatatggctgct

SEQ ID NO: 9172203 - DNA, 22 bp, Homo sapiens
tgggagagcactgcagccccgg

SEQ ID NO: 9172204 - DNA, 22 bp, Homo sapiens
tgggcagacattgagtttgttc

SEQ ID NO: 9172205 - DNA, 22 bp, Homo sapiens
tgggagagaattctggtgactg

SEQ ID NO: 9172206 - DNA, 22 bp, Homo sapiens
tgggagagaattctggtgactg

SEQ ID NO: 9172207 - DNA, 22 bp, Homo sapiens
tgggagagagaattcccagtgg

SEQ ID NO: 9172208 - DNA, 22 bp, Homo sapiens
tgggagagaattctggtgactg

SEQ ID NO: 9172209 - DNA, 22 bp, Homo sapiens
tgggagagataggcttctggac

SEQ ID NO: 9172210 - DNA, 22 bp, Homo sapiens
tgggacaggaggcctctggaga

SEQ ID NO: 9172211 - DNA, 22 bp, Homo sapiens
tgggacagattataagtctgca

SEQ ID NO: 9172212 - DNA, 22 bp, Homo sapiens
tgggacagattataagtctgca

SEQ ID NO: 9172213 - DNA, 22 bp, Homo sapiens
tgggacagagtgagctttggcc

SEQ ID NO: 9172214 - DNA, 22 bp, Homo sapiens
tgggacagagtgagctttggcc

SEQ ID NO: 9172215 - DNA, 22 bp, Homo sapiens
cctctcccacgtggcagaggct

SEQ ID NO: 9172216 - DNA, 22 bp, Homo sapiens
tggctttaggagctatatacct

SEQ ID NO: 9172217 - DNA, 22 bp, Homo sapiens
tggctttacttaaactgaatca

SEQ ID NO: 9172218 - DNA, 22 bp, Homo sapiens
tgggaaggcagtcactgtccta

SEQ ID NO: 9172219 - DNA, 22 bp, Homo sapiens
tgggaaggcagtcactgtccta

SEQ ID NO: 9172220 - DNA, 22 bp, Homo sapiens
tgggaaggcagtcactgtccta

SEQ ID NO: 9172221 - DNA, 22 bp, Homo sapiens
cctctcccgggtgccgctgggc

SEQ ID NO: 9172222 - DNA, 19 bp, Homo sapiens
cctctcccatgcttacctc

SEQ ID NO: 9172223 - DNA, 22 bp, Homo sapiens
tggcttggctaagatctaagct

SEQ ID NO: 9172224 - DNA, 22 bp, Homo sapiens
tggcttgcaaaattatttttct

SEQ ID NO: 9172225 - DNA, 23 bp, Homo sapiens
tggcttgctaatgttccaaataa

SEQ ID NO: 9172226 - DNA, 22 bp, Homo sapiens
tggcttgcttccccattctcat

SEQ ID NO: 9172227 - DNA, 22 bp, Homo sapiens
tggcttgctactgaggtgtcag

SEQ ID NO: 9172228 - DNA, 22 bp, Homo sapiens
tggcttctttccactgtcctgt

SEQ ID NO: 9172229 - DNA, 22 bp, Homo sapiens
tggcttctttctttccatgtgt

SEQ ID NO: 9172230 - DNA, 22 bp, Homo sapiens
tggcttctttgtagaaattgaa

SEQ ID NO: 9172231 - DNA, 22 bp, Homo sapiens
tggcttctttgtgacagctctt

SEQ ID NO: 9172232 - DNA, 22 bp, Homo sapiens
tggcttgggtgtctcagctctt

SEQ ID NO: 9172233 - DNA, 22 bp, Homo sapiens
tggcttgtcatgtatctgaggc

SEQ ID NO: 9172234 - DNA, 22 bp, Homo sapiens
cctccaggctggttatcagctg

SEQ ID NO: 9172235 - DNA, 22 bp, Homo sapiens
cctccaggctggttatcagctg

SEQ ID NO: 9172236 - DNA, 22 bp, Homo sapiens
cctccagggcagacggggagca

SEQ ID NO: 9172237 - DNA, 22 bp, Homo sapiens
cctccagcgcgatccactccgg

SEQ ID NO: 9172238 - DNA, 21 bp, Homo sapiens
tggccaaggaatagaagctct

SEQ ID NO: 9172239 - DNA, 21 bp, Homo sapiens
tggccaaggaatagaagctct

SEQ ID NO: 9172240 - DNA, 22 bp, Homo sapiens
cctccagggcccctctcactgg

SEQ ID NO: 9172241 - DNA, 22 bp, Homo sapiens
cctccagggcccctctcactgg

SEQ ID NO: 9172242 - DNA, 22 bp, Homo sapiens
cctccagggcccctctcactgg

SEQ ID NO: 9172243 - DNA, 21 bp, Homo sapiens
cctccaggtgattccgtgctc

SEQ ID NO: 9172244 - DNA, 22 bp, Homo sapiens
cctccagggcagacggggagca

SEQ ID NO: 9172245 - DNA, 22 bp, Homo sapiens
cctccagggcagacggggagca

SEQ ID NO: 9172246 - DNA, 22 bp, Homo sapiens
cctccagggcagacggggagca

SEQ ID NO: 9172247 - DNA, 23 bp, Homo sapiens
tggccaagataatctcagttttc

SEQ ID NO: 9172248 - DNA, 21 bp, Homo sapiens
tggccaaggaatagaagctct

SEQ ID NO: 9172249 - DNA, 22 bp, Homo sapiens
tggcattttgttcagtatatgg

SEQ ID NO: 9172250 - DNA, 23 bp, Homo sapiens
tggcattttagttagcttcagtg

SEQ ID NO: 9172251 - DNA, 22 bp, Homo sapiens
tggcattttagacatgatggtg

SEQ ID NO: 9172252 - DNA, 22 bp, Homo sapiens
tggcagtggtgtctgcacaggc

SEQ ID NO: 9172253 - DNA, 22 bp, Homo sapiens
tggcagtgggaatggacaaaca

SEQ ID NO: 9172254 - DNA, 22 bp, Homo sapiens
tggcagtgggaagctggaagtc

SEQ ID NO: 9172255 - DNA, 22 bp, Homo sapiens
tggcagtgtcttgctggggcag

SEQ ID NO: 9172256 - DNA, 22 bp, Homo sapiens
tggcagtgtcttatcaggagtg

SEQ ID NO: 9172257 - DNA, 22 bp, Homo sapiens
tggcagtgtataggtggctcct

SEQ ID NO: 9172258 - DNA, 22 bp, Homo sapiens
tggcagtgtcctactggttggt

SEQ ID NO: 9172259 - DNA, 22 bp, Homo sapiens
tggcagtgtgggaggaaggtac

SEQ ID NO: 9172260 - DNA, 22 bp, Homo sapiens
tggcatttgctcccttgtgttc

SEQ ID NO: 9172261 - DNA, 19 bp, Homo sapiens
tggcatttggaggcaacct

SEQ ID NO: 9172262 - DNA, 22 bp, Homo sapiens
cctcccaccgtatctcagtggc

SEQ ID NO: 9172263 - DNA, 23 bp, Homo sapiens
cctcccacctatttcactttctt

SEQ ID NO: 9172264 - DNA, 22 bp, Homo sapiens
cctcccacttcttgctgaggtc

SEQ ID NO: 9172265 - DNA, 22 bp, Homo sapiens
cctcctctggtgctgccaaccc

SEQ ID NO: 9172266 - DNA, 17 bp, Homo sapiens
cctcccacaccgccctg

SEQ ID NO: 9172267 - DNA, 22 bp, Homo sapiens
cctccaggtgttacatatgact

SEQ ID NO: 9172268 - DNA, 22 bp, Homo sapiens
cctccatctccagcttctgcct

SEQ ID NO: 9172269 - DNA, 22 bp, Homo sapiens
cctccagtactccagtccagcg

SEQ ID NO: 9172270 - DNA, 22 bp, Homo sapiens
cctccaggtgttacatatgact

SEQ ID NO: 9172271 - DNA, 22 bp, Homo sapiens
cctccaggtgttacatatgact

SEQ ID NO: 9172272 - DNA, 22 bp, Homo sapiens
cctcctgggacaggctggcaca

SEQ ID NO: 9172273 - DNA, 22 bp, Homo sapiens
cctcctggcctgtgcagagccc

SEQ ID NO: 9172274 - DNA, 22 bp, Homo sapiens
cctcctggcctgtgcagagccc

SEQ ID NO: 9172275 - DNA, 22 bp, Homo sapiens
cctcctgggagagcacggaggg

SEQ ID NO: 9172276 - DNA, 22 bp, Homo sapiens
tggggagagaccggaatgtttc

SEQ ID NO: 9172277 - DNA, 22 bp, Homo sapiens
tggggagaagcaatagactcta

SEQ ID NO: 9172278 - DNA, 22 bp, Homo sapiens
tggggagaaatgtctttgttcc

SEQ ID NO: 9172279 - DNA, 22 bp, Homo sapiens
tggggacttgccttgttgctca

SEQ ID NO: 9172280 - DNA, 19 bp, Homo sapiens
cctgatggagctggtgcaa

SEQ ID NO: 9172281 - DNA, 22 bp, Homo sapiens
cctgagttagttgctgtgtctc

SEQ ID NO: 9172282 - DNA, 19 bp, Homo sapiens
cctgagtgtttcagagaca

SEQ ID NO: 9172283 - DNA, 19 bp, Homo sapiens
cctgagtgtttcagagaca

SEQ ID NO: 9172284 - DNA, 22 bp, Homo sapiens
cctgagtggtgctaagcagata

SEQ ID NO: 9172285 - DNA, 22 bp, Homo sapiens
cctgagtgtaataatgaaggca

SEQ ID NO: 9172286 - DNA, 22 bp, Homo sapiens
cctgagtgtaataatgaaggca

SEQ ID NO: 9172287 - DNA, 22 bp, Homo sapiens
cctgagtggggagctaagtgag

SEQ ID NO: 9172288 - DNA, 22 bp, Homo sapiens
cctgagtggggagctaagtgag

SEQ ID NO: 9172289 - DNA, 17 bp, Homo sapiens
cctgagtgggagaggaa

SEQ ID NO: 9172290 - DNA, 22 bp, Homo sapiens
cctgagtggccaggcagctgtg

SEQ ID NO: 9172291 - DNA, 22 bp, Homo sapiens
cctgagtggcagggtttgggct

SEQ ID NO: 9172292 - DNA, 22 bp, Homo sapiens
cctgagtggagggattctgcag

SEQ ID NO: 9172293 - DNA, 22 bp, Homo sapiens
cctgagtggagggattctgcag

SEQ ID NO: 9172294 - DNA, 22 bp, Homo sapiens
cctgagtgcttccagagtcatg

SEQ ID NO: 9172295 - DNA, 22 bp, Homo sapiens
cctgagtgcttccagagtcatg

SEQ ID NO: 9172296 - DNA, 21 bp, Homo sapiens
cctgagtgagacctggcccgt

SEQ ID NO: 9172297 - DNA, 22 bp, Homo sapiens
cctgagtgacctgaggtctagt

SEQ ID NO: 9172298 - DNA, 22 bp, Homo sapiens
cctgagtgaattccctcactgt

SEQ ID NO: 9172299 - DNA, 22 bp, Homo sapiens
cctgagtgccatgagagcaccc

SEQ ID NO: 9172300 - DNA, 22 bp, Homo sapiens
cctgagtgccatgagagcaccc

SEQ ID NO: 9172301 - DNA, 22 bp, Homo sapiens
cctgaggtcatggtccagtgtt

SEQ ID NO: 9172302 - DNA, 22 bp, Homo sapiens
cctgagtgaattccctcactgt

SEQ ID NO: 9172303 - DNA, 22 bp, Homo sapiens
cctgagtctttcccattgcgct

SEQ ID NO: 9172304 - DNA, 22 bp, Homo sapiens
cctgagtcttggcttcttggct

SEQ ID NO: 9172305 - DNA, 22 bp, Homo sapiens
tggggagaggtatcattgagat

SEQ ID NO: 9172306 - DNA, 22 bp, Homo sapiens
tggggagaggtatcattgagat

SEQ ID NO: 9172307 - DNA, 22 bp, Homo sapiens
tggggagcacggtagggaaatg

SEQ ID NO: 9172308 - DNA, 22 bp, Homo sapiens
tggggagcacggtagggaaatg

SEQ ID NO: 9172309 - DNA, 22 bp, Homo sapiens
cctgcagaccacactcagtcct

SEQ ID NO: 9172310 - DNA, 22 bp, Homo sapiens
cctgcagctgtaggagaaggcg

SEQ ID NO: 9172311 - DNA, 22 bp, Homo sapiens
cctgcagctttgcctcctgaac

SEQ ID NO: 9172312 - DNA, 22 bp, Homo sapiens
cctgcagctttgcctcctgaac

SEQ ID NO: 9172313 - DNA, 22 bp, Homo sapiens
cctgcagctttgcctcctgaac

SEQ ID NO: 9172314 - DNA, 22 bp, Homo sapiens
cctgcaggctgcaggccagttc

SEQ ID NO: 9172315 - DNA, 22 bp, Homo sapiens
cctgcaggctgcaggccagttc

SEQ ID NO: 9172316 - DNA, 22 bp, Homo sapiens
cctgcagggaatcgaggcagaa

SEQ ID NO: 9172317 - DNA, 22 bp, Homo sapiens
cctgcaggctgcaggccagttc

SEQ ID NO: 9172318 - DNA, 22 bp, Homo sapiens
cctgcagggaatcgaggcagaa

SEQ ID NO: 9172319 - DNA, 22 bp, Homo sapiens
cctgcagggaatcgaggcagaa

SEQ ID NO: 9172320 - DNA, 22 bp, Homo sapiens
tgggctcatggcccagcactgg

SEQ ID NO: 9172321 - DNA, 22 bp, Homo sapiens
tgggctccggcggcctcaggct

SEQ ID NO: 9172322 - DNA, 22 bp, Homo sapiens
tgggctccggcggcctcaggct

SEQ ID NO: 9172323 - DNA, 22 bp, Homo sapiens
tgggctccagcacctgtgctct

SEQ ID NO: 9172324 - DNA, 22 bp, Homo sapiens
tgggctccgttgcctggggcag

SEQ ID NO: 9172325 - DNA, 22 bp, Homo sapiens
tgggctccgttgcctggggcag

SEQ ID NO: 9172326 - DNA, 22 bp, Homo sapiens
tgggctccggcggcctcaggct

SEQ ID NO: 9172327 - DNA, 22 bp, Homo sapiens
tgggctccggcggcctcaggct

SEQ ID NO: 9172328 - DNA, 22 bp, Homo sapiens
tgggctccgttgcctggggcag

SEQ ID NO: 9172329 - DNA, 22 bp, Homo sapiens
tgggcctggagtttgtccagag

SEQ ID NO: 9172330 - DNA, 22 bp, Homo sapiens
tgggcctggccctgtggaggag

SEQ ID NO: 9172331 - DNA, 23 bp, Homo sapiens
tgggcctggcctcccagtccagc

SEQ ID NO: 9172332 - DNA, 23 bp, Homo sapiens
tgggcctggcctcccagtccagc

SEQ ID NO: 9172333 - DNA, 22 bp, Homo sapiens
tgggcctggccctgtggaggag

SEQ ID NO: 9172334 - DNA, 22 bp, Homo sapiens
tgggctcagtgggagaaagggc

SEQ ID NO: 9172335 - DNA, 23 bp, Homo sapiens
tgggcctggcctcccagtccagc

SEQ ID NO: 9172336 - DNA, 22 bp, Homo sapiens
tgggcctggacaaggccactag

SEQ ID NO: 9172337 - DNA, 22 bp, Homo sapiens
tgggcctggacaaggccactag

SEQ ID NO: 9172338 - DNA, 22 bp, Homo sapiens
tgggcctggagtttgtccagag

SEQ ID NO: 9172339 - DNA, 22 bp, Homo sapiens
tgggcctggagtttgtccagag

SEQ ID NO: 9172340 - DNA, 22 bp, Homo sapiens
tgggcctggagccctggagagt

SEQ ID NO: 9172341 - DNA, 22 bp, Homo sapiens
tgggcaggatgcgttgattctt

SEQ ID NO: 9172342 - DNA, 21 bp, Homo sapiens
tggtacagaggaggtgaagtg

SEQ ID NO: 9172343 - DNA, 22 bp, Homo sapiens
tggtaccatttcccaggagtgt

SEQ ID NO: 9172344 - DNA, 22 bp, Homo sapiens
tggtagcaacatctcagtggct

SEQ ID NO: 9172345 - DNA, 22 bp, Homo sapiens
cctgcctatgagacgttttgcc

SEQ ID NO: 9172346 - DNA, 22 bp, Homo sapiens
cctgcctactgagttttatatt

SEQ ID NO: 9172347 - DNA, 22 bp, Homo sapiens
cctgcctatgagacgttttgcc

SEQ ID NO: 9172348 - DNA, 22 bp, Homo sapiens
cctgcctcatcaacttgtcgtg

SEQ ID NO: 9172349 - DNA, 22 bp, Homo sapiens
cctgcctcaggactctgcatat

SEQ ID NO: 9172350 - DNA, 23 bp, Homo sapiens
cctgccggacctggtggggagac

SEQ ID NO: 9172351 - DNA, 22 bp, Homo sapiens
cctgcccttctttccccagcat

SEQ ID NO: 9172352 - DNA, 22 bp, Homo sapiens
cctgcccttctttccccagcat

SEQ ID NO: 9172353 - DNA, 22 bp, Homo sapiens
cctgcctcatcaacttgtcgtg

SEQ ID NO: 9172354 - DNA, 22 bp, Homo sapiens
cctgcctcccagaggtcctcta

SEQ ID NO: 9172355 - DNA, 22 bp, Homo sapiens
cctgcctcccagaggtcctcta

SEQ ID NO: 9172356 - DNA, 23 bp, Homo sapiens
cctgcctccccatcagttataca

SEQ ID NO: 9172357 - DNA, 22 bp, Homo sapiens
cctgcctgaaggtcagccaccc

SEQ ID NO: 9172358 - DNA, 19 bp, Homo sapiens
cctgcctgaccccggctac

SEQ ID NO: 9172359 - DNA, 22 bp, Homo sapiens
cctgcctgacagagaaggttca

SEQ ID NO: 9172360 - DNA, 19 bp, Homo sapiens
cctgcctgagctgtccctc

SEQ ID NO: 9172361 - DNA, 22 bp, Homo sapiens
tggttacccagtcgctggagtt

SEQ ID NO: 9172362 - DNA, 22 bp, Homo sapiens
tggttacccagtcgctggagtt

SEQ ID NO: 9172363 - DNA, 22 bp, Homo sapiens
tggttacatatcctttggagcc

SEQ ID NO: 9172364 - DNA, 22 bp, Homo sapiens
tggtgggagtccgctgtgctgc

SEQ ID NO: 9172365 - DNA, 22 bp, Homo sapiens
cctgcctgattccaggatggct

SEQ ID NO: 9172366 - DNA, 22 bp, Homo sapiens
cctgcctgcaaaatgggacaag

SEQ ID NO: 9172367 - DNA, 22 bp, Homo sapiens
cctgcctgcaccttctctgggg

SEQ ID NO: 9172368 - DNA, 22 bp, Homo sapiens
tggtaatatatgccagataaaa

SEQ ID NO: 9172369 - DNA, 22 bp, Homo sapiens
tgggtgggagcaccctgtctgg

SEQ ID NO: 9172370 - DNA, 22 bp, Homo sapiens
tgggtgggagcaccctgtctgg

SEQ ID NO: 9172371 - DNA, 22 bp, Homo sapiens
tgggtgggagcaccctgtctgg

SEQ ID NO: 9172372 - DNA, 23 bp, Homo sapiens
tggtaatagggagcagaaggtag

SEQ ID NO: 9172373 - DNA, 22 bp, Homo sapiens
tggtaatactcatggcctgtca

SEQ ID NO: 9172374 - DNA, 22 bp, Homo sapiens
tgggtggcacttctggggtcca

SEQ ID NO: 9172375 - DNA, 22 bp, Homo sapiens
tgggtggcacttctggggtcca

SEQ ID NO: 9172376 - DNA, 22 bp, Homo sapiens
tgggtcagtttgggggccagcc

SEQ ID NO: 9172377 - DNA, 18 bp, Homo sapiens
tgggtggctagggagttt

SEQ ID NO: 9172378 - DNA, 22 bp, Homo sapiens
tgggtggattaggatagggtat

SEQ ID NO: 9172379 - DNA, 22 bp, Homo sapiens
tgggtccacaaacatcagatat

SEQ ID NO: 9172380 - DNA, 22 bp, Homo sapiens
tgggtggagaagtggacctgct

SEQ ID NO: 9172381 - DNA, 19 bp, Homo sapiens
cctgcagggatgagaggtt

SEQ ID NO: 9172382 - DNA, 22 bp, Homo sapiens
cctgcagggaatcgaggcagaa

SEQ ID NO: 9172383 - DNA, 19 bp, Homo sapiens
cctgcagggatgagaggtt

SEQ ID NO: 9172384 - DNA, 22 bp, Homo sapiens
cctgcaggggagagacttctag

SEQ ID NO: 9172385 - DNA, 22 bp, Homo sapiens
cctgcaggggagagacttctag

SEQ ID NO: 9172386 - DNA, 19 bp, Homo sapiens
cctgcagggatgagaggtt

SEQ ID NO: 9172387 - DNA, 22 bp, Homo sapiens
cctgcaggtccccggatgcgca

SEQ ID NO: 9172388 - DNA, 22 bp, Homo sapiens
cctgcaggtccccggatgcgca

SEQ ID NO: 9172389 - DNA, 22 bp, Homo sapiens
cctgcagggtgctgccacagat

SEQ ID NO: 9172390 - DNA, 22 bp, Homo sapiens
cctgcagggtgctgccacagat

SEQ ID NO: 9172391 - DNA, 22 bp, Homo sapiens
cctgcagggtgctgccacagat

SEQ ID NO: 9172392 - DNA, 22 bp, Homo sapiens
cctgcagggtgctgccacagat

SEQ ID NO: 9172393 - DNA, 22 bp, Homo sapiens
cctgccagaaaagagggagttc

SEQ ID NO: 9172394 - DNA, 22 bp, Homo sapiens
tgggtcagtttgggggccagcc

SEQ ID NO: 9172395 - DNA, 22 bp, Homo sapiens
cctgcaggttgcagaggcggaa

SEQ ID NO: 9172396 - DNA, 22 bp, Homo sapiens
cctgcaggttgcagaggcggaa

SEQ ID NO: 9172397 - DNA, 22 bp, Homo sapiens
cctgcaggttgcagaggcggaa

SEQ ID NO: 9172398 - DNA, 22 bp, Homo sapiens
cctgcaggtttcccccggacgg

SEQ ID NO: 9172399 - DNA, 22 bp, Homo sapiens
cctgcaggttgcagaggcggaa

SEQ ID NO: 9172400 - DNA, 22 bp, Homo sapiens
cctgcaggttgcagaggcggaa

SEQ ID NO: 9172401 - DNA, 22 bp, Homo sapiens
tggaaagaaaaacaggccatga

SEQ ID NO: 9172402 - DNA, 22 bp, Homo sapiens
tggagaatgatattccatcatt

SEQ ID NO: 9172403 - DNA, 22 bp, Homo sapiens
tggagaatctggaaactgttga

SEQ ID NO: 9172404 - DNA, 22 bp, Homo sapiens
tggagaattctatgttgagggg

SEQ ID NO: 9172405 - DNA, 18 bp, Homo sapiens
tggagacatagacaatgt

SEQ ID NO: 9172406 - DNA, 22 bp, Homo sapiens
tggagacagagatagccaattg

SEQ ID NO: 9172407 - DNA, 23 bp, Homo sapiens
tggagaattcttccttccactgt

SEQ ID NO: 9172408 - DNA, 22 bp, Homo sapiens
tggagatgaatatgtgtacctg

SEQ ID NO: 9172409 - DNA, 22 bp, Homo sapiens
tggagacatttctcattaaaaa

SEQ ID NO: 9172410 - DNA, 22 bp, Homo sapiens
tggagactctgcatctgtgaca

SEQ ID NO: 9172411 - DNA, 21 bp, Homo sapiens
tggagactctggttctttgtg

SEQ ID NO: 9172412 - DNA, 21 bp, Homo sapiens
tggagactctggttctttgtg

SEQ ID NO: 9172413 - DNA, 22 bp, Homo sapiens
ccctccctttgcagcagtgcat

SEQ ID NO: 9172414 - DNA, 22 bp, Homo sapiens
ccctccctgaagaagttactct

SEQ ID NO: 9172415 - DNA, 22 bp, Homo sapiens
ccctcctcaactctggcttcca

SEQ ID NO: 9172416 - DNA, 22 bp, Homo sapiens
ccctcctcaactctggcttcca

SEQ ID NO: 9172417 - DNA, 22 bp, Homo sapiens
ccctcctcaactctggcttcca

SEQ ID NO: 9172418 - DNA, 23 bp, Homo sapiens
tggaaacattctgaatgtccatc

SEQ ID NO: 9172419 - DNA, 22 bp, Homo sapiens
tggaaactaggatggaagaaat

SEQ ID NO: 9172420 - DNA, 22 bp, Homo sapiens
tggaaactctacctctctaaga

SEQ ID NO: 9172421 - DNA, 22 bp, Homo sapiens
tggaaactcagggccagaagga

SEQ ID NO: 9172422 - DNA, 22 bp, Homo sapiens
tggagatgcacgagcaggtgga

SEQ ID NO: 9172423 - DNA, 22 bp, Homo sapiens
tggagatgggttaatggagaga

SEQ ID NO: 9172424 - DNA, 18 bp, Homo sapiens
tggagctgagggcaatgc

SEQ ID NO: 9172425 - DNA, 22 bp, Homo sapiens
tggaggaaaattactggggtct

SEQ ID NO: 9172426 - DNA, 23 bp, Homo sapiens
tggaggaaacacatcagaagacc

SEQ ID NO: 9172427 - DNA, 21 bp, Homo sapiens
tggaggaataaagcacagaag

SEQ ID NO: 9172428 - DNA, 22 bp, Homo sapiens
tggaggaatcagggcttaggct

SEQ ID NO: 9172429 - DNA, 19 bp, Homo sapiens
tggaggaagtatatttcat

SEQ ID NO: 9172430 - DNA, 22 bp, Homo sapiens
tggaggaagtggacagttgtgt

SEQ ID NO: 9172431 - DNA, 22 bp, Homo sapiens
tggaggaagttgctggaagtca

SEQ ID NO: 9172432 - DNA, 22 bp, Homo sapiens
tggaggaagtggctggccagaa

SEQ ID NO: 9172433 - DNA, 22 bp, Homo sapiens
tggaggcagtttaagtctgaga

SEQ ID NO: 9172434 - DNA, 22 bp, Homo sapiens
tggaggcagtttaagtctgaga

SEQ ID NO: 9172435 - DNA, 22 bp, Homo sapiens
tggaggagaactccctggctac

SEQ ID NO: 9172436 - DNA, 22 bp, Homo sapiens
tggaggacgtgtccaccatgaa

SEQ ID NO: 9172437 - DNA, 22 bp, Homo sapiens
tggaggcatcagagtgcttggc

SEQ ID NO: 9172438 - DNA, 22 bp, Homo sapiens
ccctggaggaagaaacaatggc

SEQ ID NO: 9172439 - DNA, 22 bp, Homo sapiens
ccctggaggaccccaatgtggc

SEQ ID NO: 9172440 - DNA, 22 bp, Homo sapiens
ccctggagggacagctgctcta

SEQ ID NO: 9172441 - DNA, 22 bp, Homo sapiens
ccctggagggacagctgctcta

SEQ ID NO: 9172442 - DNA, 22 bp, Homo sapiens
ccctggagggacagctgctcta

SEQ ID NO: 9172443 - DNA, 22 bp, Homo sapiens
ccctggagggatttctcaatca

SEQ ID NO: 9172444 - DNA, 22 bp, Homo sapiens
ccctggagggatttctcaatca

SEQ ID NO: 9172445 - DNA, 22 bp, Homo sapiens
tggaggcatgacagtgtctgga

SEQ ID NO: 9172446 - DNA, 22 bp, Homo sapiens
ccctttaagtcctggaacaaag

SEQ ID NO: 9172447 - DNA, 22 bp, Homo sapiens
ccctttaattccaacacaggaa

SEQ ID NO: 9172448 - DNA, 22 bp, Homo sapiens
ccctttagcccctgcagagact

SEQ ID NO: 9172449 - DNA, 22 bp, Homo sapiens
ccctttagcccctgcagagact

SEQ ID NO: 9172450 - DNA, 22 bp, Homo sapiens
ccctttcaacattctgccttgt

SEQ ID NO: 9172451 - DNA, 22 bp, Homo sapiens
cccttgggtgccagccacaagt

SEQ ID NO: 9172452 - DNA, 22 bp, Homo sapiens
cccttgggccccagctcagggc

SEQ ID NO: 9172453 - DNA, 22 bp, Homo sapiens
cccttgggccccagctcagggc

SEQ ID NO: 9172454 - DNA, 22 bp, Homo sapiens
cccttggggctctttgccaggc

SEQ ID NO: 9172455 - DNA, 22 bp, Homo sapiens
cccttggggtggaggttgcagt

SEQ ID NO: 9172456 - DNA, 22 bp, Homo sapiens
cccttgggcttccacccagccc

SEQ ID NO: 9172457 - DNA, 22 bp, Homo sapiens
cccttggggtggaggttgcagt

SEQ ID NO: 9172458 - DNA, 22 bp, Homo sapiens
cccttggcttctatgggttttc

SEQ ID NO: 9172459 - DNA, 22 bp, Homo sapiens
cccttggccactgcgccagtga

SEQ ID NO: 9172460 - DNA, 22 bp, Homo sapiens
tggcagggagccaccggtcatg

SEQ ID NO: 9172461 - DNA, 21 bp, Homo sapiens
cccttgcaaagtgctttccca

SEQ ID NO: 9172462 - DNA, 22 bp, Homo sapiens
cccttgcacatttgtctttaat

SEQ ID NO: 9172463 - DNA, 22 bp, Homo sapiens
cccttgcatcccatgtgtggcc

SEQ ID NO: 9172464 - DNA, 21 bp, Homo sapiens
cccttgcctgcactcctcggc

SEQ ID NO: 9172465 - DNA, 19 bp, Homo sapiens
tggcagggagagtttgaag

SEQ ID NO: 9172466 - DNA, 19 bp, Homo sapiens
tggcagggagagtttgaag

SEQ ID NO: 9172467 - DNA, 19 bp, Homo sapiens
tggcagggagagtttgaag

SEQ ID NO: 9172468 - DNA, 22 bp, Homo sapiens
ccctggcttggcactctccact

SEQ ID NO: 9172469 - DNA, 22 bp, Homo sapiens
ccctggctggaaattaagtagt

SEQ ID NO: 9172470 - DNA, 22 bp, Homo sapiens
ccctggcttaaaaacctcatat

SEQ ID NO: 9172471 - DNA, 22 bp, Homo sapiens
ccctgggacccgctgcagaggc

SEQ ID NO: 9172472 - DNA, 22 bp, Homo sapiens
ccctgggacccgctgcagaggc

SEQ ID NO: 9172473 - DNA, 22 bp, Homo sapiens
tggcaggctgagttggcctggt

SEQ ID NO: 9172474 - DNA, 22 bp, Homo sapiens
tggcagggaatacagatgttta

SEQ ID NO: 9172475 - DNA, 22 bp, Homo sapiens
ccctgggaggcttccaggcaga

SEQ ID NO: 9172476 - DNA, 22 bp, Homo sapiens
tggcaggaaaaacattggagat

SEQ ID NO: 9172477 - DNA, 19 bp, Homo sapiens
tggcaggcccaggatggac

SEQ ID NO: 9172478 - DNA, 19 bp, Homo sapiens
tggcaggcccaggatggac

SEQ ID NO: 9172479 - DNA, 19 bp, Homo sapiens
tggcaggcccaggatggac

SEQ ID NO: 9172480 - DNA, 22 bp, Homo sapiens
ccctggctgctaccaggtagct

SEQ ID NO: 9172481 - DNA, 22 bp, Homo sapiens
ccctggctgcttgtagtctggc

SEQ ID NO: 9172482 - DNA, 22 bp, Homo sapiens
ccctggctgcgtgatggatgaa

SEQ ID NO: 9172483 - DNA, 22 bp, Homo sapiens
tggcagagaacacacatgattc

SEQ ID NO: 9172484 - DNA, 22 bp, Homo sapiens
tggcagagaacacacatgattc

SEQ ID NO: 9172485 - DNA, 22 bp, Homo sapiens
tggcagaattttaaagacagat

SEQ ID NO: 9172486 - DNA, 22 bp, Homo sapiens
tggcagaatttctagcagattc

SEQ ID NO: 9172487 - DNA, 22 bp, Homo sapiens
ccctggagtgtgacgaggcatt

SEQ ID NO: 9172488 - DNA, 22 bp, Homo sapiens
ccctggagtgtgacgaggcatt

SEQ ID NO: 9172489 - DNA, 22 bp, Homo sapiens
ccctggagtgtgacgaggcatt

SEQ ID NO: 9172490 - DNA, 22 bp, Homo sapiens
tggcacagtcctgggtgcctgc

SEQ ID NO: 9172491 - DNA, 22 bp, Homo sapiens
tggcacagtcctgggtgcctgc

SEQ ID NO: 9172492 - DNA, 22 bp, Homo sapiens
ccctggagtcctggcagttgat

SEQ ID NO: 9172493 - DNA, 22 bp, Homo sapiens
ccctggagtccggagctcacct

SEQ ID NO: 9172494 - DNA, 22 bp, Homo sapiens
ccctggagtccggagctcacct

SEQ ID NO: 9172495 - DNA, 22 bp, Homo sapiens
ccctggagtcctggcagttgat

SEQ ID NO: 9172496 - DNA, 22 bp, Homo sapiens
ccctggagtcctggcagttgat

SEQ ID NO: 9172497 - DNA, 22 bp, Homo sapiens
ccctggagtcctggcagttgat

SEQ ID NO: 9172498 - DNA, 22 bp, Homo sapiens
ccctggagtgccggaatcaaga

SEQ ID NO: 9172499 - DNA, 22 bp, Homo sapiens
ccctggagtgccggaatcaaga

SEQ ID NO: 9172500 - DNA, 22 bp, Homo sapiens
ccctggagtcctggcagttgat

SEQ ID NO: 9172501 - DNA, 22 bp, Homo sapiens
ccctggagtcaggttggcctgg

SEQ ID NO: 9172502 - DNA, 22 bp, Homo sapiens
ccctggagtagcactgggtcgc

SEQ ID NO: 9172503 - DNA, 22 bp, Homo sapiens
ccctggagtagcactgggtcgc

SEQ ID NO: 9172504 - DNA, 22 bp, Homo sapiens
ccctggagtagcactgggtcgc

SEQ ID NO: 9172505 - DNA, 23 bp, Homo sapiens
ccctggagtaaattcttggaagg

SEQ ID NO: 9172506 - DNA, 23 bp, Homo sapiens
ccctggagtaaattcttggaagg

SEQ ID NO: 9172507 - DNA, 22 bp, Homo sapiens
ccctggagggcagacagatgcc

SEQ ID NO: 9172508 - DNA, 22 bp, Homo sapiens
ccctggagggcagacagatgcc

SEQ ID NO: 9172509 - DNA, 22 bp, Homo sapiens
ccctggaggtcagaggcctggg

SEQ ID NO: 9172510 - DNA, 22 bp, Homo sapiens
ccctggaggtcagaggcctggg

SEQ ID NO: 9172511 - DNA, 22 bp, Homo sapiens
ccctggaggtcagaggcctggg

SEQ ID NO: 9172512 - DNA, 22 bp, Homo sapiens
ccctggaggttgaggctgcagt

SEQ ID NO: 9172513 - DNA, 22 bp, Homo sapiens
ccctggaggttgaggctgcagt

SEQ ID NO: 9172514 - DNA, 22 bp, Homo sapiens
ccctggaggtggaggttgcagg

SEQ ID NO: 9172515 - DNA, 22 bp, Homo sapiens
ccctggaggtggaggttgcagg

SEQ ID NO: 9172516 - DNA, 22 bp, Homo sapiens
tgctcaggtcgttctgcccctt

SEQ ID NO: 9172517 - DNA, 22 bp, Homo sapiens
tgctcagggagcttcctggtgg

SEQ ID NO: 9172518 - DNA, 22 bp, Homo sapiens
tgctcaggtgccttggctgctg

SEQ ID NO: 9172519 - DNA, 22 bp, Homo sapiens
cccaggtctcctgcttcccagg

SEQ ID NO: 9172520 - DNA, 22 bp, Homo sapiens
cccaggtctgccagcctgtggg

SEQ ID NO: 9172521 - DNA, 22 bp, Homo sapiens
cccaggtctgtgccagctctga

SEQ ID NO: 9172522 - DNA, 22 bp, Homo sapiens
cccagtgccaggcacaggcagc

SEQ ID NO: 9172523 - DNA, 20 bp, Homo sapiens
cccagtgaagcatggaagag

SEQ ID NO: 9172524 - DNA, 22 bp, Homo sapiens
cccagtgccaggcacaggcagc

SEQ ID NO: 9172525 - DNA, 19 bp, Homo sapiens
cccagtccttgtcctgggc

SEQ ID NO: 9172526 - DNA, 22 bp, Homo sapiens
cccagtggagataggagtgtgg

SEQ ID NO: 9172527 - DNA, 22 bp, Homo sapiens
cccagtggaaggagtagaagac

SEQ ID NO: 9172528 - DNA, 18 bp, Homo sapiens
cccagtgctcactgcctc

SEQ ID NO: 9172529 - DNA, 22 bp, Homo sapiens
cccagtggcccagcatgtggtg

SEQ ID NO: 9172530 - DNA, 22 bp, Homo sapiens
tgctgccttgtgctgcctttca

SEQ ID NO: 9172531 - DNA, 22 bp, Homo sapiens
tgctgcaggcagcccctctact

SEQ ID NO: 9172532 - DNA, 22 bp, Homo sapiens
tgctgcaggcagcccctctact

SEQ ID NO: 9172533 - DNA, 22 bp, Homo sapiens
tgctctggacgctgagtggttt

SEQ ID NO: 9172534 - DNA, 19 bp, Homo sapiens
tgctctggagccagctctc

SEQ ID NO: 9172535 - DNA, 19 bp, Homo sapiens
tgctgcaggatgctgctgg

SEQ ID NO: 9172536 - DNA, 22 bp, Homo sapiens
tgctctggaccatgactatgtg

SEQ ID NO: 9172537 - DNA, 22 bp, Homo sapiens
tgctctggaaataaatgattta

SEQ ID NO: 9172538 - DNA, 20 bp, Homo sapiens
tgctctggaaatggtctgag

SEQ ID NO: 9172539 - DNA, 22 bp, Homo sapiens
tgctcaggaggaggctgtgagg

SEQ ID NO: 9172540 - DNA, 22 bp, Homo sapiens
tgctcaggaggaggctgtgagg

SEQ ID NO: 9172541 - DNA, 22 bp, Homo sapiens
tgctcaggagcttagagcacag

SEQ ID NO: 9172542 - DNA, 22 bp, Homo sapiens
tgctcaggaaataatgtctgtg

SEQ ID NO: 9172543 - DNA, 22 bp, Homo sapiens
tgctcaggacagtggaacctaa

SEQ ID NO: 9172544 - DNA, 22 bp, Homo sapiens
tgctcaggaaataatgtctgtg

SEQ ID NO: 9172545 - DNA, 22 bp, Homo sapiens
tgctcaggccctgggccatcct

SEQ ID NO: 9172546 - DNA, 22 bp, Homo sapiens
tgctcaggccagccggacagag

SEQ ID NO: 9172547 - DNA, 19 bp, Homo sapiens
tgctcaggccaaggagccc

SEQ ID NO: 9172548 - DNA, 22 bp, Homo sapiens
tgctcagggacaatggagaggg

SEQ ID NO: 9172549 - DNA, 22 bp, Homo sapiens
tgctagaatttgcagaagcata

SEQ ID NO: 9172550 - DNA, 22 bp, Homo sapiens
tgctactacttgtcaacggtca

SEQ ID NO: 9172551 - DNA, 22 bp, Homo sapiens
tgctactcaattcacctgccac

SEQ ID NO: 9172552 - DNA, 22 bp, Homo sapiens
tgctaggcattgtctgggagta

SEQ ID NO: 9172553 - DNA, 22 bp, Homo sapiens
tgctaggcagtgcttccctgac

SEQ ID NO: 9172554 - DNA, 22 bp, Homo sapiens
tgctaggagaggcagcacagcg

SEQ ID NO: 9172555 - DNA, 22 bp, Homo sapiens
tgctaggagttattctaagatt

SEQ ID NO: 9172556 - DNA, 22 bp, Homo sapiens
tgctaggaatacacagagcaat

SEQ ID NO: 9172557 - DNA, 22 bp, Homo sapiens
tgctaggtgctcctccctaatt

SEQ ID NO: 9172558 - DNA, 22 bp, Homo sapiens
tgctagtgcagggttttcagtt

SEQ ID NO: 9172559 - DNA, 22 bp, Homo sapiens
tgctacactcaatcagtgctat

SEQ ID NO: 9172560 - DNA, 22 bp, Homo sapiens
tgctacattatatggcaaagga

SEQ ID NO: 9172561 - DNA, 21 bp, Homo sapiens
tgctacattgctggttatgtt

SEQ ID NO: 9172562 - DNA, 22 bp, Homo sapiens
tgctacatgcactgtgatctag

SEQ ID NO: 9172563 - DNA, 22 bp, Homo sapiens
tgctacataggatagctcaaat

SEQ ID NO: 9172564 - DNA, 22 bp, Homo sapiens
tgctacataccacgatgcagta

SEQ ID NO: 9172565 - DNA, 22 bp, Homo sapiens
tgccttctcttccctgggagct

SEQ ID NO: 9172566 - DNA, 22 bp, Homo sapiens
tgccttctcccttggaccctga

SEQ ID NO: 9172567 - DNA, 22 bp, Homo sapiens
tgcaggtgctgtgtcaagagag

SEQ ID NO: 9172568 - DNA, 22 bp, Homo sapiens
tgcaggtgctgtgtcaagagag

SEQ ID NO: 9172569 - DNA, 22 bp, Homo sapiens
tgcaggtgctccgggggtgccc

SEQ ID NO: 9172570 - DNA, 22 bp, Homo sapiens
tgcaggtgctgatacctactcc

SEQ ID NO: 9172571 - DNA, 22 bp, Homo sapiens
tgcaggtgcgttttcaagcctc

SEQ ID NO: 9172572 - DNA, 22 bp, Homo sapiens
tgcaggtgcgttttcaagcctc

SEQ ID NO: 9172573 - DNA, 22 bp, Homo sapiens
tgcaggtgctacaagaactcac

SEQ ID NO: 9172574 - DNA, 22 bp, Homo sapiens
tgcagggctaagtcagagcctg

SEQ ID NO: 9172575 - DNA, 22 bp, Homo sapiens
tgcagggctaagtcagagcctg

SEQ ID NO: 9172576 - DNA, 22 bp, Homo sapiens
tgcagggctaagtcagagcctg

SEQ ID NO: 9172577 - DNA, 22 bp, Homo sapiens
ccctccctatgtagatgatgtt

SEQ ID NO: 9172578 - DNA, 22 bp, Homo sapiens
ccctccccagggtcatattgaa

SEQ ID NO: 9172579 - DNA, 22 bp, Homo sapiens
ccctccccagggtcatattgaa

SEQ ID NO: 9172580 - DNA, 22 bp, Homo sapiens
ccctccccacaaagcttcacac

SEQ ID NO: 9172581 - DNA, 22 bp, Homo sapiens
ccctccccacaaagcttcacac

SEQ ID NO: 9172582 - DNA, 22 bp, Homo sapiens
ccctccagtgtcccagtgggga

SEQ ID NO: 9172583 - DNA, 22 bp, Homo sapiens
tgcttggcctacttgtcctttg

SEQ ID NO: 9172584 - DNA, 22 bp, Homo sapiens
tgcttggctagcttggcagctc

SEQ ID NO: 9172585 - DNA, 22 bp, Homo sapiens
tgcttggctttctgagcttctg

SEQ ID NO: 9172586 - DNA, 22 bp, Homo sapiens
tgcttgggcggccagcatggcg

SEQ ID NO: 9172587 - DNA, 22 bp, Homo sapiens
tgcttgggaatgtggagtcaga

SEQ ID NO: 9172588 - DNA, 22 bp, Homo sapiens
tgctgtttgagcttattttcag

SEQ ID NO: 9172589 - DNA, 22 bp, Homo sapiens
tgctgtttgagcttattttcag

SEQ ID NO: 9172590 - DNA, 22 bp, Homo sapiens
ccccaggagatttgggagcaca

SEQ ID NO: 9172591 - DNA, 22 bp, Homo sapiens
ccccaggagaaatcttaaacta

SEQ ID NO: 9172592 - DNA, 22 bp, Homo sapiens
ccccaggagatttgggagcaca

SEQ ID NO: 9172593 - DNA, 22 bp, Homo sapiens
ccccaggacgtggccctcatag

SEQ ID NO: 9172594 - DNA, 22 bp, Homo sapiens
tgcttccttcccgttcttctcc

SEQ ID NO: 9172595 - DNA, 22 bp, Homo sapiens
cccagtgttacgtgacagcctg

SEQ ID NO: 9172596 - DNA, 22 bp, Homo sapiens
cccagttagttgcttccacatc

SEQ ID NO: 9172597 - DNA, 22 bp, Homo sapiens
cccagttgttgccggctctgga

SEQ ID NO: 9172598 - DNA, 22 bp, Homo sapiens
cccagttgttgccggctctgga

SEQ ID NO: 9172599 - DNA, 22 bp, Homo sapiens
tgctgggcaccagtgcctgcag

SEQ ID NO: 9172600 - DNA, 22 bp, Homo sapiens
tgctgggcaccagtgcctgcag

SEQ ID NO: 9172601 - DNA, 22 bp, Homo sapiens
tgctggggctctgaccactcca

SEQ ID NO: 9172602 - DNA, 22 bp, Homo sapiens
cccagttgttgccggctctgga

SEQ ID NO: 9172603 - DNA, 22 bp, Homo sapiens
cccagtggtgctggcatctgtg

SEQ ID NO: 9172604 - DNA, 22 bp, Homo sapiens
cccagtggtgctggcatctgtg

SEQ ID NO: 9172605 - DNA, 22 bp, Homo sapiens
cccagtgggtcactgcatctca

SEQ ID NO: 9172606 - DNA, 22 bp, Homo sapiens
tgctgctccatctgaccattcc

SEQ ID NO: 9172607 - DNA, 22 bp, Homo sapiens
tgctgctcagaacccctgggct

SEQ ID NO: 9172608 - DNA, 22 bp, Homo sapiens
tgctgctcacacacagtgaatg

SEQ ID NO: 9172609 - DNA, 22 bp, Homo sapiens
tgctgctcaatgagatgccatc

SEQ ID NO: 9172610 - DNA, 22 bp, Homo sapiens
tgctgcctttgggacctggcct

SEQ ID NO: 9172611 - DNA, 22 bp, Homo sapiens
tgctgctcaagctgcagcaaaa

SEQ ID NO: 9172612 - DNA, 18 bp, Homo sapiens
tgctggggtagaatccac

SEQ ID NO: 9172613 - DNA, 23 bp, Homo sapiens
tgctggggtagtttgtggcacag

SEQ ID NO: 9172614 - DNA, 22 bp, Homo sapiens
tgctgggggttcagatgagtaa

SEQ ID NO: 9172615 - DNA, 18 bp, Homo sapiens
tgctggggtagaatccac

SEQ ID NO: 9172616 - DNA, 18 bp, Homo sapiens
tgctggggtagaatccac

SEQ ID NO: 9172617 - DNA, 22 bp, Homo sapiens
tgctgggggtagctctgcgtag

SEQ ID NO: 9172618 - DNA, 22 bp, Homo sapiens
tgctgggggtagctctgcgtag

SEQ ID NO: 9172619 - DNA, 22 bp, Homo sapiens
tgctgggggtagctctgcgtag

SEQ ID NO: 9172620 - DNA, 22 bp, Homo sapiens
tgctgggggtgtctcaccaggc

SEQ ID NO: 9172621 - DNA, 22 bp, Homo sapiens
tgctgggggtgtctcaccaggc

SEQ ID NO: 9172622 - DNA, 22 bp, Homo sapiens
tgctgggggttcagatgagtaa

SEQ ID NO: 9172623 - DNA, 22 bp, Homo sapiens
tgctgggggtgtctcaccaggc

SEQ ID NO: 9172624 - DNA, 22 bp, Homo sapiens
tgctgggggtagctctgcgtag

SEQ ID NO: 9172625 - DNA, 22 bp, Homo sapiens
tgctgggggctttctggatacc

SEQ ID NO: 9172626 - DNA, 22 bp, Homo sapiens
tgctgggggctttctggatacc

SEQ ID NO: 9172627 - DNA, 22 bp, Homo sapiens
cagtacaggctgccttgtccaa

SEQ ID NO: 9172628 - DNA, 22 bp, Homo sapiens
cagtacatttcatatgattcta

SEQ ID NO: 9172629 - DNA, 22 bp, Homo sapiens
tatgtacatgttaaagggcaaa

SEQ ID NO: 9172630 - DNA, 22 bp, Homo sapiens
tatgtacatggagagcaattga

SEQ ID NO: 9172631 - DNA, 22 bp, Homo sapiens
tatgtacatggagagcaattga

SEQ ID NO: 9172632 - DNA, 22 bp, Homo sapiens
tatgtacatgatttcatttgct

SEQ ID NO: 9172633 - DNA, 22 bp, Homo sapiens
tatgtacatcttgagcaatgaa

SEQ ID NO: 9172634 - DNA, 22 bp, Homo sapiens
tatgtacatcttgagcaatgaa

SEQ ID NO: 9172635 - DNA, 22 bp, Homo sapiens
tatgtacatgatttcatttgct

SEQ ID NO: 9172636 - DNA, 22 bp, Homo sapiens
tatgtacatcgttgaattcaaa

SEQ ID NO: 9172637 - DNA, 22 bp, Homo sapiens
tatgtacatcgttgaattcaaa

SEQ ID NO: 9172638 - DNA, 22 bp, Homo sapiens
tatgtacatcgttgaattcaaa

SEQ ID NO: 9172639 - DNA, 22 bp, Homo sapiens
caggtggggcgccctcaggcag

SEQ ID NO: 9172640 - DNA, 22 bp, Homo sapiens
caggtggggcagctgtgggagc

SEQ ID NO: 9172641 - DNA, 22 bp, Homo sapiens
caggtggggagagtgtggagca

SEQ ID NO: 9172642 - DNA, 22 bp, Homo sapiens
caggtggggcagctgtgggagc

SEQ ID NO: 9172643 - DNA, 22 bp, Homo sapiens
caggtgggctgcctctccagct

SEQ ID NO: 9172644 - DNA, 22 bp, Homo sapiens
caggtggggagagtgtggagca

SEQ ID NO: 9172645 - DNA, 22 bp, Homo sapiens
caggtgggcgtggcgagaaggc

SEQ ID NO: 9172646 - DNA, 22 bp, Homo sapiens
tatgaagatatatctgatctct

SEQ ID NO: 9172647 - DNA, 22 bp, Homo sapiens
tatgatctttataacctatctt

SEQ ID NO: 9172648 - DNA, 22 bp, Homo sapiens
tatgaagaagttctgtgaaatg

SEQ ID NO: 9172649 - DNA, 22 bp, Homo sapiens
tatgaagaagacaaatgacact

SEQ ID NO: 9172650 - DNA, 22 bp, Homo sapiens
tatgaagaagttctgtgaaatg

SEQ ID NO: 9172651 - DNA, 22 bp, Homo sapiens
tatgaagacaatgatagcatga

SEQ ID NO: 9172652 - DNA, 19 bp, Homo sapiens
tatgaagaatgtggcaaag

SEQ ID NO: 9172653 - DNA, 22 bp, Homo sapiens
tatgaagaagttctgtgaaatg

SEQ ID NO: 9172654 - DNA, 22 bp, Homo sapiens
tatgaagacaatgatagcatga

SEQ ID NO: 9172655 - DNA, 22 bp, Homo sapiens
tatgaagacaatgatagcatga

SEQ ID NO: 9172656 - DNA, 20 bp, Homo sapiens
tatgaagactcaagtagggc

SEQ ID NO: 9172657 - DNA, 20 bp, Homo sapiens
tatgaagactcaagtagggc

SEQ ID NO: 9172658 - DNA, 22 bp, Homo sapiens
tatgaagactcatttattgggt

SEQ ID NO: 9172659 - DNA, 22 bp, Homo sapiens
tatgaagatatatctgatctct

SEQ ID NO: 9172660 - DNA, 22 bp, Homo sapiens
tatgcaaatcattagatttcct

SEQ ID NO: 9172661 - DNA, 22 bp, Homo sapiens
tatgcaaagccacccagggacg

SEQ ID NO: 9172662 - DNA, 22 bp, Homo sapiens
tatgcaaagtcctaagaaagaa

SEQ ID NO: 9172663 - DNA, 22 bp, Homo sapiens
tatgcaaacagttcaggtgaca

SEQ ID NO: 9172664 - DNA, 22 bp, Homo sapiens
tatgatgtgtacctaagtcacc

SEQ ID NO: 9172665 - DNA, 22 bp, Homo sapiens
tatgatttgtagacatttgatt

SEQ ID NO: 9172666 - DNA, 22 bp, Homo sapiens
tatgaagaaatctttgaaaatc

SEQ ID NO: 9172667 - DNA, 22 bp, Homo sapiens
tatgaagaaacctatcctctag

SEQ ID NO: 9172668 - DNA, 22 bp, Homo sapiens
tatgaactgtgagtgtgatggg

SEQ ID NO: 9172669 - DNA, 22 bp, Homo sapiens
tatgaaccgagaatgtcaggga

SEQ ID NO: 9172670 - DNA, 22 bp, Homo sapiens
tatgaactagctgatttagttt

SEQ ID NO: 9172671 - DNA, 23 bp, Homo sapiens
tatgaactgcattgctggtgtgt

SEQ ID NO: 9172672 - DNA, 22 bp, Homo sapiens
tatgaactgctcttgtgttttg

SEQ ID NO: 9172673 - DNA, 22 bp, Homo sapiens
tatgaactgtgagtgtgatggg

SEQ ID NO: 9172674 - DNA, 21 bp, Homo sapiens
tatgaacatgaccaatagtcc

SEQ ID NO: 9172675 - DNA, 23 bp, Homo sapiens
tatctgtatttgttcactgctgt

SEQ ID NO: 9172676 - DNA, 22 bp, Homo sapiens
tatctgtatccccatctagcta

SEQ ID NO: 9172677 - DNA, 22 bp, Homo sapiens
tatctgtagtctcatggttcct

SEQ ID NO: 9172678 - DNA, 22 bp, Homo sapiens
tatattgactttaaagaagcaa

SEQ ID NO: 9172679 - DNA, 22 bp, Homo sapiens
tatattgagatttgagcattgt

SEQ ID NO: 9172680 - DNA, 18 bp, Homo sapiens
tatattctgtgccctggt

SEQ ID NO: 9172681 - DNA, 22 bp, Homo sapiens
tatattccagttcatctcttga

SEQ ID NO: 9172682 - DNA, 22 bp, Homo sapiens
tatattccagttcatctcttga

SEQ ID NO: 9172683 - DNA, 22 bp, Homo sapiens
tatattccttttggcagggact

SEQ ID NO: 9172684 - DNA, 22 bp, Homo sapiens
tagtaatcagaggtaaacttta

SEQ ID NO: 9172685 - DNA, 22 bp, Homo sapiens
tagtacagtggagagcaaagaa

SEQ ID NO: 9172686 - DNA, 22 bp, Homo sapiens
tagtacagtggcattcaaactt

SEQ ID NO: 9172687 - DNA, 22 bp, Homo sapiens
cagggctgagtcatatagcctt

SEQ ID NO: 9172688 - DNA, 22 bp, Homo sapiens
cagggctgaggacacaagtaaa

SEQ ID NO: 9172689 - DNA, 22 bp, Homo sapiens
cagggctgagaatttagagaca

SEQ ID NO: 9172690 - DNA, 22 bp, Homo sapiens
cagggctgaggacacaagtaaa

SEQ ID NO: 9172691 - DNA, 22 bp, Homo sapiens
cagggctgctggccgtgccctc

SEQ ID NO: 9172692 - DNA, 22 bp, Homo sapiens
cagggctgctggccgtgccctc

SEQ ID NO: 9172693 - DNA, 22 bp, Homo sapiens
cagggctggatcctccagactc

SEQ ID NO: 9172694 - DNA, 22 bp, Homo sapiens
cagggctggatcctccagactc

SEQ ID NO: 9172695 - DNA, 22 bp, Homo sapiens
tagtgattttctgtttccatca

SEQ ID NO: 9172696 - DNA, 22 bp, Homo sapiens
cagggctggatttcatttctag

SEQ ID NO: 9172697 - DNA, 22 bp, Homo sapiens
taggtataatattttgaagaaa

SEQ ID NO: 9172698 - DNA, 22 bp, Homo sapiens
cagggccaccgtgtttgctgct

SEQ ID NO: 9172699 - DNA, 22 bp, Homo sapiens
cagggccaccctctgctgggtg

SEQ ID NO: 9172700 - DNA, 22 bp, Homo sapiens
cagggccaagctgcagcatctg

SEQ ID NO: 9172701 - DNA, 21 bp, Homo sapiens
cagggccaatcctgacctcta

SEQ ID NO: 9172702 - DNA, 22 bp, Homo sapiens
cagggccaagttggtgcctttt

SEQ ID NO: 9172703 - DNA, 22 bp, Homo sapiens
taggtataggattctaggttgg

SEQ ID NO: 9172704 - DNA, 22 bp, Homo sapiens
taggtatacagagatttctggg

SEQ ID NO: 9172705 - DNA, 22 bp, Homo sapiens
tagtaaattaaaatattgactt

SEQ ID NO: 9172706 - DNA, 22 bp, Homo sapiens
tagtaaattaaaatattgactt

SEQ ID NO: 9172707 - DNA, 22 bp, Homo sapiens
tagtaagttctcgcattgttat

SEQ ID NO: 9172708 - DNA, 22 bp, Homo sapiens
tagtaactggttgaacaactgt

SEQ ID NO: 9172709 - DNA, 22 bp, Homo sapiens
tagtaactggttgaacaactgt

SEQ ID NO: 9172710 - DNA, 22 bp, Homo sapiens
tagtaactctacacacgacact

SEQ ID NO: 9172711 - DNA, 21 bp, Homo sapiens
tagtttctacccagttaatgg

SEQ ID NO: 9172712 - DNA, 22 bp, Homo sapiens
tagtttctagacagtaagaatt

SEQ ID NO: 9172713 - DNA, 22 bp, Homo sapiens
tagtttctagtaacaaacccat

SEQ ID NO: 9172714 - DNA, 22 bp, Homo sapiens
tagtgtggtaaataaatgtttt

SEQ ID NO: 9172715 - DNA, 22 bp, Homo sapiens
tagtgtggtaaataaatgtttt

SEQ ID NO: 9172716 - DNA, 22 bp, Homo sapiens
tagtttctggttcttgctctgg

SEQ ID NO: 9172717 - DNA, 22 bp, Homo sapiens
tagtttctggttcttgctctgg

SEQ ID NO: 9172718 - DNA, 22 bp, Homo sapiens
tagtttcttgattagccacttt

SEQ ID NO: 9172719 - DNA, 22 bp, Homo sapiens
tagtttcttcacctgtaaaatg

SEQ ID NO: 9172720 - DNA, 22 bp, Homo sapiens
tagtttctagtcaatcttcttt

SEQ ID NO: 9172721 - DNA, 22 bp, Homo sapiens
tagtttctcagggaggaaagaa

SEQ ID NO: 9172722 - DNA, 22 bp, Homo sapiens
tagtttctgaggattgaaagat

SEQ ID NO: 9172723 - DNA, 22 bp, Homo sapiens
tagtttctgggttggcttctac

SEQ ID NO: 9172724 - DNA, 22 bp, Homo sapiens
tagtttctgcctcggaagctga

SEQ ID NO: 9172725 - DNA, 22 bp, Homo sapiens
tagtttctttcacgtagtaata

SEQ ID NO: 9172726 - DNA, 22 bp, Homo sapiens
tatatactatgcgattcctgcc

SEQ ID NO: 9172727 - DNA, 22 bp, Homo sapiens
tatatagaaaagcagatgttgg

SEQ ID NO: 9172728 - DNA, 22 bp, Homo sapiens
tatatacttttgtaagttggct

SEQ ID NO: 9172729 - DNA, 22 bp, Homo sapiens
tatatactttcttcctgggtag

SEQ ID NO: 9172730 - DNA, 22 bp, Homo sapiens
tatattcatattgttgtctctc

SEQ ID NO: 9172731 - DNA, 22 bp, Homo sapiens
tatattcaatgattagtatcag

SEQ ID NO: 9172732 - DNA, 22 bp, Homo sapiens
tatatacaaggtaggtttaggt

SEQ ID NO: 9172733 - DNA, 22 bp, Homo sapiens
tatataattttctgccatatcc

SEQ ID NO: 9172734 - DNA, 22 bp, Homo sapiens
tatataatttgtaaaagcacct

SEQ ID NO: 9172735 - DNA, 22 bp, Homo sapiens
tatacatcagtatgtttagata

SEQ ID NO: 9172736 - DNA, 21 bp, Homo sapiens
tatacatgtgcacacacatgc

SEQ ID NO: 9172737 - DNA, 22 bp, Homo sapiens
tatagtttcatgagctttttaa

SEQ ID NO: 9172738 - DNA, 21 bp, Homo sapiens
tatacatgtgtgcatacgtgt

SEQ ID NO: 9172739 - DNA, 21 bp, Homo sapiens
tatacatgtgtgcatacgtgt

SEQ ID NO: 9172740 - DNA, 22 bp, Homo sapiens
tatataactactattttgctca

SEQ ID NO: 9172741 - DNA, 22 bp, Homo sapiens
tcaaaggagtttaagttactgg

SEQ ID NO: 9172742 - DNA, 22 bp, Homo sapiens
tcaaaggataactgagggcagt

SEQ ID NO: 9172743 - DNA, 22 bp, Homo sapiens
tcaaaggagtttaagttactgg

SEQ ID NO: 9172744 - DNA, 23 bp, Homo sapiens
tcaaaggaggcatcgttctgcag

SEQ ID NO: 9172745 - DNA, 22 bp, Homo sapiens
tcaaaggagtttaagttactgg

SEQ ID NO: 9172746 - DNA, 22 bp, Homo sapiens
cagtcccagacccagaaggtgg

SEQ ID NO: 9172747 - DNA, 22 bp, Homo sapiens
tcaaaggagacacaaggagaaa

SEQ ID NO: 9172748 - DNA, 22 bp, Homo sapiens
tcaaaggaatttgattttgatg

SEQ ID NO: 9172749 - DNA, 22 bp, Homo sapiens
tcaaaggaatttgattttgatg

SEQ ID NO: 9172750 - DNA, 22 bp, Homo sapiens
tcaaaggaaacacaagcttctg

SEQ ID NO: 9172751 - DNA, 22 bp, Homo sapiens
tcaaaggaaacgtggtcctggc

SEQ ID NO: 9172752 - DNA, 22 bp, Homo sapiens
tcaaagcagcacattcgcaagc

SEQ ID NO: 9172753 - DNA, 22 bp, Homo sapiens
tcaaagcatcagtcaatttagg

SEQ ID NO: 9172754 - DNA, 22 bp, Homo sapiens
tcaaagcatcagtcaatttagg

SEQ ID NO: 9172755 - DNA, 22 bp, Homo sapiens
tcaaagcatggttttgaaagac

SEQ ID NO: 9172756 - DNA, 22 bp, Homo sapiens
tcaaagcctgtggatagtttgg

SEQ ID NO: 9172757 - DNA, 19 bp, Homo sapiens
tcaaagcaagcatgttctg

SEQ ID NO: 9172758 - DNA, 21 bp, Homo sapiens
tcaaagcacatatttgcacat

SEQ ID NO: 9172759 - DNA, 20 bp, Homo sapiens
tcaaagcactgcctgtcatc

SEQ ID NO: 9172760 - DNA, 22 bp, Homo sapiens
tcaaagcactggggaaagcctg

SEQ ID NO: 9172761 - DNA, 22 bp, Homo sapiens
tcaaagcaatttcaccagtgcc

SEQ ID NO: 9172762 - DNA, 22 bp, Homo sapiens
tcaaagcaatttcaccagtgcc

SEQ ID NO: 9172763 - DNA, 22 bp, Homo sapiens
tcaaagcacacttagtggtaga

SEQ ID NO: 9172764 - DNA, 22 bp, Homo sapiens
tcaaaagaaacaccatgttcct

SEQ ID NO: 9172765 - DNA, 19 bp, Homo sapiens
tcaaagcaagcatgttctg

SEQ ID NO: 9172766 - DNA, 22 bp, Homo sapiens
tcaaaactcattttggaagtaa

SEQ ID NO: 9172767 - DNA, 22 bp, Homo sapiens
tattccctatttagtaattctg

SEQ ID NO: 9172768 - DNA, 22 bp, Homo sapiens
cagtacttttctggctttctac

SEQ ID NO: 9172769 - DNA, 22 bp, Homo sapiens
cagtagacacattaatatggaa

SEQ ID NO: 9172770 - DNA, 20 bp, Homo sapiens
tattccaagggtagagaaaa

SEQ ID NO: 9172771 - DNA, 22 bp, Homo sapiens
tattccagataccttgtgtaag

SEQ ID NO: 9172772 - DNA, 22 bp, Homo sapiens
tattccatgccagagtttattg

SEQ ID NO: 9172773 - DNA, 22 bp, Homo sapiens
tattcccagcctctttctatct

SEQ ID NO: 9172774 - DNA, 22 bp, Homo sapiens
tattcccattccacttatcaag

SEQ ID NO: 9172775 - DNA, 22 bp, Homo sapiens
tattccagtatgtctggtgtcc

SEQ ID NO: 9172776 - DNA, 22 bp, Homo sapiens
tattccaggtttcttgttgtat

SEQ ID NO: 9172777 - DNA, 17 bp, Homo sapiens
tattccaggaaataaag

SEQ ID NO: 9172778 - DNA, 22 bp, Homo sapiens
cagtcttctgagaaggcaaggg

SEQ ID NO: 9172779 - DNA, 22 bp, Homo sapiens
cagtcttttgtatattagcaga

SEQ ID NO: 9172780 - DNA, 22 bp, Homo sapiens
cagtctttgttcccattactga

SEQ ID NO: 9172781 - DNA, 22 bp, Homo sapiens
cagtctttgttcccattactga

SEQ ID NO: 9172782 - DNA, 22 bp, Homo sapiens
cagtctttgttcccattactga

SEQ ID NO: 9172783 - DNA, 22 bp, Homo sapiens
cagtgaaatagtggacatcaaa

SEQ ID NO: 9172784 - DNA, 17 bp, Homo sapiens
tcaaatgtacagaacta

SEQ ID NO: 9172785 - DNA, 22 bp, Homo sapiens
tcaaattagtggaataataatg

SEQ ID NO: 9172786 - DNA, 22 bp, Homo sapiens
tcaacaaatacttaaagcagag

SEQ ID NO: 9172787 - DNA, 22 bp, Homo sapiens
tcaaattatttaggatagtgct

SEQ ID NO: 9172788 - DNA, 15 bp, Homo sapiens
cagtcccagggaccc

SEQ ID NO: 9172789 - DNA, 22 bp, Homo sapiens
cagtcccagctgctcagaaggc

SEQ ID NO: 9172790 - DNA, 22 bp, Homo sapiens
cagtcccagtttgagactctgg

SEQ ID NO: 9172791 - DNA, 22 bp, Homo sapiens
cagtcccagggttggttcagct

SEQ ID NO: 9172792 - DNA, 22 bp, Homo sapiens
cagtcccatctcccaggtggct

SEQ ID NO: 9172793 - DNA, 22 bp, Homo sapiens
cagtccctagtggagctcacag

SEQ ID NO: 9172794 - DNA, 22 bp, Homo sapiens
cagtccctgggggagtcaccag

SEQ ID NO: 9172795 - DNA, 22 bp, Homo sapiens
cagtcccatgagcccagaacat

SEQ ID NO: 9172796 - DNA, 22 bp, Homo sapiens
cagtcccatgagcccagaacat

SEQ ID NO: 9172797 - DNA, 22 bp, Homo sapiens
cagtctggaggtcagctggctt

SEQ ID NO: 9172798 - DNA, 22 bp, Homo sapiens
cagtctggaggtcagctggctt

SEQ ID NO: 9172799 - DNA, 22 bp, Homo sapiens
cagtctggactcaggcatacct

SEQ ID NO: 9172800 - DNA, 23 bp, Homo sapiens
cagtctgcagcccacttgggcag

SEQ ID NO: 9172801 - DNA, 22 bp, Homo sapiens
cagtctggcacagcacactgaa

SEQ ID NO: 9172802 - DNA, 22 bp, Homo sapiens
cagtctggatctgtgctgctgt

SEQ ID NO: 9172803 - DNA, 22 bp, Homo sapiens
cagtctgtttctgagaaacaga

SEQ ID NO: 9172804 - DNA, 22 bp, Homo sapiens
cagtctgggactgagctccacc

SEQ ID NO: 9172805 - DNA, 22 bp, Homo sapiens
tcacacatttctcaagtgtagg

SEQ ID NO: 9172806 - DNA, 22 bp, Homo sapiens
tcacacatttgaaggcctgtca

SEQ ID NO: 9172807 - DNA, 22 bp, Homo sapiens
tcacacatttctcaagtgtagg

SEQ ID NO: 9172808 - DNA, 22 bp, Homo sapiens
cagtgcagtttcccagatgctg

SEQ ID NO: 9172809 - DNA, 22 bp, Homo sapiens
cagtgcagtttcccagatgctg

SEQ ID NO: 9172810 - DNA, 20 bp, Homo sapiens
tcacacatggtaagctatga

SEQ ID NO: 9172811 - DNA, 22 bp, Homo sapiens
tcacacatgtaagggctttgga

SEQ ID NO: 9172812 - DNA, 22 bp, Homo sapiens
cagtgcagttggtggcaggggt

SEQ ID NO: 9172813 - DNA, 22 bp, Homo sapiens
cagtgcagtcaaggaagaacca

SEQ ID NO: 9172814 - DNA, 22 bp, Homo sapiens
cagtgcagtcaaggaagaacca

SEQ ID NO: 9172815 - DNA, 22 bp, Homo sapiens
cagtgcaggtttagggctgggg

SEQ ID NO: 9172816 - DNA, 22 bp, Homo sapiens
cagtgcaggtggcagaggacag

SEQ ID NO: 9172817 - DNA, 22 bp, Homo sapiens
cagtggagtgggactggtctga

SEQ ID NO: 9172818 - DNA, 22 bp, Homo sapiens
cagtggaggctcaagtgtgctt

SEQ ID NO: 9172819 - DNA, 22 bp, Homo sapiens
cagtggaggccttgggaccttt

SEQ ID NO: 9172820 - DNA, 22 bp, Homo sapiens
cagtggaggctcaagtgtgctt

SEQ ID NO: 9172821 - DNA, 22 bp, Homo sapiens
cagtggcaatgggacagagcac

SEQ ID NO: 9172822 - DNA, 22 bp, Homo sapiens
cagtggattagccagagctgga

SEQ ID NO: 9172823 - DNA, 22 bp, Homo sapiens
cagtggattagccagagctgga

SEQ ID NO: 9172824 - DNA, 22 bp, Homo sapiens
cagtggattaaggagggcagct

SEQ ID NO: 9172825 - DNA, 22 bp, Homo sapiens
tcacacctgtaatcccaggcct

SEQ ID NO: 9172826 - DNA, 22 bp, Homo sapiens
tcacaccttgctggctgagtgc

SEQ ID NO: 9172827 - DNA, 22 bp, Homo sapiens
tcacactggcagtgctgaaggc

SEQ ID NO: 9172828 - DNA, 19 bp, Homo sapiens
cagtggagattggaggagg

SEQ ID NO: 9172829 - DNA, 22 bp, Homo sapiens
tcactctctaagcatgacagac

SEQ ID NO: 9172830 - DNA, 22 bp, Homo sapiens
tcactgcaacctccacctcctg

SEQ ID NO: 9172831 - DNA, 22 bp, Homo sapiens
tcactgcaacctctgccttccg

SEQ ID NO: 9172832 - DNA, 22 bp, Homo sapiens
tcactgcaacctctgcctcttg

SEQ ID NO: 9172833 - DNA, 22 bp, Homo sapiens
tcactgcaacctctgcctcccg

SEQ ID NO: 9172834 - DNA, 22 bp, Homo sapiens
tcactgcaagctcctcctcctg

SEQ ID NO: 9172835 - DNA, 22 bp, Homo sapiens
tcactgcaaggaggcttctcaa

SEQ ID NO: 9172836 - DNA, 22 bp, Homo sapiens
tcactgcaagctctgccttccg

SEQ ID NO: 9172837 - DNA, 18 bp, Homo sapiens
tcacattataatgtaaca

SEQ ID NO: 9172838 - DNA, 22 bp, Homo sapiens
tcacatgtgttttctcaccaac

SEQ ID NO: 9172839 - DNA, 22 bp, Homo sapiens
tcacatgtcaaaaactacataa

SEQ ID NO: 9172840 - DNA, 22 bp, Homo sapiens
tcacatgtcaaaaactacataa

SEQ ID NO: 9172841 - DNA, 22 bp, Homo sapiens
tcacatgtcacaaaacactgcc

SEQ ID NO: 9172842 - DNA, 22 bp, Homo sapiens
tcacatgtcaagaagataattt

SEQ ID NO: 9172843 - DNA, 22 bp, Homo sapiens
tcacatgtcaagaagataattt

SEQ ID NO: 9172844 - DNA, 22 bp, Homo sapiens
tcacatgtcagtcttaaacaga

SEQ ID NO: 9172845 - DNA, 22 bp, Homo sapiens
cagtggttggtagatacttgag

SEQ ID NO: 9172846 - DNA, 22 bp, Homo sapiens
cagtggcacttgtcatttctga

SEQ ID NO: 9172847 - DNA, 22 bp, Homo sapiens
cagtggcagagaacagagacct

SEQ ID NO: 9172848 - DNA, 17 bp, Homo sapiens
cagtggcagatcttctc

SEQ ID NO: 9172849 - DNA, 22 bp, Homo sapiens
cagtggcacccacgggctgggc

SEQ ID NO: 9172850 - DNA, 21 bp, Homo sapiens
cagtggcacgatttcggctca

SEQ ID NO: 9172851 - DNA, 22 bp, Homo sapiens
cagtggcacccacgggctgggc

SEQ ID NO: 9172852 - DNA, 22 bp, Homo sapiens
cagtggcacatggaccttgtca

SEQ ID NO: 9172853 - DNA, 22 bp, Homo sapiens
tcactgcagagacctctagtca

SEQ ID NO: 9172854 - DNA, 22 bp, Homo sapiens
tcactgcagcctctgcctcccg

SEQ ID NO: 9172855 - DNA, 22 bp, Homo sapiens
tcactgcaatctctgccttcca

SEQ ID NO: 9172856 - DNA, 21 bp, Homo sapiens
tcactgcaatgctaggagaaa

SEQ ID NO: 9172857 - DNA, 22 bp, Homo sapiens
tagaaagaacttcatgtaaaac

SEQ ID NO: 9172858 - DNA, 22 bp, Homo sapiens
tagaaagaacttcatgtaaaac

SEQ ID NO: 9172859 - DNA, 22 bp, Homo sapiens
tagaaagacaatgggaagtgct

SEQ ID NO: 9172860 - DNA, 22 bp, Homo sapiens
tagaaagacaatgggaagtgct

SEQ ID NO: 9172861 - DNA, 22 bp, Homo sapiens
tagaaagacagaggttttgtct

SEQ ID NO: 9172862 - DNA, 22 bp, Homo sapiens
tagaaagacagaggttttgtct

SEQ ID NO: 9172863 - DNA, 22 bp, Homo sapiens
tagaaagaacttcatgtaaaac

SEQ ID NO: 9172864 - DNA, 22 bp, Homo sapiens
tacctcaagttccaggaaagcg

SEQ ID NO: 9172865 - DNA, 22 bp, Homo sapiens
tacctcactgggcctcagtttt

SEQ ID NO: 9172866 - DNA, 22 bp, Homo sapiens
tacctcactgaagctgagtttt

SEQ ID NO: 9172867 - DNA, 22 bp, Homo sapiens
tacctcactgaagctgagtttt

SEQ ID NO: 9172868 - DNA, 22 bp, Homo sapiens
tagaaagagcatagtattataa

SEQ ID NO: 9172869 - DNA, 22 bp, Homo sapiens
tagaaagagcatagtattataa

SEQ ID NO: 9172870 - DNA, 22 bp, Homo sapiens
tagaaagagcatagtattataa

SEQ ID NO: 9172871 - DNA, 22 bp, Homo sapiens
tagaaagactgtccagatttca

SEQ ID NO: 9172872 - DNA, 22 bp, Homo sapiens
tagaaagactgtccagatttca

SEQ ID NO: 9172873 - DNA, 22 bp, Homo sapiens
tagaaagactgtccagatttca

SEQ ID NO: 9172874 - DNA, 22 bp, Homo sapiens
tagaaagacagaggttttgtct

SEQ ID NO: 9172875 - DNA, 22 bp, Homo sapiens
tagaaagacatgggccagcagc

SEQ ID NO: 9172876 - DNA, 22 bp, Homo sapiens
tagaaagacatgggccagcagc

SEQ ID NO: 9172877 - DNA, 22 bp, Homo sapiens
tagaaagacatgggccagcagc

SEQ ID NO: 9172878 - DNA, 22 bp, Homo sapiens
tagaaagacagaggttttgtct

SEQ ID NO: 9172879 - DNA, 19 bp, Homo sapiens
tagaaagatgatgggtggg

SEQ ID NO: 9172880 - DNA, 22 bp, Homo sapiens
tagaaagatctgtaggcaagag

SEQ ID NO: 9172881 - DNA, 22 bp, Homo sapiens
tagaaagatctgtaggcaagag

SEQ ID NO: 9172882 - DNA, 19 bp, Homo sapiens
tagaaagatgatgggtggg

SEQ ID NO: 9172883 - DNA, 22 bp, Homo sapiens
tagaaagagcatagtattataa

SEQ ID NO: 9172884 - DNA, 22 bp, Homo sapiens
tagaaagagctttgcttccttt

SEQ ID NO: 9172885 - DNA, 22 bp, Homo sapiens
tagaaagagctttgcttccttt

SEQ ID NO: 9172886 - DNA, 22 bp, Homo sapiens
tagaaagagctttgcttccttt

SEQ ID NO: 9172887 - DNA, 22 bp, Homo sapiens
tagaaagatctgtaggcaagag

SEQ ID NO: 9172888 - DNA, 22 bp, Homo sapiens
tagaaagagctttgcttccttt

SEQ ID NO: 9172889 - DNA, 22 bp, Homo sapiens
taccctctcccggtccagcttt

SEQ ID NO: 9172890 - DNA, 22 bp, Homo sapiens
caggctgatagggtccaaagtt

SEQ ID NO: 9172891 - DNA, 22 bp, Homo sapiens
caggctgaggcagtagggtttg

SEQ ID NO: 9172892 - DNA, 22 bp, Homo sapiens
caggctgagggttaggccttag

SEQ ID NO: 9172893 - DNA, 22 bp, Homo sapiens
caggctgatcagggctgggatg

SEQ ID NO: 9172894 - DNA, 22 bp, Homo sapiens
caggctgcagcagcagtggccc

SEQ ID NO: 9172895 - DNA, 22 bp, Homo sapiens
caggctgcagaggcctttcatg

SEQ ID NO: 9172896 - DNA, 22 bp, Homo sapiens
caggctgattaggcctcgtcca

SEQ ID NO: 9172897 - DNA, 22 bp, Homo sapiens
caggctgcaagaaaggcattca

SEQ ID NO: 9172898 - DNA, 22 bp, Homo sapiens
tagaaatgttagatgtattgag

SEQ ID NO: 9172899 - DNA, 22 bp, Homo sapiens
tagaaatgttggtattaacatt

SEQ ID NO: 9172900 - DNA, 22 bp, Homo sapiens
tagaaatgttggtattaacatt

SEQ ID NO: 9172901 - DNA, 22 bp, Homo sapiens
tagaaatgttggtattaacatt

SEQ ID NO: 9172902 - DNA, 22 bp, Homo sapiens
tagaaatgtgataatagcttaa

SEQ ID NO: 9172903 - DNA, 22 bp, Homo sapiens
tagaaatgtgataatagcttaa

SEQ ID NO: 9172904 - DNA, 22 bp, Homo sapiens
tagaaatgtgataatagcttaa

SEQ ID NO: 9172905 - DNA, 22 bp, Homo sapiens
tagaaatgtcgtctccacattt

SEQ ID NO: 9172906 - DNA, 22 bp, Homo sapiens
tagaacaggaataagggaaata

SEQ ID NO: 9172907 - DNA, 22 bp, Homo sapiens
cagggacagccttggggtggcg

SEQ ID NO: 9172908 - DNA, 22 bp, Homo sapiens
tagaacaggctgtcagagcggg

SEQ ID NO: 9172909 - DNA, 22 bp, Homo sapiens
tagacatacagtgcagtacata

SEQ ID NO: 9172910 - DNA, 22 bp, Homo sapiens
cagggatgaccagagggatgtg

SEQ ID NO: 9172911 - DNA, 22 bp, Homo sapiens
cagggatgaccagagggatgtg

SEQ ID NO: 9172912 - DNA, 22 bp, Homo sapiens
cagggatgaccagagggatgtg

SEQ ID NO: 9172913 - DNA, 22 bp, Homo sapiens
cagggatgaccagagggatgtg

SEQ ID NO: 9172914 - DNA, 22 bp, Homo sapiens
cagggatgaccagagggatgtg

SEQ ID NO: 9172915 - DNA, 22 bp, Homo sapiens
cagggagggacaattgtcacct

SEQ ID NO: 9172916 - DNA, 22 bp, Homo sapiens
cagggaggctgtcttatgcctg

SEQ ID NO: 9172917 - DNA, 22 bp, Homo sapiens
cagggagggacaattgtcacct

SEQ ID NO: 9172918 - DNA, 22 bp, Homo sapiens
cagggagggaggaaaatttgct

SEQ ID NO: 9172919 - DNA, 22 bp, Homo sapiens
cagggagcctgaatgttccagg

SEQ ID NO: 9172920 - DNA, 22 bp, Homo sapiens
cagggagctttcccaggaccct

SEQ ID NO: 9172921 - DNA, 22 bp, Homo sapiens
cagggagcctgaatgttccagg

SEQ ID NO: 9172922 - DNA, 22 bp, Homo sapiens
cagggagctttcccaggaccct

SEQ ID NO: 9172923 - DNA, 22 bp, Homo sapiens
cagggagctttcccaggaccct

SEQ ID NO: 9172924 - DNA, 22 bp, Homo sapiens
cagggagctttgtcttctcatt

SEQ ID NO: 9172925 - DNA, 22 bp, Homo sapiens
cagggagctttgtcttctcatt

SEQ ID NO: 9172926 - DNA, 22 bp, Homo sapiens
cagggaggatgggctgttttgc

SEQ ID NO: 9172927 - DNA, 23 bp, Homo sapiens
cagggaggagatactgtgtatct

SEQ ID NO: 9172928 - DNA, 22 bp, Homo sapiens
cagggatgctgcttaggcagtt

SEQ ID NO: 9172929 - DNA, 22 bp, Homo sapiens
cagggatgctgcttaggcagtt

SEQ ID NO: 9172930 - DNA, 22 bp, Homo sapiens
cagggatgctgcttaggcagtt

SEQ ID NO: 9172931 - DNA, 22 bp, Homo sapiens
cagggatgagcagatggagcaa

SEQ ID NO: 9172932 - DNA, 22 bp, Homo sapiens
cagggatggagagactactggc

SEQ ID NO: 9172933 - DNA, 22 bp, Homo sapiens
cagggatggagagactactggc

SEQ ID NO: 9172934 - DNA, 22 bp, Homo sapiens
cagggatgctgcttaggcagtt

SEQ ID NO: 9172935 - DNA, 22 bp, Homo sapiens
cagggatgctgttaaacatcct

SEQ ID NO: 9172936 - DNA, 22 bp, Homo sapiens
cagggatgagcagatggagcaa

SEQ ID NO: 9172937 - DNA, 22 bp, Homo sapiens
cagggatgagcagatggagcaa

SEQ ID NO: 9172938 - DNA, 22 bp, Homo sapiens
cagggatgagaaagctctctaa

SEQ ID NO: 9172939 - DNA, 22 bp, Homo sapiens
cagggatgagagatggcacaga

SEQ ID NO: 9172940 - DNA, 22 bp, Homo sapiens
cagggatgagagatggcacaga

SEQ ID NO: 9172941 - DNA, 22 bp, Homo sapiens
tagcagcacagaaagcctggag

SEQ ID NO: 9172942 - DNA, 22 bp, Homo sapiens
tagcagcaatttcagaagtttg

SEQ ID NO: 9172943 - DNA, 22 bp, Homo sapiens
tagcagcaattcaggtgtgatg

SEQ ID NO: 9172944 - DNA, 22 bp, Homo sapiens
tagcagcaagaatgggatgtgt

SEQ ID NO: 9172945 - DNA, 22 bp, Homo sapiens
tagcagcaattcaggtgtgatg

SEQ ID NO: 9172946 - DNA, 22 bp, Homo sapiens
cagggatggcctggcgggccac

SEQ ID NO: 9172947 - DNA, 22 bp, Homo sapiens
cagggatggcctggcgggccac

SEQ ID NO: 9172948 - DNA, 22 bp, Homo sapiens
tagcagcaaaatgaccttctaa

SEQ ID NO: 9172949 - DNA, 22 bp, Homo sapiens
tagcagagtttggtacctgggg

SEQ ID NO: 9172950 - DNA, 22 bp, Homo sapiens
tagcagagtgattggccatgag

SEQ ID NO: 9172951 - DNA, 22 bp, Homo sapiens
tagcataacaggtaagagtgag

SEQ ID NO: 9172952 - DNA, 22 bp, Homo sapiens
tagcataacaggtaagagtgag

SEQ ID NO: 9172953 - DNA, 22 bp, Homo sapiens
tagcataacaggtaagagtgag

SEQ ID NO: 9172954 - DNA, 22 bp, Homo sapiens
tagcataacaggtaagagtgag

SEQ ID NO: 9172955 - DNA, 22 bp, Homo sapiens
tagcagtgttgccgttggctgc

SEQ ID NO: 9172956 - DNA, 22 bp, Homo sapiens
tagcagttaatctgagccaaga

SEQ ID NO: 9172957 - DNA, 22 bp, Homo sapiens
tagcagtgtgcaaaatctttaa

SEQ ID NO: 9172958 - DNA, 18 bp, Homo sapiens
tagcagcactggccgctt

SEQ ID NO: 9172959 - DNA, 18 bp, Homo sapiens
tagcagcactggccgctt

SEQ ID NO: 9172960 - DNA, 22 bp, Homo sapiens
tagcagcactatttgttgtagt

SEQ ID NO: 9172961 - DNA, 22 bp, Homo sapiens
tagcatggctgtggtttcttct

SEQ ID NO: 9172962 - DNA, 22 bp, Homo sapiens
tagcatggctgtggtttcttct

SEQ ID NO: 9172963 - DNA, 22 bp, Homo sapiens
tagcatggggagcagaaagtca

SEQ ID NO: 9172964 - DNA, 20 bp, Homo sapiens
tagcatgggtgagggtagag

SEQ ID NO: 9172965 - DNA, 22 bp, Homo sapiens
tagcatgggtcgcgtctctgga

SEQ ID NO: 9172966 - DNA, 22 bp, Homo sapiens
tagcatggtctgacatcctttg

SEQ ID NO: 9172967 - DNA, 22 bp, Homo sapiens
tagcatggtctggaattctcag

SEQ ID NO: 9172968 - DNA, 22 bp, Homo sapiens
tagcattagtcagatatgtttt

SEQ ID NO: 9172969 - DNA, 22 bp, Homo sapiens
cagggcaggacagatacattac

SEQ ID NO: 9172970 - DNA, 22 bp, Homo sapiens
cagggcagtaccgccctctggc

SEQ ID NO: 9172971 - DNA, 22 bp, Homo sapiens
cagggcagtaccgccctctggc

SEQ ID NO: 9172972 - DNA, 22 bp, Homo sapiens
cagggcagtaccgccctctggc

SEQ ID NO: 9172973 - DNA, 22 bp, Homo sapiens
cagggcagtaccgccctctggc

SEQ ID NO: 9172974 - DNA, 22 bp, Homo sapiens
cagggcagtgaagaacacacgt

SEQ ID NO: 9172975 - DNA, 22 bp, Homo sapiens
cagggcagtttgtgcctatgag

SEQ ID NO: 9172976 - DNA, 22 bp, Homo sapiens
cagggcagtttgtgcctatgag

SEQ ID NO: 9172977 - DNA, 22 bp, Homo sapiens
cagggcagttttacttctctct

SEQ ID NO: 9172978 - DNA, 22 bp, Homo sapiens
cagggcagttttacttctctct

SEQ ID NO: 9172979 - DNA, 22 bp, Homo sapiens
cagggcagttttacttctctct

SEQ ID NO: 9172980 - DNA, 22 bp, Homo sapiens
cagggcagttttacttctctct

SEQ ID NO: 9172981 - DNA, 22 bp, Homo sapiens
cagggccaagcccctttggctg

SEQ ID NO: 9172982 - DNA, 22 bp, Homo sapiens
tacagtttctcattatgctctc

SEQ ID NO: 9172983 - DNA, 22 bp, Homo sapiens
caggctcccacttggcttaaag

SEQ ID NO: 9172984 - DNA, 22 bp, Homo sapiens
caggctccattaatcatcctgc

SEQ ID NO: 9172985 - DNA, 22 bp, Homo sapiens
caggctcaaggctgacttccat

SEQ ID NO: 9172986 - DNA, 22 bp, Homo sapiens
caggctccactgtaggcagctc

SEQ ID NO: 9172987 - DNA, 22 bp, Homo sapiens
caggctccagcttcctgctcag

SEQ ID NO: 9172988 - DNA, 22 bp, Homo sapiens
caggctccagcttcctgctcag

SEQ ID NO: 9172989 - DNA, 22 bp, Homo sapiens
caggctccttcccagggatggt

SEQ ID NO: 9172990 - DNA, 22 bp, Homo sapiens
caggctcctcactcatgctccc

SEQ ID NO: 9172991 - DNA, 20 bp, Homo sapiens
caggctccgcaggactaggg

SEQ ID NO: 9172992 - DNA, 22 bp, Homo sapiens
caggctccctaagtcagcagcc

SEQ ID NO: 9172993 - DNA, 23 bp, Homo sapiens
caggctcccggaccaggatccgc

SEQ ID NO: 9172994 - DNA, 22 bp, Homo sapiens
caggctccctgggcagtggcag

SEQ ID NO: 9172995 - DNA, 22 bp, Homo sapiens
caggctccctgccagggccggc

SEQ ID NO: 9172996 - DNA, 22 bp, Homo sapiens
caggctccctgcaggccagtga

SEQ ID NO: 9172997 - DNA, 22 bp, Homo sapiens
tacagagacccacaagagactg

SEQ ID NO: 9172998 - DNA, 22 bp, Homo sapiens
tacagagacccacaagagactg

SEQ ID NO: 9172999 - DNA, 22 bp, Homo sapiens
tacagagactttatggcacaaa

SEQ ID NO: 9173000 - DNA, 22 bp, Homo sapiens
tacagcatgtccttagcaaggc

SEQ ID NO: 9173001 - DNA, 22 bp, Homo sapiens
tacagcattttgtagagtacta

SEQ ID NO: 9173002 - DNA, 22 bp, Homo sapiens
tacagcccaagaagtttatacg

SEQ ID NO: 9173003 - DNA, 20 bp, Homo sapiens
tacagcctattcaccacata

SEQ ID NO: 9173004 - DNA, 20 bp, Homo sapiens
tacagcctattcaccacata

SEQ ID NO: 9173005 - DNA, 22 bp, Homo sapiens
tacagcctcacatttacttaca

SEQ ID NO: 9173006 - DNA, 22 bp, Homo sapiens
tacagcctccacaggccaagtg

SEQ ID NO: 9173007 - DNA, 22 bp, Homo sapiens
tacagcctcatcacgggagctg

SEQ ID NO: 9173008 - DNA, 22 bp, Homo sapiens
tacagcctccacaggccaagtg

SEQ ID NO: 9173009 - DNA, 22 bp, Homo sapiens
tacagctagagggcacgtgaac

SEQ ID NO: 9173010 - DNA, 22 bp, Homo sapiens
tacagctatgtcttggtgttct

SEQ ID NO: 9173011 - DNA, 21 bp, Homo sapiens
tacagctcggcagataaagcc

SEQ ID NO: 9173012 - DNA, 22 bp, Homo sapiens
tacagctcccggggagcttcgt

SEQ ID NO: 9173013 - DNA, 22 bp, Homo sapiens
tacagctccaaaaatcactgtt

SEQ ID NO: 9173014 - DNA, 22 bp, Homo sapiens
tacagcctggcactaccctggg

SEQ ID NO: 9173015 - DNA, 22 bp, Homo sapiens
tacagcctgttacctatatttg

SEQ ID NO: 9173016 - DNA, 22 bp, Homo sapiens
tacagcctgttacctatatttg

SEQ ID NO: 9173017 - DNA, 22 bp, Homo sapiens
tacagccttcatctttgccttg

SEQ ID NO: 9173018 - DNA, 22 bp, Homo sapiens
tacagccttcatctttgccttg

SEQ ID NO: 9173019 - DNA, 22 bp, Homo sapiens
tacagccttcatctttgccttg

SEQ ID NO: 9173020 - DNA, 22 bp, Homo sapiens
tacagcctcttccctggagtgg

SEQ ID NO: 9173021 - DNA, 22 bp, Homo sapiens
tacagcctgatttggagccact

SEQ ID NO: 9173022 - DNA, 22 bp, Homo sapiens
tacagcctcgaactcctgcatt

SEQ ID NO: 9173023 - DNA, 22 bp, Homo sapiens
tacagcctcgaactcctgcatt

SEQ ID NO: 9173024 - DNA, 22 bp, Homo sapiens
caggccttctccctccctcaac

SEQ ID NO: 9173025 - DNA, 20 bp, Homo sapiens
caggccttcaggatggctgg

SEQ ID NO: 9173026 - DNA, 22 bp, Homo sapiens
caggccttatctccaccctgca

SEQ ID NO: 9173027 - DNA, 22 bp, Homo sapiens
caggccttaaggactcggagaa

SEQ ID NO: 9173028 - DNA, 22 bp, Homo sapiens
caggccttgaaggcctgcggga

SEQ ID NO: 9173029 - DNA, 22 bp, Homo sapiens
caggccttctccctccctcaac

SEQ ID NO: 9173030 - DNA, 22 bp, Homo sapiens
caggccttgggagagggtagat

SEQ ID NO: 9173031 - DNA, 22 bp, Homo sapiens
caggccttgcagtctgttgtaa

SEQ ID NO: 9173032 - DNA, 22 bp, Homo sapiens
caggccttgagttttgggcttt

SEQ ID NO: 9173033 - DNA, 22 bp, Homo sapiens
caggcctgtgagttgaggcccc

SEQ ID NO: 9173034 - DNA, 22 bp, Homo sapiens
caggcctgtgagttgaggcccc

SEQ ID NO: 9173035 - DNA, 22 bp, Homo sapiens
caggcctgtgacaccgtgtctg

SEQ ID NO: 9173036 - DNA, 23 bp, Homo sapiens
tacagctgcagaatcaggctaag

SEQ ID NO: 9173037 - DNA, 23 bp, Homo sapiens
tacagctgcagaatcaggctaag

SEQ ID NO: 9173038 - DNA, 22 bp, Homo sapiens
caggcctgtctgcacatgaggc

SEQ ID NO: 9173039 - DNA, 22 bp, Homo sapiens
tacagagaataataggacaggt

SEQ ID NO: 9173040 - DNA, 22 bp, Homo sapiens
tacactttcgtttgtggattag

SEQ ID NO: 9173041 - DNA, 22 bp, Homo sapiens
tacactgtttttggaaagaaga

SEQ ID NO: 9173042 - DNA, 22 bp, Homo sapiens
tacactgtgtaaaatgcacttt

SEQ ID NO: 9173043 - DNA, 22 bp, Homo sapiens
tacactgtaggtggcaggcagc

SEQ ID NO: 9173044 - DNA, 22 bp, Homo sapiens
tacactgtgacaatcatgacag

SEQ ID NO: 9173045 - DNA, 22 bp, Homo sapiens
caggccctcgtggtgagctggg

SEQ ID NO: 9173046 - DNA, 22 bp, Homo sapiens
caggccctcgtggtgagctggg

SEQ ID NO: 9173047 - DNA, 22 bp, Homo sapiens
caggccctgcacagtggtcctg

SEQ ID NO: 9173048 - DNA, 22 bp, Homo sapiens
caggccccattcctcttgggac

SEQ ID NO: 9173049 - DNA, 22 bp, Homo sapiens
caggccaatatcacatgctatg

SEQ ID NO: 9173050 - DNA, 22 bp, Homo sapiens
caggccacaagttgggttcaag

SEQ ID NO: 9173051 - DNA, 22 bp, Homo sapiens
caggccacacggcggctccctg

SEQ ID NO: 9173052 - DNA, 22 bp, Homo sapiens
caggccacagctaaagaggatt

SEQ ID NO: 9173053 - DNA, 22 bp, Homo sapiens
tacacagatttcagtatcatca

SEQ ID NO: 9173054 - DNA, 22 bp, Homo sapiens
tacacaggctgcctctttgcat

SEQ ID NO: 9173055 - DNA, 22 bp, Homo sapiens
caggccaataaatgtgatggcc

SEQ ID NO: 9173056 - DNA, 22 bp, Homo sapiens
caggccaagcctccccagctcc

SEQ ID NO: 9173057 - DNA, 22 bp, Homo sapiens
caggccaagtcccaagtgcggg

SEQ ID NO: 9173058 - DNA, 22 bp, Homo sapiens
caggccaactgcatggtgacca

SEQ ID NO: 9173059 - DNA, 22 bp, Homo sapiens
caggccaaagatcccattgaca

SEQ ID NO: 9173060 - DNA, 22 bp, Homo sapiens
caggccaaaattcaggcattct

SEQ ID NO: 9173061 - DNA, 22 bp, Homo sapiens
tacacagatatgtgatcaatca

SEQ ID NO: 9173062 - DNA, 22 bp, Homo sapiens
tacacagactcttcaattcaga

SEQ ID NO: 9173063 - DNA, 22 bp, Homo sapiens
tacacagaacctggtgtacagt

SEQ ID NO: 9173064 - DNA, 22 bp, Homo sapiens
gtggagccaggggctgtaggta

SEQ ID NO: 9173065 - DNA, 22 bp, Homo sapiens
gtggagcataacacactagcct

SEQ ID NO: 9173066 - DNA, 22 bp, Homo sapiens
gtggagcaggactagctgagaa

SEQ ID NO: 9173067 - DNA, 22 bp, Homo sapiens
gtggagcaggactagctgagaa

SEQ ID NO: 9173068 - DNA, 22 bp, Homo sapiens
gtggagcaatcagagggtcagt

SEQ ID NO: 9173069 - DNA, 22 bp, Homo sapiens
cagctctgccacttcctagcta

SEQ ID NO: 9173070 - DNA, 22 bp, Homo sapiens
cagctctgccacttcctagcta

SEQ ID NO: 9173071 - DNA, 22 bp, Homo sapiens
cagctctgccacttcctagcta

SEQ ID NO: 9173072 - DNA, 17 bp, Homo sapiens
cagctctgcatcttcct

SEQ ID NO: 9173073 - DNA, 22 bp, Homo sapiens
cagctctgccatcatctgcctt

SEQ ID NO: 9173074 - DNA, 22 bp, Homo sapiens
catgtaaagcacttcataacag

SEQ ID NO: 9173075 - DNA, 22 bp, Homo sapiens
catgtaaagaatttcacacaag

SEQ ID NO: 9173076 - DNA, 22 bp, Homo sapiens
catgtaaagcatccttctaggg

SEQ ID NO: 9173077 - DNA, 22 bp, Homo sapiens
catgtaaaacactcagaacagt

SEQ ID NO: 9173078 - DNA, 22 bp, Homo sapiens
catgtaaaacactcagaacagt

SEQ ID NO: 9173079 - DNA, 19 bp, Homo sapiens
catggtgaaaccccgtctc

SEQ ID NO: 9173080 - DNA, 22 bp, Homo sapiens
catgggctcttctggactgcac

SEQ ID NO: 9173081 - DNA, 22 bp, Homo sapiens
catggtgcaggagagaaggcag

SEQ ID NO: 9173082 - DNA, 22 bp, Homo sapiens
catggtgcagggcacatgagga

SEQ ID NO: 9173083 - DNA, 19 bp, Homo sapiens
catggtgaaaccccgtctc

SEQ ID NO: 9173084 - DNA, 19 bp, Homo sapiens
catggtgaaaccccgtctc

SEQ ID NO: 9173085 - DNA, 20 bp, Homo sapiens
catggtggaggagcagggcc

SEQ ID NO: 9173086 - DNA, 20 bp, Homo sapiens
catggtggaggagcagggcc

SEQ ID NO: 9173087 - DNA, 22 bp, Homo sapiens
catgctttaccaaagcagtgat

SEQ ID NO: 9173088 - DNA, 22 bp, Homo sapiens
catgcttcacacactgaatgac

SEQ ID NO: 9173089 - DNA, 22 bp, Homo sapiens
catgcttacctgccaaagcact

SEQ ID NO: 9173090 - DNA, 22 bp, Homo sapiens
catgcttaaaaatgcagagagt

SEQ ID NO: 9173091 - DNA, 22 bp, Homo sapiens
catgcttacttgtctcagcaga

SEQ ID NO: 9173092 - DNA, 22 bp, Homo sapiens
catgcttattcattctgctaac

SEQ ID NO: 9173093 - DNA, 22 bp, Homo sapiens
catgcttatgatttgctaagcc

SEQ ID NO: 9173094 - DNA, 22 bp, Homo sapiens
catgctttgggtcagaaatgcc

SEQ ID NO: 9173095 - DNA, 22 bp, Homo sapiens
tccagcagaaccagagacctgg

SEQ ID NO: 9173096 - DNA, 22 bp, Homo sapiens
tccagcagaaccagagacctgg

SEQ ID NO: 9173097 - DNA, 22 bp, Homo sapiens
tccagcagaaaagaggtaggga

SEQ ID NO: 9173098 - DNA, 22 bp, Homo sapiens
tccagcagaaaagaggtaggga

SEQ ID NO: 9173099 - DNA, 22 bp, Homo sapiens
tccagcagaaaagaggtaggga

SEQ ID NO: 9173100 - DNA, 17 bp, Homo sapiens
tccagagaggcttccct

SEQ ID NO: 9173101 - DNA, 18 bp, Homo sapiens
tccagagagggagaagtg

SEQ ID NO: 9173102 - DNA, 22 bp, Homo sapiens
tccaagcactgttaattaaact

SEQ ID NO: 9173103 - DNA, 22 bp, Homo sapiens
tccaagcactgttaattaaact

SEQ ID NO: 9173104 - DNA, 22 bp, Homo sapiens
tccaagcaacaactaatttaca

SEQ ID NO: 9173105 - DNA, 22 bp, Homo sapiens
tccaagcatgtggtcaggagcc

SEQ ID NO: 9173106 - DNA, 18 bp, Homo sapiens
tccagaggtgttggagcc

SEQ ID NO: 9173107 - DNA, 22 bp, Homo sapiens
tccaagatctacagcagtttag

SEQ ID NO: 9173108 - DNA, 20 bp, Homo sapiens
tccaagagtgatgtttcata

SEQ ID NO: 9173109 - DNA, 22 bp, Homo sapiens
tccaagagtatagtttattggc

SEQ ID NO: 9173110 - DNA, 22 bp, Homo sapiens
tcatcagtccttttcattatga

SEQ ID NO: 9173111 - DNA, 22 bp, Homo sapiens
tcatcagggatattggcctgaa

SEQ ID NO: 9173112 - DNA, 22 bp, Homo sapiens
tcatcaggaaacttatgcagtg

SEQ ID NO: 9173113 - DNA, 22 bp, Homo sapiens
catgctacttgctatgcaaaaa

SEQ ID NO: 9173114 - DNA, 22 bp, Homo sapiens
catgctacttgctatgcaaaaa

SEQ ID NO: 9173115 - DNA, 22 bp, Homo sapiens
catgctggtcagccagtggatg

SEQ ID NO: 9173116 - DNA, 22 bp, Homo sapiens
catgctggtcagccagtggatg

SEQ ID NO: 9173117 - DNA, 22 bp, Homo sapiens
catgctgtcctgccagggatgg

SEQ ID NO: 9173118 - DNA, 23 bp, Homo sapiens
catgctgtgatacaggaaggttg

SEQ ID NO: 9173119 - DNA, 22 bp, Homo sapiens
catgctgtggtaaatcactgaa

SEQ ID NO: 9173120 - DNA, 22 bp, Homo sapiens
catgctgtgcatcttgatgacc

SEQ ID NO: 9173121 - DNA, 22 bp, Homo sapiens
catgctgtgtggttagaactgt

SEQ ID NO: 9173122 - DNA, 22 bp, Homo sapiens
catgctgtgtgttttagctcca

SEQ ID NO: 9173123 - DNA, 22 bp, Homo sapiens
catgctgggtaaaggtggtgaa

SEQ ID NO: 9173124 - DNA, 22 bp, Homo sapiens
catgctgggtaaaggtggtgaa

SEQ ID NO: 9173125 - DNA, 20 bp, Homo sapiens
catgctgcctccattgatgc

SEQ ID NO: 9173126 - DNA, 22 bp, Homo sapiens
catgctgggccttgggtgcact

SEQ ID NO: 9173127 - DNA, 22 bp, Homo sapiens
catgctgcaggagctcttctca

SEQ ID NO: 9173128 - DNA, 22 bp, Homo sapiens
catgctctgcagcagacctgtg

SEQ ID NO: 9173129 - DNA, 22 bp, Homo sapiens
catgttttgtgtacagaatatt

SEQ ID NO: 9173130 - DNA, 22 bp, Homo sapiens
catgttttgtgtacagaatatt

SEQ ID NO: 9173131 - DNA, 22 bp, Homo sapiens
catgtggcacaaagaaggaaat

SEQ ID NO: 9173132 - DNA, 22 bp, Homo sapiens
tccaggctttttcatgctgtct

SEQ ID NO: 9173133 - DNA, 22 bp, Homo sapiens
tccaggctttttcatgctgtct

SEQ ID NO: 9173134 - DNA, 22 bp, Homo sapiens
tccaggcttgagaccaggctct

SEQ ID NO: 9173135 - DNA, 22 bp, Homo sapiens
tccaggcttgagaccaggctct

SEQ ID NO: 9173136 - DNA, 22 bp, Homo sapiens
tccaggcttgagaccaggctct

SEQ ID NO: 9173137 - DNA, 22 bp, Homo sapiens
tccaggctttggggcaggagcg

SEQ ID NO: 9173138 - DNA, 22 bp, Homo sapiens
tccaggctttggggcaggagcg

SEQ ID NO: 9173139 - DNA, 22 bp, Homo sapiens
tccaggctttggggcaggagcg

SEQ ID NO: 9173140 - DNA, 22 bp, Homo sapiens
tccaggctgtgcatgagtttag

SEQ ID NO: 9173141 - DNA, 22 bp, Homo sapiens
tccaggctcctgactttttggg

SEQ ID NO: 9173142 - DNA, 22 bp, Homo sapiens
tccaggctgggctgaagggtgc

SEQ ID NO: 9173143 - DNA, 22 bp, Homo sapiens
catgtacatgcatgggcactgt

SEQ ID NO: 9173144 - DNA, 22 bp, Homo sapiens
tccaggctgtgcgcaccgtgtg

SEQ ID NO: 9173145 - DNA, 22 bp, Homo sapiens
tccaggcttcacgtctgccctc

SEQ ID NO: 9173146 - DNA, 22 bp, Homo sapiens
tccaggcttcacgtctgccctc

SEQ ID NO: 9173147 - DNA, 22 bp, Homo sapiens
catgtacaaggatgctcagagt

SEQ ID NO: 9173148 - DNA, 22 bp, Homo sapiens
catgtacacacaaagggacaat

SEQ ID NO: 9173149 - DNA, 23 bp, Homo sapiens
catgtacacacagctgtacagtg

SEQ ID NO: 9173150 - DNA, 22 bp, Homo sapiens
catgtacactcatgtaactata

SEQ ID NO: 9173151 - DNA, 21 bp, Homo sapiens
cattacaagatttccaatttg

SEQ ID NO: 9173152 - DNA, 22 bp, Homo sapiens
tccagggcagggtgcgcatggg

SEQ ID NO: 9173153 - DNA, 22 bp, Homo sapiens
tccagggcagggtgcgcatggg

SEQ ID NO: 9173154 - DNA, 22 bp, Homo sapiens
cattacaaccccaaattacaaa

SEQ ID NO: 9173155 - DNA, 22 bp, Homo sapiens
cattacaaccccaaattacaaa

SEQ ID NO: 9173156 - DNA, 22 bp, Homo sapiens
cattacaaccccaaattacaaa

SEQ ID NO: 9173157 - DNA, 22 bp, Homo sapiens
cattacaaccccaaattacaaa

SEQ ID NO: 9173158 - DNA, 22 bp, Homo sapiens
tccagggcaggtgctgggctct

SEQ ID NO: 9173159 - DNA, 22 bp, Homo sapiens
tccagggcaggtgctgggctct

SEQ ID NO: 9173160 - DNA, 22 bp, Homo sapiens
tccagggcagtgactacagcgg

SEQ ID NO: 9173161 - DNA, 22 bp, Homo sapiens
tccagggcagtgactacagcgg

SEQ ID NO: 9173162 - DNA, 22 bp, Homo sapiens
tccagggcagtgactacagcgg

SEQ ID NO: 9173163 - DNA, 23 bp, Homo sapiens
tccagggcagtggctgggtctgc

SEQ ID NO: 9173164 - DNA, 19 bp, Homo sapiens
cattacaaatttgtaggga

SEQ ID NO: 9173165 - DNA, 22 bp, Homo sapiens
cattacaacaatctgccatggc

SEQ ID NO: 9173166 - DNA, 19 bp, Homo sapiens
cattacaaatttgtaggga

SEQ ID NO: 9173167 - DNA, 22 bp, Homo sapiens
cattacaaagttataaacagtt

SEQ ID NO: 9173168 - DNA, 22 bp, Homo sapiens
cattacaaagttataaacagtt

SEQ ID NO: 9173169 - DNA, 22 bp, Homo sapiens
cattacaaacatgttaagattt

SEQ ID NO: 9173170 - DNA, 22 bp, Homo sapiens
cattacaaacatgttaagattt

SEQ ID NO: 9173171 - DNA, 22 bp, Homo sapiens
cattaataaacatttcagaaga

SEQ ID NO: 9173172 - DNA, 22 bp, Homo sapiens
tccaggtcatcttggagagctg

SEQ ID NO: 9173173 - DNA, 22 bp, Homo sapiens
tccaggtcccagactgggcagc

SEQ ID NO: 9173174 - DNA, 18 bp, Homo sapiens
tccaggtcccaggggaag

SEQ ID NO: 9173175 - DNA, 22 bp, Homo sapiens
tccaggtcagacttctgtgccc

SEQ ID NO: 9173176 - DNA, 22 bp, Homo sapiens
tccaggtattactaagtgttaa

SEQ ID NO: 9173177 - DNA, 19 bp, Homo sapiens
tccagggtcattaacaatg

SEQ ID NO: 9173178 - DNA, 20 bp, Homo sapiens
tccagggtagatgaattctg

SEQ ID NO: 9173179 - DNA, 22 bp, Homo sapiens
tccagggcatccacgcgtgggg

SEQ ID NO: 9173180 - DNA, 22 bp, Homo sapiens
tccagggcatccacgcgtgggg

SEQ ID NO: 9173181 - DNA, 22 bp, Homo sapiens
tccagggcatgctcagactcag

SEQ ID NO: 9173182 - DNA, 22 bp, Homo sapiens
tccagggcatgctcagactcag

SEQ ID NO: 9173183 - DNA, 22 bp, Homo sapiens
tccagggcatgctcagactcag

SEQ ID NO: 9173184 - DNA, 22 bp, Homo sapiens
tccagggccaagtcatggaacc

SEQ ID NO: 9173185 - DNA, 22 bp, Homo sapiens
tccagggcatggggagagagtg

SEQ ID NO: 9173186 - DNA, 22 bp, Homo sapiens
catcatcaaaagtgacagagaa

SEQ ID NO: 9173187 - DNA, 22 bp, Homo sapiens
catcatcaaaacaaatggagtc

SEQ ID NO: 9173188 - DNA, 22 bp, Homo sapiens
catcatatatttctacaagtgc

SEQ ID NO: 9173189 - DNA, 22 bp, Homo sapiens
catcatatggaatttaaagtca

SEQ ID NO: 9173190 - DNA, 22 bp, Homo sapiens
catcagttttagaggggtgaaa

SEQ ID NO: 9173191 - DNA, 22 bp, Homo sapiens
catcataaaattgagataactg

SEQ ID NO: 9173192 - DNA, 22 bp, Homo sapiens
tcagtgctgtaaacaaaaggaa

SEQ ID NO: 9173193 - DNA, 22 bp, Homo sapiens
catcatcacctgctatacgatc

SEQ ID NO: 9173194 - DNA, 22 bp, Homo sapiens
tcagtgtgagtaccatgctcag

SEQ ID NO: 9173195 - DNA, 22 bp, Homo sapiens
tcagtgtgggtaagcatgctgt

SEQ ID NO: 9173196 - DNA, 22 bp, Homo sapiens
catcaggaataaatgaggctgt

SEQ ID NO: 9173197 - DNA, 22 bp, Homo sapiens
catcaggaaaggacgtctagcc

SEQ ID NO: 9173198 - DNA, 22 bp, Homo sapiens
catcagcaggcaacactcttgg

SEQ ID NO: 9173199 - DNA, 22 bp, Homo sapiens
catcagcctggaaggcagcctg

SEQ ID NO: 9173200 - DNA, 23 bp, Homo sapiens
catcagcctcagtctgtggaccc

SEQ ID NO: 9173201 - DNA, 22 bp, Homo sapiens
catcagctaaacttagtgaaat

SEQ ID NO: 9173202 - DNA, 22 bp, Homo sapiens
catcagtgaaagtgaatgttct

SEQ ID NO: 9173203 - DNA, 23 bp, Homo sapiens
catcagtgagggggaatcactaa

SEQ ID NO: 9173204 - DNA, 20 bp, Homo sapiens
catcagtgcctgacaggtcc

SEQ ID NO: 9173205 - DNA, 22 bp, Homo sapiens
catcagtgtgttgccttgctca

SEQ ID NO: 9173206 - DNA, 22 bp, Homo sapiens
catcagtttggagaggcggttt

SEQ ID NO: 9173207 - DNA, 22 bp, Homo sapiens
catcagttcctgcccctgcccc

SEQ ID NO: 9173208 - DNA, 22 bp, Homo sapiens
catcagttcatgtctagctgct

SEQ ID NO: 9173209 - DNA, 22 bp, Homo sapiens
catcagtgtctctctggtactt

SEQ ID NO: 9173210 - DNA, 22 bp, Homo sapiens
catcagtgtggcagttcactgt

SEQ ID NO: 9173211 - DNA, 22 bp, Homo sapiens
catccgttaataaaaagacagt

SEQ ID NO: 9173212 - DNA, 21 bp, Homo sapiens
catccgtttatatctctgtgg

SEQ ID NO: 9173213 - DNA, 22 bp, Homo sapiens
catccgttgtgctgttgctctc

SEQ ID NO: 9173214 - DNA, 22 bp, Homo sapiens
catccctgtctgccactctgaa

SEQ ID NO: 9173215 - DNA, 22 bp, Homo sapiens
catccgcatgcaagtgctgtcc

SEQ ID NO: 9173216 - DNA, 17 bp, Homo sapiens
catccgtgagctcggca

SEQ ID NO: 9173217 - DNA, 22 bp, Homo sapiens
catccctgtcgtcaagtctctg

SEQ ID NO: 9173218 - DNA, 19 bp, Homo sapiens
tcagtgtgtgggaggtggt

SEQ ID NO: 9173219 - DNA, 22 bp, Homo sapiens
catcctgtttctgtgcagcatg

SEQ ID NO: 9173220 - DNA, 22 bp, Homo sapiens
catcctgtgatgtctttggctg

SEQ ID NO: 9173221 - DNA, 22 bp, Homo sapiens
catcctgcggggagcagagggc

SEQ ID NO: 9173222 - DNA, 22 bp, Homo sapiens
catcctgagaggtctctctacc

SEQ ID NO: 9173223 - DNA, 19 bp, Homo sapiens
tcataaggagagaggaaat

SEQ ID NO: 9173224 - DNA, 22 bp, Homo sapiens
tcagtttcctcatctacaaaag

SEQ ID NO: 9173225 - DNA, 22 bp, Homo sapiens
tcagtttcctcatctacaaaag

SEQ ID NO: 9173226 - DNA, 22 bp, Homo sapiens
tcagtttcacttgaagaaaaga

SEQ ID NO: 9173227 - DNA, 22 bp, Homo sapiens
tcagtttcacagtctgtgcaga

SEQ ID NO: 9173228 - DNA, 22 bp, Homo sapiens
tcagtttcacagtctgtgcaga

SEQ ID NO: 9173229 - DNA, 22 bp, Homo sapiens
catctaaccagtcgtttttgga

SEQ ID NO: 9173230 - DNA, 22 bp, Homo sapiens
catctaaatttgactccaagga

SEQ ID NO: 9173231 - DNA, 22 bp, Homo sapiens
tcataattgtatacatttatgg

SEQ ID NO: 9173232 - DNA, 19 bp, Homo sapiens
tcatcacttcagaggaaaa

SEQ ID NO: 9173233 - DNA, 22 bp, Homo sapiens
tcatcacatgtgtagtcatccc

SEQ ID NO: 9173234 - DNA, 22 bp, Homo sapiens
tcatcacatgtgtagtcatccc

SEQ ID NO: 9173235 - DNA, 19 bp, Homo sapiens
tcatcacccctcctctcta

SEQ ID NO: 9173236 - DNA, 22 bp, Homo sapiens
tcatacaggctcaagctatacg

SEQ ID NO: 9173237 - DNA, 22 bp, Homo sapiens
tcatcaaagtcaaagaatgact

SEQ ID NO: 9173238 - DNA, 22 bp, Homo sapiens
tcatcacaattttatgaccctc

SEQ ID NO: 9173239 - DNA, 22 bp, Homo sapiens
tcatcaaagtcaaagaatgact

SEQ ID NO: 9173240 - DNA, 22 bp, Homo sapiens
tcatcacatatgtcatgatttg

SEQ ID NO: 9173241 - DNA, 21 bp, Homo sapiens
catattaaatcggtgccttta

SEQ ID NO: 9173242 - DNA, 22 bp, Homo sapiens
catcaaatggcaagtgaaagct

SEQ ID NO: 9173243 - DNA, 22 bp, Homo sapiens
tcaggcagagctgtggagctct

SEQ ID NO: 9173244 - DNA, 22 bp, Homo sapiens
tcaggcagaccaccgtgggcag

SEQ ID NO: 9173245 - DNA, 22 bp, Homo sapiens
tcaggcagagctgtggagctct

SEQ ID NO: 9173246 - DNA, 22 bp, Homo sapiens
tcaggcagagctgtggagctct

SEQ ID NO: 9173247 - DNA, 22 bp, Homo sapiens
tcaggcagaccaccgtgggcag

SEQ ID NO: 9173248 - DNA, 22 bp, Homo sapiens
tcaggcagaattatcaaaagat

SEQ ID NO: 9173249 - DNA, 22 bp, Homo sapiens
tcaggcagaccaccgtgggcag

SEQ ID NO: 9173250 - DNA, 22 bp, Homo sapiens
tcaggcagagggagaagccaag

SEQ ID NO: 9173251 - DNA, 22 bp, Homo sapiens
tcaggcagagggagaagccaag

SEQ ID NO: 9173252 - DNA, 22 bp, Homo sapiens
tcaggcagaggatggggagcgt

SEQ ID NO: 9173253 - DNA, 22 bp, Homo sapiens
tcaggcagagctgtggagctct

SEQ ID NO: 9173254 - DNA, 21 bp, Homo sapiens
catcaactcttgtgctcacac

SEQ ID NO: 9173255 - DNA, 22 bp, Homo sapiens
catcaatagggtttgaaagcaa

SEQ ID NO: 9173256 - DNA, 22 bp, Homo sapiens
tcaggctgatttcttttgaggg

SEQ ID NO: 9173257 - DNA, 22 bp, Homo sapiens
catcaatgtgcagagatgaacg

SEQ ID NO: 9173258 - DNA, 22 bp, Homo sapiens
tcaggctgcctatcagactgtg

SEQ ID NO: 9173259 - DNA, 22 bp, Homo sapiens
tcaggctgcatctgtaagggtg

SEQ ID NO: 9173260 - DNA, 22 bp, Homo sapiens
tcaggctgcatctgtaagggtg

SEQ ID NO: 9173261 - DNA, 22 bp, Homo sapiens
tcaggctgcatctgtaagggtg

SEQ ID NO: 9173262 - DNA, 22 bp, Homo sapiens
tcaggctgcccgttcagggctc

SEQ ID NO: 9173263 - DNA, 22 bp, Homo sapiens
tcaggaggcgtgctggggtaca

SEQ ID NO: 9173264 - DNA, 22 bp, Homo sapiens
tcaggaggcgtgctggggtaca

SEQ ID NO: 9173265 - DNA, 22 bp, Homo sapiens
tcaggaggctcaagacctggca

SEQ ID NO: 9173266 - DNA, 22 bp, Homo sapiens
tcaggaggcgtctcgctggggc

SEQ ID NO: 9173267 - DNA, 22 bp, Homo sapiens
tcaggaggcgtctcgctggggc

SEQ ID NO: 9173268 - DNA, 21 bp, Homo sapiens
tcaggaggctcagactcctgc

SEQ ID NO: 9173269 - DNA, 22 bp, Homo sapiens
tcaggagggagtgtggatagag

SEQ ID NO: 9173270 - DNA, 22 bp, Homo sapiens
tcaggcagaaaaatcactaatt

SEQ ID NO: 9173271 - DNA, 22 bp, Homo sapiens
tcaggcagaattatcaaaagat

SEQ ID NO: 9173272 - DNA, 22 bp, Homo sapiens
tcaggaggccggcaggatttga

SEQ ID NO: 9173273 - DNA, 22 bp, Homo sapiens
tcaggaggccgtgtgctcagtg

SEQ ID NO: 9173274 - DNA, 22 bp, Homo sapiens
tcaggaggccaccaggacctgt

SEQ ID NO: 9173275 - DNA, 22 bp, Homo sapiens
tcaggaggcggaggttgcagtg

SEQ ID NO: 9173276 - DNA, 22 bp, Homo sapiens
tcaggaggcggaggttgcagtg

SEQ ID NO: 9173277 - DNA, 22 bp, Homo sapiens
tcaggaggcggtgctgcctttg

SEQ ID NO: 9173278 - DNA, 22 bp, Homo sapiens
tcaggaggccgtgtgctcagtg

SEQ ID NO: 9173279 - DNA, 22 bp, Homo sapiens
tcaggaggcctgagtagctcta

SEQ ID NO: 9173280 - DNA, 22 bp, Homo sapiens
tcacttataaaatgcaagatct

SEQ ID NO: 9173281 - DNA, 21 bp, Homo sapiens
tcacttataatgtatttgctg

SEQ ID NO: 9173282 - DNA, 22 bp, Homo sapiens
tcacttataaaatgcaagatct

SEQ ID NO: 9173283 - DNA, 22 bp, Homo sapiens
tcacttattgctcatctcatgc

SEQ ID NO: 9173284 - DNA, 22 bp, Homo sapiens
tcacttattgctcatctcatgc

SEQ ID NO: 9173285 - DNA, 22 bp, Homo sapiens
tcacttattttctaaccaaagg

SEQ ID NO: 9173286 - DNA, 22 bp, Homo sapiens
tcaggaagttttgaatcaactg

SEQ ID NO: 9173287 - DNA, 22 bp, Homo sapiens
cagtgtataaactttaacatag

SEQ ID NO: 9173288 - DNA, 22 bp, Homo sapiens
tctcagcttgagtggatgagct

SEQ ID NO: 9173289 - DNA, 22 bp, Homo sapiens
tctcagagacctgaactccctg

SEQ ID NO: 9173290 - DNA, 22 bp, Homo sapiens
tctcaggaaataggatttgagt

SEQ ID NO: 9173291 - DNA, 22 bp, Homo sapiens
tctcaggaagattagggctaag

SEQ ID NO: 9173292 - DNA, 22 bp, Homo sapiens
tctcaggaagattagggctaag

SEQ ID NO: 9173293 - DNA, 22 bp, Homo sapiens
tctcaggaatagagtggcagca

SEQ ID NO: 9173294 - DNA, 22 bp, Homo sapiens
tctcaggaatagagtggcagca

SEQ ID NO: 9173295 - DNA, 22 bp, Homo sapiens
tctagaattcccttttgacaat

SEQ ID NO: 9173296 - DNA, 22 bp, Homo sapiens
tctagaatgttccaccttgttt

SEQ ID NO: 9173297 - DNA, 22 bp, Homo sapiens
tctagaatgacatgcaagagta

SEQ ID NO: 9173298 - DNA, 22 bp, Homo sapiens
tctcagtgttgttctgcagatg

SEQ ID NO: 9173299 - DNA, 22 bp, Homo sapiens
tctcagtgtttaaaaagatttc

SEQ ID NO: 9173300 - DNA, 22 bp, Homo sapiens
tctcagtgttatctatctgcct

SEQ ID NO: 9173301 - DNA, 22 bp, Homo sapiens
tctcagtggcttcctcactttt

SEQ ID NO: 9173302 - DNA, 22 bp, Homo sapiens
tctcagtgtggtgcttaggata

SEQ ID NO: 9173303 - DNA, 22 bp, Homo sapiens
tctcagtgtgttttctctcaga

SEQ ID NO: 9173304 - DNA, 22 bp, Homo sapiens
tctcaggactcctctggccata

SEQ ID NO: 9173305 - DNA, 23 bp, Homo sapiens
tctcaggacacacatgtctatca

SEQ ID NO: 9173306 - DNA, 22 bp, Homo sapiens
tctcaggactttgggaagctca

SEQ ID NO: 9173307 - DNA, 22 bp, Homo sapiens
tctcaggactttgggaagctca

SEQ ID NO: 9173308 - DNA, 22 bp, Homo sapiens
tctcaggagccacagcgggagt

SEQ ID NO: 9173309 - DNA, 22 bp, Homo sapiens
tctcaggagtagtgggatccat

SEQ ID NO: 9173310 - DNA, 22 bp, Homo sapiens
tctcaggagccacagcgggagt

SEQ ID NO: 9173311 - DNA, 22 bp, Homo sapiens
tctcaggcatctgtgtggcaca

SEQ ID NO: 9173312 - DNA, 22 bp, Homo sapiens
tctcaggcatggtttgttcatc

SEQ ID NO: 9173313 - DNA, 17 bp, Homo sapiens
tcctgtttatcattgat

SEQ ID NO: 9173314 - DNA, 22 bp, Homo sapiens
tcctgtttctcctgcaaaatcc

SEQ ID NO: 9173315 - DNA, 22 bp, Homo sapiens
tctagaaacatgacattgatct

SEQ ID NO: 9173316 - DNA, 18 bp, Homo sapiens
tctagaaacccagactct

SEQ ID NO: 9173317 - DNA, 22 bp, Homo sapiens
tctagaaattttgccttgtatt

SEQ ID NO: 9173318 - DNA, 22 bp, Homo sapiens
tctagaaattttgccttgtatt

SEQ ID NO: 9173319 - DNA, 22 bp, Homo sapiens
tctagaagtatattgtagggtg

SEQ ID NO: 9173320 - DNA, 22 bp, Homo sapiens
tctagaatagattctgctgatc

SEQ ID NO: 9173321 - DNA, 19 bp, Homo sapiens
ccacccctttgctgggccc

SEQ ID NO: 9173322 - DNA, 19 bp, Homo sapiens
ccacccctttgctgggccc

SEQ ID NO: 9173323 - DNA, 22 bp, Homo sapiens
ccaccctgagccgcaagagcag

SEQ ID NO: 9173324 - DNA, 22 bp, Homo sapiens
ccacccctgggtgcagggagcg

SEQ ID NO: 9173325 - DNA, 22 bp, Homo sapiens
ccaccccaaatgaagacctctc

SEQ ID NO: 9173326 - DNA, 22 bp, Homo sapiens
ccaccccaaatgaagacctctc

SEQ ID NO: 9173327 - DNA, 22 bp, Homo sapiens
ccaccaggcactcacagggaag

SEQ ID NO: 9173328 - DNA, 22 bp, Homo sapiens
tcctgtggtctggaaggaatgg

SEQ ID NO: 9173329 - DNA, 22 bp, Homo sapiens
ccaccctgagccgcaagagcag

SEQ ID NO: 9173330 - DNA, 22 bp, Homo sapiens
ccagagggcaaaatgaagctta

SEQ ID NO: 9173331 - DNA, 22 bp, Homo sapiens
ccagagggccctggtctcagct

SEQ ID NO: 9173332 - DNA, 22 bp, Homo sapiens
ccagagggccctggtctcagct

SEQ ID NO: 9173333 - DNA, 22 bp, Homo sapiens
ccagagggcttggtttgggcca

SEQ ID NO: 9173334 - DNA, 22 bp, Homo sapiens
ccagaggggctgagcaggtcac

SEQ ID NO: 9173335 - DNA, 20 bp, Homo sapiens
ccagagggtagggccgcccc

SEQ ID NO: 9173336 - DNA, 22 bp, Homo sapiens
ccagaggtcctgctcactggtg

SEQ ID NO: 9173337 - DNA, 18 bp, Homo sapiens
ccagagggtgcgtcagct

SEQ ID NO: 9173338 - DNA, 22 bp, Homo sapiens
tctctgggataaactgggccag

SEQ ID NO: 9173339 - DNA, 22 bp, Homo sapiens
ccagatgtccctctcaggtttg

SEQ ID NO: 9173340 - DNA, 22 bp, Homo sapiens
ccagatgtccctctcaggtttg

SEQ ID NO: 9173341 - DNA, 22 bp, Homo sapiens
ccagcaaggtccagcataggga

SEQ ID NO: 9173342 - DNA, 22 bp, Homo sapiens
ccagcaagccaggtctgtggct

SEQ ID NO: 9173343 - DNA, 20 bp, Homo sapiens
ccagcaccctctcagctgaa

SEQ ID NO: 9173344 - DNA, 20 bp, Homo sapiens
ccagcaccctctcagctgaa

SEQ ID NO: 9173345 - DNA, 22 bp, Homo sapiens
tctctgtattctgatattcact

SEQ ID NO: 9173346 - DNA, 21 bp, Homo sapiens
tctctgtatccatgggttcca

SEQ ID NO: 9173347 - DNA, 22 bp, Homo sapiens
tctctgtatcccagaaccaaaa

SEQ ID NO: 9173348 - DNA, 22 bp, Homo sapiens
tctctgtatcccagaaccaaaa

SEQ ID NO: 9173349 - DNA, 22 bp, Homo sapiens
tctctgtagagacagcactgtg

SEQ ID NO: 9173350 - DNA, 22 bp, Homo sapiens
tctctgtagttgggcagctgct

SEQ ID NO: 9173351 - DNA, 22 bp, Homo sapiens
tctctgtagggctgcttgagta

SEQ ID NO: 9173352 - DNA, 22 bp, Homo sapiens
tctctgtaatatcttttacaac

SEQ ID NO: 9173353 - DNA, 22 bp, Homo sapiens
tctctgtaagctgccttctcgt

SEQ ID NO: 9173354 - DNA, 22 bp, Homo sapiens
tctctgtagacctgaccagcac

SEQ ID NO: 9173355 - DNA, 22 bp, Homo sapiens
tctctgtacagtacatgccgtg

SEQ ID NO: 9173356 - DNA, 22 bp, Homo sapiens
tctctgtacagtacatgccgtg

SEQ ID NO: 9173357 - DNA, 22 bp, Homo sapiens
tctctgggataaactgggccag

SEQ ID NO: 9173358 - DNA, 22 bp, Homo sapiens
tctctgggataaactgggccag

SEQ ID NO: 9173359 - DNA, 22 bp, Homo sapiens
tctctgtaaaatgtggatgata

SEQ ID NO: 9173360 - DNA, 22 bp, Homo sapiens
tctctgtaaaatgtggatgata

SEQ ID NO: 9173361 - DNA, 22 bp, Homo sapiens
ccagaggatcagtactggctgg

SEQ ID NO: 9173362 - DNA, 22 bp, Homo sapiens
ccagaggctggcagccagctga

SEQ ID NO: 9173363 - DNA, 22 bp, Homo sapiens
ccagagcctcttatgaagatcg

SEQ ID NO: 9173364 - DNA, 22 bp, Homo sapiens
ccagagcctcgcccggagcctc

SEQ ID NO: 9173365 - DNA, 22 bp, Homo sapiens
ccagagcctcaacacaggtcct

SEQ ID NO: 9173366 - DNA, 22 bp, Homo sapiens
ccagagcctaagatctgatcct

SEQ ID NO: 9173367 - DNA, 22 bp, Homo sapiens
ccagagggaactgggcctcatt

SEQ ID NO: 9173368 - DNA, 22 bp, Homo sapiens
ccagagggaagaggaagcgctg

SEQ ID NO: 9173369 - DNA, 22 bp, Homo sapiens
ccagaggctgggttcacctcag

SEQ ID NO: 9173370 - DNA, 22 bp, Homo sapiens
ccagaggctggggaaggataca

SEQ ID NO: 9173371 - DNA, 22 bp, Homo sapiens
ccagaggctgggttcacctcag

SEQ ID NO: 9173372 - DNA, 22 bp, Homo sapiens
ccagagcccgggacctggactt

SEQ ID NO: 9173373 - DNA, 22 bp, Homo sapiens
ccagagccggattgtgaagtgc

SEQ ID NO: 9173374 - DNA, 22 bp, Homo sapiens
ccagagcccgggacctggactt

SEQ ID NO: 9173375 - DNA, 22 bp, Homo sapiens
ccagagcccgggacctggactt

SEQ ID NO: 9173376 - DNA, 22 bp, Homo sapiens
ccagagccggctccctcagctt

SEQ ID NO: 9173377 - DNA, 22 bp, Homo sapiens
ccagagcccagggtcatgcagg

SEQ ID NO: 9173378 - DNA, 22 bp, Homo sapiens
ccagagcccagggtcatgcagg

SEQ ID NO: 9173379 - DNA, 22 bp, Homo sapiens
ccagagcccctgagcttccctg

SEQ ID NO: 9173380 - DNA, 22 bp, Homo sapiens
ccagagcccctgagcttccctg

SEQ ID NO: 9173381 - DNA, 22 bp, Homo sapiens
ccagagccagagaggtgcctgc

SEQ ID NO: 9173382 - DNA, 22 bp, Homo sapiens
ccagagcccagcacacggtgct

SEQ ID NO: 9173383 - DNA, 22 bp, Homo sapiens
ccagagccagagaggtgcctgc

SEQ ID NO: 9173384 - DNA, 22 bp, Homo sapiens
ccagagccagagaggtgcctgc

SEQ ID NO: 9173385 - DNA, 22 bp, Homo sapiens
ccagagagggcgccacctggag

SEQ ID NO: 9173386 - DNA, 20 bp, Homo sapiens
ccagagcagccactgaagtt

SEQ ID NO: 9173387 - DNA, 22 bp, Homo sapiens
ccagagcagggcagcagggctc

SEQ ID NO: 9173388 - DNA, 22 bp, Homo sapiens
ccagagcagggcagcagggctc

SEQ ID NO: 9173389 - DNA, 22 bp, Homo sapiens
ccagagcagggcagcagggctc

SEQ ID NO: 9173390 - DNA, 22 bp, Homo sapiens
catttctagggatcataaagta

SEQ ID NO: 9173391 - DNA, 22 bp, Homo sapiens
catttctaccaaatgtgactgg

SEQ ID NO: 9173392 - DNA, 22 bp, Homo sapiens
catttctaccaaatgtgactgg

SEQ ID NO: 9173393 - DNA, 21 bp, Homo sapiens
catttctaagcctggctatag

SEQ ID NO: 9173394 - DNA, 22 bp, Homo sapiens
catttccttcctgctgctcctc

SEQ ID NO: 9173395 - DNA, 22 bp, Homo sapiens
catttcctgtctggaggtcaaa

SEQ ID NO: 9173396 - DNA, 22 bp, Homo sapiens
catttcagtgttattctaattt

SEQ ID NO: 9173397 - DNA, 22 bp, Homo sapiens
catttcagtgtcttgtgatgaa

SEQ ID NO: 9173398 - DNA, 21 bp, Homo sapiens
catttcagtaaggaagcctgt

SEQ ID NO: 9173399 - DNA, 22 bp, Homo sapiens
catttcactattcactaaaagg

SEQ ID NO: 9173400 - DNA, 22 bp, Homo sapiens
catttcatagttgtcacaataa

SEQ ID NO: 9173401 - DNA, 22 bp, Homo sapiens
catttcatagttgtcacaataa

SEQ ID NO: 9173402 - DNA, 21 bp, Homo sapiens
catttcatgattatagaaatg

SEQ ID NO: 9173403 - DNA, 21 bp, Homo sapiens
catttcatgattatagaaatg

SEQ ID NO: 9173404 - DNA, 21 bp, Homo sapiens
catttcatgattatagaaatg

SEQ ID NO: 9173405 - DNA, 21 bp, Homo sapiens
catttcatgattatagaaatg

SEQ ID NO: 9173406 - DNA, 22 bp, Homo sapiens
catttccactctgggagtcaga

SEQ ID NO: 9173407 - DNA, 22 bp, Homo sapiens
tccataaaccagaaaatcaaga

SEQ ID NO: 9173408 - DNA, 22 bp, Homo sapiens
tccagttttgaatcctgcttct

SEQ ID NO: 9173409 - DNA, 20 bp, Homo sapiens
tccagttttggagacattct

SEQ ID NO: 9173410 - DNA, 18 bp, Homo sapiens
tccagttttcccagcatc

SEQ ID NO: 9173411 - DNA, 22 bp, Homo sapiens
tccagttttaatactcactgcc

SEQ ID NO: 9173412 - DNA, 22 bp, Homo sapiens
tccagtttggttctgttctcca

SEQ ID NO: 9173413 - DNA, 22 bp, Homo sapiens
tccagtttgggtgtgagctgcg

SEQ ID NO: 9173414 - DNA, 22 bp, Homo sapiens
tccaggtcctactggcccatag

SEQ ID NO: 9173415 - DNA, 22 bp, Homo sapiens
tccaggtccctggggagatttt

SEQ ID NO: 9173416 - DNA, 18 bp, Homo sapiens
tccaggtcccaggggaag

SEQ ID NO: 9173417 - DNA, 22 bp, Homo sapiens
tccaggtccctggggagatttt

SEQ ID NO: 9173418 - DNA, 22 bp, Homo sapiens
tccagtttctctcaatcaatta

SEQ ID NO: 9173419 - DNA, 22 bp, Homo sapiens
tccagtttgcactgtataatag

SEQ ID NO: 9173420 - DNA, 22 bp, Homo sapiens
catttcacagtatattcaaaat

SEQ ID NO: 9173421 - DNA, 22 bp, Homo sapiens
catttcaccttagagaattatt

SEQ ID NO: 9173422 - DNA, 22 bp, Homo sapiens
catttattggcatgtagtaggt

SEQ ID NO: 9173423 - DNA, 22 bp, Homo sapiens
catttcacagtatattcaaaat

SEQ ID NO: 9173424 - DNA, 22 bp, Homo sapiens
tccatataatgggattccttat

SEQ ID NO: 9173425 - DNA, 22 bp, Homo sapiens
cattttcagcacccatctgaaa

SEQ ID NO: 9173426 - DNA, 22 bp, Homo sapiens
cattttcagcacccatctgaaa

SEQ ID NO: 9173427 - DNA, 22 bp, Homo sapiens
cattttatgtttatggagtgct

SEQ ID NO: 9173428 - DNA, 19 bp, Homo sapiens
cattttaagcatccccagt

SEQ ID NO: 9173429 - DNA, 22 bp, Homo sapiens
catttgtcatcactgagctgcc

SEQ ID NO: 9173430 - DNA, 22 bp, Homo sapiens
catttctagggatcataaagta

SEQ ID NO: 9173431 - DNA, 21 bp, Homo sapiens
catttctattgatgagaaaag

SEQ ID NO: 9173432 - DNA, 22 bp, Homo sapiens
cattttaaatgatttaagccaa

SEQ ID NO: 9173433 - DNA, 22 bp, Homo sapiens
cattttaaatgatttaagccaa

SEQ ID NO: 9173434 - DNA, 22 bp, Homo sapiens
cattttaagatgacctggtttc

SEQ ID NO: 9173435 - DNA, 22 bp, Homo sapiens
tcctgagggctcggggctcatg

SEQ ID NO: 9173436 - DNA, 22 bp, Homo sapiens
tcctgagggctcggggctcatg

SEQ ID NO: 9173437 - DNA, 22 bp, Homo sapiens
tcctgaggctcactttgaatgt

SEQ ID NO: 9173438 - DNA, 22 bp, Homo sapiens
cattttcctctgctggtgttca

SEQ ID NO: 9173439 - DNA, 19 bp, Homo sapiens
cattttcccatcatccttt

SEQ ID NO: 9173440 - DNA, 19 bp, Homo sapiens
cattttcccatcatccttt

SEQ ID NO: 9173441 - DNA, 22 bp, Homo sapiens
cattttccacaggcctatttcc

SEQ ID NO: 9173442 - DNA, 22 bp, Homo sapiens
cattttcatgagtttctgttca

SEQ ID NO: 9173443 - DNA, 22 bp, Homo sapiens
tcctgcccagagctctccactc

SEQ ID NO: 9173444 - DNA, 19 bp, Homo sapiens
tcctgcccaccagccaggg

SEQ ID NO: 9173445 - DNA, 19 bp, Homo sapiens
tcctgcccaccagccaggg

SEQ ID NO: 9173446 - DNA, 22 bp, Homo sapiens
ccaagaggcagaatgcagagaa

SEQ ID NO: 9173447 - DNA, 22 bp, Homo sapiens
ccaagaggcagaatgcagagaa

SEQ ID NO: 9173448 - DNA, 22 bp, Homo sapiens
ccaagaggggcagagggctgca

SEQ ID NO: 9173449 - DNA, 21 bp, Homo sapiens
tcctgccttagtccagagcag

SEQ ID NO: 9173450 - DNA, 22 bp, Homo sapiens
tcctggagccacggagctttca

SEQ ID NO: 9173451 - DNA, 22 bp, Homo sapiens
tcctggagccacggagctttca

SEQ ID NO: 9173452 - DNA, 22 bp, Homo sapiens
tcctggagccaggacccttccc

SEQ ID NO: 9173453 - DNA, 22 bp, Homo sapiens
tcctggagccatgattcccctc

SEQ ID NO: 9173454 - DNA, 22 bp, Homo sapiens
tcctggagccatgattcccctc

SEQ ID NO: 9173455 - DNA, 22 bp, Homo sapiens
tcctggagccaggacccttccc

SEQ ID NO: 9173456 - DNA, 22 bp, Homo sapiens
tcctggagccaggacccttccc

SEQ ID NO: 9173457 - DNA, 22 bp, Homo sapiens
tcctgctctgatgggttctcct

SEQ ID NO: 9173458 - DNA, 23 bp, Homo sapiens
tcctgctgaaagctccagctggc

SEQ ID NO: 9173459 - DNA, 23 bp, Homo sapiens
tcctgctgaaagctccagctggc

SEQ ID NO: 9173460 - DNA, 22 bp, Homo sapiens
tcctggagccaatgtgctgctg

SEQ ID NO: 9173461 - DNA, 22 bp, Homo sapiens
ccaaattaaatcatacagacag

SEQ ID NO: 9173462 - DNA, 22 bp, Homo sapiens
tcctgaggtggattgagcagag

SEQ ID NO: 9173463 - DNA, 23 bp, Homo sapiens
tcctgagggtttcccagccttgg

SEQ ID NO: 9173464 - DNA, 22 bp, Homo sapiens
tcctgaggtctgaaaaaggagc

SEQ ID NO: 9173465 - DNA, 22 bp, Homo sapiens
tcctgaggtgctcagccaggaa

SEQ ID NO: 9173466 - DNA, 22 bp, Homo sapiens
ccaagagctacagatatgaaat

SEQ ID NO: 9173467 - DNA, 22 bp, Homo sapiens
ccaacaggttgagagtctgaat

SEQ ID NO: 9173468 - DNA, 22 bp, Homo sapiens
tcctggaggaataagttttcca

SEQ ID NO: 9173469 - DNA, 22 bp, Homo sapiens
ccacagctgacaatggatagac

SEQ ID NO: 9173470 - DNA, 22 bp, Homo sapiens
tcctggagcttccttcatggta

SEQ ID NO: 9173471 - DNA, 22 bp, Homo sapiens
tcctggagcttccttcatggta

SEQ ID NO: 9173472 - DNA, 22 bp, Homo sapiens
tcctggaggaataagttttcca

SEQ ID NO: 9173473 - DNA, 20 bp, Homo sapiens
tcctggagctgcttgaattc

SEQ ID NO: 9173474 - DNA, 22 bp, Homo sapiens
tcctggagctggtgtctttccc

SEQ ID NO: 9173475 - DNA, 22 bp, Homo sapiens
tcctggagctggtgtctttccc

SEQ ID NO: 9173476 - DNA, 22 bp, Homo sapiens
tcctggagctggtgtctttccc

SEQ ID NO: 9173477 - DNA, 22 bp, Homo sapiens
tcctggagcttcagtttccttt

SEQ ID NO: 9173478 - DNA, 22 bp, Homo sapiens
tcctggagcttcagtttccttt

SEQ ID NO: 9173479 - DNA, 22 bp, Homo sapiens
tcctggagcttcagtttccttt

SEQ ID NO: 9173480 - DNA, 22 bp, Homo sapiens
tcctggagcttcagtttccttt

SEQ ID NO: 9173481 - DNA, 20 bp, Homo sapiens
tcctggagctgcttgaattc

SEQ ID NO: 9173482 - DNA, 22 bp, Homo sapiens
tcctggagctgactccgtttga

SEQ ID NO: 9173483 - DNA, 22 bp, Homo sapiens
tcctggagctgactccgtttga

SEQ ID NO: 9173484 - DNA, 22 bp, Homo sapiens
tcctggagcctcattcaaacac

SEQ ID NO: 9173485 - DNA, 22 bp, Homo sapiens
tcctggagccatgattcccctc

SEQ ID NO: 9173486 - DNA, 22 bp, Homo sapiens
tcctggagctgactccgtttga

SEQ ID NO: 9173487 - DNA, 22 bp, Homo sapiens
tcctggagcctcattcaaacac

SEQ ID NO: 9173488 - DNA, 22 bp, Homo sapiens
ccacagggaacatgacagcctt

SEQ ID NO: 9173489 - DNA, 22 bp, Homo sapiens
ccacaggctgctgcaggtcccg

SEQ ID NO: 9173490 - DNA, 22 bp, Homo sapiens
ccacaggctgctgcaggtcccg

SEQ ID NO: 9173491 - DNA, 22 bp, Homo sapiens
ccacagggcacaagggaggttg

SEQ ID NO: 9173492 - DNA, 22 bp, Homo sapiens
ccacagggcacagacaggaagc

SEQ ID NO: 9173493 - DNA, 22 bp, Homo sapiens
ccacagggcctttcctgctggc

SEQ ID NO: 9173494 - DNA, 22 bp, Homo sapiens
ccacagggcacagacaggaagc

SEQ ID NO: 9173495 - DNA, 22 bp, Homo sapiens
tcctggctccactgagcaggcc

SEQ ID NO: 9173496 - DNA, 22 bp, Homo sapiens
ccaccaggacagccctgagggg

SEQ ID NO: 9173497 - DNA, 22 bp, Homo sapiens
ccaccaggacagccctgagggg

SEQ ID NO: 9173498 - DNA, 22 bp, Homo sapiens
ccaccaggcactcacagggaag

SEQ ID NO: 9173499 - DNA, 22 bp, Homo sapiens
tcctggctagttttgctgaaat

SEQ ID NO: 9173500 - DNA, 22 bp, Homo sapiens
tcctggctagttttgctgaaat

SEQ ID NO: 9173501 - DNA, 22 bp, Homo sapiens
tcctggctagttttgctgaaat

SEQ ID NO: 9173502 - DNA, 22 bp, Homo sapiens
tcctggctcaggcccctggtgc

SEQ ID NO: 9173503 - DNA, 22 bp, Homo sapiens
tcctggccttgctcctgatgcc

SEQ ID NO: 9173504 - DNA, 16 bp, Homo sapiens
tcctggcctttggaag

SEQ ID NO: 9173505 - DNA, 22 bp, Homo sapiens
tcctggctaatgctgctgatgg

SEQ ID NO: 9173506 - DNA, 21 bp, Homo sapiens
ccacaggggctcccctgtcag

SEQ ID NO: 9173507 - DNA, 22 bp, Homo sapiens
ccacagggctctaggcgcttcc

SEQ ID NO: 9173508 - DNA, 22 bp, Homo sapiens
tcctggccttatccccaaactg

SEQ ID NO: 9173509 - DNA, 22 bp, Homo sapiens
tcctggccttatccccaaactg

SEQ ID NO: 9173510 - DNA, 22 bp, Homo sapiens
tcctggcctgtctggagtagct

SEQ ID NO: 9173511 - DNA, 22 bp, Homo sapiens
ttccctctgcgcattgaatttc

SEQ ID NO: 9173512 - DNA, 22 bp, Homo sapiens
ttccctctttcactgtgatttt

SEQ ID NO: 9173513 - DNA, 22 bp, Homo sapiens
ttccctcttttccaacagttgt

SEQ ID NO: 9173514 - DNA, 20 bp, Homo sapiens
ttcgctgggagtggccaggc

SEQ ID NO: 9173515 - DNA, 20 bp, Homo sapiens
ttcgctgggagtggccaggc

SEQ ID NO: 9173516 - DNA, 22 bp, Homo sapiens
ttcgactctgtgcctgaagagc

SEQ ID NO: 9173517 - DNA, 21 bp, Homo sapiens
ttcctttttatggcttagtgg

SEQ ID NO: 9173518 - DNA, 21 bp, Homo sapiens
ttcctttttatggcttagtgg

SEQ ID NO: 9173519 - DNA, 22 bp, Homo sapiens
ttcgactctgtgcctgaagagc

SEQ ID NO: 9173520 - DNA, 22 bp, Homo sapiens
ttccctctccaggagccctgag

SEQ ID NO: 9173521 - DNA, 22 bp, Homo sapiens
ttccctctccaggagccctgag

SEQ ID NO: 9173522 - DNA, 22 bp, Homo sapiens
ttccctctgcgcattgaatttc

SEQ ID NO: 9173523 - DNA, 22 bp, Homo sapiens
ttccctctcacttaaagcttgg

SEQ ID NO: 9173524 - DNA, 22 bp, Homo sapiens
ttccctcctatgcccactgaaa

SEQ ID NO: 9173525 - DNA, 22 bp, Homo sapiens
ttccctctccaggagccctgag

SEQ ID NO: 9173526 - DNA, 22 bp, Homo sapiens
ttccctctcacttaaagcttgg

SEQ ID NO: 9173527 - DNA, 22 bp, Homo sapiens
ttccctcccccagcctggcagg

SEQ ID NO: 9173528 - DNA, 22 bp, Homo sapiens
ttcccctgtcacagtggttctc

SEQ ID NO: 9173529 - DNA, 22 bp, Homo sapiens
ttcggtcttgtgtaaacactgt

SEQ ID NO: 9173530 - DNA, 22 bp, Homo sapiens
ttcggtctggctgttatacgct

SEQ ID NO: 9173531 - DNA, 22 bp, Homo sapiens
ttcgggaatttgttggtgattt

SEQ ID NO: 9173532 - DNA, 22 bp, Homo sapiens
ttctaaaaccaattctgcttct

SEQ ID NO: 9173533 - DNA, 22 bp, Homo sapiens
ttctaaaataagtttatctggt

SEQ ID NO: 9173534 - DNA, 22 bp, Homo sapiens
ttctaaaataagtttatctggt

SEQ ID NO: 9173535 - DNA, 22 bp, Homo sapiens
ttctaaaataagtttatctggt

SEQ ID NO: 9173536 - DNA, 22 bp, Homo sapiens
ttctaaattttggaagatgcag

SEQ ID NO: 9173537 - DNA, 22 bp, Homo sapiens
ttctaaattttggaagatgcag

SEQ ID NO: 9173538 - DNA, 22 bp, Homo sapiens
ttctatattggaagtgagaaat

SEQ ID NO: 9173539 - DNA, 22 bp, Homo sapiens
ttctcaaagaaagctgtcatta

SEQ ID NO: 9173540 - DNA, 22 bp, Homo sapiens
ttctcagaaaatgtagagaaaa

SEQ ID NO: 9173541 - DNA, 22 bp, Homo sapiens
ttctcagaaaagcaagctttct

SEQ ID NO: 9173542 - DNA, 22 bp, Homo sapiens
ttctcacaattcttgtatttgc

SEQ ID NO: 9173543 - DNA, 22 bp, Homo sapiens
ttctcacaaatccatccaggag

SEQ ID NO: 9173544 - DNA, 22 bp, Homo sapiens
ttctcacaggaagtaggacttt

SEQ ID NO: 9173545 - DNA, 22 bp, Homo sapiens
ttctcacactttccactgaggt

SEQ ID NO: 9173546 - DNA, 22 bp, Homo sapiens
ttctccagctcatcagggaggg

SEQ ID NO: 9173547 - DNA, 22 bp, Homo sapiens
ttctccagctcatcagggaggg

SEQ ID NO: 9173548 - DNA, 19 bp, Homo sapiens
ttctccagcctgacctgag

SEQ ID NO: 9173549 - DNA, 19 bp, Homo sapiens
ttctccagcctgacctgag

SEQ ID NO: 9173550 - DNA, 19 bp, Homo sapiens
ttctccagcctgacctgag

SEQ ID NO: 9173551 - DNA, 22 bp, Homo sapiens
ttctccagagtttctctcactg

SEQ ID NO: 9173552 - DNA, 22 bp, Homo sapiens
ttctccagagtttctctcactg

SEQ ID NO: 9173553 - DNA, 22 bp, Homo sapiens
ttctccagcacattttctttga

SEQ ID NO: 9173554 - DNA, 22 bp, Homo sapiens
ttctccagcacattttctttga

SEQ ID NO: 9173555 - DNA, 22 bp, Homo sapiens
ttctccagcctattggcctatc

SEQ ID NO: 9173556 - DNA, 22 bp, Homo sapiens
ttctccagcctattggcctatc

SEQ ID NO: 9173557 - DNA, 19 bp, Homo sapiens
ttctccaggctgcagaggg

SEQ ID NO: 9173558 - DNA, 19 bp, Homo sapiens
ttctccaggctgcagaggg

SEQ ID NO: 9173559 - DNA, 19 bp, Homo sapiens
ttctccaggctgcagaggg

SEQ ID NO: 9173560 - DNA, 22 bp, Homo sapiens
ttctccagctcatcagggaggg

SEQ ID NO: 9173561 - DNA, 21 bp, Homo sapiens
ttctccaggcaaccatttcag

SEQ ID NO: 9173562 - DNA, 21 bp, Homo sapiens
ttctccaggcaaccatttcag

SEQ ID NO: 9173563 - DNA, 22 bp, Homo sapiens
ttctccaggccgcgcagggggc

SEQ ID NO: 9173564 - DNA, 22 bp, Homo sapiens
ttctccaggccgcgcagggggc

SEQ ID NO: 9173565 - DNA, 22 bp, Homo sapiens
ttctccaggccgcgcagggggc

SEQ ID NO: 9173566 - DNA, 22 bp, Homo sapiens
ttctccaggcttgggccaggtc

SEQ ID NO: 9173567 - DNA, 22 bp, Homo sapiens
ttctccaggcttgggccaggtc

SEQ ID NO: 9173568 - DNA, 22 bp, Homo sapiens
ttctccaggcttgggccaggtc

SEQ ID NO: 9173569 - DNA, 19 bp, Homo sapiens
ttctccagggacttaggga

SEQ ID NO: 9173570 - DNA, 22 bp, Homo sapiens
ttctccaggggagggttctcca

SEQ ID NO: 9173571 - DNA, 22 bp, Homo sapiens
ttctccaggggagggttctcca

SEQ ID NO: 9173572 - DNA, 22 bp, Homo sapiens
ttctccaggggagggttctcca

SEQ ID NO: 9173573 - DNA, 19 bp, Homo sapiens
ttctccagggacttaggga

SEQ ID NO: 9173574 - DNA, 21 bp, Homo sapiens
ttctcagagtctattacagtt

SEQ ID NO: 9173575 - DNA, 22 bp, Homo sapiens
ttctcagagtgaccaagtcttt

SEQ ID NO: 9173576 - DNA, 22 bp, Homo sapiens
ttctcagatatttactgagcat

SEQ ID NO: 9173577 - DNA, 22 bp, Homo sapiens
ttctccagaggtggctagagtt

SEQ ID NO: 9173578 - DNA, 22 bp, Homo sapiens
ttctccagaggtggctagagtt

SEQ ID NO: 9173579 - DNA, 22 bp, Homo sapiens
ttctccagaggtggctagagtt

SEQ ID NO: 9173580 - DNA, 22 bp, Homo sapiens
ttctcagagcactgctgacaaa

SEQ ID NO: 9173581 - DNA, 22 bp, Homo sapiens
ttctcagaattgactgggagca

SEQ ID NO: 9173582 - DNA, 22 bp, Homo sapiens
ttctcagagcactgctgacaaa

SEQ ID NO: 9173583 - DNA, 22 bp, Homo sapiens
ttctcagagctcactgtagtaa

SEQ ID NO: 9173584 - DNA, 22 bp, Homo sapiens
ttctcagaggagtcgggagctg

SEQ ID NO: 9173585 - DNA, 22 bp, Homo sapiens
ttctcttagtattgctagttta

SEQ ID NO: 9173586 - DNA, 22 bp, Homo sapiens
ttctcttatctggcattattgg

SEQ ID NO: 9173587 - DNA, 22 bp, Homo sapiens
ttctcttcacagggatcatcct

SEQ ID NO: 9173588 - DNA, 22 bp, Homo sapiens
ttctcttagcactttgtgttac

SEQ ID NO: 9173589 - DNA, 22 bp, Homo sapiens
ttctcttagctgtaaagtcaat

SEQ ID NO: 9173590 - DNA, 22 bp, Homo sapiens
ttctctggtttgctgtttctga

SEQ ID NO: 9173591 - DNA, 16 bp, Homo sapiens
ttctctgttccttgtg

SEQ ID NO: 9173592 - DNA, 22 bp, Homo sapiens
ttctcttcccactttctgtatt

SEQ ID NO: 9173593 - DNA, 22 bp, Homo sapiens
ttctcttcccactttctgtatt

SEQ ID NO: 9173594 - DNA, 22 bp, Homo sapiens
ttctcttctgttcagtgcccaa

SEQ ID NO: 9173595 - DNA, 22 bp, Homo sapiens
ttctcttgtgccaagttgttgc

SEQ ID NO: 9173596 - DNA, 23 bp, Homo sapiens
ttctctttagatttacattactc

SEQ ID NO: 9173597 - DNA, 22 bp, Homo sapiens
ttctccagttatattatgttaa

SEQ ID NO: 9173598 - DNA, 22 bp, Homo sapiens
ttctccagtttctcccttcagt

SEQ ID NO: 9173599 - DNA, 22 bp, Homo sapiens
ttctccagtttctcccttcagt

SEQ ID NO: 9173600 - DNA, 22 bp, Homo sapiens
ttctccagttatattatgttaa

SEQ ID NO: 9173601 - DNA, 22 bp, Homo sapiens
ttctccatttaacttccttatg

SEQ ID NO: 9173602 - DNA, 20 bp, Homo sapiens
ttctccagtgcggtagccat

SEQ ID NO: 9173603 - DNA, 20 bp, Homo sapiens
ttctccagtgcggtagccat

SEQ ID NO: 9173604 - DNA, 21 bp, Homo sapiens
ttctccagggggagctctctc

SEQ ID NO: 9173605 - DNA, 21 bp, Homo sapiens
ttctccagggggagctctctc

SEQ ID NO: 9173606 - DNA, 22 bp, Homo sapiens
ttctccagtcactgacttcgag

SEQ ID NO: 9173607 - DNA, 22 bp, Homo sapiens
ttctccagtcactgacttcgag

SEQ ID NO: 9173608 - DNA, 22 bp, Homo sapiens
ttctcccactccgtgcttcagt

SEQ ID NO: 9173609 - DNA, 22 bp, Homo sapiens
ttctccctggtatttacttagt

SEQ ID NO: 9173610 - DNA, 22 bp, Homo sapiens
ttctcctcagcaaggcagcttt

SEQ ID NO: 9173611 - DNA, 22 bp, Homo sapiens
ttctcctcactgcagcctttca

SEQ ID NO: 9173612 - DNA, 22 bp, Homo sapiens
ttctcctcagcaaggcagcttt

SEQ ID NO: 9173613 - DNA, 22 bp, Homo sapiens
ttctcctctacatagactgtgc

SEQ ID NO: 9173614 - DNA, 22 bp, Homo sapiens
ttctcctctgcaatgactggca

SEQ ID NO: 9173615 - DNA, 21 bp, Homo sapiens
ttctcctccaagttgctcctg

SEQ ID NO: 9173616 - DNA, 22 bp, Homo sapiens
ttctcctcagcaaggcagcttt

SEQ ID NO: 9173617 - DNA, 21 bp, Homo sapiens
ttctcctccaagttgctcctg

SEQ ID NO: 9173618 - DNA, 18 bp, Homo sapiens
ttctctggtggatgttat

SEQ ID NO: 9173619 - DNA, 22 bp, Homo sapiens
ttctcctctgttaccttgcaaa

SEQ ID NO: 9173620 - DNA, 17 bp, Homo sapiens
ttctcctctgtgtcctt

SEQ ID NO: 9173621 - DNA, 20 bp, Homo sapiens
ttctggaggctacaagtctg

SEQ ID NO: 9173622 - DNA, 22 bp, Homo sapiens
ttctggaggccccttccttctc

SEQ ID NO: 9173623 - DNA, 22 bp, Homo sapiens
ttctggaggcgggcgacctcgc

SEQ ID NO: 9173624 - DNA, 22 bp, Homo sapiens
ttctggaggcgggcgacctcgc

SEQ ID NO: 9173625 - DNA, 22 bp, Homo sapiens
ttctggaggctccagggaagaa

SEQ ID NO: 9173626 - DNA, 20 bp, Homo sapiens
ttctggaggctacaagtctg

SEQ ID NO: 9173627 - DNA, 22 bp, Homo sapiens
ttctggaggacaactgttttca

SEQ ID NO: 9173628 - DNA, 22 bp, Homo sapiens
ttctggaggagaaagggtgggc

SEQ ID NO: 9173629 - DNA, 22 bp, Homo sapiens
ttctggaggagaaagggtgggc

SEQ ID NO: 9173630 - DNA, 22 bp, Homo sapiens
ttctggaggccagctgccacct

SEQ ID NO: 9173631 - DNA, 22 bp, Homo sapiens
ttctggaggccagctgccacct

SEQ ID NO: 9173632 - DNA, 22 bp, Homo sapiens
ttctggaggccccttccttctc

SEQ ID NO: 9173633 - DNA, 22 bp, Homo sapiens
ttctggagctctcgaccccact

SEQ ID NO: 9173634 - DNA, 22 bp, Homo sapiens
ttctggaggacaactgttttca

SEQ ID NO: 9173635 - DNA, 22 bp, Homo sapiens
ttctggagcttggcttgtatgt

SEQ ID NO: 9173636 - DNA, 22 bp, Homo sapiens
ttctggaggacaactgttttca

SEQ ID NO: 9173637 - DNA, 22 bp, Homo sapiens
ttctggagcttggcttgtatgt

SEQ ID NO: 9173638 - DNA, 22 bp, Homo sapiens
ttctgccagtgatcaataattg

SEQ ID NO: 9173639 - DNA, 22 bp, Homo sapiens
ttctgccatctgcagaagggga

SEQ ID NO: 9173640 - DNA, 22 bp, Homo sapiens
ttctgccattgccatgagggct

SEQ ID NO: 9173641 - DNA, 22 bp, Homo sapiens
ttctgcagcatgaggctggagc

SEQ ID NO: 9173642 - DNA, 22 bp, Homo sapiens
ttctgcagcatgaggctggagc

SEQ ID NO: 9173643 - DNA, 22 bp, Homo sapiens
ttctgcagcatgaggctggagc

SEQ ID NO: 9173644 - DNA, 22 bp, Homo sapiens
ttctgcattcaaattatgtgag

SEQ ID NO: 9173645 - DNA, 22 bp, Homo sapiens
ttctgccaaagaagtaaatgga

SEQ ID NO: 9173646 - DNA, 23 bp, Homo sapiens
ttctgccactgaaaatgcctcag

SEQ ID NO: 9173647 - DNA, 23 bp, Homo sapiens
ttctgccactgaaaatgcctcag

SEQ ID NO: 9173648 - DNA, 22 bp, Homo sapiens
ttctgccagctcagagctctag

SEQ ID NO: 9173649 - DNA, 22 bp, Homo sapiens
ttctgccagtgaaaataatgat

SEQ ID NO: 9173650 - DNA, 22 bp, Homo sapiens
ttctgccagctcagagctctag

SEQ ID NO: 9173651 - DNA, 22 bp, Homo sapiens
ttctgcattggagtctattctt

SEQ ID NO: 9173652 - DNA, 22 bp, Homo sapiens
ttctgcattggagtctattctt

SEQ ID NO: 9173653 - DNA, 22 bp, Homo sapiens
ttctgcattcatttttcctaca

SEQ ID NO: 9173654 - DNA, 22 bp, Homo sapiens
ttctgcattgacttttatttcc

SEQ ID NO: 9173655 - DNA, 22 bp, Homo sapiens
ttctgagctgcaacactaacat

SEQ ID NO: 9173656 - DNA, 20 bp, Homo sapiens
ttctctttgggtccagagaa

SEQ ID NO: 9173657 - DNA, 20 bp, Homo sapiens
ttctctttgggtccagagaa

SEQ ID NO: 9173658 - DNA, 22 bp, Homo sapiens
ttctctttatgtatttagtggg

SEQ ID NO: 9173659 - DNA, 22 bp, Homo sapiens
ttctctttatgtatttagtggg

SEQ ID NO: 9173660 - DNA, 22 bp, Homo sapiens
ttctctttatgtatttagtggg

SEQ ID NO: 9173661 - DNA, 22 bp, Homo sapiens
ttctctttctacagtgtgattg

SEQ ID NO: 9173662 - DNA, 22 bp, Homo sapiens
ttctctttctgctgggctggaa

SEQ ID NO: 9173663 - DNA, 22 bp, Homo sapiens
ttctctttctgctgggctggaa

SEQ ID NO: 9173664 - DNA, 22 bp, Homo sapiens
ttctctttgacattattcaggt

SEQ ID NO: 9173665 - DNA, 22 bp, Homo sapiens
ttctctttgacattattcaggt

SEQ ID NO: 9173666 - DNA, 22 bp, Homo sapiens
ttctgattgctgatgaggccca

SEQ ID NO: 9173667 - DNA, 22 bp, Homo sapiens
ttctgattgctgatgaggccca

SEQ ID NO: 9173668 - DNA, 22 bp, Homo sapiens
ttctgatactggaatcgatgcc

SEQ ID NO: 9173669 - DNA, 22 bp, Homo sapiens
ttctgatgatggcggctggagc

SEQ ID NO: 9173670 - DNA, 22 bp, Homo sapiens
ttgagactcgagtctctcagac

SEQ ID NO: 9173671 - DNA, 22 bp, Homo sapiens
ttgagagaaaaaatttattggt

SEQ ID NO: 9173672 - DNA, 22 bp, Homo sapiens
ttgagaaatgttttttaagctg

SEQ ID NO: 9173673 - DNA, 22 bp, Homo sapiens
ttgagaaataagcatgtctaga

SEQ ID NO: 9173674 - DNA, 22 bp, Homo sapiens
ttgagaaataagcatgtctaga

SEQ ID NO: 9173675 - DNA, 22 bp, Homo sapiens
ttgagataggtggaatctcttt

SEQ ID NO: 9173676 - DNA, 22 bp, Homo sapiens
ttgagatagatctcatcttccc

SEQ ID NO: 9173677 - DNA, 22 bp, Homo sapiens
ttgaggcctgctggaaggtgtt

SEQ ID NO: 9173678 - DNA, 22 bp, Homo sapiens
ttgaggctgcacagtacaggct

SEQ ID NO: 9173679 - DNA, 22 bp, Homo sapiens
ttgagagttaccagcagaggaa

SEQ ID NO: 9173680 - DNA, 22 bp, Homo sapiens
ttgagaggctgttgacattctg

SEQ ID NO: 9173681 - DNA, 22 bp, Homo sapiens
ttgagggattgcaccagaagag

SEQ ID NO: 9173682 - DNA, 23 bp, Homo sapiens
ttgaaaaatatagtcccattgtc

SEQ ID NO: 9173683 - DNA, 22 bp, Homo sapiens
ttgaaaacatttatattagaat

SEQ ID NO: 9173684 - DNA, 22 bp, Homo sapiens
ttgaaaaccgtgggaggctgaa

SEQ ID NO: 9173685 - DNA, 22 bp, Homo sapiens
ttgaaaagcaaatgatgggtag

SEQ ID NO: 9173686 - DNA, 22 bp, Homo sapiens
ttgaaaaaattggtagaggatg

SEQ ID NO: 9173687 - DNA, 22 bp, Homo sapiens
ttctttttatcttcccataaga

SEQ ID NO: 9173688 - DNA, 22 bp, Homo sapiens
ttctttttggatagctgatgaa

SEQ ID NO: 9173689 - DNA, 22 bp, Homo sapiens
ttctttttatcttcccataaga

SEQ ID NO: 9173690 - DNA, 22 bp, Homo sapiens
ttgaaaatggtaagcatgatat

SEQ ID NO: 9173691 - DNA, 22 bp, Homo sapiens
ttgaaacagacaagtaaatgtc

SEQ ID NO: 9173692 - DNA, 22 bp, Homo sapiens
ttgaaaagttttgaaacactct

SEQ ID NO: 9173693 - DNA, 22 bp, Homo sapiens
ttgaaaatatcacaggagcagc

SEQ ID NO: 9173694 - DNA, 19 bp, Homo sapiens
ttgaaaatatggatctgag

SEQ ID NO: 9173695 - DNA, 22 bp, Homo sapiens
ttgaaagatagtgaagccagcc

SEQ ID NO: 9173696 - DNA, 22 bp, Homo sapiens
ttgaaaggaatacagaggccta

SEQ ID NO: 9173697 - DNA, 23 bp, Homo sapiens
ttgaaagattgctaagtaaaaat

SEQ ID NO: 9173698 - DNA, 22 bp, Homo sapiens
ttgaccagtgcctgggaccccg

SEQ ID NO: 9173699 - DNA, 22 bp, Homo sapiens
ttgaccagtgcctgggaccccg

SEQ ID NO: 9173700 - DNA, 22 bp, Homo sapiens
ttgaccagttccccaaattgct

SEQ ID NO: 9173701 - DNA, 22 bp, Homo sapiens
ttgacccaaggccctggaattg

SEQ ID NO: 9173702 - DNA, 22 bp, Homo sapiens
ttgacatgtagtatagttgcat

SEQ ID NO: 9173703 - DNA, 22 bp, Homo sapiens
ttgaccactgaatggttctgaa

SEQ ID NO: 9173704 - DNA, 21 bp, Homo sapiens
ttgaccaagggtgcgtgctcc

SEQ ID NO: 9173705 - DNA, 22 bp, Homo sapiens
ttgaaactttagtaaactaagg

SEQ ID NO: 9173706 - DNA, 22 bp, Homo sapiens
ttgaaactcccttttgtctagt

SEQ ID NO: 9173707 - DNA, 22 bp, Homo sapiens
ttgaaagacttctcctgtgaaa

SEQ ID NO: 9173708 - DNA, 22 bp, Homo sapiens
ttgaaagacttctcctgtgaaa

SEQ ID NO: 9173709 - DNA, 22 bp, Homo sapiens
ttgaaagacattatttatatat

SEQ ID NO: 9173710 - DNA, 22 bp, Homo sapiens
ttgaaagacattatttatatat

SEQ ID NO: 9173711 - DNA, 22 bp, Homo sapiens
ttgaaagaaggtggtagagaat

SEQ ID NO: 9173712 - DNA, 22 bp, Homo sapiens
ttgaaagaaggtggtagagaat

SEQ ID NO: 9173713 - DNA, 22 bp, Homo sapiens
ttgaaagaagaagctgcgatgt

SEQ ID NO: 9173714 - DNA, 22 bp, Homo sapiens
ttgaaagaactcttcagagata

SEQ ID NO: 9173715 - DNA, 22 bp, Homo sapiens
ttgaaagaacaattctgtgatg

SEQ ID NO: 9173716 - DNA, 22 bp, Homo sapiens
ttgaaagaacaattctgtgatg

SEQ ID NO: 9173717 - DNA, 22 bp, Homo sapiens
ttgaaagaacaattctgtgatg

SEQ ID NO: 9173718 - DNA, 22 bp, Homo sapiens
ttcttctctcatagattaaggt

SEQ ID NO: 9173719 - DNA, 20 bp, Homo sapiens
ttcttctctagttatcttca

SEQ ID NO: 9173720 - DNA, 22 bp, Homo sapiens
ttcttctgaaacagtgacagac

SEQ ID NO: 9173721 - DNA, 22 bp, Homo sapiens
ttcttctgacactgatgctgta

SEQ ID NO: 9173722 - DNA, 22 bp, Homo sapiens
ttcttctgcctcccacctgata

SEQ ID NO: 9173723 - DNA, 22 bp, Homo sapiens
ttcttctgcctcccacctgata

SEQ ID NO: 9173724 - DNA, 22 bp, Homo sapiens
ttcttctgtgaggtgtgtgcct

SEQ ID NO: 9173725 - DNA, 22 bp, Homo sapiens
ttcttctgttggcagagcatac

SEQ ID NO: 9173726 - DNA, 22 bp, Homo sapiens
ttcttctgattgccttctgcaa

SEQ ID NO: 9173727 - DNA, 22 bp, Homo sapiens
ttcttctgattgccttctgcaa

SEQ ID NO: 9173728 - DNA, 22 bp, Homo sapiens
ttcttctgagagaaaaagctca

SEQ ID NO: 9173729 - DNA, 22 bp, Homo sapiens
ttctttctcactctttaggaag

SEQ ID NO: 9173730 - DNA, 22 bp, Homo sapiens
ttctttctcactctttaggaag

SEQ ID NO: 9173731 - DNA, 22 bp, Homo sapiens
ttctttctcagtgggcagatac

SEQ ID NO: 9173732 - DNA, 22 bp, Homo sapiens
ttctttctcagtgggcagatac

SEQ ID NO: 9173733 - DNA, 22 bp, Homo sapiens
ttctttctcagtgggcagatac

SEQ ID NO: 9173734 - DNA, 22 bp, Homo sapiens
ttctttctcagtgggcagatac

SEQ ID NO: 9173735 - DNA, 22 bp, Homo sapiens
ttctttctctactagcagagct

SEQ ID NO: 9173736 - DNA, 22 bp, Homo sapiens
ttctttcttagcaatctatggt

SEQ ID NO: 9173737 - DNA, 22 bp, Homo sapiens
ttctttcttagcaatctatggt

SEQ ID NO: 9173738 - DNA, 22 bp, Homo sapiens
ttcttcttgaaactttaggttg

SEQ ID NO: 9173739 - DNA, 22 bp, Homo sapiens
ttcttcttcatttctgacgatg

SEQ ID NO: 9173740 - DNA, 22 bp, Homo sapiens
ttcttcttcatttctgacgatg

SEQ ID NO: 9173741 - DNA, 22 bp, Homo sapiens
ttcttcttctggctgcacctgg

SEQ ID NO: 9173742 - DNA, 22 bp, Homo sapiens
ttcttcttctggctgcacctgg

SEQ ID NO: 9173743 - DNA, 22 bp, Homo sapiens
ttcttctgttggcagagcatac

SEQ ID NO: 9173744 - DNA, 22 bp, Homo sapiens
ttcttcttaatgtcctgggaac

SEQ ID NO: 9173745 - DNA, 22 bp, Homo sapiens
ttcttcttcaagtgctgcattc

SEQ ID NO: 9173746 - DNA, 22 bp, Homo sapiens
ttcttcttcaagtgctgcattc

SEQ ID NO: 9173747 - DNA, 22 bp, Homo sapiens
ttctttgggctcagagagggag

SEQ ID NO: 9173748 - DNA, 22 bp, Homo sapiens
ttctttggggtctccagcatag

SEQ ID NO: 9173749 - DNA, 22 bp, Homo sapiens
ttctttggcttacgtctggcct

SEQ ID NO: 9173750 - DNA, 22 bp, Homo sapiens
ttctttgggcaattgctggccc

SEQ ID NO: 9173751 - DNA, 22 bp, Homo sapiens
ttctttgggattgtagctgtct

SEQ ID NO: 9173752 - DNA, 22 bp, Homo sapiens
ttctttctttgtagtcctgaac

SEQ ID NO: 9173753 - DNA, 22 bp, Homo sapiens
ttctttctttgtagtcctgaac

SEQ ID NO: 9173754 - DNA, 22 bp, Homo sapiens
ttctttggcatttcctgtatgt

SEQ ID NO: 9173755 - DNA, 22 bp, Homo sapiens
ttctttggcatttcctgtatgt

SEQ ID NO: 9173756 - DNA, 22 bp, Homo sapiens
ttcttctcctaaggagagtcct

SEQ ID NO: 9173757 - DNA, 22 bp, Homo sapiens
ttcttctcctaaggagagtcct

SEQ ID NO: 9173758 - DNA, 22 bp, Homo sapiens
ttcttctcggctgtcagatagt

SEQ ID NO: 9173759 - DNA, 22 bp, Homo sapiens
ttcttctcagggtcccacatgg

SEQ ID NO: 9173760 - DNA, 22 bp, Homo sapiens
ttcttctccgaggagggctggt

SEQ ID NO: 9173761 - DNA, 23 bp, Homo sapiens
ttcttctcaattagttgattcag

SEQ ID NO: 9173762 - DNA, 19 bp, Homo sapiens
ttcttctacctctaccact

SEQ ID NO: 9173763 - DNA, 22 bp, Homo sapiens
ttcttctacctctgagacttgt

SEQ ID NO: 9173764 - DNA, 23 bp, Homo sapiens
ttcttctaaggagggccaccatt

SEQ ID NO: 9173765 - DNA, 22 bp, Homo sapiens
ttctgggagagaaagggccttg

SEQ ID NO: 9173766 - DNA, 22 bp, Homo sapiens
ttctgggaggctggctgtcata

SEQ ID NO: 9173767 - DNA, 22 bp, Homo sapiens
ttcttcagagagtagaagcaag

SEQ ID NO: 9173768 - DNA, 22 bp, Homo sapiens
ttctggagtattcctggcagcc

SEQ ID NO: 9173769 - DNA, 22 bp, Homo sapiens
ttctggagtcattggggctgat

SEQ ID NO: 9173770 - DNA, 22 bp, Homo sapiens
ttctggagtcattggggctgat

SEQ ID NO: 9173771 - DNA, 22 bp, Homo sapiens
ttctggagtcccacagccaggg

SEQ ID NO: 9173772 - DNA, 22 bp, Homo sapiens
ttctggagtattcctggcagcc

SEQ ID NO: 9173773 - DNA, 22 bp, Homo sapiens
ttctggagtattcctggcagcc

SEQ ID NO: 9173774 - DNA, 22 bp, Homo sapiens
ttctggagtattcctggcacct

SEQ ID NO: 9173775 - DNA, 22 bp, Homo sapiens
ttctggagtgtattgggtctgc

SEQ ID NO: 9173776 - DNA, 22 bp, Homo sapiens
ttctggagtgataaaacaccac

SEQ ID NO: 9173777 - DNA, 22 bp, Homo sapiens
ttctggagtgtattgggtctgc

SEQ ID NO: 9173778 - DNA, 22 bp, Homo sapiens
ttctggagtgtggaccgctgtt

SEQ ID NO: 9173779 - DNA, 22 bp, Homo sapiens
ttctggagttcaggtccctaaa

SEQ ID NO: 9173780 - DNA, 22 bp, Homo sapiens
ttctggagtgtggaccgctgtt

SEQ ID NO: 9173781 - DNA, 22 bp, Homo sapiens
ttctggagtcttcaattttaga

SEQ ID NO: 9173782 - DNA, 22 bp, Homo sapiens
ttctggagtgataaaacaccac

SEQ ID NO: 9173783 - DNA, 22 bp, Homo sapiens
ttctggagtcccacagccaggg

SEQ ID NO: 9173784 - DNA, 22 bp, Homo sapiens
ttctggagtcttcaattttaga

SEQ ID NO: 9173785 - DNA, 19 bp, Homo sapiens
ttctggaggttaccctgag

SEQ ID NO: 9173786 - DNA, 22 bp, Homo sapiens
ttctggaggttattaggagtct

SEQ ID NO: 9173787 - DNA, 22 bp, Homo sapiens
ttctggagtattcctggcacct

SEQ ID NO: 9173788 - DNA, 22 bp, Homo sapiens
ttctggaggttattaggagtct

SEQ ID NO: 9173789 - DNA, 22 bp, Homo sapiens
ttctggagggcctgatcacaca

SEQ ID NO: 9173790 - DNA, 22 bp, Homo sapiens
ttctggaggtgtgaccattagc

SEQ ID NO: 9173791 - DNA, 19 bp, Homo sapiens
ttctggaggttaccctgag

SEQ ID NO: 9173792 - DNA, 22 bp, Homo sapiens
ttctggaggtgtgaccattagc

SEQ ID NO: 9173793 - DNA, 22 bp, Homo sapiens
ttctggagggcatgctgctgcc

SEQ ID NO: 9173794 - DNA, 22 bp, Homo sapiens
ttctggagggcctgatcacaca

SEQ ID NO: 9173795 - DNA, 22 bp, Homo sapiens
ttctggagggcatgctgctgcc

SEQ ID NO: 9173796 - DNA, 22 bp, Homo sapiens
ttctggaggctctaagggacaa

SEQ ID NO: 9173797 - DNA, 22 bp, Homo sapiens
ttctggaggctctaagggacaa

SEQ ID NO: 9173798 - DNA, 22 bp, Homo sapiens
ttctggaggctccagggaagaa

SEQ ID NO: 9173799 - DNA, 22 bp, Homo sapiens
ttctggagttcaggtccctaaa

SEQ ID NO: 9173800 - DNA, 22 bp, Homo sapiens
ttctggagttgtgacctcaggg

SEQ ID NO: 9173801 - DNA, 22 bp, Homo sapiens
ttctggagttgtgacctcaggg

SEQ ID NO: 9173802 - DNA, 22 bp, Homo sapiens
ttctggagtttgaagatcaggt

SEQ ID NO: 9173803 - DNA, 22 bp, Homo sapiens
ttctggagtttgaagatcaggt

SEQ ID NO: 9173804 - DNA, 22 bp, Homo sapiens
ttctggatataacattcagtcc

SEQ ID NO: 9173805 - DNA, 22 bp, Homo sapiens
ttctggatatgggagagggagc

SEQ ID NO: 9173806 - DNA, 22 bp, Homo sapiens
ttctggatgatccatttacaga

SEQ ID NO: 9173807 - DNA, 22 bp, Homo sapiens
ttctggatctgagggggaagat

SEQ ID NO: 9173808 - DNA, 22 bp, Homo sapiens
ttctggctttcttgtcaggatg

SEQ ID NO: 9173809 - DNA, 22 bp, Homo sapiens
ttctgggacatctggacagttt

SEQ ID NO: 9173810 - DNA, 21 bp, Homo sapiens
ttctgggaaatgagctggggc

SEQ ID NO: 9173811 - DNA, 22 bp, Homo sapiens
ttatttatatctctgcagttta

SEQ ID NO: 9173812 - DNA, 22 bp, Homo sapiens
ttatttatatctctgcagttta

SEQ ID NO: 9173813 - DNA, 22 bp, Homo sapiens
ttatttagtctagatgaatttt

SEQ ID NO: 9173814 - DNA, 22 bp, Homo sapiens
ttatttatggcactgttggtgg

SEQ ID NO: 9173815 - DNA, 22 bp, Homo sapiens
ttatttatggcactgttggtgg

SEQ ID NO: 9173816 - DNA, 22 bp, Homo sapiens
ttatttatggcactgttggtgg

SEQ ID NO: 9173817 - DNA, 22 bp, Homo sapiens
ttatttgtggcatccatgttgg

SEQ ID NO: 9173818 - DNA, 20 bp, Homo sapiens
ttatttgtttactttggtcc

SEQ ID NO: 9173819 - DNA, 18 bp, Homo sapiens
ttatttgttacagcacat

SEQ ID NO: 9173820 - DNA, 18 bp, Homo sapiens
ttatttgttacagcacat

SEQ ID NO: 9173821 - DNA, 22 bp, Homo sapiens
ttatttagtctagatgaatttt

SEQ ID NO: 9173822 - DNA, 22 bp, Homo sapiens
ttatttacaactcttctcttcc

SEQ ID NO: 9173823 - DNA, 22 bp, Homo sapiens
ttatttaaaagtggtaagattc

SEQ ID NO: 9173824 - DNA, 22 bp, Homo sapiens
ttattgtttgggtataatttga

SEQ ID NO: 9173825 - DNA, 22 bp, Homo sapiens
ttattgtttactagtttgcaga

SEQ ID NO: 9173826 - DNA, 22 bp, Homo sapiens
ttattgtttactagtttgcaga

SEQ ID NO: 9173827 - DNA, 22 bp, Homo sapiens
ttattgtttgggtataatttga

SEQ ID NO: 9173828 - DNA, 22 bp, Homo sapiens
ttattaaaatgcggatttggct

SEQ ID NO: 9173829 - DNA, 22 bp, Homo sapiens
ttatgtttgagtatatgactca

SEQ ID NO: 9173830 - DNA, 22 bp, Homo sapiens
ttatgttttatggctatatcat

SEQ ID NO: 9173831 - DNA, 22 bp, Homo sapiens
ttatgttttaagtgtgtatctt

SEQ ID NO: 9173832 - DNA, 22 bp, Homo sapiens
ttcaagatggctgcaaatactt

SEQ ID NO: 9173833 - DNA, 22 bp, Homo sapiens
ttcaagatcttccaaaggatac

SEQ ID NO: 9173834 - DNA, 22 bp, Homo sapiens
ttcaagatgtcttcacaatagt

SEQ ID NO: 9173835 - DNA, 22 bp, Homo sapiens
ttcaagcagttaagcagtctcc

SEQ ID NO: 9173836 - DNA, 22 bp, Homo sapiens
ttcaaaattgttctaagctctg

SEQ ID NO: 9173837 - DNA, 22 bp, Homo sapiens
ttcaaacaactcatttatgcaa

SEQ ID NO: 9173838 - DNA, 22 bp, Homo sapiens
ttcaaacaaaactctttcctat

SEQ ID NO: 9173839 - DNA, 17 bp, Homo sapiens
ttcaagatattgaaatg

SEQ ID NO: 9173840 - DNA, 22 bp, Homo sapiens
ttcaagataataggaatgaaaa

SEQ ID NO: 9173841 - DNA, 17 bp, Homo sapiens
ttcaagatattgaaatg

SEQ ID NO: 9173842 - DNA, 22 bp, Homo sapiens
ttcaagaggcttaattctggat

SEQ ID NO: 9173843 - DNA, 22 bp, Homo sapiens
ttattttcagctaggaaagcca

SEQ ID NO: 9173844 - DNA, 22 bp, Homo sapiens
ttattttcagctaggaaagcca

SEQ ID NO: 9173845 - DNA, 22 bp, Homo sapiens
ttattttctcctcagaaagtgg

SEQ ID NO: 9173846 - DNA, 22 bp, Homo sapiens
ttattttaccttcctctgagct

SEQ ID NO: 9173847 - DNA, 22 bp, Homo sapiens
ttattttaccttcctctgagct

SEQ ID NO: 9173848 - DNA, 22 bp, Homo sapiens
ttattttctcctcagaaagtgg

SEQ ID NO: 9173849 - DNA, 22 bp, Homo sapiens
ttattttgagagaatgtgtgct

SEQ ID NO: 9173850 - DNA, 22 bp, Homo sapiens
ttattttgccacaggtgacctt

SEQ ID NO: 9173851 - DNA, 22 bp, Homo sapiens
ttattttggtaaatgtttgcct

SEQ ID NO: 9173852 - DNA, 22 bp, Homo sapiens
ttcaaaagactcagatgtagcg

SEQ ID NO: 9173853 - DNA, 22 bp, Homo sapiens
ttcaaaagtaatcagtattaga

SEQ ID NO: 9173854 - DNA, 22 bp, Homo sapiens
ttcaaaagtaatcagtattaga

SEQ ID NO: 9173855 - DNA, 22 bp, Homo sapiens
ttattttggtaaatgtttgcct

SEQ ID NO: 9173856 - DNA, 22 bp, Homo sapiens
ttattttggtaaatgtttgcct

SEQ ID NO: 9173857 - DNA, 23 bp, Homo sapiens
ttcaaaactggaaaatcagatgc

SEQ ID NO: 9173858 - DNA, 23 bp, Homo sapiens
ttcaaaactggaaaatcagatgc

SEQ ID NO: 9173859 - DNA, 23 bp, Homo sapiens
ttcaaaactggaaaatcagatgc

SEQ ID NO: 9173860 - DNA, 22 bp, Homo sapiens
tcctctggatataagcctcacc

SEQ ID NO: 9173861 - DNA, 22 bp, Homo sapiens
tcctctgctgttctggttcttt

SEQ ID NO: 9173862 - DNA, 22 bp, Homo sapiens
tcctctgctccatctttactgt

SEQ ID NO: 9173863 - DNA, 21 bp, Homo sapiens
tcctctgctctcataccacaa

SEQ ID NO: 9173864 - DNA, 22 bp, Homo sapiens
tcctctggctctttccctagga

SEQ ID NO: 9173865 - DNA, 22 bp, Homo sapiens
tcctctggccttggaatccttt

SEQ ID NO: 9173866 - DNA, 22 bp, Homo sapiens
tcctctggcccagctgcctctg

SEQ ID NO: 9173867 - DNA, 22 bp, Homo sapiens
tcctctggcccagctgcctctg

SEQ ID NO: 9173868 - DNA, 22 bp, Homo sapiens
ttagttaaaattctgctgacat

SEQ ID NO: 9173869 - DNA, 22 bp, Homo sapiens
ttagtgtttaaaggtttcagag

SEQ ID NO: 9173870 - DNA, 22 bp, Homo sapiens
ttagtgttagggcctgttacct

SEQ ID NO: 9173871 - DNA, 22 bp, Homo sapiens
ttagtgctcatccagatggggg

SEQ ID NO: 9173872 - DNA, 17 bp, Homo sapiens
ttagtgtatctgttttg

SEQ ID NO: 9173873 - DNA, 18 bp, Homo sapiens
ttagtgtaataccattgc

SEQ ID NO: 9173874 - DNA, 22 bp, Homo sapiens
ttagtgtattttcaaatgtaga

SEQ ID NO: 9173875 - DNA, 22 bp, Homo sapiens
tcctctccagcaaactggctat

SEQ ID NO: 9173876 - DNA, 22 bp, Homo sapiens
tcctctactcgcttgccctttg

SEQ ID NO: 9173877 - DNA, 22 bp, Homo sapiens
tcctcctgtttctcaggcctgg

SEQ ID NO: 9173878 - DNA, 22 bp, Homo sapiens
ttatggaaaatacaattataag

SEQ ID NO: 9173879 - DNA, 22 bp, Homo sapiens
ttatgtctcaaccgggcacggt

SEQ ID NO: 9173880 - DNA, 22 bp, Homo sapiens
ttatgtgtgtacatgcatatgt

SEQ ID NO: 9173881 - DNA, 22 bp, Homo sapiens
ttatgtgtataattacaggaag

SEQ ID NO: 9173882 - DNA, 22 bp, Homo sapiens
ttatgtgtgtgtatacatacaa

SEQ ID NO: 9173883 - DNA, 22 bp, Homo sapiens
ttatgtgtgtgtatacatacaa

SEQ ID NO: 9173884 - DNA, 22 bp, Homo sapiens
ttatgtgtacctcaatctgagg

SEQ ID NO: 9173885 - DNA, 22 bp, Homo sapiens
ttatgtgtacctcaatctgagg

SEQ ID NO: 9173886 - DNA, 22 bp, Homo sapiens
ttatgtcttaagtatgctaatt

SEQ ID NO: 9173887 - DNA, 21 bp, Homo sapiens
ttatgtctctttggtgactgg

SEQ ID NO: 9173888 - DNA, 22 bp, Homo sapiens
ttatgtctgtgaattggcaagc

SEQ ID NO: 9173889 - DNA, 22 bp, Homo sapiens
ttagttgacccccagtcctggc

SEQ ID NO: 9173890 - DNA, 22 bp, Homo sapiens
ttagttgatagccaaaatttat

SEQ ID NO: 9173891 - DNA, 22 bp, Homo sapiens
ttagttgatgttctggaggtag

SEQ ID NO: 9173892 - DNA, 22 bp, Homo sapiens
ttagttgatgctaagggatccc

SEQ ID NO: 9173893 - DNA, 22 bp, Homo sapiens
ttagttgatcattcaacatggg

SEQ ID NO: 9173894 - DNA, 22 bp, Homo sapiens
ttagttatagtgaagaaatact

SEQ ID NO: 9173895 - DNA, 22 bp, Homo sapiens
ttagttatactactgaatggag

SEQ ID NO: 9173896 - DNA, 22 bp, Homo sapiens
ttataagagtatatagtgtact

SEQ ID NO: 9173897 - DNA, 22 bp, Homo sapiens
ttataactttggatatgacaag

SEQ ID NO: 9173898 - DNA, 23 bp, Homo sapiens
ttataagaagcatcacaggaaga

SEQ ID NO: 9173899 - DNA, 22 bp, Homo sapiens
ttagttgtaaaatggaatttgt

SEQ ID NO: 9173900 - DNA, 22 bp, Homo sapiens
ttatgcagaggcatgctcactc

SEQ ID NO: 9173901 - DNA, 23 bp, Homo sapiens
ttatgcaagcttcctggtctcag

SEQ ID NO: 9173902 - DNA, 22 bp, Homo sapiens
ttatacagcattgctagtgatg

SEQ ID NO: 9173903 - DNA, 22 bp, Homo sapiens
ttcataggtttgctgtgaacat

SEQ ID NO: 9173904 - DNA, 22 bp, Homo sapiens
ttcataggtggatgctgccagg

SEQ ID NO: 9173905 - DNA, 22 bp, Homo sapiens
ttcataggcagcactggctcct

SEQ ID NO: 9173906 - DNA, 22 bp, Homo sapiens
ttcatagggagagtggtggaaa

SEQ ID NO: 9173907 - DNA, 22 bp, Homo sapiens
ttcatagggctggggtgggagc

SEQ ID NO: 9173908 - DNA, 22 bp, Homo sapiens
ttcatagggtatttccatagta

SEQ ID NO: 9173909 - DNA, 22 bp, Homo sapiens
ttcataggtacagggaatttct

SEQ ID NO: 9173910 - DNA, 22 bp, Homo sapiens
ttcataggtcaaaaaacaagag

SEQ ID NO: 9173911 - DNA, 19 bp, Homo sapiens
ttcataggtgagcatacag

SEQ ID NO: 9173912 - DNA, 22 bp, Homo sapiens
ttcataggaaaaatgtgaggtg

SEQ ID NO: 9173913 - DNA, 22 bp, Homo sapiens
ttcataggaaaatgctggcccc

SEQ ID NO: 9173914 - DNA, 22 bp, Homo sapiens
ttcatagagcagctcactgaat

SEQ ID NO: 9173915 - DNA, 22 bp, Homo sapiens
ttcataggaaatagtgttcttt

SEQ ID NO: 9173916 - DNA, 22 bp, Homo sapiens
ttcataggaatttaaagaggaa

SEQ ID NO: 9173917 - DNA, 21 bp, Homo sapiens
ttcataggacgactgtctgtc

SEQ ID NO: 9173918 - DNA, 22 bp, Homo sapiens
ttcataggagagaagaaagtgt

SEQ ID NO: 9173919 - DNA, 22 bp, Homo sapiens
ttcataggatagagtgagattt

SEQ ID NO: 9173920 - DNA, 22 bp, Homo sapiens
ttcataggatcaaaagctgttt

SEQ ID NO: 9173921 - DNA, 23 bp, Homo sapiens
ttcataggcacattgcgcacaga

SEQ ID NO: 9173922 - DNA, 22 bp, Homo sapiens
ttcataggcaccctgtctgagg

SEQ ID NO: 9173923 - DNA, 22 bp, Homo sapiens
ttcatataaatggaatcagaat

SEQ ID NO: 9173924 - DNA, 22 bp, Homo sapiens
ttcatagtgtttccttccagtg

SEQ ID NO: 9173925 - DNA, 22 bp, Homo sapiens
ttcatagtgtttccttccagtg

SEQ ID NO: 9173926 - DNA, 22 bp, Homo sapiens
ttcatagtgtttccttccagtg

SEQ ID NO: 9173927 - DNA, 22 bp, Homo sapiens
ttcatatttgaaacagaagtta

SEQ ID NO: 9173928 - DNA, 22 bp, Homo sapiens
ttcatactgtgtttccaagttt

SEQ ID NO: 9173929 - DNA, 22 bp, Homo sapiens
ttcatacatttttactaacagc

SEQ ID NO: 9173930 - DNA, 22 bp, Homo sapiens
ttcatacatttttactaacagc

SEQ ID NO: 9173931 - DNA, 16 bp, Homo sapiens
ttcagaatttgtagaa

SEQ ID NO: 9173932 - DNA, 22 bp, Homo sapiens
ttcagaatgatttcagcgagca

SEQ ID NO: 9173933 - DNA, 22 bp, Homo sapiens
ttcagaatgtactgatagaaca

SEQ ID NO: 9173934 - DNA, 22 bp, Homo sapiens
ttcagacaggcagctgggctgg

SEQ ID NO: 9173935 - DNA, 22 bp, Homo sapiens
ttcagacagtaagaaagaggtt

SEQ ID NO: 9173936 - DNA, 22 bp, Homo sapiens
ttcagaatgtactgatagaaca

SEQ ID NO: 9173937 - DNA, 22 bp, Homo sapiens
ttcagaatctatgtgccagctc

SEQ ID NO: 9173938 - DNA, 22 bp, Homo sapiens
ttcagaatgattacattctggt

SEQ ID NO: 9173939 - DNA, 22 bp, Homo sapiens
ttcagaatgacttatgtaaggc

SEQ ID NO: 9173940 - DNA, 22 bp, Homo sapiens
ttcagaatgacttatgtaaggc

SEQ ID NO: 9173941 - DNA, 22 bp, Homo sapiens
ttcagaatctatgtgccagctc

SEQ ID NO: 9173942 - DNA, 22 bp, Homo sapiens
ttcaatatctctaagaatgagg

SEQ ID NO: 9173943 - DNA, 22 bp, Homo sapiens
ttcaatcatttttacatagtcc

SEQ ID NO: 9173944 - DNA, 22 bp, Homo sapiens
ttcaatcattagaatctcaggc

SEQ ID NO: 9173945 - DNA, 22 bp, Homo sapiens
ttcaatatgatattagctgtgg

SEQ ID NO: 9173946 - DNA, 17 bp, Homo sapiens
ttcagaagcattttggc

SEQ ID NO: 9173947 - DNA, 17 bp, Homo sapiens
ttcagaagcattttggc

SEQ ID NO: 9173948 - DNA, 22 bp, Homo sapiens
ttcagaatatttgttttacatg

SEQ ID NO: 9173949 - DNA, 22 bp, Homo sapiens
ttcagaatatttgttttacatg

SEQ ID NO: 9173950 - DNA, 22 bp, Homo sapiens
ttcagaatattattttaaaggc

SEQ ID NO: 9173951 - DNA, 22 bp, Homo sapiens
ttcagaagttttcaaaactaag

SEQ ID NO: 9173952 - DNA, 22 bp, Homo sapiens
ttcagaagttttcaaaactaag

SEQ ID NO: 9173953 - DNA, 22 bp, Homo sapiens
ttcagaaattcatggagttcag

SEQ ID NO: 9173954 - DNA, 22 bp, Homo sapiens
ttcagaaatcgagtttcatgtc

SEQ ID NO: 9173955 - DNA, 22 bp, Homo sapiens
ttcagaaatcgagtttcatgtc

SEQ ID NO: 9173956 - DNA, 22 bp, Homo sapiens
ttcagaaatcgagtttcatgtc

SEQ ID NO: 9173957 - DNA, 22 bp, Homo sapiens
ttcagaaataaaatatcccaac

SEQ ID NO: 9173958 - DNA, 20 bp, Homo sapiens
ttcagaaataaggaatgagg

SEQ ID NO: 9173959 - DNA, 22 bp, Homo sapiens
ttccccaggctggagtgcagtg

SEQ ID NO: 9173960 - DNA, 22 bp, Homo sapiens
ttccccagggaagctcctgcgc

SEQ ID NO: 9173961 - DNA, 22 bp, Homo sapiens
ttcccctttttgtgtgcagctg

SEQ ID NO: 9173962 - DNA, 22 bp, Homo sapiens
ttccccttataagtctggcttc

SEQ ID NO: 9173963 - DNA, 22 bp, Homo sapiens
ttcccaggctgtgctaccagag

SEQ ID NO: 9173964 - DNA, 22 bp, Homo sapiens
ttcccaggtaattctgaggcag

SEQ ID NO: 9173965 - DNA, 22 bp, Homo sapiens
ttcccaggctgtgctaccagag

SEQ ID NO: 9173966 - DNA, 22 bp, Homo sapiens
ttcccaggctgtgctaccagag

SEQ ID NO: 9173967 - DNA, 22 bp, Homo sapiens
ttcccaggactctgggtgtctt

SEQ ID NO: 9173968 - DNA, 22 bp, Homo sapiens
ttcccaggactctgggtgtctt

SEQ ID NO: 9173969 - DNA, 19 bp, Homo sapiens
ttcccaggaaaggggtgca

SEQ ID NO: 9173970 - DNA, 22 bp, Homo sapiens
ttcccagaggcaaagtctggat

SEQ ID NO: 9173971 - DNA, 21 bp, Homo sapiens
ttcccagcacctagcacaggt

SEQ ID NO: 9173972 - DNA, 22 bp, Homo sapiens
ttcccagattggagggcagggg

SEQ ID NO: 9173973 - DNA, 22 bp, Homo sapiens
ttcccagaggagatttgcttat

SEQ ID NO: 9173974 - DNA, 19 bp, Homo sapiens
ttcccagagccatgagtga

SEQ ID NO: 9173975 - DNA, 22 bp, Homo sapiens
ttccatttattcttgtccagat

SEQ ID NO: 9173976 - DNA, 22 bp, Homo sapiens
ttccatgctaagacacgcaggg

SEQ ID NO: 9173977 - DNA, 22 bp, Homo sapiens
ttccatgcctagaacaggattc

SEQ ID NO: 9173978 - DNA, 22 bp, Homo sapiens
ttccatctttcagctttgttgg

SEQ ID NO: 9173979 - DNA, 22 bp, Homo sapiens
ttccatctttcagctttgttgg

SEQ ID NO: 9173980 - DNA, 22 bp, Homo sapiens
ttccatctgagagctgtgaaga

SEQ ID NO: 9173981 - DNA, 22 bp, Homo sapiens
ttccatcattaacaccacaagg

SEQ ID NO: 9173982 - DNA, 22 bp, Homo sapiens
ttccatccatgtcccgtttctg

SEQ ID NO: 9173983 - DNA, 22 bp, Homo sapiens
ttccatcattaacaccacaagg

SEQ ID NO: 9173984 - DNA, 22 bp, Homo sapiens
ttccatcacatcactgaagaca

SEQ ID NO: 9173985 - DNA, 22 bp, Homo sapiens
ttccaataaaatgttatttgca

SEQ ID NO: 9173986 - DNA, 22 bp, Homo sapiens
ttccaagtgcccatatttcatc

SEQ ID NO: 9173987 - DNA, 22 bp, Homo sapiens
ttccaaggctaggttgtaaagg

SEQ ID NO: 9173988 - DNA, 22 bp, Homo sapiens
ttccaattgtgagattttttaa

SEQ ID NO: 9173989 - DNA, 22 bp, Homo sapiens
ttccaatgactagtggcatcct

SEQ ID NO: 9173990 - DNA, 22 bp, Homo sapiens
ttccaatccaaacttcaccttt

SEQ ID NO: 9173991 - DNA, 22 bp, Homo sapiens
ttccaacaatgtgttattgttc

SEQ ID NO: 9173992 - DNA, 20 bp, Homo sapiens
ttccaactcacatctctaca

SEQ ID NO: 9173993 - DNA, 22 bp, Homo sapiens
ttccaaggcccagcagagagga

SEQ ID NO: 9173994 - DNA, 22 bp, Homo sapiens
ttccaaggcccagcagagagga

SEQ ID NO: 9173995 - DNA, 22 bp, Homo sapiens
ttccaaggcatgttctcaagta

SEQ ID NO: 9173996 - DNA, 22 bp, Homo sapiens
ttccaaggattgaaatgtagtc

SEQ ID NO: 9173997 - DNA, 22 bp, Homo sapiens
tttcatatgggcattggcaata

SEQ ID NO: 9173998 - DNA, 22 bp, Homo sapiens
tttcatctaacactacataggg

SEQ ID NO: 9173999 - DNA, 22 bp, Homo sapiens
tttcatctctctaaaagacagt

SEQ ID NO: 9174000 - DNA, 22 bp, Homo sapiens
tttcataatactgtacatgaaa

SEQ ID NO: 9174001 - DNA, 22 bp, Homo sapiens
tttccaggtatcaagcttcagg

SEQ ID NO: 9174002 - DNA, 22 bp, Homo sapiens
tttccaggtatcaagcttcagg

SEQ ID NO: 9174003 - DNA, 22 bp, Homo sapiens
tttccaggtgcatagaaaacag

SEQ ID NO: 9174004 - DNA, 22 bp, Homo sapiens
tttccaggtattaatactgtat

SEQ ID NO: 9174005 - DNA, 22 bp, Homo sapiens
tttccaaataaggtcacattct

SEQ ID NO: 9174006 - DNA, 22 bp, Homo sapiens
tttccaaataaggtcacattct

SEQ ID NO: 9174007 - DNA, 22 bp, Homo sapiens
tttccaggaagtaaggataatc

SEQ ID NO: 9174008 - DNA, 22 bp, Homo sapiens
tttccaggagaaagagagcctt

SEQ ID NO: 9174009 - DNA, 22 bp, Homo sapiens
tttccaggcagaggagttgtga

SEQ ID NO: 9174010 - DNA, 22 bp, Homo sapiens
tttccaaataaggtcacactca

SEQ ID NO: 9174011 - DNA, 22 bp, Homo sapiens
tttcatcttcccagagaccttg

SEQ ID NO: 9174012 - DNA, 17 bp, Homo sapiens
tttcatctgggaccacc

SEQ ID NO: 9174013 - DNA, 22 bp, Homo sapiens
tttctaaaatagattttatggt

SEQ ID NO: 9174014 - DNA, 21 bp, Homo sapiens
tttcggtcccagatgcctgtg

SEQ ID NO: 9174015 - DNA, 22 bp, Homo sapiens
tttccttttaagcagtcggcct

SEQ ID NO: 9174016 - DNA, 22 bp, Homo sapiens
tttccttttaagcagtcggcct

SEQ ID NO: 9174017 - DNA, 22 bp, Homo sapiens
tttctaaatggtggctgcattg

SEQ ID NO: 9174018 - DNA, 22 bp, Homo sapiens
tttctaaagggtagatttggcc

SEQ ID NO: 9174019 - DNA, 22 bp, Homo sapiens
tttctaaatggtggctgcattg

SEQ ID NO: 9174020 - DNA, 21 bp, Homo sapiens
tttctaaggaggaagaaaaga

SEQ ID NO: 9174021 - DNA, 19 bp, Homo sapiens
tttctaagctaaatgcttc

SEQ ID NO: 9174022 - DNA, 22 bp, Homo sapiens
tttccatatttaatcaaaataa

SEQ ID NO: 9174023 - DNA, 22 bp, Homo sapiens
tttccatgatcgttatagaact

SEQ ID NO: 9174024 - DNA, 22 bp, Homo sapiens
tttcccaagaaaaataattgga

SEQ ID NO: 9174025 - DNA, 22 bp, Homo sapiens
tttcccaagaccatagatggaa

SEQ ID NO: 9174026 - DNA, 22 bp, Homo sapiens
tttcctttgagggtcctacact

SEQ ID NO: 9174027 - DNA, 21 bp, Homo sapiens
tttatttatataggacacatg

SEQ ID NO: 9174028 - DNA, 22 bp, Homo sapiens
tttatttataagccacttgctg

SEQ ID NO: 9174029 - DNA, 21 bp, Homo sapiens
tttatttatataggacacatg

SEQ ID NO: 9174030 - DNA, 22 bp, Homo sapiens
tttatttatccttctggattgc

SEQ ID NO: 9174031 - DNA, 22 bp, Homo sapiens
tttatttatccttctggattgc

SEQ ID NO: 9174032 - DNA, 22 bp, Homo sapiens
tttcaagtcattctataatatc

SEQ ID NO: 9174033 - DNA, 20 bp, Homo sapiens
tttcaagtcagcaattctca

SEQ ID NO: 9174034 - DNA, 22 bp, Homo sapiens
tttcaagtactgtaaacatgct

SEQ ID NO: 9174035 - DNA, 22 bp, Homo sapiens
tttcaaggccttctggttcagt

SEQ ID NO: 9174036 - DNA, 22 bp, Homo sapiens
tttcaagtttagtgtgttcaaa

SEQ ID NO: 9174037 - DNA, 22 bp, Homo sapiens
tttcaataacaaagctcatttt

SEQ ID NO: 9174038 - DNA, 22 bp, Homo sapiens
tttcaagttctgttctagggta

SEQ ID NO: 9174039 - DNA, 22 bp, Homo sapiens
tttcacaactgcttatttgaga

SEQ ID NO: 9174040 - DNA, 22 bp, Homo sapiens
tttcacaacgttgtggtgagag

SEQ ID NO: 9174041 - DNA, 18 bp, Homo sapiens
tttcacaacctccagagg

SEQ ID NO: 9174042 - DNA, 22 bp, Homo sapiens
tttcacaactgcttatttgaga

SEQ ID NO: 9174043 - DNA, 22 bp, Homo sapiens
tttcacatcctgaagccccact

SEQ ID NO: 9174044 - DNA, 22 bp, Homo sapiens
tttcacatgtatataggcatta

SEQ ID NO: 9174045 - DNA, 22 bp, Homo sapiens
tttcacatgtatataggcatta

SEQ ID NO: 9174046 - DNA, 22 bp, Homo sapiens
tttcacaggagttgtaccattt

SEQ ID NO: 9174047 - DNA, 22 bp, Homo sapiens
tttcacaggagtcctttctata

SEQ ID NO: 9174048 - DNA, 22 bp, Homo sapiens
tttcacaatcaaatggtgaaat

SEQ ID NO: 9174049 - DNA, 22 bp, Homo sapiens
tttcacaggccttttgtagccc

SEQ ID NO: 9174050 - DNA, 22 bp, Homo sapiens
tttcacatatcaactctatcct

SEQ ID NO: 9174051 - DNA, 22 bp, Homo sapiens
tttcacatcagaggtagattag

SEQ ID NO: 9174052 - DNA, 22 bp, Homo sapiens
tttcacatcagaggtagattag

SEQ ID NO: 9174053 - DNA, 22 bp, Homo sapiens
tttcataaacagtagaagacta

SEQ ID NO: 9174054 - DNA, 22 bp, Homo sapiens
tttcataaacagtagaagacta

SEQ ID NO: 9174055 - DNA, 23 bp, Homo sapiens
tttcacatttactgttagatggc

SEQ ID NO: 9174056 - DNA, 22 bp, Homo sapiens
tttcacatttgttttaagaagt

SEQ ID NO: 9174057 - DNA, 22 bp, Homo sapiens
tttcacattagatatgtcattt

SEQ ID NO: 9174058 - DNA, 22 bp, Homo sapiens
tttcacattagatatgtcattt

SEQ ID NO: 9174059 - DNA, 22 bp, Homo sapiens
tttcacattagatatgtcattt

SEQ ID NO: 9174060 - DNA, 22 bp, Homo sapiens
tttcacattagatatgtcattt

SEQ ID NO: 9174061 - DNA, 23 bp, Homo sapiens
tttcacattaatgtttagcagga

SEQ ID NO: 9174062 - DNA, 22 bp, Homo sapiens
tttcacatgtggaatgccaggt

SEQ ID NO: 9174063 - DNA, 22 bp, Homo sapiens
ttgttggtggaattgatgctag

SEQ ID NO: 9174064 - DNA, 22 bp, Homo sapiens
ttgttgccaaatgtaaaatatg

SEQ ID NO: 9174065 - DNA, 22 bp, Homo sapiens
ttgttgttggagccaatatgca

SEQ ID NO: 9174066 - DNA, 22 bp, Homo sapiens
ttgttgaatggataaataaatt

SEQ ID NO: 9174067 - DNA, 22 bp, Homo sapiens
ttgttcttccatcatccctcag

SEQ ID NO: 9174068 - DNA, 22 bp, Homo sapiens
tttaaccagtttacaaagaatt

SEQ ID NO: 9174069 - DNA, 23 bp, Homo sapiens
tttaaccttggtcaagaatttcc

SEQ ID NO: 9174070 - DNA, 22 bp, Homo sapiens
tttaacctgtcaatttgcatgc

SEQ ID NO: 9174071 - DNA, 22 bp, Homo sapiens
tttaacctctaatttagttctc

SEQ ID NO: 9174072 - DNA, 22 bp, Homo sapiens
tttaacatgttcaagaaacata

SEQ ID NO: 9174073 - DNA, 22 bp, Homo sapiens
tttaacatgttcaagaaacata

SEQ ID NO: 9174074 - DNA, 23 bp, Homo sapiens
tttaactttccaataattcattg

SEQ ID NO: 9174075 - DNA, 22 bp, Homo sapiens
tttaactctctagaaaatggct

SEQ ID NO: 9174076 - DNA, 22 bp, Homo sapiens
tttaacttgatcagtagagcat

SEQ ID NO: 9174077 - DNA, 22 bp, Homo sapiens
tttaacagatgtgaaattttca

SEQ ID NO: 9174078 - DNA, 22 bp, Homo sapiens
tttaacatgttcaagaaacata

SEQ ID NO: 9174079 - DNA, 22 bp, Homo sapiens
tttaacagatgtgaaattttca

SEQ ID NO: 9174080 - DNA, 22 bp, Homo sapiens
tttaacaggtaaagtaaatgtg

SEQ ID NO: 9174081 - DNA, 22 bp, Homo sapiens
tttaacaggtaaagtaaatgtg

SEQ ID NO: 9174082 - DNA, 22 bp, Homo sapiens
tttaagacagtgcaagctgaat

SEQ ID NO: 9174083 - DNA, 22 bp, Homo sapiens
tttacactgacagcacataagg

SEQ ID NO: 9174084 - DNA, 22 bp, Homo sapiens
tttacactgccattctgaatac

SEQ ID NO: 9174085 - DNA, 22 bp, Homo sapiens
tttacactgcttgaacaatctc

SEQ ID NO: 9174086 - DNA, 22 bp, Homo sapiens
tttacaagtttacagaatgatg

SEQ ID NO: 9174087 - DNA, 22 bp, Homo sapiens
tttacacatacctctttaaagt

SEQ ID NO: 9174088 - DNA, 22 bp, Homo sapiens
tttacagagaatgtacataaag

SEQ ID NO: 9174089 - DNA, 22 bp, Homo sapiens
tttacagacaacttaatagggg

SEQ ID NO: 9174090 - DNA, 22 bp, Homo sapiens
tttacagagagagaactggact

SEQ ID NO: 9174091 - DNA, 22 bp, Homo sapiens
tttacagatctgttgatttgtt

SEQ ID NO: 9174092 - DNA, 22 bp, Homo sapiens
tttacagagaatgtacataaag

SEQ ID NO: 9174093 - DNA, 22 bp, Homo sapiens
tttacagaatgttgaatttggg

SEQ ID NO: 9174094 - DNA, 22 bp, Homo sapiens
tttacagaatgttgaatttggg

SEQ ID NO: 9174095 - DNA, 22 bp, Homo sapiens
tttacagaatgtcaatttctat

SEQ ID NO: 9174096 - DNA, 22 bp, Homo sapiens
tttacagatgaggaaactgaga

SEQ ID NO: 9174097 - DNA, 22 bp, Homo sapiens
tttacagatgaggaaactgaga

SEQ ID NO: 9174098 - DNA, 22 bp, Homo sapiens
tttacagatgaggaaactgaga

SEQ ID NO: 9174099 - DNA, 22 bp, Homo sapiens
tttacagatgaggatactgagg

SEQ ID NO: 9174100 - DNA, 22 bp, Homo sapiens
tttacagatgaggatactgagg

SEQ ID NO: 9174101 - DNA, 22 bp, Homo sapiens
tttacagattctgggtattagg

SEQ ID NO: 9174102 - DNA, 22 bp, Homo sapiens
tttacagatgtggaaagtgagc

SEQ ID NO: 9174103 - DNA, 22 bp, Homo sapiens
tttacagatgtggaaagtgagc

SEQ ID NO: 9174104 - DNA, 22 bp, Homo sapiens
tttacagatgtggaaagtgagc

SEQ ID NO: 9174105 - DNA, 22 bp, Homo sapiens
tttacagatgtggaaagtgagc

SEQ ID NO: 9174106 - DNA, 22 bp, Homo sapiens
tttagcatgttcctttcataga

SEQ ID NO: 9174107 - DNA, 22 bp, Homo sapiens
tttagcatcgaagtaaatttag

SEQ ID NO: 9174108 - DNA, 22 bp, Homo sapiens
tttagcattaagcttttcaaat

SEQ ID NO: 9174109 - DNA, 22 bp, Homo sapiens
tttagctcatactgctcttcca

SEQ ID NO: 9174110 - DNA, 22 bp, Homo sapiens
tttagctcagttctagccccat

SEQ ID NO: 9174111 - DNA, 22 bp, Homo sapiens
tttagcttgaatcttgtttaaa

SEQ ID NO: 9174112 - DNA, 23 bp, Homo sapiens
tttagcttataaatgcttttgaa

SEQ ID NO: 9174113 - DNA, 22 bp, Homo sapiens
tttaggaacttaggtttatgga

SEQ ID NO: 9174114 - DNA, 22 bp, Homo sapiens
tttaggatattaatgttcagag

SEQ ID NO: 9174115 - DNA, 22 bp, Homo sapiens
tttatctgtggtaaataacatt

SEQ ID NO: 9174116 - DNA, 22 bp, Homo sapiens
tttatctgctatctgctgtgct

SEQ ID NO: 9174117 - DNA, 22 bp, Homo sapiens
tttatctgtagagcttcaccta

SEQ ID NO: 9174118 - DNA, 22 bp, Homo sapiens
tttatctgggattttgcagtct

SEQ ID NO: 9174119 - DNA, 22 bp, Homo sapiens
tttatctgggattttgcagtct

SEQ ID NO: 9174120 - DNA, 22 bp, Homo sapiens
tttatctgttgtacatttatgc

SEQ ID NO: 9174121 - DNA, 22 bp, Homo sapiens
tttagtgtgacagtccccagta

SEQ ID NO: 9174122 - DNA, 22 bp, Homo sapiens
tttagtgtttgcgtgtactcct

SEQ ID NO: 9174123 - DNA, 22 bp, Homo sapiens
tttatgtcaaaactacagttgg

SEQ ID NO: 9174124 - DNA, 21 bp, Homo sapiens
tttatgtacttcatagagtag

SEQ ID NO: 9174125 - DNA, 22 bp, Homo sapiens
tttatgttcctcttgagctttc

SEQ ID NO: 9174126 - DNA, 22 bp, Homo sapiens
tttattgccctgtagtacagga

SEQ ID NO: 9174127 - DNA, 22 bp, Homo sapiens
tttatgacccaagaagatacca

SEQ ID NO: 9174128 - DNA, 22 bp, Homo sapiens
tttatgacattacaatatcaag

SEQ ID NO: 9174129 - DNA, 22 bp, Homo sapiens
tttatgacttctaatctgaagc

SEQ ID NO: 9174130 - DNA, 22 bp, Homo sapiens
tttatgtacatatccacaagga

SEQ ID NO: 9174131 - DNA, 21 bp, Homo sapiens
tttatgtacttcatagagtag

SEQ ID NO: 9174132 - DNA, 22 bp, Homo sapiens
tttatctttggatcttcagaaa

SEQ ID NO: 9174133 - DNA, 22 bp, Homo sapiens
tttatctttggatcttcagaaa

SEQ ID NO: 9174134 - DNA, 22 bp, Homo sapiens
tttatctttggatcttcagaaa

SEQ ID NO: 9174135 - DNA, 22 bp, Homo sapiens
tttatgaactacagatataact

SEQ ID NO: 9174136 - DNA, 22 bp, Homo sapiens
tttatgacattacaatatcaag

SEQ ID NO: 9174137 - DNA, 20 bp, Homo sapiens
tttattggcctttcaggaac

SEQ ID NO: 9174138 - DNA, 22 bp, Homo sapiens
tttattgtctatgaactgcttg

SEQ ID NO: 9174139 - DNA, 22 bp, Homo sapiens
tttattgtcaatctattcccag

SEQ ID NO: 9174140 - DNA, 22 bp, Homo sapiens
tttattgggtgcagtgcccaca

SEQ ID NO: 9174141 - DNA, 22 bp, Homo sapiens
tttattgtgttgaaactgaatt

SEQ ID NO: 9174142 - DNA, 22 bp, Homo sapiens
tttattgtgttgaaactgaatt

SEQ ID NO: 9174143 - DNA, 22 bp, Homo sapiens
tttattgtcttcgtggtgccta

SEQ ID NO: 9174144 - DNA, 22 bp, Homo sapiens
tttatttataagccacttgctg

SEQ ID NO: 9174145 - DNA, 22 bp, Homo sapiens
tttattggaacacagccatgac

SEQ ID NO: 9174146 - DNA, 22 bp, Homo sapiens
tttattgctgagaaggattcca

SEQ ID NO: 9174147 - DNA, 22 bp, Homo sapiens
tttattggatggatggatggat

SEQ ID NO: 9174148 - DNA, 22 bp, Homo sapiens
tttattggatatttacaagata

SEQ ID NO: 9174149 - DNA, 22 bp, Homo sapiens
tttattggatatttacaagata

SEQ ID NO: 9174150 - DNA, 23 bp, Homo sapiens
ttggaatatattgtttgacatag

SEQ ID NO: 9174151 - DNA, 22 bp, Homo sapiens
ttggaagacaatgctgattctc

SEQ ID NO: 9174152 - DNA, 22 bp, Homo sapiens
ttggaagacagtgaaacagcac

SEQ ID NO: 9174153 - DNA, 22 bp, Homo sapiens
ttggaagttcttagccttttca

SEQ ID NO: 9174154 - DNA, 22 bp, Homo sapiens
ttggaattcagcttgcttataa

SEQ ID NO: 9174155 - DNA, 22 bp, Homo sapiens
ttggaattaaaaggagaacttc

SEQ ID NO: 9174156 - DNA, 22 bp, Homo sapiens
ttggaattaatatttgtataca

SEQ ID NO: 9174157 - DNA, 22 bp, Homo sapiens
ttggaggatggagttagcatct

SEQ ID NO: 9174158 - DNA, 22 bp, Homo sapiens
ttggaggcaatgggaaggaggc

SEQ ID NO: 9174159 - DNA, 22 bp, Homo sapiens
ttggaggatgtcggcatattta

SEQ ID NO: 9174160 - DNA, 22 bp, Homo sapiens
ttggcactcatcctggttgttt

SEQ ID NO: 9174161 - DNA, 22 bp, Homo sapiens
ttggcaatttaaatagcaggag

SEQ ID NO: 9174162 - DNA, 22 bp, Homo sapiens
ttggcacagctccatggctttg

SEQ ID NO: 9174163 - DNA, 22 bp, Homo sapiens
ttggatgtttgaaatcacgtac

SEQ ID NO: 9174164 - DNA, 22 bp, Homo sapiens
ttggatttgtctaccagggaat

SEQ ID NO: 9174165 - DNA, 22 bp, Homo sapiens
ttggcaaaggactcaaagcagg

SEQ ID NO: 9174166 - DNA, 22 bp, Homo sapiens
ttggaagaaatatcaatagtgt

SEQ ID NO: 9174167 - DNA, 22 bp, Homo sapiens
ttggaacatgccggggtccagg

SEQ ID NO: 9174168 - DNA, 22 bp, Homo sapiens
ttggaacaggattcaattaaag

SEQ ID NO: 9174169 - DNA, 22 bp, Homo sapiens
ttgctttagggcaaatatttca

SEQ ID NO: 9174170 - DNA, 22 bp, Homo sapiens
ttgctttaggtatagaatccat

SEQ ID NO: 9174171 - DNA, 22 bp, Homo sapiens
ttgctttagaatctgcttctgg

SEQ ID NO: 9174172 - DNA, 22 bp, Homo sapiens
ttgctttaggatttaagtggca

SEQ ID NO: 9174173 - DNA, 22 bp, Homo sapiens
ttgctttagggcaaatatttca

SEQ ID NO: 9174174 - DNA, 20 bp, Homo sapiens
ttgctttatcagacatgata

SEQ ID NO: 9174175 - DNA, 22 bp, Homo sapiens
ttgctttatctcttatgcctca

SEQ ID NO: 9174176 - DNA, 22 bp, Homo sapiens
ttgctttatctaagcatggcca

SEQ ID NO: 9174177 - DNA, 22 bp, Homo sapiens
ttgctttatattcaagagagga

SEQ ID NO: 9174178 - DNA, 22 bp, Homo sapiens
ttgctttattcacatctatatt

SEQ ID NO: 9174179 - DNA, 22 bp, Homo sapiens
ttgctttattcctagcccttgt

SEQ ID NO: 9174180 - DNA, 22 bp, Homo sapiens
ttgctttatgtgtatgacttga

SEQ ID NO: 9174181 - DNA, 22 bp, Homo sapiens
ttgctttatgtgtatgacttga

SEQ ID NO: 9174182 - DNA, 22 bp, Homo sapiens
ttgctttatctcttatgcctca

SEQ ID NO: 9174183 - DNA, 22 bp, Homo sapiens
ttgctttattcacatctatatt

SEQ ID NO: 9174184 - DNA, 20 bp, Homo sapiens
ttgctttatcagacatgata

SEQ ID NO: 9174185 - DNA, 22 bp, Homo sapiens
ttgctttacaaaaattgatggt

SEQ ID NO: 9174186 - DNA, 22 bp, Homo sapiens
ttgctttacaaaaattgatggt

SEQ ID NO: 9174187 - DNA, 22 bp, Homo sapiens
ttgctttaccatttgatctcta

SEQ ID NO: 9174188 - DNA, 22 bp, Homo sapiens
ttgctttacatgttctggtaaa

SEQ ID NO: 9174189 - DNA, 22 bp, Homo sapiens
ttgctttacctgtggtatattt

SEQ ID NO: 9174190 - DNA, 22 bp, Homo sapiens
ttgctttaccatttgatctcta

SEQ ID NO: 9174191 - DNA, 22 bp, Homo sapiens
ttgctttactttgccattcgtt

SEQ ID NO: 9174192 - DNA, 22 bp, Homo sapiens
ttgctttactttgccattcgtt

SEQ ID NO: 9174193 - DNA, 22 bp, Homo sapiens
ttgctttacggcaaggccccag

SEQ ID NO: 9174194 - DNA, 22 bp, Homo sapiens
ttgctttagaatctgcttctgg

SEQ ID NO: 9174195 - DNA, 22 bp, Homo sapiens
ttgctttagaatctgcttctgg

SEQ ID NO: 9174196 - DNA, 22 bp, Homo sapiens
ttgctttaatgagattttgcca

SEQ ID NO: 9174197 - DNA, 22 bp, Homo sapiens
ttgctttaatgagattttgcca

SEQ ID NO: 9174198 - DNA, 22 bp, Homo sapiens
ttgctttaaggtatctggagaa

SEQ ID NO: 9174199 - DNA, 15 bp, Homo sapiens
ttgctttaagacatg

SEQ ID NO: 9174200 - DNA, 22 bp, Homo sapiens
ttgctttaactagtaaatgggg

SEQ ID NO: 9174201 - DNA, 22 bp, Homo sapiens
ttgctttaaaatggctaagtct

SEQ ID NO: 9174202 - DNA, 22 bp, Homo sapiens
ttgcttgcttctattttataca

SEQ ID NO: 9174203 - DNA, 22 bp, Homo sapiens
ttgcttgatgcttatatacttg

SEQ ID NO: 9174204 - DNA, 22 bp, Homo sapiens
ttgcttgactttgtgtacctgt

SEQ ID NO: 9174205 - DNA, 22 bp, Homo sapiens
ttgcttcttagatattcctctc

SEQ ID NO: 9174206 - DNA, 22 bp, Homo sapiens
ttgcttcttagatattcctctc

SEQ ID NO: 9174207 - DNA, 18 bp, Homo sapiens
ttgcttcttttctctagg

SEQ ID NO: 9174208 - DNA, 21 bp, Homo sapiens
ttgcttgaaccaaaaggcata

SEQ ID NO: 9174209 - DNA, 18 bp, Homo sapiens
ttgcttcttttctctagg

SEQ ID NO: 9174210 - DNA, 22 bp, Homo sapiens
ttgcttctggaactttctgttc

SEQ ID NO: 9174211 - DNA, 22 bp, Homo sapiens
ttgcttctggaactttctgttc

SEQ ID NO: 9174212 - DNA, 22 bp, Homo sapiens
ttgcctttaagtataactgctg

SEQ ID NO: 9174213 - DNA, 22 bp, Homo sapiens
ttgcctcattttctggtgaaat

SEQ ID NO: 9174214 - DNA, 22 bp, Homo sapiens
ttgcttcatatttgtggcttgc

SEQ ID NO: 9174215 - DNA, 22 bp, Homo sapiens
ttgcttcattaagttctcacag

SEQ ID NO: 9174216 - DNA, 22 bp, Homo sapiens
ttgcttcagtagctctttaaag

SEQ ID NO: 9174217 - DNA, 19 bp, Homo sapiens
ttgcttcatgtcttttgct

SEQ ID NO: 9174218 - DNA, 22 bp, Homo sapiens
ttgcttcattaagttctcacag

SEQ ID NO: 9174219 - DNA, 19 bp, Homo sapiens
ttgcttcaggctgtgtgct

SEQ ID NO: 9174220 - DNA, 22 bp, Homo sapiens
ttgcttcagagggagacacttt

SEQ ID NO: 9174221 - DNA, 22 bp, Homo sapiens
ttgctcaggcttagagctacta

SEQ ID NO: 9174222 - DNA, 22 bp, Homo sapiens
ttgctcaggctggtgtgcagtg

SEQ ID NO: 9174223 - DNA, 22 bp, Homo sapiens
ttgctcaggctggtgtgcagtg

SEQ ID NO: 9174224 - DNA, 22 bp, Homo sapiens
ttgctcaggcttagagctacta

SEQ ID NO: 9174225 - DNA, 22 bp, Homo sapiens
ttgctcagtggcagggctggta

SEQ ID NO: 9174226 - DNA, 22 bp, Homo sapiens
ttgctcagcactggagccagct

SEQ ID NO: 9174227 - DNA, 22 bp, Homo sapiens
ttgctatttcctgaaataagca

SEQ ID NO: 9174228 - DNA, 22 bp, Homo sapiens
ttgctcagcactggagccagct

SEQ ID NO: 9174229 - DNA, 22 bp, Homo sapiens
ttgctcagctgtgagatatcca

SEQ ID NO: 9174230 - DNA, 22 bp, Homo sapiens
ttgctcaggctggtgtgcagtg

SEQ ID NO: 9174231 - DNA, 22 bp, Homo sapiens
ttgctaaaaatggaattatagg

SEQ ID NO: 9174232 - DNA, 22 bp, Homo sapiens
ttgctaaaaggtgaaaagtgta

SEQ ID NO: 9174233 - DNA, 22 bp, Homo sapiens
ttgctaaaggattttgtattta

SEQ ID NO: 9174234 - DNA, 22 bp, Homo sapiens
ttgctaataaagtttttatgtg

SEQ ID NO: 9174235 - DNA, 22 bp, Homo sapiens
ttgctaaatgtgttatatctgt

SEQ ID NO: 9174236 - DNA, 22 bp, Homo sapiens
ttgctaaatccctataatattc

SEQ ID NO: 9174237 - DNA, 22 bp, Homo sapiens
ttgctaatttaactaccttgtt

SEQ ID NO: 9174238 - DNA, 22 bp, Homo sapiens
ttgctagctggtgtatgcattg

SEQ ID NO: 9174239 - DNA, 22 bp, Homo sapiens
ttgctataaatggtttcatatt

SEQ ID NO: 9174240 - DNA, 22 bp, Homo sapiens
ttgcatttgacaaattatttaa

SEQ ID NO: 9174241 - DNA, 22 bp, Homo sapiens
ttgcatttgagaaagttctcct

SEQ ID NO: 9174242 - DNA, 22 bp, Homo sapiens
ttgcatttgatcttgggttctc

SEQ ID NO: 9174243 - DNA, 22 bp, Homo sapiens
ttgcatttgacaaattatttaa

SEQ ID NO: 9174244 - DNA, 22 bp, Homo sapiens
ttgcatttcctgtactgtttga

SEQ ID NO: 9174245 - DNA, 22 bp, Homo sapiens
ttgcatttcccattgagtaatg

SEQ ID NO: 9174246 - DNA, 22 bp, Homo sapiens
ttgcatttcccattgagtaatg

SEQ ID NO: 9174247 - DNA, 22 bp, Homo sapiens
ttgccacacaagtaaagaaaca

SEQ ID NO: 9174248 - DNA, 22 bp, Homo sapiens
ttgccacagtagcaaaaggttc

SEQ ID NO: 9174249 - DNA, 22 bp, Homo sapiens
ttgcatttttagatgcttctgt

SEQ ID NO: 9174250 - DNA, 22 bp, Homo sapiens
ttgcatttttagatgcttctgt

SEQ ID NO: 9174251 - DNA, 22 bp, Homo sapiens
ttgccaggggacatctggagcc

SEQ ID NO: 9174252 - DNA, 22 bp, Homo sapiens
ttgccagggtcaggatgagatc

SEQ ID NO: 9174253 - DNA, 22 bp, Homo sapiens
ttgccatcccttacctcagtca

SEQ ID NO: 9174254 - DNA, 22 bp, Homo sapiens
ttgccagggccagtgggggtgt

SEQ ID NO: 9174255 - DNA, 22 bp, Homo sapiens
ttgccagggctttggtggcatc

SEQ ID NO: 9174256 - DNA, 22 bp, Homo sapiens
ttgccagggctttggtggcatc

SEQ ID NO: 9174257 - DNA, 22 bp, Homo sapiens
ttgccagggaacagggagaggc

SEQ ID NO: 9174258 - DNA, 22 bp, Homo sapiens
ttgccagggaacagggagaggc

SEQ ID NO: 9174259 - DNA, 22 bp, Homo sapiens
ttgccaggcttgtttctaggct

SEQ ID NO: 9174260 - DNA, 22 bp, Homo sapiens
ttgccaggcttgtttctaggct

SEQ ID NO: 9174261 - DNA, 22 bp, Homo sapiens
ttgccaggctctggttccagcc

SEQ ID NO: 9174262 - DNA, 22 bp, Homo sapiens
ttgccaggagacatctggagcc

SEQ ID NO: 9174263 - DNA, 22 bp, Homo sapiens
ttgccaggagagccacttgcag

SEQ ID NO: 9174264 - DNA, 22 bp, Homo sapiens
ttgccaggagacaaagtgggcc

SEQ ID NO: 9174265 - DNA, 22 bp, Homo sapiens
ttgtatatattcttaaagatgt

SEQ ID NO: 9174266 - DNA, 22 bp, Homo sapiens
ttgtagtagtctcgttctttta

SEQ ID NO: 9174267 - DNA, 20 bp, Homo sapiens
ttgtatcagtgtctcccaaa

SEQ ID NO: 9174268 - DNA, 22 bp, Homo sapiens
ttgtatcactccaccagctgag

SEQ ID NO: 9174269 - DNA, 22 bp, Homo sapiens
ttgtattaattgaaatgaatgc

SEQ ID NO: 9174270 - DNA, 22 bp, Homo sapiens
ttgtattaattgaaatgaatgc

SEQ ID NO: 9174271 - DNA, 22 bp, Homo sapiens
ttgtatgtttctgtgcacatga

SEQ ID NO: 9174272 - DNA, 22 bp, Homo sapiens
ttgtattaaaatgtgtttctgt

SEQ ID NO: 9174273 - DNA, 22 bp, Homo sapiens
ttgtattaattgaaatgaatgc

SEQ ID NO: 9174274 - DNA, 22 bp, Homo sapiens
ttgtattagctgtaaattttct

SEQ ID NO: 9174275 - DNA, 22 bp, Homo sapiens
ttgtatttatattgaatagctt

SEQ ID NO: 9174276 - DNA, 22 bp, Homo sapiens
ttgtatttatattgaatagctt

SEQ ID NO: 9174277 - DNA, 22 bp, Homo sapiens
ttgtatttcctataacctttct

SEQ ID NO: 9174278 - DNA, 22 bp, Homo sapiens
ttgtatttatattgaatagctt

SEQ ID NO: 9174279 - DNA, 22 bp, Homo sapiens
ttgtagaatttggatctcggca

SEQ ID NO: 9174280 - DNA, 22 bp, Homo sapiens
ttgtagatggcttatttctgtg

SEQ ID NO: 9174281 - DNA, 22 bp, Homo sapiens
ttgtagatgtgtttttatctca

SEQ ID NO: 9174282 - DNA, 22 bp, Homo sapiens
ttgtagaaaattctcttggata

SEQ ID NO: 9174283 - DNA, 22 bp, Homo sapiens
ttgtacttttgtcaggtggaca

SEQ ID NO: 9174284 - DNA, 22 bp, Homo sapiens
ttgggggcagagggagcatctg

SEQ ID NO: 9174285 - DNA, 22 bp, Homo sapiens
ttgggggcatattgagtagtgg

SEQ ID NO: 9174286 - DNA, 22 bp, Homo sapiens
ttggggcatgattagattatga

SEQ ID NO: 9174287 - DNA, 22 bp, Homo sapiens
ttggggcagttattctgtgccc

SEQ ID NO: 9174288 - DNA, 22 bp, Homo sapiens
ttggggctctgaaaaagatgta

SEQ ID NO: 9174289 - DNA, 22 bp, Homo sapiens
ttggggtacgcaggtctgggag

SEQ ID NO: 9174290 - DNA, 22 bp, Homo sapiens
ttggggtcccacaggctgcctg

SEQ ID NO: 9174291 - DNA, 22 bp, Homo sapiens
ttggggggttgaggagtagata

SEQ ID NO: 9174292 - DNA, 19 bp, Homo sapiens
ttggggtgaatgccagaca

SEQ ID NO: 9174293 - DNA, 22 bp, Homo sapiens
ttggggtcccacaggctgcctg

SEQ ID NO: 9174294 - DNA, 20 bp, Homo sapiens
ttgttcattgagctgttttc

SEQ ID NO: 9174295 - DNA, 23 bp, Homo sapiens
ttgttctatcaacctagacttag

SEQ ID NO: 9174296 - DNA, 22 bp, Homo sapiens
ttgttcagaaatttggactcct

SEQ ID NO: 9174297 - DNA, 22 bp, Homo sapiens
ttgttcagaagtttaaagaatt

SEQ ID NO: 9174298 - DNA, 22 bp, Homo sapiens
ttgttcagtagagagattatta

SEQ ID NO: 9174299 - DNA, 22 bp, Homo sapiens
ttgttcaggcctgggacagttt

SEQ ID NO: 9174300 - DNA, 22 bp, Homo sapiens
ttgttcaggaggggaatgtgag

SEQ ID NO: 9174301 - DNA, 22 bp, Homo sapiens
ttgtggcagaccatgagtctaa

SEQ ID NO: 9174302 - DNA, 22 bp, Homo sapiens
ttgtgctcctatgagaatctaa

SEQ ID NO: 9174303 - DNA, 22 bp, Homo sapiens
ttgtgctcctatgagaatctaa

SEQ ID NO: 9174304 - DNA, 22 bp, Homo sapiens
ttgtgctcctgtgagaatctag

SEQ ID NO: 9174305 - DNA, 22 bp, Homo sapiens
ttgtgctctgtgttatttaagg

SEQ ID NO: 9174306 - DNA, 22 bp, Homo sapiens
ttgtgctcctgtgagaatctag

SEQ ID NO: 9174307 - DNA, 22 bp, Homo sapiens
ttgtgcttaagcaagctttctt

SEQ ID NO: 9174308 - DNA, 22 bp, Homo sapiens
ttgtgctttggaacagaatcct

SEQ ID NO: 9174309 - DNA, 22 bp, Homo sapiens
ttgtatttcctataacctttct

SEQ ID NO: 9174310 - DNA, 22 bp, Homo sapiens
ttgtatttcctataacctttct

SEQ ID NO: 9174311 - DNA, 22 bp, Homo sapiens
ttgtgagacacaaatcaatgca

SEQ ID NO: 9174312 - DNA, 22 bp, Homo sapiens
ttgtgagaaatcttaatcccaa

SEQ ID NO: 9174313 - DNA, 22 bp, Homo sapiens
ttgtgagactcgtaagagaagg

SEQ ID NO: 9174314 - DNA, 23 bp, Homo sapiens
ttgtgagaccttggaagaagtat

SEQ ID NO: 9174315 - DNA, 22 bp, Homo sapiens
ttgtgagagaaaatgtgtatat

SEQ ID NO: 9174316 - DNA, 22 bp, Homo sapiens
ttgtgagagccaaacatgtaag

SEQ ID NO: 9174317 - DNA, 22 bp, Homo sapiens
ttgtgagatgtctactgaagaa

SEQ ID NO: 9174318 - DNA, 22 bp, Homo sapiens
ttgtgagagtttaccttgacca

SEQ ID NO: 9174319 - DNA, 22 bp, Homo sapiens
ttgtgagatgatttgaaagtgt

SEQ ID NO: 9174320 - DNA, 22 bp, Homo sapiens
ttgtgatagggcaatttttctc

SEQ ID NO: 9174321 - DNA, 22 bp, Homo sapiens
ttgtgataaaacattagacatt

SEQ ID NO: 9174322 - DNA, 22 bp, Homo sapiens
ttgtgataacagaattcactct

SEQ ID NO: 9174323 - DNA, 22 bp, Homo sapiens
ttgtgcctggggtctgacagcc

SEQ ID NO: 9174324 - DNA, 22 bp, Homo sapiens
ttgtgccattaataaggagttg

SEQ ID NO: 9174325 - DNA, 22 bp, Homo sapiens
ttgtgccaagaacatggaattt

SEQ ID NO: 9174326 - DNA, 22 bp, Homo sapiens
ttgtgcatttctctgagtgtgt

SEQ ID NO: 9174327 - DNA, 22 bp, Homo sapiens
ttgtgcatttctctgagtgtgt

SEQ ID NO: 9174328 - DNA, 22 bp, Homo sapiens
ttgtgcatattaggtacatgct

SEQ ID NO: 9174329 - DNA, 22 bp, Homo sapiens
ttggctggtttcaagaaggcat

SEQ ID NO: 9174330 - DNA, 22 bp, Homo sapiens
ttggctgtatgtacatctgtta

SEQ ID NO: 9174331 - DNA, 22 bp, Homo sapiens
ttggctggttttgagtatgtgc

SEQ ID NO: 9174332 - DNA, 22 bp, Homo sapiens
ttggctggcttctcgacttgtt

SEQ ID NO: 9174333 - DNA, 22 bp, Homo sapiens
ttggctggctacctgggccgag

SEQ ID NO: 9174334 - DNA, 22 bp, Homo sapiens
ttggctgggcacagtgtctcat

SEQ ID NO: 9174335 - DNA, 22 bp, Homo sapiens
ttggctgggcacagtgtctcat

SEQ ID NO: 9174336 - DNA, 22 bp, Homo sapiens
ttggctggtaagccaaatgaaa

SEQ ID NO: 9174337 - DNA, 22 bp, Homo sapiens
ttggctcagtgtgagggagatg

SEQ ID NO: 9174338 - DNA, 22 bp, Homo sapiens
ttggctcaggacccctgtgact

SEQ ID NO: 9174339 - DNA, 20 bp, Homo sapiens
ttggctcatgcaacacctac

SEQ ID NO: 9174340 - DNA, 22 bp, Homo sapiens
ttggctcattaaagatgataat

SEQ ID NO: 9174341 - DNA, 22 bp, Homo sapiens
ttggctcccactaactccagca

SEQ ID NO: 9174342 - DNA, 22 bp, Homo sapiens
ttggctcccactaactccagca

SEQ ID NO: 9174343 - DNA, 22 bp, Homo sapiens
ttggcgcccaggacgccgccgc

SEQ ID NO: 9174344 - DNA, 22 bp, Homo sapiens
ttggctcacctgtctacccaga

SEQ ID NO: 9174345 - DNA, 20 bp, Homo sapiens
ttggctcagatttttatggg

SEQ ID NO: 9174346 - DNA, 22 bp, Homo sapiens
ttggctcagctgggactgttga

SEQ ID NO: 9174347 - DNA, 22 bp, Homo sapiens
ttggccctttatgggatgggca

SEQ ID NO: 9174348 - DNA, 22 bp, Homo sapiens
ttggccctggggccagcttcga

SEQ ID NO: 9174349 - DNA, 22 bp, Homo sapiens
ttggccctgaggaggcagctgc

SEQ ID NO: 9174350 - DNA, 22 bp, Homo sapiens
ttggccctccacctggctgtgc

SEQ ID NO: 9174351 - DNA, 22 bp, Homo sapiens
ttggcagactgggtcctgggga

SEQ ID NO: 9174352 - DNA, 22 bp, Homo sapiens
ttggcccagactcggggactga

SEQ ID NO: 9174353 - DNA, 22 bp, Homo sapiens
ttgggaaagaatgagaaggtga

SEQ ID NO: 9174354 - DNA, 22 bp, Homo sapiens
ttgggaaagccacaaattggag

SEQ ID NO: 9174355 - DNA, 22 bp, Homo sapiens
ttgggaaagggattatgagtag

SEQ ID NO: 9174356 - DNA, 22 bp, Homo sapiens
ttgggaagaaacatgtccatca

SEQ ID NO: 9174357 - DNA, 22 bp, Homo sapiens
ttggctttagacctgagactgt

SEQ ID NO: 9174358 - DNA, 22 bp, Homo sapiens
ttggctttacaagcagtggcac

SEQ ID NO: 9174359 - DNA, 22 bp, Homo sapiens
ttggctttcaggctggaaatct

SEQ ID NO: 9174360 - DNA, 22 bp, Homo sapiens
ttggcttttatgcagcttaggt

SEQ ID NO: 9174361 - DNA, 18 bp, Homo sapiens
ttggctttgagaactggt

SEQ ID NO: 9174362 - DNA, 22 bp, Homo sapiens
ttggcttcttttctagacagaa

SEQ ID NO: 9174363 - DNA, 22 bp, Homo sapiens
ttggcttcttgtgaaatctgag

SEQ ID NO: 9174364 - DNA, 22 bp, Homo sapiens
ttggcttcttcgcacagcagta

SEQ ID NO: 9174365 - DNA, 22 bp, Homo sapiens
ttggcttcttcgcacagcagta

SEQ ID NO: 9174366 - DNA, 22 bp, Homo sapiens
ttggcttctgatgtattcctga

SEQ ID NO: 9174367 - DNA, 22 bp, Homo sapiens
ttggcttccaggatctcagcag

SEQ ID NO: 9174368 - DNA, 22 bp, Homo sapiens
ttggcttcaatgtcagagacag

SEQ ID NO: 9174369 - DNA, 22 bp, Homo sapiens
ttggcttcaatgtcagagacag

SEQ ID NO: 9174370 - DNA, 22 bp, Homo sapiens
ttggggagttaatgccaaagat

SEQ ID NO: 9174371 - DNA, 22 bp, Homo sapiens
ttggggcagagaggatacggca

SEQ ID NO: 9174372 - DNA, 22 bp, Homo sapiens
ttggggagttaatgccaaagat

SEQ ID NO: 9174373 - DNA, 23 bp, Homo sapiens
ttggggacaaacatgctactttc

SEQ ID NO: 9174374 - DNA, 22 bp, Homo sapiens
ttggggagaaatgaaatgaagt

SEQ ID NO: 9174375 - DNA, 22 bp, Homo sapiens
ttgggctggcccttgtctctgg

SEQ ID NO: 9174376 - DNA, 22 bp, Homo sapiens
ttgggctggcccttgtctctgg

SEQ ID NO: 9174377 - DNA, 22 bp, Homo sapiens
ttgggctggcagaggtggtctt

SEQ ID NO: 9174378 - DNA, 22 bp, Homo sapiens
ttgggctggcagaggtggtctt

SEQ ID NO: 9174379 - DNA, 22 bp, Homo sapiens
ttgggctcaggagtttgagacc

SEQ ID NO: 9174380 - DNA, 21 bp, Homo sapiens
ttgggccttttctggtagctt

SEQ ID NO: 9174381 - DNA, 22 bp, Homo sapiens
ttgggctcaggagtttgagacc

SEQ ID NO: 9174382 - DNA, 22 bp, Homo sapiens
ttgggctcaggagtttgagacc

SEQ ID NO: 9174383 - DNA, 22 bp, Homo sapiens
ttgggctgatctgtggaagaag

SEQ ID NO: 9174384 - DNA, 22 bp, Homo sapiens
ttgggctggagatgatctgctg

SEQ ID NO: 9174385 - DNA, 22 bp, Homo sapiens
ttgggctggataagtctttgtt

SEQ ID NO: 9174386 - DNA, 22 bp, Homo sapiens
ttttagaaggaatgctatggtg

SEQ ID NO: 9174387 - DNA, 22 bp, Homo sapiens
ttttagaaatactgatttagtg

SEQ ID NO: 9174388 - DNA, 22 bp, Homo sapiens
ttttagaaatactgatttagtg

SEQ ID NO: 9174389 - DNA, 22 bp, Homo sapiens
ttttagaaagatccctggcagg

SEQ ID NO: 9174390 - DNA, 22 bp, Homo sapiens
ttttagaaatactgatttagtg

SEQ ID NO: 9174391 - DNA, 22 bp, Homo sapiens
ttttactttggatacagtactt

SEQ ID NO: 9174392 - DNA, 22 bp, Homo sapiens
ttttagaaagatccctggcagg

SEQ ID NO: 9174393 - DNA, 22 bp, Homo sapiens
ttttagaaagatccctggcagg

SEQ ID NO: 9174394 - DNA, 22 bp, Homo sapiens
ttttacattgggaaatgcctct

SEQ ID NO: 9174395 - DNA, 22 bp, Homo sapiens
ttttacttaattcttggtcatg

SEQ ID NO: 9174396 - DNA, 22 bp, Homo sapiens
ttttactttggatacagtactt

SEQ ID NO: 9174397 - DNA, 22 bp, Homo sapiens
ttttacttcattcctgacttca

SEQ ID NO: 9174398 - DNA, 22 bp, Homo sapiens
ttttacttaattcttggtcatg

SEQ ID NO: 9174399 - DNA, 22 bp, Homo sapiens
ttttattggtaatgataaaagt

SEQ ID NO: 9174400 - DNA, 22 bp, Homo sapiens
ttttattggtaatgataaaagt

SEQ ID NO: 9174401 - DNA, 22 bp, Homo sapiens
ttttattggtaatgataaaagt

SEQ ID NO: 9174402 - DNA, 22 bp, Homo sapiens
ttttattggtaatgataaaagt

SEQ ID NO: 9174403 - DNA, 22 bp, Homo sapiens
ttttattgggagtcctctactg

SEQ ID NO: 9174404 - DNA, 22 bp, Homo sapiens
ttttattgggagtcctctactg

SEQ ID NO: 9174405 - DNA, 22 bp, Homo sapiens
ttttagaagtgcctatcctatg

SEQ ID NO: 9174406 - DNA, 22 bp, Homo sapiens
ttttagaaggaatgctatggtg

SEQ ID NO: 9174407 - DNA, 22 bp, Homo sapiens
ttttagaagtgcctatcctatg

SEQ ID NO: 9174408 - DNA, 22 bp, Homo sapiens
ttttagaagtgcctatcctatg

SEQ ID NO: 9174409 - DNA, 22 bp, Homo sapiens
ttttcaagggcagggaaatcat

SEQ ID NO: 9174410 - DNA, 22 bp, Homo sapiens
ttttcaagggcagggaaatcat

SEQ ID NO: 9174411 - DNA, 22 bp, Homo sapiens
ttttcacacaaggtgataagtt

SEQ ID NO: 9174412 - DNA, 22 bp, Homo sapiens
ttttattgtctgtattgcctat

SEQ ID NO: 9174413 - DNA, 16 bp, Homo sapiens
ttttattgtgacagcc

SEQ ID NO: 9174414 - DNA, 16 bp, Homo sapiens
ttttattgtgacagcc

SEQ ID NO: 9174415 - DNA, 22 bp, Homo sapiens
ttttattgtctcccagttctgg

SEQ ID NO: 9174416 - DNA, 22 bp, Homo sapiens
ttttattgtctcccagttctgg

SEQ ID NO: 9174417 - DNA, 22 bp, Homo sapiens
ttttattgtctcccagttctgg

SEQ ID NO: 9174418 - DNA, 22 bp, Homo sapiens
ttttattgtctgtattgcctat

SEQ ID NO: 9174419 - DNA, 22 bp, Homo sapiens
ttttattgtcaatgaagacaga

SEQ ID NO: 9174420 - DNA, 22 bp, Homo sapiens
ttttattgtcaatgaagacaga

SEQ ID NO: 9174421 - DNA, 22 bp, Homo sapiens
ttttattgtcaatgaagacaga

SEQ ID NO: 9174422 - DNA, 22 bp, Homo sapiens
ttttattggtaatgataaaagt

SEQ ID NO: 9174423 - DNA, 22 bp, Homo sapiens
ttttattggtaatgataaaagt

SEQ ID NO: 9174424 - DNA, 22 bp, Homo sapiens
ttttaattttagcccttctggt

SEQ ID NO: 9174425 - DNA, 22 bp, Homo sapiens
ttttaattttgcaaatctggtg

SEQ ID NO: 9174426 - DNA, 23 bp, Homo sapiens
ttttaatttggacataagaagat

SEQ ID NO: 9174427 - DNA, 23 bp, Homo sapiens
ttttaatttggacataagaagat

SEQ ID NO: 9174428 - DNA, 22 bp, Homo sapiens
tttgtggcaggagcggagaccg

SEQ ID NO: 9174429 - DNA, 23 bp, Homo sapiens
tttgtgcagaagacaaagtggcc

SEQ ID NO: 9174430 - DNA, 22 bp, Homo sapiens
tttgtgcaggtataggcggaga

SEQ ID NO: 9174431 - DNA, 20 bp, Homo sapiens
tttgtgccaagtagccagtg

SEQ ID NO: 9174432 - DNA, 19 bp, Homo sapiens
tttgtgccaggaaggttgt

SEQ ID NO: 9174433 - DNA, 19 bp, Homo sapiens
tttgtgccattcttggggc

SEQ ID NO: 9174434 - DNA, 22 bp, Homo sapiens
tttgtgcctcatcatccaaggt

SEQ ID NO: 9174435 - DNA, 22 bp, Homo sapiens
tttgtgccctgcatgtgccttt

SEQ ID NO: 9174436 - DNA, 22 bp, Homo sapiens
tttgtgccctgtagatccccag

SEQ ID NO: 9174437 - DNA, 22 bp, Homo sapiens
tttgtgcctatacatgcgactg

SEQ ID NO: 9174438 - DNA, 22 bp, Homo sapiens
tttgtggcaggagcggagaccg

SEQ ID NO: 9174439 - DNA, 22 bp, Homo sapiens
tttgtcttatccaatctctcag

SEQ ID NO: 9174440 - DNA, 22 bp, Homo sapiens
tttgtcttccccctttaatcag

SEQ ID NO: 9174441 - DNA, 19 bp, Homo sapiens
tttgtcctgccctttctca

SEQ ID NO: 9174442 - DNA, 20 bp, Homo sapiens
tttgtctgttaagtgtttct

SEQ ID NO: 9174443 - DNA, 19 bp, Homo sapiens
tttgtctctgaataatatt

SEQ ID NO: 9174444 - DNA, 22 bp, Homo sapiens
ttttggcttaaagagaatgtat

SEQ ID NO: 9174445 - DNA, 19 bp, Homo sapiens
ttttggctggagtgatctg

SEQ ID NO: 9174446 - DNA, 22 bp, Homo sapiens
ttttggctgtagctggaaatct

SEQ ID NO: 9174447 - DNA, 22 bp, Homo sapiens
ttttggctgtagctggaaatct

SEQ ID NO: 9174448 - DNA, 22 bp, Homo sapiens
ttttggctctgtctgtatcttt

SEQ ID NO: 9174449 - DNA, 22 bp, Homo sapiens
ttttggctctgtctgtatcttt

SEQ ID NO: 9174450 - DNA, 22 bp, Homo sapiens
ttttccttctagagcagatttc

SEQ ID NO: 9174451 - DNA, 19 bp, Homo sapiens
ttttccttctatatgtttc

SEQ ID NO: 9174452 - DNA, 22 bp, Homo sapiens
ttttccttctagagcagatttc

SEQ ID NO: 9174453 - DNA, 22 bp, Homo sapiens
ttttggtagccaacaaaatgtt

SEQ ID NO: 9174454 - DNA, 22 bp, Homo sapiens
ttttggtcaacagtacatgcgg

SEQ ID NO: 9174455 - DNA, 22 bp, Homo sapiens
ttttggtagaatcaacaatgta

SEQ ID NO: 9174456 - DNA, 22 bp, Homo sapiens
ttttcctcacctaactcaaggt

SEQ ID NO: 9174457 - DNA, 22 bp, Homo sapiens
ttttcctagtaggcctattaga

SEQ ID NO: 9174458 - DNA, 23 bp, Homo sapiens
ttttccagaatcgactctgtaga

SEQ ID NO: 9174459 - DNA, 21 bp, Homo sapiens
ttttcccactgaaagctccca

SEQ ID NO: 9174460 - DNA, 20 bp, Homo sapiens
ttttcctcgtgtttgttcta

SEQ ID NO: 9174461 - DNA, 22 bp, Homo sapiens
ttttccttagcttctctgcgag

SEQ ID NO: 9174462 - DNA, 22 bp, Homo sapiens
ttttccttcatatcccttatgt

SEQ ID NO: 9174463 - DNA, 22 bp, Homo sapiens
ttttccttcatatcccttatgt

SEQ ID NO: 9174464 - DNA, 22 bp, Homo sapiens
ttttccttcacctcttgagcct

SEQ ID NO: 9174465 - DNA, 22 bp, Homo sapiens
ttttccttcacctcttgagcct

SEQ ID NO: 9174466 - DNA, 22 bp, Homo sapiens
ttttgtatgagaagtgctttac

SEQ ID NO: 9174467 - DNA, 22 bp, Homo sapiens
ttttgtatcctccctttcactg

SEQ ID NO: 9174468 - DNA, 22 bp, Homo sapiens
ttttgtatagtcaaagacaaga

SEQ ID NO: 9174469 - DNA, 22 bp, Homo sapiens
ttttgtatagtcaaagacaaga

SEQ ID NO: 9174470 - DNA, 17 bp, Homo sapiens
ttttgttcatcttcaaa

SEQ ID NO: 9174471 - DNA, 22 bp, Homo sapiens
tttttgtagtcattagaagagg

SEQ ID NO: 9174472 - DNA, 22 bp, Homo sapiens
tttttgtatagaaatgaactaa

SEQ ID NO: 9174473 - DNA, 22 bp, Homo sapiens
ttttgtgagcccataaatgcca

SEQ ID NO: 9174474 - DNA, 22 bp, Homo sapiens
tttttgttcccagagaatttgt

SEQ ID NO: 9174475 - DNA, 22 bp, Homo sapiens
tttttgttcccagagaatttgt

SEQ ID NO: 9174476 - DNA, 22 bp, Homo sapiens
tttttgttgcagagaggccact

SEQ ID NO: 9174477 - DNA, 22 bp, Homo sapiens
tttttgttctgattatactggt

SEQ ID NO: 9174478 - DNA, 22 bp, Homo sapiens
tttttgtggtgcagactaaagc

SEQ ID NO: 9174479 - DNA, 22 bp, Homo sapiens
tttttgtctagcgtctctagtt

SEQ ID NO: 9174480 - DNA, 22 bp, Homo sapiens
ttttttatatcaactgaagtct

SEQ ID NO: 9174481 - DNA, 22 bp, Homo sapiens
ttttttatagcaatgaacccac

SEQ ID NO: 9174482 - DNA, 22 bp, Homo sapiens
ttttttatctatggtagtacca

SEQ ID NO: 9174483 - DNA, 22 bp, Homo sapiens
ttttttatctatggtagtacca

SEQ ID NO: 9174484 - DNA, 22 bp, Homo sapiens
ttttttcagcctgtctgtgcca

SEQ ID NO: 9174485 - DNA, 22 bp, Homo sapiens
ttttttccaacttaagacttca

SEQ ID NO: 9174486 - DNA, 22 bp, Homo sapiens
tttctaggacatgataggatat

SEQ ID NO: 9174487 - DNA, 22 bp, Homo sapiens
tttctagctgtaggaagctgag

SEQ ID NO: 9174488 - DNA, 22 bp, Homo sapiens
tttctagatgcggggcttgtgc

SEQ ID NO: 9174489 - DNA, 22 bp, Homo sapiens
tttctagtcctcatgcatcatt

SEQ ID NO: 9174490 - DNA, 22 bp, Homo sapiens
tttctagtcctcatgcatcatt

SEQ ID NO: 9174491 - DNA, 22 bp, Homo sapiens
tttctagtcctcatgcatcatt

SEQ ID NO: 9174492 - DNA, 22 bp, Homo sapiens
tttctagtatataactagatct

SEQ ID NO: 9174493 - DNA, 22 bp, Homo sapiens
tttctagtatataactagatct

SEQ ID NO: 9174494 - DNA, 22 bp, Homo sapiens
tttctaggtgttcacagagcat

SEQ ID NO: 9174495 - DNA, 22 bp, Homo sapiens
tttctagtgggtattccctgtt

SEQ ID NO: 9174496 - DNA, 19 bp, Homo sapiens
tttctagtttcagcttgtc

SEQ ID NO: 9174497 - DNA, 22 bp, Homo sapiens
tttctagttctaccacagtaat

SEQ ID NO: 9174498 - DNA, 22 bp, Homo sapiens
tttctataactggactggattg

SEQ ID NO: 9174499 - DNA, 22 bp, Homo sapiens
tttgaaatctaatcaaggaaca

SEQ ID NO: 9174500 - DNA, 22 bp, Homo sapiens
tttgaaatatgtgtcttttgaa

SEQ ID NO: 9174501 - DNA, 22 bp, Homo sapiens
tttgaaatctaatcaaggaaca

SEQ ID NO: 9174502 - DNA, 22 bp, Homo sapiens
tttctatatgaggagctaaagt

SEQ ID NO: 9174503 - DNA, 20 bp, Homo sapiens
tttctatggggccagcacat

SEQ ID NO: 9174504 - DNA, 22 bp, Homo sapiens
tttgacattgccaatttgctca

SEQ ID NO: 9174505 - DNA, 22 bp, Homo sapiens
tttgacattggcttattctgtt

SEQ ID NO: 9174506 - DNA, 22 bp, Homo sapiens
tttgacattgccaatttgctca

SEQ ID NO: 9174507 - DNA, 22 bp, Homo sapiens
tttgagaaggtgacaaattcta

SEQ ID NO: 9174508 - DNA, 22 bp, Homo sapiens
tttgacatggaataactcattt

SEQ ID NO: 9174509 - DNA, 22 bp, Homo sapiens
tttgacatctaagaattcttac

SEQ ID NO: 9174510 - DNA, 22 bp, Homo sapiens
tttgacatgcaaagcactttag

SEQ ID NO: 9174511 - DNA, 22 bp, Homo sapiens
tttgacattatcctgttactgg

SEQ ID NO: 9174512 - DNA, 22 bp, Homo sapiens
tttgacattaaggaacatatat

SEQ ID NO: 9174513 - DNA, 22 bp, Homo sapiens
tttgacagcttgcagtgagacc

SEQ ID NO: 9174514 - DNA, 22 bp, Homo sapiens
tttgacagtcccctgatgtttg

SEQ ID NO: 9174515 - DNA, 22 bp, Homo sapiens
tttgacatctaagaattcttac

SEQ ID NO: 9174516 - DNA, 22 bp, Homo sapiens
tttgacatcaataccctagaat

SEQ ID NO: 9174517 - DNA, 22 bp, Homo sapiens
tttgacatcactgacctgtttt

SEQ ID NO: 9174518 - DNA, 22 bp, Homo sapiens
tttgaaccccgaccaaacactg

SEQ ID NO: 9174519 - DNA, 22 bp, Homo sapiens
tttgaacctgagcttctgcatg

SEQ ID NO: 9174520 - DNA, 22 bp, Homo sapiens
tttgaactcagcttcagacaac

SEQ ID NO: 9174521 - DNA, 23 bp, Homo sapiens
tttgaagaagtgaatatcatata

SEQ ID NO: 9174522 - DNA, 21 bp, Homo sapiens
tttgagaattggtcagagtgc

SEQ ID NO: 9174523 - DNA, 22 bp, Homo sapiens
tttgcagtgtcagcttctgtgt

SEQ ID NO: 9174524 - DNA, 22 bp, Homo sapiens
tttgcagtgattcttgcagtga

SEQ ID NO: 9174525 - DNA, 22 bp, Homo sapiens
tttgagatggagtcttgctctg

SEQ ID NO: 9174526 - DNA, 22 bp, Homo sapiens
tttgcagtttgttcagctcttt

SEQ ID NO: 9174527 - DNA, 22 bp, Homo sapiens
tttgcagtttcattgctgaaat

SEQ ID NO: 9174528 - DNA, 22 bp, Homo sapiens
tttgcagtttcattgctgaaat

SEQ ID NO: 9174529 - DNA, 22 bp, Homo sapiens
tttgcagttcatgttggaaaat

SEQ ID NO: 9174530 - DNA, 22 bp, Homo sapiens
tttgcagttccatccaggcaga

SEQ ID NO: 9174531 - DNA, 22 bp, Homo sapiens
tttgcagttcatctgagaaaaa

SEQ ID NO: 9174532 - DNA, 22 bp, Homo sapiens
tttgcagttcatctgagaaaaa

SEQ ID NO: 9174533 - DNA, 22 bp, Homo sapiens
tttgcagtgttcatcagtattt

SEQ ID NO: 9174534 - DNA, 22 bp, Homo sapiens
tttgcatacatgagaatgtctt

SEQ ID NO: 9174535 - DNA, 22 bp, Homo sapiens
tttgcataggatggacatttta

SEQ ID NO: 9174536 - DNA, 22 bp, Homo sapiens
tttgcataagtcatgtccagtg

SEQ ID NO: 9174537 - DNA, 22 bp, Homo sapiens
tttgcataagtcatgtccagtg

SEQ ID NO: 9174538 - DNA, 22 bp, Homo sapiens
tttgcataaaggagcatttctc

SEQ ID NO: 9174539 - DNA, 22 bp, Homo sapiens
tttgcataaaggagcatttctc

SEQ ID NO: 9174540 - DNA, 22 bp, Homo sapiens
tttgcattcctgcctgcattca

SEQ ID NO: 9174541 - DNA, 22 bp, Homo sapiens
tttgcttgacccttgtgctgaa

SEQ ID NO: 9174542 - DNA, 22 bp, Homo sapiens
tttgcttaaagttctttctggt

SEQ ID NO: 9174543 - DNA, 20 bp, Homo sapiens
tttgctgtgggtgtaagaat

SEQ ID NO: 9174544 - DNA, 22 bp, Homo sapiens
tttgctgtgggatatccatgtg

SEQ ID NO: 9174545 - DNA, 22 bp, Homo sapiens
tttgctgtgcttacatatgtat

SEQ ID NO: 9174546 - DNA, 22 bp, Homo sapiens
tttgctgtcagccgctattttc

SEQ ID NO: 9174547 - DNA, 22 bp, Homo sapiens
tttgctgactggatgcagttgg

SEQ ID NO: 9174548 - DNA, 22 bp, Homo sapiens
tttgctgactggatgcagttgg

SEQ ID NO: 9174549 - DNA, 22 bp, Homo sapiens
tttgctgaccccattctgagtc

SEQ ID NO: 9174550 - DNA, 22 bp, Homo sapiens
tttgctgaataaatgtgtgact

SEQ ID NO: 9174551 - DNA, 21 bp, Homo sapiens
tttgctgaagattttaggctg

SEQ ID NO: 9174552 - DNA, 22 bp, Homo sapiens
tttgctgaataaatgtgtgact

SEQ ID NO: 9174553 - DNA, 22 bp, Homo sapiens
tttgctgaatagattgtaaact

SEQ ID NO: 9174554 - DNA, 22 bp, Homo sapiens
tttgctgatattttgctgatac

SEQ ID NO: 9174555 - DNA, 22 bp, Homo sapiens
tttgctgaggtgaggtgaaggt

SEQ ID NO: 9174556 - DNA, 22 bp, Homo sapiens
tttgctgagttgaagtttgagg

SEQ ID NO: 9174557 - DNA, 22 bp, Homo sapiens
tttggctgtgtgctcccttttc

SEQ ID NO: 9174558 - DNA, 22 bp, Homo sapiens
tttggctgtcatttgaaaatgt

SEQ ID NO: 9174559 - DNA, 22 bp, Homo sapiens
tttggctgaagaccagattaaa

SEQ ID NO: 9174560 - DNA, 22 bp, Homo sapiens
tttggctcttcccgtaccataa

SEQ ID NO: 9174561 - DNA, 22 bp, Homo sapiens
tttggctggatgatagaactaa

SEQ ID NO: 9174562 - DNA, 23 bp, Homo sapiens
tttggctgggctgtgggcacacc

SEQ ID NO: 9174563 - DNA, 22 bp, Homo sapiens
tttggctgagaagttgtgcttt

SEQ ID NO: 9174564 - DNA, 22 bp, Homo sapiens
tttggcttaacttacatgatat

SEQ ID NO: 9174565 - DNA, 22 bp, Homo sapiens
tttggctcatctcagtcctagg

SEQ ID NO: 9174566 - DNA, 23 bp, Homo sapiens
tttggctccatgggtggctcatt

SEQ ID NO: 9174567 - DNA, 22 bp, Homo sapiens
tttggctcgatggactttgaat

SEQ ID NO: 9174568 - DNA, 22 bp, Homo sapiens
tttggctcggctgctgatggtg

SEQ ID NO: 9174569 - DNA, 22 bp, Homo sapiens
tttggctctagtaaatataacc

SEQ ID NO: 9174570 - DNA, 19 bp, Homo sapiens
tttggctctggtcagagag

SEQ ID NO: 9174571 - DNA, 22 bp, Homo sapiens
tttggccaacaacatggaagct

SEQ ID NO: 9174572 - DNA, 22 bp, Homo sapiens
tttggccacttgggagtccagg

SEQ ID NO: 9174573 - DNA, 22 bp, Homo sapiens
tttggcctcgtttagaaatggc

SEQ ID NO: 9174574 - DNA, 22 bp, Homo sapiens
tttggccatgctcaagggtata

SEQ ID NO: 9174575 - DNA, 22 bp, Homo sapiens
tttggccatgctcaagggtata

SEQ ID NO: 9174576 - DNA, 18 bp, Homo sapiens
tttggccatgacctggct

SEQ ID NO: 9174577 - DNA, 22 bp, Homo sapiens
tttggtaaccttgcattcttta

SEQ ID NO: 9174578 - DNA, 22 bp, Homo sapiens
tttgtcctctccatgtacaata

SEQ ID NO: 9174579 - DNA, 22 bp, Homo sapiens
tttgggctcccacaggcttgtg

SEQ ID NO: 9174580 - DNA, 22 bp, Homo sapiens
tttgggcagtagatgtatcact

SEQ ID NO: 9174581 - DNA, 22 bp, Homo sapiens
tttggggaaccactgaggtagg

SEQ ID NO: 9174582 - DNA, 22 bp, Homo sapiens
tttggggagacatggccagctg

SEQ ID NO: 9174583 - DNA, 22 bp, Homo sapiens
tttgggttccttgagcttaatg

SEQ ID NO: 9174584 - DNA, 22 bp, Homo sapiens
tttggtaaatgcaggttcttct

SEQ ID NO: 9174585 - DNA, 22 bp, Homo sapiens
ttttttccaggaagccactgga

SEQ ID NO: 9174586 - DNA, 22 bp, Homo sapiens
ttttttcctctgtgatggcaaa

SEQ ID NO: 9174587 - DNA, 22 bp, Homo sapiens
ttttttccagcttctagaggcc

SEQ ID NO: 9174588 - DNA, 22 bp, Homo sapiens
ttttttccttcatgacttaaga

SEQ ID NO: 9174589 - DNA, 22 bp, Homo sapiens
ttttttcctgagccttgtggtc

SEQ ID NO: 9174590 - DNA, 22 bp, Homo sapiens
atatcattctgatgtatatctt

SEQ ID NO: 9174591 - DNA, 22 bp, Homo sapiens
atatgaaagtaagcatgtgtgt

SEQ ID NO: 9174592 - DNA, 22 bp, Homo sapiens
atatatgcatgtgtacttatgt

SEQ ID NO: 9174593 - DNA, 22 bp, Homo sapiens
atatatcatgagtaaaacttga

SEQ ID NO: 9174594 - DNA, 22 bp, Homo sapiens
atatgaagtcagacaaactggg

SEQ ID NO: 9174595 - DNA, 22 bp, Homo sapiens
atatgaagaatctaggataggc

SEQ ID NO: 9174596 - DNA, 22 bp, Homo sapiens
atatgaagaattccaatttgga

SEQ ID NO: 9174597 - DNA, 22 bp, Homo sapiens
atatgaagttacaggtaagaaa

SEQ ID NO: 9174598 - DNA, 22 bp, Homo sapiens
atatgacagcggattcacatat

SEQ ID NO: 9174599 - DNA, 22 bp, Homo sapiens
atatgacataaaatcatttttg

SEQ ID NO: 9174600 - DNA, 22 bp, Homo sapiens
atatgattccactattgtatgg

SEQ ID NO: 9174601 - DNA, 20 bp, Homo sapiens
ctgggcaggtgtttgatctc

SEQ ID NO: 9174602 - DNA, 22 bp, Homo sapiens
ctgggcaggatacttcatggga

SEQ ID NO: 9174603 - DNA, 22 bp, Homo sapiens
ctgggcaggtatacaaaaaatg

SEQ ID NO: 9174604 - DNA, 22 bp, Homo sapiens
ctgggcagtatgaatattcaaa

SEQ ID NO: 9174605 - DNA, 22 bp, Homo sapiens
ctgggcagtatgaatattcaaa

SEQ ID NO: 9174606 - DNA, 22 bp, Homo sapiens
ctgggcagtgcagctatagaac

SEQ ID NO: 9174607 - DNA, 22 bp, Homo sapiens
atatgattgtccttagcaaatt

SEQ ID NO: 9174608 - DNA, 22 bp, Homo sapiens
atatgattccactattgtatgg

SEQ ID NO: 9174609 - DNA, 22 bp, Homo sapiens
ctgggcaggagggctctatgga

SEQ ID NO: 9174610 - DNA, 22 bp, Homo sapiens
ctgggcaggagggctctatgga

SEQ ID NO: 9174611 - DNA, 22 bp, Homo sapiens
ctgggcaggagggctctatgga

SEQ ID NO: 9174612 - DNA, 22 bp, Homo sapiens
ctgggcagtggtggcatctttg

SEQ ID NO: 9174613 - DNA, 22 bp, Homo sapiens
ctgggcagtggtggcatctttg

SEQ ID NO: 9174614 - DNA, 22 bp, Homo sapiens
ctgggcagtgggcaagttgtat

SEQ ID NO: 9174615 - DNA, 22 bp, Homo sapiens
ctgggcagtggtggcccttccc

SEQ ID NO: 9174616 - DNA, 22 bp, Homo sapiens
atatgctattgctgtaatttaa

SEQ ID NO: 9174617 - DNA, 20 bp, Homo sapiens
atatgcttaatctcactaca

SEQ ID NO: 9174618 - DNA, 22 bp, Homo sapiens
atatgcttacactacaagatga

SEQ ID NO: 9174619 - DNA, 22 bp, Homo sapiens
atatggctctggctctgccttg

SEQ ID NO: 9174620 - DNA, 22 bp, Homo sapiens
atatgtgtacgtgcagtatata

SEQ ID NO: 9174621 - DNA, 22 bp, Homo sapiens
atatgtgaagtgggttattttg

SEQ ID NO: 9174622 - DNA, 22 bp, Homo sapiens
atatgtcttgtttacagccttg

SEQ ID NO: 9174623 - DNA, 22 bp, Homo sapiens
atatgtcttgtttacagccttg

SEQ ID NO: 9174624 - DNA, 22 bp, Homo sapiens
atatgtccacctgtatgctaaa

SEQ ID NO: 9174625 - DNA, 23 bp, Homo sapiens
atatgtcatgcaccagcacttta

SEQ ID NO: 9174626 - DNA, 22 bp, Homo sapiens
atatgtcctcggcacataatgt

SEQ ID NO: 9174627 - DNA, 22 bp, Homo sapiens
atatgtctatagagcctgtggg

SEQ ID NO: 9174628 - DNA, 22 bp, Homo sapiens
atatgtctctgtacaacagtct

SEQ ID NO: 9174629 - DNA, 22 bp, Homo sapiens
atatgtcaagattttgagcaga

SEQ ID NO: 9174630 - DNA, 22 bp, Homo sapiens
atatgtgtgtatttcttactag

SEQ ID NO: 9174631 - DNA, 22 bp, Homo sapiens
atatgtgtgccatttcagcagt

SEQ ID NO: 9174632 - DNA, 22 bp, Homo sapiens
atatgtgtgcacatatgtattt

SEQ ID NO: 9174633 - DNA, 20 bp, Homo sapiens
atatgtgtacgtgtatacat

SEQ ID NO: 9174634 - DNA, 22 bp, Homo sapiens
atatgtatgtacgcacatattc

SEQ ID NO: 9174635 - DNA, 20 bp, Homo sapiens
atatttcttaagaactttca

SEQ ID NO: 9174636 - DNA, 22 bp, Homo sapiens
atatttgagggcaatagggtgg

SEQ ID NO: 9174637 - DNA, 22 bp, Homo sapiens
atatttgcattttaaacaggca

SEQ ID NO: 9174638 - DNA, 22 bp, Homo sapiens
atatttgcaggaaactagtttt

SEQ ID NO: 9174639 - DNA, 22 bp, Homo sapiens
atatttgctgagaaggagggag

SEQ ID NO: 9174640 - DNA, 22 bp, Homo sapiens
atatttgtagtgggtaagaagt

SEQ ID NO: 9174641 - DNA, 22 bp, Homo sapiens
atatttagctcatttccagtgc

SEQ ID NO: 9174642 - DNA, 22 bp, Homo sapiens
atatttagctcatttccagtgc

SEQ ID NO: 9174643 - DNA, 22 bp, Homo sapiens
atatgttactctttcaagcaga

SEQ ID NO: 9174644 - DNA, 22 bp, Homo sapiens
atatgttagggaacaatttgag

SEQ ID NO: 9174645 - DNA, 19 bp, Homo sapiens
ctgggaggtgttcagagaa

SEQ ID NO: 9174646 - DNA, 22 bp, Homo sapiens
ctgggcaatatgctgggcctgg

SEQ ID NO: 9174647 - DNA, 22 bp, Homo sapiens
ctgggcacagcgttgggctctt

SEQ ID NO: 9174648 - DNA, 22 bp, Homo sapiens
atatatatcgagttcatgtctc

SEQ ID NO: 9174649 - DNA, 20 bp, Homo sapiens
ctgggcacctgtctgcagtt

SEQ ID NO: 9174650 - DNA, 23 bp, Homo sapiens
ctgggcacccagtacctaggccc

SEQ ID NO: 9174651 - DNA, 20 bp, Homo sapiens
ctgggcacctgtctgcagtt

SEQ ID NO: 9174652 - DNA, 22 bp, Homo sapiens
ctgggactttgtaggccagttg

SEQ ID NO: 9174653 - DNA, 22 bp, Homo sapiens
atatatatcgagttcatgtctc

SEQ ID NO: 9174654 - DNA, 22 bp, Homo sapiens
atatatactttgacacattctg

SEQ ID NO: 9174655 - DNA, 22 bp, Homo sapiens
atatatacaactagattaaaag

SEQ ID NO: 9174656 - DNA, 22 bp, Homo sapiens
atatatacaactagattaaaag

SEQ ID NO: 9174657 - DNA, 22 bp, Homo sapiens
ctgggagaggaacctcgagggt

SEQ ID NO: 9174658 - DNA, 22 bp, Homo sapiens
ctgggagacgcagctggggatc

SEQ ID NO: 9174659 - DNA, 22 bp, Homo sapiens
ctgggagacaagagagggctga

SEQ ID NO: 9174660 - DNA, 22 bp, Homo sapiens
ctgggagaatttgttgaaggat

SEQ ID NO: 9174661 - DNA, 22 bp, Homo sapiens
ctgggagaatttgttgaaggat

SEQ ID NO: 9174662 - DNA, 22 bp, Homo sapiens
ctgggaaggggaaggtcctctc

SEQ ID NO: 9174663 - DNA, 22 bp, Homo sapiens
ctgggaaggggaaggtcctctc

SEQ ID NO: 9174664 - DNA, 22 bp, Homo sapiens
ctgggaagtagaatcagatgag

SEQ ID NO: 9174665 - DNA, 22 bp, Homo sapiens
ctgggaaggggaaggtcctctc

SEQ ID NO: 9174666 - DNA, 22 bp, Homo sapiens
ctgggaagtagaatcagatgag

SEQ ID NO: 9174667 - DNA, 22 bp, Homo sapiens
ctgggaagtggtgagggcctga

SEQ ID NO: 9174668 - DNA, 22 bp, Homo sapiens
ctgggaagtggtgagggcctga

SEQ ID NO: 9174669 - DNA, 22 bp, Homo sapiens
ctgggaagtggtgagggcctga

SEQ ID NO: 9174670 - DNA, 22 bp, Homo sapiens
ctgggaagccatgtttctagga

SEQ ID NO: 9174671 - DNA, 22 bp, Homo sapiens
ctgggaagccacagggtgtggg

SEQ ID NO: 9174672 - DNA, 22 bp, Homo sapiens
ctgggaagcttcgagcaggaaa

SEQ ID NO: 9174673 - DNA, 22 bp, Homo sapiens
ctgggaagcttcgagcaggaaa

SEQ ID NO: 9174674 - DNA, 22 bp, Homo sapiens
ctgggaaggagggttgcgaagg

SEQ ID NO: 9174675 - DNA, 22 bp, Homo sapiens
ctgggaagggacgccagtgcct

SEQ ID NO: 9174676 - DNA, 22 bp, Homo sapiens
ctgggaagggagtcaagatact

SEQ ID NO: 9174677 - DNA, 22 bp, Homo sapiens
ctgggaagggagtcaagatact

SEQ ID NO: 9174678 - DNA, 22 bp, Homo sapiens
ctgggaagggacgccagtgcct

SEQ ID NO: 9174679 - DNA, 22 bp, Homo sapiens
ctgggaagcatggtgatggtat

SEQ ID NO: 9174680 - DNA, 22 bp, Homo sapiens
ctgggaagatggtgacagaatt

SEQ ID NO: 9174681 - DNA, 22 bp, Homo sapiens
ctggcttctgggccagggcaga

SEQ ID NO: 9174682 - DNA, 23 bp, Homo sapiens
ctggcttctggggcctctgtttc

SEQ ID NO: 9174683 - DNA, 22 bp, Homo sapiens
ctggcagctgcccgagatgccc

SEQ ID NO: 9174684 - DNA, 22 bp, Homo sapiens
atatacttttcactaatggcta

SEQ ID NO: 9174685 - DNA, 22 bp, Homo sapiens
atataatacaacctgctaagtg

SEQ ID NO: 9174686 - DNA, 22 bp, Homo sapiens
atatataagctgatgagccaca

SEQ ID NO: 9174687 - DNA, 22 bp, Homo sapiens
atatataagctgatgagccaca

SEQ ID NO: 9174688 - DNA, 22 bp, Homo sapiens
atatataagctgatgagccaca

SEQ ID NO: 9174689 - DNA, 22 bp, Homo sapiens
atatataagctgatgagccaca

SEQ ID NO: 9174690 - DNA, 22 bp, Homo sapiens
atatataatacttgctgtgggc

SEQ ID NO: 9174691 - DNA, 22 bp, Homo sapiens
ctgggacaagctctgtctagct

SEQ ID NO: 9174692 - DNA, 22 bp, Homo sapiens
ctgggaatgagcaggtggctcc

SEQ ID NO: 9174693 - DNA, 22 bp, Homo sapiens
ctgggacacagccttacctggg

SEQ ID NO: 9174694 - DNA, 19 bp, Homo sapiens
ctgggacaatgaaagcatc

SEQ ID NO: 9174695 - DNA, 22 bp, Homo sapiens
atataacatacatacagaaaag

SEQ ID NO: 9174696 - DNA, 22 bp, Homo sapiens
atataacatacatacagaaaag

SEQ ID NO: 9174697 - DNA, 22 bp, Homo sapiens
atataactcttgttcttatagt

SEQ ID NO: 9174698 - DNA, 22 bp, Homo sapiens
atataactcttgttcttatagt

SEQ ID NO: 9174699 - DNA, 20 bp, Homo sapiens
atataataaattttggttac

SEQ ID NO: 9174700 - DNA, 22 bp, Homo sapiens
atataagttagtggtcatgttt

SEQ ID NO: 9174701 - DNA, 22 bp, Homo sapiens
ctgtctttagtacaaaaaatgt

SEQ ID NO: 9174702 - DNA, 22 bp, Homo sapiens
ctgtctttagtacaaaaaatgt

SEQ ID NO: 9174703 - DNA, 20 bp, Homo sapiens
ctgtcttgtgggcttcccct

SEQ ID NO: 9174704 - DNA, 22 bp, Homo sapiens
ctgtcttcccgaggccctggag

SEQ ID NO: 9174705 - DNA, 22 bp, Homo sapiens
atcacattatgtagtgaaaagg

SEQ ID NO: 9174706 - DNA, 22 bp, Homo sapiens
atcacatggaatgattttagac

SEQ ID NO: 9174707 - DNA, 22 bp, Homo sapiens
ctgtctttggtcctgtctgtta

SEQ ID NO: 9174708 - DNA, 22 bp, Homo sapiens
ctgtcttttactatcatttact

SEQ ID NO: 9174709 - DNA, 22 bp, Homo sapiens
ctgtctttggtcctgtctgtta

SEQ ID NO: 9174710 - DNA, 22 bp, Homo sapiens
ctgtcttttcatactttccctc

SEQ ID NO: 9174711 - DNA, 22 bp, Homo sapiens
ctgtcttttcatactttccctc

SEQ ID NO: 9174712 - DNA, 22 bp, Homo sapiens
ctgtgagtgagatggccacagg

SEQ ID NO: 9174713 - DNA, 18 bp, Homo sapiens
ctgtcttttttctctcca

SEQ ID NO: 9174714 - DNA, 18 bp, Homo sapiens
ctgtcttttttctctcca

SEQ ID NO: 9174715 - DNA, 18 bp, Homo sapiens
ctgtcttttttctctcca

SEQ ID NO: 9174716 - DNA, 18 bp, Homo sapiens
ctgtcttttttctctcca

SEQ ID NO: 9174717 - DNA, 22 bp, Homo sapiens
ctgtctttttagagagtaggat

SEQ ID NO: 9174718 - DNA, 22 bp, Homo sapiens
ctgtcttttcttctcattgatg

SEQ ID NO: 9174719 - DNA, 22 bp, Homo sapiens
atcatgaatcttgtgttctatg

SEQ ID NO: 9174720 - DNA, 22 bp, Homo sapiens
atcatgactaagtgctgacaca

SEQ ID NO: 9174721 - DNA, 22 bp, Homo sapiens
atcatgtgtaatttcaagctac

SEQ ID NO: 9174722 - DNA, 22 bp, Homo sapiens
atcatgtctatcttagtcacca

SEQ ID NO: 9174723 - DNA, 19 bp, Homo sapiens
ctgtgcaggccgggctgag

SEQ ID NO: 9174724 - DNA, 18 bp, Homo sapiens
ctgtgcagcaaactgagc

SEQ ID NO: 9174725 - DNA, 22 bp, Homo sapiens
ctgtgatgatggaaactttctt

SEQ ID NO: 9174726 - DNA, 22 bp, Homo sapiens
ctgtgatttctaaagagtagca

SEQ ID NO: 9174727 - DNA, 22 bp, Homo sapiens
ctgtgattgttagttcctatac

SEQ ID NO: 9174728 - DNA, 22 bp, Homo sapiens
ctgggtataggaaacagttaag

SEQ ID NO: 9174729 - DNA, 22 bp, Homo sapiens
ctgggtagggcaaggaactggc

SEQ ID NO: 9174730 - DNA, 22 bp, Homo sapiens
ctgggtcaggagcggctgcccg

SEQ ID NO: 9174731 - DNA, 22 bp, Homo sapiens
ctgggtcccaaattctattttc

SEQ ID NO: 9174732 - DNA, 22 bp, Homo sapiens
ctgggtcccacagcctgctggg

SEQ ID NO: 9174733 - DNA, 22 bp, Homo sapiens
atatttgtcaattcactgttca

SEQ ID NO: 9174734 - DNA, 22 bp, Homo sapiens
ctgggtcccaatagcttttgtt

SEQ ID NO: 9174735 - DNA, 22 bp, Homo sapiens
ctgggtcccacagcctgctggg

SEQ ID NO: 9174736 - DNA, 22 bp, Homo sapiens
ctgggtcccggcttctatccac

SEQ ID NO: 9174737 - DNA, 22 bp, Homo sapiens
ctgggtcccctcagtgacactg

SEQ ID NO: 9174738 - DNA, 22 bp, Homo sapiens
ctgggtcccggcttctatccac

SEQ ID NO: 9174739 - DNA, 19 bp, Homo sapiens
ctgggtcctgttcttttac

SEQ ID NO: 9174740 - DNA, 22 bp, Homo sapiens
ctgggtctcaggagttctgagg

SEQ ID NO: 9174741 - DNA, 22 bp, Homo sapiens
ctgggtctaaaaattctcagat

SEQ ID NO: 9174742 - DNA, 22 bp, Homo sapiens
ctgtccagtcagaacgtcatta

SEQ ID NO: 9174743 - DNA, 22 bp, Homo sapiens
ctgtccagtctttagcaagctg

SEQ ID NO: 9174744 - DNA, 22 bp, Homo sapiens
ctgtccagtctttagcaagctg

SEQ ID NO: 9174745 - DNA, 22 bp, Homo sapiens
ctgtcccttcccaagcccagcc

SEQ ID NO: 9174746 - DNA, 22 bp, Homo sapiens
ctgtcccttcattattcactac

SEQ ID NO: 9174747 - DNA, 22 bp, Homo sapiens
ctgtccagtgactttgggccat

SEQ ID NO: 9174748 - DNA, 22 bp, Homo sapiens
ctgtcctcaccttggcaggggg

SEQ ID NO: 9174749 - DNA, 22 bp, Homo sapiens
ctgtcctatgagtactcactag

SEQ ID NO: 9174750 - DNA, 22 bp, Homo sapiens
ctgtcctcaacccatccttctc

SEQ ID NO: 9174751 - DNA, 22 bp, Homo sapiens
ctgtcctccggccacctacagt

SEQ ID NO: 9174752 - DNA, 22 bp, Homo sapiens
ctgtcctccagacgacagtccc

SEQ ID NO: 9174753 - DNA, 22 bp, Homo sapiens
atcacatatatgcaccaagaca

SEQ ID NO: 9174754 - DNA, 22 bp, Homo sapiens
atccaaggggaaagacgtctgg

SEQ ID NO: 9174755 - DNA, 22 bp, Homo sapiens
atccaatggggagtgagttctt

SEQ ID NO: 9174756 - DNA, 22 bp, Homo sapiens
atccaaactatgactagtgttc

SEQ ID NO: 9174757 - DNA, 22 bp, Homo sapiens
atccaaacctggacatgagtgg

SEQ ID NO: 9174758 - DNA, 22 bp, Homo sapiens
atccaaatcatgtcagaagaac

SEQ ID NO: 9174759 - DNA, 22 bp, Homo sapiens
ctgtggagtgcttggctcagtg

SEQ ID NO: 9174760 - DNA, 22 bp, Homo sapiens
ctgtggagtggggagtactggt

SEQ ID NO: 9174761 - DNA, 22 bp, Homo sapiens
ctgtggagtgcttggctcagtg

SEQ ID NO: 9174762 - DNA, 22 bp, Homo sapiens
ctgtggagtgcttggctcagtg

SEQ ID NO: 9174763 - DNA, 22 bp, Homo sapiens
ctgtggagtgcttggctcagtg

SEQ ID NO: 9174764 - DNA, 22 bp, Homo sapiens
ctgtggagcttgtggcagtggg

SEQ ID NO: 9174765 - DNA, 22 bp, Homo sapiens
ctgtggagcttgtggcagtggg

SEQ ID NO: 9174766 - DNA, 22 bp, Homo sapiens
ctgtggagtcctggggaatgga

SEQ ID NO: 9174767 - DNA, 22 bp, Homo sapiens
ctgtggagtcctggggaatgga

SEQ ID NO: 9174768 - DNA, 22 bp, Homo sapiens
ctgtggagtcctggggaatgga

SEQ ID NO: 9174769 - DNA, 22 bp, Homo sapiens
ctgtggaggtaggagcaggaca

SEQ ID NO: 9174770 - DNA, 22 bp, Homo sapiens
ctgtggagatgcagaccaggcc

SEQ ID NO: 9174771 - DNA, 22 bp, Homo sapiens
ctgtggagcagggcagggtcac

SEQ ID NO: 9174772 - DNA, 22 bp, Homo sapiens
atcatgtttagttttaagggct

SEQ ID NO: 9174773 - DNA, 22 bp, Homo sapiens
atcctcagacctcagcaaagcc

SEQ ID NO: 9174774 - DNA, 22 bp, Homo sapiens
atcctcacaacactgcaagatg

SEQ ID NO: 9174775 - DNA, 22 bp, Homo sapiens
atcctcacattctcaggacaac

SEQ ID NO: 9174776 - DNA, 22 bp, Homo sapiens
atcctcagacctcagcaaagcc

SEQ ID NO: 9174777 - DNA, 22 bp, Homo sapiens
atccctggacggcgcctcccca

SEQ ID NO: 9174778 - DNA, 22 bp, Homo sapiens
atccctgtgacgagcatcccta

SEQ ID NO: 9174779 - DNA, 22 bp, Homo sapiens
atcctaaaattgttcaatttct

SEQ ID NO: 9174780 - DNA, 21 bp, Homo sapiens
atccgtttaataatactgaat

SEQ ID NO: 9174781 - DNA, 22 bp, Homo sapiens
atccgcttatctcagctggcag

SEQ ID NO: 9174782 - DNA, 22 bp, Homo sapiens
atccgtttttatgaaatgtcca

SEQ ID NO: 9174783 - DNA, 22 bp, Homo sapiens
atcctttagtcctacaactcga

SEQ ID NO: 9174784 - DNA, 22 bp, Homo sapiens
atcctttaagttaataaaattc

SEQ ID NO: 9174785 - DNA, 22 bp, Homo sapiens
atcctctgtggattacacctag

SEQ ID NO: 9174786 - DNA, 22 bp, Homo sapiens
atcctctgtggattacacctag

SEQ ID NO: 9174787 - DNA, 22 bp, Homo sapiens
atctacaacgggtggagtaggg

SEQ ID NO: 9174788 - DNA, 22 bp, Homo sapiens
atcctccagctcctgcttctgc

SEQ ID NO: 9174789 - DNA, 22 bp, Homo sapiens
atcctcatctggttttaggctg

SEQ ID NO: 9174790 - DNA, 22 bp, Homo sapiens
atcctcagtgtttctgacatct

SEQ ID NO: 9174791 - DNA, 22 bp, Homo sapiens
atcctcagtgtttctgacatct

SEQ ID NO: 9174792 - DNA, 22 bp, Homo sapiens
atcctcagtgtttctgacatct

SEQ ID NO: 9174793 - DNA, 22 bp, Homo sapiens
atcctcagcatctagcatgaag

SEQ ID NO: 9174794 - DNA, 22 bp, Homo sapiens
atccctctctgcatgactgtgt

SEQ ID NO: 9174795 - DNA, 20 bp, Homo sapiens
atccctcttcctagagtccc

SEQ ID NO: 9174796 - DNA, 22 bp, Homo sapiens
atccctctctgcatgactgtgt

SEQ ID NO: 9174797 - DNA, 23 bp, Homo sapiens
atccctagaagggaaatatagtg

SEQ ID NO: 9174798 - DNA, 22 bp, Homo sapiens
atccccagggagtgagctgtct

SEQ ID NO: 9174799 - DNA, 22 bp, Homo sapiens
atccccagggagtgagctgtct

SEQ ID NO: 9174800 - DNA, 22 bp, Homo sapiens
atccccaggggcattcaagctt

SEQ ID NO: 9174801 - DNA, 22 bp, Homo sapiens
atccccctcttggatggcggca

SEQ ID NO: 9174802 - DNA, 22 bp, Homo sapiens
atccccctcttggatggcggca

SEQ ID NO: 9174803 - DNA, 22 bp, Homo sapiens
atccccctgtatctggaagaat

SEQ ID NO: 9174804 - DNA, 22 bp, Homo sapiens
atccatttgccgtgctatgtgc

SEQ ID NO: 9174805 - DNA, 22 bp, Homo sapiens
atccatttgtaaatgttagagt

SEQ ID NO: 9174806 - DNA, 22 bp, Homo sapiens
atccacagggtgtgttaagatg

SEQ ID NO: 9174807 - DNA, 22 bp, Homo sapiens
atccacagaaggaacttgaaag

SEQ ID NO: 9174808 - DNA, 22 bp, Homo sapiens
ataaaagtaggaccaacttaca

SEQ ID NO: 9174809 - DNA, 22 bp, Homo sapiens
ataaaagtaggaccaacttaca

SEQ ID NO: 9174810 - DNA, 22 bp, Homo sapiens
ataaaagtaggaccaacttaca

SEQ ID NO: 9174811 - DNA, 22 bp, Homo sapiens
ataaaagtaggaccaacttaca

SEQ ID NO: 9174812 - DNA, 22 bp, Homo sapiens
ctgccaggcctccgctgtcccc

SEQ ID NO: 9174813 - DNA, 22 bp, Homo sapiens
ctgccaggcagcagagggagaa

SEQ ID NO: 9174814 - DNA, 22 bp, Homo sapiens
ctgccaggcctcatcccagcca

SEQ ID NO: 9174815 - DNA, 22 bp, Homo sapiens
ctgccaggcctcatcccagcca

SEQ ID NO: 9174816 - DNA, 22 bp, Homo sapiens
ctgccaggcagggagatggctg

SEQ ID NO: 9174817 - DNA, 22 bp, Homo sapiens
ctgccaggcactgggctctgca

SEQ ID NO: 9174818 - DNA, 22 bp, Homo sapiens
ctgccaggcacgtgcagcatca

SEQ ID NO: 9174819 - DNA, 21 bp, Homo sapiens
ctgccaggatagcatgcaggc

SEQ ID NO: 9174820 - DNA, 21 bp, Homo sapiens
ctgccaggatagcatgcaggc

SEQ ID NO: 9174821 - DNA, 21 bp, Homo sapiens
ctgccaggatagcatgcaggc

SEQ ID NO: 9174822 - DNA, 21 bp, Homo sapiens
ctgccaggatagcatgcaggc

SEQ ID NO: 9174823 - DNA, 21 bp, Homo sapiens
ctgccaggatagcatgcaggc

SEQ ID NO: 9174824 - DNA, 20 bp, Homo sapiens
ataaaataactgccacaaga

SEQ ID NO: 9174825 - DNA, 20 bp, Homo sapiens
ataaaataactgccacaaga

SEQ ID NO: 9174826 - DNA, 20 bp, Homo sapiens
ataaaataactgccacaaga

SEQ ID NO: 9174827 - DNA, 20 bp, Homo sapiens
ataaaataactgccacaaga

SEQ ID NO: 9174828 - DNA, 22 bp, Homo sapiens
ataaaagtttccaatcatgcct

SEQ ID NO: 9174829 - DNA, 22 bp, Homo sapiens
ataaatagtgtgtcataaagtc

SEQ ID NO: 9174830 - DNA, 22 bp, Homo sapiens
ataaatagtgtgtcataaagtc

SEQ ID NO: 9174831 - DNA, 22 bp, Homo sapiens
ataaatatcactgttgtccctc

SEQ ID NO: 9174832 - DNA, 22 bp, Homo sapiens
ataaatatcactgttgtccctc

SEQ ID NO: 9174833 - DNA, 22 bp, Homo sapiens
ataaatatcactgttgtccctc

SEQ ID NO: 9174834 - DNA, 22 bp, Homo sapiens
ataaatatcactgttgtccctc

SEQ ID NO: 9174835 - DNA, 22 bp, Homo sapiens
ataaatagtgaagggagccggt

SEQ ID NO: 9174836 - DNA, 22 bp, Homo sapiens
ataaaggataatccattagact

SEQ ID NO: 9174837 - DNA, 22 bp, Homo sapiens
agtttgaattgaaatgcagatg

SEQ ID NO: 9174838 - DNA, 22 bp, Homo sapiens
agtttgatggcttaatagtaga

SEQ ID NO: 9174839 - DNA, 22 bp, Homo sapiens
agtttgatgattacagagaaaa

SEQ ID NO: 9174840 - DNA, 22 bp, Homo sapiens
agtttgctcagaaatttgaaat

SEQ ID NO: 9174841 - DNA, 22 bp, Homo sapiens
agtttgctcagctgtcaaatgg

SEQ ID NO: 9174842 - DNA, 22 bp, Homo sapiens
agtttgctcagctgtcaaatgg

SEQ ID NO: 9174843 - DNA, 22 bp, Homo sapiens
agtttggagtgtggtctttgag

SEQ ID NO: 9174844 - DNA, 22 bp, Homo sapiens
agtttggaggcagggttgatga

SEQ ID NO: 9174845 - DNA, 22 bp, Homo sapiens
agtttggaagtcaggcttttct

SEQ ID NO: 9174846 - DNA, 22 bp, Homo sapiens
ctgcagctgcgggaccggagcg

SEQ ID NO: 9174847 - DNA, 22 bp, Homo sapiens
ctgcagctgccagtgatttcag

SEQ ID NO: 9174848 - DNA, 22 bp, Homo sapiens
ctgcagctgcagttctgagaga

SEQ ID NO: 9174849 - DNA, 22 bp, Homo sapiens
ctgcagctggctcatgggatat

SEQ ID NO: 9174850 - DNA, 23 bp, Homo sapiens
agtttctttgagacttgccctgt

SEQ ID NO: 9174851 - DNA, 22 bp, Homo sapiens
agtttgaaagtattgacagaag

SEQ ID NO: 9174852 - DNA, 22 bp, Homo sapiens
agtttgaaagtattgacagaag

SEQ ID NO: 9174853 - DNA, 22 bp, Homo sapiens
agtttgaagaaggatctatgaa

SEQ ID NO: 9174854 - DNA, 22 bp, Homo sapiens
agtttgaagaaggtgagatgca

SEQ ID NO: 9174855 - DNA, 22 bp, Homo sapiens
agtttgaagattatgccagagt

SEQ ID NO: 9174856 - DNA, 22 bp, Homo sapiens
agtttgaagaaggatctatgaa

SEQ ID NO: 9174857 - DNA, 22 bp, Homo sapiens
agtttgaagcaaaattgaggaa

SEQ ID NO: 9174858 - DNA, 22 bp, Homo sapiens
agtttgaaggagttgaatcacc

SEQ ID NO: 9174859 - DNA, 22 bp, Homo sapiens
agtttaaatcatgttttgtaac

SEQ ID NO: 9174860 - DNA, 22 bp, Homo sapiens
agttgttcgtggtggattcgct

SEQ ID NO: 9174861 - DNA, 22 bp, Homo sapiens
agtttaactttggaaaactata

SEQ ID NO: 9174862 - DNA, 22 bp, Homo sapiens
agtttaatcctccagcccaact

SEQ ID NO: 9174863 - DNA, 22 bp, Homo sapiens
agtttaatatccttcaactttc

SEQ ID NO: 9174864 - DNA, 22 bp, Homo sapiens
agtttaatatccttcaactttc

SEQ ID NO: 9174865 - DNA, 22 bp, Homo sapiens
agtttacaaagtttcactgttc

SEQ ID NO: 9174866 - DNA, 22 bp, Homo sapiens
agtttaattggaggcgtggctc

SEQ ID NO: 9174867 - DNA, 22 bp, Homo sapiens
agtttaattggaggcgtggctc

SEQ ID NO: 9174868 - DNA, 22 bp, Homo sapiens
agtttaatcctccagcccaact

SEQ ID NO: 9174869 - DNA, 22 bp, Homo sapiens
ctgcagagcaagttctctgttg

SEQ ID NO: 9174870 - DNA, 22 bp, Homo sapiens
ctgcagagcaagttctctgttg

SEQ ID NO: 9174871 - DNA, 22 bp, Homo sapiens
ctgcagagcagccagtccccca

SEQ ID NO: 9174872 - DNA, 22 bp, Homo sapiens
ctgcagagcagccagtccccca

SEQ ID NO: 9174873 - DNA, 22 bp, Homo sapiens
ctgcagcctcctccagctacgt

SEQ ID NO: 9174874 - DNA, 22 bp, Homo sapiens
agttgtattagagaacacaaac

SEQ ID NO: 9174875 - DNA, 22 bp, Homo sapiens
agttgtaataacaataccaaaa

SEQ ID NO: 9174876 - DNA, 22 bp, Homo sapiens
agttgtaataacaataccaaaa

SEQ ID NO: 9174877 - DNA, 22 bp, Homo sapiens
ctgaggtaattttccagataat

SEQ ID NO: 9174878 - DNA, 22 bp, Homo sapiens
ctgaggtatgtgggactagcct

SEQ ID NO: 9174879 - DNA, 22 bp, Homo sapiens
ctgaggggataaaggtttgggt

SEQ ID NO: 9174880 - DNA, 22 bp, Homo sapiens
ctgaggggtatccaaggggtaa

SEQ ID NO: 9174881 - DNA, 22 bp, Homo sapiens
ctgaggggtatccaaggggtaa

SEQ ID NO: 9174882 - DNA, 22 bp, Homo sapiens
ctgaggctttgtgtgcatgcct

SEQ ID NO: 9174883 - DNA, 22 bp, Homo sapiens
ctgagggaacttgggcaagtct

SEQ ID NO: 9174884 - DNA, 22 bp, Homo sapiens
ctgagggtcaacttgattgtat

SEQ ID NO: 9174885 - DNA, 22 bp, Homo sapiens
ctgagggtcaacttgattgtat

SEQ ID NO: 9174886 - DNA, 22 bp, Homo sapiens
ctgagggtcaacttgattgtat

SEQ ID NO: 9174887 - DNA, 20 bp, Homo sapiens
ctgaggggtctgacttggac

SEQ ID NO: 9174888 - DNA, 22 bp, Homo sapiens
ctgaggggtcgtgggagcccag

SEQ ID NO: 9174889 - DNA, 18 bp, Homo sapiens
ctgaggcttagagaggtt

SEQ ID NO: 9174890 - DNA, 18 bp, Homo sapiens
ctgaggcttagagaggtt

SEQ ID NO: 9174891 - DNA, 22 bp, Homo sapiens
ctgaggcctctgttcaccagaa

SEQ ID NO: 9174892 - DNA, 22 bp, Homo sapiens
ctgaggcctctgttcaccagaa

SEQ ID NO: 9174893 - DNA, 22 bp, Homo sapiens
ctgaggcaggggcagctggaga

SEQ ID NO: 9174894 - DNA, 22 bp, Homo sapiens
ctgaggcatgaatgtgggcttt

SEQ ID NO: 9174895 - DNA, 22 bp, Homo sapiens
ctgaggcatgaatgtgggcttt

SEQ ID NO: 9174896 - DNA, 22 bp, Homo sapiens
ctgaggcctaagacatgaatga

SEQ ID NO: 9174897 - DNA, 21 bp, Homo sapiens
ctgaggcagcacagctagtca

SEQ ID NO: 9174898 - DNA, 22 bp, Homo sapiens
agttgtaagagacagatataaa

SEQ ID NO: 9174899 - DNA, 22 bp, Homo sapiens
agttgtaagaggcacaaggaag

SEQ ID NO: 9174900 - DNA, 22 bp, Homo sapiens
agttgtaagagacagatataaa

SEQ ID NO: 9174901 - DNA, 22 bp, Homo sapiens
agttgtaagagacagatataaa

SEQ ID NO: 9174902 - DNA, 22 bp, Homo sapiens
agttggcaaaggtaggtattct

SEQ ID NO: 9174903 - DNA, 22 bp, Homo sapiens
agttgcttccctattcttagca

SEQ ID NO: 9174904 - DNA, 22 bp, Homo sapiens
agttggcactgagctgtgattg

SEQ ID NO: 9174905 - DNA, 23 bp, Homo sapiens
agttggcatattcaagcacagtc

SEQ ID NO: 9174906 - DNA, 19 bp, Homo sapiens
agttcttgtcctgtctgtt

SEQ ID NO: 9174907 - DNA, 22 bp, Homo sapiens
ctctttggtgcaccttgcagtc

SEQ ID NO: 9174908 - DNA, 21 bp, Homo sapiens
agttgctgctgctgcaggtga

SEQ ID NO: 9174909 - DNA, 22 bp, Homo sapiens
ctctttggctttgactcccatt

SEQ ID NO: 9174910 - DNA, 22 bp, Homo sapiens
ctctttgggatgggctctgctg

SEQ ID NO: 9174911 - DNA, 16 bp, Homo sapiens
ctctttgggcttccag

SEQ ID NO: 9174912 - DNA, 22 bp, Homo sapiens
ctctttgggatgggctctgctg

SEQ ID NO: 9174913 - DNA, 22 bp, Homo sapiens
ctctttggggtgccccactggt

SEQ ID NO: 9174914 - DNA, 22 bp, Homo sapiens
ctctttggggtgccccactggt

SEQ ID NO: 9174915 - DNA, 22 bp, Homo sapiens
ctggagccccagacagggagag

SEQ ID NO: 9174916 - DNA, 22 bp, Homo sapiens
ctggagagaccgaaagaggctg

SEQ ID NO: 9174917 - DNA, 22 bp, Homo sapiens
ctggagcatccatgcccagggt

SEQ ID NO: 9174918 - DNA, 22 bp, Homo sapiens
atacaagtggccacttgaattc

SEQ ID NO: 9174919 - DNA, 22 bp, Homo sapiens
ctggaggaaaacaactgcagac

SEQ ID NO: 9174920 - DNA, 22 bp, Homo sapiens
ctggagggatgtagggtgtatt

SEQ ID NO: 9174921 - DNA, 22 bp, Homo sapiens
ctggagggaggaggctgctatt

SEQ ID NO: 9174922 - DNA, 22 bp, Homo sapiens
atacagatgaaatactaagcta

SEQ ID NO: 9174923 - DNA, 22 bp, Homo sapiens
atacagagaagggaggcaaaat

SEQ ID NO: 9174924 - DNA, 22 bp, Homo sapiens
ctggcagcgtgagcagcatcca

SEQ ID NO: 9174925 - DNA, 22 bp, Homo sapiens
ctggcagctctactcagagcct

SEQ ID NO: 9174926 - DNA, 22 bp, Homo sapiens
atacttgaggttgtataaatat

SEQ ID NO: 9174927 - DNA, 22 bp, Homo sapiens
atacttgatggtgtctgtcaaa

SEQ ID NO: 9174928 - DNA, 22 bp, Homo sapiens
atacttgatggtgtctgtcaaa

SEQ ID NO: 9174929 - DNA, 22 bp, Homo sapiens
atacttgaggtagcaacttaag

SEQ ID NO: 9174930 - DNA, 21 bp, Homo sapiens
atacttgaaaatggttactct

SEQ ID NO: 9174931 - DNA, 22 bp, Homo sapiens
atacttctttagcatattgaac

SEQ ID NO: 9174932 - DNA, 22 bp, Homo sapiens
atacttgttcctgttgctatag

SEQ ID NO: 9174933 - DNA, 22 bp, Homo sapiens
atactttagagctagattgcct

SEQ ID NO: 9174934 - DNA, 22 bp, Homo sapiens
atacttctttaagagtaagtct

SEQ ID NO: 9174935 - DNA, 22 bp, Homo sapiens
atacttctagaaatactatgca

SEQ ID NO: 9174936 - DNA, 22 bp, Homo sapiens
ctggagtgcaatgaacaaggtc

SEQ ID NO: 9174937 - DNA, 22 bp, Homo sapiens
ctggagtgatactcagaatgtg

SEQ ID NO: 9174938 - DNA, 22 bp, Homo sapiens
ctggagtgatactcagaatgtg

SEQ ID NO: 9174939 - DNA, 22 bp, Homo sapiens
ctggagtgatactcagaatgtg

SEQ ID NO: 9174940 - DNA, 22 bp, Homo sapiens
ctggagtgaggtctgggagcct

SEQ ID NO: 9174941 - DNA, 22 bp, Homo sapiens
ctggagtgaggtctgggagcct

SEQ ID NO: 9174942 - DNA, 22 bp, Homo sapiens
atacttatactaagaatgtact

SEQ ID NO: 9174943 - DNA, 22 bp, Homo sapiens
atacttatgataaataattgct

SEQ ID NO: 9174944 - DNA, 22 bp, Homo sapiens
atacttcatgcttcatgtctgt

SEQ ID NO: 9174945 - DNA, 22 bp, Homo sapiens
atacttcaacatatcagtcaga

SEQ ID NO: 9174946 - DNA, 22 bp, Homo sapiens
atacttatactaagaatgtact

SEQ ID NO: 9174947 - DNA, 21 bp, Homo sapiens
ctggagtctgggggtggcagt

SEQ ID NO: 9174948 - DNA, 22 bp, Homo sapiens
ctggagtcttaggttatggtga

SEQ ID NO: 9174949 - DNA, 22 bp, Homo sapiens
ctggagtcttaggttatggtga

SEQ ID NO: 9174950 - DNA, 22 bp, Homo sapiens
ctggagtcttcagcttgctgcc

SEQ ID NO: 9174951 - DNA, 21 bp, Homo sapiens
ctggagtctgggggtggcagt

SEQ ID NO: 9174952 - DNA, 22 bp, Homo sapiens
ctggagtcttaggttatggtga

SEQ ID NO: 9174953 - DNA, 22 bp, Homo sapiens
ctggagtgaagtctggcagctt

SEQ ID NO: 9174954 - DNA, 22 bp, Homo sapiens
ctggagtgaagcttatttttca

SEQ ID NO: 9174955 - DNA, 22 bp, Homo sapiens
ctggagtgaagtctggcagctt

SEQ ID NO: 9174956 - DNA, 22 bp, Homo sapiens
ctggagtgaagtctggcagctt

SEQ ID NO: 9174957 - DNA, 22 bp, Homo sapiens
ctggagtgaggtctgggagcct

SEQ ID NO: 9174958 - DNA, 22 bp, Homo sapiens
ctggagggctgcagcgaggctg

SEQ ID NO: 9174959 - DNA, 22 bp, Homo sapiens
ctggagggctggactaaggaaa

SEQ ID NO: 9174960 - DNA, 22 bp, Homo sapiens
ctggagtctcttctgtagctac

SEQ ID NO: 9174961 - DNA, 22 bp, Homo sapiens
ctggagggatgtagggtgtatt

SEQ ID NO: 9174962 - DNA, 22 bp, Homo sapiens
ctggagggctgcagcgaggctg

SEQ ID NO: 9174963 - DNA, 22 bp, Homo sapiens
atacaagatcactccagaaaat

SEQ ID NO: 9174964 - DNA, 22 bp, Homo sapiens
atacaagtgagaaaactgaaga

SEQ ID NO: 9174965 - DNA, 22 bp, Homo sapiens
atacaactttatctgtaatgag

SEQ ID NO: 9174966 - DNA, 22 bp, Homo sapiens
ctgctttaatggaaagtgtttt

SEQ ID NO: 9174967 - DNA, 22 bp, Homo sapiens
ataatcagaattcatgaaagat

SEQ ID NO: 9174968 - DNA, 22 bp, Homo sapiens
ctgctgtgtgaccatggacagg

SEQ ID NO: 9174969 - DNA, 22 bp, Homo sapiens
ataatcaaagtcctatgacatc

SEQ ID NO: 9174970 - DNA, 22 bp, Homo sapiens
ataatataatcctacttcccat

SEQ ID NO: 9174971 - DNA, 22 bp, Homo sapiens
ataatataatcctacttcccat

SEQ ID NO: 9174972 - DNA, 22 bp, Homo sapiens
ataatattgagtcaggacctga

SEQ ID NO: 9174973 - DNA, 22 bp, Homo sapiens
ataatattgaagagccttggcc

SEQ ID NO: 9174974 - DNA, 22 bp, Homo sapiens
ctgcttgcaaagtgttggtgat

SEQ ID NO: 9174975 - DNA, 22 bp, Homo sapiens
ctgcttgcctggacagcgttag

SEQ ID NO: 9174976 - DNA, 18 bp, Homo sapiens
ctgcttgggagacgtcag

SEQ ID NO: 9174977 - DNA, 22 bp, Homo sapiens
ctgcttgggtcctggcatgggt

SEQ ID NO: 9174978 - DNA, 22 bp, Homo sapiens
ctgcttcttttgggtaattgat

SEQ ID NO: 9174979 - DNA, 18 bp, Homo sapiens
ctgcttctgtctgccagt

SEQ ID NO: 9174980 - DNA, 18 bp, Homo sapiens
ctgcttctgtctgccagt

SEQ ID NO: 9174981 - DNA, 22 bp, Homo sapiens
ctgcttctccctgagatagtgt

SEQ ID NO: 9174982 - DNA, 22 bp, Homo sapiens
ctgcttctccctgagatagtgt

SEQ ID NO: 9174983 - DNA, 22 bp, Homo sapiens
ctgcttctgggatgatggagta

SEQ ID NO: 9174984 - DNA, 22 bp, Homo sapiens
ctgctgtgtgcttacttgggtt

SEQ ID NO: 9174985 - DNA, 22 bp, Homo sapiens
ctgcttctagcaccaagtccct

SEQ ID NO: 9174986 - DNA, 22 bp, Homo sapiens
ctgcccacagttctctgccatg

SEQ ID NO: 9174987 - DNA, 22 bp, Homo sapiens
ctgcccactatgttgtcatggg

SEQ ID NO: 9174988 - DNA, 20 bp, Homo sapiens
ctgcccactagaactacctg

SEQ ID NO: 9174989 - DNA, 22 bp, Homo sapiens
ctgcccaccgtgtgcacgtgcg

SEQ ID NO: 9174990 - DNA, 22 bp, Homo sapiens
ctgcccaccacacctgctcctg

SEQ ID NO: 9174991 - DNA, 22 bp, Homo sapiens
ctgcccaccacacctgctcctg

SEQ ID NO: 9174992 - DNA, 22 bp, Homo sapiens
ctgcccaccacacctgctcctg

SEQ ID NO: 9174993 - DNA, 22 bp, Homo sapiens
ctgcccaccccgaggcaggaag

SEQ ID NO: 9174994 - DNA, 22 bp, Homo sapiens
ctgcccagaagcttagagctta

SEQ ID NO: 9174995 - DNA, 22 bp, Homo sapiens
ctgcccagaagccagatgggca

SEQ ID NO: 9174996 - DNA, 22 bp, Homo sapiens
ctgcccactatgttgtcatggg

SEQ ID NO: 9174997 - DNA, 22 bp, Homo sapiens
ctgcccacttggccaccttcta

SEQ ID NO: 9174998 - DNA, 18 bp, Homo sapiens
ctgcccagagcacttgtg

SEQ ID NO: 9174999 - DNA, 18 bp, Homo sapiens
ctgcccagagcacttgtg

SEQ ID NO: 9175000 - DNA, 22 bp, Homo sapiens
ctgctctggcgtactcggcatc

SEQ ID NO: 9175001 - DNA, 21 bp, Homo sapiens
ctgctctggggaccggctgtg

SEQ ID NO: 9175002 - DNA, 22 bp, Homo sapiens
ataatacatggttaacctcttt

SEQ ID NO: 9175003 - DNA, 22 bp, Homo sapiens
ataatacatggttgatcttttc

SEQ ID NO: 9175004 - DNA, 22 bp, Homo sapiens
ctgctctgcaaggcacagtgat

SEQ ID NO: 9175005 - DNA, 20 bp, Homo sapiens
ctgctctgctttgcaggtgg

SEQ ID NO: 9175006 - DNA, 22 bp, Homo sapiens
ctcagaggtcaagagcagagct

SEQ ID NO: 9175007 - DNA, 22 bp, Homo sapiens
ctcagatcatcagaaacaatgt

SEQ ID NO: 9175008 - DNA, 21 bp, Homo sapiens
ctcagaccacagctcacaccc

SEQ ID NO: 9175009 - DNA, 22 bp, Homo sapiens
ctcagaagccttcagtcttggc

SEQ ID NO: 9175010 - DNA, 22 bp, Homo sapiens
ctcagaataatgtttctaaagg

SEQ ID NO: 9175011 - DNA, 22 bp, Homo sapiens
ctcagaattaataaccacaagg

SEQ ID NO: 9175012 - DNA, 22 bp, Homo sapiens
ctcagaattacatcccatttta

SEQ ID NO: 9175013 - DNA, 22 bp, Homo sapiens
ctcagaagaacaaaggctctac

SEQ ID NO: 9175014 - DNA, 22 bp, Homo sapiens
ctcagaagaacaaaggctctac

SEQ ID NO: 9175015 - DNA, 22 bp, Homo sapiens
ctcaccatggatcttccatttc

SEQ ID NO: 9175016 - DNA, 22 bp, Homo sapiens
agtcccagcccagtcctgtaag

SEQ ID NO: 9175017 - DNA, 22 bp, Homo sapiens
agtcccagcctaggctgtgctg

SEQ ID NO: 9175018 - DNA, 22 bp, Homo sapiens
agtcccagatgacccagctact

SEQ ID NO: 9175019 - DNA, 22 bp, Homo sapiens
agtcccagcctgtaggattggg

SEQ ID NO: 9175020 - DNA, 22 bp, Homo sapiens
ctcaccagacatggaacctgtc

SEQ ID NO: 9175021 - DNA, 22 bp, Homo sapiens
agtcccagcctgtaggattggg

SEQ ID NO: 9175022 - DNA, 22 bp, Homo sapiens
ctcaccagatgtcgggctgagt

SEQ ID NO: 9175023 - DNA, 20 bp, Homo sapiens
ctcaccaggtgtaggctgag

SEQ ID NO: 9175024 - DNA, 22 bp, Homo sapiens
agtcccagagaggtcggggcca

SEQ ID NO: 9175025 - DNA, 20 bp, Homo sapiens
agtcccagatcaaatttctg

SEQ ID NO: 9175026 - DNA, 22 bp, Homo sapiens
agtcccagatctacaggaggga

SEQ ID NO: 9175027 - DNA, 22 bp, Homo sapiens
agtcccagatctacaggaggga

SEQ ID NO: 9175028 - DNA, 22 bp, Homo sapiens
agtcccagatctacaggaggga

SEQ ID NO: 9175029 - DNA, 22 bp, Homo sapiens
agtcccagatctccattcggtc

SEQ ID NO: 9175030 - DNA, 22 bp, Homo sapiens
agtcccagactccagttttctg

SEQ ID NO: 9175031 - DNA, 21 bp, Homo sapiens
ctcaaatgccagttttattta

SEQ ID NO: 9175032 - DNA, 21 bp, Homo sapiens
ctcaaatgccagttttattta

SEQ ID NO: 9175033 - DNA, 22 bp, Homo sapiens
cgggttcttaaacgactgggct

SEQ ID NO: 9175034 - DNA, 22 bp, Homo sapiens
ctatttatgtccaagtgtttta

SEQ ID NO: 9175035 - DNA, 22 bp, Homo sapiens
cgggttcacgccattctcctgc

SEQ ID NO: 9175036 - DNA, 22 bp, Homo sapiens
ctatttatgtgctattttgtat

SEQ ID NO: 9175037 - DNA, 22 bp, Homo sapiens
ctatttatgtccaagtgtttta

SEQ ID NO: 9175038 - DNA, 22 bp, Homo sapiens
ctcaaagaagggaggtatttgg

SEQ ID NO: 9175039 - DNA, 22 bp, Homo sapiens
ctcaaatatgtggtcagaaagc

SEQ ID NO: 9175040 - DNA, 22 bp, Homo sapiens
cgggttcacgccattctcctgc

SEQ ID NO: 9175041 - DNA, 22 bp, Homo sapiens
cgggttcacgccattctcctgc

SEQ ID NO: 9175042 - DNA, 22 bp, Homo sapiens
cggggttcatccatgctgtggc

SEQ ID NO: 9175043 - DNA, 22 bp, Homo sapiens
cggggtgggaatagacctgtct

SEQ ID NO: 9175044 - DNA, 22 bp, Homo sapiens
cggggtccctgcccacccatac

SEQ ID NO: 9175045 - DNA, 22 bp, Homo sapiens
ctccagagacacttctcatgat

SEQ ID NO: 9175046 - DNA, 22 bp, Homo sapiens
ctccagagacacttctcatgat

SEQ ID NO: 9175047 - DNA, 22 bp, Homo sapiens
ctccagagagaaaggaggccgc

SEQ ID NO: 9175048 - DNA, 22 bp, Homo sapiens
ctccagagacacttctcatgat

SEQ ID NO: 9175049 - DNA, 22 bp, Homo sapiens
ctccagaaattcaacagcaaat

SEQ ID NO: 9175050 - DNA, 22 bp, Homo sapiens
ctccactctggggtgggtgaga

SEQ ID NO: 9175051 - DNA, 22 bp, Homo sapiens
ctccagaactgggagagaataa

SEQ ID NO: 9175052 - DNA, 19 bp, Homo sapiens
ctccagaatacatgttcct

SEQ ID NO: 9175053 - DNA, 22 bp, Homo sapiens
agtgacagagcttggtgccccc

SEQ ID NO: 9175054 - DNA, 22 bp, Homo sapiens
agtgacagggaaaatgacactg

SEQ ID NO: 9175055 - DNA, 22 bp, Homo sapiens
agtgacagggaaggataggatt

SEQ ID NO: 9175056 - DNA, 22 bp, Homo sapiens
agtgacagggaaaatgacactg

SEQ ID NO: 9175057 - DNA, 22 bp, Homo sapiens
ctccactcaccagatgccagga

SEQ ID NO: 9175058 - DNA, 22 bp, Homo sapiens
ctccactcaccgaggcagagca

SEQ ID NO: 9175059 - DNA, 22 bp, Homo sapiens
ctccactcaggtgcttaagttg

SEQ ID NO: 9175060 - DNA, 17 bp, Homo sapiens
agtgaaatttacattgc

SEQ ID NO: 9175061 - DNA, 22 bp, Homo sapiens
agtgaaattgctgtaagaggaa

SEQ ID NO: 9175062 - DNA, 22 bp, Homo sapiens
agtgacaacaagttgactagaa

SEQ ID NO: 9175063 - DNA, 22 bp, Homo sapiens
agtgacaaaacggaacatacag

SEQ ID NO: 9175064 - DNA, 22 bp, Homo sapiens
agtgacaaagattctccttgtt

SEQ ID NO: 9175065 - DNA, 22 bp, Homo sapiens
ctcagtgtcttattgtacacat

SEQ ID NO: 9175066 - DNA, 22 bp, Homo sapiens
ctcagtggttgagagcctgggc

SEQ ID NO: 9175067 - DNA, 22 bp, Homo sapiens
ctcagtggttgagagcctgggc

SEQ ID NO: 9175068 - DNA, 22 bp, Homo sapiens
ctcagggacgttagaggacagg

SEQ ID NO: 9175069 - DNA, 22 bp, Homo sapiens
ctcagggacttggatcctggcc

SEQ ID NO: 9175070 - DNA, 22 bp, Homo sapiens
ctcagggacggaggcttgcgga

SEQ ID NO: 9175071 - DNA, 22 bp, Homo sapiens
ctcagggacaaggggagacccc

SEQ ID NO: 9175072 - DNA, 22 bp, Homo sapiens
ctcagggaggagcttctgggcc

SEQ ID NO: 9175073 - DNA, 22 bp, Homo sapiens
ctcagggagagccaagagttcc

SEQ ID NO: 9175074 - DNA, 22 bp, Homo sapiens
ctcagggacttggatcctggcc

SEQ ID NO: 9175075 - DNA, 22 bp, Homo sapiens
ctcagggaggccctgggaccct

SEQ ID NO: 9175076 - DNA, 22 bp, Homo sapiens
ctcagggaggtcctgtgctgaa

SEQ ID NO: 9175077 - DNA, 22 bp, Homo sapiens
ctcagggaggcctctgctggtt

SEQ ID NO: 9175078 - DNA, 22 bp, Homo sapiens
agtctccacactggcagatgcc

SEQ ID NO: 9175079 - DNA, 22 bp, Homo sapiens
agtctccacactggcagatgcc

SEQ ID NO: 9175080 - DNA, 21 bp, Homo sapiens
ctcaggcatttgaggagagtc

SEQ ID NO: 9175081 - DNA, 22 bp, Homo sapiens
agtctccacttgacatcagcag

SEQ ID NO: 9175082 - DNA, 22 bp, Homo sapiens
agtctcagcaagcatggctagt

SEQ ID NO: 9175083 - DNA, 22 bp, Homo sapiens
agtctcagagtacctgagggac

SEQ ID NO: 9175084 - DNA, 22 bp, Homo sapiens
ctcagctgcagcctggctggca

SEQ ID NO: 9175085 - DNA, 22 bp, Homo sapiens
agtctcagagtacctgagggac

SEQ ID NO: 9175086 - DNA, 22 bp, Homo sapiens
ctcagctccaggtgtgcatctt

SEQ ID NO: 9175087 - DNA, 20 bp, Homo sapiens
ctcagctcttcagggcaagt

SEQ ID NO: 9175088 - DNA, 22 bp, Homo sapiens
ctcagcctgtgaagagcagagg

SEQ ID NO: 9175089 - DNA, 22 bp, Homo sapiens
ctcagcctgtgaagagcagagg

SEQ ID NO: 9175090 - DNA, 22 bp, Homo sapiens
ctcagccccaatttgccctctt

SEQ ID NO: 9175091 - DNA, 19 bp, Homo sapiens
ctcagcaagatagaaatgg

SEQ ID NO: 9175092 - DNA, 22 bp, Homo sapiens
ctcagctccagccctcagcagc

SEQ ID NO: 9175093 - DNA, 22 bp, Homo sapiens
agtgctgggattgcaggcatga

SEQ ID NO: 9175094 - DNA, 22 bp, Homo sapiens
ctctccattccctacagttttc

SEQ ID NO: 9175095 - DNA, 22 bp, Homo sapiens
ctctccattccctacagttttc

SEQ ID NO: 9175096 - DNA, 22 bp, Homo sapiens
ctctccattccctacagttttc

SEQ ID NO: 9175097 - DNA, 22 bp, Homo sapiens
ctctccagttatagctgatttg

SEQ ID NO: 9175098 - DNA, 22 bp, Homo sapiens
ctctccagttatagctgatttg

SEQ ID NO: 9175099 - DNA, 23 bp, Homo sapiens
ctctccaccttcccacccaggga

SEQ ID NO: 9175100 - DNA, 22 bp, Homo sapiens
agtgctgggattacaggcataa

SEQ ID NO: 9175101 - DNA, 22 bp, Homo sapiens
ctcgggcaccctggttctggtg

SEQ ID NO: 9175102 - DNA, 22 bp, Homo sapiens
ctcgggcaccctggttctggtg

SEQ ID NO: 9175103 - DNA, 22 bp, Homo sapiens
ctctccccacaccctctgcatg

SEQ ID NO: 9175104 - DNA, 22 bp, Homo sapiens
ctctccccacaccctctgcatg

SEQ ID NO: 9175105 - DNA, 20 bp, Homo sapiens
ctctcccagcacagcttcct

SEQ ID NO: 9175106 - DNA, 22 bp, Homo sapiens
ctctcctttactgcagagagcg

SEQ ID NO: 9175107 - DNA, 22 bp, Homo sapiens
ctctcgccagcggggctgcgct

SEQ ID NO: 9175108 - DNA, 22 bp, Homo sapiens
ctctcgccagcggggctgcgct

SEQ ID NO: 9175109 - DNA, 22 bp, Homo sapiens
ctctctatggatgcagtttttc

SEQ ID NO: 9175110 - DNA, 22 bp, Homo sapiens
ctccagagagtccagctctggg

SEQ ID NO: 9175111 - DNA, 22 bp, Homo sapiens
ctccagagagtccagctctggg

SEQ ID NO: 9175112 - DNA, 22 bp, Homo sapiens
agtgctatcgagttctaatgct

SEQ ID NO: 9175113 - DNA, 22 bp, Homo sapiens
agtgctatcgagttctaatgct

SEQ ID NO: 9175114 - DNA, 22 bp, Homo sapiens
agtgctgactctgggcacagtg

SEQ ID NO: 9175115 - DNA, 23 bp, Homo sapiens
agtgctgaattgaaagctccagg

SEQ ID NO: 9175116 - DNA, 22 bp, Homo sapiens
agtgctatcgagttctaatgct

SEQ ID NO: 9175117 - DNA, 22 bp, Homo sapiens
agtgctgaggccatactccata

SEQ ID NO: 9175118 - DNA, 22 bp, Homo sapiens
agtgctgagtgattgcaaagga

SEQ ID NO: 9175119 - DNA, 22 bp, Homo sapiens
agtgctgaggagaggtactcca

SEQ ID NO: 9175120 - DNA, 22 bp, Homo sapiens
agtgctgactctgggcacagtg

SEQ ID NO: 9175121 - DNA, 22 bp, Homo sapiens
agtgctgaggaaggggcccatt

SEQ ID NO: 9175122 - DNA, 22 bp, Homo sapiens
ctcctgagggatgcttaggctt

SEQ ID NO: 9175123 - DNA, 22 bp, Homo sapiens
agtgctggattacaggcgtgag

SEQ ID NO: 9175124 - DNA, 22 bp, Homo sapiens
ctcgcctgcctgtgtctctccc

SEQ ID NO: 9175125 - DNA, 22 bp, Homo sapiens
ctcgcaggacagtgctaggact

SEQ ID NO: 9175126 - DNA, 22 bp, Homo sapiens
ctcgcatccaggataccctgag

SEQ ID NO: 9175127 - DNA, 18 bp, Homo sapiens
ctccttggagaagaggcc

SEQ ID NO: 9175128 - DNA, 18 bp, Homo sapiens
ctcctttccctacacctc

SEQ ID NO: 9175129 - DNA, 22 bp, Homo sapiens
ctcctttgatcccaaatgaccc

SEQ ID NO: 9175130 - DNA, 22 bp, Homo sapiens
ctcctgaggggacaggactcat

SEQ ID NO: 9175131 - DNA, 22 bp, Homo sapiens
ctcctgcaagcctccccaagca

SEQ ID NO: 9175132 - DNA, 22 bp, Homo sapiens
ctcctgcagccctcagcagcca

SEQ ID NO: 9175133 - DNA, 22 bp, Homo sapiens
ctcctgagtagtagcattgtca

SEQ ID NO: 9175134 - DNA, 22 bp, Homo sapiens
ctcctgcaggtcagcaggcttg

SEQ ID NO: 9175135 - DNA, 22 bp, Homo sapiens
ctcctgcagtatgtttctctat

SEQ ID NO: 9175136 - DNA, 22 bp, Homo sapiens
ctcctgcatgctcacatatgcc

SEQ ID NO: 9175137 - DNA, 22 bp, Homo sapiens
ctcctgcatggttgtgctattg

SEQ ID NO: 9175138 - DNA, 22 bp, Homo sapiens
ctcctggttcagagagctgaga

SEQ ID NO: 9175139 - DNA, 22 bp, Homo sapiens
ctctttggctttgactcccatt

SEQ ID NO: 9175140 - DNA, 22 bp, Homo sapiens
ctcttggccagacacagaggca

SEQ ID NO: 9175141 - DNA, 22 bp, Homo sapiens
ctcttgggagtgctctggagaa

SEQ ID NO: 9175142 - DNA, 20 bp, Homo sapiens
ctcttgggcccaaagggcct

SEQ ID NO: 9175143 - DNA, 22 bp, Homo sapiens
ctcttgatgactgttgctggtt

SEQ ID NO: 9175144 - DNA, 21 bp, Homo sapiens
ctcttgctgatgtctccttta

SEQ ID NO: 9175145 - DNA, 22 bp, Homo sapiens
ctcttgcattctatccctccag

SEQ ID NO: 9175146 - DNA, 22 bp, Homo sapiens
ctcttagtaatgccatgaagca

SEQ ID NO: 9175147 - DNA, 22 bp, Homo sapiens
ctcttagtaatgccatgaagca

SEQ ID NO: 9175148 - DNA, 22 bp, Homo sapiens
ctcttcttggcccccatgaggg

SEQ ID NO: 9175149 - DNA, 22 bp, Homo sapiens
ctcttcttgtctctggttagaa

SEQ ID NO: 9175150 - DNA, 22 bp, Homo sapiens
ctcttctttagtccagaccatc

SEQ ID NO: 9175151 - DNA, 22 bp, Homo sapiens
ctcttctttccatccctagcca

SEQ ID NO: 9175152 - DNA, 22 bp, Homo sapiens
ctcttctttccatccctagcca

SEQ ID NO: 9175153 - DNA, 22 bp, Homo sapiens
ctcttctttccatccctagcca

SEQ ID NO: 9175154 - DNA, 22 bp, Homo sapiens
agtggtgcccacctgagcctga

SEQ ID NO: 9175155 - DNA, 22 bp, Homo sapiens
agtggtgccgggtgggttttgc

SEQ ID NO: 9175156 - DNA, 22 bp, Homo sapiens
agtggtgtcgtgggagtggaag

SEQ ID NO: 9175157 - DNA, 22 bp, Homo sapiens
agtggtgtctgagtggccaggg

SEQ ID NO: 9175158 - DNA, 22 bp, Homo sapiens
ctctgtcctatgcttgatagaa

SEQ ID NO: 9175159 - DNA, 18 bp, Homo sapiens
ctctgtcataagtgtcat

SEQ ID NO: 9175160 - DNA, 22 bp, Homo sapiens
ctctgtgagggtctgtacagaa

SEQ ID NO: 9175161 - DNA, 22 bp, Homo sapiens
ctctggaccctcctgctgagag

SEQ ID NO: 9175162 - DNA, 22 bp, Homo sapiens
ctctggacagcaggtgctgtgg

SEQ ID NO: 9175163 - DNA, 22 bp, Homo sapiens
ctctggacagccctccaggaag

SEQ ID NO: 9175164 - DNA, 22 bp, Homo sapiens
ctctgctgcaggaaggcgtgca

SEQ ID NO: 9175165 - DNA, 22 bp, Homo sapiens
ctctgctgcaggaaggcgtgca

SEQ ID NO: 9175166 - DNA, 20 bp, Homo sapiens
ctctctccatctcagtggcc

SEQ ID NO: 9175167 - DNA, 19 bp, Homo sapiens
ctctctccagtggctggct

SEQ ID NO: 9175168 - DNA, 19 bp, Homo sapiens
ctctggagaacaatagtgc

SEQ ID NO: 9175169 - DNA, 19 bp, Homo sapiens
ctctggagaacaatagtgc

SEQ ID NO: 9175170 - DNA, 22 bp, Homo sapiens
ctctggagaacgctatggatct

SEQ ID NO: 9175171 - DNA, 22 bp, Homo sapiens
ctctggagaacgctatggatct

SEQ ID NO: 9175172 - DNA, 22 bp, Homo sapiens
ctctggagaggttcccatggga

SEQ ID NO: 9175173 - DNA, 22 bp, Homo sapiens
ctctggagaactccttgtgtct

SEQ ID NO: 9175174 - DNA, 22 bp, Homo sapiens
ctctggagaactccttgtgtct

SEQ ID NO: 9175175 - DNA, 22 bp, Homo sapiens
ctctggagaggttcccatggga

SEQ ID NO: 9175176 - DNA, 23 bp, Homo sapiens
ctctggagatcctctgcctgggt

SEQ ID NO: 9175177 - DNA, 22 bp, Homo sapiens
ctctggagatggttctcaattg

SEQ ID NO: 9175178 - DNA, 22 bp, Homo sapiens
ctctggagatggttctcaattg

SEQ ID NO: 9175179 - DNA, 23 bp, Homo sapiens
ctctggagatcctctgcctgggt

SEQ ID NO: 9175180 - DNA, 22 bp, Homo sapiens
ctctggagatggttctcaattg

SEQ ID NO: 9175181 - DNA, 22 bp, Homo sapiens
agtggctgtgaaatacatggga

SEQ ID NO: 9175182 - DNA, 22 bp, Homo sapiens
ctctggagcaccgggctatcca

SEQ ID NO: 9175183 - DNA, 22 bp, Homo sapiens
ctctggagcaccgggctatcca

SEQ ID NO: 9175184 - DNA, 22 bp, Homo sapiens
ctctggagatggttctcaattg

SEQ ID NO: 9175185 - DNA, 22 bp, Homo sapiens
agtggcttgctctgcctcagcc

SEQ ID NO: 9175186 - DNA, 18 bp, Homo sapiens
agtggcttcctgctcata

SEQ ID NO: 9175187 - DNA, 22 bp, Homo sapiens
agtggcttggctgcactacagg

SEQ ID NO: 9175188 - DNA, 22 bp, Homo sapiens
agtggcttttcttgcttctggc

SEQ ID NO: 9175189 - DNA, 22 bp, Homo sapiens
agtggctttttagtggcagatg

SEQ ID NO: 9175190 - DNA, 22 bp, Homo sapiens
agtgggaatttcagtgctaaaa

SEQ ID NO: 9175191 - DNA, 22 bp, Homo sapiens
agtgggaatttcagtgctaaaa

SEQ ID NO: 9175192 - DNA, 22 bp, Homo sapiens
agtgggaccggtgctattccag

SEQ ID NO: 9175193 - DNA, 22 bp, Homo sapiens
agtggcttatctgggacagcta

SEQ ID NO: 9175194 - DNA, 22 bp, Homo sapiens
agtggcttatctgggacagcta

SEQ ID NO: 9175195 - DNA, 22 bp, Homo sapiens
agtggctgtttataggtgggta

SEQ ID NO: 9175196 - DNA, 22 bp, Homo sapiens
agtggctgtttataggtgggta

SEQ ID NO: 9175197 - DNA, 22 bp, Homo sapiens
agtggctgttccaggtgaggac

SEQ ID NO: 9175198 - DNA, 22 bp, Homo sapiens
agtggctgttcattttacacaa

SEQ ID NO: 9175199 - DNA, 22 bp, Homo sapiens
ctctgtatgaatcatatggagt

SEQ ID NO: 9175200 - DNA, 22 bp, Homo sapiens
ctctgtatagaaaggaaacatt

SEQ ID NO: 9175201 - DNA, 22 bp, Homo sapiens
ctctggggttagatctgatgct

SEQ ID NO: 9175202 - DNA, 22 bp, Homo sapiens
cgaggcaatagagcccagaggt

SEQ ID NO: 9175203 - DNA, 22 bp, Homo sapiens
cgaggccacacctgcttctggg

SEQ ID NO: 9175204 - DNA, 20 bp, Homo sapiens
cgaggccaaggggctgggcc

SEQ ID NO: 9175205 - DNA, 22 bp, Homo sapiens
ccttttatactctgtcctctgg

SEQ ID NO: 9175206 - DNA, 22 bp, Homo sapiens
cgagcatgatgacggctgtggc

SEQ ID NO: 9175207 - DNA, 22 bp, Homo sapiens
cgagcatgatgacggctgtggc

SEQ ID NO: 9175208 - DNA, 22 bp, Homo sapiens
cgagcatgatgacggctgtggc

SEQ ID NO: 9175209 - DNA, 22 bp, Homo sapiens
cgaggaagaagtttgagtcaag

SEQ ID NO: 9175210 - DNA, 22 bp, Homo sapiens
cgaggaaatatttacaactgat

SEQ ID NO: 9175211 - DNA, 22 bp, Homo sapiens
cgaggaaaggcgatggctctcg

SEQ ID NO: 9175212 - DNA, 22 bp, Homo sapiens
cgaggaaatatttacaactgat

SEQ ID NO: 9175213 - DNA, 22 bp, Homo sapiens
cgaggaaaggcgatggctctcg

SEQ ID NO: 9175214 - DNA, 22 bp, Homo sapiens
aggtggggtgttggatgtttat

SEQ ID NO: 9175215 - DNA, 22 bp, Homo sapiens
aggtggggtgagctgcagacta

SEQ ID NO: 9175216 - DNA, 22 bp, Homo sapiens
cctttattcaattagtcctaat

SEQ ID NO: 9175217 - DNA, 22 bp, Homo sapiens
aggtgggggctgtgtccttgac

SEQ ID NO: 9175218 - DNA, 22 bp, Homo sapiens
aggtgggggctgtgtccttgac

SEQ ID NO: 9175219 - DNA, 22 bp, Homo sapiens
aggtggggtgagctgcagacta

SEQ ID NO: 9175220 - DNA, 22 bp, Homo sapiens
cctttgtggggcggtgggtaat

SEQ ID NO: 9175221 - DNA, 22 bp, Homo sapiens
cctttgtggtggcccagtgtgg

SEQ ID NO: 9175222 - DNA, 22 bp, Homo sapiens
cctttgttcactggagagtgga

SEQ ID NO: 9175223 - DNA, 22 bp, Homo sapiens
cctttgttcattgccttcagtc

SEQ ID NO: 9175224 - DNA, 22 bp, Homo sapiens
ccttttaagggagactagagat

SEQ ID NO: 9175225 - DNA, 22 bp, Homo sapiens
cctttgtaccttaaatcctgtg

SEQ ID NO: 9175226 - DNA, 19 bp, Homo sapiens
cctttggtttttggttcat

SEQ ID NO: 9175227 - DNA, 19 bp, Homo sapiens
cctttggtttccatgacat

SEQ ID NO: 9175228 - DNA, 22 bp, Homo sapiens
cctttgtgaggtcctgtggggg

SEQ ID NO: 9175229 - DNA, 22 bp, Homo sapiens
cctttgtgaatatgcagaaaat

SEQ ID NO: 9175230 - DNA, 22 bp, Homo sapiens
cctttggtggttttcagagatc

SEQ ID NO: 9175231 - DNA, 22 bp, Homo sapiens
cctttggttgagtgaaagtaag

SEQ ID NO: 9175232 - DNA, 22 bp, Homo sapiens
cctttggtgttattgggagaca

SEQ ID NO: 9175233 - DNA, 22 bp, Homo sapiens
cctttattcaattagtcctaat

SEQ ID NO: 9175234 - DNA, 22 bp, Homo sapiens
cctttattcaattagtcctaat

SEQ ID NO: 9175235 - DNA, 22 bp, Homo sapiens
cctttggtcacctccactctta

SEQ ID NO: 9175236 - DNA, 22 bp, Homo sapiens
cctttggtggcttcaaaatggc

SEQ ID NO: 9175237 - DNA, 22 bp, Homo sapiens
cctttggtcttgatgaactgtt

SEQ ID NO: 9175238 - DNA, 22 bp, Homo sapiens
cctttggtcttgatgaactgtt

SEQ ID NO: 9175239 - DNA, 20 bp, Homo sapiens
agtaggtgtccttcaggata

SEQ ID NO: 9175240 - DNA, 22 bp, Homo sapiens
cggctcactgcagctccgcctc

SEQ ID NO: 9175241 - DNA, 22 bp, Homo sapiens
cggcctgcacttgcctcgaggc

SEQ ID NO: 9175242 - DNA, 22 bp, Homo sapiens
cggccgcagcagtgtcggccca

SEQ ID NO: 9175243 - DNA, 22 bp, Homo sapiens
cggagaggtgggggcagcatct

SEQ ID NO: 9175244 - DNA, 21 bp, Homo sapiens
cgctccaccccacccactggc

SEQ ID NO: 9175245 - DNA, 22 bp, Homo sapiens
cggagcagaaggcgccgccggc

SEQ ID NO: 9175246 - DNA, 22 bp, Homo sapiens
cggagcagagccactcgggccg

SEQ ID NO: 9175247 - DNA, 22 bp, Homo sapiens
cggagcctgcttgttgcagctg

SEQ ID NO: 9175248 - DNA, 22 bp, Homo sapiens
cggagcctgcttgttgcagctg

SEQ ID NO: 9175249 - DNA, 22 bp, Homo sapiens
cggagcctgcttgttgcagctg

SEQ ID NO: 9175250 - DNA, 19 bp, Homo sapiens
cggcccctcctctcgcgcc

SEQ ID NO: 9175251 - DNA, 22 bp, Homo sapiens
cggccaagccggggccccgaag

SEQ ID NO: 9175252 - DNA, 22 bp, Homo sapiens
cggccaagccggggccccgaag

SEQ ID NO: 9175253 - DNA, 22 bp, Homo sapiens
cggcatgggcgtccccctcact

SEQ ID NO: 9175254 - DNA, 22 bp, Homo sapiens
cggccaagccggggccccgaag

SEQ ID NO: 9175255 - DNA, 22 bp, Homo sapiens
cggccaagccggggccccgaag

SEQ ID NO: 9175256 - DNA, 22 bp, Homo sapiens
cggaggggatacattttctgaa

SEQ ID NO: 9175257 - DNA, 22 bp, Homo sapiens
cggaggggatacattttctgaa

SEQ ID NO: 9175258 - DNA, 22 bp, Homo sapiens
cggaggggtttgaacagaggag

SEQ ID NO: 9175259 - DNA, 22 bp, Homo sapiens
cggaggggtttgaacagaggag

SEQ ID NO: 9175260 - DNA, 22 bp, Homo sapiens
cggaggggtttgaacagaggag

SEQ ID NO: 9175261 - DNA, 22 bp, Homo sapiens
aggtgctgaactggtgaggtct

SEQ ID NO: 9175262 - DNA, 17 bp, Homo sapiens
aggtgctggagcatcag

SEQ ID NO: 9175263 - DNA, 22 bp, Homo sapiens
aggtgctggagtagaagaaaaa

SEQ ID NO: 9175264 - DNA, 22 bp, Homo sapiens
aggtgctggagtctgggcagga

SEQ ID NO: 9175265 - DNA, 22 bp, Homo sapiens
aggtgctggagtctgggcagga

SEQ ID NO: 9175266 - DNA, 22 bp, Homo sapiens
aggtgctggagtctgggcagga

SEQ ID NO: 9175267 - DNA, 22 bp, Homo sapiens
aggtgctggcgccccaggagac

SEQ ID NO: 9175268 - DNA, 22 bp, Homo sapiens
aggtggctctgacagctctggt

SEQ ID NO: 9175269 - DNA, 22 bp, Homo sapiens
aggtgctgtttgtcagcagttt

SEQ ID NO: 9175270 - DNA, 22 bp, Homo sapiens
aggtgctgtttgtcagcagttt

SEQ ID NO: 9175271 - DNA, 22 bp, Homo sapiens
aggtgctgggcagcagtcattg

SEQ ID NO: 9175272 - DNA, 22 bp, Homo sapiens
aggtgctggcgccccaggagac

SEQ ID NO: 9175273 - DNA, 19 bp, Homo sapiens
aggtgctggtgagggtgtt

SEQ ID NO: 9175274 - DNA, 19 bp, Homo sapiens
aggtgctggtgagggtgtt

SEQ ID NO: 9175275 - DNA, 22 bp, Homo sapiens
aggtgctgtgctatgcacttgt

SEQ ID NO: 9175276 - DNA, 22 bp, Homo sapiens
aggtgctgttggcagcgggcag

SEQ ID NO: 9175277 - DNA, 22 bp, Homo sapiens
aggtgcccatcacctcacagtc

SEQ ID NO: 9175278 - DNA, 22 bp, Homo sapiens
aggtgcctatctggtctctgca

SEQ ID NO: 9175279 - DNA, 22 bp, Homo sapiens
aggtgcctgggagctccctgag

SEQ ID NO: 9175280 - DNA, 22 bp, Homo sapiens
aggtgccagctctcaggcagga

SEQ ID NO: 9175281 - DNA, 22 bp, Homo sapiens
cctgggagaactgctgggttgg

SEQ ID NO: 9175282 - DNA, 19 bp, Homo sapiens
cctgggacttaggctgggt

SEQ ID NO: 9175283 - DNA, 22 bp, Homo sapiens
cctgggacctcgcgggaagcgg

SEQ ID NO: 9175284 - DNA, 22 bp, Homo sapiens
cctgggaatgatgaccttgcct

SEQ ID NO: 9175285 - DNA, 22 bp, Homo sapiens
cctgggaagttgtggctgcagt

SEQ ID NO: 9175286 - DNA, 22 bp, Homo sapiens
cctgggaagttgtggctgcagt

SEQ ID NO: 9175287 - DNA, 22 bp, Homo sapiens
aggtgggacccgtggggtgcga

SEQ ID NO: 9175288 - DNA, 22 bp, Homo sapiens
aggtgggaacccagcagggccc

SEQ ID NO: 9175289 - DNA, 22 bp, Homo sapiens
aggtgggaacccagcagggccc

SEQ ID NO: 9175290 - DNA, 22 bp, Homo sapiens
ccttgctgcgtgctagcacaga

SEQ ID NO: 9175291 - DNA, 22 bp, Homo sapiens
ccttgctgcgtgctagcacaga

SEQ ID NO: 9175292 - DNA, 22 bp, Homo sapiens
ccttggagaagacagtgccagg

SEQ ID NO: 9175293 - DNA, 22 bp, Homo sapiens
ccttggagaagacagtgccagg

SEQ ID NO: 9175294 - DNA, 22 bp, Homo sapiens
ccttgcgttttacagcttctag

SEQ ID NO: 9175295 - DNA, 19 bp, Homo sapiens
ccttgcctgtccctgcagc

SEQ ID NO: 9175296 - DNA, 22 bp, Homo sapiens
ccttgctgaccatcacctttga

SEQ ID NO: 9175297 - DNA, 22 bp, Homo sapiens
ccttgctcggggagctgcagga

SEQ ID NO: 9175298 - DNA, 22 bp, Homo sapiens
ccttgctcaagctagtgacggg

SEQ ID NO: 9175299 - DNA, 22 bp, Homo sapiens
ccttgctcaagctagtgacggg

SEQ ID NO: 9175300 - DNA, 22 bp, Homo sapiens
ccttggcatcctctgaagaaat

SEQ ID NO: 9175301 - DNA, 22 bp, Homo sapiens
ccttggcaggggagaaatatat

SEQ ID NO: 9175302 - DNA, 16 bp, Homo sapiens
ccttggcatcagctgt

SEQ ID NO: 9175303 - DNA, 22 bp, Homo sapiens
cctgctctagactctgggaagg

SEQ ID NO: 9175304 - DNA, 22 bp, Homo sapiens
cctgctctccatacactttcta

SEQ ID NO: 9175305 - DNA, 22 bp, Homo sapiens
cctgctctaaatctcatggaac

SEQ ID NO: 9175306 - DNA, 22 bp, Homo sapiens
cctgcctggcttccagaagaga

SEQ ID NO: 9175307 - DNA, 22 bp, Homo sapiens
cctgctctgccaagtcctcttt

SEQ ID NO: 9175308 - DNA, 22 bp, Homo sapiens
cctgctctccatacactttcta

SEQ ID NO: 9175309 - DNA, 22 bp, Homo sapiens
cctgctctgccaagtcctcttt

SEQ ID NO: 9175310 - DNA, 22 bp, Homo sapiens
cctgctcttatagctgtttcca

SEQ ID NO: 9175311 - DNA, 22 bp, Homo sapiens
cctgctgaggtcagccacccaa

SEQ ID NO: 9175312 - DNA, 22 bp, Homo sapiens
cctgctgctatgaaggtgacag

SEQ ID NO: 9175313 - DNA, 22 bp, Homo sapiens
cctgctgctatgaaggtgacag

SEQ ID NO: 9175314 - DNA, 19 bp, Homo sapiens
cctgctgcaccacttgtta

SEQ ID NO: 9175315 - DNA, 22 bp, Homo sapiens
cctgctgctatgaaggtgacag

SEQ ID NO: 9175316 - DNA, 19 bp, Homo sapiens
cctgctgcccaccctctgc

SEQ ID NO: 9175317 - DNA, 22 bp, Homo sapiens
cctggaaatgtcgcgtgtagaa

SEQ ID NO: 9175318 - DNA, 22 bp, Homo sapiens
cctggcagcccagagcgccgct

SEQ ID NO: 9175319 - DNA, 22 bp, Homo sapiens
cctggaaggtgatggtacagca

SEQ ID NO: 9175320 - DNA, 22 bp, Homo sapiens
cctggaagattcaccactacca

SEQ ID NO: 9175321 - DNA, 22 bp, Homo sapiens
cctggaccaaacactggcctgg

SEQ ID NO: 9175322 - DNA, 22 bp, Homo sapiens
cctggaccaaacactggcctgg

SEQ ID NO: 9175323 - DNA, 22 bp, Homo sapiens
cctggacagagggcagcggcca

SEQ ID NO: 9175324 - DNA, 22 bp, Homo sapiens
cctggaagttggaggttgcagt

SEQ ID NO: 9175325 - DNA, 22 bp, Homo sapiens
cctgggaaggtgaggccctgga

SEQ ID NO: 9175326 - DNA, 22 bp, Homo sapiens
cctgggaaggggaagagaattc

SEQ ID NO: 9175327 - DNA, 22 bp, Homo sapiens
cctgggaaggtcttagcatcta

SEQ ID NO: 9175328 - DNA, 22 bp, Homo sapiens
cctggctgctttcactatggag

SEQ ID NO: 9175329 - DNA, 22 bp, Homo sapiens
cctggctggactggaccgtggc

SEQ ID NO: 9175330 - DNA, 19 bp, Homo sapiens
cctggctgctgtgggatgc

SEQ ID NO: 9175331 - DNA, 22 bp, Homo sapiens
cctggctgcttcctctgccatg

SEQ ID NO: 9175332 - DNA, 22 bp, Homo sapiens
cctggctcttcagaggttccta

SEQ ID NO: 9175333 - DNA, 22 bp, Homo sapiens
cctggctgctgtcactgaccat

SEQ ID NO: 9175334 - DNA, 19 bp, Homo sapiens
cctggctgctgtgggatgc

SEQ ID NO: 9175335 - DNA, 22 bp, Homo sapiens
cctggctctgtcctcgcgcaaa

SEQ ID NO: 9175336 - DNA, 22 bp, Homo sapiens
cctggccagaggcgtgcctgtg

SEQ ID NO: 9175337 - DNA, 22 bp, Homo sapiens
cctggctctgtcctcgcgcaaa

SEQ ID NO: 9175338 - DNA, 21 bp, Homo sapiens
cctggccaatctgatagggtt

SEQ ID NO: 9175339 - DNA, 22 bp, Homo sapiens
cctggcagctcctccccggcgg

SEQ ID NO: 9175340 - DNA, 22 bp, Homo sapiens
cctggcagctcctccccggcgg

SEQ ID NO: 9175341 - DNA, 21 bp, Homo sapiens
cctggccaatctgatagggtt

SEQ ID NO: 9175342 - DNA, 22 bp, Homo sapiens
cctggccacccagccttggcca

SEQ ID NO: 9175343 - DNA, 22 bp, Homo sapiens
cctggccacagggctctgcatt

SEQ ID NO: 9175344 - DNA, 22 bp, Homo sapiens
cctggccacccagccttggcca

SEQ ID NO: 9175345 - DNA, 22 bp, Homo sapiens
cctctctctcctgcacacacac

SEQ ID NO: 9175346 - DNA, 22 bp, Homo sapiens
cctctctctcctgcacacacac

SEQ ID NO: 9175347 - DNA, 22 bp, Homo sapiens
cctctctctcctgcacacacac

SEQ ID NO: 9175348 - DNA, 22 bp, Homo sapiens
cctctctctgcatctggagggc

SEQ ID NO: 9175349 - DNA, 22 bp, Homo sapiens
cctctctccaattttcacctca

SEQ ID NO: 9175350 - DNA, 22 bp, Homo sapiens
cctctctccaattttcacctca

SEQ ID NO: 9175351 - DNA, 22 bp, Homo sapiens
cctctctccaattttcacctca

SEQ ID NO: 9175352 - DNA, 22 bp, Homo sapiens
cctctctccttcctttgccaaa

SEQ ID NO: 9175353 - DNA, 22 bp, Homo sapiens
cctctgagtgacagcctcctct

SEQ ID NO: 9175354 - DNA, 22 bp, Homo sapiens
cctgcccctcaaggcctggtgc

SEQ ID NO: 9175355 - DNA, 22 bp, Homo sapiens
cctgccctaatccagagactag

SEQ ID NO: 9175356 - DNA, 22 bp, Homo sapiens
cctgccctaatccagagactag

SEQ ID NO: 9175357 - DNA, 22 bp, Homo sapiens
cctgccctatgaccagcttcac

SEQ ID NO: 9175358 - DNA, 22 bp, Homo sapiens
cctgccctatgaccagcttcac

SEQ ID NO: 9175359 - DNA, 22 bp, Homo sapiens
cctctgccacctcccacgaggc

SEQ ID NO: 9175360 - DNA, 22 bp, Homo sapiens
cctgccaggacattgcttgaag

SEQ ID NO: 9175361 - DNA, 22 bp, Homo sapiens
cctgcccagcttcacctcaggc

SEQ ID NO: 9175362 - DNA, 22 bp, Homo sapiens
cctgccaggagctggtgctgca

SEQ ID NO: 9175363 - DNA, 23 bp, Homo sapiens
cctgcccaggaatccggcggcgt

SEQ ID NO: 9175364 - DNA, 22 bp, Homo sapiens
cctgcccagcttcccgagtgca

SEQ ID NO: 9175365 - DNA, 22 bp, Homo sapiens
cctgcccaggagtctctctgtg

SEQ ID NO: 9175366 - DNA, 22 bp, Homo sapiens
cctgccctgctcactgtcggta

SEQ ID NO: 9175367 - DNA, 20 bp, Homo sapiens
agggtcagagagcgtgagtg

SEQ ID NO: 9175368 - DNA, 22 bp, Homo sapiens
agggtcagagatcggccatgtg

SEQ ID NO: 9175369 - DNA, 22 bp, Homo sapiens
agggtcagagatcggccatgtg

SEQ ID NO: 9175370 - DNA, 21 bp, Homo sapiens
agggtcaggaaccagggtacc

SEQ ID NO: 9175371 - DNA, 19 bp, Homo sapiens
agggtcaggacaaggactt

SEQ ID NO: 9175372 - DNA, 22 bp, Homo sapiens
agggtcagagtcaggtgcagta

SEQ ID NO: 9175373 - DNA, 22 bp, Homo sapiens
agggtcagagtcaggtgcagta

SEQ ID NO: 9175374 - DNA, 22 bp, Homo sapiens
agggtcagctggctgtcagggg

SEQ ID NO: 9175375 - DNA, 22 bp, Homo sapiens
agggtcagctggctgtcagggg

SEQ ID NO: 9175376 - DNA, 22 bp, Homo sapiens
agggtcctgggtgcagttgctt

SEQ ID NO: 9175377 - DNA, 22 bp, Homo sapiens
agggtccttctgttcctgagca

SEQ ID NO: 9175378 - DNA, 21 bp, Homo sapiens
agggtcctacagggctcagga

SEQ ID NO: 9175379 - DNA, 22 bp, Homo sapiens
agggtcctgagcctggggcgca

SEQ ID NO: 9175380 - DNA, 22 bp, Homo sapiens
agggtcctgagcctggggcgca

SEQ ID NO: 9175381 - DNA, 21 bp, Homo sapiens
agggtcctacagggctcagga

SEQ ID NO: 9175382 - DNA, 22 bp, Homo sapiens
agggtcaggagacactggcaac

SEQ ID NO: 9175383 - DNA, 22 bp, Homo sapiens
agggtcagggagtgagtattta

SEQ ID NO: 9175384 - DNA, 22 bp, Homo sapiens
agggtcaggagacactggcaac

SEQ ID NO: 9175385 - DNA, 20 bp, Homo sapiens
agggtcagtagcacagagct

SEQ ID NO: 9175386 - DNA, 22 bp, Homo sapiens
agggtcaggttaagggagtcat

SEQ ID NO: 9175387 - DNA, 22 bp, Homo sapiens
agggtcaggttaagggagtcat

SEQ ID NO: 9175388 - DNA, 22 bp, Homo sapiens
agggtcaggttaagggagtcat

SEQ ID NO: 9175389 - DNA, 17 bp, Homo sapiens
agggtcaggtgaagttc

SEQ ID NO: 9175390 - DNA, 17 bp, Homo sapiens
agggtcaggtgaagttc

SEQ ID NO: 9175391 - DNA, 22 bp, Homo sapiens
agggtctgactcctctggcaag

SEQ ID NO: 9175392 - DNA, 22 bp, Homo sapiens
agggtctgactgaatggaaaag

SEQ ID NO: 9175393 - DNA, 20 bp, Homo sapiens
agggtctgatgtggtggccc

SEQ ID NO: 9175394 - DNA, 20 bp, Homo sapiens
agggtctgctgggtaggaca

SEQ ID NO: 9175395 - DNA, 22 bp, Homo sapiens
agggtctgaccaccagtaggga

SEQ ID NO: 9175396 - DNA, 22 bp, Homo sapiens
agggtctcttgccatgcctcag

SEQ ID NO: 9175397 - DNA, 22 bp, Homo sapiens
agggtctctggagagctgagga

SEQ ID NO: 9175398 - DNA, 22 bp, Homo sapiens
agggtctctgggagtagggcac

SEQ ID NO: 9175399 - DNA, 22 bp, Homo sapiens
agggtctgtatttctggcaagc

SEQ ID NO: 9175400 - DNA, 22 bp, Homo sapiens
agggtctgtggatgcatctggg

SEQ ID NO: 9175401 - DNA, 22 bp, Homo sapiens
agggtctgttgtttgttctgga

SEQ ID NO: 9175402 - DNA, 22 bp, Homo sapiens
agggtgaatctcacaactctta

SEQ ID NO: 9175403 - DNA, 20 bp, Homo sapiens
agggtgagacatgagcctcc

SEQ ID NO: 9175404 - DNA, 22 bp, Homo sapiens
catttacagcagactgatgaaa

SEQ ID NO: 9175405 - DNA, 22 bp, Homo sapiens
aggcagcagcttgctggttgcc

SEQ ID NO: 9175406 - DNA, 22 bp, Homo sapiens
aggcagcagcttgctggttgcc

SEQ ID NO: 9175407 - DNA, 22 bp, Homo sapiens
catttacataacagtaacgctg

SEQ ID NO: 9175408 - DNA, 22 bp, Homo sapiens
aggcagcagccacaaggcctga

SEQ ID NO: 9175409 - DNA, 18 bp, Homo sapiens
aggcagcagcatcttctc

SEQ ID NO: 9175410 - DNA, 22 bp, Homo sapiens
aggcagcagccacaaggcctga

SEQ ID NO: 9175411 - DNA, 22 bp, Homo sapiens
aggcagcagccacaaggcctga

SEQ ID NO: 9175412 - DNA, 22 bp, Homo sapiens
aggcagcagccacaaggcctga

SEQ ID NO: 9175413 - DNA, 18 bp, Homo sapiens
aggcagcagcatcttctc

SEQ ID NO: 9175414 - DNA, 18 bp, Homo sapiens
aggcagcagcatcttctc

SEQ ID NO: 9175415 - DNA, 22 bp, Homo sapiens
aggcagcagaggttgaggaaag

SEQ ID NO: 9175416 - DNA, 22 bp, Homo sapiens
aggcagcagaggttgaggaaag

SEQ ID NO: 9175417 - DNA, 22 bp, Homo sapiens
aggcagcagaggttgaggaaag

SEQ ID NO: 9175418 - DNA, 22 bp, Homo sapiens
aggcagcagaggttgaggaaag

SEQ ID NO: 9175419 - DNA, 22 bp, Homo sapiens
aggcagcagaggttgaggaaag

SEQ ID NO: 9175420 - DNA, 22 bp, Homo sapiens
aggcagcagactgttaatcaga

SEQ ID NO: 9175421 - DNA, 22 bp, Homo sapiens
aggcagcagactgttaatcaga

SEQ ID NO: 9175422 - DNA, 22 bp, Homo sapiens
aggcagcagaaaacaaatggtt

SEQ ID NO: 9175423 - DNA, 22 bp, Homo sapiens
aggcagcagaaaacaaatggtt

SEQ ID NO: 9175424 - DNA, 22 bp, Homo sapiens
catttacatttaaggttaatat

SEQ ID NO: 9175425 - DNA, 22 bp, Homo sapiens
aggcagcagtcatgaggaaaga

SEQ ID NO: 9175426 - DNA, 22 bp, Homo sapiens
aggcagcagtcatgaggaaaga

SEQ ID NO: 9175427 - DNA, 19 bp, Homo sapiens
aggcagcattctggggctt

SEQ ID NO: 9175428 - DNA, 19 bp, Homo sapiens
aggcagcattctggggctt

SEQ ID NO: 9175429 - DNA, 19 bp, Homo sapiens
aggcagcattctggggctt

SEQ ID NO: 9175430 - DNA, 22 bp, Homo sapiens
aggcagcatttctgcttatcca

SEQ ID NO: 9175431 - DNA, 22 bp, Homo sapiens
aggcagcagtcatgaggaaaga

SEQ ID NO: 9175432 - DNA, 21 bp, Homo sapiens
catttacatgacagattggtt

SEQ ID NO: 9175433 - DNA, 22 bp, Homo sapiens
aggcagcagtcatgaggaaaga

SEQ ID NO: 9175434 - DNA, 19 bp, Homo sapiens
aggcagcattctggggctt

SEQ ID NO: 9175435 - DNA, 19 bp, Homo sapiens
aggcagcattctggggctt

SEQ ID NO: 9175436 - DNA, 22 bp, Homo sapiens
aggcagccagttcaggtttctt

SEQ ID NO: 9175437 - DNA, 22 bp, Homo sapiens
aggcagccagatggcagcctgc

SEQ ID NO: 9175438 - DNA, 22 bp, Homo sapiens
aggcagccagatggcagcctgc

SEQ ID NO: 9175439 - DNA, 22 bp, Homo sapiens
aggcagccaatcagaggctgac

SEQ ID NO: 9175440 - DNA, 22 bp, Homo sapiens
aggcagccaatcagaggctgac

SEQ ID NO: 9175441 - DNA, 22 bp, Homo sapiens
aggcagcatttgaatccaggtc

SEQ ID NO: 9175442 - DNA, 22 bp, Homo sapiens
aggcagcatttgaatccaggtc

SEQ ID NO: 9175443 - DNA, 22 bp, Homo sapiens
aggcagcatttgaatccaggtc

SEQ ID NO: 9175444 - DNA, 22 bp, Homo sapiens
cattatgaagcatcatcttatt

SEQ ID NO: 9175445 - DNA, 22 bp, Homo sapiens
cattatgaagcatcatcttatt

SEQ ID NO: 9175446 - DNA, 22 bp, Homo sapiens
cattatctcttctatatgctag

SEQ ID NO: 9175447 - DNA, 22 bp, Homo sapiens
cattatctcttctatatgctag

SEQ ID NO: 9175448 - DNA, 22 bp, Homo sapiens
cattatggcagccaggatattg

SEQ ID NO: 9175449 - DNA, 20 bp, Homo sapiens
cattatggttgggcacagtg

SEQ ID NO: 9175450 - DNA, 22 bp, Homo sapiens
cattattaattcagcacatgct

SEQ ID NO: 9175451 - DNA, 22 bp, Homo sapiens
catggcctcaaaggactgcaga

SEQ ID NO: 9175452 - DNA, 22 bp, Homo sapiens
catggcctctctcctggaatgg

SEQ ID NO: 9175453 - DNA, 22 bp, Homo sapiens
catggccttcacctcccctgcc

SEQ ID NO: 9175454 - DNA, 22 bp, Homo sapiens
catggcctgcctcctcctggtg

SEQ ID NO: 9175455 - DNA, 22 bp, Homo sapiens
catggccttgagtgactgcact

SEQ ID NO: 9175456 - DNA, 22 bp, Homo sapiens
catggcggtcaggatgtaggtg

SEQ ID NO: 9175457 - DNA, 22 bp, Homo sapiens
cattaagatgcaaacctaacta

SEQ ID NO: 9175458 - DNA, 21 bp, Homo sapiens
cattaagtaccagggcactgt

SEQ ID NO: 9175459 - DNA, 22 bp, Homo sapiens
cattcctattatgtccctagtg

SEQ ID NO: 9175460 - DNA, 21 bp, Homo sapiens
cattcctcggctcatagagga

SEQ ID NO: 9175461 - DNA, 21 bp, Homo sapiens
cattcctcggctcatagagga

SEQ ID NO: 9175462 - DNA, 19 bp, Homo sapiens
aggcagaggcttggctagc

SEQ ID NO: 9175463 - DNA, 19 bp, Homo sapiens
aggcagaggcttggctagc

SEQ ID NO: 9175464 - DNA, 19 bp, Homo sapiens
aggcagaggcttggctagc

SEQ ID NO: 9175465 - DNA, 19 bp, Homo sapiens
aggcagaggcttggctagc

SEQ ID NO: 9175466 - DNA, 19 bp, Homo sapiens
aggcagaggcttggctagc

SEQ ID NO: 9175467 - DNA, 19 bp, Homo sapiens
aggcagcacccagtccttg

SEQ ID NO: 9175468 - DNA, 19 bp, Homo sapiens
aggcagcacccagtccttg

SEQ ID NO: 9175469 - DNA, 22 bp, Homo sapiens
aggcagcagaaaacaaatggtt

SEQ ID NO: 9175470 - DNA, 22 bp, Homo sapiens
cattccaagtatatacatgata

SEQ ID NO: 9175471 - DNA, 22 bp, Homo sapiens
cattcccacgtgttctttgctt

SEQ ID NO: 9175472 - DNA, 22 bp, Homo sapiens
cattcccatgactcctgctcag

SEQ ID NO: 9175473 - DNA, 22 bp, Homo sapiens
cattcccacgtgttctttgctt

SEQ ID NO: 9175474 - DNA, 22 bp, Homo sapiens
catgaaatgtgttaatctcttg

SEQ ID NO: 9175475 - DNA, 22 bp, Homo sapiens
catgaaatgtgttaatctcttg

SEQ ID NO: 9175476 - DNA, 22 bp, Homo sapiens
catgaaatgttagaattagaca

SEQ ID NO: 9175477 - DNA, 22 bp, Homo sapiens
catgaaatgttagaattagaca

SEQ ID NO: 9175478 - DNA, 22 bp, Homo sapiens
catgaaattcagcaggtgagta

SEQ ID NO: 9175479 - DNA, 22 bp, Homo sapiens
catgaaattcagcaggtgagta

SEQ ID NO: 9175480 - DNA, 22 bp, Homo sapiens
catgaaatggccaaccttcggc

SEQ ID NO: 9175481 - DNA, 22 bp, Homo sapiens
catgaaatgatatttgggtggg

SEQ ID NO: 9175482 - DNA, 22 bp, Homo sapiens
catgaaatcacaagctgaggac

SEQ ID NO: 9175483 - DNA, 22 bp, Homo sapiens
catgaaatcacaagctgaggac

SEQ ID NO: 9175484 - DNA, 22 bp, Homo sapiens
catgaaatctgagtatgtttcc

SEQ ID NO: 9175485 - DNA, 22 bp, Homo sapiens
catgaaatcacaagctgaggac

SEQ ID NO: 9175486 - DNA, 22 bp, Homo sapiens
catgaaagcaggaatggtttta

SEQ ID NO: 9175487 - DNA, 22 bp, Homo sapiens
catgaaatatgctacctgtctt

SEQ ID NO: 9175488 - DNA, 22 bp, Homo sapiens
catgaaatattagtaactgttt

SEQ ID NO: 9175489 - DNA, 22 bp, Homo sapiens
aggaggcactcactctcagggt

SEQ ID NO: 9175490 - DNA, 22 bp, Homo sapiens
aggaggcactcactctcagggt

SEQ ID NO: 9175491 - DNA, 22 bp, Homo sapiens
aggaggtggctgaacttgaggg

SEQ ID NO: 9175492 - DNA, 22 bp, Homo sapiens
catgagtatgattatacccagt

SEQ ID NO: 9175493 - DNA, 22 bp, Homo sapiens
catgcacactgcaacaaggact

SEQ ID NO: 9175494 - DNA, 22 bp, Homo sapiens
catgcacagtgatatctgaaga

SEQ ID NO: 9175495 - DNA, 22 bp, Homo sapiens
catgcctgtaatcccagcactt

SEQ ID NO: 9175496 - DNA, 22 bp, Homo sapiens
catgcctctgcagctgtttatt

SEQ ID NO: 9175497 - DNA, 17 bp, Homo sapiens
catgccccaggcttagc

SEQ ID NO: 9175498 - DNA, 22 bp, Homo sapiens
catgccatttcttctctttatg

SEQ ID NO: 9175499 - DNA, 22 bp, Homo sapiens
catgccagttttgagatgcacc

SEQ ID NO: 9175500 - DNA, 22 bp, Homo sapiens
catgccattccctgatcctaac

SEQ ID NO: 9175501 - DNA, 22 bp, Homo sapiens
catgcagatatttttattgtgg

SEQ ID NO: 9175502 - DNA, 22 bp, Homo sapiens
catgcaggcccgcctgaatggg

SEQ ID NO: 9175503 - DNA, 22 bp, Homo sapiens
catgcaggcacccagagcccac

SEQ ID NO: 9175504 - DNA, 22 bp, Homo sapiens
catggccaggcccagggcccag

SEQ ID NO: 9175505 - DNA, 22 bp, Homo sapiens
catggccagggcagatggcagg

SEQ ID NO: 9175506 - DNA, 22 bp, Homo sapiens
aggcacaggaggtggtaagaag

SEQ ID NO: 9175507 - DNA, 22 bp, Homo sapiens
aggcacaggaatgtcatccagt

SEQ ID NO: 9175508 - DNA, 22 bp, Homo sapiens
aggcacaggaggtggtaagaag

SEQ ID NO: 9175509 - DNA, 22 bp, Homo sapiens
aggcacaggaatgtcatccagt

SEQ ID NO: 9175510 - DNA, 22 bp, Homo sapiens
aggcacaggaatgtcatccagt

SEQ ID NO: 9175511 - DNA, 22 bp, Homo sapiens
aggcacaggaggtggtaagaag

SEQ ID NO: 9175512 - DNA, 22 bp, Homo sapiens
aggcacaggaacaggaaaagag

SEQ ID NO: 9175513 - DNA, 22 bp, Homo sapiens
aggcacaggaacaggaaaagag

SEQ ID NO: 9175514 - DNA, 22 bp, Homo sapiens
aggcacaggaacaggaaaagag

SEQ ID NO: 9175515 - DNA, 22 bp, Homo sapiens
aggcacagcctcccttcacatg

SEQ ID NO: 9175516 - DNA, 22 bp, Homo sapiens
aggcacagcctcccttcacatg

SEQ ID NO: 9175517 - DNA, 22 bp, Homo sapiens
aggcacagcacacctggccccc

SEQ ID NO: 9175518 - DNA, 22 bp, Homo sapiens
aggcacagcctcccccaactcc

SEQ ID NO: 9175519 - DNA, 22 bp, Homo sapiens
aggcacagcctcccccaactcc

SEQ ID NO: 9175520 - DNA, 22 bp, Homo sapiens
aggcaatggggcttcaggcagg

SEQ ID NO: 9175521 - DNA, 22 bp, Homo sapiens
aggaggaattgacacagaagcc

SEQ ID NO: 9175522 - DNA, 22 bp, Homo sapiens
aggaggaattgacacagaagcc

SEQ ID NO: 9175523 - DNA, 22 bp, Homo sapiens
aggaggaatacaatccagcagc

SEQ ID NO: 9175524 - DNA, 22 bp, Homo sapiens
aggaggaatacaatccagcagc

SEQ ID NO: 9175525 - DNA, 22 bp, Homo sapiens
aggaggaatacaatccagcagc

SEQ ID NO: 9175526 - DNA, 22 bp, Homo sapiens
aggaggaggctggagtacaccc

SEQ ID NO: 9175527 - DNA, 22 bp, Homo sapiens
aggaggaggctggagtacaccc

SEQ ID NO: 9175528 - DNA, 22 bp, Homo sapiens
aggaggaggctggagtacaccc

SEQ ID NO: 9175529 - DNA, 21 bp, Homo sapiens
aggaggagagcttggcctacc

SEQ ID NO: 9175530 - DNA, 22 bp, Homo sapiens
aggaggaggtgggacacagtga

SEQ ID NO: 9175531 - DNA, 17 bp, Homo sapiens
aggaggatcagagagta

SEQ ID NO: 9175532 - DNA, 20 bp, Homo sapiens
aggagctgaattagagggtt

SEQ ID NO: 9175533 - DNA, 22 bp, Homo sapiens
aggagctgacttgtaaagcatt

SEQ ID NO: 9175534 - DNA, 22 bp, Homo sapiens
aggagctgaagtctctgcactc

SEQ ID NO: 9175535 - DNA, 22 bp, Homo sapiens
aggagctgaagtctctgcactc

SEQ ID NO: 9175536 - DNA, 22 bp, Homo sapiens
aggagctgaaacttctcatatg

SEQ ID NO: 9175537 - DNA, 20 bp, Homo sapiens
aggagctctgtgctgggaag

SEQ ID NO: 9175538 - DNA, 20 bp, Homo sapiens
aggagctctgtgctgggaag

SEQ ID NO: 9175539 - DNA, 22 bp, Homo sapiens
aggaggaagggaagacaagtaa

SEQ ID NO: 9175540 - DNA, 20 bp, Homo sapiens
aggaggaagaaagcacactg

SEQ ID NO: 9175541 - DNA, 22 bp, Homo sapiens
aggagctgtgaatgggaggggt

SEQ ID NO: 9175542 - DNA, 22 bp, Homo sapiens
aggagctgatagtctatggaga

SEQ ID NO: 9175543 - DNA, 22 bp, Homo sapiens
aggagctgataaaagggggtca

SEQ ID NO: 9175544 - DNA, 22 bp, Homo sapiens
aggagctgagtcagcccgacag

SEQ ID NO: 9175545 - DNA, 22 bp, Homo sapiens
aggagctgagtcagcccgacag

SEQ ID NO: 9175546 - DNA, 22 bp, Homo sapiens
aggagctgagggagcgcccttg

SEQ ID NO: 9175547 - DNA, 22 bp, Homo sapiens
aggagctgagggagcgcccttg

SEQ ID NO: 9175548 - DNA, 22 bp, Homo sapiens
aggagaggcatcaagaaaatcg

SEQ ID NO: 9175549 - DNA, 22 bp, Homo sapiens
aggagaggcatcaagaaaatcg

SEQ ID NO: 9175550 - DNA, 22 bp, Homo sapiens
aggagaggcatcaagaaaatcg

SEQ ID NO: 9175551 - DNA, 22 bp, Homo sapiens
aggagaggaatcattattacaa

SEQ ID NO: 9175552 - DNA, 22 bp, Homo sapiens
aggagagctggtgtctggaatc

SEQ ID NO: 9175553 - DNA, 22 bp, Homo sapiens
aggagaggggtaggattaattt

SEQ ID NO: 9175554 - DNA, 22 bp, Homo sapiens
aggagaggggtaggattaattt

SEQ ID NO: 9175555 - DNA, 22 bp, Homo sapiens
aggagaggctctaactctgtgt

SEQ ID NO: 9175556 - DNA, 22 bp, Homo sapiens
aggagagagaacacttgggtcc

SEQ ID NO: 9175557 - DNA, 22 bp, Homo sapiens
aggagactgtgaattgactgtc

SEQ ID NO: 9175558 - DNA, 22 bp, Homo sapiens
aggagagaattactgggtgtca

SEQ ID NO: 9175559 - DNA, 22 bp, Homo sapiens
aggagagaatgttccaggcttg

SEQ ID NO: 9175560 - DNA, 22 bp, Homo sapiens
aggagctaattcataagccact

SEQ ID NO: 9175561 - DNA, 22 bp, Homo sapiens
aggagcctgtgcctggcactcc

SEQ ID NO: 9175562 - DNA, 19 bp, Homo sapiens
aggagccttgagcagtgag

SEQ ID NO: 9175563 - DNA, 18 bp, Homo sapiens
aggagcctttgcactgga

SEQ ID NO: 9175564 - DNA, 22 bp, Homo sapiens
aggagctcagctaagttggaga

SEQ ID NO: 9175565 - DNA, 22 bp, Homo sapiens
aggagctcagcctgcagggagc

SEQ ID NO: 9175566 - DNA, 22 bp, Homo sapiens
aggagctcagcctgcagggagc

SEQ ID NO: 9175567 - DNA, 22 bp, Homo sapiens
aggagctcagcctgcagggagc

SEQ ID NO: 9175568 - DNA, 22 bp, Homo sapiens
aggagctcaaagatgccaggag

SEQ ID NO: 9175569 - DNA, 22 bp, Homo sapiens
aggagctcccgtgaggagacca

SEQ ID NO: 9175570 - DNA, 21 bp, Homo sapiens
aggagctctccaaggacaaag

SEQ ID NO: 9175571 - DNA, 21 bp, Homo sapiens
aggagctctccaaggacaaag

SEQ ID NO: 9175572 - DNA, 22 bp, Homo sapiens
aggagctccagcccagggaagt

SEQ ID NO: 9175573 - DNA, 22 bp, Homo sapiens
aggagctcattgaagtggatga

SEQ ID NO: 9175574 - DNA, 22 bp, Homo sapiens
aggagctcattgaagtggatga

SEQ ID NO: 9175575 - DNA, 22 bp, Homo sapiens
aggagccatgagcaggaggcaa

SEQ ID NO: 9175576 - DNA, 22 bp, Homo sapiens
aggagcctgtgcctggcactcc

SEQ ID NO: 9175577 - DNA, 22 bp, Homo sapiens
aggagccatgagcaggaggcaa

SEQ ID NO: 9175578 - DNA, 22 bp, Homo sapiens
aggagcctggctggcccacagg

SEQ ID NO: 9175579 - DNA, 22 bp, Homo sapiens
aggagagggtggcattaagttt

SEQ ID NO: 9175580 - DNA, 22 bp, Homo sapiens
aggagagggtggcattaagttt

SEQ ID NO: 9175581 - DNA, 22 bp, Homo sapiens
aggagaggtctcccttccccag

SEQ ID NO: 9175582 - DNA, 22 bp, Homo sapiens
aggagaggtctcccttccccag

SEQ ID NO: 9175583 - DNA, 22 bp, Homo sapiens
aggagaaatccatcgagaatgg

SEQ ID NO: 9175584 - DNA, 18 bp, Homo sapiens
aggagaaagggaccaggg

SEQ ID NO: 9175585 - DNA, 20 bp, Homo sapiens
aggagaaattcgggacacct

SEQ ID NO: 9175586 - DNA, 22 bp, Homo sapiens
aggactttgattttgtaagatc

SEQ ID NO: 9175587 - DNA, 22 bp, Homo sapiens
aggacaggattccttgccttgc

SEQ ID NO: 9175588 - DNA, 22 bp, Homo sapiens
aggactgacttttgccatgaaa

SEQ ID NO: 9175589 - DNA, 22 bp, Homo sapiens
aggacagcccttgagagcacat

SEQ ID NO: 9175590 - DNA, 22 bp, Homo sapiens
aggacagcccttgagagcacat

SEQ ID NO: 9175591 - DNA, 21 bp, Homo sapiens
aggacaggaactggctgaata

SEQ ID NO: 9175592 - DNA, 21 bp, Homo sapiens
aggacaggaactggctgaata

SEQ ID NO: 9175593 - DNA, 21 bp, Homo sapiens
aggacaggaactggctgaata

SEQ ID NO: 9175594 - DNA, 22 bp, Homo sapiens
aggacagcagttggtgaggttc

SEQ ID NO: 9175595 - DNA, 22 bp, Homo sapiens
aggacagcagtgctggcacttg

SEQ ID NO: 9175596 - DNA, 22 bp, Homo sapiens
aggacagcatatgggaaccagt

SEQ ID NO: 9175597 - DNA, 22 bp, Homo sapiens
aggacagcatatgggaaccagt

SEQ ID NO: 9175598 - DNA, 22 bp, Homo sapiens
aggacagcattttcagcatctc

SEQ ID NO: 9175599 - DNA, 22 bp, Homo sapiens
aggacagcattttcagcatctc

SEQ ID NO: 9175600 - DNA, 22 bp, Homo sapiens
aggacagcccccaacagcaaca

SEQ ID NO: 9175601 - DNA, 22 bp, Homo sapiens
cagtctctggcagctgctggcc

SEQ ID NO: 9175602 - DNA, 22 bp, Homo sapiens
cagtctctgtgccagatcctgg

SEQ ID NO: 9175603 - DNA, 23 bp, Homo sapiens
aggagaagagatttccacatgca

SEQ ID NO: 9175604 - DNA, 19 bp, Homo sapiens
aggagaagactctctcccc

SEQ ID NO: 9175605 - DNA, 23 bp, Homo sapiens
aggagaagagatttccacatgca

SEQ ID NO: 9175606 - DNA, 22 bp, Homo sapiens
aggagaagccaagttgtgagca

SEQ ID NO: 9175607 - DNA, 23 bp, Homo sapiens
aggagaagagatttccacatgca

SEQ ID NO: 9175608 - DNA, 22 bp, Homo sapiens
cagtcctgagccaatcatgatg

SEQ ID NO: 9175609 - DNA, 22 bp, Homo sapiens
cagtcctgagccaatcatgatg

SEQ ID NO: 9175610 - DNA, 20 bp, Homo sapiens
cagtcctgcaggcgggagaa

SEQ ID NO: 9175611 - DNA, 22 bp, Homo sapiens
cagtcctgcccaggctgacaga

SEQ ID NO: 9175612 - DNA, 22 bp, Homo sapiens
cagtcctgaggaagagctgctg

SEQ ID NO: 9175613 - DNA, 22 bp, Homo sapiens
cagtcctgctggccttccctgg

SEQ ID NO: 9175614 - DNA, 22 bp, Homo sapiens
cagtcctgctggccttccctgg

SEQ ID NO: 9175615 - DNA, 22 bp, Homo sapiens
cagtcctgggagacttacccag

SEQ ID NO: 9175616 - DNA, 20 bp, Homo sapiens
cagtcctgccccttggggac

SEQ ID NO: 9175617 - DNA, 22 bp, Homo sapiens
cagtcctgcccaggctgacaga

SEQ ID NO: 9175618 - DNA, 22 bp, Homo sapiens
cagtcctgcccaggctgacaga

SEQ ID NO: 9175619 - DNA, 21 bp, Homo sapiens
aggacagcaggagcatttatt

SEQ ID NO: 9175620 - DNA, 22 bp, Homo sapiens
aggacagcagccattggcagtc

SEQ ID NO: 9175621 - DNA, 20 bp, Homo sapiens
aggacagcagctgccacttg

SEQ ID NO: 9175622 - DNA, 22 bp, Homo sapiens
cagtcctgggcacagccctggg

SEQ ID NO: 9175623 - DNA, 22 bp, Homo sapiens
aggacagcaaccgttattcaca

SEQ ID NO: 9175624 - DNA, 20 bp, Homo sapiens
aggaaggaagtttgcatgga

SEQ ID NO: 9175625 - DNA, 22 bp, Homo sapiens
aggaaggactccatggtccgtc

SEQ ID NO: 9175626 - DNA, 22 bp, Homo sapiens
aggaaggactgcagcatttggt

SEQ ID NO: 9175627 - DNA, 22 bp, Homo sapiens
aggaagcttggggcagggctac

SEQ ID NO: 9175628 - DNA, 22 bp, Homo sapiens
aggaagctttatgaccagctaa

SEQ ID NO: 9175629 - DNA, 19 bp, Homo sapiens
aggaaggaacctgagtctg

SEQ ID NO: 9175630 - DNA, 19 bp, Homo sapiens
aggaaggaacctgagtctg

SEQ ID NO: 9175631 - DNA, 19 bp, Homo sapiens
aggaaggaacctgagtctg

SEQ ID NO: 9175632 - DNA, 22 bp, Homo sapiens
aggaaggaagagacaccatttg

SEQ ID NO: 9175633 - DNA, 19 bp, Homo sapiens
aggaaggaacctgagtctg

SEQ ID NO: 9175634 - DNA, 21 bp, Homo sapiens
aggaagctgcccagatagtag

SEQ ID NO: 9175635 - DNA, 22 bp, Homo sapiens
aggaagctgcctgggatgggaa

SEQ ID NO: 9175636 - DNA, 22 bp, Homo sapiens
aggaagctggttacgaagggat

SEQ ID NO: 9175637 - DNA, 22 bp, Homo sapiens
aggaagctggtgtgaggatgaa

SEQ ID NO: 9175638 - DNA, 22 bp, Homo sapiens
aggaagctggggtgttcttcat

SEQ ID NO: 9175639 - DNA, 22 bp, Homo sapiens
agctgctgaatgacactgcaag

SEQ ID NO: 9175640 - DNA, 22 bp, Homo sapiens
agctgctgaatgacactgcaag

SEQ ID NO: 9175641 - DNA, 22 bp, Homo sapiens
agctgctgaatgacactgcaag

SEQ ID NO: 9175642 - DNA, 22 bp, Homo sapiens
agctgctgaatgacactgcaag

SEQ ID NO: 9175643 - DNA, 22 bp, Homo sapiens
agctgctgagagtctgccgggc

SEQ ID NO: 9175644 - DNA, 22 bp, Homo sapiens
agctgctcctttcctgcaggcg

SEQ ID NO: 9175645 - DNA, 22 bp, Homo sapiens
agctgctctacatgatggggaa

SEQ ID NO: 9175646 - DNA, 22 bp, Homo sapiens
agctgctcgaagccggtggccc

SEQ ID NO: 9175647 - DNA, 20 bp, Homo sapiens
agctgctctcatccagacct

SEQ ID NO: 9175648 - DNA, 22 bp, Homo sapiens
agctgctctcagcagttccagg

SEQ ID NO: 9175649 - DNA, 22 bp, Homo sapiens
agctgctccaacccagcgggct

SEQ ID NO: 9175650 - DNA, 22 bp, Homo sapiens
caggaaaaatgccaggagtcag

SEQ ID NO: 9175651 - DNA, 22 bp, Homo sapiens
caggaaaaatgccaggagtcag

SEQ ID NO: 9175652 - DNA, 22 bp, Homo sapiens
caggaaaaatgccaggagtcag

SEQ ID NO: 9175653 - DNA, 21 bp, Homo sapiens
caggaaaagcggaagtctagc

SEQ ID NO: 9175654 - DNA, 21 bp, Homo sapiens
caggaaaagcggaagtctagc

SEQ ID NO: 9175655 - DNA, 21 bp, Homo sapiens
caggaaaagcggaagtctagc

SEQ ID NO: 9175656 - DNA, 21 bp, Homo sapiens
caggaaaagcggaagtctagc

SEQ ID NO: 9175657 - DNA, 22 bp, Homo sapiens
caggacagaaataaggaatata

SEQ ID NO: 9175658 - DNA, 22 bp, Homo sapiens
caggacagaaataaggaatata

SEQ ID NO: 9175659 - DNA, 22 bp, Homo sapiens
caggacagaaataaggaatata

SEQ ID NO: 9175660 - DNA, 22 bp, Homo sapiens
caggacagacagaatgcctaac

SEQ ID NO: 9175661 - DNA, 22 bp, Homo sapiens
caggacagacagaatgcctaac

SEQ ID NO: 9175662 - DNA, 22 bp, Homo sapiens
caggacagaccaagatcgtgct

SEQ ID NO: 9175663 - DNA, 22 bp, Homo sapiens
caggacagaccaagatcgtgct

SEQ ID NO: 9175664 - DNA, 19 bp, Homo sapiens
caggacagacttcaaagcc

SEQ ID NO: 9175665 - DNA, 19 bp, Homo sapiens
caggacagacttcaaagcc

SEQ ID NO: 9175666 - DNA, 22 bp, Homo sapiens
caggacagagcccagactgtgt

SEQ ID NO: 9175667 - DNA, 22 bp, Homo sapiens
agctggaggataactcacttct

SEQ ID NO: 9175668 - DNA, 22 bp, Homo sapiens
caggacagagcccagactgtgt

SEQ ID NO: 9175669 - DNA, 23 bp, Homo sapiens
agctggaggctgtctactcccaa

SEQ ID NO: 9175670 - DNA, 22 bp, Homo sapiens
caggacagagcccagactgtgt

SEQ ID NO: 9175671 - DNA, 22 bp, Homo sapiens
caggacagagcccagactgtgt

SEQ ID NO: 9175672 - DNA, 22 bp, Homo sapiens
caggacagagcccagactgtgt

SEQ ID NO: 9175673 - DNA, 21 bp, Homo sapiens
agctggcagtgcctggacctc

SEQ ID NO: 9175674 - DNA, 22 bp, Homo sapiens
agctggcagtatgactggtgac

SEQ ID NO: 9175675 - DNA, 22 bp, Homo sapiens
agctggcagtcatcctagtgag

SEQ ID NO: 9175676 - DNA, 22 bp, Homo sapiens
agctggcagtcatcctagtgag

SEQ ID NO: 9175677 - DNA, 22 bp, Homo sapiens
caggagtctctcttgagcccag

SEQ ID NO: 9175678 - DNA, 22 bp, Homo sapiens
caggagtccctctggccagcat

SEQ ID NO: 9175679 - DNA, 22 bp, Homo sapiens
caggagtcccaggggtgggcca

SEQ ID NO: 9175680 - DNA, 22 bp, Homo sapiens
agctggctggccccttcctgcc

SEQ ID NO: 9175681 - DNA, 22 bp, Homo sapiens
agctggctggccccttcctgcc

SEQ ID NO: 9175682 - DNA, 21 bp, Homo sapiens
agctggcctggtttgagctcc

SEQ ID NO: 9175683 - DNA, 19 bp, Homo sapiens
agctggctcttctttgtct

SEQ ID NO: 9175684 - DNA, 22 bp, Homo sapiens
agctggctgggtgccagtctcc

SEQ ID NO: 9175685 - DNA, 22 bp, Homo sapiens
agctggctgggtgccagtctcc

SEQ ID NO: 9175686 - DNA, 22 bp, Homo sapiens
agctggcttctctgcagacatt

SEQ ID NO: 9175687 - DNA, 22 bp, Homo sapiens
agctggcttctctgcagacatt

SEQ ID NO: 9175688 - DNA, 22 bp, Homo sapiens
agctggcttcacaggcagtgtg

SEQ ID NO: 9175689 - DNA, 22 bp, Homo sapiens
agctggctttatggttggctaa

SEQ ID NO: 9175690 - DNA, 22 bp, Homo sapiens
agctggctttatggttggctaa

SEQ ID NO: 9175691 - DNA, 22 bp, Homo sapiens
agctggctttgagctgggaggt

SEQ ID NO: 9175692 - DNA, 22 bp, Homo sapiens
agctggctttgagctgggaggt

SEQ ID NO: 9175693 - DNA, 22 bp, Homo sapiens
caggaggttgagggtgcagtga

SEQ ID NO: 9175694 - DNA, 22 bp, Homo sapiens
caggaggttgtaagagcaggcc

SEQ ID NO: 9175695 - DNA, 22 bp, Homo sapiens
caggagtccagagtgtcatttt

SEQ ID NO: 9175696 - DNA, 22 bp, Homo sapiens
caggagtccatctggcctggtg

SEQ ID NO: 9175697 - DNA, 22 bp, Homo sapiens
agctggccagcacctccaggtc

SEQ ID NO: 9175698 - DNA, 22 bp, Homo sapiens
caggagggtgtggaaaactggg

SEQ ID NO: 9175699 - DNA, 22 bp, Homo sapiens
agctggcatctgaagtcagggc

SEQ ID NO: 9175700 - DNA, 22 bp, Homo sapiens
agctggcattacaggagcatgc

SEQ ID NO: 9175701 - DNA, 22 bp, Homo sapiens
agctggcattacaggagcatgc

SEQ ID NO: 9175702 - DNA, 22 bp, Homo sapiens
cagctctgaagaaaggtgtcta

SEQ ID NO: 9175703 - DNA, 22 bp, Homo sapiens
cagcttctgtttattgtgtgcc

SEQ ID NO: 9175704 - DNA, 22 bp, Homo sapiens
cagcttctgctcatggaggggt

SEQ ID NO: 9175705 - DNA, 22 bp, Homo sapiens
cagcttctggcgtggagcctga

SEQ ID NO: 9175706 - DNA, 22 bp, Homo sapiens
cagcttcttcagtcctggagct

SEQ ID NO: 9175707 - DNA, 22 bp, Homo sapiens
cagcttcttcagtcctggagct

SEQ ID NO: 9175708 - DNA, 22 bp, Homo sapiens
cagcttctttgggattctttat

SEQ ID NO: 9175709 - DNA, 22 bp, Homo sapiens
cagcttctttgggattctttat

SEQ ID NO: 9175710 - DNA, 22 bp, Homo sapiens
cagcttcttacgagctggtact

SEQ ID NO: 9175711 - DNA, 22 bp, Homo sapiens
cagcttctgtttctagcccctg

SEQ ID NO: 9175712 - DNA, 22 bp, Homo sapiens
cagcttcttagtctttccttgt

SEQ ID NO: 9175713 - DNA, 22 bp, Homo sapiens
cagcttcttagtctttccttgt

SEQ ID NO: 9175714 - DNA, 22 bp, Homo sapiens
agctctcttgtgttctgtatgg

SEQ ID NO: 9175715 - DNA, 22 bp, Homo sapiens
agctcctgtgtgaagcctccct

SEQ ID NO: 9175716 - DNA, 22 bp, Homo sapiens
agctctgcaggcacagctgagg

SEQ ID NO: 9175717 - DNA, 22 bp, Homo sapiens
agctctgcagcccagcaggtgg

SEQ ID NO: 9175718 - DNA, 22 bp, Homo sapiens
agctctggaactcccggctgct

SEQ ID NO: 9175719 - DNA, 22 bp, Homo sapiens
cagctcctgcctgggcagctgt

SEQ ID NO: 9175720 - DNA, 22 bp, Homo sapiens
cagctcctgcagctggctccca

SEQ ID NO: 9175721 - DNA, 22 bp, Homo sapiens
cagctcctgcctgggcagctgt

SEQ ID NO: 9175722 - DNA, 22 bp, Homo sapiens
cagctcctgcagctggctccca

SEQ ID NO: 9175723 - DNA, 22 bp, Homo sapiens
agctctggaagccctggtagtt

SEQ ID NO: 9175724 - DNA, 22 bp, Homo sapiens
cagctcctgcctgggcagctgt

SEQ ID NO: 9175725 - DNA, 22 bp, Homo sapiens
cagctcctgggccatctcctag

SEQ ID NO: 9175726 - DNA, 22 bp, Homo sapiens
agctgcaggcccatgctcagtc

SEQ ID NO: 9175727 - DNA, 21 bp, Homo sapiens
agctgcagcccaaaggcctgt

SEQ ID NO: 9175728 - DNA, 21 bp, Homo sapiens
agctgcaggcctcccagggat

SEQ ID NO: 9175729 - DNA, 22 bp, Homo sapiens
agctgaggctctgagagggaag

SEQ ID NO: 9175730 - DNA, 22 bp, Homo sapiens
agctgaggctctgagagggaag

SEQ ID NO: 9175731 - DNA, 22 bp, Homo sapiens
agctgaggctctgagagggaag

SEQ ID NO: 9175732 - DNA, 23 bp, Homo sapiens
agctgaggctgtgggtgtcagag

SEQ ID NO: 9175733 - DNA, 22 bp, Homo sapiens
cagcttgaaatattaggagatg

SEQ ID NO: 9175734 - DNA, 23 bp, Homo sapiens
cagcttctttgggattctttata

SEQ ID NO: 9175735 - DNA, 23 bp, Homo sapiens
agctgaggcagaggggcattctc

SEQ ID NO: 9175736 - DNA, 23 bp, Homo sapiens
agctgaggcagaggggcattctc

SEQ ID NO: 9175737 - DNA, 22 bp, Homo sapiens
agctgaggcatggacaggctgc

SEQ ID NO: 9175738 - DNA, 22 bp, Homo sapiens
agctgaggcatgatgctatcag

SEQ ID NO: 9175739 - DNA, 22 bp, Homo sapiens
agctgaggcatggacaggctgc

SEQ ID NO: 9175740 - DNA, 22 bp, Homo sapiens
agctgaggccacgagtgaaggg

SEQ ID NO: 9175741 - DNA, 22 bp, Homo sapiens
agctgaggccacgagtgaaggg

SEQ ID NO: 9175742 - DNA, 22 bp, Homo sapiens
agctgaggccacgagtgaaggg

SEQ ID NO: 9175743 - DNA, 22 bp, Homo sapiens
agctgaggcctgatttcgccgt

SEQ ID NO: 9175744 - DNA, 22 bp, Homo sapiens
cagctttggagtgtgagtgctg

SEQ ID NO: 9175745 - DNA, 22 bp, Homo sapiens
cagctttggagtgtgagtgctg

SEQ ID NO: 9175746 - DNA, 22 bp, Homo sapiens
agctgcagtcaagctgggccac

SEQ ID NO: 9175747 - DNA, 22 bp, Homo sapiens
agctgcagtcaagctgggccac

SEQ ID NO: 9175748 - DNA, 22 bp, Homo sapiens
cagctttgtgcaatgcagtctc

SEQ ID NO: 9175749 - DNA, 21 bp, Homo sapiens
agctgcagtcaagccagaggt

SEQ ID NO: 9175750 - DNA, 22 bp, Homo sapiens
agctgcagtatgaggctggtgg

SEQ ID NO: 9175751 - DNA, 22 bp, Homo sapiens
agctgcaggttcagcattccac

SEQ ID NO: 9175752 - DNA, 22 bp, Homo sapiens
agctgcagtaaagctctccagg

SEQ ID NO: 9175753 - DNA, 22 bp, Homo sapiens
agctgcaggtggacccgtaccg

SEQ ID NO: 9175754 - DNA, 22 bp, Homo sapiens
agctgcagggcttgggtttccc

SEQ ID NO: 9175755 - DNA, 22 bp, Homo sapiens
agcttggtgttgcctgcttgag

SEQ ID NO: 9175756 - DNA, 22 bp, Homo sapiens
agcttgtagaaggccacgagca

SEQ ID NO: 9175757 - DNA, 22 bp, Homo sapiens
agcttgggtgtgcctgcgagct

SEQ ID NO: 9175758 - DNA, 22 bp, Homo sapiens
agcttgggtgtgcctgcgagct

SEQ ID NO: 9175759 - DNA, 22 bp, Homo sapiens
agcttgcacagagaatacagta

SEQ ID NO: 9175760 - DNA, 22 bp, Homo sapiens
agcttgagttttggatgaagtg

SEQ ID NO: 9175761 - DNA, 22 bp, Homo sapiens
agcttgcctgtttcctagggct

SEQ ID NO: 9175762 - DNA, 23 bp, Homo sapiens
agcttggaacaatgcaaatacag

SEQ ID NO: 9175763 - DNA, 22 bp, Homo sapiens
agcttcttaagttcctgcagca

SEQ ID NO: 9175764 - DNA, 22 bp, Homo sapiens
agcttcttaagttcctgcagca

SEQ ID NO: 9175765 - DNA, 22 bp, Homo sapiens
agcttacagttcaatgacaaag

SEQ ID NO: 9175766 - DNA, 22 bp, Homo sapiens
agctgtttttgtgggcatgtga

SEQ ID NO: 9175767 - DNA, 22 bp, Homo sapiens
agctgttttttcctcaccactt

SEQ ID NO: 9175768 - DNA, 22 bp, Homo sapiens
agctgttttctaatgcatttga

SEQ ID NO: 9175769 - DNA, 21 bp, Homo sapiens
agctgtttgaagctatattgg

SEQ ID NO: 9175770 - DNA, 22 bp, Homo sapiens
agctgttgttaattaactcatt

SEQ ID NO: 9175771 - DNA, 22 bp, Homo sapiens
agctgttgcagggatcagcacc

SEQ ID NO: 9175772 - DNA, 18 bp, Homo sapiens
agctgttgttgactctgt

SEQ ID NO: 9175773 - DNA, 22 bp, Homo sapiens
agctgtgtgcccatggtggagg

SEQ ID NO: 9175774 - DNA, 22 bp, Homo sapiens
agctgtgtgccaggggagatgt

SEQ ID NO: 9175775 - DNA, 23 bp, Homo sapiens
agctgtgtgcgcgtccgggttct

SEQ ID NO: 9175776 - DNA, 22 bp, Homo sapiens
agctgtgtgcccatggtggagg

SEQ ID NO: 9175777 - DNA, 22 bp, Homo sapiens
agctgtgtggtgtctgacagct

SEQ ID NO: 9175778 - DNA, 23 bp, Homo sapiens
agctgtgtggccttgggcaagtt

SEQ ID NO: 9175779 - DNA, 22 bp, Homo sapiens
agctgtgtgtttccactgagct

SEQ ID NO: 9175780 - DNA, 22 bp, Homo sapiens
agctgtgttaggatgttaataa

SEQ ID NO: 9175781 - DNA, 22 bp, Homo sapiens
agctgtgtgtttgtcatgggcg

SEQ ID NO: 9175782 - DNA, 22 bp, Homo sapiens
agctgtgtggtttgggcaaatt

SEQ ID NO: 9175783 - DNA, 22 bp, Homo sapiens
agctgtgtgtgaatttggccta

SEQ ID NO: 9175784 - DNA, 22 bp, Homo sapiens
agctgtgtgtgcttgggattat

SEQ ID NO: 9175785 - DNA, 22 bp, Homo sapiens
agctgtgtgtttccactgagct

SEQ ID NO: 9175786 - DNA, 22 bp, Homo sapiens
agctgtgttctggttgattcac

SEQ ID NO: 9175787 - DNA, 22 bp, Homo sapiens
agctgtgttctggttgattcac

SEQ ID NO: 9175788 - DNA, 22 bp, Homo sapiens
agctgtgttattagaaacctgc

SEQ ID NO: 9175789 - DNA, 22 bp, Homo sapiens
agctgtgtttccagatggtagc

SEQ ID NO: 9175790 - DNA, 22 bp, Homo sapiens
agctgggaagactggaagacag

SEQ ID NO: 9175791 - DNA, 22 bp, Homo sapiens
agctgggaagagttttctgcag

SEQ ID NO: 9175792 - DNA, 23 bp, Homo sapiens
agctgggaattttctgaagcttt

SEQ ID NO: 9175793 - DNA, 23 bp, Homo sapiens
agctgggaattttctgaagcttt

SEQ ID NO: 9175794 - DNA, 21 bp, Homo sapiens
caggccccaggcctggggtgc

SEQ ID NO: 9175795 - DNA, 21 bp, Homo sapiens
caggccccaggcctggggtgc

SEQ ID NO: 9175796 - DNA, 22 bp, Homo sapiens
caggcctcagagagtggcgggg

SEQ ID NO: 9175797 - DNA, 22 bp, Homo sapiens
caggcctcagggctgtccgtag

SEQ ID NO: 9175798 - DNA, 22 bp, Homo sapiens
caggcctcaccagcggagctgc

SEQ ID NO: 9175799 - DNA, 22 bp, Homo sapiens
caggcctcatggtgtgtccttc

SEQ ID NO: 9175800 - DNA, 22 bp, Homo sapiens
caggcctggggctggcttccag

SEQ ID NO: 9175801 - DNA, 22 bp, Homo sapiens
caggcctggggctggcttccag

SEQ ID NO: 9175802 - DNA, 22 bp, Homo sapiens
agctgtgtagggaatcagagaa

SEQ ID NO: 9175803 - DNA, 22 bp, Homo sapiens
agctgtgtcatcctggaaaatg

SEQ ID NO: 9175804 - DNA, 22 bp, Homo sapiens
agctgtgtgcatttgggtctca

SEQ ID NO: 9175805 - DNA, 22 bp, Homo sapiens
agctgtgtgcatttgggtctca

SEQ ID NO: 9175806 - DNA, 22 bp, Homo sapiens
agctgtgtgcatttgggtctca

SEQ ID NO: 9175807 - DNA, 22 bp, Homo sapiens
agctgtgtgactctaagcaagt

SEQ ID NO: 9175808 - DNA, 22 bp, Homo sapiens
agctgtgtgacctagggcaagc

SEQ ID NO: 9175809 - DNA, 22 bp, Homo sapiens
agctgtgtcctgaagacactgc

SEQ ID NO: 9175810 - DNA, 22 bp, Homo sapiens
caggcctcccggtgcacactga

SEQ ID NO: 9175811 - DNA, 22 bp, Homo sapiens
caggcctcaggggctcaggctg

SEQ ID NO: 9175812 - DNA, 22 bp, Homo sapiens
caggcctggcccccggcacacc

SEQ ID NO: 9175813 - DNA, 22 bp, Homo sapiens
caggcctggagtgcaatggcac

SEQ ID NO: 9175814 - DNA, 22 bp, Homo sapiens
caggcctcccggtgcacactga

SEQ ID NO: 9175815 - DNA, 22 bp, Homo sapiens
caggcctggctgcagctcgcct

SEQ ID NO: 9175816 - DNA, 22 bp, Homo sapiens
caggcctggctgcagctcgcct

SEQ ID NO: 9175817 - DNA, 22 bp, Homo sapiens
caggcctgggctgggtatcagg

SEQ ID NO: 9175818 - DNA, 22 bp, Homo sapiens
caggcctgggcttcggggctga

SEQ ID NO: 9175819 - DNA, 22 bp, Homo sapiens
aggaacaactgattcagtcaac

SEQ ID NO: 9175820 - DNA, 22 bp, Homo sapiens
aggaacaattgataaactcaca

SEQ ID NO: 9175821 - DNA, 22 bp, Homo sapiens
aggaacaattgataaactcaca

SEQ ID NO: 9175822 - DNA, 22 bp, Homo sapiens
aggaaatgtacaaatgaagatg

SEQ ID NO: 9175823 - DNA, 22 bp, Homo sapiens
aggaaatgtacaaatgaagatg

SEQ ID NO: 9175824 - DNA, 22 bp, Homo sapiens
aggaaatgggaatagatggtat

SEQ ID NO: 9175825 - DNA, 22 bp, Homo sapiens
aggaaataggaccagacaaagc

SEQ ID NO: 9175826 - DNA, 22 bp, Homo sapiens
cagggccagcgtctcgggctat

SEQ ID NO: 9175827 - DNA, 18 bp, Homo sapiens
aggaagcaggaggaaggc

SEQ ID NO: 9175828 - DNA, 22 bp, Homo sapiens
aggaactggggctattcaccct

SEQ ID NO: 9175829 - DNA, 22 bp, Homo sapiens
aggaactgggctcagcaaacat

SEQ ID NO: 9175830 - DNA, 22 bp, Homo sapiens
aggaactgggctcagcaaacat

SEQ ID NO: 9175831 - DNA, 22 bp, Homo sapiens
aggaactgtcatgtattgctca

SEQ ID NO: 9175832 - DNA, 22 bp, Homo sapiens
aggaagctcctggagagccagt

SEQ ID NO: 9175833 - DNA, 22 bp, Homo sapiens
aggaagctcctggagagccagt

SEQ ID NO: 9175834 - DNA, 22 bp, Homo sapiens
aggaagctccatgaaggcagag

SEQ ID NO: 9175835 - DNA, 22 bp, Homo sapiens
aggaactgaagacttttactgt

SEQ ID NO: 9175836 - DNA, 22 bp, Homo sapiens
aggaactgatttataactttag

SEQ ID NO: 9175837 - DNA, 22 bp, Homo sapiens
aggaactgatttataactttag

SEQ ID NO: 9175838 - DNA, 22 bp, Homo sapiens
aggaactgatgagcagccaggg

SEQ ID NO: 9175839 - DNA, 22 bp, Homo sapiens
aggaacagaagagcaatgcagg

SEQ ID NO: 9175840 - DNA, 22 bp, Homo sapiens
aggaaccagaggttgagcaact

SEQ ID NO: 9175841 - DNA, 22 bp, Homo sapiens
aggaaagcaatggctgagaaca

SEQ ID NO: 9175842 - DNA, 22 bp, Homo sapiens
aggaaagactggggccccagaa

SEQ ID NO: 9175843 - DNA, 22 bp, Homo sapiens
aggaaagatggaaggaggataa

SEQ ID NO: 9175844 - DNA, 22 bp, Homo sapiens
aggaaagatggaaggaggataa

SEQ ID NO: 9175845 - DNA, 20 bp, Homo sapiens
aggaaagcctgtgtgagtct

SEQ ID NO: 9175846 - DNA, 22 bp, Homo sapiens
aggaaagcttggcaaactaaat

SEQ ID NO: 9175847 - DNA, 21 bp, Homo sapiens
aggaaaggaagtccccagggt

SEQ ID NO: 9175848 - DNA, 22 bp, Homo sapiens
cagggccagagagggctggctg

SEQ ID NO: 9175849 - DNA, 22 bp, Homo sapiens
cagggccagagagggctggctg

SEQ ID NO: 9175850 - DNA, 22 bp, Homo sapiens
cagggccagcgcccaggcccag

SEQ ID NO: 9175851 - DNA, 22 bp, Homo sapiens
cagggccagccatcctgctggg

SEQ ID NO: 9175852 - DNA, 18 bp, Homo sapiens
aggaaagacgaagagggc

SEQ ID NO: 9175853 - DNA, 22 bp, Homo sapiens
aggaaagaagtacattctcatg

SEQ ID NO: 9175854 - DNA, 22 bp, Homo sapiens
aggaaagaagtacattctcatg

SEQ ID NO: 9175855 - DNA, 22 bp, Homo sapiens
aggaaagaagtacattctcatg

SEQ ID NO: 9175856 - DNA, 22 bp, Homo sapiens
aggaaactaacttatctttata

SEQ ID NO: 9175857 - DNA, 18 bp, Homo sapiens
aggaaagacgaagagggc

SEQ ID NO: 9175858 - DNA, 18 bp, Homo sapiens
aggaaagacgaagagggc

SEQ ID NO: 9175859 - DNA, 17 bp, Homo sapiens
aggaaacattttctttc

SEQ ID NO: 9175860 - DNA, 22 bp, Homo sapiens
agctttatatgttgtttctcca

SEQ ID NO: 9175861 - DNA, 22 bp, Homo sapiens
aggaaacggcaaaactgcttag

SEQ ID NO: 9175862 - DNA, 22 bp, Homo sapiens
agcttgttaaggatgcatatta

SEQ ID NO: 9175863 - DNA, 22 bp, Homo sapiens
agcttgttagaaatgtagactc

SEQ ID NO: 9175864 - DNA, 22 bp, Homo sapiens
agctttacctgaaatttgatcc

SEQ ID NO: 9175865 - DNA, 18 bp, Homo sapiens
agcttgtttttgccttct

SEQ ID NO: 9175866 - DNA, 22 bp, Homo sapiens
aggctgagcaaagggccttacc

SEQ ID NO: 9175867 - DNA, 22 bp, Homo sapiens
aggctgagataggtggatcatt

SEQ ID NO: 9175868 - DNA, 22 bp, Homo sapiens
aggctgagataggtggatcatt

SEQ ID NO: 9175869 - DNA, 22 bp, Homo sapiens
aggctgagccacggggctggct

SEQ ID NO: 9175870 - DNA, 22 bp, Homo sapiens
aggctgagcctgggcgtggtgg

SEQ ID NO: 9175871 - DNA, 20 bp, Homo sapiens
aggctctgccattgtccctg

SEQ ID NO: 9175872 - DNA, 20 bp, Homo sapiens
aggctctgcctgcaggccca

SEQ ID NO: 9175873 - DNA, 20 bp, Homo sapiens
aggctctgccattgtccctg

SEQ ID NO: 9175874 - DNA, 22 bp, Homo sapiens
aggctctgccaattccttcctc

SEQ ID NO: 9175875 - DNA, 20 bp, Homo sapiens
aggctctgcatttctgagtg

SEQ ID NO: 9175876 - DNA, 22 bp, Homo sapiens
aggctgagagcaacgtgtcaga

SEQ ID NO: 9175877 - DNA, 22 bp, Homo sapiens
aggctgagagcaacgtgtcaga

SEQ ID NO: 9175878 - DNA, 22 bp, Homo sapiens
aggctctgatgcaagcccaggg

SEQ ID NO: 9175879 - DNA, 22 bp, Homo sapiens
aggctctgcagtccatcccgtg

SEQ ID NO: 9175880 - DNA, 22 bp, Homo sapiens
aggctctgcagtgctggaggac

SEQ ID NO: 9175881 - DNA, 22 bp, Homo sapiens
aggctctgcagtgctggaggac

SEQ ID NO: 9175882 - DNA, 22 bp, Homo sapiens
aggctctgcagtgctggaggac

SEQ ID NO: 9175883 - DNA, 22 bp, Homo sapiens
aggctctgatcaggtggctgtg

SEQ ID NO: 9175884 - DNA, 22 bp, Homo sapiens
aggctctgagtctggtgtctgc

SEQ ID NO: 9175885 - DNA, 22 bp, Homo sapiens
aggctctgagtagagctgccag

SEQ ID NO: 9175886 - DNA, 22 bp, Homo sapiens
aggctctgagtagagctgccag

SEQ ID NO: 9175887 - DNA, 22 bp, Homo sapiens
aggctccttgctcacaggctca

SEQ ID NO: 9175888 - DNA, 19 bp, Homo sapiens
aggctctgagctcctggag

SEQ ID NO: 9175889 - DNA, 22 bp, Homo sapiens
aggctgaggcgggaggatcact

SEQ ID NO: 9175890 - DNA, 22 bp, Homo sapiens
aggctgaggcaggtggatcatt

SEQ ID NO: 9175891 - DNA, 22 bp, Homo sapiens
aggctgaggcaggtggatcact

SEQ ID NO: 9175892 - DNA, 22 bp, Homo sapiens
aggctgaggcaggtggatcatt

SEQ ID NO: 9175893 - DNA, 22 bp, Homo sapiens
ccagtgcaccaagaggcctaga

SEQ ID NO: 9175894 - DNA, 22 bp, Homo sapiens
ccagtgcaccatttccctctgt

SEQ ID NO: 9175895 - DNA, 22 bp, Homo sapiens
aggctgaggcaggtggatcact

SEQ ID NO: 9175896 - DNA, 22 bp, Homo sapiens
ccagtttataagaaagaaaacc

SEQ ID NO: 9175897 - DNA, 22 bp, Homo sapiens
ccagtttataagaaagaaaacc

SEQ ID NO: 9175898 - DNA, 22 bp, Homo sapiens
ccagtttcttaagtaggaagaa

SEQ ID NO: 9175899 - DNA, 22 bp, Homo sapiens
ccagttctttctgtgtgcaaca

SEQ ID NO: 9175900 - DNA, 22 bp, Homo sapiens
ccagttcaccagtggcagaagt

SEQ ID NO: 9175901 - DNA, 22 bp, Homo sapiens
ccagttagttaaaggcgcagta

SEQ ID NO: 9175902 - DNA, 22 bp, Homo sapiens
ccagtgtgcattatcatgtgtc

SEQ ID NO: 9175903 - DNA, 22 bp, Homo sapiens
ccagttagaactacatttccca

SEQ ID NO: 9175904 - DNA, 22 bp, Homo sapiens
ccagttatccagcatgctgtct

SEQ ID NO: 9175905 - DNA, 22 bp, Homo sapiens
ccagttagttaaaggcgcagta

SEQ ID NO: 9175906 - DNA, 22 bp, Homo sapiens
ccagtgtgcattatcatgtgtc

SEQ ID NO: 9175907 - DNA, 22 bp, Homo sapiens
aggctgagcggggtcccagagc

SEQ ID NO: 9175908 - DNA, 23 bp, Homo sapiens
aggctgagctctcccagcttcag

SEQ ID NO: 9175909 - DNA, 22 bp, Homo sapiens
aggctgagctgacctggtttgg

SEQ ID NO: 9175910 - DNA, 22 bp, Homo sapiens
ccagtctgtactttgctctgtt

SEQ ID NO: 9175911 - DNA, 22 bp, Homo sapiens
ccagtctgtactttgctctgtt

SEQ ID NO: 9175912 - DNA, 22 bp, Homo sapiens
ccagtctgtactttgctctgtt

SEQ ID NO: 9175913 - DNA, 21 bp, Homo sapiens
ccagtctgtaaaatggggaca

SEQ ID NO: 9175914 - DNA, 22 bp, Homo sapiens
ccagtctggcaggagggggaac

SEQ ID NO: 9175915 - DNA, 22 bp, Homo sapiens
ccagtctggcaggagggggaac

SEQ ID NO: 9175916 - DNA, 22 bp, Homo sapiens
ccagtctgttctcacctctgag

SEQ ID NO: 9175917 - DNA, 23 bp, Homo sapiens
ccagtgagcatggctgtgttcca

SEQ ID NO: 9175918 - DNA, 22 bp, Homo sapiens
ccagtgagatatctgggcatta

SEQ ID NO: 9175919 - DNA, 22 bp, Homo sapiens
ccagtgagaatgaagataaggc

SEQ ID NO: 9175920 - DNA, 19 bp, Homo sapiens
ccagtgcaaggtaagatag

SEQ ID NO: 9175921 - DNA, 22 bp, Homo sapiens
ccagtgcacaatggaacaactc

SEQ ID NO: 9175922 - DNA, 22 bp, Homo sapiens
ccagtgcacagccaggcaggtg

SEQ ID NO: 9175923 - DNA, 22 bp, Homo sapiens
ccagtgcacagccaggcaggtg

SEQ ID NO: 9175924 - DNA, 23 bp, Homo sapiens
ccagtgattgcctggaaggaggt

SEQ ID NO: 9175925 - DNA, 22 bp, Homo sapiens
ccaggcctcacctgcccaccta

SEQ ID NO: 9175926 - DNA, 22 bp, Homo sapiens
ccaggcctcacctgcccaccta

SEQ ID NO: 9175927 - DNA, 22 bp, Homo sapiens
ccaggcctagcccctgagggta

SEQ ID NO: 9175928 - DNA, 22 bp, Homo sapiens
aggctccacggcaggatgctgt

SEQ ID NO: 9175929 - DNA, 22 bp, Homo sapiens
aggctccacggcaggatgctgt

SEQ ID NO: 9175930 - DNA, 22 bp, Homo sapiens
ccaggccctgctcctcacacca

SEQ ID NO: 9175931 - DNA, 22 bp, Homo sapiens
ccaggccagagtgcagtggcac

SEQ ID NO: 9175932 - DNA, 22 bp, Homo sapiens
ccaggccctgcctgtggttcct

SEQ ID NO: 9175933 - DNA, 22 bp, Homo sapiens
ccaggcctagcccctgagggta

SEQ ID NO: 9175934 - DNA, 22 bp, Homo sapiens
ccaggcccttgcaagtcccacc

SEQ ID NO: 9175935 - DNA, 22 bp, Homo sapiens
ccaggctctatccctccttctt

SEQ ID NO: 9175936 - DNA, 22 bp, Homo sapiens
aggctccattccaggagctaga

SEQ ID NO: 9175937 - DNA, 22 bp, Homo sapiens
aggctccattcatgtgaaggca

SEQ ID NO: 9175938 - DNA, 22 bp, Homo sapiens
aggctccattcatgtgaaggca

SEQ ID NO: 9175939 - DNA, 22 bp, Homo sapiens
aggctccattcatgtgaaggca

SEQ ID NO: 9175940 - DNA, 22 bp, Homo sapiens
ccaggctctgcaaaatcaggct

SEQ ID NO: 9175941 - DNA, 22 bp, Homo sapiens
ccaggctctgagcctcactctt

SEQ ID NO: 9175942 - DNA, 22 bp, Homo sapiens
ccaggctctgagcctcactctt

SEQ ID NO: 9175943 - DNA, 22 bp, Homo sapiens
ccaggctctgccaggcccttga

SEQ ID NO: 9175944 - DNA, 17 bp, Homo sapiens
aggcctcaggtgaaacc

SEQ ID NO: 9175945 - DNA, 22 bp, Homo sapiens
aggcctcagttcttgccaggtg

SEQ ID NO: 9175946 - DNA, 22 bp, Homo sapiens
aggcctcacacaacagatgcat

SEQ ID NO: 9175947 - DNA, 22 bp, Homo sapiens
aggcctcacacaacagatgcat

SEQ ID NO: 9175948 - DNA, 17 bp, Homo sapiens
aggcctccctccaggcc

SEQ ID NO: 9175949 - DNA, 21 bp, Homo sapiens
aggcctccctgttgacagggc

SEQ ID NO: 9175950 - DNA, 22 bp, Homo sapiens
aggcctctctccttggcttgta

SEQ ID NO: 9175951 - DNA, 22 bp, Homo sapiens
aggcctcctgcagggatgagtg

SEQ ID NO: 9175952 - DNA, 22 bp, Homo sapiens
aggcctctctgcttagcttgta

SEQ ID NO: 9175953 - DNA, 22 bp, Homo sapiens
ccaggcagtcagggttgtgtgt

SEQ ID NO: 9175954 - DNA, 22 bp, Homo sapiens
ccaggcagggctcaaggaacct

SEQ ID NO: 9175955 - DNA, 22 bp, Homo sapiens
ccaggcagggctcaaggaacct

SEQ ID NO: 9175956 - DNA, 22 bp, Homo sapiens
ccaggcatccattgcttcctct

SEQ ID NO: 9175957 - DNA, 22 bp, Homo sapiens
ccaggcatggggagagccagat

SEQ ID NO: 9175958 - DNA, 21 bp, Homo sapiens
ccaggcatgactgcagagagc

SEQ ID NO: 9175959 - DNA, 22 bp, Homo sapiens
ccaggcatggggagagccagat

SEQ ID NO: 9175960 - DNA, 22 bp, Homo sapiens
ccaggcattgtgagtgggcagg

SEQ ID NO: 9175961 - DNA, 22 bp, Homo sapiens
ccaggcattgtgagtgggcagg

SEQ ID NO: 9175962 - DNA, 22 bp, Homo sapiens
ccaggccaaattcagtcagcag

SEQ ID NO: 9175963 - DNA, 22 bp, Homo sapiens
ccaggccaaattcagtcagcag

SEQ ID NO: 9175964 - DNA, 22 bp, Homo sapiens
ccaggccaaattcagtcagcag

SEQ ID NO: 9175965 - DNA, 22 bp, Homo sapiens
aggcagttgttgctgagcagct

SEQ ID NO: 9175966 - DNA, 22 bp, Homo sapiens
aggcagtttaggcagcgattta

SEQ ID NO: 9175967 - DNA, 22 bp, Homo sapiens
aggcagtttatccccagagcct

SEQ ID NO: 9175968 - DNA, 22 bp, Homo sapiens
aggcagttgttgctgagcagct

SEQ ID NO: 9175969 - DNA, 22 bp, Homo sapiens
aggcagtttctgggacagcata

SEQ ID NO: 9175970 - DNA, 22 bp, Homo sapiens
aggcagtttatccccagagcct

SEQ ID NO: 9175971 - DNA, 22 bp, Homo sapiens
aggcataaccttttatctggat

SEQ ID NO: 9175972 - DNA, 22 bp, Homo sapiens
aggcagttctcgtgtgtgtccc

SEQ ID NO: 9175973 - DNA, 22 bp, Homo sapiens
aggcatctctctgcttctgagc

SEQ ID NO: 9175974 - DNA, 22 bp, Homo sapiens
aggcatctgagatttttatact

SEQ ID NO: 9175975 - DNA, 22 bp, Homo sapiens
ccactggagatgtcagacaggt

SEQ ID NO: 9175976 - DNA, 22 bp, Homo sapiens
ccactggattttcttactgtag

SEQ ID NO: 9175977 - DNA, 22 bp, Homo sapiens
ccactggagactggtctctgtg

SEQ ID NO: 9175978 - DNA, 22 bp, Homo sapiens
ccactggcatccagctgccatc

SEQ ID NO: 9175979 - DNA, 22 bp, Homo sapiens
ccactggcatccagctgccatc

SEQ ID NO: 9175980 - DNA, 22 bp, Homo sapiens
ccactggcatccagctgccatc

SEQ ID NO: 9175981 - DNA, 22 bp, Homo sapiens
ccactggaaatgacacgtcact

SEQ ID NO: 9175982 - DNA, 22 bp, Homo sapiens
ccactggaagatgctgaggtca

SEQ ID NO: 9175983 - DNA, 23 bp, Homo sapiens
ccactggagaaagtggcaggtgg

SEQ ID NO: 9175984 - DNA, 22 bp, Homo sapiens
ccactggagaacgtctgatgaa

SEQ ID NO: 9175985 - DNA, 22 bp, Homo sapiens
ccactggcttttcctaggtctc

SEQ ID NO: 9175986 - DNA, 22 bp, Homo sapiens
ccactgggcgtttctgtccaat

SEQ ID NO: 9175987 - DNA, 22 bp, Homo sapiens
aggcatggcatggggcagatgt

SEQ ID NO: 9175988 - DNA, 22 bp, Homo sapiens
aggcatggcatggggcagatgt

SEQ ID NO: 9175989 - DNA, 22 bp, Homo sapiens
aggcattacatctaaatattta

SEQ ID NO: 9175990 - DNA, 22 bp, Homo sapiens
aggcattagttgtaaagtattg

SEQ ID NO: 9175991 - DNA, 22 bp, Homo sapiens
aggcattattagatgatgttat

SEQ ID NO: 9175992 - DNA, 22 bp, Homo sapiens
aggcattaatgtaatacagtga

SEQ ID NO: 9175993 - DNA, 22 bp, Homo sapiens
aggcattaagttgataatcata

SEQ ID NO: 9175994 - DNA, 22 bp, Homo sapiens
aggcattaagttgataatcata

SEQ ID NO: 9175995 - DNA, 22 bp, Homo sapiens
aggcatttggctgtcatttgta

SEQ ID NO: 9175996 - DNA, 22 bp, Homo sapiens
aggcatttaaagatgtaagact

SEQ ID NO: 9175997 - DNA, 22 bp, Homo sapiens
aggcagtgctcaagacagcagc

SEQ ID NO: 9175998 - DNA, 22 bp, Homo sapiens
aggcagtgcctggaccccagct

SEQ ID NO: 9175999 - DNA, 22 bp, Homo sapiens
aggcagtgcatgcaaaggtcgg

SEQ ID NO: 9176000 - DNA, 22 bp, Homo sapiens
aggcagtgagcagggtgtcatg

SEQ ID NO: 9176001 - DNA, 22 bp, Homo sapiens
aggcagtgagtgtgacttcaca

SEQ ID NO: 9176002 - DNA, 22 bp, Homo sapiens
aggcagtgagtgtgacttcaca

SEQ ID NO: 9176003 - DNA, 22 bp, Homo sapiens
aggcagtgatgagtcatgaata

SEQ ID NO: 9176004 - DNA, 22 bp, Homo sapiens
aggcagtgagaaatagcaagat

SEQ ID NO: 9176005 - DNA, 22 bp, Homo sapiens
aggcagtggagctggaataggc

SEQ ID NO: 9176006 - DNA, 22 bp, Homo sapiens
aggcagtggatgtcaggaatgg

SEQ ID NO: 9176007 - DNA, 22 bp, Homo sapiens
aggcagtggctgagaccagggg

SEQ ID NO: 9176008 - DNA, 22 bp, Homo sapiens
aggcagtggaaggagaaagcaa

SEQ ID NO: 9176009 - DNA, 22 bp, Homo sapiens
aggcagtggagctggaataggc

SEQ ID NO: 9176010 - DNA, 22 bp, Homo sapiens
aggcagtggagaaggtttgtga

SEQ ID NO: 9176011 - DNA, 22 bp, Homo sapiens
aggcagtggagctggaataggc

SEQ ID NO: 9176012 - DNA, 22 bp, Homo sapiens
aggcagccatctgcaggaagga

SEQ ID NO: 9176013 - DNA, 22 bp, Homo sapiens
aggcagccatctgcaggaagga

SEQ ID NO: 9176014 - DNA, 22 bp, Homo sapiens
aggcagccattaccaagggcat

SEQ ID NO: 9176015 - DNA, 22 bp, Homo sapiens
aggcagccattaccaagggcat

SEQ ID NO: 9176016 - DNA, 22 bp, Homo sapiens
aggcagccatccaggaggctca

SEQ ID NO: 9176017 - DNA, 22 bp, Homo sapiens
aggcagccctgtgctggatgct

SEQ ID NO: 9176018 - DNA, 22 bp, Homo sapiens
aggcagcctatggggagctcag

SEQ ID NO: 9176019 - DNA, 22 bp, Homo sapiens
aggcagcctatggggagctcag

SEQ ID NO: 9176020 - DNA, 22 bp, Homo sapiens
aggcagcctggtttgaatggaa

SEQ ID NO: 9176021 - DNA, 22 bp, Homo sapiens
aggcagccctgtgctggatgct

SEQ ID NO: 9176022 - DNA, 22 bp, Homo sapiens
aggcagcccacaggacacagga

SEQ ID NO: 9176023 - DNA, 22 bp, Homo sapiens
aggcagcctggtttgaatggaa

SEQ ID NO: 9176024 - DNA, 22 bp, Homo sapiens
aggcagcctttagacagtctgc

SEQ ID NO: 9176025 - DNA, 22 bp, Homo sapiens
aggcagcctttagacagtctgc

SEQ ID NO: 9176026 - DNA, 22 bp, Homo sapiens
aggcagcctttttggaaacata

SEQ ID NO: 9176027 - DNA, 22 bp, Homo sapiens
aggcagtctatctctggagcct

SEQ ID NO: 9176028 - DNA, 19 bp, Homo sapiens
aggcagtcattggaatata

SEQ ID NO: 9176029 - DNA, 22 bp, Homo sapiens
aggccagcaagaaagagagtct

SEQ ID NO: 9176030 - DNA, 22 bp, Homo sapiens
aggccagcaagaaagagagtct

SEQ ID NO: 9176031 - DNA, 22 bp, Homo sapiens
aggccacaagaaaatgcttcat

SEQ ID NO: 9176032 - DNA, 22 bp, Homo sapiens
aggccacaaccaccctgtgccc

SEQ ID NO: 9176033 - DNA, 22 bp, Homo sapiens
aggccacaagaaaatgcttcat

SEQ ID NO: 9176034 - DNA, 22 bp, Homo sapiens
aggccagcgctgctagctcccg

SEQ ID NO: 9176035 - DNA, 22 bp, Homo sapiens
aggccagctatgactctgctcc

SEQ ID NO: 9176036 - DNA, 22 bp, Homo sapiens
aggccagctatgactctgctcc

SEQ ID NO: 9176037 - DNA, 22 bp, Homo sapiens
aggccagcctgcccaaagctgc

SEQ ID NO: 9176038 - DNA, 22 bp, Homo sapiens
aggccagctcaccctggctcct

SEQ ID NO: 9176039 - DNA, 22 bp, Homo sapiens
aggccagctcaccctggctcct

SEQ ID NO: 9176040 - DNA, 22 bp, Homo sapiens
aggccagctgttactagagcca

SEQ ID NO: 9176041 - DNA, 22 bp, Homo sapiens
aggccagcttccagaggggcag

SEQ ID NO: 9176042 - DNA, 22 bp, Homo sapiens
aggccaagggcaaagcggagag

SEQ ID NO: 9176043 - DNA, 22 bp, Homo sapiens
aggccaagctcccagagaagct

SEQ ID NO: 9176044 - DNA, 22 bp, Homo sapiens
aggccaagtgaacaatgctagt

SEQ ID NO: 9176045 - DNA, 22 bp, Homo sapiens
aggccaagtgctgggacaggtg

SEQ ID NO: 9176046 - DNA, 22 bp, Homo sapiens
aggccaagtgctgggacaggtg

SEQ ID NO: 9176047 - DNA, 21 bp, Homo sapiens
aggccaagttggatttcttca

SEQ ID NO: 9176048 - DNA, 22 bp, Homo sapiens
aggccaattgctccccactccc

SEQ ID NO: 9176049 - DNA, 22 bp, Homo sapiens
aggccaagttacttgggaaagc

SEQ ID NO: 9176050 - DNA, 22 bp, Homo sapiens
aggccaagctcccagagaagct

SEQ ID NO: 9176051 - DNA, 22 bp, Homo sapiens
aggccaaaccggatggaaaagg

SEQ ID NO: 9176052 - DNA, 22 bp, Homo sapiens
aggcatttttgttaatctttgg

SEQ ID NO: 9176053 - DNA, 20 bp, Homo sapiens
aggccaaacccagcgcgccc

SEQ ID NO: 9176054 - DNA, 22 bp, Homo sapiens
aggcatttttattgtccttaaa

SEQ ID NO: 9176055 - DNA, 22 bp, Homo sapiens
aggcattttctgtatggacaga

SEQ ID NO: 9176056 - DNA, 22 bp, Homo sapiens
aggcatttggctgtcatttgta

SEQ ID NO: 9176057 - DNA, 22 bp, Homo sapiens
aggcatttggctgtcatttgta

SEQ ID NO: 9176058 - DNA, 20 bp, Homo sapiens
aggccccaggtggacactag

SEQ ID NO: 9176059 - DNA, 22 bp, Homo sapiens
aggcccccacaggcttgaggca

SEQ ID NO: 9176060 - DNA, 22 bp, Homo sapiens
aggcccagtgtggcttcctgga

SEQ ID NO: 9176061 - DNA, 22 bp, Homo sapiens
aggccctattcaatggggccca

SEQ ID NO: 9176062 - DNA, 22 bp, Homo sapiens
aggccctctcattccagaggca

SEQ ID NO: 9176063 - DNA, 22 bp, Homo sapiens
aggccagcttctaccctctgtt

SEQ ID NO: 9176064 - DNA, 22 bp, Homo sapiens
aggccaggacacttaagtaaga

SEQ ID NO: 9176065 - DNA, 22 bp, Homo sapiens
aggccaggaatccttgtcccag

SEQ ID NO: 9176066 - DNA, 22 bp, Homo sapiens
aggccaggatagcatggatcag

SEQ ID NO: 9176067 - DNA, 22 bp, Homo sapiens
aggcccagtcctctgccgtctg

SEQ ID NO: 9176068 - DNA, 22 bp, Homo sapiens
aggcccagtgccattagttttg

SEQ ID NO: 9176069 - DNA, 22 bp, Homo sapiens
agggagagtagatatcaggtgt

SEQ ID NO: 9176070 - DNA, 22 bp, Homo sapiens
agggaatgctccgtataaatct

SEQ ID NO: 9176071 - DNA, 19 bp, Homo sapiens
agggaatccggctgaggga

SEQ ID NO: 9176072 - DNA, 22 bp, Homo sapiens
agggagaaggtttagctgtgag

SEQ ID NO: 9176073 - DNA, 22 bp, Homo sapiens
agggaagggcagggtctatgca

SEQ ID NO: 9176074 - DNA, 22 bp, Homo sapiens
agggaagggcagggtctatgca

SEQ ID NO: 9176075 - DNA, 22 bp, Homo sapiens
agggaagggaaaaacactcgtc

SEQ ID NO: 9176076 - DNA, 23 bp, Homo sapiens
agggaagggggcttattccacag

SEQ ID NO: 9176077 - DNA, 22 bp, Homo sapiens
agggaagtgaatgacagatatc

SEQ ID NO: 9176078 - DNA, 22 bp, Homo sapiens
agggaagtgaatgacagatatc

SEQ ID NO: 9176079 - DNA, 19 bp, Homo sapiens
agggaatccggctgaggga

SEQ ID NO: 9176080 - DNA, 22 bp, Homo sapiens
agggaaggtagaggtcaccggc

SEQ ID NO: 9176081 - DNA, 22 bp, Homo sapiens
agggaaggtagaggtcaccggc

SEQ ID NO: 9176082 - DNA, 22 bp, Homo sapiens
agggaaggaggccatgtgtccc

SEQ ID NO: 9176083 - DNA, 22 bp, Homo sapiens
agggaaggaggccatgtgtccc

SEQ ID NO: 9176084 - DNA, 22 bp, Homo sapiens
agggaaggaggttagaacccac

SEQ ID NO: 9176085 - DNA, 22 bp, Homo sapiens
agggaaggaggttagaacccac

SEQ ID NO: 9176086 - DNA, 22 bp, Homo sapiens
agggaaggcttttgacatttcc

SEQ ID NO: 9176087 - DNA, 19 bp, Homo sapiens
agggaaggattctgtcatt

SEQ ID NO: 9176088 - DNA, 19 bp, Homo sapiens
agggaaggattctgtcatt

SEQ ID NO: 9176089 - DNA, 19 bp, Homo sapiens
agggaaggattctgtcatt

SEQ ID NO: 9176090 - DNA, 22 bp, Homo sapiens
aggcttaatgagttaaatcact

SEQ ID NO: 9176091 - DNA, 22 bp, Homo sapiens
agggaagcttgttactgagaag

SEQ ID NO: 9176092 - DNA, 22 bp, Homo sapiens
agggaaggaaaagctgtcgctt

SEQ ID NO: 9176093 - DNA, 22 bp, Homo sapiens
agggaaggaaaagctgtcgctt

SEQ ID NO: 9176094 - DNA, 22 bp, Homo sapiens
agggagagtttgatgtttcctc

SEQ ID NO: 9176095 - DNA, 22 bp, Homo sapiens
agggagagtagatatcaggtgt

SEQ ID NO: 9176096 - DNA, 22 bp, Homo sapiens
agggagcaaaggtttcagggtt

SEQ ID NO: 9176097 - DNA, 22 bp, Homo sapiens
agggagcagcagccacaggatg

SEQ ID NO: 9176098 - DNA, 22 bp, Homo sapiens
agggagcatgggtgaagcaggc

SEQ ID NO: 9176099 - DNA, 22 bp, Homo sapiens
agggagccctgaaccagagggt

SEQ ID NO: 9176100 - DNA, 22 bp, Homo sapiens
agggagccagagttgggagctc

SEQ ID NO: 9176101 - DNA, 21 bp, Homo sapiens
agggagcatgttagctttcga

SEQ ID NO: 9176102 - DNA, 21 bp, Homo sapiens
agggagcatgttagctttcga

SEQ ID NO: 9176103 - DNA, 22 bp, Homo sapiens
ccccatgaagtagggtctctga

SEQ ID NO: 9176104 - DNA, 22 bp, Homo sapiens
ccccatgaagtagggtctctga

SEQ ID NO: 9176105 - DNA, 22 bp, Homo sapiens
ccccatgaagtagggtctctga

SEQ ID NO: 9176106 - DNA, 22 bp, Homo sapiens
ccccatgaagtagggtctctga

SEQ ID NO: 9176107 - DNA, 22 bp, Homo sapiens
ccccatcctattcatgtttctg

SEQ ID NO: 9176108 - DNA, 22 bp, Homo sapiens
agggaggaaggaactccttcta

SEQ ID NO: 9176109 - DNA, 19 bp, Homo sapiens
ccccagggtaggctagggg

SEQ ID NO: 9176110 - DNA, 19 bp, Homo sapiens
ccccagggtaggctagggg

SEQ ID NO: 9176111 - DNA, 22 bp, Homo sapiens
ccccagggtcagtgtgtggagg

SEQ ID NO: 9176112 - DNA, 22 bp, Homo sapiens
ccccagggtcagtgtgtggagg

SEQ ID NO: 9176113 - DNA, 22 bp, Homo sapiens
ccccagcagactcagggcaggt

SEQ ID NO: 9176114 - DNA, 22 bp, Homo sapiens
ccccagggactggtttcatgga

SEQ ID NO: 9176115 - DNA, 19 bp, Homo sapiens
ccccagggtaggctagggg

SEQ ID NO: 9176116 - DNA, 19 bp, Homo sapiens
ccccagggtaggctagggg

SEQ ID NO: 9176117 - DNA, 22 bp, Homo sapiens
ccagtttgaggtttcaagatgt

SEQ ID NO: 9176118 - DNA, 20 bp, Homo sapiens
ccagtttctttcccagcctc

SEQ ID NO: 9176119 - DNA, 22 bp, Homo sapiens
ccataatcgtgtgttaaataat

SEQ ID NO: 9176120 - DNA, 22 bp, Homo sapiens
ccataatcatgtaagtaaattc

SEQ ID NO: 9176121 - DNA, 21 bp, Homo sapiens
ccataattttgtttcagaagt

SEQ ID NO: 9176122 - DNA, 22 bp, Homo sapiens
ccatctccaaataccatcacat

SEQ ID NO: 9176123 - DNA, 22 bp, Homo sapiens
ccatcgcttcaaatctcagact

SEQ ID NO: 9176124 - DNA, 22 bp, Homo sapiens
ccatccttggctcgctctctgt

SEQ ID NO: 9176125 - DNA, 22 bp, Homo sapiens
ccatgagccaggctgaggaagc

SEQ ID NO: 9176126 - DNA, 22 bp, Homo sapiens
ccatgacattttaattttcact

SEQ ID NO: 9176127 - DNA, 22 bp, Homo sapiens
ccatctccagtttattcttcct

SEQ ID NO: 9176128 - DNA, 22 bp, Homo sapiens
ccatctgtctcctcctcgaatt

SEQ ID NO: 9176129 - DNA, 22 bp, Homo sapiens
ccatctggagcatttgacctgg

SEQ ID NO: 9176130 - DNA, 22 bp, Homo sapiens
cccagcagttgttggtgcacat

SEQ ID NO: 9176131 - DNA, 22 bp, Homo sapiens
cccagcagttgttggtgcacat

SEQ ID NO: 9176132 - DNA, 22 bp, Homo sapiens
cccagcagtttgcttagagtga

SEQ ID NO: 9176133 - DNA, 22 bp, Homo sapiens
cccagcagtggttctcaaactt

SEQ ID NO: 9176134 - DNA, 22 bp, Homo sapiens
cccagcagtggttctcaaactt

SEQ ID NO: 9176135 - DNA, 22 bp, Homo sapiens
cccagcatcccagtgggcagca

SEQ ID NO: 9176136 - DNA, 22 bp, Homo sapiens
cccagcatcctcagggagcggg

SEQ ID NO: 9176137 - DNA, 22 bp, Homo sapiens
cccagcagtacccaagcccttg

SEQ ID NO: 9176138 - DNA, 22 bp, Homo sapiens
cccagcagtacccaagcccttg

SEQ ID NO: 9176139 - DNA, 22 bp, Homo sapiens
cccagcagtagagctcatatgg

SEQ ID NO: 9176140 - DNA, 22 bp, Homo sapiens
cccagcagtgacccagtgatac

SEQ ID NO: 9176141 - DNA, 22 bp, Homo sapiens
cccagcagtgacccagtgatac

SEQ ID NO: 9176142 - DNA, 22 bp, Homo sapiens
cccagcagtaaccagtggaaat

SEQ ID NO: 9176143 - DNA, 22 bp, Homo sapiens
cccagcaaggccagctcagggc

SEQ ID NO: 9176144 - DNA, 22 bp, Homo sapiens
aggcttaaagatagtaagaaac

SEQ ID NO: 9176145 - DNA, 23 bp, Homo sapiens
aggcttaaatccttggttttgcc

SEQ ID NO: 9176146 - DNA, 21 bp, Homo sapiens
aggcttaaagccattatttcc

SEQ ID NO: 9176147 - DNA, 22 bp, Homo sapiens
aggctgttgagccccagcaagt

SEQ ID NO: 9176148 - DNA, 22 bp, Homo sapiens
aggctgttgcatgccacagata

SEQ ID NO: 9176149 - DNA, 22 bp, Homo sapiens
aggcttaacctgatcacatgag

SEQ ID NO: 9176150 - DNA, 22 bp, Homo sapiens
aggcttaaatgctcatatcagt

SEQ ID NO: 9176151 - DNA, 22 bp, Homo sapiens
aggcttaactacaatttttgcc

SEQ ID NO: 9176152 - DNA, 22 bp, Homo sapiens
aggcttaactttactgttatgc

SEQ ID NO: 9176153 - DNA, 22 bp, Homo sapiens
aggctgtgtttcccctggagct

SEQ ID NO: 9176154 - DNA, 22 bp, Homo sapiens
aggctgttctaggagagtggga

SEQ ID NO: 9176155 - DNA, 22 bp, Homo sapiens
cccagctctgccatctacccac

SEQ ID NO: 9176156 - DNA, 22 bp, Homo sapiens
cccagctctgcagacctgccct

SEQ ID NO: 9176157 - DNA, 22 bp, Homo sapiens
cccagctctctcagttctgctt

SEQ ID NO: 9176158 - DNA, 22 bp, Homo sapiens
cccagctctctgctcttagcct

SEQ ID NO: 9176159 - DNA, 22 bp, Homo sapiens
cccagctctcgcacttactagc

SEQ ID NO: 9176160 - DNA, 22 bp, Homo sapiens
cccagctctaggagtggtggca

SEQ ID NO: 9176161 - DNA, 22 bp, Homo sapiens
cccagcctctgtttgctcctct

SEQ ID NO: 9176162 - DNA, 22 bp, Homo sapiens
cccagcctctgtttgctcctct

SEQ ID NO: 9176163 - DNA, 22 bp, Homo sapiens
cccagcctgatctcggccagct

SEQ ID NO: 9176164 - DNA, 23 bp, Homo sapiens
cctcagagaggcagagccacatg

SEQ ID NO: 9176165 - DNA, 22 bp, Homo sapiens
cctcagaatagtcctcagatca

SEQ ID NO: 9176166 - DNA, 22 bp, Homo sapiens
cctcaaattgtcaaataagaat

SEQ ID NO: 9176167 - DNA, 19 bp, Homo sapiens
ccctgggggtttctggtac

SEQ ID NO: 9176168 - DNA, 22 bp, Homo sapiens
ccctggggctgagggatggccg

SEQ ID NO: 9176169 - DNA, 22 bp, Homo sapiens
ccctgtggttgctagggcacag

SEQ ID NO: 9176170 - DNA, 22 bp, Homo sapiens
ccctgtggttgctagggcacag

SEQ ID NO: 9176171 - DNA, 22 bp, Homo sapiens
ccctgtggttgctagggcacag

SEQ ID NO: 9176172 - DNA, 22 bp, Homo sapiens
cccttagagattctgtcagagt

SEQ ID NO: 9176173 - DNA, 18 bp, Homo sapiens
cccttagcctttcctctc

SEQ ID NO: 9176174 - DNA, 22 bp, Homo sapiens
cccttagaacaacattagcata

SEQ ID NO: 9176175 - DNA, 22 bp, Homo sapiens
cccttaaaggctttgcctctct

SEQ ID NO: 9176176 - DNA, 22 bp, Homo sapiens
cccttcagggttaagtagaggg

SEQ ID NO: 9176177 - DNA, 22 bp, Homo sapiens
cccttcagctgagtgggacagc

SEQ ID NO: 9176178 - DNA, 22 bp, Homo sapiens
cccttcaagctctctgggtttt

SEQ ID NO: 9176179 - DNA, 22 bp, Homo sapiens
cccttagctccaaggggtttgg

SEQ ID NO: 9176180 - DNA, 22 bp, Homo sapiens
cccttagctcaatttcttgccc

SEQ ID NO: 9176181 - DNA, 22 bp, Homo sapiens
cctcaaaggcctggcaccagaa

SEQ ID NO: 9176182 - DNA, 22 bp, Homo sapiens
cctcaaagtagagggagatgag

SEQ ID NO: 9176183 - DNA, 22 bp, Homo sapiens
cctcaaagcggtatgcagacgg

SEQ ID NO: 9176184 - DNA, 22 bp, Homo sapiens
cctctccttgcacccgtcccgc

SEQ ID NO: 9176185 - DNA, 22 bp, Homo sapiens
cctcgcggcactcgggccggat

SEQ ID NO: 9176186 - DNA, 22 bp, Homo sapiens
cctccccacccacggctggtgg

SEQ ID NO: 9176187 - DNA, 22 bp, Homo sapiens
cctcgacctccccaggctcagg

SEQ ID NO: 9176188 - DNA, 22 bp, Homo sapiens
cctctccttgcacccgtcccgc

SEQ ID NO: 9176189 - DNA, 22 bp, Homo sapiens
cctctctcagcttgctgcaact

SEQ ID NO: 9176190 - DNA, 22 bp, Homo sapiens
cctccccacagcccaggagact

SEQ ID NO: 9176191 - DNA, 21 bp, Homo sapiens
cctccaggagcagagccctga

SEQ ID NO: 9176192 - DNA, 21 bp, Homo sapiens
cctccaggagcagagccctga

SEQ ID NO: 9176193 - DNA, 21 bp, Homo sapiens
cctccaggagcagagccctga

SEQ ID NO: 9176194 - DNA, 22 bp, Homo sapiens
cctccaggaacttgagagacac

SEQ ID NO: 9176195 - DNA, 22 bp, Homo sapiens
cctccaggaacttgagagacac

SEQ ID NO: 9176196 - DNA, 21 bp, Homo sapiens
cctccaggagcagagccctga

SEQ ID NO: 9176197 - DNA, 21 bp, Homo sapiens
cctccaggagcagagccctga

SEQ ID NO: 9176198 - DNA, 22 bp, Homo sapiens
cctccaggaggaaatggaacac

SEQ ID NO: 9176199 - DNA, 22 bp, Homo sapiens
cctccagctgcctcagtctctt

SEQ ID NO: 9176200 - DNA, 22 bp, Homo sapiens
cctccagctgcctcagtctctt

SEQ ID NO: 9176201 - DNA, 22 bp, Homo sapiens
cctccaggaacttgagagacac

SEQ ID NO: 9176202 - DNA, 22 bp, Homo sapiens
cctccaggaacttgagagacac

SEQ ID NO: 9176203 - DNA, 20 bp, Homo sapiens
cctccaggcacacccatgtg

SEQ ID NO: 9176204 - DNA, 20 bp, Homo sapiens
cctccaggcacacccatgtg

SEQ ID NO: 9176205 - DNA, 20 bp, Homo sapiens
cctccaggcacacccatgtg

SEQ ID NO: 9176206 - DNA, 22 bp, Homo sapiens
cctccaggataagtcagggcct

SEQ ID NO: 9176207 - DNA, 22 bp, Homo sapiens
cctccaggataagtcagggcct

SEQ ID NO: 9176208 - DNA, 23 bp, Homo sapiens
cctcccaggctgcgagtcccgag

SEQ ID NO: 9176209 - DNA, 22 bp, Homo sapiens
cctcccaggcattgccattttc

SEQ ID NO: 9176210 - DNA, 22 bp, Homo sapiens
cctccaggccttgcaggttaac

SEQ ID NO: 9176211 - DNA, 20 bp, Homo sapiens
cctccaggcacacccatgtg

SEQ ID NO: 9176212 - DNA, 22 bp, Homo sapiens
cctccaggccttgcaggttaac

SEQ ID NO: 9176213 - DNA, 22 bp, Homo sapiens
cctccaggccttgcaggttaac

SEQ ID NO: 9176214 - DNA, 22 bp, Homo sapiens
cctccaggctgaatatctagaa

SEQ ID NO: 9176215 - DNA, 22 bp, Homo sapiens
cctccaggctgaatatctagaa

SEQ ID NO: 9176216 - DNA, 22 bp, Homo sapiens
agggcagcagctcctcctagct

SEQ ID NO: 9176217 - DNA, 22 bp, Homo sapiens
agggcagcagctcctcctagct

SEQ ID NO: 9176218 - DNA, 22 bp, Homo sapiens
agggcagcagctgtccctgaga

SEQ ID NO: 9176219 - DNA, 22 bp, Homo sapiens
agggcagcagctgtccctgaga

SEQ ID NO: 9176220 - DNA, 22 bp, Homo sapiens
agggcagcattgcctttctcca

SEQ ID NO: 9176221 - DNA, 22 bp, Homo sapiens
agggcagccatgagccttcagg

SEQ ID NO: 9176222 - DNA, 22 bp, Homo sapiens
agggaggagaatggactccttc

SEQ ID NO: 9176223 - DNA, 22 bp, Homo sapiens
agggaggagaatggactccttc

SEQ ID NO: 9176224 - DNA, 22 bp, Homo sapiens
agggaggagaatggactccttc

SEQ ID NO: 9176225 - DNA, 22 bp, Homo sapiens
agggaggaaggatgttccaaag

SEQ ID NO: 9176226 - DNA, 22 bp, Homo sapiens
agggcagcctctcagcctaggt

SEQ ID NO: 9176227 - DNA, 22 bp, Homo sapiens
agggcagcccttctgggagggc

SEQ ID NO: 9176228 - DNA, 22 bp, Homo sapiens
agggcagcccttctgggagggc

SEQ ID NO: 9176229 - DNA, 22 bp, Homo sapiens
agggcagcccttctgggagggc

SEQ ID NO: 9176230 - DNA, 22 bp, Homo sapiens
agggcagcctctcagcctaggt

SEQ ID NO: 9176231 - DNA, 22 bp, Homo sapiens
agggcagcctctcagcctaggt

SEQ ID NO: 9176232 - DNA, 22 bp, Homo sapiens
agggcagctaaggtgctgactg

SEQ ID NO: 9176233 - DNA, 22 bp, Homo sapiens
agggcagctagctgtagaaaga

SEQ ID NO: 9176234 - DNA, 22 bp, Homo sapiens
agggcagctaaggtgctgactg

SEQ ID NO: 9176235 - DNA, 22 bp, Homo sapiens
agggcagctagctgtagaaaga

SEQ ID NO: 9176236 - DNA, 22 bp, Homo sapiens
agggcagcctgagtgctggccc

SEQ ID NO: 9176237 - DNA, 22 bp, Homo sapiens
agggcagcctgagtgctggccc

SEQ ID NO: 9176238 - DNA, 22 bp, Homo sapiens
agggcagcctgagtgctggccc

SEQ ID NO: 9176239 - DNA, 22 bp, Homo sapiens
agggcagcctgagtgctggccc

SEQ ID NO: 9176240 - DNA, 22 bp, Homo sapiens
agggcagctctcacctctggcc

SEQ ID NO: 9176241 - DNA, 22 bp, Homo sapiens
agggcagctggaaggtggcttc

SEQ ID NO: 9176242 - DNA, 22 bp, Homo sapiens
agggcagctgtgagccactgtg

SEQ ID NO: 9176243 - DNA, 21 bp, Homo sapiens
agggccagatcaccaaggagc

SEQ ID NO: 9176244 - DNA, 22 bp, Homo sapiens
agggccagagtctgtgtagata

SEQ ID NO: 9176245 - DNA, 22 bp, Homo sapiens
agggccaggaacacctgaaggg

SEQ ID NO: 9176246 - DNA, 22 bp, Homo sapiens
agggccaggatcacagccaaga

SEQ ID NO: 9176247 - DNA, 18 bp, Homo sapiens
agggccagctgtgagtag

SEQ ID NO: 9176248 - DNA, 22 bp, Homo sapiens
agggccaggaacacctgaaggg

SEQ ID NO: 9176249 - DNA, 18 bp, Homo sapiens
agggccagctgtgagtag

SEQ ID NO: 9176250 - DNA, 18 bp, Homo sapiens
agggccagctgtgagtag

SEQ ID NO: 9176251 - DNA, 22 bp, Homo sapiens
agggccaggaacacctgaaggg

SEQ ID NO: 9176252 - DNA, 22 bp, Homo sapiens
agggccaggaacacctgaaggg

SEQ ID NO: 9176253 - DNA, 22 bp, Homo sapiens
agggccaggaacacctgaaggg

SEQ ID NO: 9176254 - DNA, 22 bp, Homo sapiens
agggccagccgacttccagcct

SEQ ID NO: 9176255 - DNA, 22 bp, Homo sapiens
ccctgggctcagagcaggtagc

SEQ ID NO: 9176256 - DNA, 22 bp, Homo sapiens
ccctgggctcagagcaggtagc

SEQ ID NO: 9176257 - DNA, 22 bp, Homo sapiens
ccctgggcagtctgcacttcag

SEQ ID NO: 9176258 - DNA, 22 bp, Homo sapiens
ccctggggctgagggatggccg

SEQ ID NO: 9176259 - DNA, 22 bp, Homo sapiens
ccctggggagcaggcgaaggag

SEQ ID NO: 9176260 - DNA, 22 bp, Homo sapiens
ccctgggcagtctgcacttcag

SEQ ID NO: 9176261 - DNA, 22 bp, Homo sapiens
ccctgggcagtctgcacttcag

SEQ ID NO: 9176262 - DNA, 22 bp, Homo sapiens
ccctgggcagtctgcacttcag

SEQ ID NO: 9176263 - DNA, 22 bp, Homo sapiens
ccctgggcaccaggcctggtaa

SEQ ID NO: 9176264 - DNA, 22 bp, Homo sapiens
ccctgggcaccaggcctggtaa

SEQ ID NO: 9176265 - DNA, 22 bp, Homo sapiens
ccctgggcaagccctattttcc

SEQ ID NO: 9176266 - DNA, 22 bp, Homo sapiens
ccctggcccctcactccgaggc

SEQ ID NO: 9176267 - DNA, 22 bp, Homo sapiens
ccctggcccctcactccgaggc

SEQ ID NO: 9176268 - DNA, 22 bp, Homo sapiens
ccctgggatggattggcaggaa

SEQ ID NO: 9176269 - DNA, 22 bp, Homo sapiens
ccctgggatggattggcaggaa

SEQ ID NO: 9176270 - DNA, 22 bp, Homo sapiens
agggccagggaaacgatcagca

SEQ ID NO: 9176271 - DNA, 22 bp, Homo sapiens
agggccaggctcccatgtcagg

SEQ ID NO: 9176272 - DNA, 22 bp, Homo sapiens
agggccaggctcccatgtcagg

SEQ ID NO: 9176273 - DNA, 20 bp, Homo sapiens
gtaaaatatggtctttgggt

SEQ ID NO: 9176274 - DNA, 20 bp, Homo sapiens
gtaaaatatggtctttgggt

SEQ ID NO: 9176275 - DNA, 20 bp, Homo sapiens
gtaaaatatggtctttgggt

SEQ ID NO: 9176276 - DNA, 22 bp, Homo sapiens
gtaaaatcatttagttacttaa

SEQ ID NO: 9176277 - DNA, 22 bp, Homo sapiens
gtaaaatagaataacgtggcta

SEQ ID NO: 9176278 - DNA, 22 bp, Homo sapiens
ggttgctgggggtggcagagct

SEQ ID NO: 9176279 - DNA, 22 bp, Homo sapiens
ggttgcaaactcctgggatcaa

SEQ ID NO: 9176280 - DNA, 17 bp, Homo sapiens
ggttgagtaatctgagg

SEQ ID NO: 9176281 - DNA, 22 bp, Homo sapiens
gtaaaattctagcatctgaaag

SEQ ID NO: 9176282 - DNA, 22 bp, Homo sapiens
gtaaaatctttattgctggtga

SEQ ID NO: 9176283 - DNA, 22 bp, Homo sapiens
gtaaaatctttcctatttgcct

SEQ ID NO: 9176284 - DNA, 22 bp, Homo sapiens
gtaaaattgcaattacttttgc

SEQ ID NO: 9176285 - DNA, 22 bp, Homo sapiens
cagcagagctgtgtgggaaggg

SEQ ID NO: 9176286 - DNA, 22 bp, Homo sapiens
gtaaacaaactctcaggccagt

SEQ ID NO: 9176287 - DNA, 22 bp, Homo sapiens
cagcacaattttcaggagtcca

SEQ ID NO: 9176288 - DNA, 22 bp, Homo sapiens
ggttccagaagggggcgaggtg

SEQ ID NO: 9176289 - DNA, 22 bp, Homo sapiens
cagcaatctttcttggtcttct

SEQ ID NO: 9176290 - DNA, 22 bp, Homo sapiens
cagcaagggttatatcaaagat

SEQ ID NO: 9176291 - DNA, 22 bp, Homo sapiens
cagcaataaggtaagcttctcc

SEQ ID NO: 9176292 - DNA, 22 bp, Homo sapiens
cagcaataactcaaagccattt

SEQ ID NO: 9176293 - DNA, 22 bp, Homo sapiens
ggttctgaagtggtcccattcc

SEQ ID NO: 9176294 - DNA, 22 bp, Homo sapiens
ggttctctaactttgactggag

SEQ ID NO: 9176295 - DNA, 22 bp, Homo sapiens
ggttccttctgaggtccctgta

SEQ ID NO: 9176296 - DNA, 19 bp, Homo sapiens
ggttcctcacgctaagggc

SEQ ID NO: 9176297 - DNA, 22 bp, Homo sapiens
ggttccagagtatttcatttca

SEQ ID NO: 9176298 - DNA, 22 bp, Homo sapiens
ggttccagagtgggctgggaaa

SEQ ID NO: 9176299 - DNA, 22 bp, Homo sapiens
ggttccccaggcggcccttgga

SEQ ID NO: 9176300 - DNA, 22 bp, Homo sapiens
ggttccaggcatggcaggatgt

SEQ ID NO: 9176301 - DNA, 22 bp, Homo sapiens
ggttccccaggcggcccttgga

SEQ ID NO: 9176302 - DNA, 22 bp, Homo sapiens
gggtgggactctttggcctgag

SEQ ID NO: 9176303 - DNA, 22 bp, Homo sapiens
gggtgggactgaagtctgaggg

SEQ ID NO: 9176304 - DNA, 22 bp, Homo sapiens
gggtgggagaaatgagtatcta

SEQ ID NO: 9176305 - DNA, 22 bp, Homo sapiens
gggtgggactgaagtctgaggg

SEQ ID NO: 9176306 - DNA, 22 bp, Homo sapiens
gggtgggagaaatgagtatcta

SEQ ID NO: 9176307 - DNA, 20 bp, Homo sapiens
gggtgggagagtctgagggt

SEQ ID NO: 9176308 - DNA, 20 bp, Homo sapiens
gggtgggagagtctgagggt

SEQ ID NO: 9176309 - DNA, 20 bp, Homo sapiens
gggtgggagagtctgagggt

SEQ ID NO: 9176310 - DNA, 21 bp, Homo sapiens
gggtgggaggacacagcaggc

SEQ ID NO: 9176311 - DNA, 21 bp, Homo sapiens
gggtgggaggacacagcaggc

SEQ ID NO: 9176312 - DNA, 21 bp, Homo sapiens
gggtgggaggacacagcaggc

SEQ ID NO: 9176313 - DNA, 22 bp, Homo sapiens
ggtgggagagctctgtctccag

SEQ ID NO: 9176314 - DNA, 22 bp, Homo sapiens
ggtgggagagctctgtctccag

SEQ ID NO: 9176315 - DNA, 22 bp, Homo sapiens
gggtgggagtctggccctcaaa

SEQ ID NO: 9176316 - DNA, 22 bp, Homo sapiens
gggtgggatctgtggagcctca

SEQ ID NO: 9176317 - DNA, 22 bp, Homo sapiens
cagcaagggataaagagttact

SEQ ID NO: 9176318 - DNA, 22 bp, Homo sapiens
cagcaaggccattggatgcagt

SEQ ID NO: 9176319 - DNA, 22 bp, Homo sapiens
ggtgggtgaaatctaggtgtgt

SEQ ID NO: 9176320 - DNA, 22 bp, Homo sapiens
ggtggggtcacgacagagggaa

SEQ ID NO: 9176321 - DNA, 22 bp, Homo sapiens
ggtggggtcacgacagagggaa

SEQ ID NO: 9176322 - DNA, 22 bp, Homo sapiens
ggtggggtcacgacagagggaa

SEQ ID NO: 9176323 - DNA, 22 bp, Homo sapiens
ggtggggtatttggtacttgta

SEQ ID NO: 9176324 - DNA, 22 bp, Homo sapiens
ggtggggtcacgacagagggaa

SEQ ID NO: 9176325 - DNA, 22 bp, Homo sapiens
ggtgggggagacttggtcaaga

SEQ ID NO: 9176326 - DNA, 22 bp, Homo sapiens
gtatgaaagcatcattcctgct

SEQ ID NO: 9176327 - DNA, 22 bp, Homo sapiens
cagcagctaaggcatgttcctg

SEQ ID NO: 9176328 - DNA, 22 bp, Homo sapiens
cagcagctacctgctcttgtgg

SEQ ID NO: 9176329 - DNA, 22 bp, Homo sapiens
cagcaggacatggaggagtaaa

SEQ ID NO: 9176330 - DNA, 22 bp, Homo sapiens
cagcaggacatggaggagtaaa

SEQ ID NO: 9176331 - DNA, 22 bp, Homo sapiens
cagcaggatttgaaaggaagag

SEQ ID NO: 9176332 - DNA, 22 bp, Homo sapiens
cagcaggattggatacatctca

SEQ ID NO: 9176333 - DNA, 22 bp, Homo sapiens
cagcaggattggatacatctca

SEQ ID NO: 9176334 - DNA, 22 bp, Homo sapiens
cagcaggcaggtgggccaagtc

SEQ ID NO: 9176335 - DNA, 22 bp, Homo sapiens
cagcaggcaggtgggccaagtc

SEQ ID NO: 9176336 - DNA, 22 bp, Homo sapiens
cagcaggcccaggtgctggtga

SEQ ID NO: 9176337 - DNA, 22 bp, Homo sapiens
cagcaggcccaggtgctggtga

SEQ ID NO: 9176338 - DNA, 22 bp, Homo sapiens
cagcaggcggcccgcgggcccg

SEQ ID NO: 9176339 - DNA, 22 bp, Homo sapiens
gtatttctggtaactgctgcta

SEQ ID NO: 9176340 - DNA, 22 bp, Homo sapiens
gtatttctggttaaatgtgcta

SEQ ID NO: 9176341 - DNA, 22 bp, Homo sapiens
gtatttctttccattatagtca

SEQ ID NO: 9176342 - DNA, 22 bp, Homo sapiens
cagcagagtaattctcacctct

SEQ ID NO: 9176343 - DNA, 22 bp, Homo sapiens
cagcagagtaattctcacctct

SEQ ID NO: 9176344 - DNA, 21 bp, Homo sapiens
cagcagagtaatgcattcgta

SEQ ID NO: 9176345 - DNA, 22 bp, Homo sapiens
cagcagagctgtgtgggaaggg

SEQ ID NO: 9176346 - DNA, 22 bp, Homo sapiens
cagcagagctgtgtgggaaggg

SEQ ID NO: 9176347 - DNA, 22 bp, Homo sapiens
cagcagagctgtgtgggaaggg

SEQ ID NO: 9176348 - DNA, 22 bp, Homo sapiens
cagcagagtaggtgctacttct

SEQ ID NO: 9176349 - DNA, 22 bp, Homo sapiens
cagcagagtatggcactcaact

SEQ ID NO: 9176350 - DNA, 22 bp, Homo sapiens
cagcagagtatggcactcaact

SEQ ID NO: 9176351 - DNA, 22 bp, Homo sapiens
cagcagagtttggcttctaatg

SEQ ID NO: 9176352 - DNA, 22 bp, Homo sapiens
cagcagagtttggcttctaatg

SEQ ID NO: 9176353 - DNA, 22 bp, Homo sapiens
cagcagagtttggcttctaatg

SEQ ID NO: 9176354 - DNA, 22 bp, Homo sapiens
cagcagcaacaacggaagcctt

SEQ ID NO: 9176355 - DNA, 22 bp, Homo sapiens
cagcagcaacaacggaagcctt

SEQ ID NO: 9176356 - DNA, 22 bp, Homo sapiens
cagcagcaacaacggaagcctt

SEQ ID NO: 9176357 - DNA, 22 bp, Homo sapiens
cagcagcaacaacggaagcctt

SEQ ID NO: 9176358 - DNA, 22 bp, Homo sapiens
cagcagcaaatctagaagagga

SEQ ID NO: 9176359 - DNA, 22 bp, Homo sapiens
cagcagcaacaacggaagcctt

SEQ ID NO: 9176360 - DNA, 22 bp, Homo sapiens
cagcagcaaatctagaagagga

SEQ ID NO: 9176361 - DNA, 22 bp, Homo sapiens
cagcagcaaggtgagggtggag

SEQ ID NO: 9176362 - DNA, 22 bp, Homo sapiens
cagcagcaaggtgagggtggag

SEQ ID NO: 9176363 - DNA, 22 bp, Homo sapiens
cagcagcaaggtgagggtggag

SEQ ID NO: 9176364 - DNA, 22 bp, Homo sapiens
gtagggataggtgtccagagac

SEQ ID NO: 9176365 - DNA, 22 bp, Homo sapiens
gtagggattcttctcactgagc

SEQ ID NO: 9176366 - DNA, 22 bp, Homo sapiens
gtatccatgggggattggttcc

SEQ ID NO: 9176367 - DNA, 22 bp, Homo sapiens
gtatccatgggggattggttcc

SEQ ID NO: 9176368 - DNA, 22 bp, Homo sapiens
gtatcctccccgctggccttca

SEQ ID NO: 9176369 - DNA, 22 bp, Homo sapiens
gtatctatgatcctttatatct

SEQ ID NO: 9176370 - DNA, 22 bp, Homo sapiens
gtatatgtatgcgtatacacac

SEQ ID NO: 9176371 - DNA, 22 bp, Homo sapiens
gtatatgtatgcgtatacacac

SEQ ID NO: 9176372 - DNA, 22 bp, Homo sapiens
gtatatgtgtgcaagtgcatgg

SEQ ID NO: 9176373 - DNA, 22 bp, Homo sapiens
cagcccagcagactgttaccac

SEQ ID NO: 9176374 - DNA, 22 bp, Homo sapiens
cagcccagcactaagtagattt

SEQ ID NO: 9176375 - DNA, 22 bp, Homo sapiens
cagcccagagccagttcccgct

SEQ ID NO: 9176376 - DNA, 22 bp, Homo sapiens
cagcccagcactaagtagattt

SEQ ID NO: 9176377 - DNA, 22 bp, Homo sapiens
cagcccagcagactgttaccac

SEQ ID NO: 9176378 - DNA, 22 bp, Homo sapiens
cagcccagcagggtctggccct

SEQ ID NO: 9176379 - DNA, 22 bp, Homo sapiens
cagcccagcagggtctggccct

SEQ ID NO: 9176380 - DNA, 22 bp, Homo sapiens
cagcccagcagggtctggccct

SEQ ID NO: 9176381 - DNA, 22 bp, Homo sapiens
cagcccagcagtcttagcctgc

SEQ ID NO: 9176382 - DNA, 22 bp, Homo sapiens
cagcccagcagtcttagcctgc

SEQ ID NO: 9176383 - DNA, 21 bp, Homo sapiens
cagcccagcccattgacagtg

SEQ ID NO: 9176384 - DNA, 21 bp, Homo sapiens
cagcccagcccattgacagtg

SEQ ID NO: 9176385 - DNA, 21 bp, Homo sapiens
cagcccagcccattgacagtg

SEQ ID NO: 9176386 - DNA, 22 bp, Homo sapiens
cagccaggttcaagtccttata

SEQ ID NO: 9176387 - DNA, 21 bp, Homo sapiens
cagcccagagcagtggggcca

SEQ ID NO: 9176388 - DNA, 22 bp, Homo sapiens
cagccaggttcaagtccttata

SEQ ID NO: 9176389 - DNA, 17 bp, Homo sapiens
cagccagtcccttcatt

SEQ ID NO: 9176390 - DNA, 22 bp, Homo sapiens
cagccactgaactcctggctat

SEQ ID NO: 9176391 - DNA, 22 bp, Homo sapiens
cagccactctcagacagtccca

SEQ ID NO: 9176392 - DNA, 22 bp, Homo sapiens
cagccacagctgggtgcctgac

SEQ ID NO: 9176393 - DNA, 22 bp, Homo sapiens
cagccaccatacagcagaagct

SEQ ID NO: 9176394 - DNA, 22 bp, Homo sapiens
cagccaagaaagcagtgctcca

SEQ ID NO: 9176395 - DNA, 22 bp, Homo sapiens
cagccaagaaagcagtgctcca

SEQ ID NO: 9176396 - DNA, 22 bp, Homo sapiens
cagccaagaaccacagacccag

SEQ ID NO: 9176397 - DNA, 22 bp, Homo sapiens
cagccaatcctgggaaagtgca

SEQ ID NO: 9176398 - DNA, 22 bp, Homo sapiens
cagccaatagcaagggaagctg

SEQ ID NO: 9176399 - DNA, 22 bp, Homo sapiens
cagccaagaaccacagacccag

SEQ ID NO: 9176400 - DNA, 22 bp, Homo sapiens
cagccaagaaccacagacccag

SEQ ID NO: 9176401 - DNA, 22 bp, Homo sapiens
cagccaatcctgggaaagtgca

SEQ ID NO: 9176402 - DNA, 22 bp, Homo sapiens
cagccaatctgcatatttcttt

SEQ ID NO: 9176403 - DNA, 22 bp, Homo sapiens
cagccaatgggggacttggcca

SEQ ID NO: 9176404 - DNA, 22 bp, Homo sapiens
cagccaattctagcttgtgaat

SEQ ID NO: 9176405 - DNA, 22 bp, Homo sapiens
cagccacagctgggtgcctgac

SEQ ID NO: 9176406 - DNA, 22 bp, Homo sapiens
cagcattttccatagaaagaag

SEQ ID NO: 9176407 - DNA, 22 bp, Homo sapiens
cagcatttggaggagaggcttt

SEQ ID NO: 9176408 - DNA, 22 bp, Homo sapiens
cagcatttcaggaggctgaggt

SEQ ID NO: 9176409 - DNA, 22 bp, Homo sapiens
gtatttgatacatgaaatggtg

SEQ ID NO: 9176410 - DNA, 22 bp, Homo sapiens
gtatttgatcattagaatgatt

SEQ ID NO: 9176411 - DNA, 22 bp, Homo sapiens
gtatttgctcatacagtgatac

SEQ ID NO: 9176412 - DNA, 22 bp, Homo sapiens
gtatttgcaaatctaaaagaga

SEQ ID NO: 9176413 - DNA, 22 bp, Homo sapiens
gtattttactgctcaaagctct

SEQ ID NO: 9176414 - DNA, 22 bp, Homo sapiens
gtattttactgctcaaagctct

SEQ ID NO: 9176415 - DNA, 22 bp, Homo sapiens
gtattttactgctcaaagctct

SEQ ID NO: 9176416 - DNA, 22 bp, Homo sapiens
gtattttaagtgactactaggt

SEQ ID NO: 9176417 - DNA, 22 bp, Homo sapiens
gtattttaagtgactactaggt

SEQ ID NO: 9176418 - DNA, 22 bp, Homo sapiens
gtattttaagtgactactaggt

SEQ ID NO: 9176419 - DNA, 22 bp, Homo sapiens
gggaaagagaggtggacgcagg

SEQ ID NO: 9176420 - DNA, 22 bp, Homo sapiens
gggaaagagtgcttgtccagag

SEQ ID NO: 9176421 - DNA, 22 bp, Homo sapiens
gggaaagaccttcctggggtgt

SEQ ID NO: 9176422 - DNA, 22 bp, Homo sapiens
gggaaagaccctgagtcttatt

SEQ ID NO: 9176423 - DNA, 22 bp, Homo sapiens
gggaaagaagaagagccatttt

SEQ ID NO: 9176424 - DNA, 22 bp, Homo sapiens
gggaaagaagatctagatactg

SEQ ID NO: 9176425 - DNA, 22 bp, Homo sapiens
gggaaactggggactgaatctg

SEQ ID NO: 9176426 - DNA, 21 bp, Homo sapiens
cagaagtaagggtaacttctc

SEQ ID NO: 9176427 - DNA, 22 bp, Homo sapiens
cagaagtaagattactgtgagt

SEQ ID NO: 9176428 - DNA, 22 bp, Homo sapiens
cagaagtaagattactgtgaga

SEQ ID NO: 9176429 - DNA, 22 bp, Homo sapiens
cagaagggcagcactgggaagg

SEQ ID NO: 9176430 - DNA, 22 bp, Homo sapiens
ggcttttgctgtgttttccaga

SEQ ID NO: 9176431 - DNA, 22 bp, Homo sapiens
ggcttttgaattccaaggcatt

SEQ ID NO: 9176432 - DNA, 22 bp, Homo sapiens
gggaaaaataatgcacagatat

SEQ ID NO: 9176433 - DNA, 22 bp, Homo sapiens
gggaaactagaagcagggttat

SEQ ID NO: 9176434 - DNA, 22 bp, Homo sapiens
cagaaggctggcagattgagat

SEQ ID NO: 9176435 - DNA, 22 bp, Homo sapiens
cagaaggctttgtggagtagac

SEQ ID NO: 9176436 - DNA, 22 bp, Homo sapiens
cagaagggcagcactgggaagg

SEQ ID NO: 9176437 - DNA, 22 bp, Homo sapiens
cagaagggcagcactgggaagg

SEQ ID NO: 9176438 - DNA, 22 bp, Homo sapiens
cagaaggcaaacaaaaggattt

SEQ ID NO: 9176439 - DNA, 22 bp, Homo sapiens
cagaaggcaaacaaaaggattt

SEQ ID NO: 9176440 - DNA, 22 bp, Homo sapiens
cagaaggcagcaaatgaaaacc

SEQ ID NO: 9176441 - DNA, 22 bp, Homo sapiens
cagaaggcaaggcctgccacgc

SEQ ID NO: 9176442 - DNA, 22 bp, Homo sapiens
cagaaggcatagatgaaggcct

SEQ ID NO: 9176443 - DNA, 22 bp, Homo sapiens
cagaaggcatagatgaaggcct

SEQ ID NO: 9176444 - DNA, 22 bp, Homo sapiens
cactggctgggccagcactcct

SEQ ID NO: 9176445 - DNA, 22 bp, Homo sapiens
cactggctatgagggagatggg

SEQ ID NO: 9176446 - DNA, 22 bp, Homo sapiens
cactgggacctaggactgagct

SEQ ID NO: 9176447 - DNA, 22 bp, Homo sapiens
cactggctaaagataagctcaa

SEQ ID NO: 9176448 - DNA, 22 bp, Homo sapiens
cactggctaaaaaagaggcaga

SEQ ID NO: 9176449 - DNA, 22 bp, Homo sapiens
cactggcctaagcgcctcagcc

SEQ ID NO: 9176450 - DNA, 22 bp, Homo sapiens
gggacagacccatgggccaggt

SEQ ID NO: 9176451 - DNA, 22 bp, Homo sapiens
gggactggcacagggctgggag

SEQ ID NO: 9176452 - DNA, 22 bp, Homo sapiens
gggactggcacagggctgggag

SEQ ID NO: 9176453 - DNA, 22 bp, Homo sapiens
gggactggatagatgtgggtga

SEQ ID NO: 9176454 - DNA, 22 bp, Homo sapiens
gggactggcacagggctgggag

SEQ ID NO: 9176455 - DNA, 19 bp, Homo sapiens
gggactggaggatgtggag

SEQ ID NO: 9176456 - DNA, 22 bp, Homo sapiens
gggaatgtgtctgatggaaaga

SEQ ID NO: 9176457 - DNA, 22 bp, Homo sapiens
gggaaggaggtggcttgaagtg

SEQ ID NO: 9176458 - DNA, 22 bp, Homo sapiens
gggaatgtggccctggggctcc

SEQ ID NO: 9176459 - DNA, 22 bp, Homo sapiens
gggacaatggaggcctctctcc

SEQ ID NO: 9176460 - DNA, 22 bp, Homo sapiens
gggacaatggaggcctctctcc

SEQ ID NO: 9176461 - DNA, 22 bp, Homo sapiens
gggacaatggaggcctctctcc

SEQ ID NO: 9176462 - DNA, 22 bp, Homo sapiens
gggacaatggaggcctctctcc

SEQ ID NO: 9176463 - DNA, 22 bp, Homo sapiens
gggaaggaggtggacctgcccc

SEQ ID NO: 9176464 - DNA, 22 bp, Homo sapiens
gggaaggaggtggacctgcccc

SEQ ID NO: 9176465 - DNA, 22 bp, Homo sapiens
gggaaggaggtggacctgcccc

SEQ ID NO: 9176466 - DNA, 22 bp, Homo sapiens
gggaaggaggtggacctgcccc

SEQ ID NO: 9176467 - DNA, 22 bp, Homo sapiens
gggaaggagcctgcttgctaga

SEQ ID NO: 9176468 - DNA, 22 bp, Homo sapiens
gggaaggaaagttattagcaga

SEQ ID NO: 9176469 - DNA, 22 bp, Homo sapiens
gggaaggaaagttattagcaga

SEQ ID NO: 9176470 - DNA, 22 bp, Homo sapiens
gggaaggacacagccatgactg

SEQ ID NO: 9176471 - DNA, 22 bp, Homo sapiens
gggaaggacacagccatgactg

SEQ ID NO: 9176472 - DNA, 22 bp, Homo sapiens
gggaaggacacagccatgactg

SEQ ID NO: 9176473 - DNA, 22 bp, Homo sapiens
gggaaggacattctgggctcag

SEQ ID NO: 9176474 - DNA, 22 bp, Homo sapiens
gggaagctgcgtggtctagggc

SEQ ID NO: 9176475 - DNA, 22 bp, Homo sapiens
gggaaagagtgcttgtccagag

SEQ ID NO: 9176476 - DNA, 18 bp, Homo sapiens
gggaagccgggaagccgg

SEQ ID NO: 9176477 - DNA, 22 bp, Homo sapiens
gggactgggagatcctcctggc

SEQ ID NO: 9176478 - DNA, 22 bp, Homo sapiens
gggactgtcctctgtgtctgtg

SEQ ID NO: 9176479 - DNA, 22 bp, Homo sapiens
cagaagttagacttcaactaat

SEQ ID NO: 9176480 - DNA, 22 bp, Homo sapiens
cagaagtggcctcagagggagt

SEQ ID NO: 9176481 - DNA, 22 bp, Homo sapiens
cagaagtggcctcagagggagt

SEQ ID NO: 9176482 - DNA, 22 bp, Homo sapiens
cagaagtgcaatttaaattagg

SEQ ID NO: 9176483 - DNA, 22 bp, Homo sapiens
cagaagtttgaccttggtgggt

SEQ ID NO: 9176484 - DNA, 22 bp, Homo sapiens
cagaagtttgacatgtttagct

SEQ ID NO: 9176485 - DNA, 22 bp, Homo sapiens
cagaagtttgcaattgtttatt

SEQ ID NO: 9176486 - DNA, 22 bp, Homo sapiens
cagaagttttgctctcttgggt

SEQ ID NO: 9176487 - DNA, 22 bp, Homo sapiens
cagaagttttgctctcttgggt

SEQ ID NO: 9176488 - DNA, 22 bp, Homo sapiens
cagaagttggagctttccatca

SEQ ID NO: 9176489 - DNA, 22 bp, Homo sapiens
cagaagttggagctttccatca

SEQ ID NO: 9176490 - DNA, 22 bp, Homo sapiens
cagaagttctagatttgagtcc

SEQ ID NO: 9176491 - DNA, 22 bp, Homo sapiens
cagaagttgatcctgcgtttcc

SEQ ID NO: 9176492 - DNA, 22 bp, Homo sapiens
cagaagttagacttcaactaat

SEQ ID NO: 9176493 - DNA, 22 bp, Homo sapiens
cagaagttagtgtctgccagta

SEQ ID NO: 9176494 - DNA, 22 bp, Homo sapiens
cagaagttcctatttacctcct

SEQ ID NO: 9176495 - DNA, 22 bp, Homo sapiens
cagacaggaattctggcgtggt

SEQ ID NO: 9176496 - DNA, 22 bp, Homo sapiens
cagacaggagactggatcatgg

SEQ ID NO: 9176497 - DNA, 22 bp, Homo sapiens
cagacaggagactggatcatgg

SEQ ID NO: 9176498 - DNA, 22 bp, Homo sapiens
cagacaggcaggtgagagctcc

SEQ ID NO: 9176499 - DNA, 22 bp, Homo sapiens
cagacaggcaggtgctgctttg

SEQ ID NO: 9176500 - DNA, 22 bp, Homo sapiens
cagacaggcaggtgctgctttg

SEQ ID NO: 9176501 - DNA, 19 bp, Homo sapiens
gggagcaggaaagctgtgg

SEQ ID NO: 9176502 - DNA, 19 bp, Homo sapiens
gggagcaggaaagctgtgg

SEQ ID NO: 9176503 - DNA, 19 bp, Homo sapiens
gggagcaggaaagctgtgg

SEQ ID NO: 9176504 - DNA, 22 bp, Homo sapiens
gggagcagcctgcctcccacct

SEQ ID NO: 9176505 - DNA, 22 bp, Homo sapiens
gggagcaggacataatagcaat

SEQ ID NO: 9176506 - DNA, 22 bp, Homo sapiens
gggagcaggacataatagcaat

SEQ ID NO: 9176507 - DNA, 22 bp, Homo sapiens
gggagcaggagcctgcctgcca

SEQ ID NO: 9176508 - DNA, 22 bp, Homo sapiens
gggaggtgaaaggtcatgtgtg

SEQ ID NO: 9176509 - DNA, 22 bp, Homo sapiens
gggaggtgaaaggtcatgtgtg

SEQ ID NO: 9176510 - DNA, 22 bp, Homo sapiens
gggaggtgaaaggtcatgtgtg

SEQ ID NO: 9176511 - DNA, 20 bp, Homo sapiens
gggaggccagcctcagagaa

SEQ ID NO: 9176512 - DNA, 22 bp, Homo sapiens
gggagcagttaaaatgattcct

SEQ ID NO: 9176513 - DNA, 22 bp, Homo sapiens
gggagggcttggacccagatgt

SEQ ID NO: 9176514 - DNA, 22 bp, Homo sapiens
gggaggggttgcatgtttgagt

SEQ ID NO: 9176515 - DNA, 22 bp, Homo sapiens
gggaggggttgcatgtttgagt

SEQ ID NO: 9176516 - DNA, 22 bp, Homo sapiens
gggaggggttgcatgtttgagt

SEQ ID NO: 9176517 - DNA, 20 bp, Homo sapiens
gggatgagagtcctagctct

SEQ ID NO: 9176518 - DNA, 20 bp, Homo sapiens
gggatgagagtcctagctct

SEQ ID NO: 9176519 - DNA, 22 bp, Homo sapiens
cagacagggacctcgctccaga

SEQ ID NO: 9176520 - DNA, 22 bp, Homo sapiens
cagacagggccctgtgatggta

SEQ ID NO: 9176521 - DNA, 22 bp, Homo sapiens
gggcacagaagtctaagacatc

SEQ ID NO: 9176522 - DNA, 22 bp, Homo sapiens
gggcacaaaatttcagaaagct

SEQ ID NO: 9176523 - DNA, 22 bp, Homo sapiens
gggcaagtgttttgtctgcctg

SEQ ID NO: 9176524 - DNA, 22 bp, Homo sapiens
gggcaagtgtcaagcatgtcat

SEQ ID NO: 9176525 - DNA, 22 bp, Homo sapiens
gggcaagtaactctcgtgcggg

SEQ ID NO: 9176526 - DNA, 19 bp, Homo sapiens
cagagctgctggcctcgtc

SEQ ID NO: 9176527 - DNA, 22 bp, Homo sapiens
cagagctgctcatggtggccag

SEQ ID NO: 9176528 - DNA, 19 bp, Homo sapiens
cagagctgctggcctcgtc

SEQ ID NO: 9176529 - DNA, 22 bp, Homo sapiens
cagagctgctcatggtggccag

SEQ ID NO: 9176530 - DNA, 22 bp, Homo sapiens
cagagctgcagattgaaggcat

SEQ ID NO: 9176531 - DNA, 22 bp, Homo sapiens
cagagctgcagattgaaggcat

SEQ ID NO: 9176532 - DNA, 22 bp, Homo sapiens
cagagctgcgctttttcctggt

SEQ ID NO: 9176533 - DNA, 22 bp, Homo sapiens
cagagctgcgctttttcctggt

SEQ ID NO: 9176534 - DNA, 20 bp, Homo sapiens
ggggaagaaaaggatgtgat

SEQ ID NO: 9176535 - DNA, 23 bp, Homo sapiens
ggggaaagaccatgcttgaggac

SEQ ID NO: 9176536 - DNA, 22 bp, Homo sapiens
ggggaaagccagccctgcttcc

SEQ ID NO: 9176537 - DNA, 22 bp, Homo sapiens
ggggaaacatgttgttcagacc

SEQ ID NO: 9176538 - DNA, 22 bp, Homo sapiens
ggggaaactgaggcacagacag

SEQ ID NO: 9176539 - DNA, 22 bp, Homo sapiens
gggctgtgtactatgaggaggg

SEQ ID NO: 9176540 - DNA, 22 bp, Homo sapiens
gggcgcatcacctgaggtcagg

SEQ ID NO: 9176541 - DNA, 22 bp, Homo sapiens
gggcgccgtgggaaacagccgg

SEQ ID NO: 9176542 - DNA, 22 bp, Homo sapiens
cagagcctgctcacgtctctgt

SEQ ID NO: 9176543 - DNA, 22 bp, Homo sapiens
cagagcctgctgccttctgaag

SEQ ID NO: 9176544 - DNA, 21 bp, Homo sapiens
cagagctgaagggtgtagtgt

SEQ ID NO: 9176545 - DNA, 21 bp, Homo sapiens
cagagctgaagggtgtagtgt

SEQ ID NO: 9176546 - DNA, 21 bp, Homo sapiens
cagagctgaagggtgtagtgt

SEQ ID NO: 9176547 - DNA, 21 bp, Homo sapiens
cagagctctttctgcttgctg

SEQ ID NO: 9176548 - DNA, 22 bp, Homo sapiens
cagagctgagaatgttgatgct

SEQ ID NO: 9176549 - DNA, 22 bp, Homo sapiens
cagagctgacccaaggattgaa

SEQ ID NO: 9176550 - DNA, 22 bp, Homo sapiens
cagagctgacccaaggattgaa

SEQ ID NO: 9176551 - DNA, 23 bp, Homo sapiens
cagagctgattaaacttaatctc

SEQ ID NO: 9176552 - DNA, 22 bp, Homo sapiens
cagagctgagtcttcaaggttg

SEQ ID NO: 9176553 - DNA, 22 bp, Homo sapiens
cagagctgagtcttcaaggttg

SEQ ID NO: 9176554 - DNA, 22 bp, Homo sapiens
cagagctgagaatgttgatgct

SEQ ID NO: 9176555 - DNA, 22 bp, Homo sapiens
cagagctgagaatgttgatgct

SEQ ID NO: 9176556 - DNA, 22 bp, Homo sapiens
cagagctgcaaatgcccctccg

SEQ ID NO: 9176557 - DNA, 22 bp, Homo sapiens
cagagctgcaaatgcccctccg

SEQ ID NO: 9176558 - DNA, 22 bp, Homo sapiens
cagagctgattggatccagaga

SEQ ID NO: 9176559 - DNA, 22 bp, Homo sapiens
cagagctgcaaatgcccctccg

SEQ ID NO: 9176560 - DNA, 22 bp, Homo sapiens
cagagctgcagattgaaggcat

SEQ ID NO: 9176561 - DNA, 22 bp, Homo sapiens
cagagctgcacattctatgatg

SEQ ID NO: 9176562 - DNA, 22 bp, Homo sapiens
gggcagagaaatggacagttgg

SEQ ID NO: 9176563 - DNA, 22 bp, Homo sapiens
gggcagagaaatggacagttgg

SEQ ID NO: 9176564 - DNA, 22 bp, Homo sapiens
gggcactgtgttcagagtgcag

SEQ ID NO: 9176565 - DNA, 22 bp, Homo sapiens
gggcactgtgctaggtgctgag

SEQ ID NO: 9176566 - DNA, 22 bp, Homo sapiens
gggcacagagggtcttgaagaa

SEQ ID NO: 9176567 - DNA, 22 bp, Homo sapiens
gggcacagagggtcttgaagaa

SEQ ID NO: 9176568 - DNA, 22 bp, Homo sapiens
gggcacagagggtcttgaagaa

SEQ ID NO: 9176569 - DNA, 22 bp, Homo sapiens
gggcacagagggtcttgaagaa

SEQ ID NO: 9176570 - DNA, 22 bp, Homo sapiens
gggcacagagaaggttttagtg

SEQ ID NO: 9176571 - DNA, 22 bp, Homo sapiens
gggcacagagaaggttttagtg

SEQ ID NO: 9176572 - DNA, 22 bp, Homo sapiens
gggcgagggcgaaagcgagagc

SEQ ID NO: 9176573 - DNA, 22 bp, Homo sapiens
gggcgaggactgactctgggca

SEQ ID NO: 9176574 - DNA, 22 bp, Homo sapiens
cagagccctgcatgctccatct

SEQ ID NO: 9176575 - DNA, 22 bp, Homo sapiens
cagagcccctgggttgggagct

SEQ ID NO: 9176576 - DNA, 22 bp, Homo sapiens
cagagcccctcagctctctccc

SEQ ID NO: 9176577 - DNA, 22 bp, Homo sapiens
cagagccccccttctgatcaca

SEQ ID NO: 9176578 - DNA, 22 bp, Homo sapiens
cagaggccagggggctcacaaa

SEQ ID NO: 9176579 - DNA, 22 bp, Homo sapiens
cagaggcccagtgagagggctg

SEQ ID NO: 9176580 - DNA, 22 bp, Homo sapiens
cagaggcctcacttccagccag

SEQ ID NO: 9176581 - DNA, 21 bp, Homo sapiens
cagaggcctcatgctctgtgc

SEQ ID NO: 9176582 - DNA, 20 bp, Homo sapiens
ggggaagaaaaggatgtgat

SEQ ID NO: 9176583 - DNA, 22 bp, Homo sapiens
cagagctggtaagtggtagagg

SEQ ID NO: 9176584 - DNA, 22 bp, Homo sapiens
cagagctggtgtgtcctggcat

SEQ ID NO: 9176585 - DNA, 22 bp, Homo sapiens
cagagctggtgtgtcctggcat

SEQ ID NO: 9176586 - DNA, 22 bp, Homo sapiens
cagagctggtgtgtcctggcat

SEQ ID NO: 9176587 - DNA, 22 bp, Homo sapiens
cagagctggtgtgtcctggcat

SEQ ID NO: 9176588 - DNA, 22 bp, Homo sapiens
cagagctgtcatttgccagtga

SEQ ID NO: 9176589 - DNA, 22 bp, Homo sapiens
cagaggcaggataagaactgcg

SEQ ID NO: 9176590 - DNA, 20 bp, Homo sapiens
cagaggcattttcagactct

SEQ ID NO: 9176591 - DNA, 20 bp, Homo sapiens
cagaggcattttcagactct

SEQ ID NO: 9176592 - DNA, 20 bp, Homo sapiens
cagaggcattttcagactct

SEQ ID NO: 9176593 - DNA, 22 bp, Homo sapiens
cagagctggtgttacaagtcca

SEQ ID NO: 9176594 - DNA, 22 bp, Homo sapiens
cagagctggtgttacaagtcca

SEQ ID NO: 9176595 - DNA, 22 bp, Homo sapiens
cagagctggtgttacaagtcca

SEQ ID NO: 9176596 - DNA, 22 bp, Homo sapiens
cagagctgtatttatctttcca

SEQ ID NO: 9176597 - DNA, 22 bp, Homo sapiens
cagagctgtcatttgccagtga

SEQ ID NO: 9176598 - DNA, 22 bp, Homo sapiens
cagaggtgttggtgaatggaga

SEQ ID NO: 9176599 - DNA, 22 bp, Homo sapiens
cagaggtgttggtgaatggaga

SEQ ID NO: 9176600 - DNA, 22 bp, Homo sapiens
cagaggtggggagtatttcaag

SEQ ID NO: 9176601 - DNA, 22 bp, Homo sapiens
cagaggtgtacagagggaggcc

SEQ ID NO: 9176602 - DNA, 22 bp, Homo sapiens
cagaggctgtgtaggcagactg

SEQ ID NO: 9176603 - DNA, 22 bp, Homo sapiens
cagaggcttatacctgattagg

SEQ ID NO: 9176604 - DNA, 22 bp, Homo sapiens
cagaggcttggcattatcatgc

SEQ ID NO: 9176605 - DNA, 22 bp, Homo sapiens
cagaggcttcaagtcattctcc

SEQ ID NO: 9176606 - DNA, 22 bp, Homo sapiens
cagaggctgggacctcaggcat

SEQ ID NO: 9176607 - DNA, 22 bp, Homo sapiens
cagaggctgggacctcaggcat

SEQ ID NO: 9176608 - DNA, 22 bp, Homo sapiens
cagaggctggcggccgccccga

SEQ ID NO: 9176609 - DNA, 22 bp, Homo sapiens
cagaggctggatggacttgcct

SEQ ID NO: 9176610 - DNA, 22 bp, Homo sapiens
gggtcgctgccgctgctggacc

SEQ ID NO: 9176611 - DNA, 20 bp, Homo sapiens
gggtcgctctgagcccatcc

SEQ ID NO: 9176612 - DNA, 22 bp, Homo sapiens
gggtcgcttggagaggcttcct

SEQ ID NO: 9176613 - DNA, 18 bp, Homo sapiens
gggtcctgttcttggaag

SEQ ID NO: 9176614 - DNA, 22 bp, Homo sapiens
gggtgcaggggaccctagggac

SEQ ID NO: 9176615 - DNA, 22 bp, Homo sapiens
gggtgcaggggaccctagggac

SEQ ID NO: 9176616 - DNA, 22 bp, Homo sapiens
gggtgcagggtctccagcagct

SEQ ID NO: 9176617 - DNA, 22 bp, Homo sapiens
gggtgcagggtctccagcagct

SEQ ID NO: 9176618 - DNA, 22 bp, Homo sapiens
gggtgctcctggcggcctcttt

SEQ ID NO: 9176619 - DNA, 22 bp, Homo sapiens
gggtgcagtggttcacgcctgt

SEQ ID NO: 9176620 - DNA, 22 bp, Homo sapiens
cagaggctgctctgggtggcat

SEQ ID NO: 9176621 - DNA, 22 bp, Homo sapiens
caacattatatagccacatgcc

SEQ ID NO: 9176622 - DNA, 19 bp, Homo sapiens
caacagttgcaacactgtc

SEQ ID NO: 9176623 - DNA, 22 bp, Homo sapiens
caacatataatatttgagttct

SEQ ID NO: 9176624 - DNA, 22 bp, Homo sapiens
gctgcagtgagccaagatcgtg

SEQ ID NO: 9176625 - DNA, 22 bp, Homo sapiens
gctgcagtgagccaagatcgtg

SEQ ID NO: 9176626 - DNA, 22 bp, Homo sapiens
gctgcagtgagccaagatcgtg

SEQ ID NO: 9176627 - DNA, 22 bp, Homo sapiens
gctgcagtgttggacctcaggg

SEQ ID NO: 9176628 - DNA, 22 bp, Homo sapiens
gctgcagtgttggacctcaggg

SEQ ID NO: 9176629 - DNA, 21 bp, Homo sapiens
gctgcatcaatctacccaggg

SEQ ID NO: 9176630 - DNA, 21 bp, Homo sapiens
gctgccaccgcgtgctccagg

SEQ ID NO: 9176631 - DNA, 22 bp, Homo sapiens
gctgccaatccagctgtgggag

SEQ ID NO: 9176632 - DNA, 22 bp, Homo sapiens
gctgccaagggaagcgcagtgc

SEQ ID NO: 9176633 - DNA, 22 bp, Homo sapiens
caacactgacaatggactgatt

SEQ ID NO: 9176634 - DNA, 22 bp, Homo sapiens
caacactgattatggctgagct

SEQ ID NO: 9176635 - DNA, 22 bp, Homo sapiens
caacactgattatggctgagct

SEQ ID NO: 9176636 - DNA, 22 bp, Homo sapiens
caacagtgattctgcatgagga

SEQ ID NO: 9176637 - DNA, 22 bp, Homo sapiens
gctcctgaaggctctgcagggt

SEQ ID NO: 9176638 - DNA, 18 bp, Homo sapiens
gctcctggaccaggtcac

SEQ ID NO: 9176639 - DNA, 22 bp, Homo sapiens
gctcctgccctcttgcaattcc

SEQ ID NO: 9176640 - DNA, 22 bp, Homo sapiens
gctcctgcagagatgttccatg

SEQ ID NO: 9176641 - DNA, 22 bp, Homo sapiens
gctcctgcaggacccaggagac

SEQ ID NO: 9176642 - DNA, 22 bp, Homo sapiens
caaagtaatttggagatatata

SEQ ID NO: 9176643 - DNA, 22 bp, Homo sapiens
caaagtaatttggagatatata

SEQ ID NO: 9176644 - DNA, 22 bp, Homo sapiens
caaagtatatttcatagtctca

SEQ ID NO: 9176645 - DNA, 22 bp, Homo sapiens
caaagtatattggattgaatgg

SEQ ID NO: 9176646 - DNA, 22 bp, Homo sapiens
caaagtaatttggagatatata

SEQ ID NO: 9176647 - DNA, 19 bp, Homo sapiens
gctgcagcagagaaactgg

SEQ ID NO: 9176648 - DNA, 22 bp, Homo sapiens
gctgcagccaaattcattgtca

SEQ ID NO: 9176649 - DNA, 22 bp, Homo sapiens
gctgcagcagaagttctcagag

SEQ ID NO: 9176650 - DNA, 22 bp, Homo sapiens
gctgcagcagaagttctcagag

SEQ ID NO: 9176651 - DNA, 22 bp, Homo sapiens
gctgcagcaagccctccagggg

SEQ ID NO: 9176652 - DNA, 22 bp, Homo sapiens
gctgcagagggtcttagagagg

SEQ ID NO: 9176653 - DNA, 19 bp, Homo sapiens
gctgcagaggtgaagaaga

SEQ ID NO: 9176654 - DNA, 22 bp, Homo sapiens
gctgcagagtgatgaagtgggg

SEQ ID NO: 9176655 - DNA, 22 bp, Homo sapiens
gctgcagacttctcatctcatt

SEQ ID NO: 9176656 - DNA, 22 bp, Homo sapiens
gctgcagacttctcatctcatt

SEQ ID NO: 9176657 - DNA, 19 bp, Homo sapiens
gctcctggatgacctgtgg

SEQ ID NO: 9176658 - DNA, 18 bp, Homo sapiens
gctcctggagtctgactc

SEQ ID NO: 9176659 - DNA, 18 bp, Homo sapiens
gctcctggaccaggtcac

SEQ ID NO: 9176660 - DNA, 18 bp, Homo sapiens
gctcctggaccaggtcac

SEQ ID NO: 9176661 - DNA, 18 bp, Homo sapiens
gctcctggaccaggtcac

SEQ ID NO: 9176662 - DNA, 22 bp, Homo sapiens
caagatatcaatgacatagtat

SEQ ID NO: 9176663 - DNA, 22 bp, Homo sapiens
caagatcaaggtatcagcagat

SEQ ID NO: 9176664 - DNA, 22 bp, Homo sapiens
caagatcaaggtgtcagcaggt

SEQ ID NO: 9176665 - DNA, 22 bp, Homo sapiens
caagatcaagtgtagtatcaaa

SEQ ID NO: 9176666 - DNA, 22 bp, Homo sapiens
caagatgaaattgtgatatttt

SEQ ID NO: 9176667 - DNA, 22 bp, Homo sapiens
caagatgaaattgtgatatttt

SEQ ID NO: 9176668 - DNA, 22 bp, Homo sapiens
caagagcttctgctcttcatgg

SEQ ID NO: 9176669 - DNA, 22 bp, Homo sapiens
caagagctttagaaatgctcat

SEQ ID NO: 9176670 - DNA, 22 bp, Homo sapiens
caagagctgtgacctcattcac

SEQ ID NO: 9176671 - DNA, 22 bp, Homo sapiens
caagaggagcaggcaggtgtgc

SEQ ID NO: 9176672 - DNA, 22 bp, Homo sapiens
caagagcttctgctcttcatgg

SEQ ID NO: 9176673 - DNA, 22 bp, Homo sapiens
caagagctgtgacctcattcac

SEQ ID NO: 9176674 - DNA, 22 bp, Homo sapiens
caagagctgggtggcaagctag

SEQ ID NO: 9176675 - DNA, 22 bp, Homo sapiens
caagagctggagaggcagtcta

SEQ ID NO: 9176676 - DNA, 18 bp, Homo sapiens
caagagctgctcctggcc

SEQ ID NO: 9176677 - DNA, 22 bp, Homo sapiens
caagagtgaaactctgtctcaa

SEQ ID NO: 9176678 - DNA, 22 bp, Homo sapiens
caagagttgagggatgtcagtt

SEQ ID NO: 9176679 - DNA, 22 bp, Homo sapiens
caagagttgaggttcaaatggg

SEQ ID NO: 9176680 - DNA, 22 bp, Homo sapiens
caagatggagaagcagcaaggg

SEQ ID NO: 9176681 - DNA, 22 bp, Homo sapiens
caagatggagaagcagcaaggg

SEQ ID NO: 9176682 - DNA, 22 bp, Homo sapiens
caagatgtggtgggctgagttt

SEQ ID NO: 9176683 - DNA, 22 bp, Homo sapiens
caagatgttaaaaccacccttg

SEQ ID NO: 9176684 - DNA, 22 bp, Homo sapiens
caagctgccaccagaagagcat

SEQ ID NO: 9176685 - DNA, 22 bp, Homo sapiens
caagctgcttattctctgctct

SEQ ID NO: 9176686 - DNA, 22 bp, Homo sapiens
caaggacactccctgctgggca

SEQ ID NO: 9176687 - DNA, 22 bp, Homo sapiens
caaggacactgatgttcatcct

SEQ ID NO: 9176688 - DNA, 22 bp, Homo sapiens
caaggagagtaattgaatgaga

SEQ ID NO: 9176689 - DNA, 22 bp, Homo sapiens
caacctggccctagccctggga

SEQ ID NO: 9176690 - DNA, 20 bp, Homo sapiens
gctgccttggatggctacac

SEQ ID NO: 9176691 - DNA, 22 bp, Homo sapiens
gctgccttgaacttggcctggg

SEQ ID NO: 9176692 - DNA, 22 bp, Homo sapiens
gctgccttcccaggcctttgct

SEQ ID NO: 9176693 - DNA, 22 bp, Homo sapiens
gctgccttccctgttctttcag

SEQ ID NO: 9176694 - DNA, 22 bp, Homo sapiens
gctgctggagagcgagactgtt

SEQ ID NO: 9176695 - DNA, 22 bp, Homo sapiens
gctgctggagagcgagactgtt

SEQ ID NO: 9176696 - DNA, 22 bp, Homo sapiens
gctgctggagagcgagactgtt

SEQ ID NO: 9176697 - DNA, 22 bp, Homo sapiens
gctgctggagctttgcagaagg

SEQ ID NO: 9176698 - DNA, 22 bp, Homo sapiens
gctgccttttaaagcctcgctt

SEQ ID NO: 9176699 - DNA, 22 bp, Homo sapiens
gctgctggcactggagtgagcc

SEQ ID NO: 9176700 - DNA, 22 bp, Homo sapiens
gctgctggagctttgcagaagg

SEQ ID NO: 9176701 - DNA, 22 bp, Homo sapiens
gctgctggagctttgcagaagg

SEQ ID NO: 9176702 - DNA, 22 bp, Homo sapiens
gctgctggagctttgcagaagg

SEQ ID NO: 9176703 - DNA, 22 bp, Homo sapiens
caagagctcaccggagagcatt

SEQ ID NO: 9176704 - DNA, 22 bp, Homo sapiens
caagagctcagaaacccttgct

SEQ ID NO: 9176705 - DNA, 22 bp, Homo sapiens
caagagctcccagacctgggca

SEQ ID NO: 9176706 - DNA, 22 bp, Homo sapiens
caagagctctccactaggttgg

SEQ ID NO: 9176707 - DNA, 22 bp, Homo sapiens
caagagctgaggctggagaggt

SEQ ID NO: 9176708 - DNA, 22 bp, Homo sapiens
caagagctgcaaatagcgtgac

SEQ ID NO: 9176709 - DNA, 22 bp, Homo sapiens
gctgctggccccacatgctcca

SEQ ID NO: 9176710 - DNA, 22 bp, Homo sapiens
gctgctggcatctagggggtgg

SEQ ID NO: 9176711 - DNA, 22 bp, Homo sapiens
gctgctggcatctagggggtgg

SEQ ID NO: 9176712 - DNA, 22 bp, Homo sapiens
gcttctgaggaaggctcagcct

SEQ ID NO: 9176713 - DNA, 22 bp, Homo sapiens
gcttggccagcagccgggatgc

SEQ ID NO: 9176714 - DNA, 22 bp, Homo sapiens
gcttggcattgaccattatcat

SEQ ID NO: 9176715 - DNA, 22 bp, Homo sapiens
gcttggccagcagccgggatgc

SEQ ID NO: 9176716 - DNA, 22 bp, Homo sapiens
gcttggccagcagccgggatgc

SEQ ID NO: 9176717 - DNA, 22 bp, Homo sapiens
gcttggctcctggctcacaggt

SEQ ID NO: 9176718 - DNA, 22 bp, Homo sapiens
gcttggcttgggctcagaggcc

SEQ ID NO: 9176719 - DNA, 22 bp, Homo sapiens
cacaaaagtaggaggcaggcgg

SEQ ID NO: 9176720 - DNA, 22 bp, Homo sapiens
gctgtggcctccagcactcccc

SEQ ID NO: 9176721 - DNA, 22 bp, Homo sapiens
gctgtggcccttggcatctgcg

SEQ ID NO: 9176722 - DNA, 22 bp, Homo sapiens
gctgtggcccttggcatctgcg

SEQ ID NO: 9176723 - DNA, 22 bp, Homo sapiens
gctgtggccgggcccaggccgc

SEQ ID NO: 9176724 - DNA, 22 bp, Homo sapiens
gcttccaggggctgtgggctga

SEQ ID NO: 9176725 - DNA, 22 bp, Homo sapiens
gcttccagggtgggggatgttt

SEQ ID NO: 9176726 - DNA, 22 bp, Homo sapiens
gcttccaggtcattctcaccct

SEQ ID NO: 9176727 - DNA, 22 bp, Homo sapiens
gcttctctcaggagcatcagcc

SEQ ID NO: 9176728 - DNA, 22 bp, Homo sapiens
gcttctctggcctgcagggcat

SEQ ID NO: 9176729 - DNA, 22 bp, Homo sapiens
gcttctcttaatgcctggcttt

SEQ ID NO: 9176730 - DNA, 22 bp, Homo sapiens
gcttctcctcccgctcccaggc

SEQ ID NO: 9176731 - DNA, 22 bp, Homo sapiens
gcttctcctcccgctcccaggc

SEQ ID NO: 9176732 - DNA, 22 bp, Homo sapiens
gcttctcctcccgctcccaggc

SEQ ID NO: 9176733 - DNA, 22 bp, Homo sapiens
gcttctccagaccttcatcccc

SEQ ID NO: 9176734 - DNA, 22 bp, Homo sapiens
gcttctccctacagatgtcagt

SEQ ID NO: 9176735 - DNA, 15 bp, Homo sapiens
gcttctccagatgac

SEQ ID NO: 9176736 - DNA, 20 bp, Homo sapiens
gctgtggcaaagctttgtgt

SEQ ID NO: 9176737 - DNA, 22 bp, Homo sapiens
gctgtggagtacagagctggtt

SEQ ID NO: 9176738 - DNA, 22 bp, Homo sapiens
gctgtggagtacagagctggtt

SEQ ID NO: 9176739 - DNA, 22 bp, Homo sapiens
gctgtggatgctatggatcatc

SEQ ID NO: 9176740 - DNA, 20 bp, Homo sapiens
gctgtggcaagtgctcactg

SEQ ID NO: 9176741 - DNA, 22 bp, Homo sapiens
gctgtgctggaaggggacctgc

SEQ ID NO: 9176742 - DNA, 22 bp, Homo sapiens
gctgtgcttgggaagaatctct

SEQ ID NO: 9176743 - DNA, 19 bp, Homo sapiens
gctgtctgatgctgaggtc

SEQ ID NO: 9176744 - DNA, 22 bp, Homo sapiens
gctgtctgagaacatggtggaa

SEQ ID NO: 9176745 - DNA, 21 bp, Homo sapiens
gctgtctctggctcctgggaa

SEQ ID NO: 9176746 - DNA, 21 bp, Homo sapiens
gctgtctctggctcctgggaa

SEQ ID NO: 9176747 - DNA, 22 bp, Homo sapiens
gctgtctctcccaggatccatg

SEQ ID NO: 9176748 - DNA, 22 bp, Homo sapiens
gctgtctcgcctgacactggct

SEQ ID NO: 9176749 - DNA, 22 bp, Homo sapiens
gctgtctcggggctttctcctg

SEQ ID NO: 9176750 - DNA, 22 bp, Homo sapiens
gctgtctcggggctttctcctg

SEQ ID NO: 9176751 - DNA, 20 bp, Homo sapiens
caaggcagaccagagtgagt

SEQ ID NO: 9176752 - DNA, 22 bp, Homo sapiens
gctgtctcatgggtgctagtcc

SEQ ID NO: 9176753 - DNA, 22 bp, Homo sapiens
gctgtctcatgggtgctagtcc

SEQ ID NO: 9176754 - DNA, 22 bp, Homo sapiens
gctgtctccccgcacccgaccg

SEQ ID NO: 9176755 - DNA, 21 bp, Homo sapiens
gctgtctcctccttgcaccag

SEQ ID NO: 9176756 - DNA, 22 bp, Homo sapiens
gctgtctcgcctgacactggct

SEQ ID NO: 9176757 - DNA, 21 bp, Homo sapiens
gctgtctcctccttgcaccag

SEQ ID NO: 9176758 - DNA, 22 bp, Homo sapiens
gctgtctccatagctgtgtgtc

SEQ ID NO: 9176759 - DNA, 22 bp, Homo sapiens
gctgtctccccgcacccgaccg

SEQ ID NO: 9176760 - DNA, 22 bp, Homo sapiens
caaggcagctattgtctccata

SEQ ID NO: 9176761 - DNA, 22 bp, Homo sapiens
caaggcagctattgtctccata

SEQ ID NO: 9176762 - DNA, 22 bp, Homo sapiens
cacaccagaggttacctgcaaa

SEQ ID NO: 9176763 - DNA, 22 bp, Homo sapiens
cacacatttcagatgctacaat

SEQ ID NO: 9176764 - DNA, 22 bp, Homo sapiens
cacacccaaattctaacagtag

SEQ ID NO: 9176765 - DNA, 22 bp, Homo sapiens
cacaccatatgattccatttag

SEQ ID NO: 9176766 - DNA, 19 bp, Homo sapiens
cacacccatgcttgccaag

SEQ ID NO: 9176767 - DNA, 22 bp, Homo sapiens
cacacctgtaataccagctact

SEQ ID NO: 9176768 - DNA, 22 bp, Homo sapiens
cacacctgtaatcctagcactt

SEQ ID NO: 9176769 - DNA, 22 bp, Homo sapiens
cacacctgcctgccgtgtgctg

SEQ ID NO: 9176770 - DNA, 22 bp, Homo sapiens
cacacctgtgagtctcggcttg

SEQ ID NO: 9176771 - DNA, 23 bp, Homo sapiens
cacacctgttaagaagagtgcct

SEQ ID NO: 9176772 - DNA, 22 bp, Homo sapiens
cacactaatttttcaagagttt

SEQ ID NO: 9176773 - DNA, 22 bp, Homo sapiens
cacaatttgtattttgcatcca

SEQ ID NO: 9176774 - DNA, 22 bp, Homo sapiens
cacaatttccttgcttcacttt

SEQ ID NO: 9176775 - DNA, 22 bp, Homo sapiens
cacaatttggtgctaaagaaag

SEQ ID NO: 9176776 - DNA, 19 bp, Homo sapiens
cacaattatgagacactta

SEQ ID NO: 9176777 - DNA, 22 bp, Homo sapiens
cacaattatagaagaaagcata

SEQ ID NO: 9176778 - DNA, 22 bp, Homo sapiens
cacaatttcagttgcatgcaac

SEQ ID NO: 9176779 - DNA, 22 bp, Homo sapiens
cacaaaatctttctcgattatt

SEQ ID NO: 9176780 - DNA, 22 bp, Homo sapiens
cacaaaatatcaagcactttta

SEQ ID NO: 9176781 - DNA, 22 bp, Homo sapiens
cacaaaggagaatgtcagcata

SEQ ID NO: 9176782 - DNA, 22 bp, Homo sapiens
cacaaagccctccctgcgccag

SEQ ID NO: 9176783 - DNA, 23 bp, Homo sapiens
cacaaaggttccattctctcacc

SEQ ID NO: 9176784 - DNA, 22 bp, Homo sapiens
cacaaagtgttagatgccactc

SEQ ID NO: 9176785 - DNA, 22 bp, Homo sapiens
ggaaaagaattgcagtgaagta

SEQ ID NO: 9176786 - DNA, 17 bp, Homo sapiens
ggaaaagaagagtagga

SEQ ID NO: 9176787 - DNA, 22 bp, Homo sapiens
cacaactttaggaaccacattc

SEQ ID NO: 9176788 - DNA, 22 bp, Homo sapiens
ggaaaatactgattcatgccat

SEQ ID NO: 9176789 - DNA, 22 bp, Homo sapiens
ggaaaatactgattcatgccat

SEQ ID NO: 9176790 - DNA, 22 bp, Homo sapiens
ggaaaagacaggttaactgtga

SEQ ID NO: 9176791 - DNA, 22 bp, Homo sapiens
ggaaaagacaggttaactgtga

SEQ ID NO: 9176792 - DNA, 17 bp, Homo sapiens
ggaaaaggatgatacag

SEQ ID NO: 9176793 - DNA, 17 bp, Homo sapiens
ggaaaaggatgatacag

SEQ ID NO: 9176794 - DNA, 22 bp, Homo sapiens
cacaatgtatatgtatatcaaa

SEQ ID NO: 9176795 - DNA, 22 bp, Homo sapiens
ggcacagggagccgcagttgca

SEQ ID NO: 9176796 - DNA, 22 bp, Homo sapiens
ggcacaggagtcacagcatttc

SEQ ID NO: 9176797 - DNA, 22 bp, Homo sapiens
ggcacacaaaggcagcatttga

SEQ ID NO: 9176798 - DNA, 22 bp, Homo sapiens
ggcacaggagctagtcaaagcc

SEQ ID NO: 9176799 - DNA, 22 bp, Homo sapiens
cacagggcagagacctgggtgc

SEQ ID NO: 9176800 - DNA, 22 bp, Homo sapiens
cacagggcagagggtccgtggc

SEQ ID NO: 9176801 - DNA, 22 bp, Homo sapiens
ggcacaagtttgatgtgagtta

SEQ ID NO: 9176802 - DNA, 22 bp, Homo sapiens
ggcacagggggctgaggactag

SEQ ID NO: 9176803 - DNA, 22 bp, Homo sapiens
ggcacagggggctgaggactag

SEQ ID NO: 9176804 - DNA, 22 bp, Homo sapiens
ggcacagggtgatgttgcagtt

SEQ ID NO: 9176805 - DNA, 22 bp, Homo sapiens
ggcacagttttctacatatgct

SEQ ID NO: 9176806 - DNA, 22 bp, Homo sapiens
ggcacagggggctgaggactag

SEQ ID NO: 9176807 - DNA, 22 bp, Homo sapiens
ggcacagggggctgaggactag

SEQ ID NO: 9176808 - DNA, 22 bp, Homo sapiens
ggcacagggggctgaggactag

SEQ ID NO: 9176809 - DNA, 22 bp, Homo sapiens
ggcactgcttcctgagcctgag

SEQ ID NO: 9176810 - DNA, 22 bp, Homo sapiens
ggcactgctgtaggcagtgagg

SEQ ID NO: 9176811 - DNA, 20 bp, Homo sapiens
ggcacagtttttgcacctgc

SEQ ID NO: 9176812 - DNA, 22 bp, Homo sapiens
ggcactggcctggggccaagag

SEQ ID NO: 9176813 - DNA, 22 bp, Homo sapiens
ggcactggaaggatcatgtgag

SEQ ID NO: 9176814 - DNA, 22 bp, Homo sapiens
ggcactggaaggatcatgtgag

SEQ ID NO: 9176815 - DNA, 22 bp, Homo sapiens
ggcagagagttctccacctctc

SEQ ID NO: 9176816 - DNA, 22 bp, Homo sapiens
ggcagagatgtgggtcagaatc

SEQ ID NO: 9176817 - DNA, 22 bp, Homo sapiens
ggcagagccttctggagctcgc

SEQ ID NO: 9176818 - DNA, 22 bp, Homo sapiens
ggcagagcattcgatggacctg

SEQ ID NO: 9176819 - DNA, 22 bp, Homo sapiens
ggcactgggagaggtgagacgg

SEQ ID NO: 9176820 - DNA, 22 bp, Homo sapiens
ggcactgggcaccggctgaggg

SEQ ID NO: 9176821 - DNA, 22 bp, Homo sapiens
ggcactgggagaggtgagacgg

SEQ ID NO: 9176822 - DNA, 22 bp, Homo sapiens
ggcagcagtggctgctattgtc

SEQ ID NO: 9176823 - DNA, 22 bp, Homo sapiens
ggcagcagttacaaatgtgcag

SEQ ID NO: 9176824 - DNA, 22 bp, Homo sapiens
ggcagcagttacaaatgtgcag

SEQ ID NO: 9176825 - DNA, 22 bp, Homo sapiens
ggcagatggaaggacagacgga

SEQ ID NO: 9176826 - DNA, 22 bp, Homo sapiens
ggcagcatctctggcagcagct

SEQ ID NO: 9176827 - DNA, 22 bp, Homo sapiens
ggcagcatctctggcagcagct

SEQ ID NO: 9176828 - DNA, 22 bp, Homo sapiens
ggcagcatccgcccggcaccct

SEQ ID NO: 9176829 - DNA, 22 bp, Homo sapiens
ggcagcatccgcccggcaccct

SEQ ID NO: 9176830 - DNA, 22 bp, Homo sapiens
ggcagcatcccatggaccgcat

SEQ ID NO: 9176831 - DNA, 22 bp, Homo sapiens
ggcagcatctcatatcttcagg

SEQ ID NO: 9176832 - DNA, 22 bp, Homo sapiens
ggcagcatatattcagtgggca

SEQ ID NO: 9176833 - DNA, 22 bp, Homo sapiens
ggcagcatcacttgtctccagc

SEQ ID NO: 9176834 - DNA, 22 bp, Homo sapiens
ggcagcagttacaaatgtgcag

SEQ ID NO: 9176835 - DNA, 20 bp, Homo sapiens
ggcagccaatcagcgtgccg

SEQ ID NO: 9176836 - DNA, 20 bp, Homo sapiens
ggcagccaatcagcgtgccg

SEQ ID NO: 9176837 - DNA, 22 bp, Homo sapiens
ggcagccaccctgggaggcaga

SEQ ID NO: 9176838 - DNA, 22 bp, Homo sapiens
ggcagcatgggtgcctttgtga

SEQ ID NO: 9176839 - DNA, 22 bp, Homo sapiens
ggcagcatgtgtggtccgctgg

SEQ ID NO: 9176840 - DNA, 22 bp, Homo sapiens
ggcagcatgggtgcctttgtga

SEQ ID NO: 9176841 - DNA, 22 bp, Homo sapiens
ggcagcatttagagcacagtgt

SEQ ID NO: 9176842 - DNA, 22 bp, Homo sapiens
ggcagagctagtggcttctctt

SEQ ID NO: 9176843 - DNA, 22 bp, Homo sapiens
ggcagagctagtggcttctctt

SEQ ID NO: 9176844 - DNA, 20 bp, Homo sapiens
ggcagagctatgtctgttgc

SEQ ID NO: 9176845 - DNA, 19 bp, Homo sapiens
ggcagagctcctgctttct

SEQ ID NO: 9176846 - DNA, 19 bp, Homo sapiens
ggcagagctcctgctttct

SEQ ID NO: 9176847 - DNA, 22 bp, Homo sapiens
ggcagagctgcatgagcactca

SEQ ID NO: 9176848 - DNA, 22 bp, Homo sapiens
ggcagagctctggactgagaac

SEQ ID NO: 9176849 - DNA, 22 bp, Homo sapiens
ggcagagctctggactgagaac

SEQ ID NO: 9176850 - DNA, 17 bp, Homo sapiens
ggcagagctgacagggc

SEQ ID NO: 9176851 - DNA, 21 bp, Homo sapiens
ggcagagctggggcctccagc

SEQ ID NO: 9176852 - DNA, 22 bp, Homo sapiens
ggatgttctggggttctcttgt

SEQ ID NO: 9176853 - DNA, 22 bp, Homo sapiens
cacagggaggcagccatgctcc

SEQ ID NO: 9176854 - DNA, 22 bp, Homo sapiens
cacagggaggcggtcactggct

SEQ ID NO: 9176855 - DNA, 22 bp, Homo sapiens
cacagggagttacagaagcact

SEQ ID NO: 9176856 - DNA, 22 bp, Homo sapiens
cacagggagttacagaagcact

SEQ ID NO: 9176857 - DNA, 22 bp, Homo sapiens
cacagggcaccagttggccatc

SEQ ID NO: 9176858 - DNA, 22 bp, Homo sapiens
ggatgttctggggttctcttgt

SEQ ID NO: 9176859 - DNA, 18 bp, Homo sapiens
ggatgtgaaccagagata

SEQ ID NO: 9176860 - DNA, 22 bp, Homo sapiens
ggatgtctttactttgggattt

SEQ ID NO: 9176861 - DNA, 22 bp, Homo sapiens
ggatgtctcccagcaccaaagt

SEQ ID NO: 9176862 - DNA, 22 bp, Homo sapiens
ggatgtctagggtttatgtgcc

SEQ ID NO: 9176863 - DNA, 22 bp, Homo sapiens
ggatgtctggtctatttcaagt

SEQ ID NO: 9176864 - DNA, 22 bp, Homo sapiens
ggatgtctgtcattatgctttc

SEQ ID NO: 9176865 - DNA, 22 bp, Homo sapiens
ggatgggttccgtgggcaaatg

SEQ ID NO: 9176866 - DNA, 22 bp, Homo sapiens
ggatggtcagaggaccaaatac

SEQ ID NO: 9176867 - DNA, 22 bp, Homo sapiens
ggatgggtgactttgggcaatg

SEQ ID NO: 9176868 - DNA, 22 bp, Homo sapiens
ggatgtaactttcctagtccat

SEQ ID NO: 9176869 - DNA, 22 bp, Homo sapiens
ggatgggaacttggtagggcat

SEQ ID NO: 9176870 - DNA, 22 bp, Homo sapiens
ggatctgggctctgccaatcag

SEQ ID NO: 9176871 - DNA, 22 bp, Homo sapiens
ggatctgagagcaagcaggacc

SEQ ID NO: 9176872 - DNA, 22 bp, Homo sapiens
ggatgggcagacaggacggcac

SEQ ID NO: 9176873 - DNA, 22 bp, Homo sapiens
ggatgggagcagaggacgacca

SEQ ID NO: 9176874 - DNA, 22 bp, Homo sapiens
ggagggagtttcattcctgccc

SEQ ID NO: 9176875 - DNA, 22 bp, Homo sapiens
ggatcctgatatgtgtttctca

SEQ ID NO: 9176876 - DNA, 22 bp, Homo sapiens
ggagggagtcagctgattagaa

SEQ ID NO: 9176877 - DNA, 22 bp, Homo sapiens
ggagggagtcagctgattagaa

SEQ ID NO: 9176878 - DNA, 22 bp, Homo sapiens
ggagggagcatccccttgctga

SEQ ID NO: 9176879 - DNA, 22 bp, Homo sapiens
ggagggagcatccccttgctga

SEQ ID NO: 9176880 - DNA, 22 bp, Homo sapiens
ggaggcggaggctgcagtgagc

SEQ ID NO: 9176881 - DNA, 22 bp, Homo sapiens
ggaggcggaggctgcagtgagc

SEQ ID NO: 9176882 - DNA, 22 bp, Homo sapiens
cacagctggtgacagagcccag

SEQ ID NO: 9176883 - DNA, 22 bp, Homo sapiens
cacactgtcaggtaaataacac

SEQ ID NO: 9176884 - DNA, 22 bp, Homo sapiens
cacagcttcagtttctgacttg

SEQ ID NO: 9176885 - DNA, 22 bp, Homo sapiens
cacagcttcccaaagtggacct

SEQ ID NO: 9176886 - DNA, 22 bp, Homo sapiens
cacagcttcccaaagtggacct

SEQ ID NO: 9176887 - DNA, 22 bp, Homo sapiens
cacagcttccattagaatgaga

SEQ ID NO: 9176888 - DNA, 22 bp, Homo sapiens
cacagctgtcagctgacctagg

SEQ ID NO: 9176889 - DNA, 22 bp, Homo sapiens
cacagctgtgagaagggagcct

SEQ ID NO: 9176890 - DNA, 22 bp, Homo sapiens
cacagctgttttctccaggcag

SEQ ID NO: 9176891 - DNA, 22 bp, Homo sapiens
cacagctgtgagaagggagcct

SEQ ID NO: 9176892 - DNA, 22 bp, Homo sapiens
ggaggccaaggcaggtggatcg

SEQ ID NO: 9176893 - DNA, 22 bp, Homo sapiens
ggaggccttgcctgcaggcaca

SEQ ID NO: 9176894 - DNA, 22 bp, Homo sapiens
ggaggccaaggcgggcggatca

SEQ ID NO: 9176895 - DNA, 22 bp, Homo sapiens
cacagcttctccttgatatcgc

SEQ ID NO: 9176896 - DNA, 22 bp, Homo sapiens
cacagcttctgtctgacccatg

SEQ ID NO: 9176897 - DNA, 22 bp, Homo sapiens
cacagcttctccccgctgcggc

SEQ ID NO: 9176898 - DNA, 22 bp, Homo sapiens
cacagcttctccccgctgcggc

SEQ ID NO: 9176899 - DNA, 22 bp, Homo sapiens
cacagcttcccaaagtggacct

SEQ ID NO: 9176900 - DNA, 22 bp, Homo sapiens
cacagcttctccccgctgcggc

SEQ ID NO: 9176901 - DNA, 22 bp, Homo sapiens
ggaggcggaagttgcagtgagc

SEQ ID NO: 9176902 - DNA, 22 bp, Homo sapiens
ggaggcggaagttgcagtgagc

SEQ ID NO: 9176903 - DNA, 22 bp, Homo sapiens
ggaggcggagcttgcagtgagc

SEQ ID NO: 9176904 - DNA, 22 bp, Homo sapiens
ggaggcggagcttgcagtgagc

SEQ ID NO: 9176905 - DNA, 22 bp, Homo sapiens
ggaggcggacacaggtagtgtt

SEQ ID NO: 9176906 - DNA, 22 bp, Homo sapiens
ggaggcggacacaggtagtgtt

SEQ ID NO: 9176907 - DNA, 22 bp, Homo sapiens
cactgacagtatcagagctgtt

SEQ ID NO: 9176908 - DNA, 22 bp, Homo sapiens
cactgaatttaacttgtatccc

SEQ ID NO: 9176909 - DNA, 22 bp, Homo sapiens
cactgaatctcaaggggagggt

SEQ ID NO: 9176910 - DNA, 22 bp, Homo sapiens
cactgactccaaaaataaagaa

SEQ ID NO: 9176911 - DNA, 22 bp, Homo sapiens
ggcctcctcaccctgctcaggc

SEQ ID NO: 9176912 - DNA, 22 bp, Homo sapiens
ggcctcctcaccctgctcaggc

SEQ ID NO: 9176913 - DNA, 22 bp, Homo sapiens
ggcctcctcaccctgctcaggc

SEQ ID NO: 9176914 - DNA, 22 bp, Homo sapiens
ggcctcctgttggctagtgtga

SEQ ID NO: 9176915 - DNA, 23 bp, Homo sapiens
ggcctcctggtctaggctagact

SEQ ID NO: 9176916 - DNA, 22 bp, Homo sapiens
ggcctcctgttggctagtgtga

SEQ ID NO: 9176917 - DNA, 22 bp, Homo sapiens
ggcctcgcggcttctggtggct

SEQ ID NO: 9176918 - DNA, 21 bp, Homo sapiens
cactgaggaggaaaaggagct

SEQ ID NO: 9176919 - DNA, 22 bp, Homo sapiens
cactgaggagagaggtaactag

SEQ ID NO: 9176920 - DNA, 22 bp, Homo sapiens
cactgaggactcccacgtaggt

SEQ ID NO: 9176921 - DNA, 22 bp, Homo sapiens
cactgagccaggagcaatatca

SEQ ID NO: 9176922 - DNA, 22 bp, Homo sapiens
cactgagcagtggtgaaaatct

SEQ ID NO: 9176923 - DNA, 17 bp, Homo sapiens
cactgagaggtttgaga

SEQ ID NO: 9176924 - DNA, 22 bp, Homo sapiens
ggcctcgcggcttctggtggct

SEQ ID NO: 9176925 - DNA, 22 bp, Homo sapiens
ggcctcgcggcttctggtggct

SEQ ID NO: 9176926 - DNA, 22 bp, Homo sapiens
ggcctctctagcatccagcctg

SEQ ID NO: 9176927 - DNA, 22 bp, Homo sapiens
cactgcactccagcttgggtga

SEQ ID NO: 9176928 - DNA, 22 bp, Homo sapiens
cactgcactccagcttgggtga

SEQ ID NO: 9176929 - DNA, 21 bp, Homo sapiens
cactgcagccttgacctgggc

SEQ ID NO: 9176930 - DNA, 22 bp, Homo sapiens
cactgcagcctcgctctcctga

SEQ ID NO: 9176931 - DNA, 21 bp, Homo sapiens
cactgcagccttgacctgggc

SEQ ID NO: 9176932 - DNA, 22 bp, Homo sapiens
cactgcagcctctgcctctcag

SEQ ID NO: 9176933 - DNA, 22 bp, Homo sapiens
cactgcaggtctgagatggggg

SEQ ID NO: 9176934 - DNA, 22 bp, Homo sapiens
cactgcagtaactctaggactg

SEQ ID NO: 9176935 - DNA, 23 bp, Homo sapiens
cactgcagcgtggtctggcagga

SEQ ID NO: 9176936 - DNA, 23 bp, Homo sapiens
cactgcagcgtggtctggcagga

SEQ ID NO: 9176937 - DNA, 22 bp, Homo sapiens
cactgcactccatcctgggaaa

SEQ ID NO: 9176938 - DNA, 22 bp, Homo sapiens
cactgcagatcagaggctgaga

SEQ ID NO: 9176939 - DNA, 22 bp, Homo sapiens
cactgcagatcagaggctgaga

SEQ ID NO: 9176940 - DNA, 22 bp, Homo sapiens
cactgcagcaccatgcagggct

SEQ ID NO: 9176941 - DNA, 22 bp, Homo sapiens
cactgcagccacatagatgacg

SEQ ID NO: 9176942 - DNA, 22 bp, Homo sapiens
cactgcagccacatagatgacg

SEQ ID NO: 9176943 - DNA, 22 bp, Homo sapiens
cactgcagcaccatgcagggct

SEQ ID NO: 9176944 - DNA, 22 bp, Homo sapiens
ggctagggagacagagggcatg

SEQ ID NO: 9176945 - DNA, 22 bp, Homo sapiens
ggctagggagacagagggcatg

SEQ ID NO: 9176946 - DNA, 22 bp, Homo sapiens
cactgcccaactgttttccaaa

SEQ ID NO: 9176947 - DNA, 22 bp, Homo sapiens
cactgcccaccaagtggctggt

SEQ ID NO: 9176948 - DNA, 22 bp, Homo sapiens
cactgcccactccttcgtccaa

SEQ ID NO: 9176949 - DNA, 21 bp, Homo sapiens
cactgcagccttgacctgggc

SEQ ID NO: 9176950 - DNA, 22 bp, Homo sapiens
cactgcagtaactctaggactg

SEQ ID NO: 9176951 - DNA, 22 bp, Homo sapiens
cactgcagtaactctaggactg

SEQ ID NO: 9176952 - DNA, 22 bp, Homo sapiens
cactgcagtaactctaggactg

SEQ ID NO: 9176953 - DNA, 21 bp, Homo sapiens
cactgcattaagtctgtaggt

SEQ ID NO: 9176954 - DNA, 22 bp, Homo sapiens
cactgcatggctgtgaggcagc

SEQ ID NO: 9176955 - DNA, 22 bp, Homo sapiens
cactgcagttccccagtgcgca

SEQ ID NO: 9176956 - DNA, 22 bp, Homo sapiens
cactgcagtaactctaggactg

SEQ ID NO: 9176957 - DNA, 22 bp, Homo sapiens
cactgcagttccccagtgcgca

SEQ ID NO: 9176958 - DNA, 22 bp, Homo sapiens
ggctagggatctagaccaggac

SEQ ID NO: 9176959 - DNA, 22 bp, Homo sapiens
ggctatgggaagatggcagggg

SEQ ID NO: 9176960 - DNA, 22 bp, Homo sapiens
ggctatggaaatggcaggacat

SEQ ID NO: 9176961 - DNA, 22 bp, Homo sapiens
cactggaatggatagagcagag

SEQ ID NO: 9176962 - DNA, 22 bp, Homo sapiens
cactggaatggatagagcagag

SEQ ID NO: 9176963 - DNA, 22 bp, Homo sapiens
cactggaatagcattgattctt

SEQ ID NO: 9176964 - DNA, 20 bp, Homo sapiens
cactggaaagcaggcgactc

SEQ ID NO: 9176965 - DNA, 22 bp, Homo sapiens
cactggaaccaagacccagggc

SEQ ID NO: 9176966 - DNA, 22 bp, Homo sapiens
cactgcttttttggctatgtac

SEQ ID NO: 9176967 - DNA, 22 bp, Homo sapiens
cactggaagagcatctgagcca

SEQ ID NO: 9176968 - DNA, 22 bp, Homo sapiens
cactggaagagcatctgagcca

SEQ ID NO: 9176969 - DNA, 22 bp, Homo sapiens
cactggaaccatccacatagtg

SEQ ID NO: 9176970 - DNA, 22 bp, Homo sapiens
cactgctttaaggctgagtaac

SEQ ID NO: 9176971 - DNA, 21 bp, Homo sapiens
cactggaattttctgtgacat

SEQ ID NO: 9176972 - DNA, 22 bp, Homo sapiens
cactggaatgttgaggagacaa

SEQ ID NO: 9176973 - DNA, 22 bp, Homo sapiens
cactggaatgttgaggagacaa

SEQ ID NO: 9176974 - DNA, 20 bp, Homo sapiens
cactggacctctctgagcct

SEQ ID NO: 9176975 - DNA, 18 bp, Homo sapiens
cactggacctcatgagag

SEQ ID NO: 9176976 - DNA, 22 bp, Homo sapiens
cactggacttaaggcagagttt

SEQ ID NO: 9176977 - DNA, 22 bp, Homo sapiens
cactggacctgctttgatcctg

SEQ ID NO: 9176978 - DNA, 22 bp, Homo sapiens
cactggacttggagtcagaagg

SEQ ID NO: 9176979 - DNA, 22 bp, Homo sapiens
cactggaggtcagtggagcact

SEQ ID NO: 9176980 - DNA, 22 bp, Homo sapiens
cactggaggtcagtggagcact

SEQ ID NO: 9176981 - DNA, 22 bp, Homo sapiens
cactggaggtcagtggagcact

SEQ ID NO: 9176982 - DNA, 22 bp, Homo sapiens
cactggataaaaatttggaagt

SEQ ID NO: 9176983 - DNA, 22 bp, Homo sapiens
cactggataaaaatttggaagt

SEQ ID NO: 9176984 - DNA, 22 bp, Homo sapiens
cactggatttccaggaatactc

SEQ ID NO: 9176985 - DNA, 17 bp, Homo sapiens
cactggattcgcagagc

SEQ ID NO: 9176986 - DNA, 17 bp, Homo sapiens
cactggattcgcagagc

SEQ ID NO: 9176987 - DNA, 22 bp, Homo sapiens
cactggcaaatggagagaatgt

SEQ ID NO: 9176988 - DNA, 22 bp, Homo sapiens
cactggcattagtcacgaggca

SEQ ID NO: 9176989 - DNA, 22 bp, Homo sapiens
ggcatacaagagaaatataaga

SEQ ID NO: 9176990 - DNA, 22 bp, Homo sapiens
ggcagttttaacagaggtagta

SEQ ID NO: 9176991 - DNA, 22 bp, Homo sapiens
ggcatagatttctttaggttta

SEQ ID NO: 9176992 - DNA, 22 bp, Homo sapiens
ggcatagaatgtgctgtgacaa

SEQ ID NO: 9176993 - DNA, 22 bp, Homo sapiens
ggcatagatgcaggcaaagtgg

SEQ ID NO: 9176994 - DNA, 22 bp, Homo sapiens
ggcagtttggcaggatggaggg

SEQ ID NO: 9176995 - DNA, 22 bp, Homo sapiens
ggcagtttctcaggcaggggta

SEQ ID NO: 9176996 - DNA, 22 bp, Homo sapiens
ggcagtttcatcaggagaaaag

SEQ ID NO: 9176997 - DNA, 22 bp, Homo sapiens
ggcatagcggctcagcgtccag

SEQ ID NO: 9176998 - DNA, 22 bp, Homo sapiens
ggcatatgtagcgtgtgttctg

SEQ ID NO: 9176999 - DNA, 22 bp, Homo sapiens
ggcatcagaggtgtgttctgct

SEQ ID NO: 9177000 - DNA, 22 bp, Homo sapiens
ggcatcagaggtgtgttctgct

SEQ ID NO: 9177001 - DNA, 22 bp, Homo sapiens
caccccagtctaaaaccagcct

SEQ ID NO: 9177002 - DNA, 22 bp, Homo sapiens
caccctcaagcagtggcacgtg

SEQ ID NO: 9177003 - DNA, 22 bp, Homo sapiens
caccccttccgccactgccttc

SEQ ID NO: 9177004 - DNA, 22 bp, Homo sapiens
cacccctgggctgggcacacag

SEQ ID NO: 9177005 - DNA, 18 bp, Homo sapiens
caccctccgcggctgccc

SEQ ID NO: 9177006 - DNA, 22 bp, Homo sapiens
caccctgcccactagcaatctg

SEQ ID NO: 9177007 - DNA, 22 bp, Homo sapiens
caccctgaggccacccagacct

SEQ ID NO: 9177008 - DNA, 22 bp, Homo sapiens
caccctgctacaaagcctcctg

SEQ ID NO: 9177009 - DNA, 22 bp, Homo sapiens
caccctgctacaaagcctcctg

SEQ ID NO: 9177010 - DNA, 22 bp, Homo sapiens
cactctgagaagtacaagctcc

SEQ ID NO: 9177011 - DNA, 22 bp, Homo sapiens
ggcagttgctgtggatgaggtt

SEQ ID NO: 9177012 - DNA, 22 bp, Homo sapiens
ggcagttgcgtgcatcagtggt

SEQ ID NO: 9177013 - DNA, 22 bp, Homo sapiens
ggcagtgtgcatctgtgtggcc

SEQ ID NO: 9177014 - DNA, 22 bp, Homo sapiens
ggcagtgtccagcttcctggag

SEQ ID NO: 9177015 - DNA, 22 bp, Homo sapiens
ggcagtgtcaaaataggcagaa

SEQ ID NO: 9177016 - DNA, 22 bp, Homo sapiens
ggcagtgtcaaaataggcagaa

SEQ ID NO: 9177017 - DNA, 22 bp, Homo sapiens
cacccacattccatcactctgc

SEQ ID NO: 9177018 - DNA, 22 bp, Homo sapiens
cacccacatggaaattcacagt

SEQ ID NO: 9177019 - DNA, 22 bp, Homo sapiens
cacccacccagaagatcctggc

SEQ ID NO: 9177020 - DNA, 22 bp, Homo sapiens
cacccacccactgctcattggc

SEQ ID NO: 9177021 - DNA, 22 bp, Homo sapiens
caccattgttgttactgggaga

SEQ ID NO: 9177022 - DNA, 22 bp, Homo sapiens
caccatgtattcagtttggcac

SEQ ID NO: 9177023 - DNA, 22 bp, Homo sapiens
caccatctagcatttatttgga

SEQ ID NO: 9177024 - DNA, 22 bp, Homo sapiens
caccatctatagaggtatttgg

SEQ ID NO: 9177025 - DNA, 22 bp, Homo sapiens
caccatgactggttgagagagg

SEQ ID NO: 9177026 - DNA, 22 bp, Homo sapiens
caccatctggtaggcattagtg

SEQ ID NO: 9177027 - DNA, 22 bp, Homo sapiens
ggcagctgattagcatcaagga

SEQ ID NO: 9177028 - DNA, 22 bp, Homo sapiens
ggcagctgattagcatcaagga

SEQ ID NO: 9177029 - DNA, 22 bp, Homo sapiens
ggcagctgagcatggctacctt

SEQ ID NO: 9177030 - DNA, 22 bp, Homo sapiens
caccaggttccgggcagagctg

SEQ ID NO: 9177031 - DNA, 22 bp, Homo sapiens
caccagtttaacaatcaaaaga

SEQ ID NO: 9177032 - DNA, 23 bp, Homo sapiens
caccagttaaaatataaatcagc

SEQ ID NO: 9177033 - DNA, 22 bp, Homo sapiens
caccagtgtttacctgtgacaa

SEQ ID NO: 9177034 - DNA, 23 bp, Homo sapiens
caccagttaaaatataaatcagc

SEQ ID NO: 9177035 - DNA, 22 bp, Homo sapiens
caccaggctggagtgcagtggc

SEQ ID NO: 9177036 - DNA, 22 bp, Homo sapiens
ggcagctgagatcatgctgttg

SEQ ID NO: 9177037 - DNA, 22 bp, Homo sapiens
ggcagctgagatcatgctgttg

SEQ ID NO: 9177038 - DNA, 22 bp, Homo sapiens
ggcagctgagatcatgctgttg

SEQ ID NO: 9177039 - DNA, 22 bp, Homo sapiens
ggcagctgaagaggaactttgg

SEQ ID NO: 9177040 - DNA, 21 bp, Homo sapiens
ggcagctgaccgcgcggtgca

SEQ ID NO: 9177041 - DNA, 22 bp, Homo sapiens
ggcagccagagggcagctggat

SEQ ID NO: 9177042 - DNA, 22 bp, Homo sapiens
attaaatactgcaggctaagca

SEQ ID NO: 9177043 - DNA, 22 bp, Homo sapiens
attaaaattccaaggtatgcca

SEQ ID NO: 9177044 - DNA, 22 bp, Homo sapiens
attaaaagcttcccaagagtta

SEQ ID NO: 9177045 - DNA, 22 bp, Homo sapiens
attaaatgttccttaaattata

SEQ ID NO: 9177046 - DNA, 22 bp, Homo sapiens
attaaatactgcaggctaagca

SEQ ID NO: 9177047 - DNA, 22 bp, Homo sapiens
atgtttttaaatagacttacag

SEQ ID NO: 9177048 - DNA, 22 bp, Homo sapiens
atgtttttaaatagacttacag

SEQ ID NO: 9177049 - DNA, 22 bp, Homo sapiens
atgtttttgagatacaaacaga

SEQ ID NO: 9177050 - DNA, 22 bp, Homo sapiens
attaaaagcttcccaagagtta

SEQ ID NO: 9177051 - DNA, 22 bp, Homo sapiens
gatgagggcctggtggctgtgc

SEQ ID NO: 9177052 - DNA, 21 bp, Homo sapiens
gatgagttttctgtgatgttc

SEQ ID NO: 9177053 - DNA, 22 bp, Homo sapiens
attaaatgttccttaaattata

SEQ ID NO: 9177054 - DNA, 22 bp, Homo sapiens
attaaattaagtggctaattta

SEQ ID NO: 9177055 - DNA, 22 bp, Homo sapiens
gatgaggaatttgaggttagaa

SEQ ID NO: 9177056 - DNA, 22 bp, Homo sapiens
attaaattagcaaactgtgaaa

SEQ ID NO: 9177057 - DNA, 22 bp, Homo sapiens
attaaattagcaaactgtgaaa

SEQ ID NO: 9177058 - DNA, 22 bp, Homo sapiens
atgtgttaatgtcaaccagaaa

SEQ ID NO: 9177059 - DNA, 22 bp, Homo sapiens
atgtgtgtgtttaatcctcaaa

SEQ ID NO: 9177060 - DNA, 22 bp, Homo sapiens
atgtgttgcagaagattaagct

SEQ ID NO: 9177061 - DNA, 22 bp, Homo sapiens
atgtgttaattggagcagcagg

SEQ ID NO: 9177062 - DNA, 22 bp, Homo sapiens
atgtgtgtgtgcgcgcgcagga

SEQ ID NO: 9177063 - DNA, 22 bp, Homo sapiens
atgtgtttttattctggcatgt

SEQ ID NO: 9177064 - DNA, 22 bp, Homo sapiens
atgtgttttggtggatcattca

SEQ ID NO: 9177065 - DNA, 22 bp, Homo sapiens
atgtgttttggtaatttctgct

SEQ ID NO: 9177066 - DNA, 22 bp, Homo sapiens
atgtgtttgtacctttaaatat

SEQ ID NO: 9177067 - DNA, 22 bp, Homo sapiens
atgtgtttgtcctgcagaaata

SEQ ID NO: 9177068 - DNA, 22 bp, Homo sapiens
atgtgtttgtcctgcagaaata

SEQ ID NO: 9177069 - DNA, 22 bp, Homo sapiens
atgtgtttataattactcaatc

SEQ ID NO: 9177070 - DNA, 22 bp, Homo sapiens
atgttttatgttccactcaagg

SEQ ID NO: 9177071 - DNA, 22 bp, Homo sapiens
atgttttatgcttcagatgagg

SEQ ID NO: 9177072 - DNA, 19 bp, Homo sapiens
atgttttatgctgatggga

SEQ ID NO: 9177073 - DNA, 19 bp, Homo sapiens
atgttttatgctgatggga

SEQ ID NO: 9177074 - DNA, 22 bp, Homo sapiens
atgttttatattttgcagcagt

SEQ ID NO: 9177075 - DNA, 20 bp, Homo sapiens
atgttttataaaagaacggg

SEQ ID NO: 9177076 - DNA, 22 bp, Homo sapiens
atgttttaccctttgcacaaac

SEQ ID NO: 9177077 - DNA, 22 bp, Homo sapiens
atgttttccccaaatgatcttc

SEQ ID NO: 9177078 - DNA, 22 bp, Homo sapiens
atgttttccccaaatgatcttc

SEQ ID NO: 9177079 - DNA, 22 bp, Homo sapiens
atgttttattaccaacttgtac

SEQ ID NO: 9177080 - DNA, 22 bp, Homo sapiens
attagaactaggctaagtaaaa

SEQ ID NO: 9177081 - DNA, 22 bp, Homo sapiens
gcaagttatttccatttaaagc

SEQ ID NO: 9177082 - DNA, 22 bp, Homo sapiens
attagaatgacagaaatgaggc

SEQ ID NO: 9177083 - DNA, 17 bp, Homo sapiens
gcaagggatgggagatt

SEQ ID NO: 9177084 - DNA, 17 bp, Homo sapiens
gcaagggatgggagatt

SEQ ID NO: 9177085 - DNA, 17 bp, Homo sapiens
gcaagggatgggagatt

SEQ ID NO: 9177086 - DNA, 20 bp, Homo sapiens
gcaagtgaaaactatgggtg

SEQ ID NO: 9177087 - DNA, 19 bp, Homo sapiens
gcaaggttcactcccagag

SEQ ID NO: 9177088 - DNA, 22 bp, Homo sapiens
attattcaatcatattaaaagt

SEQ ID NO: 9177089 - DNA, 22 bp, Homo sapiens
attattaaagctacatcaagga

SEQ ID NO: 9177090 - DNA, 22 bp, Homo sapiens
attattcaatcatattaaaagt

SEQ ID NO: 9177091 - DNA, 22 bp, Homo sapiens
attattcaatgttatttcagtg

SEQ ID NO: 9177092 - DNA, 22 bp, Homo sapiens
attattcaatcatattaaaagt

SEQ ID NO: 9177093 - DNA, 22 bp, Homo sapiens
attagagaaatgttgccaagat

SEQ ID NO: 9177094 - DNA, 22 bp, Homo sapiens
attagagagagcatattactgg

SEQ ID NO: 9177095 - DNA, 22 bp, Homo sapiens
attagagattatgaattcctag

SEQ ID NO: 9177096 - DNA, 22 bp, Homo sapiens
attagagaatgtgctgacattg

SEQ ID NO: 9177097 - DNA, 22 bp, Homo sapiens
attagagcagtgtattatgata

SEQ ID NO: 9177098 - DNA, 22 bp, Homo sapiens
attagagcagtaattgtggcag

SEQ ID NO: 9177099 - DNA, 20 bp, Homo sapiens
attagagctacatggctaca

SEQ ID NO: 9177100 - DNA, 22 bp, Homo sapiens
attattaaagctacatcaagga

SEQ ID NO: 9177101 - DNA, 22 bp, Homo sapiens
attattcttatgtcatcatggc

SEQ ID NO: 9177102 - DNA, 22 bp, Homo sapiens
attattcttaatgcagggatta

SEQ ID NO: 9177103 - DNA, 22 bp, Homo sapiens
attattcttatgtcatcatggc

SEQ ID NO: 9177104 - DNA, 22 bp, Homo sapiens
attattcatggtcttccacaat

SEQ ID NO: 9177105 - DNA, 22 bp, Homo sapiens
attattcatggtcttccacaat

SEQ ID NO: 9177106 - DNA, 22 bp, Homo sapiens
attattcatggtcttccacaat

SEQ ID NO: 9177107 - DNA, 22 bp, Homo sapiens
attattcattggtaggcaagct

SEQ ID NO: 9177108 - DNA, 22 bp, Homo sapiens
attattcagtcttgtaaggagt

SEQ ID NO: 9177109 - DNA, 20 bp, Homo sapiens
attattcatacatgtgtgac

SEQ ID NO: 9177110 - DNA, 22 bp, Homo sapiens
attaattttacctttgtaaaca

SEQ ID NO: 9177111 - DNA, 22 bp, Homo sapiens
attaattttacctttgtaaaca

SEQ ID NO: 9177112 - DNA, 22 bp, Homo sapiens
attaattgggaacttgttgaaa

SEQ ID NO: 9177113 - DNA, 22 bp, Homo sapiens
attaatgagcttctgcactcat

SEQ ID NO: 9177114 - DNA, 22 bp, Homo sapiens
attaatgacgcagataataatt

SEQ ID NO: 9177115 - DNA, 22 bp, Homo sapiens
attaatatcctgctggctaaat

SEQ ID NO: 9177116 - DNA, 22 bp, Homo sapiens
attaatatacactgttagcatg

SEQ ID NO: 9177117 - DNA, 22 bp, Homo sapiens
attaatatacactgttagcatg

SEQ ID NO: 9177118 - DNA, 22 bp, Homo sapiens
gatgatggacaaagcattggtg

SEQ ID NO: 9177119 - DNA, 22 bp, Homo sapiens
attaagatcattgtagaagatt

SEQ ID NO: 9177120 - DNA, 22 bp, Homo sapiens
gatgatcatctgtaaagttaga

SEQ ID NO: 9177121 - DNA, 22 bp, Homo sapiens
gcaaggctgggagatgaggcct

SEQ ID NO: 9177122 - DNA, 22 bp, Homo sapiens
gcaagaaaaaggcttcatgaac

SEQ ID NO: 9177123 - DNA, 22 bp, Homo sapiens
attacaataatacatgctcatt

SEQ ID NO: 9177124 - DNA, 22 bp, Homo sapiens
gcaactgttttgagcacccagt

SEQ ID NO: 9177125 - DNA, 22 bp, Homo sapiens
attacaagtagactaactttca

SEQ ID NO: 9177126 - DNA, 22 bp, Homo sapiens
attacaacaagaaaagggtaag

SEQ ID NO: 9177127 - DNA, 22 bp, Homo sapiens
attacaaaagaagggagaaggt

SEQ ID NO: 9177128 - DNA, 22 bp, Homo sapiens
attacaaaagaagggagaaggt

SEQ ID NO: 9177129 - DNA, 22 bp, Homo sapiens
attacaaaagaagggagaaggt

SEQ ID NO: 9177130 - DNA, 22 bp, Homo sapiens
attacaaaagaagggagaaggt

SEQ ID NO: 9177131 - DNA, 22 bp, Homo sapiens
attacaaaagaagggagaaggt

SEQ ID NO: 9177132 - DNA, 22 bp, Homo sapiens
attcttaattccaaagactgag

SEQ ID NO: 9177133 - DNA, 22 bp, Homo sapiens
attcttcacacctgttcctgtt

SEQ ID NO: 9177134 - DNA, 22 bp, Homo sapiens
attctattttttaagaagtagt

SEQ ID NO: 9177135 - DNA, 22 bp, Homo sapiens
attctattttttaagaagtagt

SEQ ID NO: 9177136 - DNA, 22 bp, Homo sapiens
attctcaaaacataacttcact

SEQ ID NO: 9177137 - DNA, 22 bp, Homo sapiens
attctattttttaagaagtagt

SEQ ID NO: 9177138 - DNA, 22 bp, Homo sapiens
attctagataagaaaagggctg

SEQ ID NO: 9177139 - DNA, 22 bp, Homo sapiens
attctgtctttttatacatcta

SEQ ID NO: 9177140 - DNA, 22 bp, Homo sapiens
attctcaaacaagtggtttgat

SEQ ID NO: 9177141 - DNA, 22 bp, Homo sapiens
attctcagatcttagaggaata

SEQ ID NO: 9177142 - DNA, 22 bp, Homo sapiens
attgaatagctgcttgttgtat

SEQ ID NO: 9177143 - DNA, 22 bp, Homo sapiens
attgaagcatacacaatgagga

SEQ ID NO: 9177144 - DNA, 22 bp, Homo sapiens
attgaagagaagctaaatagag

SEQ ID NO: 9177145 - DNA, 22 bp, Homo sapiens
attgaagatcagggaaagattc

SEQ ID NO: 9177146 - DNA, 22 bp, Homo sapiens
attgaagatcagggaaagattc

SEQ ID NO: 9177147 - DNA, 22 bp, Homo sapiens
attgaaattgatgaaattcttg

SEQ ID NO: 9177148 - DNA, 22 bp, Homo sapiens
attgaaattgatgaaattcttg

SEQ ID NO: 9177149 - DNA, 22 bp, Homo sapiens
attcttcagcaggggacactat

SEQ ID NO: 9177150 - DNA, 22 bp, Homo sapiens
attcttcagaatatctggcact

SEQ ID NO: 9177151 - DNA, 20 bp, Homo sapiens
attgaaatttttctgagatt

SEQ ID NO: 9177152 - DNA, 22 bp, Homo sapiens
attgaacagaaaccatcagagt

SEQ ID NO: 9177153 - DNA, 22 bp, Homo sapiens
attgaactataattatgatttg

SEQ ID NO: 9177154 - DNA, 22 bp, Homo sapiens
attgaacatacatatccacacc

SEQ ID NO: 9177155 - DNA, 22 bp, Homo sapiens
attgaacattgttctaggaggc

SEQ ID NO: 9177156 - DNA, 22 bp, Homo sapiens
attgaacattgttctaggaggc

SEQ ID NO: 9177157 - DNA, 23 bp, Homo sapiens
attgaacagagagaaaaacatcc

SEQ ID NO: 9177158 - DNA, 22 bp, Homo sapiens
attgacaattctatgcagagca

SEQ ID NO: 9177159 - DNA, 22 bp, Homo sapiens
attgacacaatgggatgtaagg

SEQ ID NO: 9177160 - DNA, 22 bp, Homo sapiens
attgacaattagcccttaggtg

SEQ ID NO: 9177161 - DNA, 22 bp, Homo sapiens
attgacagagctttcaccatga

SEQ ID NO: 9177162 - DNA, 22 bp, Homo sapiens
attgcacttcagcctgggtgac

SEQ ID NO: 9177163 - DNA, 22 bp, Homo sapiens
attgcacttcagcctgggtgac

SEQ ID NO: 9177164 - DNA, 22 bp, Homo sapiens
attgcacttcagcctgggtgac

SEQ ID NO: 9177165 - DNA, 22 bp, Homo sapiens
attgacaggtctttgggagtat

SEQ ID NO: 9177166 - DNA, 22 bp, Homo sapiens
attgacagtggctagtgcccag

SEQ ID NO: 9177167 - DNA, 22 bp, Homo sapiens
attgctgtaaattatcttatta

SEQ ID NO: 9177168 - DNA, 22 bp, Homo sapiens
attgctgtgatgatgttctgag

SEQ ID NO: 9177169 - DNA, 22 bp, Homo sapiens
attgctgtacacttctagatct

SEQ ID NO: 9177170 - DNA, 22 bp, Homo sapiens
attgctgtaaattatcttatta

SEQ ID NO: 9177171 - DNA, 22 bp, Homo sapiens
attgctgttgttatggcactgt

SEQ ID NO: 9177172 - DNA, 22 bp, Homo sapiens
attgctgtttaggcaagtgtat

SEQ ID NO: 9177173 - DNA, 22 bp, Homo sapiens
attgctgtggaaatataagatg

SEQ ID NO: 9177174 - DNA, 22 bp, Homo sapiens
attgctgtggaaatataagatg

SEQ ID NO: 9177175 - DNA, 22 bp, Homo sapiens
attgctggcatcagtgacaata

SEQ ID NO: 9177176 - DNA, 22 bp, Homo sapiens
attgctggcccagatgctttag

SEQ ID NO: 9177177 - DNA, 22 bp, Homo sapiens
attatttatcctcttggtctat

SEQ ID NO: 9177178 - DNA, 22 bp, Homo sapiens
attatttcagtcagacactggc

SEQ ID NO: 9177179 - DNA, 22 bp, Homo sapiens
attcagtgctgtaatacgctaa

SEQ ID NO: 9177180 - DNA, 22 bp, Homo sapiens
attcagtgctgtaatacgctaa

SEQ ID NO: 9177181 - DNA, 21 bp, Homo sapiens
attcagagtaattcatcttta

SEQ ID NO: 9177182 - DNA, 22 bp, Homo sapiens
attattgtactttcaataaggt

SEQ ID NO: 9177183 - DNA, 22 bp, Homo sapiens
attattgtgataggtgtcagtg

SEQ ID NO: 9177184 - DNA, 22 bp, Homo sapiens
attattgtcatcttaatcttaa

SEQ ID NO: 9177185 - DNA, 22 bp, Homo sapiens
attattgtgtaaaatgaggctt

SEQ ID NO: 9177186 - DNA, 22 bp, Homo sapiens
attattgtactttcaataaggt

SEQ ID NO: 9177187 - DNA, 22 bp, Homo sapiens
attattgttgcggctgttaccg

SEQ ID NO: 9177188 - DNA, 22 bp, Homo sapiens
attattgttagtgacagggtga

SEQ ID NO: 9177189 - DNA, 22 bp, Homo sapiens
attattgttttaatagtagaga

SEQ ID NO: 9177190 - DNA, 22 bp, Homo sapiens
attatttacagtgtgctcgaag

SEQ ID NO: 9177191 - DNA, 22 bp, Homo sapiens
attatttagaaatcgattgaaa

SEQ ID NO: 9177192 - DNA, 22 bp, Homo sapiens
attatttacagtgtgctcgaag

SEQ ID NO: 9177193 - DNA, 22 bp, Homo sapiens
attcagtgggtgctcagcacaa

SEQ ID NO: 9177194 - DNA, 22 bp, Homo sapiens
attcagttatttactttgctat

SEQ ID NO: 9177195 - DNA, 22 bp, Homo sapiens
attcagttactctagacacttc

SEQ ID NO: 9177196 - DNA, 22 bp, Homo sapiens
attcagttaaaaactgtacttc

SEQ ID NO: 9177197 - DNA, 22 bp, Homo sapiens
attcagttactctagacacttc

SEQ ID NO: 9177198 - DNA, 22 bp, Homo sapiens
attcagttagatcatcctaatt

SEQ ID NO: 9177199 - DNA, 22 bp, Homo sapiens
attcagttagatcatcctaatt

SEQ ID NO: 9177200 - DNA, 21 bp, Homo sapiens
gcagagctggaaccaggaccc

SEQ ID NO: 9177201 - DNA, 21 bp, Homo sapiens
gcagagctggaaccaggaccc

SEQ ID NO: 9177202 - DNA, 21 bp, Homo sapiens
gcagagctggaaccaggaccc

SEQ ID NO: 9177203 - DNA, 21 bp, Homo sapiens
gcagagctggaaccaggaccc

SEQ ID NO: 9177204 - DNA, 22 bp, Homo sapiens
gcagagctgcagcgaggcctgg

SEQ ID NO: 9177205 - DNA, 22 bp, Homo sapiens
gcagagctgggtctgtatccaa

SEQ ID NO: 9177206 - DNA, 22 bp, Homo sapiens
gcagagctgggatttgtactgg

SEQ ID NO: 9177207 - DNA, 21 bp, Homo sapiens
gcagagctggaaccaggaccc

SEQ ID NO: 9177208 - DNA, 22 bp, Homo sapiens
gcagagctgggatatgaaccca

SEQ ID NO: 9177209 - DNA, 22 bp, Homo sapiens
gcagagctgggatatgaaccca

SEQ ID NO: 9177210 - DNA, 18 bp, Homo sapiens
gcagagctgggattccca

SEQ ID NO: 9177211 - DNA, 22 bp, Homo sapiens
gcagagctgttaatggagctga

SEQ ID NO: 9177212 - DNA, 20 bp, Homo sapiens
gcagagctgttctgtgggga

SEQ ID NO: 9177213 - DNA, 20 bp, Homo sapiens
gcagagctgttctgtgggga

SEQ ID NO: 9177214 - DNA, 22 bp, Homo sapiens
gcagagcttctgtccttcagga

SEQ ID NO: 9177215 - DNA, 22 bp, Homo sapiens
gcagagctgtctaagtcacttc

SEQ ID NO: 9177216 - DNA, 22 bp, Homo sapiens
gcagagctgtctaagtcacttc

SEQ ID NO: 9177217 - DNA, 22 bp, Homo sapiens
gcagagctgggtctgtatccaa

SEQ ID NO: 9177218 - DNA, 22 bp, Homo sapiens
gcagagctgggtctgtatccaa

SEQ ID NO: 9177219 - DNA, 22 bp, Homo sapiens
gcagagctgggtctgtatccaa

SEQ ID NO: 9177220 - DNA, 22 bp, Homo sapiens
gcagagctggtacttgagcctg

SEQ ID NO: 9177221 - DNA, 22 bp, Homo sapiens
gcagagctggtacttgagcctg

SEQ ID NO: 9177222 - DNA, 22 bp, Homo sapiens
attctacagatgaaagcggctg

SEQ ID NO: 9177223 - DNA, 22 bp, Homo sapiens
attctagaaggcaaagcaaggg

SEQ ID NO: 9177224 - DNA, 21 bp, Homo sapiens
attctagacaacactgaaatc

SEQ ID NO: 9177225 - DNA, 22 bp, Homo sapiens
gcagcagggtgccagctttgca

SEQ ID NO: 9177226 - DNA, 22 bp, Homo sapiens
gcagcaggcttttcataccttg

SEQ ID NO: 9177227 - DNA, 22 bp, Homo sapiens
gcagcagggagcaggggtgtca

SEQ ID NO: 9177228 - DNA, 22 bp, Homo sapiens
gcagcagggagcaggggtgtca

SEQ ID NO: 9177229 - DNA, 22 bp, Homo sapiens
attcctcatttgttgagaacca

SEQ ID NO: 9177230 - DNA, 22 bp, Homo sapiens
attcctgagacttatctgtttc

SEQ ID NO: 9177231 - DNA, 22 bp, Homo sapiens
attcctgattaacgacctttca

SEQ ID NO: 9177232 - DNA, 23 bp, Homo sapiens
attcctgaggctccttatgcacc

SEQ ID NO: 9177233 - DNA, 22 bp, Homo sapiens
gcagcaggcatggccgccctgg

SEQ ID NO: 9177234 - DNA, 22 bp, Homo sapiens
gcagcaggcttttcataccttg

SEQ ID NO: 9177235 - DNA, 22 bp, Homo sapiens
gcagcaggcacttaccgttgct

SEQ ID NO: 9177236 - DNA, 22 bp, Homo sapiens
attcctgtcccttcattgttga

SEQ ID NO: 9177237 - DNA, 22 bp, Homo sapiens
attcctgtgtatgtcttgctgc

SEQ ID NO: 9177238 - DNA, 20 bp, Homo sapiens
attcctcagccccagcctca

SEQ ID NO: 9177239 - DNA, 19 bp, Homo sapiens
attcctcaaggacagaaat

SEQ ID NO: 9177240 - DNA, 22 bp, Homo sapiens
attcctcattatttactgagga

SEQ ID NO: 9177241 - DNA, 22 bp, Homo sapiens
attcctcatttgttgagaacca

SEQ ID NO: 9177242 - DNA, 22 bp, Homo sapiens
attcctatcattagtgaagccc

SEQ ID NO: 9177243 - DNA, 22 bp, Homo sapiens
gcagagcttctgtccttcagga

SEQ ID NO: 9177244 - DNA, 22 bp, Homo sapiens
attccctgaaattgtgctttca

SEQ ID NO: 9177245 - DNA, 22 bp, Homo sapiens
attccactttgctaatcttctg

SEQ ID NO: 9177246 - DNA, 22 bp, Homo sapiens
atttacacattcataagatttc

SEQ ID NO: 9177247 - DNA, 19 bp, Homo sapiens
gccaggagggctctggctg

SEQ ID NO: 9177248 - DNA, 22 bp, Homo sapiens
gccagctggctgcaggtcccag

SEQ ID NO: 9177249 - DNA, 22 bp, Homo sapiens
gccagctggctgcaggtcccag

SEQ ID NO: 9177250 - DNA, 22 bp, Homo sapiens
gccagctggagtgagagtgggc

SEQ ID NO: 9177251 - DNA, 22 bp, Homo sapiens
gccaggagtgtcccactcattt

SEQ ID NO: 9177252 - DNA, 22 bp, Homo sapiens
gccaggaggtcagcccctcaac

SEQ ID NO: 9177253 - DNA, 17 bp, Homo sapiens
gccaggaggtttgagct

SEQ ID NO: 9177254 - DNA, 22 bp, Homo sapiens
atttagaaattccaaaagtatt

SEQ ID NO: 9177255 - DNA, 22 bp, Homo sapiens
atttactgaggtaaataaactg

SEQ ID NO: 9177256 - DNA, 22 bp, Homo sapiens
atttactgagcagctaccatgt

SEQ ID NO: 9177257 - DNA, 19 bp, Homo sapiens
atttactgcctaaaatctc

SEQ ID NO: 9177258 - DNA, 22 bp, Homo sapiens
atttagaagctaatttttcaga

SEQ ID NO: 9177259 - DNA, 22 bp, Homo sapiens
atttagaagctaatttttcaga

SEQ ID NO: 9177260 - DNA, 22 bp, Homo sapiens
atttagaactttgtttgccaat

SEQ ID NO: 9177261 - DNA, 22 bp, Homo sapiens
atttagaactttgtttgccaat

SEQ ID NO: 9177262 - DNA, 22 bp, Homo sapiens
atttagaactttgtttgccaat

SEQ ID NO: 9177263 - DNA, 22 bp, Homo sapiens
atttagaaccccttccaacctg

SEQ ID NO: 9177264 - DNA, 22 bp, Homo sapiens
atttagaactttgtttgccaat

SEQ ID NO: 9177265 - DNA, 22 bp, Homo sapiens
atttagaaattccaaaagtatt

SEQ ID NO: 9177266 - DNA, 22 bp, Homo sapiens
atttagaaattccaaaagtatt

SEQ ID NO: 9177267 - DNA, 22 bp, Homo sapiens
atttagaactttgtttgccaat

SEQ ID NO: 9177268 - DNA, 22 bp, Homo sapiens
atttagaaccccttccaacctg

SEQ ID NO: 9177269 - DNA, 22 bp, Homo sapiens
attgcttttcagacaatgaggc

SEQ ID NO: 9177270 - DNA, 22 bp, Homo sapiens
attgcttttccttaacacatgc

SEQ ID NO: 9177271 - DNA, 18 bp, Homo sapiens
attgcttttgtaccaacc

SEQ ID NO: 9177272 - DNA, 22 bp, Homo sapiens
attgcttttgagctagaatttt

SEQ ID NO: 9177273 - DNA, 22 bp, Homo sapiens
attgctttctttggggaactgt

SEQ ID NO: 9177274 - DNA, 22 bp, Homo sapiens
attgctttgtacatgcctagca

SEQ ID NO: 9177275 - DNA, 22 bp, Homo sapiens
attgcttttagtgaaattatat

SEQ ID NO: 9177276 - DNA, 22 bp, Homo sapiens
attgcttttaagcaccacctaa

SEQ ID NO: 9177277 - DNA, 22 bp, Homo sapiens
attgctttagaaagaaaaatat

SEQ ID NO: 9177278 - DNA, 22 bp, Homo sapiens
attgctgtacacttctagatct

SEQ ID NO: 9177279 - DNA, 22 bp, Homo sapiens
attgcttcatgtcctttgccgg

SEQ ID NO: 9177280 - DNA, 22 bp, Homo sapiens
attggaaatacagtagaaaaat

SEQ ID NO: 9177281 - DNA, 22 bp, Homo sapiens
attggaaatactgagagataaa

SEQ ID NO: 9177282 - DNA, 22 bp, Homo sapiens
attggaaatgctacaagttaga

SEQ ID NO: 9177283 - DNA, 22 bp, Homo sapiens
attggaaatgctacaagttaga

SEQ ID NO: 9177284 - DNA, 22 bp, Homo sapiens
attggaaatactgagagataaa

SEQ ID NO: 9177285 - DNA, 22 bp, Homo sapiens
attggactgcagcacaaaagcc

SEQ ID NO: 9177286 - DNA, 22 bp, Homo sapiens
atttaatttacatttgacagag

SEQ ID NO: 9177287 - DNA, 22 bp, Homo sapiens
atttaattgttcttctggctat

SEQ ID NO: 9177288 - DNA, 22 bp, Homo sapiens
atttaattaatcatggtgaatt

SEQ ID NO: 9177289 - DNA, 22 bp, Homo sapiens
atttaattaatcatggtgaatt

SEQ ID NO: 9177290 - DNA, 22 bp, Homo sapiens
atttaattaatcatggtgaatt

SEQ ID NO: 9177291 - DNA, 22 bp, Homo sapiens
attggcactgcacatgattgct

SEQ ID NO: 9177292 - DNA, 22 bp, Homo sapiens
atttaattttctcaacagtgct

SEQ ID NO: 9177293 - DNA, 22 bp, Homo sapiens
atttaattttctcaacagtgct

SEQ ID NO: 9177294 - DNA, 22 bp, Homo sapiens
atttaattttctcaacagtgct

SEQ ID NO: 9177295 - DNA, 21 bp, Homo sapiens
atttacaaaacagtcccttcc

SEQ ID NO: 9177296 - DNA, 22 bp, Homo sapiens
atttaatttggagagagaaacc

SEQ ID NO: 9177297 - DNA, 22 bp, Homo sapiens
atttaatttggagagagaaacc

SEQ ID NO: 9177298 - DNA, 22 bp, Homo sapiens
atttaatttgtgtctttagctg

SEQ ID NO: 9177299 - DNA, 22 bp, Homo sapiens
atttaatttgtgtctttagctg

SEQ ID NO: 9177300 - DNA, 22 bp, Homo sapiens
atttaatttatagatgtggata

SEQ ID NO: 9177301 - DNA, 22 bp, Homo sapiens
atttaatttatagatgtggata

SEQ ID NO: 9177302 - DNA, 22 bp, Homo sapiens
atttaatttggagagagaaacc

SEQ ID NO: 9177303 - DNA, 22 bp, Homo sapiens
atttcaggatggaaagaggcca

SEQ ID NO: 9177304 - DNA, 22 bp, Homo sapiens
atttcagggatgtctgtaaatt

SEQ ID NO: 9177305 - DNA, 22 bp, Homo sapiens
atttcaggaatctgtatgaaag

SEQ ID NO: 9177306 - DNA, 22 bp, Homo sapiens
atttcagtagtccttacttgta

SEQ ID NO: 9177307 - DNA, 20 bp, Homo sapiens
atttcaggttgtgttctgtt

SEQ ID NO: 9177308 - DNA, 22 bp, Homo sapiens
atttcatactaaggctcaaaaa

SEQ ID NO: 9177309 - DNA, 22 bp, Homo sapiens
atttcatactaaggctcaaaaa

SEQ ID NO: 9177310 - DNA, 22 bp, Homo sapiens
atttcatctctggaacataact

SEQ ID NO: 9177311 - DNA, 22 bp, Homo sapiens
atttcatgagttattatagtgg

SEQ ID NO: 9177312 - DNA, 22 bp, Homo sapiens
atttcatggcagactttaaccc

SEQ ID NO: 9177313 - DNA, 22 bp, Homo sapiens
atttcatggtacatcgtgactt

SEQ ID NO: 9177314 - DNA, 22 bp, Homo sapiens
atttctagcagggcaggaaaga

SEQ ID NO: 9177315 - DNA, 22 bp, Homo sapiens
atttctagatatggagagtggt

SEQ ID NO: 9177316 - DNA, 22 bp, Homo sapiens
atttctataggaggacagtatt

SEQ ID NO: 9177317 - DNA, 22 bp, Homo sapiens
atttctcaaaggaatagagtga

SEQ ID NO: 9177318 - DNA, 22 bp, Homo sapiens
atttctataggaggacagtatt

SEQ ID NO: 9177319 - DNA, 22 bp, Homo sapiens
atttctactgtgagaaacatga

SEQ ID NO: 9177320 - DNA, 22 bp, Homo sapiens
atttcctttgcaaagactgtgc

SEQ ID NO: 9177321 - DNA, 21 bp, Homo sapiens
atttcatggtgcttttaagaa

SEQ ID NO: 9177322 - DNA, 22 bp, Homo sapiens
atttccttgcaagtttctgtaa

SEQ ID NO: 9177323 - DNA, 22 bp, Homo sapiens
atttccttcccagatttggttc

SEQ ID NO: 9177324 - DNA, 22 bp, Homo sapiens
atttccttgcaagtttctgtaa

SEQ ID NO: 9177325 - DNA, 22 bp, Homo sapiens
gccaggcctgcaagtgctggtg

SEQ ID NO: 9177326 - DNA, 22 bp, Homo sapiens
gccaggccctgggcacttcgtg

SEQ ID NO: 9177327 - DNA, 22 bp, Homo sapiens
gccaggccctgggcacttcgtg

SEQ ID NO: 9177328 - DNA, 22 bp, Homo sapiens
gccaggcctgcaagtgctggtg

SEQ ID NO: 9177329 - DNA, 22 bp, Homo sapiens
atttcagagaatgaacctaatc

SEQ ID NO: 9177330 - DNA, 21 bp, Homo sapiens
atttcagagcacacaagtaaa

SEQ ID NO: 9177331 - DNA, 22 bp, Homo sapiens
atttcagaatgtcctaatttag

SEQ ID NO: 9177332 - DNA, 22 bp, Homo sapiens
atttcagactgtgttggaaaat

SEQ ID NO: 9177333 - DNA, 22 bp, Homo sapiens
atttcagagtgagagtgctcaa

SEQ ID NO: 9177334 - DNA, 22 bp, Homo sapiens
atttcagagctttgcagctaat

SEQ ID NO: 9177335 - DNA, 22 bp, Homo sapiens
atttcagagtagatcgttattt

SEQ ID NO: 9177336 - DNA, 22 bp, Homo sapiens
atttcagatgaccaaatggaaa

SEQ ID NO: 9177337 - DNA, 22 bp, Homo sapiens
atttcagagtgagagtgctcaa

SEQ ID NO: 9177338 - DNA, 22 bp, Homo sapiens
atttcagattcagaaatgtagg

SEQ ID NO: 9177339 - DNA, 22 bp, Homo sapiens
atttcagattcgagaggaagtg

SEQ ID NO: 9177340 - DNA, 22 bp, Homo sapiens
atttattgagacttaacaaccc

SEQ ID NO: 9177341 - DNA, 22 bp, Homo sapiens
atttattgagacttaacaaccc

SEQ ID NO: 9177342 - DNA, 22 bp, Homo sapiens
atttattgagacttaacaaccc

SEQ ID NO: 9177343 - DNA, 22 bp, Homo sapiens
atttattgagacttaacaaccc

SEQ ID NO: 9177344 - DNA, 22 bp, Homo sapiens
atttattgagacttaacaaccc

SEQ ID NO: 9177345 - DNA, 22 bp, Homo sapiens
atttattgagagggaggggaat

SEQ ID NO: 9177346 - DNA, 22 bp, Homo sapiens
atttattgagcctttcctatgt

SEQ ID NO: 9177347 - DNA, 22 bp, Homo sapiens
atttattgagagggaggggaat

SEQ ID NO: 9177348 - DNA, 22 bp, Homo sapiens
atttattgagcctttcctatgt

SEQ ID NO: 9177349 - DNA, 22 bp, Homo sapiens
atttattggatgcttacttggg

SEQ ID NO: 9177350 - DNA, 22 bp, Homo sapiens
atttattggatgcttacttggg

SEQ ID NO: 9177351 - DNA, 22 bp, Homo sapiens
atttattggatgcttacttggg

SEQ ID NO: 9177352 - DNA, 22 bp, Homo sapiens
gccaggcattctagaagtagtg

SEQ ID NO: 9177353 - DNA, 22 bp, Homo sapiens
caaactttgcaaaacttacagt

SEQ ID NO: 9177354 - DNA, 22 bp, Homo sapiens
caaactttcagttataacatga

SEQ ID NO: 9177355 - DNA, 22 bp, Homo sapiens
gctcaggaaacagcagggcttg

SEQ ID NO: 9177356 - DNA, 22 bp, Homo sapiens
gctcaggacccaggtgtgacct

SEQ ID NO: 9177357 - DNA, 22 bp, Homo sapiens
caaaggcaacatatacttgttt

SEQ ID NO: 9177358 - DNA, 22 bp, Homo sapiens
caaaggcaacatatacttgttt

SEQ ID NO: 9177359 - DNA, 22 bp, Homo sapiens
caaaggcaatcttgttctctgg

SEQ ID NO: 9177360 - DNA, 22 bp, Homo sapiens
caaaggcacacatacctttctg

SEQ ID NO: 9177361 - DNA, 22 bp, Homo sapiens
caaaggcacacatacctttctg

SEQ ID NO: 9177362 - DNA, 22 bp, Homo sapiens
gctcaggcaggagtgcagtggc

SEQ ID NO: 9177363 - DNA, 22 bp, Homo sapiens
gctcaggcaggagtgcagtggc

SEQ ID NO: 9177364 - DNA, 22 bp, Homo sapiens
gctcaggcaaatttctggtgaa

SEQ ID NO: 9177365 - DNA, 22 bp, Homo sapiens
gctcaggatcagccacctcttt

SEQ ID NO: 9177366 - DNA, 22 bp, Homo sapiens
gctcaggagctgacagcctcaa

SEQ ID NO: 9177367 - DNA, 22 bp, Homo sapiens
gcgagtgccgagagggcagggc

SEQ ID NO: 9177368 - DNA, 22 bp, Homo sapiens
gcgagggcacgcggttgaaggc

SEQ ID NO: 9177369 - DNA, 22 bp, Homo sapiens
gcgagtcgccgctgcagcccta

SEQ ID NO: 9177370 - DNA, 22 bp, Homo sapiens
gcgagggcacgcggttgaaggc

SEQ ID NO: 9177371 - DNA, 22 bp, Homo sapiens
caaacattgcactttctgctat

SEQ ID NO: 9177372 - DNA, 22 bp, Homo sapiens
gcgcagagtagcagagtgctga

SEQ ID NO: 9177373 - DNA, 22 bp, Homo sapiens
gcgatttggttacagaagggca

SEQ ID NO: 9177374 - DNA, 22 bp, Homo sapiens
gcgcaccacctccaggtggccg

SEQ ID NO: 9177375 - DNA, 23 bp, Homo sapiens
caaacctgtttctctcacctgtc

SEQ ID NO: 9177376 - DNA, 23 bp, Homo sapiens
caaacctgttctccccacatgca

SEQ ID NO: 9177377 - DNA, 22 bp, Homo sapiens
caaacctgttagaggtcatcgt

SEQ ID NO: 9177378 - DNA, 22 bp, Homo sapiens
caaacctgactggggatgggcg

SEQ ID NO: 9177379 - DNA, 22 bp, Homo sapiens
caaacctgtccttttgtctcct

SEQ ID NO: 9177380 - DNA, 22 bp, Homo sapiens
caaacctgctgctattttatcc

SEQ ID NO: 9177381 - DNA, 22 bp, Homo sapiens
caaacctgagaacatgtgctgt

SEQ ID NO: 9177382 - DNA, 22 bp, Homo sapiens
caaaaaacacctgtgtgagtat

SEQ ID NO: 9177383 - DNA, 22 bp, Homo sapiens
caaaaaacacagatgtctgtgt

SEQ ID NO: 9177384 - DNA, 22 bp, Homo sapiens
attttttagaacctggcctgat

SEQ ID NO: 9177385 - DNA, 22 bp, Homo sapiens
caaaaaacacagatgtctgtgt

SEQ ID NO: 9177386 - DNA, 22 bp, Homo sapiens
caaaacattcagagagctcact

SEQ ID NO: 9177387 - DNA, 22 bp, Homo sapiens
caaaaagcttaggtaacaagcc

SEQ ID NO: 9177388 - DNA, 22 bp, Homo sapiens
caaaaactgcaattacttttac

SEQ ID NO: 9177389 - DNA, 22 bp, Homo sapiens
caaaaactgcaattacttttac

SEQ ID NO: 9177390 - DNA, 22 bp, Homo sapiens
caaaactgtctagagagagaag

SEQ ID NO: 9177391 - DNA, 22 bp, Homo sapiens
caaaactgtctagagagagaag

SEQ ID NO: 9177392 - DNA, 21 bp, Homo sapiens
caaaacttaggtgacttagga

SEQ ID NO: 9177393 - DNA, 19 bp, Homo sapiens
gcgaggaagtcactgtggc

SEQ ID NO: 9177394 - DNA, 19 bp, Homo sapiens
gcgaggaagtcactgtggt

SEQ ID NO: 9177395 - DNA, 22 bp, Homo sapiens
caaaacattcagagagctcact

SEQ ID NO: 9177396 - DNA, 22 bp, Homo sapiens
caaaacattcagagagctcact

SEQ ID NO: 9177397 - DNA, 22 bp, Homo sapiens
caaaacattctctgcagcaggg

SEQ ID NO: 9177398 - DNA, 22 bp, Homo sapiens
caaaactatcaggctcaaagct

SEQ ID NO: 9177399 - DNA, 22 bp, Homo sapiens
caaaacctaaacagactgtcca

SEQ ID NO: 9177400 - DNA, 22 bp, Homo sapiens
caaaacctaaacagactgtcca

SEQ ID NO: 9177401 - DNA, 22 bp, Homo sapiens
caaaaccaagaacattcatttc

SEQ ID NO: 9177402 - DNA, 18 bp, Homo sapiens
gcctgggaggaggaaatg

SEQ ID NO: 9177403 - DNA, 22 bp, Homo sapiens
gcctgggagtgcacagtgaggt

SEQ ID NO: 9177404 - DNA, 23 bp, Homo sapiens
gcctgggagttgcgatctgcccg

SEQ ID NO: 9177405 - DNA, 22 bp, Homo sapiens
gcctgtccactaaacagccaag

SEQ ID NO: 9177406 - DNA, 22 bp, Homo sapiens
gcctgtcccgcaccggagcccg

SEQ ID NO: 9177407 - DNA, 22 bp, Homo sapiens
gcctgtctgcagggctgtcatt

SEQ ID NO: 9177408 - DNA, 22 bp, Homo sapiens
gcctgtgcctcagcctgcagcc

SEQ ID NO: 9177409 - DNA, 23 bp, Homo sapiens
gcctgtgcctatgcccagctctg

SEQ ID NO: 9177410 - DNA, 23 bp, Homo sapiens
gcctgtgcctatgcccagctctg

SEQ ID NO: 9177411 - DNA, 22 bp, Homo sapiens
gcctgtcctggatgctctgcaa

SEQ ID NO: 9177412 - DNA, 22 bp, Homo sapiens
gcctgtcctcccctgcgctgag

SEQ ID NO: 9177413 - DNA, 22 bp, Homo sapiens
gcctgtccttgtgaggtcccag

SEQ ID NO: 9177414 - DNA, 22 bp, Homo sapiens
gcctgtctgcagggctgtcatt

SEQ ID NO: 9177415 - DNA, 22 bp, Homo sapiens
gcctgtctacactttctctgca

SEQ ID NO: 9177416 - DNA, 22 bp, Homo sapiens
gcctccagctggggcatttcag

SEQ ID NO: 9177417 - DNA, 22 bp, Homo sapiens
gcctccagcccacgcaggcctg

SEQ ID NO: 9177418 - DNA, 22 bp, Homo sapiens
gcctccagctggggcatttcag

SEQ ID NO: 9177419 - DNA, 22 bp, Homo sapiens
gcctccagtttttttctgaact

SEQ ID NO: 9177420 - DNA, 22 bp, Homo sapiens
gcctccatgtgtcctgagtcgc

SEQ ID NO: 9177421 - DNA, 22 bp, Homo sapiens
gcctccagggtagaggaggaag

SEQ ID NO: 9177422 - DNA, 22 bp, Homo sapiens
gcctccagtttttttctgaact

SEQ ID NO: 9177423 - DNA, 22 bp, Homo sapiens
gcctccccaagcagcagggatt

SEQ ID NO: 9177424 - DNA, 22 bp, Homo sapiens
gcctccccaagcagcagggatt

SEQ ID NO: 9177425 - DNA, 22 bp, Homo sapiens
gcctccccaaagtgctgacagc

SEQ ID NO: 9177426 - DNA, 21 bp, Homo sapiens
gcctctccaaatcctgccttc

SEQ ID NO: 9177427 - DNA, 22 bp, Homo sapiens
gcctctccgagccactgcctct

SEQ ID NO: 9177428 - DNA, 22 bp, Homo sapiens
gcctctagggctgttgggaatt

SEQ ID NO: 9177429 - DNA, 22 bp, Homo sapiens
gcctcgaggctgagaaggcaca

SEQ ID NO: 9177430 - DNA, 22 bp, Homo sapiens
gcctctccgagccactgcctct

SEQ ID NO: 9177431 - DNA, 22 bp, Homo sapiens
gcctctcctcttaataccatta

SEQ ID NO: 9177432 - DNA, 22 bp, Homo sapiens
gcctctctccttggcttgcagt

SEQ ID NO: 9177433 - DNA, 22 bp, Homo sapiens
gcctctctcgggcttgtagcgg

SEQ ID NO: 9177434 - DNA, 22 bp, Homo sapiens
gcctctcctggagaaggcaggg

SEQ ID NO: 9177435 - DNA, 21 bp, Homo sapiens
gcctccagccagatggcctcc

SEQ ID NO: 9177436 - DNA, 22 bp, Homo sapiens
gcctccagcccacgcaggcctg

SEQ ID NO: 9177437 - DNA, 22 bp, Homo sapiens
atttctcaggactccatgggcg

SEQ ID NO: 9177438 - DNA, 22 bp, Homo sapiens
atttctcacagtggaatctctg

SEQ ID NO: 9177439 - DNA, 22 bp, Homo sapiens
gcctctctgggctgccgaggct

SEQ ID NO: 9177440 - DNA, 22 bp, Homo sapiens
gcctgctgaacctcatgcagtc

SEQ ID NO: 9177441 - DNA, 22 bp, Homo sapiens
gcctgctgagggaagttgggca

SEQ ID NO: 9177442 - DNA, 22 bp, Homo sapiens
gcctgctgagggaagttgggca

SEQ ID NO: 9177443 - DNA, 22 bp, Homo sapiens
gcctgctgaagccagagtgtgt

SEQ ID NO: 9177444 - DNA, 22 bp, Homo sapiens
gcctgctgaagccagagtgtgt

SEQ ID NO: 9177445 - DNA, 22 bp, Homo sapiens
gcctgctgaagccagagtgtgt

SEQ ID NO: 9177446 - DNA, 22 bp, Homo sapiens
gcctgctgaacctcatgcagtc

SEQ ID NO: 9177447 - DNA, 22 bp, Homo sapiens
gcctgctgaacctcatgcagtc

SEQ ID NO: 9177448 - DNA, 22 bp, Homo sapiens
gcctgctggacattggccggcc

SEQ ID NO: 9177449 - DNA, 22 bp, Homo sapiens
gcctgctggacattggccggcc

SEQ ID NO: 9177450 - DNA, 22 bp, Homo sapiens
gcctgctggaggagcctcaggg

SEQ ID NO: 9177451 - DNA, 22 bp, Homo sapiens
gcctgctggacattggccggcc

SEQ ID NO: 9177452 - DNA, 21 bp, Homo sapiens
gcctgctgcctgtggccggtc

SEQ ID NO: 9177453 - DNA, 21 bp, Homo sapiens
gcctgctgcctgtggccggtc

SEQ ID NO: 9177454 - DNA, 22 bp, Homo sapiens
gcctgctgccagaggcaaacac

SEQ ID NO: 9177455 - DNA, 21 bp, Homo sapiens
gcctgctgcctgtggccggtc

SEQ ID NO: 9177456 - DNA, 22 bp, Homo sapiens
gcctgctgccaccctggctccg

SEQ ID NO: 9177457 - DNA, 22 bp, Homo sapiens
gcctgctgccaccctggctccg

SEQ ID NO: 9177458 - DNA, 22 bp, Homo sapiens
gcctgctgccaccctggctccg

SEQ ID NO: 9177459 - DNA, 22 bp, Homo sapiens
gcctgctgagggaagttgggca

SEQ ID NO: 9177460 - DNA, 22 bp, Homo sapiens
gcctgctgccaccctggctccg

SEQ ID NO: 9177461 - DNA, 22 bp, Homo sapiens
gcctgctgcatccaggctattg

SEQ ID NO: 9177462 - DNA, 22 bp, Homo sapiens
gcctgctgcatccaggctattg

SEQ ID NO: 9177463 - DNA, 22 bp, Homo sapiens
gcctgctggctgtccattgcag

SEQ ID NO: 9177464 - DNA, 22 bp, Homo sapiens
gcctgctggatgtggccaggcc

SEQ ID NO: 9177465 - DNA, 22 bp, Homo sapiens
gcctgctggctggaaattctcc

SEQ ID NO: 9177466 - DNA, 22 bp, Homo sapiens
gcctgctggatgtggccaggcc

SEQ ID NO: 9177467 - DNA, 22 bp, Homo sapiens
gcctgctggatgtggccaggcc

SEQ ID NO: 9177468 - DNA, 22 bp, Homo sapiens
gcctgctggaggagcctcaggg

SEQ ID NO: 9177469 - DNA, 22 bp, Homo sapiens
gcctgctggatcaagcttatgc

SEQ ID NO: 9177470 - DNA, 22 bp, Homo sapiens
gcctgctggatgtggccaggcc

SEQ ID NO: 9177471 - DNA, 22 bp, Homo sapiens
gcctgctggaggagcctcaggg

SEQ ID NO: 9177472 - DNA, 22 bp, Homo sapiens
gcctgctggaggagcctcaggg

SEQ ID NO: 9177473 - DNA, 22 bp, Homo sapiens
gcctgctggaggagcctcaggg

SEQ ID NO: 9177474 - DNA, 22 bp, Homo sapiens
gcctggagctcatgtgggcatt

SEQ ID NO: 9177475 - DNA, 22 bp, Homo sapiens
gcctggagctactggacactga

SEQ ID NO: 9177476 - DNA, 22 bp, Homo sapiens
gcctggagctactggacactga

SEQ ID NO: 9177477 - DNA, 22 bp, Homo sapiens
gcctgctgggagacacccccag

SEQ ID NO: 9177478 - DNA, 22 bp, Homo sapiens
gcctgctggctgtccattgcag

SEQ ID NO: 9177479 - DNA, 22 bp, Homo sapiens
gcctgctggctgtccattgcag

SEQ ID NO: 9177480 - DNA, 22 bp, Homo sapiens
gcctggagcctcagcaaggagg

SEQ ID NO: 9177481 - DNA, 22 bp, Homo sapiens
gcctggagctcatgtgggcatt

SEQ ID NO: 9177482 - DNA, 22 bp, Homo sapiens
gcctggagctcggctgagggcg

SEQ ID NO: 9177483 - DNA, 22 bp, Homo sapiens
gcctggagctcggctgagggcg

SEQ ID NO: 9177484 - DNA, 22 bp, Homo sapiens
gcctgggagagggatagtgcag

SEQ ID NO: 9177485 - DNA, 22 bp, Homo sapiens
gcctgggagattaattaggaag

SEQ ID NO: 9177486 - DNA, 22 bp, Homo sapiens
gcctgggagcacatcggggtcc

SEQ ID NO: 9177487 - DNA, 22 bp, Homo sapiens
gcctggagctctccacttgggg

SEQ ID NO: 9177488 - DNA, 22 bp, Homo sapiens
gcctggctctgagtttctctcc

SEQ ID NO: 9177489 - DNA, 22 bp, Homo sapiens
gcctggctctgagtttctctcc

SEQ ID NO: 9177490 - DNA, 22 bp, Homo sapiens
gcctggaggaatgtagctgagg

SEQ ID NO: 9177491 - DNA, 22 bp, Homo sapiens
gcctgggagaatgacctccaac

SEQ ID NO: 9177492 - DNA, 22 bp, Homo sapiens
gcctggctgaggcctctgctaa

SEQ ID NO: 9177493 - DNA, 22 bp, Homo sapiens
gcctggctgaggtggggaggca

SEQ ID NO: 9177494 - DNA, 22 bp, Homo sapiens
atgcatatgccgtagaataagt

SEQ ID NO: 9177495 - DNA, 22 bp, Homo sapiens
atgcatgcatgagtgtgtacct

SEQ ID NO: 9177496 - DNA, 22 bp, Homo sapiens
atgcaggaagagccctggagct

SEQ ID NO: 9177497 - DNA, 22 bp, Homo sapiens
atgcaggaagagccctggagct

SEQ ID NO: 9177498 - DNA, 22 bp, Homo sapiens
atgcaggaagtcggggagcggg

SEQ ID NO: 9177499 - DNA, 22 bp, Homo sapiens
atgcatatgcatggacactcag

SEQ ID NO: 9177500 - DNA, 23 bp, Homo sapiens
atgcaggacttataaggtaaggt

SEQ ID NO: 9177501 - DNA, 22 bp, Homo sapiens
atgcaggacataagcatcgaca

SEQ ID NO: 9177502 - DNA, 23 bp, Homo sapiens
atgcaggacttataaggtaaggt

SEQ ID NO: 9177503 - DNA, 22 bp, Homo sapiens
atgcagctgacattttcatgtt

SEQ ID NO: 9177504 - DNA, 20 bp, Homo sapiens
atgcagcattgttgtggcaa

SEQ ID NO: 9177505 - DNA, 20 bp, Homo sapiens
atgcagcattgttgtggcaa

SEQ ID NO: 9177506 - DNA, 22 bp, Homo sapiens
atgcagcagccccttgaggtgc

SEQ ID NO: 9177507 - DNA, 22 bp, Homo sapiens
atgcagcagctacttgggaagg

SEQ ID NO: 9177508 - DNA, 22 bp, Homo sapiens
atgcatttatgtgtgtacattg

SEQ ID NO: 9177509 - DNA, 22 bp, Homo sapiens
gacactctttcctcttctggaa

SEQ ID NO: 9177510 - DNA, 21 bp, Homo sapiens
atgcatggatttcagtgagag

SEQ ID NO: 9177511 - DNA, 22 bp, Homo sapiens
atgcatgtttaaggggcatgca

SEQ ID NO: 9177512 - DNA, 20 bp, Homo sapiens
atgcaaatcccaaaatcagg

SEQ ID NO: 9177513 - DNA, 22 bp, Homo sapiens
atgcaaataaagcaactataca

SEQ ID NO: 9177514 - DNA, 22 bp, Homo sapiens
atgcaaagcaccacactaagat

SEQ ID NO: 9177515 - DNA, 22 bp, Homo sapiens
atgcaaaagtagttgcagtttt

SEQ ID NO: 9177516 - DNA, 20 bp, Homo sapiens
atgcaaactcacaaaatacc

SEQ ID NO: 9177517 - DNA, 22 bp, Homo sapiens
atgcagaaggagccatgcttgc

SEQ ID NO: 9177518 - DNA, 22 bp, Homo sapiens
atgcagaatcttgagaaaaatt

SEQ ID NO: 9177519 - DNA, 22 bp, Homo sapiens
atgcagaagcagaacttacaca

SEQ ID NO: 9177520 - DNA, 21 bp, Homo sapiens
atgcagagaactccagggaag

SEQ ID NO: 9177521 - DNA, 19 bp, Homo sapiens
atgcagagaatggcagtag

SEQ ID NO: 9177522 - DNA, 22 bp, Homo sapiens
atgcagcactgatctttagcca

SEQ ID NO: 9177523 - DNA, 22 bp, Homo sapiens
atgcagcagccccttgaggtgc

SEQ ID NO: 9177524 - DNA, 22 bp, Homo sapiens
atgcagatttctttgctgcacc

SEQ ID NO: 9177525 - DNA, 22 bp, Homo sapiens
atgcagataagaatcaggtttg

SEQ ID NO: 9177526 - DNA, 22 bp, Homo sapiens
atgattcagcaattttatatct

SEQ ID NO: 9177527 - DNA, 20 bp, Homo sapiens
atgattttgcactaacttca

SEQ ID NO: 9177528 - DNA, 22 bp, Homo sapiens
atgagttcccaggtgatttgtg

SEQ ID NO: 9177529 - DNA, 22 bp, Homo sapiens
atgagtgatacagcaagctctc

SEQ ID NO: 9177530 - DNA, 22 bp, Homo sapiens
atgagtgatgggtacattggct

SEQ ID NO: 9177531 - DNA, 22 bp, Homo sapiens
atgagtgcaacagatcagcatg

SEQ ID NO: 9177532 - DNA, 22 bp, Homo sapiens
atgagttgaagctacaagaggc

SEQ ID NO: 9177533 - DNA, 22 bp, Homo sapiens
atgataagaacacagtatgggg

SEQ ID NO: 9177534 - DNA, 22 bp, Homo sapiens
atgatacaagcaaaactaatca

SEQ ID NO: 9177535 - DNA, 22 bp, Homo sapiens
atgaggttcagtgtttatttcc

SEQ ID NO: 9177536 - DNA, 22 bp, Homo sapiens
atgagtaaaaccactatttaca

SEQ ID NO: 9177537 - DNA, 22 bp, Homo sapiens
gaaagcagtaaatgggtcccat

SEQ ID NO: 9177538 - DNA, 22 bp, Homo sapiens
gaaagcactgtgagatcttgtt

SEQ ID NO: 9177539 - DNA, 22 bp, Homo sapiens
gaaagcactgtgagatcttgtt

SEQ ID NO: 9177540 - DNA, 22 bp, Homo sapiens
gaaagcactgtgagatcttgtt

SEQ ID NO: 9177541 - DNA, 22 bp, Homo sapiens
gaaagcagtaaatgggtcccat

SEQ ID NO: 9177542 - DNA, 22 bp, Homo sapiens
gaaagcagctaagtcttatgat

SEQ ID NO: 9177543 - DNA, 22 bp, Homo sapiens
atgaggtaatactttcagtcct

SEQ ID NO: 9177544 - DNA, 22 bp, Homo sapiens
atgaagatttcccagagacatg

SEQ ID NO: 9177545 - DNA, 19 bp, Homo sapiens
atgaagattggtaaattca

SEQ ID NO: 9177546 - DNA, 22 bp, Homo sapiens
atgaagagtaagaggacctttt

SEQ ID NO: 9177547 - DNA, 22 bp, Homo sapiens
atgaagagttctgttttggaca

SEQ ID NO: 9177548 - DNA, 22 bp, Homo sapiens
atgaagatacaggcagggccat

SEQ ID NO: 9177549 - DNA, 22 bp, Homo sapiens
atgaggcagatgttgcatgagg

SEQ ID NO: 9177550 - DNA, 22 bp, Homo sapiens
atgagctgtgggattccagagg

SEQ ID NO: 9177551 - DNA, 19 bp, Homo sapiens
atgaggaactgaggctcag

SEQ ID NO: 9177552 - DNA, 22 bp, Homo sapiens
atgaggcaggagcggggaccct

SEQ ID NO: 9177553 - DNA, 22 bp, Homo sapiens
atgaggcaggagtgcagtggca

SEQ ID NO: 9177554 - DNA, 22 bp, Homo sapiens
gaaagatatttattggcaacag

SEQ ID NO: 9177555 - DNA, 22 bp, Homo sapiens
atgaggcaggtggaggctgcca

SEQ ID NO: 9177556 - DNA, 22 bp, Homo sapiens
gaaagcacagttctgaccatgt

SEQ ID NO: 9177557 - DNA, 22 bp, Homo sapiens
gaaagcacaggctcaggaacag

SEQ ID NO: 9177558 - DNA, 22 bp, Homo sapiens
gaaagcacatactataaatcac

SEQ ID NO: 9177559 - DNA, 22 bp, Homo sapiens
gaaagcacagttctgaccatgt

SEQ ID NO: 9177560 - DNA, 22 bp, Homo sapiens
gaaagcacatactataaatcac

SEQ ID NO: 9177561 - DNA, 22 bp, Homo sapiens
gaaagcacgatagtagcaaaag

SEQ ID NO: 9177562 - DNA, 22 bp, Homo sapiens
gaaagcacgatagtagcaaaag

SEQ ID NO: 9177563 - DNA, 22 bp, Homo sapiens
gaaagcaatttgtgtaatctgt

SEQ ID NO: 9177564 - DNA, 22 bp, Homo sapiens
gaaagcaatttgtgtaatctgt

SEQ ID NO: 9177565 - DNA, 22 bp, Homo sapiens
gaaagcaagttgactgcagaat

SEQ ID NO: 9177566 - DNA, 20 bp, Homo sapiens
gaaagattgtaagaggcaga

SEQ ID NO: 9177567 - DNA, 18 bp, Homo sapiens
gaaagatgaacttttttc

SEQ ID NO: 9177568 - DNA, 19 bp, Homo sapiens
gaaagatttcagttgagga

SEQ ID NO: 9177569 - DNA, 22 bp, Homo sapiens
cttttcagagctgagatcaccg

SEQ ID NO: 9177570 - DNA, 22 bp, Homo sapiens
cttttcaaacgctgatgtcagt

SEQ ID NO: 9177571 - DNA, 22 bp, Homo sapiens
cttttcatgagtctgttatggg

SEQ ID NO: 9177572 - DNA, 23 bp, Homo sapiens
cttttcattgccttagcgcagag

SEQ ID NO: 9177573 - DNA, 22 bp, Homo sapiens
cttttattttgaattaagggct

SEQ ID NO: 9177574 - DNA, 22 bp, Homo sapiens
cttttagctgcaagtgttcaca

SEQ ID NO: 9177575 - DNA, 22 bp, Homo sapiens
atgaaatgttggtcccaatcgc

SEQ ID NO: 9177576 - DNA, 22 bp, Homo sapiens
ctttggtgtcatgtttctgcgg

SEQ ID NO: 9177577 - DNA, 22 bp, Homo sapiens
atgaaatgtattcagatatgta

SEQ ID NO: 9177578 - DNA, 22 bp, Homo sapiens
atgaaatgtattcagatatgta

SEQ ID NO: 9177579 - DNA, 22 bp, Homo sapiens
atgaaatgtctggatctttttc

SEQ ID NO: 9177580 - DNA, 22 bp, Homo sapiens
atgaaatgtatgagtctgggtt

SEQ ID NO: 9177581 - DNA, 22 bp, Homo sapiens
atgaaatgtatgagtctgggtt

SEQ ID NO: 9177582 - DNA, 22 bp, Homo sapiens
atgaaatgtaagtagagagttt

SEQ ID NO: 9177583 - DNA, 22 bp, Homo sapiens
atgaaatgattgaaatctttac

SEQ ID NO: 9177584 - DNA, 23 bp, Homo sapiens
atgaaatgctggctcagggaggt

SEQ ID NO: 9177585 - DNA, 22 bp, Homo sapiens
atgaaatggtggttttccattt

SEQ ID NO: 9177586 - DNA, 23 bp, Homo sapiens
atgaaatgatactttattcactg

SEQ ID NO: 9177587 - DNA, 22 bp, Homo sapiens
atgaaatgagtcaatgcgacta

SEQ ID NO: 9177588 - DNA, 22 bp, Homo sapiens
atgaaatgaagttggcctggct

SEQ ID NO: 9177589 - DNA, 22 bp, Homo sapiens
atgaaatatcttgaagaaattc

SEQ ID NO: 9177590 - DNA, 22 bp, Homo sapiens
atgaaatattctttggtaagaa

SEQ ID NO: 9177591 - DNA, 22 bp, Homo sapiens
atgaaatatcttgaagaaattc

SEQ ID NO: 9177592 - DNA, 22 bp, Homo sapiens
atgaaatatcttgaagaaattc

SEQ ID NO: 9177593 - DNA, 22 bp, Homo sapiens
atgaaatatcttgaagaaattc

SEQ ID NO: 9177594 - DNA, 22 bp, Homo sapiens
atgaaaactttagcctcattag

SEQ ID NO: 9177595 - DNA, 22 bp, Homo sapiens
atgaaaacggaccagagctatt

SEQ ID NO: 9177596 - DNA, 22 bp, Homo sapiens
atctttttatctgtttggaaca

SEQ ID NO: 9177597 - DNA, 22 bp, Homo sapiens
atcttttacattactgcccaga

SEQ ID NO: 9177598 - DNA, 22 bp, Homo sapiens
atcttgcatttgctaaaatgca

SEQ ID NO: 9177599 - DNA, 22 bp, Homo sapiens
atcttgcttccttttaattacc

SEQ ID NO: 9177600 - DNA, 22 bp, Homo sapiens
atcttgcttgctgggcattttc

SEQ ID NO: 9177601 - DNA, 22 bp, Homo sapiens
atcttgcttgctgggcattttc

SEQ ID NO: 9177602 - DNA, 22 bp, Homo sapiens
cttgtggcaggtggatggtgcc

SEQ ID NO: 9177603 - DNA, 22 bp, Homo sapiens
atgaaaagttcgatctagaagg

SEQ ID NO: 9177604 - DNA, 18 bp, Homo sapiens
cttgttcttctcttggcg

SEQ ID NO: 9177605 - DNA, 22 bp, Homo sapiens
cttgttctgtgcttcttacatt

SEQ ID NO: 9177606 - DNA, 22 bp, Homo sapiens
atgaaagtttgcattcctcagt

SEQ ID NO: 9177607 - DNA, 22 bp, Homo sapiens
atgaaatatcttgaagaaattc

SEQ ID NO: 9177608 - DNA, 22 bp, Homo sapiens
cttgagtattttaatccataat

SEQ ID NO: 9177609 - DNA, 22 bp, Homo sapiens
atctaggtttggaagatagagt

SEQ ID NO: 9177610 - DNA, 22 bp, Homo sapiens
cttgcctttgtcttcaaaggct

SEQ ID NO: 9177611 - DNA, 22 bp, Homo sapiens
cttgctcattaagtagctcaca

SEQ ID NO: 9177612 - DNA, 22 bp, Homo sapiens
cttgctgctgcatctgagcatg

SEQ ID NO: 9177613 - DNA, 22 bp, Homo sapiens
cttgctggaaactctctctgcc

SEQ ID NO: 9177614 - DNA, 22 bp, Homo sapiens
cttgctgaaggaacttcccaga

SEQ ID NO: 9177615 - DNA, 22 bp, Homo sapiens
cttgcctttgtcttcaaaggct

SEQ ID NO: 9177616 - DNA, 22 bp, Homo sapiens
cttgcctttgtcttcaaaggct

SEQ ID NO: 9177617 - DNA, 22 bp, Homo sapiens
atctagctagatcctgtccacc

SEQ ID NO: 9177618 - DNA, 22 bp, Homo sapiens
atctagaggcaatgaaggaggt

SEQ ID NO: 9177619 - DNA, 22 bp, Homo sapiens
atctagaaagtgttgaagatca

SEQ ID NO: 9177620 - DNA, 22 bp, Homo sapiens
atctacccactgaacacaatat

SEQ ID NO: 9177621 - DNA, 19 bp, Homo sapiens
cttgtaaagggctgtttct

SEQ ID NO: 9177622 - DNA, 22 bp, Homo sapiens
cttgtaaatgcagattctgatt

SEQ ID NO: 9177623 - DNA, 22 bp, Homo sapiens
cttggtcttgggagcagggaca

SEQ ID NO: 9177624 - DNA, 20 bp, Homo sapiens
cttggtggctctgggaagtg

SEQ ID NO: 9177625 - DNA, 22 bp, Homo sapiens
atcttctcaagcagcatcctgt

SEQ ID NO: 9177626 - DNA, 22 bp, Homo sapiens
atcttctcatgtgtaatgaggt

SEQ ID NO: 9177627 - DNA, 22 bp, Homo sapiens
atcttctcaagcagcatcctgt

SEQ ID NO: 9177628 - DNA, 22 bp, Homo sapiens
atcttcctttgccatgggatag

SEQ ID NO: 9177629 - DNA, 22 bp, Homo sapiens
cttgtaaatgcagattctgatt

SEQ ID NO: 9177630 - DNA, 20 bp, Homo sapiens
atcttcttggccagcttgct

SEQ ID NO: 9177631 - DNA, 22 bp, Homo sapiens
atcttctgatttatggagcaat

SEQ ID NO: 9177632 - DNA, 22 bp, Homo sapiens
atcttcttcaaggatctggagc

SEQ ID NO: 9177633 - DNA, 22 bp, Homo sapiens
cttggcccagttgccaaggaaa

SEQ ID NO: 9177634 - DNA, 22 bp, Homo sapiens
cttggcagtttcggaaggatga

SEQ ID NO: 9177635 - DNA, 22 bp, Homo sapiens
cttgctggagcggagcgggtgt

SEQ ID NO: 9177636 - DNA, 22 bp, Homo sapiens
cttgctggagcggagcgggtgt

SEQ ID NO: 9177637 - DNA, 18 bp, Homo sapiens
cttggtaagtaaaacagc

SEQ ID NO: 9177638 - DNA, 22 bp, Homo sapiens
cttggtaaattgtcttataaat

SEQ ID NO: 9177639 - DNA, 22 bp, Homo sapiens
cttggtaaaactgtcttaaatt

SEQ ID NO: 9177640 - DNA, 21 bp, Homo sapiens
cttggcctctagctagagctg

SEQ ID NO: 9177641 - DNA, 22 bp, Homo sapiens
cttggctccaatcccagctctg

SEQ ID NO: 9177642 - DNA, 22 bp, Homo sapiens
atgggttcaagtgattctcctg

SEQ ID NO: 9177643 - DNA, 22 bp, Homo sapiens
atgggtttataggtggactttt

SEQ ID NO: 9177644 - DNA, 22 bp, Homo sapiens
atgggttcaagtgattctcctg

SEQ ID NO: 9177645 - DNA, 22 bp, Homo sapiens
atggtaaacatttaacaactag

SEQ ID NO: 9177646 - DNA, 22 bp, Homo sapiens
atgggttcaagtgattctcctg

SEQ ID NO: 9177647 - DNA, 22 bp, Homo sapiens
atggggctgttctctgccctgc

SEQ ID NO: 9177648 - DNA, 22 bp, Homo sapiens
atggctggatttgatccatggg

SEQ ID NO: 9177649 - DNA, 22 bp, Homo sapiens
atggctggatttgatccatggg

SEQ ID NO: 9177650 - DNA, 22 bp, Homo sapiens
atggctggcactggcctgggtt

SEQ ID NO: 9177651 - DNA, 22 bp, Homo sapiens
atggctggaggccgggcttcct

SEQ ID NO: 9177652 - DNA, 22 bp, Homo sapiens
atggctggaagagtcgaagagt

SEQ ID NO: 9177653 - DNA, 22 bp, Homo sapiens
atggctggatagttgaagctct

SEQ ID NO: 9177654 - DNA, 22 bp, Homo sapiens
atggtacaatgtgtgtatcttt

SEQ ID NO: 9177655 - DNA, 22 bp, Homo sapiens
atggtaaccagaagactatgac

SEQ ID NO: 9177656 - DNA, 19 bp, Homo sapiens
atggtacagtgtacacttg

SEQ ID NO: 9177657 - DNA, 22 bp, Homo sapiens
atggtagggaacttgtctattt

SEQ ID NO: 9177658 - DNA, 22 bp, Homo sapiens
gagctgggcgagccggggaagt

SEQ ID NO: 9177659 - DNA, 22 bp, Homo sapiens
gagctgggcctgcgagtgctgc

SEQ ID NO: 9177660 - DNA, 22 bp, Homo sapiens
gagctgggcctgcgagtgctgc

SEQ ID NO: 9177661 - DNA, 22 bp, Homo sapiens
gagctgggcctgcgagtgctgc

SEQ ID NO: 9177662 - DNA, 22 bp, Homo sapiens
gagctgggcctgcgagtgctgc

SEQ ID NO: 9177663 - DNA, 22 bp, Homo sapiens
atggtccttatggccgtgatat

SEQ ID NO: 9177664 - DNA, 22 bp, Homo sapiens
gagctgggcctcagaacacagt

SEQ ID NO: 9177665 - DNA, 22 bp, Homo sapiens
atggtcagttgcagctaatgtt

SEQ ID NO: 9177666 - DNA, 22 bp, Homo sapiens
atggtcagggcaccctggcccc

SEQ ID NO: 9177667 - DNA, 22 bp, Homo sapiens
gagctgggcgagccggggaagt

SEQ ID NO: 9177668 - DNA, 21 bp, Homo sapiens
gagctgggcgaggctccgggg

SEQ ID NO: 9177669 - DNA, 22 bp, Homo sapiens
gagctgggcgagccggggaagt

SEQ ID NO: 9177670 - DNA, 21 bp, Homo sapiens
gagctgggcgaggctccgggg

SEQ ID NO: 9177671 - DNA, 21 bp, Homo sapiens
gagctgggcgaggctccgggg

SEQ ID NO: 9177672 - DNA, 22 bp, Homo sapiens
gagctgggctggcttcctccct

SEQ ID NO: 9177673 - DNA, 22 bp, Homo sapiens
gagctggggcagcttaggagtg

SEQ ID NO: 9177674 - DNA, 22 bp, Homo sapiens
gagctggggcagcttaggagtg

SEQ ID NO: 9177675 - DNA, 22 bp, Homo sapiens
atgtacatctttataacaagct

SEQ ID NO: 9177676 - DNA, 22 bp, Homo sapiens
atgtacaatctatcacaagaag

SEQ ID NO: 9177677 - DNA, 22 bp, Homo sapiens
atgtagaaagttattgtcactg

SEQ ID NO: 9177678 - DNA, 22 bp, Homo sapiens
atgtactatgcagtcaactgtt

SEQ ID NO: 9177679 - DNA, 19 bp, Homo sapiens
atgtacccagtgtcaatcc

SEQ ID NO: 9177680 - DNA, 22 bp, Homo sapiens
atgtacctctgcattcctgcct

SEQ ID NO: 9177681 - DNA, 22 bp, Homo sapiens
gaggagctgcagggggagtcta

SEQ ID NO: 9177682 - DNA, 22 bp, Homo sapiens
atgtacattttcctaatgtttt

SEQ ID NO: 9177683 - DNA, 22 bp, Homo sapiens
atgtacattttcctaatgtttt

SEQ ID NO: 9177684 - DNA, 18 bp, Homo sapiens
atgtacatgtactcacac

SEQ ID NO: 9177685 - DNA, 21 bp, Homo sapiens
atgtacattcggcaacagata

SEQ ID NO: 9177686 - DNA, 22 bp, Homo sapiens
gaggccaggagtgctgtaagtt

SEQ ID NO: 9177687 - DNA, 22 bp, Homo sapiens
gaggagctgggctgagagggtc

SEQ ID NO: 9177688 - DNA, 22 bp, Homo sapiens
gaggagctggctgtcgggaggc

SEQ ID NO: 9177689 - DNA, 22 bp, Homo sapiens
gaggccaggggagtcagcgtcc

SEQ ID NO: 9177690 - DNA, 22 bp, Homo sapiens
gaggccaggggagtcagcgtcc

SEQ ID NO: 9177691 - DNA, 22 bp, Homo sapiens
gaggccagggatgcaatgagag

SEQ ID NO: 9177692 - DNA, 22 bp, Homo sapiens
gaggccaggggtcagcaattgg

SEQ ID NO: 9177693 - DNA, 22 bp, Homo sapiens
gaggccaggggcctggagatga

SEQ ID NO: 9177694 - DNA, 22 bp, Homo sapiens
gaggccaggggcctggagatga

SEQ ID NO: 9177695 - DNA, 22 bp, Homo sapiens
atgtggctttcatgattaagca

SEQ ID NO: 9177696 - DNA, 22 bp, Homo sapiens
gaggctgctttgatgacaggag

SEQ ID NO: 9177697 - DNA, 22 bp, Homo sapiens
atgtggcttagttaggtgcccc

SEQ ID NO: 9177698 - DNA, 22 bp, Homo sapiens
gaggctgctgttagccctgggc

SEQ ID NO: 9177699 - DNA, 22 bp, Homo sapiens
gaggctgctttcctcctatcct

SEQ ID NO: 9177700 - DNA, 22 bp, Homo sapiens
atgtgtccaaggccacaatagc

SEQ ID NO: 9177701 - DNA, 22 bp, Homo sapiens
gaggggagaaggcactaaccag

SEQ ID NO: 9177702 - DNA, 22 bp, Homo sapiens
atgtgtcctgctgtgtcacaca

SEQ ID NO: 9177703 - DNA, 22 bp, Homo sapiens
gaggggaagacttctggacagt

SEQ ID NO: 9177704 - DNA, 22 bp, Homo sapiens
gaggggaagacttctggacagt

SEQ ID NO: 9177705 - DNA, 22 bp, Homo sapiens
atgtgtccattatcagttctgg

SEQ ID NO: 9177706 - DNA, 22 bp, Homo sapiens
atgtgtcctctggcaggtttag

SEQ ID NO: 9177707 - DNA, 22 bp, Homo sapiens
atgtgtccacaggtgtgagaga

SEQ ID NO: 9177708 - DNA, 22 bp, Homo sapiens
atgtgtattgagcacctactgc

SEQ ID NO: 9177709 - DNA, 22 bp, Homo sapiens
atgtgtattttgtactattggg

SEQ ID NO: 9177710 - DNA, 22 bp, Homo sapiens
atgtgtgtatatatagtcattt

SEQ ID NO: 9177711 - DNA, 22 bp, Homo sapiens
atgtgtgtgcatttctctccct

SEQ ID NO: 9177712 - DNA, 22 bp, Homo sapiens
gaggggagacagggaaatcagt

SEQ ID NO: 9177713 - DNA, 22 bp, Homo sapiens
gaggggagacagggaaatcagt

SEQ ID NO: 9177714 - DNA, 22 bp, Homo sapiens
gaggggagaggcttatggatca

SEQ ID NO: 9177715 - DNA, 22 bp, Homo sapiens
gaggggagcccccatcctccag

SEQ ID NO: 9177716 - DNA, 16 bp, Homo sapiens
gaggggagcagtaggc

SEQ ID NO: 9177717 - DNA, 16 bp, Homo sapiens
gaggggagcagtaggc

SEQ ID NO: 9177718 - DNA, 22 bp, Homo sapiens
gaggggagcatgatctagattg

SEQ ID NO: 9177719 - DNA, 22 bp, Homo sapiens
atgtctttattaatatcatgcc

SEQ ID NO: 9177720 - DNA, 22 bp, Homo sapiens
atgtctttcaaattctgcctag

SEQ ID NO: 9177721 - DNA, 22 bp, Homo sapiens
atgtctttcgcatcagtagcta

SEQ ID NO: 9177722 - DNA, 22 bp, Homo sapiens
atgtctttcaaattctgcctag

SEQ ID NO: 9177723 - DNA, 22 bp, Homo sapiens
atgtctttataaatgtataatg

SEQ ID NO: 9177724 - DNA, 22 bp, Homo sapiens
atgtctttataaatgtataatg

SEQ ID NO: 9177725 - DNA, 22 bp, Homo sapiens
atgtctttaaacttgagttgtt

SEQ ID NO: 9177726 - DNA, 22 bp, Homo sapiens
gaggcctgggttacctactcgt

SEQ ID NO: 9177727 - DNA, 22 bp, Homo sapiens
atgtctgctttccttttaatca

SEQ ID NO: 9177728 - DNA, 19 bp, Homo sapiens
atgtctgggtaacagctgc

SEQ ID NO: 9177729 - DNA, 22 bp, Homo sapiens
gaggcctgggagcctgtcctcc

SEQ ID NO: 9177730 - DNA, 22 bp, Homo sapiens
gaggcctggagccgcctaggcg

SEQ ID NO: 9177731 - DNA, 23 bp, Homo sapiens
gaggcctggccctgccacatctc

SEQ ID NO: 9177732 - DNA, 22 bp, Homo sapiens
gaggcctggagccgcctaggcg

SEQ ID NO: 9177733 - DNA, 23 bp, Homo sapiens
gaggcctggccctgccacatctc

SEQ ID NO: 9177734 - DNA, 22 bp, Homo sapiens
gaggcctggctgtcagtcccca

SEQ ID NO: 9177735 - DNA, 22 bp, Homo sapiens
gaggcctgggagcctgtcctcc

SEQ ID NO: 9177736 - DNA, 22 bp, Homo sapiens
gaggcctggctgtcagtcccca

SEQ ID NO: 9177737 - DNA, 22 bp, Homo sapiens
gaggcctggctctgccctcctg

SEQ ID NO: 9177738 - DNA, 22 bp, Homo sapiens
atgtctttgccatagttcatat

SEQ ID NO: 9177739 - DNA, 22 bp, Homo sapiens
atgtctttgccatagttcatat

SEQ ID NO: 9177740 - DNA, 22 bp, Homo sapiens
atgtctttcttatggtctgttg

SEQ ID NO: 9177741 - DNA, 22 bp, Homo sapiens
atgtctttcttgtgtcccaaga

SEQ ID NO: 9177742 - DNA, 22 bp, Homo sapiens
atgtctttctagttaagagcta

SEQ ID NO: 9177743 - DNA, 22 bp, Homo sapiens
atgtctttctcacagccagttc

SEQ ID NO: 9177744 - DNA, 22 bp, Homo sapiens
atgtctttctagttaagagcta

SEQ ID NO: 9177745 - DNA, 22 bp, Homo sapiens
atgtctttctcatacaagccca

SEQ ID NO: 9177746 - DNA, 22 bp, Homo sapiens
atgtctttctcatacaagccca

SEQ ID NO: 9177747 - DNA, 22 bp, Homo sapiens
atgtctttcttatggtctgttg

SEQ ID NO: 9177748 - DNA, 22 bp, Homo sapiens
atgtcttttatgattacgggat

SEQ ID NO: 9177749 - DNA, 22 bp, Homo sapiens
atgtctttggctttgacatggc

SEQ ID NO: 9177750 - DNA, 22 bp, Homo sapiens
atgtctttgctgtgtgctgggc

SEQ ID NO: 9177751 - DNA, 22 bp, Homo sapiens
atgtcttttatggagatgtcat

SEQ ID NO: 9177752 - DNA, 22 bp, Homo sapiens
atgtcttttatggagatgtcat

SEQ ID NO: 9177753 - DNA, 22 bp, Homo sapiens
atgtgaaaatccaatggcagca

SEQ ID NO: 9177754 - DNA, 22 bp, Homo sapiens
atgtgaaaatccaatggcagca

SEQ ID NO: 9177755 - DNA, 22 bp, Homo sapiens
gaggctgctgagagccctgttt

SEQ ID NO: 9177756 - DNA, 22 bp, Homo sapiens
gaggctgctgttagccctgggc

SEQ ID NO: 9177757 - DNA, 22 bp, Homo sapiens
atgtgaaacctgtgagtagagt

SEQ ID NO: 9177758 - DNA, 21 bp, Homo sapiens
atgtgaaaccttccacgctga

SEQ ID NO: 9177759 - DNA, 22 bp, Homo sapiens
gaggctgccccttcctcagctg

SEQ ID NO: 9177760 - DNA, 22 bp, Homo sapiens
atgccactgcgctctagcctgg

SEQ ID NO: 9177761 - DNA, 22 bp, Homo sapiens
atggaaaaggctgatttcatta

SEQ ID NO: 9177762 - DNA, 22 bp, Homo sapiens
atggaaatgatggaacattaaa

SEQ ID NO: 9177763 - DNA, 22 bp, Homo sapiens
atggaaatggagtgtgcttgct

SEQ ID NO: 9177764 - DNA, 22 bp, Homo sapiens
atggaaatggagggtgctagaa

SEQ ID NO: 9177765 - DNA, 22 bp, Homo sapiens
gacagaggctggagcacctcct

SEQ ID NO: 9177766 - DNA, 22 bp, Homo sapiens
gacagaggcaagaccagaagcc

SEQ ID NO: 9177767 - DNA, 22 bp, Homo sapiens
gacagaggcaagaccagaagcc

SEQ ID NO: 9177768 - DNA, 22 bp, Homo sapiens
gacagaggcaagaccagaagcc

SEQ ID NO: 9177769 - DNA, 22 bp, Homo sapiens
atgccactgcacttcagcttgg

SEQ ID NO: 9177770 - DNA, 22 bp, Homo sapiens
atgccactgcacttcagcttgg

SEQ ID NO: 9177771 - DNA, 22 bp, Homo sapiens
atgccactgcgctccagcctgg

SEQ ID NO: 9177772 - DNA, 22 bp, Homo sapiens
atgccactgcgctccagcctgg

SEQ ID NO: 9177773 - DNA, 22 bp, Homo sapiens
atgccactgcgctccagcctgg

SEQ ID NO: 9177774 - DNA, 22 bp, Homo sapiens
atggaagtgcaacttgctcatc

SEQ ID NO: 9177775 - DNA, 22 bp, Homo sapiens
atggaataattgtttcacagaa

SEQ ID NO: 9177776 - DNA, 22 bp, Homo sapiens
atggactgggaggtcatcttct

SEQ ID NO: 9177777 - DNA, 22 bp, Homo sapiens
atggacatttgagttatttcca

SEQ ID NO: 9177778 - DNA, 22 bp, Homo sapiens
atggaccatgagttttctctgg

SEQ ID NO: 9177779 - DNA, 22 bp, Homo sapiens
atggaaggtcctacagagcgca

SEQ ID NO: 9177780 - DNA, 22 bp, Homo sapiens
atggaaggtcctacagagcgca

SEQ ID NO: 9177781 - DNA, 22 bp, Homo sapiens
atggaaggctttatgactcaaa

SEQ ID NO: 9177782 - DNA, 22 bp, Homo sapiens
gagaacacatgcagactgggta

SEQ ID NO: 9177783 - DNA, 22 bp, Homo sapiens
gagaaatgcatgcatgtcatca

SEQ ID NO: 9177784 - DNA, 22 bp, Homo sapiens
gagaaatatggctcagttccac

SEQ ID NO: 9177785 - DNA, 20 bp, Homo sapiens
atggaggaagggcaagagaa

SEQ ID NO: 9177786 - DNA, 20 bp, Homo sapiens
atggaggaagggcaagagaa

SEQ ID NO: 9177787 - DNA, 18 bp, Homo sapiens
gagaaagtttgggcagaa

SEQ ID NO: 9177788 - DNA, 18 bp, Homo sapiens
gagaaagtttgggcagaa

SEQ ID NO: 9177789 - DNA, 22 bp, Homo sapiens
gagaaatagattcatggtagat

SEQ ID NO: 9177790 - DNA, 22 bp, Homo sapiens
gagaaataggcaatggtatcta

SEQ ID NO: 9177791 - DNA, 22 bp, Homo sapiens
gagaaatatggctcagttccac

SEQ ID NO: 9177792 - DNA, 22 bp, Homo sapiens
atggagagtgaaagtctctcta

SEQ ID NO: 9177793 - DNA, 22 bp, Homo sapiens
atggcccaaactgcaattactt

SEQ ID NO: 9177794 - DNA, 22 bp, Homo sapiens
atggccatgccagtttacagcc

SEQ ID NO: 9177795 - DNA, 19 bp, Homo sapiens
atggccagtttagaggttt

SEQ ID NO: 9177796 - DNA, 22 bp, Homo sapiens
atggccctggaaagagcttgag

SEQ ID NO: 9177797 - DNA, 22 bp, Homo sapiens
gagccagccttcttctgaggtc

SEQ ID NO: 9177798 - DNA, 22 bp, Homo sapiens
gagccagcctccgcctctctcc

SEQ ID NO: 9177799 - DNA, 22 bp, Homo sapiens
gagccagctatgtagcaagagg

SEQ ID NO: 9177800 - DNA, 22 bp, Homo sapiens
gagccagctgagctgcactgtc

SEQ ID NO: 9177801 - DNA, 22 bp, Homo sapiens
gagccagctacatggtctgcaa

SEQ ID NO: 9177802 - DNA, 22 bp, Homo sapiens
gagccaggaggcagagactgca

SEQ ID NO: 9177803 - DNA, 22 bp, Homo sapiens
gagccaggagatacctaagggg

SEQ ID NO: 9177804 - DNA, 22 bp, Homo sapiens
gagccaggaggcagagactgca

SEQ ID NO: 9177805 - DNA, 22 bp, Homo sapiens
gagccaggaagaaggccttact

SEQ ID NO: 9177806 - DNA, 22 bp, Homo sapiens
atggctgcttacaaaaactgtg

SEQ ID NO: 9177807 - DNA, 22 bp, Homo sapiens
atggctgccttaattcttcagc

SEQ ID NO: 9177808 - DNA, 22 bp, Homo sapiens
gagccagggagggtctggtata

SEQ ID NO: 9177809 - DNA, 22 bp, Homo sapiens
gagccaggcccgtacttgctgt

SEQ ID NO: 9177810 - DNA, 22 bp, Homo sapiens
gagccaggcaccttctgtgttg

SEQ ID NO: 9177811 - DNA, 22 bp, Homo sapiens
atggcagggactgtggcccttg

SEQ ID NO: 9177812 - DNA, 22 bp, Homo sapiens
atggcagggaccaagctgtcat

SEQ ID NO: 9177813 - DNA, 22 bp, Homo sapiens
atggcagtgacttgaagggtag

SEQ ID NO: 9177814 - DNA, 22 bp, Homo sapiens
atggcagggcccttggctccca

SEQ ID NO: 9177815 - DNA, 22 bp, Homo sapiens
atggcagtatttctgaaaggct

SEQ ID NO: 9177816 - DNA, 22 bp, Homo sapiens
gagaacagatttttctgctgtc

SEQ ID NO: 9177817 - DNA, 23 bp, Homo sapiens
gagaacagccacagagagctgtg

SEQ ID NO: 9177818 - DNA, 22 bp, Homo sapiens
atggcagagggattgaacagct

SEQ ID NO: 9177819 - DNA, 22 bp, Homo sapiens
gagaacagaagcattcctaatt

SEQ ID NO: 9177820 - DNA, 22 bp, Homo sapiens
gagaacagatttttctgctgtc

SEQ ID NO: 9177821 - DNA, 22 bp, Homo sapiens
atggcagagggattgaacagct

SEQ ID NO: 9177822 - DNA, 22 bp, Homo sapiens
atggcagagggattgaacagct

SEQ ID NO: 9177823 - DNA, 22 bp, Homo sapiens
gagaggaagccttctgtacttg

SEQ ID NO: 9177824 - DNA, 22 bp, Homo sapiens
gagaggaagccttctgtacttg

SEQ ID NO: 9177825 - DNA, 22 bp, Homo sapiens
atggccagattatatggttttt

SEQ ID NO: 9177826 - DNA, 22 bp, Homo sapiens
atggccagattatatggttttt

SEQ ID NO: 9177827 - DNA, 22 bp, Homo sapiens
atggccagtctattcatggtta

SEQ ID NO: 9177828 - DNA, 22 bp, Homo sapiens
atggccagtctattcatggtta

SEQ ID NO: 9177829 - DNA, 22 bp, Homo sapiens
atggccagtctgactagtttcc

SEQ ID NO: 9177830 - DNA, 22 bp, Homo sapiens
atggccagtctgactagtttcc

SEQ ID NO: 9177831 - DNA, 22 bp, Homo sapiens
atggccagtctgttggacagca

SEQ ID NO: 9177832 - DNA, 22 bp, Homo sapiens
gagaggaactcccagtgcctgg

SEQ ID NO: 9177833 - DNA, 22 bp, Homo sapiens
gagaggaactcccagtgcctgg

SEQ ID NO: 9177834 - DNA, 22 bp, Homo sapiens
gagaggaaagaaccaatgaccc

SEQ ID NO: 9177835 - DNA, 22 bp, Homo sapiens
gagaggaaagatatatacttct

SEQ ID NO: 9177836 - DNA, 22 bp, Homo sapiens
atggcagtttcactctgggatt

SEQ ID NO: 9177837 - DNA, 22 bp, Homo sapiens
gagagctgtccggctgagcagc

SEQ ID NO: 9177838 - DNA, 22 bp, Homo sapiens
gagagctgtccggctgagcagc

SEQ ID NO: 9177839 - DNA, 22 bp, Homo sapiens
gagagctgtccggctgagcagc

SEQ ID NO: 9177840 - DNA, 22 bp, Homo sapiens
gagaggaaagaaccaatgaccc

SEQ ID NO: 9177841 - DNA, 22 bp, Homo sapiens
gagagctttcccattttgctta

SEQ ID NO: 9177842 - DNA, 22 bp, Homo sapiens
gagagctgtgttcattctacca

SEQ ID NO: 9177843 - DNA, 22 bp, Homo sapiens
gagagctgtttatcttcttcaa

SEQ ID NO: 9177844 - DNA, 22 bp, Homo sapiens
gagagctgtggtttgaccaggc

SEQ ID NO: 9177845 - DNA, 22 bp, Homo sapiens
gagagctgtggtttgaccaggc

SEQ ID NO: 9177846 - DNA, 22 bp, Homo sapiens
gagagctgtggtttgaccaggc

SEQ ID NO: 9177847 - DNA, 22 bp, Homo sapiens
cagaaatgacaaagtaagagga

SEQ ID NO: 9177848 - DNA, 22 bp, Homo sapiens
cagaactgacctctgattctag

SEQ ID NO: 9177849 - DNA, 22 bp, Homo sapiens
cagaactgggcagggagcagag

SEQ ID NO: 9177850 - DNA, 22 bp, Homo sapiens
cagaactgggcagggagcagag

SEQ ID NO: 9177851 - DNA, 22 bp, Homo sapiens
cagaactggcctttcatcagtc

SEQ ID NO: 9177852 - DNA, 22 bp, Homo sapiens
cagaactgagtctcatggccat

SEQ ID NO: 9177853 - DNA, 22 bp, Homo sapiens
cagaactggcctttcatcagtc

SEQ ID NO: 9177854 - DNA, 22 bp, Homo sapiens
cagaactgagtctcatggccat

SEQ ID NO: 9177855 - DNA, 23 bp, Homo sapiens
cagaaatctgaaatctagaaatg

SEQ ID NO: 9177856 - DNA, 22 bp, Homo sapiens
cagaaatgacaaagtaagagga

SEQ ID NO: 9177857 - DNA, 22 bp, Homo sapiens
agccacagcctgacttaactgt

SEQ ID NO: 9177858 - DNA, 22 bp, Homo sapiens
agccacagcctgacttaactgt

SEQ ID NO: 9177859 - DNA, 23 bp, Homo sapiens
agccacagccagagctatctcca

SEQ ID NO: 9177860 - DNA, 22 bp, Homo sapiens
agccacagcccacaggactctt

SEQ ID NO: 9177861 - DNA, 23 bp, Homo sapiens
agccacagccagagctatctcca

SEQ ID NO: 9177862 - DNA, 22 bp, Homo sapiens
agccacagagagggagctgcaa

SEQ ID NO: 9177863 - DNA, 22 bp, Homo sapiens
agccacagagcaggagaccttt

SEQ ID NO: 9177864 - DNA, 22 bp, Homo sapiens
agccacagaggttgatgtggtt

SEQ ID NO: 9177865 - DNA, 19 bp, Homo sapiens
agccacagaacttgcagga

SEQ ID NO: 9177866 - DNA, 22 bp, Homo sapiens
agccacagagagggagctgcaa

SEQ ID NO: 9177867 - DNA, 19 bp, Homo sapiens
agccacagaacttgcagga

SEQ ID NO: 9177868 - DNA, 22 bp, Homo sapiens
cactgaaacaggtattgctggt

SEQ ID NO: 9177869 - DNA, 22 bp, Homo sapiens
agccaaggaaagccctttgctg

SEQ ID NO: 9177870 - DNA, 22 bp, Homo sapiens
agccaattgtccatctttagct

SEQ ID NO: 9177871 - DNA, 22 bp, Homo sapiens
agccacaaaggcttgcctcgga

SEQ ID NO: 9177872 - DNA, 22 bp, Homo sapiens
agccacacctgtcctgccagct

SEQ ID NO: 9177873 - DNA, 22 bp, Homo sapiens
agccaggacgttgctcagctcc

SEQ ID NO: 9177874 - DNA, 22 bp, Homo sapiens
agccaggacgttgctcagctcc

SEQ ID NO: 9177875 - DNA, 22 bp, Homo sapiens
agccaggacgttgctcagctcc

SEQ ID NO: 9177876 - DNA, 22 bp, Homo sapiens
agccaggatcacccggggctgt

SEQ ID NO: 9177877 - DNA, 22 bp, Homo sapiens
agccaggatggtctcgatcggc

SEQ ID NO: 9177878 - DNA, 22 bp, Homo sapiens
cagaagctttgtctagtcttga

SEQ ID NO: 9177879 - DNA, 22 bp, Homo sapiens
cagaagctttgctcataaccat

SEQ ID NO: 9177880 - DNA, 17 bp, Homo sapiens
cagaaggaagcatggca

SEQ ID NO: 9177881 - DNA, 22 bp, Homo sapiens
agccaggacatctctagctgct

SEQ ID NO: 9177882 - DNA, 22 bp, Homo sapiens
cagacagaaggctccttgaggt

SEQ ID NO: 9177883 - DNA, 22 bp, Homo sapiens
cagacagaaggctccttgaggt

SEQ ID NO: 9177884 - DNA, 22 bp, Homo sapiens
agccaggcagggctctcgctct

SEQ ID NO: 9177885 - DNA, 22 bp, Homo sapiens
cagacagaaggctccttgaggt

SEQ ID NO: 9177886 - DNA, 22 bp, Homo sapiens
agccaggatggtctcgatcggc

SEQ ID NO: 9177887 - DNA, 21 bp, Homo sapiens
agccaggcaagcacccccact

SEQ ID NO: 9177888 - DNA, 22 bp, Homo sapiens
agccaggattggctgagcctta

SEQ ID NO: 9177889 - DNA, 22 bp, Homo sapiens
agccaggcagactctctttctt

SEQ ID NO: 9177890 - DNA, 22 bp, Homo sapiens
cagaagaatggtgtctgagctc

SEQ ID NO: 9177891 - DNA, 22 bp, Homo sapiens
cagaagaaatcattatctggac

SEQ ID NO: 9177892 - DNA, 22 bp, Homo sapiens
cagaagaaatcattatctggac

SEQ ID NO: 9177893 - DNA, 22 bp, Homo sapiens
cagaactgttataacagctgtt

SEQ ID NO: 9177894 - DNA, 22 bp, Homo sapiens
cagaactgttataacagctgtt

SEQ ID NO: 9177895 - DNA, 22 bp, Homo sapiens
cagaactgggctcgctctggtt

SEQ ID NO: 9177896 - DNA, 22 bp, Homo sapiens
cagaactgggctcgctctggtt

SEQ ID NO: 9177897 - DNA, 22 bp, Homo sapiens
cagaagaaagtggggagacaag

SEQ ID NO: 9177898 - DNA, 22 bp, Homo sapiens
cagaagaaagtggggagacaag

SEQ ID NO: 9177899 - DNA, 22 bp, Homo sapiens
cagaagaaagtggggagacaag

SEQ ID NO: 9177900 - DNA, 22 bp, Homo sapiens
cagaagcctaaatagtgcacca

SEQ ID NO: 9177901 - DNA, 22 bp, Homo sapiens
cagaagcctgcctcagatgcac

SEQ ID NO: 9177902 - DNA, 22 bp, Homo sapiens
cagaagctgcagtgatctggga

SEQ ID NO: 9177903 - DNA, 22 bp, Homo sapiens
cagaagcctgcctcagatgcac

SEQ ID NO: 9177904 - DNA, 19 bp, Homo sapiens
cagaagctgcagtcggata

SEQ ID NO: 9177905 - DNA, 19 bp, Homo sapiens
cagaagctgcagtcggata

SEQ ID NO: 9177906 - DNA, 22 bp, Homo sapiens
cagaagcagtgagagatgtgca

SEQ ID NO: 9177907 - DNA, 22 bp, Homo sapiens
cagaagcattccagcaaatagt

SEQ ID NO: 9177908 - DNA, 22 bp, Homo sapiens
cagaagcagtgagagatgtgca

SEQ ID NO: 9177909 - DNA, 22 bp, Homo sapiens
cagaagcattccagcaaatagt

SEQ ID NO: 9177910 - DNA, 22 bp, Homo sapiens
cagaagcattccagcaaatagt

SEQ ID NO: 9177911 - DNA, 23 bp, Homo sapiens
cagagctggctcagagctgcctg

SEQ ID NO: 9177912 - DNA, 23 bp, Homo sapiens
cagagctggctcagagctgcctg

SEQ ID NO: 9177913 - DNA, 22 bp, Homo sapiens
agcccctgtttttccagtcaga

SEQ ID NO: 9177914 - DNA, 19 bp, Homo sapiens
agcccccagacagcaggcc

SEQ ID NO: 9177915 - DNA, 22 bp, Homo sapiens
cagagctggagggaaccctggc

SEQ ID NO: 9177916 - DNA, 22 bp, Homo sapiens
cagagctggagggaaccctggc

SEQ ID NO: 9177917 - DNA, 22 bp, Homo sapiens
cagagctggagggaaccctggc

SEQ ID NO: 9177918 - DNA, 22 bp, Homo sapiens
cagagctggcctgtgatttttg

SEQ ID NO: 9177919 - DNA, 23 bp, Homo sapiens
cagagctggctcagagctgcctg

SEQ ID NO: 9177920 - DNA, 22 bp, Homo sapiens
cagagctggcggtgagaagaca

SEQ ID NO: 9177921 - DNA, 22 bp, Homo sapiens
cagagctggcggtgagaagaca

SEQ ID NO: 9177922 - DNA, 22 bp, Homo sapiens
agccctcatggaacagctccta

SEQ ID NO: 9177923 - DNA, 22 bp, Homo sapiens
agccctcaggctttgctgggcc

SEQ ID NO: 9177924 - DNA, 22 bp, Homo sapiens
agccctagagaaccagcctgtg

SEQ ID NO: 9177925 - DNA, 22 bp, Homo sapiens
agccctagagaaccagcctgtg

SEQ ID NO: 9177926 - DNA, 22 bp, Homo sapiens
agcccggcttccccggttgcta

SEQ ID NO: 9177927 - DNA, 19 bp, Homo sapiens
agccccttggtactgtcct

SEQ ID NO: 9177928 - DNA, 22 bp, Homo sapiens
agccccttgtgggcgcacagca

SEQ ID NO: 9177929 - DNA, 22 bp, Homo sapiens
agccccttgcacttccccacgc

SEQ ID NO: 9177930 - DNA, 22 bp, Homo sapiens
agcccaggagcctttggagggt

SEQ ID NO: 9177931 - DNA, 22 bp, Homo sapiens
agcccaggagcctttggagggt

SEQ ID NO: 9177932 - DNA, 22 bp, Homo sapiens
agcccaggaggtggaggttgca

SEQ ID NO: 9177933 - DNA, 22 bp, Homo sapiens
agcccaggaggtggaggttgca

SEQ ID NO: 9177934 - DNA, 22 bp, Homo sapiens
agcccaggaggtggaggttgca

SEQ ID NO: 9177935 - DNA, 22 bp, Homo sapiens
agcccaggaggtggaggttgca

SEQ ID NO: 9177936 - DNA, 22 bp, Homo sapiens
agcccaggaagttgaggcttgc

SEQ ID NO: 9177937 - DNA, 22 bp, Homo sapiens
agcccaggaatctgcatcttga

SEQ ID NO: 9177938 - DNA, 22 bp, Homo sapiens
agcccaggaagttgaggcttgc

SEQ ID NO: 9177939 - DNA, 22 bp, Homo sapiens
agcccagctttgaaccatatca

SEQ ID NO: 9177940 - DNA, 22 bp, Homo sapiens
agcccaggagtttgaggctgtg

SEQ ID NO: 9177941 - DNA, 22 bp, Homo sapiens
agcccaggagtttgaggctgtg

SEQ ID NO: 9177942 - DNA, 22 bp, Homo sapiens
agcccaggagtttgaggctgtg

SEQ ID NO: 9177943 - DNA, 22 bp, Homo sapiens
agcccaggagtttgaggctgtg

SEQ ID NO: 9177944 - DNA, 22 bp, Homo sapiens
agcccaggagtccttaaggacc

SEQ ID NO: 9177945 - DNA, 22 bp, Homo sapiens
agcccaggagtccttaaggacc

SEQ ID NO: 9177946 - DNA, 22 bp, Homo sapiens
cagagctggacttaaatatatt

SEQ ID NO: 9177947 - DNA, 22 bp, Homo sapiens
cagagctgcttcccagtttgtg

SEQ ID NO: 9177948 - DNA, 22 bp, Homo sapiens
agcccaggagtttgaggctgtg

SEQ ID NO: 9177949 - DNA, 22 bp, Homo sapiens
cagagctgcttcccagtttgtg

SEQ ID NO: 9177950 - DNA, 22 bp, Homo sapiens
cagagctggagaagtggattta

SEQ ID NO: 9177951 - DNA, 22 bp, Homo sapiens
cagagctggagcttgaatggag

SEQ ID NO: 9177952 - DNA, 22 bp, Homo sapiens
cagagagggagcagtagtctct

SEQ ID NO: 9177953 - DNA, 22 bp, Homo sapiens
cagagagggcggccctggcttc

SEQ ID NO: 9177954 - DNA, 22 bp, Homo sapiens
cagagagggagcagtagtctct

SEQ ID NO: 9177955 - DNA, 22 bp, Homo sapiens
agccagtgatgaagactctgga

SEQ ID NO: 9177956 - DNA, 22 bp, Homo sapiens
agccagtgatgaagactctgga

SEQ ID NO: 9177957 - DNA, 22 bp, Homo sapiens
agccagtcagccatgcttacct

SEQ ID NO: 9177958 - DNA, 19 bp, Homo sapiens
agccagtgagcctctgggt

SEQ ID NO: 9177959 - DNA, 22 bp, Homo sapiens
cagagcacacatgcatagagtg

SEQ ID NO: 9177960 - DNA, 22 bp, Homo sapiens
cagagcaacaccctttacatcg

SEQ ID NO: 9177961 - DNA, 22 bp, Homo sapiens
cagagagggcggccctggcttc

SEQ ID NO: 9177962 - DNA, 22 bp, Homo sapiens
cagagatgaggtcgttactcag

SEQ ID NO: 9177963 - DNA, 22 bp, Homo sapiens
cagagagtggcagttactgaag

SEQ ID NO: 9177964 - DNA, 22 bp, Homo sapiens
cagagatggggccagctgctcc

SEQ ID NO: 9177965 - DNA, 20 bp, Homo sapiens
agccagggttctggatgcac

SEQ ID NO: 9177966 - DNA, 22 bp, Homo sapiens
agccaggggattcatcagggac

SEQ ID NO: 9177967 - DNA, 23 bp, Homo sapiens
agccaggggatcttgggccctgg

SEQ ID NO: 9177968 - DNA, 22 bp, Homo sapiens
agccagggtgggtgaatgctat

SEQ ID NO: 9177969 - DNA, 22 bp, Homo sapiens
agccaggtactcttgtgaccat

SEQ ID NO: 9177970 - DNA, 22 bp, Homo sapiens
agccaggtcagctcaccctgct

SEQ ID NO: 9177971 - DNA, 22 bp, Homo sapiens
agccaggtcaggaaaggtccca

SEQ ID NO: 9177972 - DNA, 18 bp, Homo sapiens
agccaggtggaatggaac

SEQ ID NO: 9177973 - DNA, 22 bp, Homo sapiens
agccaggtttctttagctgtca

SEQ ID NO: 9177974 - DNA, 22 bp, Homo sapiens
agccaggtttctttagctgtca

SEQ ID NO: 9177975 - DNA, 22 bp, Homo sapiens
agccaggttaaaccacagtcaa

SEQ ID NO: 9177976 - DNA, 22 bp, Homo sapiens
agccaggttaaaccacagtcaa

SEQ ID NO: 9177977 - DNA, 22 bp, Homo sapiens
cagacagacctgcaagggcaca

SEQ ID NO: 9177978 - DNA, 22 bp, Homo sapiens
cagacagacagccgtggccacc

SEQ ID NO: 9177979 - DNA, 22 bp, Homo sapiens
cagacagaggctgtatgagggc

SEQ ID NO: 9177980 - DNA, 22 bp, Homo sapiens
cagacagagtcttcccatcagt

SEQ ID NO: 9177981 - DNA, 22 bp, Homo sapiens
cagacagagtcttcccatcagt

SEQ ID NO: 9177982 - DNA, 17 bp, Homo sapiens
cagacagatatcctggg

SEQ ID NO: 9177983 - DNA, 22 bp, Homo sapiens
cagacagcaaatctgcttgcat

SEQ ID NO: 9177984 - DNA, 22 bp, Homo sapiens
cagacagcgagcggaggggctt

SEQ ID NO: 9177985 - DNA, 22 bp, Homo sapiens
cagacagctgctttcttgctgt

SEQ ID NO: 9177986 - DNA, 22 bp, Homo sapiens
agctcccattatcttctgaaac

SEQ ID NO: 9177987 - DNA, 22 bp, Homo sapiens
agctccccacgtctctgtcttt

SEQ ID NO: 9177988 - DNA, 22 bp, Homo sapiens
agctcccctcgtttctctccat

SEQ ID NO: 9177989 - DNA, 22 bp, Homo sapiens
agctccctgagatgccacagca

SEQ ID NO: 9177990 - DNA, 22 bp, Homo sapiens
agctcccaggcagtcatgagga

SEQ ID NO: 9177991 - DNA, 22 bp, Homo sapiens
agctcccagcagagctggccac

SEQ ID NO: 9177992 - DNA, 22 bp, Homo sapiens
agctccagggaaagagtggatc

SEQ ID NO: 9177993 - DNA, 22 bp, Homo sapiens
agctccagggaaagagtggatc

SEQ ID NO: 9177994 - DNA, 22 bp, Homo sapiens
agctccagggaaagagtggatc

SEQ ID NO: 9177995 - DNA, 22 bp, Homo sapiens
cagccagcctctcaaccatgca

SEQ ID NO: 9177996 - DNA, 22 bp, Homo sapiens
cagccagcctctcaaccatgca

SEQ ID NO: 9177997 - DNA, 22 bp, Homo sapiens
cagccagatcagggcaggggtt

SEQ ID NO: 9177998 - DNA, 22 bp, Homo sapiens
cagccagatcaaactcagatgt

SEQ ID NO: 9177999 - DNA, 22 bp, Homo sapiens
cagccagaggggccagagtcgg

SEQ ID NO: 9178000 - DNA, 22 bp, Homo sapiens
cagccagaggctgcgaggggcc

SEQ ID NO: 9178001 - DNA, 22 bp, Homo sapiens
cagccagagaggaaggaatgca

SEQ ID NO: 9178002 - DNA, 22 bp, Homo sapiens
cagccagagaggaaggaatgca

SEQ ID NO: 9178003 - DNA, 22 bp, Homo sapiens
agctcctcctgagtgtctggga

SEQ ID NO: 9178004 - DNA, 21 bp, Homo sapiens
agctccctgtttcctcactct

SEQ ID NO: 9178005 - DNA, 22 bp, Homo sapiens
cagccctggcgcccccagatct

SEQ ID NO: 9178006 - DNA, 22 bp, Homo sapiens
cagccctggctagggcgagggc

SEQ ID NO: 9178007 - DNA, 22 bp, Homo sapiens
cagccctgggtccctgccctgg

SEQ ID NO: 9178008 - DNA, 22 bp, Homo sapiens
cagccctgggagttggggccga

SEQ ID NO: 9178009 - DNA, 22 bp, Homo sapiens
cagcaggagcagtcagactcct

SEQ ID NO: 9178010 - DNA, 22 bp, Homo sapiens
cagcaggaggcatggcttccct

SEQ ID NO: 9178011 - DNA, 22 bp, Homo sapiens
cagcaggaggcatggcttccct

SEQ ID NO: 9178012 - DNA, 23 bp, Homo sapiens
cagcaggagggtgcctgggctgc

SEQ ID NO: 9178013 - DNA, 22 bp, Homo sapiens
cagcaggaggcatggcttccct

SEQ ID NO: 9178014 - DNA, 22 bp, Homo sapiens
cagcaggaccattgaggcatca

SEQ ID NO: 9178015 - DNA, 22 bp, Homo sapiens
cagcaggaccattgaggcatca

SEQ ID NO: 9178016 - DNA, 22 bp, Homo sapiens
cagcaggacgtccaagtgctat

SEQ ID NO: 9178017 - DNA, 22 bp, Homo sapiens
cagcaggacccaggaatcctgc

SEQ ID NO: 9178018 - DNA, 22 bp, Homo sapiens
cagcaggacgtccaagtgctat

SEQ ID NO: 9178019 - DNA, 22 bp, Homo sapiens
cagcaggagcagtcagactcct

SEQ ID NO: 9178020 - DNA, 22 bp, Homo sapiens
cagcaggacgtccaagtgctat

SEQ ID NO: 9178021 - DNA, 22 bp, Homo sapiens
agccttctctgaaattctgttt

SEQ ID NO: 9178022 - DNA, 22 bp, Homo sapiens
agccttgaacactgactgaagg

SEQ ID NO: 9178023 - DNA, 22 bp, Homo sapiens
agccttgatcttggtaacagga

SEQ ID NO: 9178024 - DNA, 22 bp, Homo sapiens
agccttgagttcaagtgctggc

SEQ ID NO: 9178025 - DNA, 22 bp, Homo sapiens
agccttgacactggggaaactg

SEQ ID NO: 9178026 - DNA, 22 bp, Homo sapiens
agccttgttgctaccagatgcc

SEQ ID NO: 9178027 - DNA, 22 bp, Homo sapiens
agccttgggcaatttggacact

SEQ ID NO: 9178028 - DNA, 22 bp, Homo sapiens
agccttggactgaatactttag

SEQ ID NO: 9178029 - DNA, 22 bp, Homo sapiens
agctcacagcctagcactgtga

SEQ ID NO: 9178030 - DNA, 21 bp, Homo sapiens
agctcacagttctgtcctgtc

SEQ ID NO: 9178031 - DNA, 22 bp, Homo sapiens
agctcacattctcatcagatgt

SEQ ID NO: 9178032 - DNA, 22 bp, Homo sapiens
agctcagaaatgccagtaggta

SEQ ID NO: 9178033 - DNA, 22 bp, Homo sapiens
agctcagaagcctatgcatagt

SEQ ID NO: 9178034 - DNA, 22 bp, Homo sapiens
agctcagaagggaggaaatgag

SEQ ID NO: 9178035 - DNA, 22 bp, Homo sapiens
agctcacagaaatcctgcagga

SEQ ID NO: 9178036 - DNA, 18 bp, Homo sapiens
agctcacagatctgtttt

SEQ ID NO: 9178037 - DNA, 22 bp, Homo sapiens
agctcacacctcatcagggtgg

SEQ ID NO: 9178038 - DNA, 22 bp, Homo sapiens
agctaggagattttgtgaggct

SEQ ID NO: 9178039 - DNA, 22 bp, Homo sapiens
agctaggagattttgtgaggct

SEQ ID NO: 9178040 - DNA, 22 bp, Homo sapiens
agctaggataagcagagactgg

SEQ ID NO: 9178041 - DNA, 22 bp, Homo sapiens
cagcaggataggtttctttgga

SEQ ID NO: 9178042 - DNA, 22 bp, Homo sapiens
cagcaggaggtgagtagcaggt

SEQ ID NO: 9178043 - DNA, 22 bp, Homo sapiens
cagcaggaggtgagatgtgacc

SEQ ID NO: 9178044 - DNA, 22 bp, Homo sapiens
cagcaggaggtgagatgtgacc

SEQ ID NO: 9178045 - DNA, 22 bp, Homo sapiens
cagcagaggcacgtctgtgaat

SEQ ID NO: 9178046 - DNA, 22 bp, Homo sapiens
cagcagaggcacgtctgtgaat

SEQ ID NO: 9178047 - DNA, 22 bp, Homo sapiens
cagcagagcttattaactaaaa

SEQ ID NO: 9178048 - DNA, 22 bp, Homo sapiens
cagcagaggaaagcaaatctaa

SEQ ID NO: 9178049 - DNA, 22 bp, Homo sapiens
cagcagaggtggttcacattgt

SEQ ID NO: 9178050 - DNA, 22 bp, Homo sapiens
cagcagagggagccattgaaat

SEQ ID NO: 9178051 - DNA, 22 bp, Homo sapiens
cagcagagggagccattgaaat

SEQ ID NO: 9178052 - DNA, 22 bp, Homo sapiens
cagcagagggagccattgaaat

SEQ ID NO: 9178053 - DNA, 22 bp, Homo sapiens
cagcagaggtggttcacattgt

SEQ ID NO: 9178054 - DNA, 22 bp, Homo sapiens
cagcagaggttggaacagttct

SEQ ID NO: 9178055 - DNA, 22 bp, Homo sapiens
cagcagaggttggaacagttct

SEQ ID NO: 9178056 - DNA, 22 bp, Homo sapiens
agcctccaaatgtcaggtcccg

SEQ ID NO: 9178057 - DNA, 22 bp, Homo sapiens
agcctccacagatgcaaagggc

SEQ ID NO: 9178058 - DNA, 22 bp, Homo sapiens
agcctcagtgtcaccatctacc

SEQ ID NO: 9178059 - DNA, 22 bp, Homo sapiens
cagcagagcttatgttgggtca

SEQ ID NO: 9178060 - DNA, 22 bp, Homo sapiens
cagcagagcttatgttgggtca

SEQ ID NO: 9178061 - DNA, 22 bp, Homo sapiens
agcctccatctcccatctgtga

SEQ ID NO: 9178062 - DNA, 22 bp, Homo sapiens
cagcagaggttttgctccatga

SEQ ID NO: 9178063 - DNA, 22 bp, Homo sapiens
cagcagcagccccaggaaggtt

SEQ ID NO: 9178064 - DNA, 22 bp, Homo sapiens
cagcagcagccccaggaaggtt

SEQ ID NO: 9178065 - DNA, 22 bp, Homo sapiens
cagcagaggttttgctccatga

SEQ ID NO: 9178066 - DNA, 22 bp, Homo sapiens
cagcagcaggcgcacggccgtc

SEQ ID NO: 9178067 - DNA, 22 bp, Homo sapiens
cagcagcagtggctgcagaaca

SEQ ID NO: 9178068 - DNA, 22 bp, Homo sapiens
cagcagcatcaggtctgtggtt

SEQ ID NO: 9178069 - DNA, 22 bp, Homo sapiens
cagcagcagtgttctagaatct

SEQ ID NO: 9178070 - DNA, 22 bp, Homo sapiens
agcctggtttaagcattttata

SEQ ID NO: 9178071 - DNA, 22 bp, Homo sapiens
agccttcagtaaatccactgtg

SEQ ID NO: 9178072 - DNA, 22 bp, Homo sapiens
cagaggcctttctacagtgata

SEQ ID NO: 9178073 - DNA, 22 bp, Homo sapiens
cagaggctaagagtgtccaaag

SEQ ID NO: 9178074 - DNA, 22 bp, Homo sapiens
cagaggctaagatgagtgggtg

SEQ ID NO: 9178075 - DNA, 22 bp, Homo sapiens
cagaggctaagggtagcttggg

SEQ ID NO: 9178076 - DNA, 22 bp, Homo sapiens
cagaggctaagatgagtgggtg

SEQ ID NO: 9178077 - DNA, 22 bp, Homo sapiens
cagaggctaagatgagtgggtg

SEQ ID NO: 9178078 - DNA, 22 bp, Homo sapiens
cagcacacagtgactcgcacct

SEQ ID NO: 9178079 - DNA, 19 bp, Homo sapiens
cagcaagaatgaaggcata

SEQ ID NO: 9178080 - DNA, 20 bp, Homo sapiens
cagcacagagcttggctcta

SEQ ID NO: 9178081 - DNA, 20 bp, Homo sapiens
cagcacagagcttggctcta

SEQ ID NO: 9178082 - DNA, 22 bp, Homo sapiens
cagaggctcagatggccctggc

SEQ ID NO: 9178083 - DNA, 22 bp, Homo sapiens
cagaggctcagatggccctggc

SEQ ID NO: 9178084 - DNA, 22 bp, Homo sapiens
cagaggctcagatggccctggc

SEQ ID NO: 9178085 - DNA, 19 bp, Homo sapiens
cagcaagaatgaaggcata

SEQ ID NO: 9178086 - DNA, 22 bp, Homo sapiens
cagcaagaatcagacaacctca

SEQ ID NO: 9178087 - DNA, 22 bp, Homo sapiens
cagaggctcttcctcactgccc

SEQ ID NO: 9178088 - DNA, 22 bp, Homo sapiens
cagaggctcagatggccctggc

SEQ ID NO: 9178089 - DNA, 22 bp, Homo sapiens
cagaggctcagatggccctggc

SEQ ID NO: 9178090 - DNA, 22 bp, Homo sapiens
cagaggctcaccagcctttcac

SEQ ID NO: 9178091 - DNA, 22 bp, Homo sapiens
cagaggctagactgtgcttcct

SEQ ID NO: 9178092 - DNA, 22 bp, Homo sapiens
cagaggctagactgtgcttcct

SEQ ID NO: 9178093 - DNA, 22 bp, Homo sapiens
cagcacagggacaatagcagat

SEQ ID NO: 9178094 - DNA, 22 bp, Homo sapiens
cagcacagggacaatagcagat

SEQ ID NO: 9178095 - DNA, 22 bp, Homo sapiens
cagcacaggcctgtctttgtct

SEQ ID NO: 9178096 - DNA, 22 bp, Homo sapiens
cagcacaggcaggggaactata

SEQ ID NO: 9178097 - DNA, 22 bp, Homo sapiens
cagcacaggcccctctctccca

SEQ ID NO: 9178098 - DNA, 22 bp, Homo sapiens
cagcacaggcccctctctccca

SEQ ID NO: 9178099 - DNA, 22 bp, Homo sapiens
cagcacaggcccctctctccca

SEQ ID NO: 9178100 - DNA, 22 bp, Homo sapiens
cagcacaggcctgtctttgtct

SEQ ID NO: 9178101 - DNA, 22 bp, Homo sapiens
cagcacaggcctgtctttgtct

SEQ ID NO: 9178102 - DNA, 22 bp, Homo sapiens
cagcacagctggctctggaagc

SEQ ID NO: 9178103 - DNA, 22 bp, Homo sapiens
cagcacagctgaggggctgtct

SEQ ID NO: 9178104 - DNA, 22 bp, Homo sapiens
cagcacaggaagtgggccttca

SEQ ID NO: 9178105 - DNA, 22 bp, Homo sapiens
cagcacaggaatatggtggaca

SEQ ID NO: 9178106 - DNA, 22 bp, Homo sapiens
cagcacaggaatatggtggaca

SEQ ID NO: 9178107 - DNA, 22 bp, Homo sapiens
cagcacaggaatatggtggaca

SEQ ID NO: 9178108 - DNA, 22 bp, Homo sapiens
agcctcagggctctgcgcagac

SEQ ID NO: 9178109 - DNA, 23 bp, Homo sapiens
agcctcagccggtggcagaagtg

SEQ ID NO: 9178110 - DNA, 22 bp, Homo sapiens
agcctcagcacgcagctctgtg

SEQ ID NO: 9178111 - DNA, 23 bp, Homo sapiens
agcctcagccggtggcagaagtg

SEQ ID NO: 9178112 - DNA, 22 bp, Homo sapiens
cagcacaggtcagttttttaag

SEQ ID NO: 9178113 - DNA, 22 bp, Homo sapiens
agcctcagcacgcagctctgtg

SEQ ID NO: 9178114 - DNA, 22 bp, Homo sapiens
cagcacagtacaaggcacggat

SEQ ID NO: 9178115 - DNA, 22 bp, Homo sapiens
cagcacagggcttgagaggtgt

SEQ ID NO: 9178116 - DNA, 22 bp, Homo sapiens
cagcacagggcttgagaggtgt

SEQ ID NO: 9178117 - DNA, 22 bp, Homo sapiens
attttctgagcacgtgacagca

SEQ ID NO: 9178118 - DNA, 22 bp, Homo sapiens
attttctctcaaaccttaaaat

SEQ ID NO: 9178119 - DNA, 22 bp, Homo sapiens
attttctatgttgtaattgtta

SEQ ID NO: 9178120 - DNA, 22 bp, Homo sapiens
attttctggttgaggtttaaca

SEQ ID NO: 9178121 - DNA, 22 bp, Homo sapiens
attttctgtaaaaaggcactaa

SEQ ID NO: 9178122 - DNA, 22 bp, Homo sapiens
attttctgtaactatttctata

SEQ ID NO: 9178123 - DNA, 22 bp, Homo sapiens
agcaatttttgattttcagtgt

SEQ ID NO: 9178124 - DNA, 23 bp, Homo sapiens
agcacagactagaaaggtctttc

SEQ ID NO: 9178125 - DNA, 22 bp, Homo sapiens
agcacagattctgaagagtcct

SEQ ID NO: 9178126 - DNA, 22 bp, Homo sapiens
agcacagatgtactttgagggg

SEQ ID NO: 9178127 - DNA, 22 bp, Homo sapiens
agcacagcaagtgggttattaa

SEQ ID NO: 9178128 - DNA, 22 bp, Homo sapiens
agcacagatggatgtattcatt

SEQ ID NO: 9178129 - DNA, 22 bp, Homo sapiens
agcacagatgcatgatcaccag

SEQ ID NO: 9178130 - DNA, 22 bp, Homo sapiens
agcacagagttgctcactgccg

SEQ ID NO: 9178131 - DNA, 22 bp, Homo sapiens
agcacagagctcggggaatgga

SEQ ID NO: 9178132 - DNA, 22 bp, Homo sapiens
agcacagaggtggaagtgtata

SEQ ID NO: 9178133 - DNA, 22 bp, Homo sapiens
agcacagaggtggaagtgtata

SEQ ID NO: 9178134 - DNA, 22 bp, Homo sapiens
agcacagagttgcagagagcgt

SEQ ID NO: 9178135 - DNA, 22 bp, Homo sapiens
agcacagaggtggaagtgtata

SEQ ID NO: 9178136 - DNA, 22 bp, Homo sapiens
agcacagagttgcagagagcgt

SEQ ID NO: 9178137 - DNA, 22 bp, Homo sapiens
agcacagagattatttacaaga

SEQ ID NO: 9178138 - DNA, 19 bp, Homo sapiens
agcacagagagtctatagc

SEQ ID NO: 9178139 - DNA, 22 bp, Homo sapiens
agcacagagctaggagtggagg

SEQ ID NO: 9178140 - DNA, 22 bp, Homo sapiens
agcacagagattatttacaaga

SEQ ID NO: 9178141 - DNA, 22 bp, Homo sapiens
agcacagagaagatttcaatta

SEQ ID NO: 9178142 - DNA, 22 bp, Homo sapiens
caaatgcaggtcataacctgag

SEQ ID NO: 9178143 - DNA, 22 bp, Homo sapiens
caaatgcaggtcataacctgag

SEQ ID NO: 9178144 - DNA, 22 bp, Homo sapiens
caaatgcaggtcagcaggtgtc

SEQ ID NO: 9178145 - DNA, 22 bp, Homo sapiens
caaatgcaggtcagcaggtgtc

SEQ ID NO: 9178146 - DNA, 22 bp, Homo sapiens
caaatgttaaatgtgttaagac

SEQ ID NO: 9178147 - DNA, 22 bp, Homo sapiens
caaatgcatagaaagatgaaac

SEQ ID NO: 9178148 - DNA, 22 bp, Homo sapiens
caaatgcatagaaagatgaaac

SEQ ID NO: 9178149 - DNA, 22 bp, Homo sapiens
caaatgcatagaaagatgaaac

SEQ ID NO: 9178150 - DNA, 20 bp, Homo sapiens
agcacagcgcggtgttcctt

SEQ ID NO: 9178151 - DNA, 22 bp, Homo sapiens
agcacagcctctggtttctgac

SEQ ID NO: 9178152 - DNA, 20 bp, Homo sapiens
agcacagcgcggtgttcctt

SEQ ID NO: 9178153 - DNA, 22 bp, Homo sapiens
agcacagcctctggtttctgac

SEQ ID NO: 9178154 - DNA, 20 bp, Homo sapiens
agcacagcgcggtgttcctt

SEQ ID NO: 9178155 - DNA, 22 bp, Homo sapiens
agcacagctgctgaatgataca

SEQ ID NO: 9178156 - DNA, 22 bp, Homo sapiens
agcacagctggaaaataaatca

SEQ ID NO: 9178157 - DNA, 22 bp, Homo sapiens
agcacagctgttcaacaggaat

SEQ ID NO: 9178158 - DNA, 22 bp, Homo sapiens
agcacagcttagcacctggcac

SEQ ID NO: 9178159 - DNA, 21 bp, Homo sapiens
agcacagcatatccaatgtca

SEQ ID NO: 9178160 - DNA, 22 bp, Homo sapiens
agcacagcagcgtctaaccgat

SEQ ID NO: 9178161 - DNA, 22 bp, Homo sapiens
agcacagcaccatcctggtacc

SEQ ID NO: 9178162 - DNA, 21 bp, Homo sapiens
agcacagcatatccaatgtca

SEQ ID NO: 9178163 - DNA, 21 bp, Homo sapiens
agcacagcatatccaatgtca

SEQ ID NO: 9178164 - DNA, 22 bp, Homo sapiens
agcacagccagctttattggcc

SEQ ID NO: 9178165 - DNA, 22 bp, Homo sapiens
agcacagcctctggtttctgac

SEQ ID NO: 9178166 - DNA, 22 bp, Homo sapiens
caaatattccaggtacatccct

SEQ ID NO: 9178167 - DNA, 22 bp, Homo sapiens
caaatgtttggtggcattttgt

SEQ ID NO: 9178168 - DNA, 22 bp, Homo sapiens
caaatgtttggtggcattttgt

SEQ ID NO: 9178169 - DNA, 22 bp, Homo sapiens
caaattaatgtgtctcaaaata

SEQ ID NO: 9178170 - DNA, 22 bp, Homo sapiens
agcactgtggtggaagcatcaa

SEQ ID NO: 9178171 - DNA, 22 bp, Homo sapiens
agcagaagaggtcttgttgctg

SEQ ID NO: 9178172 - DNA, 22 bp, Homo sapiens
agcagaagaaagccacatgact

SEQ ID NO: 9178173 - DNA, 22 bp, Homo sapiens
agcagaagaggtcttgttgctg

SEQ ID NO: 9178174 - DNA, 17 bp, Homo sapiens
agcagaagtcagaggga

SEQ ID NO: 9178175 - DNA, 22 bp, Homo sapiens
caatgaaagcaactgcctataa

SEQ ID NO: 9178176 - DNA, 22 bp, Homo sapiens
agcagcattctctggtatgggg

SEQ ID NO: 9178177 - DNA, 20 bp, Homo sapiens
agcagcattgttctagagca

SEQ ID NO: 9178178 - DNA, 22 bp, Homo sapiens
agcagcatttaagtttcttcta

SEQ ID NO: 9178179 - DNA, 22 bp, Homo sapiens
caatcttagtggcttacaaaga

SEQ ID NO: 9178180 - DNA, 22 bp, Homo sapiens
agcagcatgttgggatgtgaaa

SEQ ID NO: 9178181 - DNA, 22 bp, Homo sapiens
agcagcatgttgggatgtgaaa

SEQ ID NO: 9178182 - DNA, 22 bp, Homo sapiens
agcagcatgttcattacattat

SEQ ID NO: 9178183 - DNA, 22 bp, Homo sapiens
agcagcattatgatatatctta

SEQ ID NO: 9178184 - DNA, 22 bp, Homo sapiens
agcagcattcctggcttctatc

SEQ ID NO: 9178185 - DNA, 22 bp, Homo sapiens
agcagcattcctggcttctatc

SEQ ID NO: 9178186 - DNA, 22 bp, Homo sapiens
agcagcatggatgggcctcagc

SEQ ID NO: 9178187 - DNA, 22 bp, Homo sapiens
agcagcatcttctgttctccgc

SEQ ID NO: 9178188 - DNA, 22 bp, Homo sapiens
agcagcatctggttctgatgtg

SEQ ID NO: 9178189 - DNA, 22 bp, Homo sapiens
agcagcatctggttctgatgtg

SEQ ID NO: 9178190 - DNA, 22 bp, Homo sapiens
agcagcatattgtgtcttcata

SEQ ID NO: 9178191 - DNA, 22 bp, Homo sapiens
agcagcatattgtgtcttcata

SEQ ID NO: 9178192 - DNA, 22 bp, Homo sapiens
agcagcatccccggcctccacc

SEQ ID NO: 9178193 - DNA, 22 bp, Homo sapiens
agcagcatctggttctgatgtg

SEQ ID NO: 9178194 - DNA, 21 bp, Homo sapiens
agcagcatcagcctcacctga

SEQ ID NO: 9178195 - DNA, 22 bp, Homo sapiens
agcagcatcaaccctcccgtgt

SEQ ID NO: 9178196 - DNA, 22 bp, Homo sapiens
agcagcatagatgctatccgag

SEQ ID NO: 9178197 - DNA, 22 bp, Homo sapiens
caaggcataacctttttagaat

SEQ ID NO: 9178198 - DNA, 22 bp, Homo sapiens
caaggcagttccccagagggct

SEQ ID NO: 9178199 - DNA, 22 bp, Homo sapiens
caaggcagtccctactccctgc

SEQ ID NO: 9178200 - DNA, 22 bp, Homo sapiens
caaggcaggtctgaggaggttg

SEQ ID NO: 9178201 - DNA, 22 bp, Homo sapiens
caaggcaggtctgaggaggttg

SEQ ID NO: 9178202 - DNA, 22 bp, Homo sapiens
caaggcaggtctgaggaggttg

SEQ ID NO: 9178203 - DNA, 22 bp, Homo sapiens
agcagcagaaagttgatggcag

SEQ ID NO: 9178204 - DNA, 22 bp, Homo sapiens
agcagcagaaagttgatggcag

SEQ ID NO: 9178205 - DNA, 22 bp, Homo sapiens
agcagcacatggggctggcaac

SEQ ID NO: 9178206 - DNA, 22 bp, Homo sapiens
agcagcagaagggagacccagg

SEQ ID NO: 9178207 - DNA, 22 bp, Homo sapiens
agcagcagaagggagacccagg

SEQ ID NO: 9178208 - DNA, 22 bp, Homo sapiens
agcagcagaagggagacccagg

SEQ ID NO: 9178209 - DNA, 22 bp, Homo sapiens
agcagcagaaagttgatggcag

SEQ ID NO: 9178210 - DNA, 22 bp, Homo sapiens
agcagcaaggaagcgaggatgg

SEQ ID NO: 9178211 - DNA, 22 bp, Homo sapiens
agcagcaatggaaagcaacaca

SEQ ID NO: 9178212 - DNA, 22 bp, Homo sapiens
agcagcaatggaaagcaacaca

SEQ ID NO: 9178213 - DNA, 22 bp, Homo sapiens
agcagcaagcagtgcacgggtt

SEQ ID NO: 9178214 - DNA, 22 bp, Homo sapiens
agcagaagtgccttagcaatca

SEQ ID NO: 9178215 - DNA, 22 bp, Homo sapiens
caactattaccatgttattgtc

SEQ ID NO: 9178216 - DNA, 21 bp, Homo sapiens
agcagacacttgtgaccttcc

SEQ ID NO: 9178217 - DNA, 22 bp, Homo sapiens
agcagacaattgcctggatgga

SEQ ID NO: 9178218 - DNA, 22 bp, Homo sapiens
caactgctgacaccatcactcc

SEQ ID NO: 9178219 - DNA, 19 bp, Homo sapiens
caactgccccctcaaacat

SEQ ID NO: 9178220 - DNA, 22 bp, Homo sapiens
caactggtaatctccacggtca

SEQ ID NO: 9178221 - DNA, 22 bp, Homo sapiens
caactggtggtcaaccttctgt

SEQ ID NO: 9178222 - DNA, 22 bp, Homo sapiens
caactgggataaagagctaaag

SEQ ID NO: 9178223 - DNA, 22 bp, Homo sapiens
caacttatctaatgttgggata

SEQ ID NO: 9178224 - DNA, 22 bp, Homo sapiens
caacttattaagaatgggcctg

SEQ ID NO: 9178225 - DNA, 22 bp, Homo sapiens
caacttattttcagtgggcctg

SEQ ID NO: 9178226 - DNA, 22 bp, Homo sapiens
caactgtgaattttatgatacc

SEQ ID NO: 9178227 - DNA, 22 bp, Homo sapiens
caactgccatacagctccatgg

SEQ ID NO: 9178228 - DNA, 22 bp, Homo sapiens
caactgcacaccaagcttgtgt

SEQ ID NO: 9178229 - DNA, 22 bp, Homo sapiens
caactccctgtggggtactggg

SEQ ID NO: 9178230 - DNA, 22 bp, Homo sapiens
agcagttcataaacattttgag

SEQ ID NO: 9178231 - DNA, 22 bp, Homo sapiens
agcagttgtagtcatggaaaat

SEQ ID NO: 9178232 - DNA, 22 bp, Homo sapiens
agcagtttagctatactgcttg

SEQ ID NO: 9178233 - DNA, 22 bp, Homo sapiens
caccagggcagcagcctagtct

SEQ ID NO: 9178234 - DNA, 22 bp, Homo sapiens
caccagggcagcagcctagtct

SEQ ID NO: 9178235 - DNA, 22 bp, Homo sapiens
caccagggctctgagctctgaa

SEQ ID NO: 9178236 - DNA, 22 bp, Homo sapiens
caccagggccccaggctgtgcc

SEQ ID NO: 9178237 - DNA, 22 bp, Homo sapiens
caccagggccccaggctgtgcc

SEQ ID NO: 9178238 - DNA, 22 bp, Homo sapiens
caccaggtgctggaggacatca

SEQ ID NO: 9178239 - DNA, 22 bp, Homo sapiens
caccagggctctgagctctgaa

SEQ ID NO: 9178240 - DNA, 22 bp, Homo sapiens
caccagggctctgagctctgaa

SEQ ID NO: 9178241 - DNA, 22 bp, Homo sapiens
caccagggctctgagctctgaa

SEQ ID NO: 9178242 - DNA, 22 bp, Homo sapiens
caccagggacaatgctaggggt

SEQ ID NO: 9178243 - DNA, 22 bp, Homo sapiens
caccagggcagcagcctagtct

SEQ ID NO: 9178244 - DNA, 22 bp, Homo sapiens
agcaggtggacagaggaagaaa

SEQ ID NO: 9178245 - DNA, 22 bp, Homo sapiens
caccagggacaatgctaggggt

SEQ ID NO: 9178246 - DNA, 22 bp, Homo sapiens
agcagtttggaaaatactagaa

SEQ ID NO: 9178247 - DNA, 22 bp, Homo sapiens
agcagtttggaaaatactagaa

SEQ ID NO: 9178248 - DNA, 22 bp, Homo sapiens
agcagttttagggagacacatt

SEQ ID NO: 9178249 - DNA, 22 bp, Homo sapiens
agcagttttcctgagctcctca

SEQ ID NO: 9178250 - DNA, 20 bp, Homo sapiens
agcagtttcctaactcagct

SEQ ID NO: 9178251 - DNA, 22 bp, Homo sapiens
agcagtttatcctcataatgga

SEQ ID NO: 9178252 - DNA, 22 bp, Homo sapiens
agcagtttctcttgtatcttca

SEQ ID NO: 9178253 - DNA, 22 bp, Homo sapiens
agcagtttttataacactggaa

SEQ ID NO: 9178254 - DNA, 22 bp, Homo sapiens
agcagtttttataacactggaa

SEQ ID NO: 9178255 - DNA, 22 bp, Homo sapiens
agcataaaggacatttgtcact

SEQ ID NO: 9178256 - DNA, 22 bp, Homo sapiens
agcataaactcagggacacaca

SEQ ID NO: 9178257 - DNA, 22 bp, Homo sapiens
agcataaaggcactagaaagag

SEQ ID NO: 9178258 - DNA, 22 bp, Homo sapiens
agcataagttggtacagccact

SEQ ID NO: 9178259 - DNA, 22 bp, Homo sapiens
agcataagttggtacagccact

SEQ ID NO: 9178260 - DNA, 22 bp, Homo sapiens
agcataaaggtcaacgttttag

SEQ ID NO: 9178261 - DNA, 22 bp, Homo sapiens
cactctgattccacaaggctcc

SEQ ID NO: 9178262 - DNA, 22 bp, Homo sapiens
agcaggtgatcgcgtgtgctcc

SEQ ID NO: 9178263 - DNA, 22 bp, Homo sapiens
agcaggtgatgtgagtctggaa

SEQ ID NO: 9178264 - DNA, 22 bp, Homo sapiens
cacatatttgatgaagctttgt

SEQ ID NO: 9178265 - DNA, 22 bp, Homo sapiens
cacatattgtagttcaccagga

SEQ ID NO: 9178266 - DNA, 22 bp, Homo sapiens
cacatcaagcatccatgagttt

SEQ ID NO: 9178267 - DNA, 22 bp, Homo sapiens
cacatcaagcatccatgagttt

SEQ ID NO: 9178268 - DNA, 22 bp, Homo sapiens
cacatccctggagttacccagt

SEQ ID NO: 9178269 - DNA, 23 bp, Homo sapiens
cacatcagtttaggtcagatttt

SEQ ID NO: 9178270 - DNA, 16 bp, Homo sapiens
agcagggcgggaagga

SEQ ID NO: 9178271 - DNA, 22 bp, Homo sapiens
agcagggcctgagtgacctaac

SEQ ID NO: 9178272 - DNA, 22 bp, Homo sapiens
agcagggcctggcactcctggg

SEQ ID NO: 9178273 - DNA, 22 bp, Homo sapiens
cacagtattcactgggcagatt

SEQ ID NO: 9178274 - DNA, 20 bp, Homo sapiens
cacagtattcttccttaaaa

SEQ ID NO: 9178275 - DNA, 22 bp, Homo sapiens
cacagtatttgtttttctgagt

SEQ ID NO: 9178276 - DNA, 22 bp, Homo sapiens
agcaggagacatgggggtggtg

SEQ ID NO: 9178277 - DNA, 22 bp, Homo sapiens
agcaggagagcagtgcgtggtc

SEQ ID NO: 9178278 - DNA, 22 bp, Homo sapiens
agcaggagaacactgtggctct

SEQ ID NO: 9178279 - DNA, 22 bp, Homo sapiens
agcaggagaacactgtggctct

SEQ ID NO: 9178280 - DNA, 22 bp, Homo sapiens
agcaggagaacactgtggctct

SEQ ID NO: 9178281 - DNA, 22 bp, Homo sapiens
agcaggagacatgggggtggtg

SEQ ID NO: 9178282 - DNA, 22 bp, Homo sapiens
agcaggagatggggcgtgatgt

SEQ ID NO: 9178283 - DNA, 22 bp, Homo sapiens
agcaggagagcagtgcgtggtc

SEQ ID NO: 9178284 - DNA, 22 bp, Homo sapiens
agcaggagagcagtgcgtggtc

SEQ ID NO: 9178285 - DNA, 22 bp, Homo sapiens
cacaggaggaggccagagcgta

SEQ ID NO: 9178286 - DNA, 22 bp, Homo sapiens
cacaggaggaggccagagcgta

SEQ ID NO: 9178287 - DNA, 22 bp, Homo sapiens
cacaggagggagcgggcagcca

SEQ ID NO: 9178288 - DNA, 22 bp, Homo sapiens
cacagggcttctcatggggtgc

SEQ ID NO: 9178289 - DNA, 22 bp, Homo sapiens
cacagtatcttttgagtaagca

SEQ ID NO: 9178290 - DNA, 22 bp, Homo sapiens
cacagtatgatctaaagtaagt

SEQ ID NO: 9178291 - DNA, 22 bp, Homo sapiens
cacagtactgctttgggatgtg

SEQ ID NO: 9178292 - DNA, 22 bp, Homo sapiens
cacagtatccctctttctcccc

SEQ ID NO: 9178293 - DNA, 22 bp, Homo sapiens
cacagggcctggggcagctgct

SEQ ID NO: 9178294 - DNA, 22 bp, Homo sapiens
cacagggcctggggcagctgct

SEQ ID NO: 9178295 - DNA, 22 bp, Homo sapiens
cacagggccttgtgtgactgca

SEQ ID NO: 9178296 - DNA, 22 bp, Homo sapiens
cacagggcctggggcagctgct

SEQ ID NO: 9178297 - DNA, 22 bp, Homo sapiens
agcagcttatcttggagaggca

SEQ ID NO: 9178298 - DNA, 22 bp, Homo sapiens
agcagctgtttgttgaattggt

SEQ ID NO: 9178299 - DNA, 22 bp, Homo sapiens
agcagctgttagaaacaggaag

SEQ ID NO: 9178300 - DNA, 22 bp, Homo sapiens
agcagctgttagaaacaggaag

SEQ ID NO: 9178301 - DNA, 22 bp, Homo sapiens
agcagctgttagaaacaggaag

SEQ ID NO: 9178302 - DNA, 22 bp, Homo sapiens
agcagctgttagaaacaggaag

SEQ ID NO: 9178303 - DNA, 23 bp, Homo sapiens
agcagctgtggtttaccttagta

SEQ ID NO: 9178304 - DNA, 23 bp, Homo sapiens
agcagctgtggtttaccttagta

SEQ ID NO: 9178305 - DNA, 22 bp, Homo sapiens
agcagctgtggggacaagggta

SEQ ID NO: 9178306 - DNA, 22 bp, Homo sapiens
agcagctgtggggacaagggta

SEQ ID NO: 9178307 - DNA, 22 bp, Homo sapiens
agcagctgtggggacaagggta

SEQ ID NO: 9178308 - DNA, 22 bp, Homo sapiens
agcagctgtggggacaagggta

SEQ ID NO: 9178309 - DNA, 22 bp, Homo sapiens
agcagctgtggggacaagggta

SEQ ID NO: 9178310 - DNA, 22 bp, Homo sapiens
agcagcttcaattttctaagtg

SEQ ID NO: 9178311 - DNA, 22 bp, Homo sapiens
cacaggagccctgaggcctccc

SEQ ID NO: 9178312 - DNA, 22 bp, Homo sapiens
cacaggagctgtggggcagtgt

SEQ ID NO: 9178313 - DNA, 22 bp, Homo sapiens
cacaggagccctgaggcctccc

SEQ ID NO: 9178314 - DNA, 18 bp, Homo sapiens
agcagctgtgccacactg

SEQ ID NO: 9178315 - DNA, 18 bp, Homo sapiens
agcagctgtgccacactg

SEQ ID NO: 9178316 - DNA, 22 bp, Homo sapiens
agcagctgtggaaaagtaacta

SEQ ID NO: 9178317 - DNA, 22 bp, Homo sapiens
agcagctgtggaaaagtaacta

SEQ ID NO: 9178318 - DNA, 22 bp, Homo sapiens
agcagctgtcccttaacatcag

SEQ ID NO: 9178319 - DNA, 18 bp, Homo sapiens
agcagctgtcagaatgcc

SEQ ID NO: 9178320 - DNA, 22 bp, Homo sapiens
agcagctgtcccttaacatcag

SEQ ID NO: 9178321 - DNA, 18 bp, Homo sapiens
agcagctgtcagaatgcc

SEQ ID NO: 9178322 - DNA, 18 bp, Homo sapiens
agcagctgtgccacactg

SEQ ID NO: 9178323 - DNA, 18 bp, Homo sapiens
agcagctgtcagaatgcc

SEQ ID NO: 9178324 - DNA, 18 bp, Homo sapiens
agcagctgtcagaatgcc

SEQ ID NO: 9178325 - DNA, 19 bp, Homo sapiens
agcagctgtagatagacac

SEQ ID NO: 9178326 - DNA, 22 bp, Homo sapiens
agcagctgggctcagagctggg

SEQ ID NO: 9178327 - DNA, 22 bp, Homo sapiens
caatgataatggctgtatttat

SEQ ID NO: 9178328 - DNA, 19 bp, Homo sapiens
agcagctgtagatagacac

SEQ ID NO: 9178329 - DNA, 19 bp, Homo sapiens
agcagctgtagatagacac

SEQ ID NO: 9178330 - DNA, 22 bp, Homo sapiens
caatgacatggataatcatatt

SEQ ID NO: 9178331 - DNA, 22 bp, Homo sapiens
caatgacatctccctgctctaa

SEQ ID NO: 9178332 - DNA, 22 bp, Homo sapiens
atttaagggatttggagaccaa

SEQ ID NO: 9178333 - DNA, 18 bp, Homo sapiens
atttaatgaactgaaagc

SEQ ID NO: 9178334 - DNA, 23 bp, Homo sapiens
agagtggcctactcacactcatt

SEQ ID NO: 9178335 - DNA, 22 bp, Homo sapiens
agagtggcctggcctggggcat

SEQ ID NO: 9178336 - DNA, 22 bp, Homo sapiens
agagtggctctgctgggcacag

SEQ ID NO: 9178337 - DNA, 22 bp, Homo sapiens
atttaatgggtagacattgtta

SEQ ID NO: 9178338 - DNA, 23 bp, Homo sapiens
atttaatgctgagttgaatgtta

SEQ ID NO: 9178339 - DNA, 22 bp, Homo sapiens
attcttctctgggttgggttca

SEQ ID NO: 9178340 - DNA, 22 bp, Homo sapiens
atttaaattttctgatggagag

SEQ ID NO: 9178341 - DNA, 22 bp, Homo sapiens
atttaaccccgatgtctccaaa

SEQ ID NO: 9178342 - DNA, 22 bp, Homo sapiens
atttaagattgcgtattcatgt

SEQ ID NO: 9178343 - DNA, 22 bp, Homo sapiens
atttaagaggctgctagagtat

SEQ ID NO: 9178344 - DNA, 22 bp, Homo sapiens
attcttcatcagagatgcacta

SEQ ID NO: 9178345 - DNA, 22 bp, Homo sapiens
attcttcatttactgttacttg

SEQ ID NO: 9178346 - DNA, 22 bp, Homo sapiens
attcttctaatatgatcgtgtt

SEQ ID NO: 9178347 - DNA, 22 bp, Homo sapiens
agaggtaattatagcctggccg

SEQ ID NO: 9178348 - DNA, 22 bp, Homo sapiens
agaggtagaaaataatggagag

SEQ ID NO: 9178349 - DNA, 22 bp, Homo sapiens
agaggtagaaaataatggagag

SEQ ID NO: 9178350 - DNA, 22 bp, Homo sapiens
agagggtggtgaggcctggttc

SEQ ID NO: 9178351 - DNA, 22 bp, Homo sapiens
agaggtaagcagtggcaagtgc

SEQ ID NO: 9178352 - DNA, 22 bp, Homo sapiens
agagggtgggcacgtgatggat

SEQ ID NO: 9178353 - DNA, 22 bp, Homo sapiens
agaggtagaggttgcagtgagc

SEQ ID NO: 9178354 - DNA, 22 bp, Homo sapiens
attcttcatacagacaagtcct

SEQ ID NO: 9178355 - DNA, 22 bp, Homo sapiens
atttattattgtggttacttct

SEQ ID NO: 9178356 - DNA, 22 bp, Homo sapiens
atttattattgtggttacttct

SEQ ID NO: 9178357 - DNA, 22 bp, Homo sapiens
atttattcctgattcctggctt

SEQ ID NO: 9178358 - DNA, 22 bp, Homo sapiens
atttattgaacactgactatgt

SEQ ID NO: 9178359 - DNA, 22 bp, Homo sapiens
atttattgaacactgactatgt

SEQ ID NO: 9178360 - DNA, 22 bp, Homo sapiens
atttattctccagatggcgaga

SEQ ID NO: 9178361 - DNA, 22 bp, Homo sapiens
atttattcctttatggctggag

SEQ ID NO: 9178362 - DNA, 22 bp, Homo sapiens
atttagcacctccatctcaaca

SEQ ID NO: 9178363 - DNA, 22 bp, Homo sapiens
atttagcacacggcctggtaca

SEQ ID NO: 9178364 - DNA, 22 bp, Homo sapiens
atttagcagtcctcctcacaat

SEQ ID NO: 9178365 - DNA, 22 bp, Homo sapiens
atttagcttacctcgttactga

SEQ ID NO: 9178366 - DNA, 22 bp, Homo sapiens
atttagtagagaaattaagaaa

SEQ ID NO: 9178367 - DNA, 22 bp, Homo sapiens
atttattatgggatttggctca

SEQ ID NO: 9178368 - DNA, 22 bp, Homo sapiens
atttattatgggatttggctca

SEQ ID NO: 9178369 - DNA, 22 bp, Homo sapiens
atttagtgtattctaatatgtg

SEQ ID NO: 9178370 - DNA, 22 bp, Homo sapiens
atttagtggctgtaatcacctt

SEQ ID NO: 9178371 - DNA, 22 bp, Homo sapiens
agagtgggcctctgagtcccag

SEQ ID NO: 9178372 - DNA, 22 bp, Homo sapiens
agagtgggcaggagcctcgact

SEQ ID NO: 9178373 - DNA, 22 bp, Homo sapiens
agagtggcttctttgacatgct

SEQ ID NO: 9178374 - DNA, 22 bp, Homo sapiens
agagtggcttgctcagctagca

SEQ ID NO: 9178375 - DNA, 22 bp, Homo sapiens
agagtggcttgctcagctagca

SEQ ID NO: 9178376 - DNA, 22 bp, Homo sapiens
agagtgggacacgggcgctgtc

SEQ ID NO: 9178377 - DNA, 22 bp, Homo sapiens
atttagaagttggagggcaaga

SEQ ID NO: 9178378 - DNA, 22 bp, Homo sapiens
atttagaagttggagggcaaga

SEQ ID NO: 9178379 - DNA, 22 bp, Homo sapiens
atttagactctcacctccacct

SEQ ID NO: 9178380 - DNA, 22 bp, Homo sapiens
atttgcttggtcttctctccgt

SEQ ID NO: 9178381 - DNA, 22 bp, Homo sapiens
atttgcttgtgctatgaaagtt

SEQ ID NO: 9178382 - DNA, 22 bp, Homo sapiens
atttgcttgtgctatgaaagtt

SEQ ID NO: 9178383 - DNA, 22 bp, Homo sapiens
atttgcttctgtgaaatcaagt

SEQ ID NO: 9178384 - DNA, 19 bp, Homo sapiens
agatgtggagtttgatttc

SEQ ID NO: 9178385 - DNA, 22 bp, Homo sapiens
agatgtggaaagaagttagaag

SEQ ID NO: 9178386 - DNA, 22 bp, Homo sapiens
atttgctgatggcatttgagct

SEQ ID NO: 9178387 - DNA, 19 bp, Homo sapiens
atttgctgcaatgcttcac

SEQ ID NO: 9178388 - DNA, 20 bp, Homo sapiens
atttgctgagctttttctcc

SEQ ID NO: 9178389 - DNA, 22 bp, Homo sapiens
atttgctgagctcaaagaaaag

SEQ ID NO: 9178390 - DNA, 22 bp, Homo sapiens
atttgctggtgaatgtatagct

SEQ ID NO: 9178391 - DNA, 20 bp, Homo sapiens
atttgctgtcagtccctagg

SEQ ID NO: 9178392 - DNA, 22 bp, Homo sapiens
atttgctggtgaatgtatagct

SEQ ID NO: 9178393 - DNA, 22 bp, Homo sapiens
atttgctggtgaaatagtgaca

SEQ ID NO: 9178394 - DNA, 20 bp, Homo sapiens
atttgcttaccttgtttcta

SEQ ID NO: 9178395 - DNA, 22 bp, Homo sapiens
agatgtgcctccaaggggtgca

SEQ ID NO: 9178396 - DNA, 23 bp, Homo sapiens
agatgtcttagaaactgaagctg

SEQ ID NO: 9178397 - DNA, 19 bp, Homo sapiens
agatgtctatttgactatc

SEQ ID NO: 9178398 - DNA, 22 bp, Homo sapiens
agatgtcagctcacatgccacc

SEQ ID NO: 9178399 - DNA, 22 bp, Homo sapiens
agcaaaataaggtaatttattg

SEQ ID NO: 9178400 - DNA, 20 bp, Homo sapiens
agcaaaatgcaagattttca

SEQ ID NO: 9178401 - DNA, 20 bp, Homo sapiens
agcaaaatgcaagattttca

SEQ ID NO: 9178402 - DNA, 22 bp, Homo sapiens
agcaaacattcagcagattggc

SEQ ID NO: 9178403 - DNA, 22 bp, Homo sapiens
agcaaacagtgtgctaagaaat

SEQ ID NO: 9178404 - DNA, 22 bp, Homo sapiens
atttgctttcagccttaaggat

SEQ ID NO: 9178405 - DNA, 22 bp, Homo sapiens
agatttcacatgctgctctatt

SEQ ID NO: 9178406 - DNA, 22 bp, Homo sapiens
agatttcaatgtgagcattagt

SEQ ID NO: 9178407 - DNA, 17 bp, Homo sapiens
agcaaaagtatcaaagc

SEQ ID NO: 9178408 - DNA, 17 bp, Homo sapiens
agcaaaagtatcaaagc

SEQ ID NO: 9178409 - DNA, 22 bp, Homo sapiens
agcaaaagatagattaacaaga

SEQ ID NO: 9178410 - DNA, 22 bp, Homo sapiens
agatgaaaagataagcagcaat

SEQ ID NO: 9178411 - DNA, 22 bp, Homo sapiens
atttattgaagcttattacgtt

SEQ ID NO: 9178412 - DNA, 22 bp, Homo sapiens
agatgaaaatacgtgactttaa

SEQ ID NO: 9178413 - DNA, 18 bp, Homo sapiens
agatgaaagcaaatgaca

SEQ ID NO: 9178414 - DNA, 22 bp, Homo sapiens
agatgaaaatacgtgactttaa

SEQ ID NO: 9178415 - DNA, 22 bp, Homo sapiens
agatgaagatgccactaagacc

SEQ ID NO: 9178416 - DNA, 22 bp, Homo sapiens
atttcattgaagttaattcttc

SEQ ID NO: 9178417 - DNA, 22 bp, Homo sapiens
atttcattgaagttaattcttc

SEQ ID NO: 9178418 - DNA, 22 bp, Homo sapiens
agatgaagatatctgcaggggc

SEQ ID NO: 9178419 - DNA, 22 bp, Homo sapiens
agatgaagatatctgcaggggc

SEQ ID NO: 9178420 - DNA, 22 bp, Homo sapiens
agatgtagtagtgggtctttta

SEQ ID NO: 9178421 - DNA, 21 bp, Homo sapiens
atttccaaataaggtcacatt

SEQ ID NO: 9178422 - DNA, 19 bp, Homo sapiens
atttccaagaattggagag

SEQ ID NO: 9178423 - DNA, 22 bp, Homo sapiens
atttccaccggctcaggaagtt

SEQ ID NO: 9178424 - DNA, 22 bp, Homo sapiens
atttccacataagggaaataag

SEQ ID NO: 9178425 - DNA, 22 bp, Homo sapiens
atgtgtgtacacacgtgactct

SEQ ID NO: 9178426 - DNA, 22 bp, Homo sapiens
atgtgtgctcttgagccttcac

SEQ ID NO: 9178427 - DNA, 22 bp, Homo sapiens
atgtgtgctacaggtgtgggaa

SEQ ID NO: 9178428 - DNA, 22 bp, Homo sapiens
atgtgtcttggagttttaatgt

SEQ ID NO: 9178429 - DNA, 22 bp, Homo sapiens
atgtgtatccatctgtctattt

SEQ ID NO: 9178430 - DNA, 22 bp, Homo sapiens
atgtgtctttgagactctgcta

SEQ ID NO: 9178431 - DNA, 22 bp, Homo sapiens
atgtgtctttgagactctgcta

SEQ ID NO: 9178432 - DNA, 22 bp, Homo sapiens
atgtgtgcatattctgccacct

SEQ ID NO: 9178433 - DNA, 20 bp, Homo sapiens
atgttaaatagcatttagag

SEQ ID NO: 9178434 - DNA, 20 bp, Homo sapiens
atgttaaatagcatttagag

SEQ ID NO: 9178435 - DNA, 23 bp, Homo sapiens
atgttaagaaggtagttaggata

SEQ ID NO: 9178436 - DNA, 22 bp, Homo sapiens
atgtttgcattcttattatcgt

SEQ ID NO: 9178437 - DNA, 22 bp, Homo sapiens
atgtttgaggactcagaagacg

SEQ ID NO: 9178438 - DNA, 19 bp, Homo sapiens
atgtttgcttgagtaataa

SEQ ID NO: 9178439 - DNA, 19 bp, Homo sapiens
atgtttgcttgagtaataa

SEQ ID NO: 9178440 - DNA, 23 bp, Homo sapiens
atgtttgcagtaacccatcctgg

SEQ ID NO: 9178441 - DNA, 22 bp, Homo sapiens
atgtttgtccctgacatcctct

SEQ ID NO: 9178442 - DNA, 22 bp, Homo sapiens
atgtttgtaggtaagtgacact

SEQ ID NO: 9178443 - DNA, 22 bp, Homo sapiens
atgtttgtgtttgctatgcggt

SEQ ID NO: 9178444 - DNA, 22 bp, Homo sapiens
attaaacaatgtaaagttcttg

SEQ ID NO: 9178445 - DNA, 22 bp, Homo sapiens
atgtttgttgaatgaagaaagg

SEQ ID NO: 9178446 - DNA, 22 bp, Homo sapiens
attaaagaaacccagcatgtga

SEQ ID NO: 9178447 - DNA, 22 bp, Homo sapiens
attaaactgagcaaattaacat

SEQ ID NO: 9178448 - DNA, 22 bp, Homo sapiens
attagatgtgaccttagataaa

SEQ ID NO: 9178449 - DNA, 22 bp, Homo sapiens
attagcaaggcagcatcaggca

SEQ ID NO: 9178450 - DNA, 22 bp, Homo sapiens
attagcaactgtcttgaaaaca

SEQ ID NO: 9178451 - DNA, 22 bp, Homo sapiens
attagcaagttgttatcctttg

SEQ ID NO: 9178452 - DNA, 22 bp, Homo sapiens
attagcaaggttcatgagaaga

SEQ ID NO: 9178453 - DNA, 21 bp, Homo sapiens
attagcaaggggaggcctcag

SEQ ID NO: 9178454 - DNA, 22 bp, Homo sapiens
attagcaacatggtgaatatgt

SEQ ID NO: 9178455 - DNA, 22 bp, Homo sapiens
attagcaactcttatgtaagca

SEQ ID NO: 9178456 - DNA, 22 bp, Homo sapiens
attagcaaaacaacttttctat

SEQ ID NO: 9178457 - DNA, 22 bp, Homo sapiens
attagcaattgccctgtgcaat

SEQ ID NO: 9178458 - DNA, 22 bp, Homo sapiens
attagcaatcacgcagtcattt

SEQ ID NO: 9178459 - DNA, 22 bp, Homo sapiens
attagcaatctgcaatggctgt

SEQ ID NO: 9178460 - DNA, 22 bp, Homo sapiens
attagcaatggtggtattagga

SEQ ID NO: 9178461 - DNA, 22 bp, Homo sapiens
attagcacataagaggtatagg

SEQ ID NO: 9178462 - DNA, 22 bp, Homo sapiens
attctggacaatgagaaactgg

SEQ ID NO: 9178463 - DNA, 22 bp, Homo sapiens
attctctgtgtctgctttccca

SEQ ID NO: 9178464 - DNA, 22 bp, Homo sapiens
attctctgtgtctgctttccca

SEQ ID NO: 9178465 - DNA, 22 bp, Homo sapiens
attctctgtgcagatttaagac

SEQ ID NO: 9178466 - DNA, 22 bp, Homo sapiens
attctctgtgcagatttaagac

SEQ ID NO: 9178467 - DNA, 22 bp, Homo sapiens
attctctgtttccaagatgaaa

SEQ ID NO: 9178468 - DNA, 22 bp, Homo sapiens
attcagcttcaatgtcttcacc

SEQ ID NO: 9178469 - DNA, 22 bp, Homo sapiens
attcagctgatggtatttaaat

SEQ ID NO: 9178470 - DNA, 22 bp, Homo sapiens
attctgggagtgtaggatggtt

SEQ ID NO: 9178471 - DNA, 22 bp, Homo sapiens
agaggggctcatatcctgtcat

SEQ ID NO: 9178472 - DNA, 22 bp, Homo sapiens
agagggtgctggagagacattg

SEQ ID NO: 9178473 - DNA, 22 bp, Homo sapiens
agagggcaagtgtagtccagta

SEQ ID NO: 9178474 - DNA, 22 bp, Homo sapiens
agagggatcaccctgtttctgg

SEQ ID NO: 9178475 - DNA, 22 bp, Homo sapiens
attcacaattagaagtagataa

SEQ ID NO: 9178476 - DNA, 22 bp, Homo sapiens
attatacaaggctggtgcctaa

SEQ ID NO: 9178477 - DNA, 22 bp, Homo sapiens
attatacattttgtgtagagat

SEQ ID NO: 9178478 - DNA, 22 bp, Homo sapiens
attatacattttgtgtagagat

SEQ ID NO: 9178479 - DNA, 22 bp, Homo sapiens
attataaatattttctaggggt

SEQ ID NO: 9178480 - DNA, 22 bp, Homo sapiens
attataaacctttgagggtggg

SEQ ID NO: 9178481 - DNA, 22 bp, Homo sapiens
attataaagaacatgtgtgtgg

SEQ ID NO: 9178482 - DNA, 22 bp, Homo sapiens
attataaagaacatgtgtgtgg

SEQ ID NO: 9178483 - DNA, 22 bp, Homo sapiens
attataaagaacatgtgtgtgg

SEQ ID NO: 9178484 - DNA, 22 bp, Homo sapiens
attcagagtctgcacaacagca

SEQ ID NO: 9178485 - DNA, 22 bp, Homo sapiens
attcagcaaacatttattatct

SEQ ID NO: 9178486 - DNA, 22 bp, Homo sapiens
attcagcaaacatttattatct

SEQ ID NO: 9178487 - DNA, 22 bp, Homo sapiens
attcagcaaacatttattgtgt

SEQ ID NO: 9178488 - DNA, 22 bp, Homo sapiens
attcagcaatgagcttggattt

SEQ ID NO: 9178489 - DNA, 22 bp, Homo sapiens
attcagcagccatggcttctga

SEQ ID NO: 9178490 - DNA, 22 bp, Homo sapiens
attcagcagttcctgcttcagt

SEQ ID NO: 9178491 - DNA, 22 bp, Homo sapiens
attcagcagttcctgcttcagt

SEQ ID NO: 9178492 - DNA, 22 bp, Homo sapiens
attcagcattcattatgcgcca

SEQ ID NO: 9178493 - DNA, 19 bp, Homo sapiens
attcagcattctgcacttc

SEQ ID NO: 9178494 - DNA, 22 bp, Homo sapiens
agaatacatctagtgctgcatg

SEQ ID NO: 9178495 - DNA, 22 bp, Homo sapiens
agaatagaattctcatagaatt

SEQ ID NO: 9178496 - DNA, 22 bp, Homo sapiens
atctttggtactattcttatca

SEQ ID NO: 9178497 - DNA, 22 bp, Homo sapiens
atctttggtactattcttatca

SEQ ID NO: 9178498 - DNA, 22 bp, Homo sapiens
agaatataaagataattctgtt

SEQ ID NO: 9178499 - DNA, 22 bp, Homo sapiens
atctttgggtacaaacttgcct

SEQ ID NO: 9178500 - DNA, 19 bp, Homo sapiens
atctttgggtcctgaaggg

SEQ ID NO: 9178501 - DNA, 22 bp, Homo sapiens
atctttggtgcttggtgctccc

SEQ ID NO: 9178502 - DNA, 22 bp, Homo sapiens
atctttggtgcttggtgctccc

SEQ ID NO: 9178503 - DNA, 22 bp, Homo sapiens
atctttggtgcatgatactttg

SEQ ID NO: 9178504 - DNA, 22 bp, Homo sapiens
agaatcaattcactgctgcagc

SEQ ID NO: 9178505 - DNA, 22 bp, Homo sapiens
agaatacagtaggagcctgggc

SEQ ID NO: 9178506 - DNA, 21 bp, Homo sapiens
agaataatggtatcatttgct

SEQ ID NO: 9178507 - DNA, 22 bp, Homo sapiens
agaagtttgttatgtaaacaaa

SEQ ID NO: 9178508 - DNA, 22 bp, Homo sapiens
agaaggctcatttgactgcatt

SEQ ID NO: 9178509 - DNA, 22 bp, Homo sapiens
agaaggctggccatggtgccct

SEQ ID NO: 9178510 - DNA, 22 bp, Homo sapiens
agaagtttggtccttttcaagg

SEQ ID NO: 9178511 - DNA, 22 bp, Homo sapiens
agaagtttggtccttttcaagg

SEQ ID NO: 9178512 - DNA, 22 bp, Homo sapiens
agaagtttggtccttttcaagg

SEQ ID NO: 9178513 - DNA, 20 bp, Homo sapiens
agaaggcattcctcattctt

SEQ ID NO: 9178514 - DNA, 22 bp, Homo sapiens
atctttatatatctcctctgaa

SEQ ID NO: 9178515 - DNA, 22 bp, Homo sapiens
atctttatatatctcctctgaa

SEQ ID NO: 9178516 - DNA, 21 bp, Homo sapiens
atctttattacgcagagaaga

SEQ ID NO: 9178517 - DNA, 22 bp, Homo sapiens
atctttagtagaggaatatatt

SEQ ID NO: 9178518 - DNA, 22 bp, Homo sapiens
agaaggccctgtgtggtctgag

SEQ ID NO: 9178519 - DNA, 22 bp, Homo sapiens
agaaggccagatggacggggct

SEQ ID NO: 9178520 - DNA, 23 bp, Homo sapiens
agaagcaatgctttttttcctct

SEQ ID NO: 9178521 - DNA, 22 bp, Homo sapiens
agaagcacacctgacctctagc

SEQ ID NO: 9178522 - DNA, 22 bp, Homo sapiens
atctttacaagaaattctttta

SEQ ID NO: 9178523 - DNA, 22 bp, Homo sapiens
atcttgttataagagataatgg

SEQ ID NO: 9178524 - DNA, 22 bp, Homo sapiens
atctttagacaggaagcaatca

SEQ ID NO: 9178525 - DNA, 22 bp, Homo sapiens
atctttaggaacctaacctatt

SEQ ID NO: 9178526 - DNA, 22 bp, Homo sapiens
agaagatgtcactgcagacagc

SEQ ID NO: 9178527 - DNA, 22 bp, Homo sapiens
agaagatgactttggagttgga

SEQ ID NO: 9178528 - DNA, 20 bp, Homo sapiens
agaagaggatacaaccaggc

SEQ ID NO: 9178529 - DNA, 20 bp, Homo sapiens
agaagaggatacaaccaggc

SEQ ID NO: 9178530 - DNA, 22 bp, Homo sapiens
agaagaggggtgtccctgtggc

SEQ ID NO: 9178531 - DNA, 22 bp, Homo sapiens
agaagaggggtgtccctgtggc

SEQ ID NO: 9178532 - DNA, 22 bp, Homo sapiens
agaagagtagtaacagaaatta

SEQ ID NO: 9178533 - DNA, 22 bp, Homo sapiens
agaagaggggtgtccctgtggc

SEQ ID NO: 9178534 - DNA, 20 bp, Homo sapiens
agaagaggatacaaccaggc

SEQ ID NO: 9178535 - DNA, 22 bp, Homo sapiens
agaagagcctggggaccatggc

SEQ ID NO: 9178536 - DNA, 22 bp, Homo sapiens
agaagagcctggggaccatggc

SEQ ID NO: 9178537 - DNA, 22 bp, Homo sapiens
agaagagccctttaagggggaa

SEQ ID NO: 9178538 - DNA, 22 bp, Homo sapiens
agaagagccactgttgacggca

SEQ ID NO: 9178539 - DNA, 22 bp, Homo sapiens
agaagagcctggggaccatggc

SEQ ID NO: 9178540 - DNA, 21 bp, Homo sapiens
agaagagaagcaggaccctct

SEQ ID NO: 9178541 - DNA, 22 bp, Homo sapiens
agaagagagtcctaccccatac

SEQ ID NO: 9178542 - DNA, 22 bp, Homo sapiens
agaagagagtcctaccccatac

SEQ ID NO: 9178543 - DNA, 22 bp, Homo sapiens
agaagaacttagctttctatct

SEQ ID NO: 9178544 - DNA, 22 bp, Homo sapiens
agaagaaatgtgaaggccactg

SEQ ID NO: 9178545 - DNA, 22 bp, Homo sapiens
agaagaaatgtgaaggccactg

SEQ ID NO: 9178546 - DNA, 22 bp, Homo sapiens
agaagagaactgccaaacactt

SEQ ID NO: 9178547 - DNA, 22 bp, Homo sapiens
agaagagaactgccaaacactt

SEQ ID NO: 9178548 - DNA, 22 bp, Homo sapiens
agaagagaaatagtgccactgt

SEQ ID NO: 9178549 - DNA, 22 bp, Homo sapiens
agaagagaaatagtgccactgt

SEQ ID NO: 9178550 - DNA, 22 bp, Homo sapiens
agaatgatcctgttcagtcggt

SEQ ID NO: 9178551 - DNA, 22 bp, Homo sapiens
agaatgaattaatcaactggaa

SEQ ID NO: 9178552 - DNA, 22 bp, Homo sapiens
agaatgaagatgacttcggaga

SEQ ID NO: 9178553 - DNA, 22 bp, Homo sapiens
agaatgcatctaaaagcagaga

SEQ ID NO: 9178554 - DNA, 17 bp, Homo sapiens
agaatgcaaagcaggct

SEQ ID NO: 9178555 - DNA, 22 bp, Homo sapiens
agaatgcaagataaactttatt

SEQ ID NO: 9178556 - DNA, 17 bp, Homo sapiens
agaatgcaaagcaggct

SEQ ID NO: 9178557 - DNA, 22 bp, Homo sapiens
agaatgtagtcttggagattta

SEQ ID NO: 9178558 - DNA, 22 bp, Homo sapiens
agaatgctccagagctgaaaga

SEQ ID NO: 9178559 - DNA, 22 bp, Homo sapiens
agaatgcattttgtgtagctat

SEQ ID NO: 9178560 - DNA, 19 bp, Homo sapiens
agaatgcatttctgctgtc

SEQ ID NO: 9178561 - DNA, 22 bp, Homo sapiens
agaatgttttcatgagaatgaa

SEQ ID NO: 9178562 - DNA, 22 bp, Homo sapiens
agaattagtcacaattatagga

SEQ ID NO: 9178563 - DNA, 22 bp, Homo sapiens
agacacagaagttgctgttggg

SEQ ID NO: 9178564 - DNA, 19 bp, Homo sapiens
agacacacttacgtggaat

SEQ ID NO: 9178565 - DNA, 22 bp, Homo sapiens
agacaatttcaaagtaatatta

SEQ ID NO: 9178566 - DNA, 22 bp, Homo sapiens
atgcagggaggtaagaggtgcc

SEQ ID NO: 9178567 - DNA, 22 bp, Homo sapiens
atgcagggaggtaagaggtgcc

SEQ ID NO: 9178568 - DNA, 22 bp, Homo sapiens
atgcagggacctttgctttggt

SEQ ID NO: 9178569 - DNA, 22 bp, Homo sapiens
atgcaggatgtcaacgcatcct

SEQ ID NO: 9178570 - DNA, 22 bp, Homo sapiens
atgcaggatgtcaacgcatcct

SEQ ID NO: 9178571 - DNA, 22 bp, Homo sapiens
atgcaggattagaaagttgcct

SEQ ID NO: 9178572 - DNA, 22 bp, Homo sapiens
atgcaggcagacactgtgggca

SEQ ID NO: 9178573 - DNA, 22 bp, Homo sapiens
atgcaggcagacactgtgggca

SEQ ID NO: 9178574 - DNA, 22 bp, Homo sapiens
atgcaggctcatgaatctgttt

SEQ ID NO: 9178575 - DNA, 22 bp, Homo sapiens
atgcaggatgcagaggggcccg

SEQ ID NO: 9178576 - DNA, 22 bp, Homo sapiens
atgcaggagttggaaaaaatga

SEQ ID NO: 9178577 - DNA, 22 bp, Homo sapiens
agacagtgatgtaagcaggagt

SEQ ID NO: 9178578 - DNA, 22 bp, Homo sapiens
agacagtaataaaataggtaag

SEQ ID NO: 9178579 - DNA, 22 bp, Homo sapiens
agacacagctgcaggaggtggg

SEQ ID NO: 9178580 - DNA, 22 bp, Homo sapiens
agacacagcagtgcctgcctca

SEQ ID NO: 9178581 - DNA, 22 bp, Homo sapiens
agacacagtctgtctggaggag

SEQ ID NO: 9178582 - DNA, 22 bp, Homo sapiens
agacacagtataagcacaacaa

SEQ ID NO: 9178583 - DNA, 22 bp, Homo sapiens
agacacagtctgtctggaggag

SEQ ID NO: 9178584 - DNA, 22 bp, Homo sapiens
agacacagtacttgccctcatg

SEQ ID NO: 9178585 - DNA, 22 bp, Homo sapiens
agacacagtgctgggtgctgag

SEQ ID NO: 9178586 - DNA, 22 bp, Homo sapiens
agacacagtgctgggtgctgag

SEQ ID NO: 9178587 - DNA, 22 bp, Homo sapiens
agacacagtctgtctggaggag

SEQ ID NO: 9178588 - DNA, 22 bp, Homo sapiens
agacacataggaccacactgtg

SEQ ID NO: 9178589 - DNA, 22 bp, Homo sapiens
atggagttctgccagcgctgct

SEQ ID NO: 9178590 - DNA, 22 bp, Homo sapiens
atggagttctgccagcgctgct

SEQ ID NO: 9178591 - DNA, 22 bp, Homo sapiens
atggagttctgccagcgctgct

SEQ ID NO: 9178592 - DNA, 22 bp, Homo sapiens
atggataagtcaaagagtatcc

SEQ ID NO: 9178593 - DNA, 22 bp, Homo sapiens
atggataagaacaaatatctga

SEQ ID NO: 9178594 - DNA, 22 bp, Homo sapiens
atggcagatggctggagcaggt

SEQ ID NO: 9178595 - DNA, 22 bp, Homo sapiens
atggcagatggctggagcaggt

SEQ ID NO: 9178596 - DNA, 22 bp, Homo sapiens
atggcagatggctggagcaggt

SEQ ID NO: 9178597 - DNA, 22 bp, Homo sapiens
atggcagagggattgaacagct

SEQ ID NO: 9178598 - DNA, 22 bp, Homo sapiens
atggcagatccacagtttgaag

SEQ ID NO: 9178599 - DNA, 20 bp, Homo sapiens
atggaggtggatgtgactgc

SEQ ID NO: 9178600 - DNA, 22 bp, Homo sapiens
atggaggtgatgttaatgatgc

SEQ ID NO: 9178601 - DNA, 22 bp, Homo sapiens
atggaggtctgtgactcccaaa

SEQ ID NO: 9178602 - DNA, 22 bp, Homo sapiens
atggagtgggccaattttagtg

SEQ ID NO: 9178603 - DNA, 20 bp, Homo sapiens
atggagtgaagagtgaaagc

SEQ ID NO: 9178604 - DNA, 22 bp, Homo sapiens
atggagtgtggccaggcagtaa

SEQ ID NO: 9178605 - DNA, 22 bp, Homo sapiens
atggctggcatgtgcataacgg

SEQ ID NO: 9178606 - DNA, 22 bp, Homo sapiens
atggctggcgtcattgtgtggg

SEQ ID NO: 9178607 - DNA, 22 bp, Homo sapiens
atggctggctgagcctggttat

SEQ ID NO: 9178608 - DNA, 22 bp, Homo sapiens
atggctggctttacttgctttg

SEQ ID NO: 9178609 - DNA, 22 bp, Homo sapiens
atggctcagcgcctttctgtgg

SEQ ID NO: 9178610 - DNA, 22 bp, Homo sapiens
atggcagcctgagcagaggaat

SEQ ID NO: 9178611 - DNA, 22 bp, Homo sapiens
atggcagcaaatgtctggctgg

SEQ ID NO: 9178612 - DNA, 22 bp, Homo sapiens
atggcagcagtttggagtcttt

SEQ ID NO: 9178613 - DNA, 22 bp, Homo sapiens
atggcagcatagtggcaagtta

SEQ ID NO: 9178614 - DNA, 22 bp, Homo sapiens
atggctggtgatactggagtga

SEQ ID NO: 9178615 - DNA, 21 bp, Homo sapiens
atggctggtggctcagcctcc

SEQ ID NO: 9178616 - DNA, 22 bp, Homo sapiens
atggctggtctcccatggaaaa

SEQ ID NO: 9178617 - DNA, 22 bp, Homo sapiens
atggctggtagtgaattaatct

SEQ ID NO: 9178618 - DNA, 22 bp, Homo sapiens
atggctgggttcttctataggt

SEQ ID NO: 9178619 - DNA, 22 bp, Homo sapiens
atggctgggatggggtagagaa

SEQ ID NO: 9178620 - DNA, 22 bp, Homo sapiens
atggctgggatgcttctagcaa

SEQ ID NO: 9178621 - DNA, 22 bp, Homo sapiens
atggctgggaggagagtatgat

SEQ ID NO: 9178622 - DNA, 22 bp, Homo sapiens
atggctgggtcaccatcagggt

SEQ ID NO: 9178623 - DNA, 22 bp, Homo sapiens
atggctgggatttcctttgcgt

SEQ ID NO: 9178624 - DNA, 22 bp, Homo sapiens
atggctgggcttttagtcagat

SEQ ID NO: 9178625 - DNA, 22 bp, Homo sapiens
agactacatatgccacatgaag

SEQ ID NO: 9178626 - DNA, 22 bp, Homo sapiens
agacgcggtggtgcatgcctgt

SEQ ID NO: 9178627 - DNA, 22 bp, Homo sapiens
agacgcggtggtgcatgcctgt

SEQ ID NO: 9178628 - DNA, 22 bp, Homo sapiens
atgcttggatgctgccatggga

SEQ ID NO: 9178629 - DNA, 23 bp, Homo sapiens
atgcagggttacagggctgactt

SEQ ID NO: 9178630 - DNA, 23 bp, Homo sapiens
atgcagggttacagggctgactt

SEQ ID NO: 9178631 - DNA, 22 bp, Homo sapiens
atgcagggtctccgtgtgacga

SEQ ID NO: 9178632 - DNA, 22 bp, Homo sapiens
atgcagggtctccgtgtgacga

SEQ ID NO: 9178633 - DNA, 22 bp, Homo sapiens
atgcagggattaaatgactgcc

SEQ ID NO: 9178634 - DNA, 22 bp, Homo sapiens
atgcaggggctgtgttttgggt

SEQ ID NO: 9178635 - DNA, 22 bp, Homo sapiens
atgcaggggccgcctggccagg

SEQ ID NO: 9178636 - DNA, 22 bp, Homo sapiens
atgcaggggccgcctggccagg

SEQ ID NO: 9178637 - DNA, 22 bp, Homo sapiens
atgcaggggccgcctggccagg

SEQ ID NO: 9178638 - DNA, 22 bp, Homo sapiens
atgcaggggcagcagagcctgg

SEQ ID NO: 9178639 - DNA, 22 bp, Homo sapiens
atgcaggggcagcagagcctgg

SEQ ID NO: 9178640 - DNA, 22 bp, Homo sapiens
atggaaatacagccagagcaga

SEQ ID NO: 9178641 - DNA, 22 bp, Homo sapiens
atggaaagtgcatggaagtcat

SEQ ID NO: 9178642 - DNA, 22 bp, Homo sapiens
atggaaaagggtctttcatttc

SEQ ID NO: 9178643 - DNA, 19 bp, Homo sapiens
atggaaaattgtactcaat

SEQ ID NO: 9178644 - DNA, 19 bp, Homo sapiens
atggaaaattgtactcaat

SEQ ID NO: 9178645 - DNA, 19 bp, Homo sapiens
atggaaaattgtactcaat

SEQ ID NO: 9178646 - DNA, 22 bp, Homo sapiens
atgggaggcaaagatcgcagaa

SEQ ID NO: 9178647 - DNA, 22 bp, Homo sapiens
atgggaggcagacactaagttc

SEQ ID NO: 9178648 - DNA, 22 bp, Homo sapiens
atgggaggcagcagagcccagc

SEQ ID NO: 9178649 - DNA, 22 bp, Homo sapiens
atgggaggcagcagagcccagc

SEQ ID NO: 9178650 - DNA, 22 bp, Homo sapiens
atggctgtgttgttcctctgaa

SEQ ID NO: 9178651 - DNA, 22 bp, Homo sapiens
atgggaggatcacttgaggcca

SEQ ID NO: 9178652 - DNA, 22 bp, Homo sapiens
atggctgtccagtttctagaga

SEQ ID NO: 9178653 - DNA, 22 bp, Homo sapiens
atggctggtttgagctttagca

SEQ ID NO: 9178654 - DNA, 22 bp, Homo sapiens
atggctgtaaattcagagatgg

SEQ ID NO: 9178655 - DNA, 22 bp, Homo sapiens
atggctgtgaaatggtaggtgg

SEQ ID NO: 9178656 - DNA, 19 bp, Homo sapiens
atggctgtgttccagtaaa

SEQ ID NO: 9178657 - DNA, 22 bp, Homo sapiens
atggctgtgcagagattgggaa

SEQ ID NO: 9178658 - DNA, 22 bp, Homo sapiens
atgtaaaagattattttcctgt

SEQ ID NO: 9178659 - DNA, 22 bp, Homo sapiens
atgtaaaagattattttcctgt

SEQ ID NO: 9178660 - DNA, 22 bp, Homo sapiens
atgtaaaagattattttcctgt

SEQ ID NO: 9178661 - DNA, 20 bp, Homo sapiens
atgtaaaattataaggctga

SEQ ID NO: 9178662 - DNA, 22 bp, Homo sapiens
atgtaaacaaagatcttcctgc

SEQ ID NO: 9178663 - DNA, 20 bp, Homo sapiens
atgtaaaattataaggctga

SEQ ID NO: 9178664 - DNA, 22 bp, Homo sapiens
atggtttattgctttaatgaaa

SEQ ID NO: 9178665 - DNA, 20 bp, Homo sapiens
atgtaaaagacagggagtag

SEQ ID NO: 9178666 - DNA, 22 bp, Homo sapiens
atgtccagagtaaagcacattc

SEQ ID NO: 9178667 - DNA, 22 bp, Homo sapiens
atgtccagcatgacacattctc

SEQ ID NO: 9178668 - DNA, 22 bp, Homo sapiens
atgtccagagtgtcctggaaag

SEQ ID NO: 9178669 - DNA, 22 bp, Homo sapiens
atgtccagccaaccactggatt

SEQ ID NO: 9178670 - DNA, 22 bp, Homo sapiens
atgtccagaggcttggtcccca

SEQ ID NO: 9178671 - DNA, 22 bp, Homo sapiens
atgtccagagccggcctgctga

SEQ ID NO: 9178672 - DNA, 22 bp, Homo sapiens
atgtccagaggcttggtcccca

SEQ ID NO: 9178673 - DNA, 22 bp, Homo sapiens
atgtccagagaacatttgcttt

SEQ ID NO: 9178674 - DNA, 22 bp, Homo sapiens
atgtccagagccggcctgctga

SEQ ID NO: 9178675 - DNA, 22 bp, Homo sapiens
atgtccagaggtgagtcagagc

SEQ ID NO: 9178676 - DNA, 22 bp, Homo sapiens
atgtccagagggttttattttg

SEQ ID NO: 9178677 - DNA, 22 bp, Homo sapiens
atgtccagaggcttggtcccca

SEQ ID NO: 9178678 - DNA, 22 bp, Homo sapiens
atgtccagaagggtcccctgtt

SEQ ID NO: 9178679 - DNA, 22 bp, Homo sapiens
atgtacatactgcattttcaaa

SEQ ID NO: 9178680 - DNA, 22 bp, Homo sapiens
atgtacaggatggtgctcatct

SEQ ID NO: 9178681 - DNA, 22 bp, Homo sapiens
atgtacagtgataagagggcag

SEQ ID NO: 9178682 - DNA, 22 bp, Homo sapiens
atgtctgtatgtggagaggggt

SEQ ID NO: 9178683 - DNA, 22 bp, Homo sapiens
atgtctgtccaaccctgcaggg

SEQ ID NO: 9178684 - DNA, 22 bp, Homo sapiens
atgtctgtcatcttccaggaag

SEQ ID NO: 9178685 - DNA, 22 bp, Homo sapiens
atgtccagctcatgatactatc

SEQ ID NO: 9178686 - DNA, 22 bp, Homo sapiens
atgtccaggaagtcttaactca

SEQ ID NO: 9178687 - DNA, 22 bp, Homo sapiens
atgtccaggatctatccccaga

SEQ ID NO: 9178688 - DNA, 22 bp, Homo sapiens
atgtccagggctttagcggggc

SEQ ID NO: 9178689 - DNA, 22 bp, Homo sapiens
atgtccagggcacacagcagtg

SEQ ID NO: 9178690 - DNA, 22 bp, Homo sapiens
atgtccagggcacacagcagtg

SEQ ID NO: 9178691 - DNA, 22 bp, Homo sapiens
atgtccagggggcttgactggt

SEQ ID NO: 9178692 - DNA, 20 bp, Homo sapiens
atgtccagtgactggaccat

SEQ ID NO: 9178693 - DNA, 22 bp, Homo sapiens
atgtccagtacttctaaatggt

SEQ ID NO: 9178694 - DNA, 22 bp, Homo sapiens
atgtccagggggcttgactggt

SEQ ID NO: 9178695 - DNA, 23 bp, Homo sapiens
atgtccagtttacttcaggatga

SEQ ID NO: 9178696 - DNA, 23 bp, Homo sapiens
atgtccagtttacttcaggatga

SEQ ID NO: 9178697 - DNA, 22 bp, Homo sapiens
atgtccagtttctacacacata

SEQ ID NO: 9178698 - DNA, 20 bp, Homo sapiens
atgtccagtgactggaccat

SEQ ID NO: 9178699 - DNA, 22 bp, Homo sapiens
atgtcttcatagcttatatcca

SEQ ID NO: 9178700 - DNA, 22 bp, Homo sapiens
atgtctgttttcatatcagata

SEQ ID NO: 9178701 - DNA, 22 bp, Homo sapiens
atgtctgtttatccttcaagat

SEQ ID NO: 9178702 - DNA, 22 bp, Homo sapiens
atgtctgtcccctagccctgat

SEQ ID NO: 9178703 - DNA, 18 bp, Homo sapiens
atgtctgtgcactggata

SEQ ID NO: 9178704 - DNA, 22 bp, Homo sapiens
atgtctgtggcaattgttgatg

SEQ ID NO: 9178705 - DNA, 22 bp, Homo sapiens
atgtctgtgtgatcttggataa

SEQ ID NO: 9178706 - DNA, 21 bp, Homo sapiens
aggtacaggtcttgtgagtct

SEQ ID NO: 9178707 - DNA, 22 bp, Homo sapiens
acctggagatccatggtgtcga

SEQ ID NO: 9178708 - DNA, 22 bp, Homo sapiens
acctggagcttccaactcaact

SEQ ID NO: 9178709 - DNA, 21 bp, Homo sapiens
aggtacaggtcttgtgagtct

SEQ ID NO: 9178710 - DNA, 20 bp, Homo sapiens
acctggagagattattacca

SEQ ID NO: 9178711 - DNA, 20 bp, Homo sapiens
acctggagacagcactctgg

SEQ ID NO: 9178712 - DNA, 17 bp, Homo sapiens
acctggagaccaagtcc

SEQ ID NO: 9178713 - DNA, 20 bp, Homo sapiens
acctggagacagcactctgg

SEQ ID NO: 9178714 - DNA, 22 bp, Homo sapiens
acctggacacctgctgtcatct

SEQ ID NO: 9178715 - DNA, 22 bp, Homo sapiens
acctggacacctgctgtcatct

SEQ ID NO: 9178716 - DNA, 22 bp, Homo sapiens
acctggaagtgggtgctatggc

SEQ ID NO: 9178717 - DNA, 22 bp, Homo sapiens
acctggacctgccacctatgag

SEQ ID NO: 9178718 - DNA, 22 bp, Homo sapiens
acctggacttgaatcctgactt

SEQ ID NO: 9178719 - DNA, 22 bp, Homo sapiens
acctggagaaagcctctccctg

SEQ ID NO: 9178720 - DNA, 22 bp, Homo sapiens
acctgcccacacttccttccca

SEQ ID NO: 9178721 - DNA, 22 bp, Homo sapiens
acctgcccacatatatatgtat

SEQ ID NO: 9178722 - DNA, 18 bp, Homo sapiens
acctgcctgttcttctct

SEQ ID NO: 9178723 - DNA, 22 bp, Homo sapiens
acctgcccggggacattccttt

SEQ ID NO: 9178724 - DNA, 22 bp, Homo sapiens
acctgcccacttcccatgacat

SEQ ID NO: 9178725 - DNA, 22 bp, Homo sapiens
acctgcccagactcagatccta

SEQ ID NO: 9178726 - DNA, 22 bp, Homo sapiens
acctgcccagactcagatccta

SEQ ID NO: 9178727 - DNA, 22 bp, Homo sapiens
acctgcccatgaaaatggggag

SEQ ID NO: 9178728 - DNA, 22 bp, Homo sapiens
acctgctgtgattctaattggc

SEQ ID NO: 9178729 - DNA, 22 bp, Homo sapiens
acctgcttgagccagtatgaga

SEQ ID NO: 9178730 - DNA, 18 bp, Homo sapiens
acctgctgagtctaagca

SEQ ID NO: 9178731 - DNA, 22 bp, Homo sapiens
acctgctgaggagggggaatta

SEQ ID NO: 9178732 - DNA, 22 bp, Homo sapiens
acctgctgtcttgggggaatgc

SEQ ID NO: 9178733 - DNA, 22 bp, Homo sapiens
aggtagaggcctccaggcagca

SEQ ID NO: 9178734 - DNA, 22 bp, Homo sapiens
aggtagagctccagtagaaaat

SEQ ID NO: 9178735 - DNA, 22 bp, Homo sapiens
aggtactgaaaaaatgtttgca

SEQ ID NO: 9178736 - DNA, 22 bp, Homo sapiens
aggtagaggcctccaggcagca

SEQ ID NO: 9178737 - DNA, 22 bp, Homo sapiens
aggtagcagcctagcagggact

SEQ ID NO: 9178738 - DNA, 22 bp, Homo sapiens
aggtagcacagcctgagtccag

SEQ ID NO: 9178739 - DNA, 22 bp, Homo sapiens
aggtacatggggtgtgtgcacg

SEQ ID NO: 9178740 - DNA, 22 bp, Homo sapiens
aggtacagtagacagacagtta

SEQ ID NO: 9178741 - DNA, 21 bp, Homo sapiens
aggtactaatgaaaagtgatt

SEQ ID NO: 9178742 - DNA, 22 bp, Homo sapiens
aggtaccaaaagcctttttctg

SEQ ID NO: 9178743 - DNA, 21 bp, Homo sapiens
aggtaccaaaagcctgcatga

SEQ ID NO: 9178744 - DNA, 22 bp, Homo sapiens
acctggctgagaacgtgcagct

SEQ ID NO: 9178745 - DNA, 23 bp, Homo sapiens
acctggctgctcaacctgcaggg

SEQ ID NO: 9178746 - DNA, 22 bp, Homo sapiens
acctggtaacctgcctgactaa

SEQ ID NO: 9178747 - DNA, 22 bp, Homo sapiens
acctggctggttgtgattccca

SEQ ID NO: 9178748 - DNA, 23 bp, Homo sapiens
acctggctgctcaacctgcaggg

SEQ ID NO: 9178749 - DNA, 21 bp, Homo sapiens
acctgtgaatagccactgcac

SEQ ID NO: 9178750 - DNA, 22 bp, Homo sapiens
acctgtgggcagaacctagtgc

SEQ ID NO: 9178751 - DNA, 23 bp, Homo sapiens
acctgtctgcctcccaccatcaa

SEQ ID NO: 9178752 - DNA, 20 bp, Homo sapiens
agggtggggacgttctgact

SEQ ID NO: 9178753 - DNA, 20 bp, Homo sapiens
agggtggggacgttctgact

SEQ ID NO: 9178754 - DNA, 20 bp, Homo sapiens
agggtggggacgttctgact

SEQ ID NO: 9178755 - DNA, 22 bp, Homo sapiens
agggtgggctagactcttcccc

SEQ ID NO: 9178756 - DNA, 22 bp, Homo sapiens
agggcttgttaacatagagatt

SEQ ID NO: 9178757 - DNA, 22 bp, Homo sapiens
agggcttgtggtcgtggctgtg

SEQ ID NO: 9178758 - DNA, 22 bp, Homo sapiens
agggcttgtagggtggctgtag

SEQ ID NO: 9178759 - DNA, 22 bp, Homo sapiens
agggcttgccattgcctgttag

SEQ ID NO: 9178760 - DNA, 22 bp, Homo sapiens
agggctttacttctcagttcta

SEQ ID NO: 9178761 - DNA, 22 bp, Homo sapiens
agggctttcggcactctgaggg

SEQ ID NO: 9178762 - DNA, 22 bp, Homo sapiens
accctcagagtaggcactgctg

SEQ ID NO: 9178763 - DNA, 22 bp, Homo sapiens
agggctggtatgtccatgaaag

SEQ ID NO: 9178764 - DNA, 22 bp, Homo sapiens
agggctggtatgtccatgaaag

SEQ ID NO: 9178765 - DNA, 22 bp, Homo sapiens
agggctgtttttggcacctggg

SEQ ID NO: 9178766 - DNA, 22 bp, Homo sapiens
agggcttgcagaaatgagaaat

SEQ ID NO: 9178767 - DNA, 22 bp, Homo sapiens
agggcttgacaagggctggagc

SEQ ID NO: 9178768 - DNA, 22 bp, Homo sapiens
agggctgtgtccctaggggagc

SEQ ID NO: 9178769 - DNA, 22 bp, Homo sapiens
acctcccagctctgagcttggg

SEQ ID NO: 9178770 - DNA, 22 bp, Homo sapiens
agggtgtcagccacggaatggg

SEQ ID NO: 9178771 - DNA, 22 bp, Homo sapiens
agggtggggtgctacatcttta

SEQ ID NO: 9178772 - DNA, 22 bp, Homo sapiens
agggtggggtgctacatcttta

SEQ ID NO: 9178773 - DNA, 21 bp, Homo sapiens
acctccctcgagcaaccagca

SEQ ID NO: 9178774 - DNA, 22 bp, Homo sapiens
acctcccctgactcgaaaccca

SEQ ID NO: 9178775 - DNA, 22 bp, Homo sapiens
acctccccgggagcagcctcct

SEQ ID NO: 9178776 - DNA, 22 bp, Homo sapiens
acctccccgggagcagcctcct

SEQ ID NO: 9178777 - DNA, 22 bp, Homo sapiens
acctcccctcaccaatctggtt

SEQ ID NO: 9178778 - DNA, 22 bp, Homo sapiens
acctccccattaggtcacccac

SEQ ID NO: 9178779 - DNA, 22 bp, Homo sapiens
actaaatagttttgacagaaca

SEQ ID NO: 9178780 - DNA, 18 bp, Homo sapiens
actagtgagcaagctagg

SEQ ID NO: 9178781 - DNA, 22 bp, Homo sapiens
actaaatagttttgacagaaca

SEQ ID NO: 9178782 - DNA, 22 bp, Homo sapiens
actatacattgaatgttaaggt

SEQ ID NO: 9178783 - DNA, 22 bp, Homo sapiens
actaaatagttttgacagaaca

SEQ ID NO: 9178784 - DNA, 22 bp, Homo sapiens
actaaatagcctctggtagttg

SEQ ID NO: 9178785 - DNA, 22 bp, Homo sapiens
actatcaacatcattgctctag

SEQ ID NO: 9178786 - DNA, 22 bp, Homo sapiens
actatgtattgtatgggctggt

SEQ ID NO: 9178787 - DNA, 22 bp, Homo sapiens
actattagcatatcatgaatgg

SEQ ID NO: 9178788 - DNA, 22 bp, Homo sapiens
actatgtaggctcaacttccac

SEQ ID NO: 9178789 - DNA, 22 bp, Homo sapiens
actatgtatactagatgtgtaa

SEQ ID NO: 9178790 - DNA, 22 bp, Homo sapiens
actatgtaaactggcgtgggag

SEQ ID NO: 9178791 - DNA, 22 bp, Homo sapiens
actatgtacccaaagatctgat

SEQ ID NO: 9178792 - DNA, 21 bp, Homo sapiens
actcaagtggagatgccaggt

SEQ ID NO: 9178793 - DNA, 18 bp, Homo sapiens
actcaagggtggagagaa

SEQ ID NO: 9178794 - DNA, 22 bp, Homo sapiens
actatttgtaaagagcaaacgg

SEQ ID NO: 9178795 - DNA, 22 bp, Homo sapiens
actcattgaaacttaagatcta

SEQ ID NO: 9178796 - DNA, 22 bp, Homo sapiens
actcattgcagctccagcaaca

SEQ ID NO: 9178797 - DNA, 21 bp, Homo sapiens
accttcaagccagaggtggtc

SEQ ID NO: 9178798 - DNA, 22 bp, Homo sapiens
accttcaagaaacatttccttg

SEQ ID NO: 9178799 - DNA, 22 bp, Homo sapiens
accttcaagtatgtgggctgaa

SEQ ID NO: 9178800 - DNA, 22 bp, Homo sapiens
accttcaatgaaaataatagtc

SEQ ID NO: 9178801 - DNA, 22 bp, Homo sapiens
accttcaatgaaaataatagtc

SEQ ID NO: 9178802 - DNA, 22 bp, Homo sapiens
accttcaactcaaagtgtccca

SEQ ID NO: 9178803 - DNA, 22 bp, Homo sapiens
accttcaactcaaagtgtccca

SEQ ID NO: 9178804 - DNA, 22 bp, Homo sapiens
accttcaaactagatagaagtt

SEQ ID NO: 9178805 - DNA, 22 bp, Homo sapiens
accttatttggaaatataatta

SEQ ID NO: 9178806 - DNA, 23 bp, Homo sapiens
acgggagggctgtttgcttggtg

SEQ ID NO: 9178807 - DNA, 21 bp, Homo sapiens
acgggaatgaacatggtggag

SEQ ID NO: 9178808 - DNA, 19 bp, Homo sapiens
actaaaaatgatgtttgag

SEQ ID NO: 9178809 - DNA, 19 bp, Homo sapiens
actaaaaatgatgtttgag

SEQ ID NO: 9178810 - DNA, 19 bp, Homo sapiens
actaaaaatgatgtttgag

SEQ ID NO: 9178811 - DNA, 22 bp, Homo sapiens
actaaagtatctcctatttcat

SEQ ID NO: 9178812 - DNA, 22 bp, Homo sapiens
actaaagctcacagagttgaac

SEQ ID NO: 9178813 - DNA, 22 bp, Homo sapiens
actaaagctcacagagttgaac

SEQ ID NO: 9178814 - DNA, 22 bp, Homo sapiens
actaaagaagccaaagttttct

SEQ ID NO: 9178815 - DNA, 22 bp, Homo sapiens
acgttttcagccttaatgtaga

SEQ ID NO: 9178816 - DNA, 22 bp, Homo sapiens
acgttttcagtgactgtgcttc

SEQ ID NO: 9178817 - DNA, 22 bp, Homo sapiens
acgttttctagagaatatgcag

SEQ ID NO: 9178818 - DNA, 22 bp, Homo sapiens
acgtttatggagtgcctatcat

SEQ ID NO: 9178819 - DNA, 22 bp, Homo sapiens
acgtggcggccgccgtgagcgg

SEQ ID NO: 9178820 - DNA, 22 bp, Homo sapiens
agtggctgagtgactgtgactc

SEQ ID NO: 9178821 - DNA, 20 bp, Homo sapiens
agtggctgatggaaagaagc

SEQ ID NO: 9178822 - DNA, 23 bp, Homo sapiens
agtggctgagagtgtttcatatg

SEQ ID NO: 9178823 - DNA, 22 bp, Homo sapiens
agtggctgatgtaggcagtggg

SEQ ID NO: 9178824 - DNA, 22 bp, Homo sapiens
agtggctgattacaaactgagt

SEQ ID NO: 9178825 - DNA, 22 bp, Homo sapiens
actgcttacttctagaactctt

SEQ ID NO: 9178826 - DNA, 23 bp, Homo sapiens
actgctgtctttgaagtgcttga

SEQ ID NO: 9178827 - DNA, 22 bp, Homo sapiens
actgctgcaggtccagcccctt

SEQ ID NO: 9178828 - DNA, 22 bp, Homo sapiens
actgctgattattgaagtagag

SEQ ID NO: 9178829 - DNA, 22 bp, Homo sapiens
actgctgatataagaaaagatt

SEQ ID NO: 9178830 - DNA, 22 bp, Homo sapiens
actgctgattatgaaagtgaca

SEQ ID NO: 9178831 - DNA, 22 bp, Homo sapiens
actgctctctttgcaggggcta

SEQ ID NO: 9178832 - DNA, 22 bp, Homo sapiens
actgctcacgcattacttgagc

SEQ ID NO: 9178833 - DNA, 22 bp, Homo sapiens
actgctctctgcaagtagatgg

SEQ ID NO: 9178834 - DNA, 22 bp, Homo sapiens
actggcagagaccctgatggcc

SEQ ID NO: 9178835 - DNA, 22 bp, Homo sapiens
actggcagcagcagcccttggg

SEQ ID NO: 9178836 - DNA, 22 bp, Homo sapiens
agtggctgctggagtggagatg

SEQ ID NO: 9178837 - DNA, 22 bp, Homo sapiens
agtggctgctgactttaataca

SEQ ID NO: 9178838 - DNA, 22 bp, Homo sapiens
agtggctgccaagatataattc

SEQ ID NO: 9178839 - DNA, 22 bp, Homo sapiens
agtggctgccaagagcaatgct

SEQ ID NO: 9178840 - DNA, 22 bp, Homo sapiens
agtggctgctatgatcaggaca

SEQ ID NO: 9178841 - DNA, 22 bp, Homo sapiens
actggatggtgtcatgagcagc

SEQ ID NO: 9178842 - DNA, 22 bp, Homo sapiens
actggattccattgtgcaaaga

SEQ ID NO: 9178843 - DNA, 22 bp, Homo sapiens
actggattgggaaagtacttca

SEQ ID NO: 9178844 - DNA, 22 bp, Homo sapiens
actggattctcttacacagatg

SEQ ID NO: 9178845 - DNA, 22 bp, Homo sapiens
actggagttttaaaggaacttg

SEQ ID NO: 9178846 - DNA, 22 bp, Homo sapiens
actggataggcgtcccgagagg

SEQ ID NO: 9178847 - DNA, 22 bp, Homo sapiens
actggatgaggggaaagagaca

SEQ ID NO: 9178848 - DNA, 22 bp, Homo sapiens
agtggctgcttctggttgctcc

SEQ ID NO: 9178849 - DNA, 22 bp, Homo sapiens
actggagttgattacataaaac

SEQ ID NO: 9178850 - DNA, 22 bp, Homo sapiens
actggagttgggtcaagattct

SEQ ID NO: 9178851 - DNA, 22 bp, Homo sapiens
actgaattagggaacactgaac

SEQ ID NO: 9178852 - DNA, 22 bp, Homo sapiens
actgaatgaggggtgatctggg

SEQ ID NO: 9178853 - DNA, 22 bp, Homo sapiens
actgaatatattccattgcatg

SEQ ID NO: 9178854 - DNA, 22 bp, Homo sapiens
actgaagtccacacatgtagga

SEQ ID NO: 9178855 - DNA, 22 bp, Homo sapiens
actgaaggtctcagcaaggatg

SEQ ID NO: 9178856 - DNA, 22 bp, Homo sapiens
actgaagttcatacaacagact

SEQ ID NO: 9178857 - DNA, 22 bp, Homo sapiens
actgatggcccaccttggtctc

SEQ ID NO: 9178858 - DNA, 22 bp, Homo sapiens
actgatgatctgggagtagagt

SEQ ID NO: 9178859 - DNA, 22 bp, Homo sapiens
actgatttcagggatgagaaga

SEQ ID NO: 9178860 - DNA, 22 bp, Homo sapiens
actgattgcattcatagggttt

SEQ ID NO: 9178861 - DNA, 22 bp, Homo sapiens
actgcaacctccacctcctggg

SEQ ID NO: 9178862 - DNA, 20 bp, Homo sapiens
actgcaaagtactctttcag

SEQ ID NO: 9178863 - DNA, 22 bp, Homo sapiens
actgcaaacatagtacttgagc

SEQ ID NO: 9178864 - DNA, 21 bp, Homo sapiens
actgcaaacagcagagactga

SEQ ID NO: 9178865 - DNA, 22 bp, Homo sapiens
actgcaaaaatgggtgcattca

SEQ ID NO: 9178866 - DNA, 22 bp, Homo sapiens
actgatttttcaggagggcctt

SEQ ID NO: 9178867 - DNA, 22 bp, Homo sapiens
actgatttggttagagggccag

SEQ ID NO: 9178868 - DNA, 22 bp, Homo sapiens
actgcaaagccagatattatca

SEQ ID NO: 9178869 - DNA, 22 bp, Homo sapiens
actgcaaagggaagccctttct

SEQ ID NO: 9178870 - DNA, 22 bp, Homo sapiens
actgcaaagggaagccctttct

SEQ ID NO: 9178871 - DNA, 22 bp, Homo sapiens
actgcacacacagaatttaggg

SEQ ID NO: 9178872 - DNA, 22 bp, Homo sapiens
actgcaattatttgttcaccaa

SEQ ID NO: 9178873 - DNA, 22 bp, Homo sapiens
actgcaacctccgcctgccagg

SEQ ID NO: 9178874 - DNA, 22 bp, Homo sapiens
actgcaacctccgcctgccagg

SEQ ID NO: 9178875 - DNA, 22 bp, Homo sapiens
actccaggcatctgcttctgct

SEQ ID NO: 9178876 - DNA, 22 bp, Homo sapiens
actccaggcatctgcttctgct

SEQ ID NO: 9178877 - DNA, 22 bp, Homo sapiens
actccagggaggtgagtgtgcg

SEQ ID NO: 9178878 - DNA, 22 bp, Homo sapiens
actccagggctccaccccagat

SEQ ID NO: 9178879 - DNA, 22 bp, Homo sapiens
actccagggctccaccccagat

SEQ ID NO: 9178880 - DNA, 19 bp, Homo sapiens
actccagggatgacagaag

SEQ ID NO: 9178881 - DNA, 22 bp, Homo sapiens
actccaggaaacttaggggaaa

SEQ ID NO: 9178882 - DNA, 22 bp, Homo sapiens
actccaggatgtagaatcagag

SEQ ID NO: 9178883 - DNA, 22 bp, Homo sapiens
actccacaccacgggggccgcc

SEQ ID NO: 9178884 - DNA, 22 bp, Homo sapiens
actccaaggccacatgcattcc

SEQ ID NO: 9178885 - DNA, 22 bp, Homo sapiens
actccacaccacgggggccgcc

SEQ ID NO: 9178886 - DNA, 22 bp, Homo sapiens
agtctctgaggttcagatgcct

SEQ ID NO: 9178887 - DNA, 20 bp, Homo sapiens
agtctctgcaacatagtgca

SEQ ID NO: 9178888 - DNA, 20 bp, Homo sapiens
agtctctgcaacatagtgca

SEQ ID NO: 9178889 - DNA, 22 bp, Homo sapiens
agtctctgaggttcagatgcct

SEQ ID NO: 9178890 - DNA, 23 bp, Homo sapiens
agtcctttttataaaattgagga

SEQ ID NO: 9178891 - DNA, 22 bp, Homo sapiens
actccagggcttctatgatggt

SEQ ID NO: 9178892 - DNA, 22 bp, Homo sapiens
actccaggggttgctatttaca

SEQ ID NO: 9178893 - DNA, 22 bp, Homo sapiens
actccagggctgaacgaggccc

SEQ ID NO: 9178894 - DNA, 22 bp, Homo sapiens
actccagggctccatcccttgt

SEQ ID NO: 9178895 - DNA, 22 bp, Homo sapiens
actccagggctccatcccttgt

SEQ ID NO: 9178896 - DNA, 22 bp, Homo sapiens
actccagggctccaccccagat

SEQ ID NO: 9178897 - DNA, 20 bp, Homo sapiens
agtctctgtagtgcctgaga

SEQ ID NO: 9178898 - DNA, 22 bp, Homo sapiens
agtctctgcatgatgcagcaca

SEQ ID NO: 9178899 - DNA, 22 bp, Homo sapiens
agtctctggactgggagatggc

SEQ ID NO: 9178900 - DNA, 22 bp, Homo sapiens
agtctcttggcattctgaaaca

SEQ ID NO: 9178901 - DNA, 22 bp, Homo sapiens
agtctggatttagaggtgggcc

SEQ ID NO: 9178902 - DNA, 22 bp, Homo sapiens
agtctcttccttcaaggctggt

SEQ ID NO: 9178903 - DNA, 22 bp, Homo sapiens
agtctcttcctcatgcatatgt

SEQ ID NO: 9178904 - DNA, 22 bp, Homo sapiens
agtctcttattccctattgctg

SEQ ID NO: 9178905 - DNA, 17 bp, Homo sapiens
agtctgggacctgcgtg

SEQ ID NO: 9178906 - DNA, 22 bp, Homo sapiens
agtctggattttctacccttct

SEQ ID NO: 9178907 - DNA, 22 bp, Homo sapiens
agtctgggagaaggtgagatta

SEQ ID NO: 9178908 - DNA, 22 bp, Homo sapiens
agtctgggagggatgccagtgt

SEQ ID NO: 9178909 - DNA, 21 bp, Homo sapiens
agtctggggaagggatcccag

SEQ ID NO: 9178910 - DNA, 22 bp, Homo sapiens
agtctgggtgtgaatgaacttg

SEQ ID NO: 9178911 - DNA, 22 bp, Homo sapiens
actgaaatatttagaagtgaag

SEQ ID NO: 9178912 - DNA, 22 bp, Homo sapiens
actgaaatatttagaagtgaag

SEQ ID NO: 9178913 - DNA, 22 bp, Homo sapiens
actgaaatatttagaagtgaag

SEQ ID NO: 9178914 - DNA, 22 bp, Homo sapiens
actgaaatggggacagtcctta

SEQ ID NO: 9178915 - DNA, 22 bp, Homo sapiens
actgaaatgaaatctatcatct

SEQ ID NO: 9178916 - DNA, 22 bp, Homo sapiens
actgaaagataaatcagttagc

SEQ ID NO: 9178917 - DNA, 23 bp, Homo sapiens
actgaaaggatcctagcagagac

SEQ ID NO: 9178918 - DNA, 22 bp, Homo sapiens
actgaagagcgtgctatgctca

SEQ ID NO: 9178919 - DNA, 18 bp, Homo sapiens
actgaagatgcaagacct

SEQ ID NO: 9178920 - DNA, 18 bp, Homo sapiens
actgaagatgcaagacct

SEQ ID NO: 9178921 - DNA, 22 bp, Homo sapiens
actgaagagaagcattttctgc

SEQ ID NO: 9178922 - DNA, 22 bp, Homo sapiens
actgaagacattactggtctaa

SEQ ID NO: 9178923 - DNA, 22 bp, Homo sapiens
atatcttttagagcaagcttgt

SEQ ID NO: 9178924 - DNA, 22 bp, Homo sapiens
agaaaattactccagagacaag

SEQ ID NO: 9178925 - DNA, 22 bp, Homo sapiens
agaaaattagattttactgtgt

SEQ ID NO: 9178926 - DNA, 22 bp, Homo sapiens
agaaaataaattgatggtggaa

SEQ ID NO: 9178927 - DNA, 22 bp, Homo sapiens
agaaaataaattgatggtggaa

SEQ ID NO: 9178928 - DNA, 22 bp, Homo sapiens
agaaaataaattgatggtggaa

SEQ ID NO: 9178929 - DNA, 22 bp, Homo sapiens
agaaaatttattcatgttagtt

SEQ ID NO: 9178930 - DNA, 22 bp, Homo sapiens
agaaaatttaaagagacacaca

SEQ ID NO: 9178931 - DNA, 22 bp, Homo sapiens
agaaaatttaaagagacacaca

SEQ ID NO: 9178932 - DNA, 22 bp, Homo sapiens
agaaacagaaccaggtgtcatt

SEQ ID NO: 9178933 - DNA, 22 bp, Homo sapiens
agaaacagaaccaggtgtcatt

SEQ ID NO: 9178934 - DNA, 22 bp, Homo sapiens
agaaacagaaccaggtgtcatt

SEQ ID NO: 9178935 - DNA, 22 bp, Homo sapiens
atatatttgagaatattcatga

SEQ ID NO: 9178936 - DNA, 22 bp, Homo sapiens
atatatttactctcctgttgca

SEQ ID NO: 9178937 - DNA, 22 bp, Homo sapiens
atatatttactctcctgttgca

SEQ ID NO: 9178938 - DNA, 22 bp, Homo sapiens
atatatttgagaatattcatga

SEQ ID NO: 9178939 - DNA, 18 bp, Homo sapiens
atatctgtgggatggaga

SEQ ID NO: 9178940 - DNA, 22 bp, Homo sapiens
atatctgtggagggcttacaaa

SEQ ID NO: 9178941 - DNA, 22 bp, Homo sapiens
atatattttgaatagcctctgt

SEQ ID NO: 9178942 - DNA, 22 bp, Homo sapiens
acttggtgaagtcaggtgatta

SEQ ID NO: 9178943 - DNA, 22 bp, Homo sapiens
atagtttacaaaaatgatgcat

SEQ ID NO: 9178944 - DNA, 22 bp, Homo sapiens
atagtttacaaaaatgatgcat

SEQ ID NO: 9178945 - DNA, 22 bp, Homo sapiens
acttggttctaactagtgtata

SEQ ID NO: 9178946 - DNA, 22 bp, Homo sapiens
acttggtggcgaacgagggtca

SEQ ID NO: 9178947 - DNA, 22 bp, Homo sapiens
atagtttacaaaaatgatgcat

SEQ ID NO: 9178948 - DNA, 22 bp, Homo sapiens
atataatagtttcataaaggct

SEQ ID NO: 9178949 - DNA, 22 bp, Homo sapiens
atataatagtttcataaaggct

SEQ ID NO: 9178950 - DNA, 22 bp, Homo sapiens
atataatttagaaggggaaaca

SEQ ID NO: 9178951 - DNA, 22 bp, Homo sapiens
atataattgttctgaagtgttt

SEQ ID NO: 9178952 - DNA, 22 bp, Homo sapiens
atataattctcaggtttgacta

SEQ ID NO: 9178953 - DNA, 22 bp, Homo sapiens
atataatagtttcataaaggct

SEQ ID NO: 9178954 - DNA, 22 bp, Homo sapiens
atataattaatttagctgcctc

SEQ ID NO: 9178955 - DNA, 22 bp, Homo sapiens
atatacaaagggcaacctcgct

SEQ ID NO: 9178956 - DNA, 22 bp, Homo sapiens
atataatttttggttagctcaa

SEQ ID NO: 9178957 - DNA, 22 bp, Homo sapiens
atatacacagagcttatggtga

SEQ ID NO: 9178958 - DNA, 22 bp, Homo sapiens
atatacacatgtgtatacattt

SEQ ID NO: 9178959 - DNA, 21 bp, Homo sapiens
actttgggcactttcctgccc

SEQ ID NO: 9178960 - DNA, 22 bp, Homo sapiens
atatacacatgtgtatacattt

SEQ ID NO: 9178961 - DNA, 21 bp, Homo sapiens
actttgggcactttcctgccc

SEQ ID NO: 9178962 - DNA, 22 bp, Homo sapiens
actttggggaacttttctcctc

SEQ ID NO: 9178963 - DNA, 20 bp, Homo sapiens
actttggggtctttctcaga

SEQ ID NO: 9178964 - DNA, 20 bp, Homo sapiens
actttggggtctttctcaga

SEQ ID NO: 9178965 - DNA, 22 bp, Homo sapiens
actttggtgatacagatacggc

SEQ ID NO: 9178966 - DNA, 19 bp, Homo sapiens
actttggtgattagaggga

SEQ ID NO: 9178967 - DNA, 22 bp, Homo sapiens
actttggtcttagaggaggaat

SEQ ID NO: 9178968 - DNA, 22 bp, Homo sapiens
actttggtgaatcagttttgtt

SEQ ID NO: 9178969 - DNA, 22 bp, Homo sapiens
actttggtctctgcccctggtg

SEQ ID NO: 9178970 - DNA, 17 bp, Homo sapiens
actttggtcctgtgctc

SEQ ID NO: 9178971 - DNA, 22 bp, Homo sapiens
actttggtcccatgtgtgtaaa

SEQ ID NO: 9178972 - DNA, 22 bp, Homo sapiens
actttgggtaagttgattaatc

SEQ ID NO: 9178973 - DNA, 22 bp, Homo sapiens
actttgggtaagccaggtgcta

SEQ ID NO: 9178974 - DNA, 22 bp, Homo sapiens
actttgtaatagtttaaggtca

SEQ ID NO: 9178975 - DNA, 22 bp, Homo sapiens
actttgtaaattgttgtgactc

SEQ ID NO: 9178976 - DNA, 22 bp, Homo sapiens
actttgtaaattgttgtgactc

SEQ ID NO: 9178977 - DNA, 22 bp, Homo sapiens
actttggtttccctgttcgtaa

SEQ ID NO: 9178978 - DNA, 22 bp, Homo sapiens
actttggttcacagctgttcat

SEQ ID NO: 9178979 - DNA, 20 bp, Homo sapiens
actttggttattgggaccat

SEQ ID NO: 9178980 - DNA, 22 bp, Homo sapiens
actttggtgcgaagtcacttta

SEQ ID NO: 9178981 - DNA, 22 bp, Homo sapiens
actttggttataggagccaaaa

SEQ ID NO: 9178982 - DNA, 22 bp, Homo sapiens
atatataacctggataaggctt

SEQ ID NO: 9178983 - DNA, 22 bp, Homo sapiens
atatataacctggataaggctt

SEQ ID NO: 9178984 - DNA, 22 bp, Homo sapiens
atcatttatgccccaattagat

SEQ ID NO: 9178985 - DNA, 20 bp, Homo sapiens
atcatctttacaatgtcagt

SEQ ID NO: 9178986 - DNA, 22 bp, Homo sapiens
atcagcaagatgtaatttctat

SEQ ID NO: 9178987 - DNA, 22 bp, Homo sapiens
atccagaggcactgccctttgt

SEQ ID NO: 9178988 - DNA, 22 bp, Homo sapiens
atccagagttatatccaagcag

SEQ ID NO: 9178989 - DNA, 22 bp, Homo sapiens
atccagagttatatccaagcag

SEQ ID NO: 9178990 - DNA, 22 bp, Homo sapiens
atccagagtgtaattctccatg

SEQ ID NO: 9178991 - DNA, 22 bp, Homo sapiens
atccagagttatatccaagcag

SEQ ID NO: 9178992 - DNA, 22 bp, Homo sapiens
atccagagtgtaattctccatg

SEQ ID NO: 9178993 - DNA, 22 bp, Homo sapiens
atccagagtggccttctttcca

SEQ ID NO: 9178994 - DNA, 22 bp, Homo sapiens
agaaccttccatcactccctac

SEQ ID NO: 9178995 - DNA, 22 bp, Homo sapiens
agaagaaatgaggccgttctgc

SEQ ID NO: 9178996 - DNA, 22 bp, Homo sapiens
agaacctttctttagaaattca

SEQ ID NO: 9178997 - DNA, 22 bp, Homo sapiens
atccagagacccaaggacagaa

SEQ ID NO: 9178998 - DNA, 22 bp, Homo sapiens
atcattttatggctgagaggac

SEQ ID NO: 9178999 - DNA, 22 bp, Homo sapiens
atccactctcccattcatgcat

SEQ ID NO: 9179000 - DNA, 22 bp, Homo sapiens
atccactctaagatctgtggtg

SEQ ID NO: 9179001 - DNA, 22 bp, Homo sapiens
agaaacatttagattatatgtc

SEQ ID NO: 9179002 - DNA, 21 bp, Homo sapiens
atcacattggctgttattatt

SEQ ID NO: 9179003 - DNA, 21 bp, Homo sapiens
atcacattggctgttattatt

SEQ ID NO: 9179004 - DNA, 22 bp, Homo sapiens
agaaacatcctgctttccattt

SEQ ID NO: 9179005 - DNA, 21 bp, Homo sapiens
agaaacatgatcaaaggaacc

SEQ ID NO: 9179006 - DNA, 22 bp, Homo sapiens
agaaacagaagggaaagctttt

SEQ ID NO: 9179007 - DNA, 22 bp, Homo sapiens
agaaacagcattagcatcaatt

SEQ ID NO: 9179008 - DNA, 22 bp, Homo sapiens
agaaacagcattagcatcaatt

SEQ ID NO: 9179009 - DNA, 20 bp, Homo sapiens
agaaacagcacaattctgtt

SEQ ID NO: 9179010 - DNA, 20 bp, Homo sapiens
agaaacagcacaattctgtt

SEQ ID NO: 9179011 - DNA, 22 bp, Homo sapiens
agaaacatcattggaacacaag

SEQ ID NO: 9179012 - DNA, 22 bp, Homo sapiens
agaaacatcattggaacacaag

SEQ ID NO: 9179013 - DNA, 22 bp, Homo sapiens
atcagatccataatgacctgtg

SEQ ID NO: 9179014 - DNA, 22 bp, Homo sapiens
atcactgtcgtcatctgagatt

SEQ ID NO: 9179015 - DNA, 22 bp, Homo sapiens
atcactgtggcccaaaacctca

SEQ ID NO: 9179016 - DNA, 22 bp, Homo sapiens
atcactgttatctagaagcaca

SEQ ID NO: 9179017 - DNA, 22 bp, Homo sapiens
atcactgatgaagttagaccta

SEQ ID NO: 9179018 - DNA, 22 bp, Homo sapiens
atcaccaggcaaaatgtcagag

SEQ ID NO: 9179019 - DNA, 22 bp, Homo sapiens
atcacatttatagtggcacgca

SEQ ID NO: 9179020 - DNA, 22 bp, Homo sapiens
atcacatttatagtggcacgca

SEQ ID NO: 9179021 - DNA, 21 bp, Homo sapiens
atcaccagcagaagctgcaga

SEQ ID NO: 9179022 - DNA, 22 bp, Homo sapiens
atcacattgttagcatagactg

SEQ ID NO: 9179023 - DNA, 22 bp, Homo sapiens
atcactatgggcattatattta

SEQ ID NO: 9179024 - DNA, 22 bp, Homo sapiens
atcactatgggcattatattta

SEQ ID NO: 9179025 - DNA, 21 bp, Homo sapiens
atcactgaatgccttcaagga

SEQ ID NO: 9179026 - DNA, 22 bp, Homo sapiens
atcactgaaatactgaaattac

SEQ ID NO: 9179027 - DNA, 22 bp, Homo sapiens
atcactatgcttatgtggcaca

SEQ ID NO: 9179028 - DNA, 22 bp, Homo sapiens
atcacctggaggtgatcacttg

SEQ ID NO: 9179029 - DNA, 22 bp, Homo sapiens
atcacgtgaagtccataatagt

SEQ ID NO: 9179030 - DNA, 22 bp, Homo sapiens
actgtaaaatgagatatgtata

SEQ ID NO: 9179031 - DNA, 22 bp, Homo sapiens
actgtaaaatacataagtattg

SEQ ID NO: 9179032 - DNA, 22 bp, Homo sapiens
actggtttttccatatgagatg

SEQ ID NO: 9179033 - DNA, 22 bp, Homo sapiens
agtttagcatttgaagttattc

SEQ ID NO: 9179034 - DNA, 20 bp, Homo sapiens
agtttagaggccaacaagcc

SEQ ID NO: 9179035 - DNA, 22 bp, Homo sapiens
agtttagagttcaaattagttc

SEQ ID NO: 9179036 - DNA, 22 bp, Homo sapiens
agtttagagttcaaattagttc

SEQ ID NO: 9179037 - DNA, 22 bp, Homo sapiens
agtttatgattttatgtaagta

SEQ ID NO: 9179038 - DNA, 22 bp, Homo sapiens
agtttacatgacgtgtatttca

SEQ ID NO: 9179039 - DNA, 22 bp, Homo sapiens
agtttacagatgctacaggagc

SEQ ID NO: 9179040 - DNA, 22 bp, Homo sapiens
agtttacactatgaaaagacta

SEQ ID NO: 9179041 - DNA, 22 bp, Homo sapiens
agtttacacttttgattcttat

SEQ ID NO: 9179042 - DNA, 19 bp, Homo sapiens
actggcagtttctgcatgg

SEQ ID NO: 9179043 - DNA, 22 bp, Homo sapiens
actggcaggctgctggccggcg

SEQ ID NO: 9179044 - DNA, 22 bp, Homo sapiens
actggcagtagagggagcgcat

SEQ ID NO: 9179045 - DNA, 22 bp, Homo sapiens
actgtaaagttacgatcaagtt

SEQ ID NO: 9179046 - DNA, 22 bp, Homo sapiens
actgtaaaggtgattagaagtt

SEQ ID NO: 9179047 - DNA, 22 bp, Homo sapiens
actgtaaagaggtgtatcttta

SEQ ID NO: 9179048 - DNA, 22 bp, Homo sapiens
actgtaaattacataagaacag

SEQ ID NO: 9179049 - DNA, 22 bp, Homo sapiens
actgtcatgacgtttgtcaccc

SEQ ID NO: 9179050 - DNA, 22 bp, Homo sapiens
actgtcatgatcgaagatgtca

SEQ ID NO: 9179051 - DNA, 22 bp, Homo sapiens
actgtaaattacataagaacag

SEQ ID NO: 9179052 - DNA, 22 bp, Homo sapiens
actgtcttcaaatgaatatatt

SEQ ID NO: 9179053 - DNA, 20 bp, Homo sapiens
actgtctggggacctcatta

SEQ ID NO: 9179054 - DNA, 22 bp, Homo sapiens
actgtctgctggcccctggtta

SEQ ID NO: 9179055 - DNA, 22 bp, Homo sapiens
actgtgaacggactgaagccca

SEQ ID NO: 9179056 - DNA, 22 bp, Homo sapiens
actgtgaaagctaacatcttag

SEQ ID NO: 9179057 - DNA, 17 bp, Homo sapiens
actgtcttttacaccct

SEQ ID NO: 9179058 - DNA, 22 bp, Homo sapiens
actgtcttgtgttaaagaacca

SEQ ID NO: 9179059 - DNA, 22 bp, Homo sapiens
actgtcttgttccaagactaaa

SEQ ID NO: 9179060 - DNA, 22 bp, Homo sapiens
actgtcttgttccaagactaaa

SEQ ID NO: 9179061 - DNA, 22 bp, Homo sapiens
actgtctttattagaatcttat

SEQ ID NO: 9179062 - DNA, 22 bp, Homo sapiens
actgtctttgagctggaggagg

SEQ ID NO: 9179063 - DNA, 22 bp, Homo sapiens
actgtcttgctatgagctccca

SEQ ID NO: 9179064 - DNA, 22 bp, Homo sapiens
actgtcttcatatctgtgtctc

SEQ ID NO: 9179065 - DNA, 22 bp, Homo sapiens
actgtcttcaaatgaatatatt

SEQ ID NO: 9179066 - DNA, 22 bp, Homo sapiens
actgtcttccaggtctggaggt

SEQ ID NO: 9179067 - DNA, 20 bp, Homo sapiens
actgtgaatgctgaattagc

SEQ ID NO: 9179068 - DNA, 22 bp, Homo sapiens
agtttcatttcttagtaccagt

SEQ ID NO: 9179069 - DNA, 23 bp, Homo sapiens
agtttccacccagggtagaaggg

SEQ ID NO: 9179070 - DNA, 21 bp, Homo sapiens
agtttcctcaactgcagaagg

SEQ ID NO: 9179071 - DNA, 22 bp, Homo sapiens
agtttcctcatgttaatatgga

SEQ ID NO: 9179072 - DNA, 22 bp, Homo sapiens
agtttcctcatctgtaaaatga

SEQ ID NO: 9179073 - DNA, 21 bp, Homo sapiens
agtttcctcatctgcatagga

SEQ ID NO: 9179074 - DNA, 21 bp, Homo sapiens
agtttcctcatctgcatagga

SEQ ID NO: 9179075 - DNA, 22 bp, Homo sapiens
actgtgggtcccagctgtgtct

SEQ ID NO: 9179076 - DNA, 22 bp, Homo sapiens
actgtgtattcctatatagtaa

SEQ ID NO: 9179077 - DNA, 22 bp, Homo sapiens
actgtgccacaattcaccaggg

SEQ ID NO: 9179078 - DNA, 22 bp, Homo sapiens
agtttctaacatatagcattgg

SEQ ID NO: 9179079 - DNA, 21 bp, Homo sapiens
actgtggggttcaactggcag

SEQ ID NO: 9179080 - DNA, 22 bp, Homo sapiens
agtttccttgggcatttgttta

SEQ ID NO: 9179081 - DNA, 22 bp, Homo sapiens
agtttccttggattcaatttgg

SEQ ID NO: 9179082 - DNA, 22 bp, Homo sapiens
agtttcctgggagattcttaca

SEQ ID NO: 9179083 - DNA, 22 bp, Homo sapiens
agtttcctgggagattcttaca

SEQ ID NO: 9179084 - DNA, 22 bp, Homo sapiens
acttcagtgtggtataaaacgt

SEQ ID NO: 9179085 - DNA, 22 bp, Homo sapiens
acttcagtttccctcaacaaga

SEQ ID NO: 9179086 - DNA, 23 bp, Homo sapiens
acttcatggcactgtcttagagg

SEQ ID NO: 9179087 - DNA, 22 bp, Homo sapiens
acttcatgttgctcttggctat

SEQ ID NO: 9179088 - DNA, 22 bp, Homo sapiens
acttccagaattagaatttaag

SEQ ID NO: 9179089 - DNA, 22 bp, Homo sapiens
acttccaaataccatcacattg

SEQ ID NO: 9179090 - DNA, 22 bp, Homo sapiens
acttgcatgatattcaacagag

SEQ ID NO: 9179091 - DNA, 22 bp, Homo sapiens
acttctttcacaatgtttctag

SEQ ID NO: 9179092 - DNA, 22 bp, Homo sapiens
acttggcttcaaggttaaggtc

SEQ ID NO: 9179093 - DNA, 22 bp, Homo sapiens
acttggcttaaagtagtgatcg

SEQ ID NO: 9179094 - DNA, 22 bp, Homo sapiens
acttggctgggagagttgaaga

SEQ ID NO: 9179095 - DNA, 22 bp, Homo sapiens
acttggatatgttcactagacc

SEQ ID NO: 9179096 - DNA, 22 bp, Homo sapiens
acttggagagataatcccatat

SEQ ID NO: 9179097 - DNA, 20 bp, Homo sapiens
acttgctgggctttgttacc

SEQ ID NO: 9179098 - DNA, 22 bp, Homo sapiens
acttgcctgttacatttctagt

SEQ ID NO: 9179099 - DNA, 22 bp, Homo sapiens
acttgctggtggcatttacagt

SEQ ID NO: 9179100 - DNA, 22 bp, Homo sapiens
acttgctggtggcatttacagt

SEQ ID NO: 9179101 - DNA, 20 bp, Homo sapiens
acttggaactcatttttctt

SEQ ID NO: 9179102 - DNA, 22 bp, Homo sapiens
acttgccccagaattgctgctg

SEQ ID NO: 9179103 - DNA, 22 bp, Homo sapiens
acttcaaatgtgacaatgtgaa

SEQ ID NO: 9179104 - DNA, 22 bp, Homo sapiens
acttcaaatgtgacaatgtgaa

SEQ ID NO: 9179105 - DNA, 22 bp, Homo sapiens
acttcaaacaattaacagagaa

SEQ ID NO: 9179106 - DNA, 22 bp, Homo sapiens
acttatttcttggatgatcctg

SEQ ID NO: 9179107 - DNA, 22 bp, Homo sapiens
acttcacaggttttcataaaac

SEQ ID NO: 9179108 - DNA, 22 bp, Homo sapiens
acttcacattagctaaaaggga

SEQ ID NO: 9179109 - DNA, 22 bp, Homo sapiens
acttcagagaaagagggaattc

SEQ ID NO: 9179110 - DNA, 22 bp, Homo sapiens
acttcacaaagagatcatctaa

SEQ ID NO: 9179111 - DNA, 22 bp, Homo sapiens
actgtgtctcattcatcattgt

SEQ ID NO: 9179112 - DNA, 22 bp, Homo sapiens
actgtgtctagcaccacgtgtc

SEQ ID NO: 9179113 - DNA, 22 bp, Homo sapiens
actgtgtctcacagtggtacca

SEQ ID NO: 9179114 - DNA, 18 bp, Homo sapiens
actgtgtgaattagctcc

SEQ ID NO: 9179115 - DNA, 22 bp, Homo sapiens
actgtgtcctatttccttgaca

SEQ ID NO: 9179116 - DNA, 22 bp, Homo sapiens
actgtgtcctcatgtggcagaa

SEQ ID NO: 9179117 - DNA, 22 bp, Homo sapiens
actgtgtcattgatcagaaaca

SEQ ID NO: 9179118 - DNA, 22 bp, Homo sapiens
actgtgtcattgaacatggaaa

SEQ ID NO: 9179119 - DNA, 19 bp, Homo sapiens
actgtgtggaagtgtgatt

SEQ ID NO: 9179120 - DNA, 22 bp, Homo sapiens
actgtgtggaaatttgtgaggg

SEQ ID NO: 9179121 - DNA, 22 bp, Homo sapiens
actgtgtgaggctgggtgagtc

SEQ ID NO: 9179122 - DNA, 22 bp, Homo sapiens
actgtgtgactgttattactgt

SEQ ID NO: 9179123 - DNA, 22 bp, Homo sapiens
actgtgtgctggacatgatgtt

SEQ ID NO: 9179124 - DNA, 22 bp, Homo sapiens
actgtgtgccctgacgccaggg

SEQ ID NO: 9179125 - DNA, 22 bp, Homo sapiens
actgtgtgccctgacgccaggg

SEQ ID NO: 9179126 - DNA, 22 bp, Homo sapiens
actgttacagagcaggaaattg

SEQ ID NO: 9179127 - DNA, 20 bp, Homo sapiens
actgttagtatacttgtgcc

SEQ ID NO: 9179128 - DNA, 22 bp, Homo sapiens
actgtgtggaccactctgaggc

SEQ ID NO: 9179129 - DNA, 22 bp, Homo sapiens
actgtgttgccttcccccagcc

SEQ ID NO: 9179130 - DNA, 22 bp, Homo sapiens
actgtgtgtttgtctagcacag

SEQ ID NO: 9179131 - DNA, 22 bp, Homo sapiens
accatttagtaagtatacctgg

SEQ ID NO: 9179132 - DNA, 22 bp, Homo sapiens
accattttgggtattttcagag

SEQ ID NO: 9179133 - DNA, 19 bp, Homo sapiens
acccaatccactccattcc

SEQ ID NO: 9179134 - DNA, 22 bp, Homo sapiens
acccacaacagctctaggaagt

SEQ ID NO: 9179135 - DNA, 22 bp, Homo sapiens
acccacacatctctaattcagt

SEQ ID NO: 9179136 - DNA, 20 bp, Homo sapiens
agggcagcttgaggagccgg

SEQ ID NO: 9179137 - DNA, 20 bp, Homo sapiens
agggcagcttgaggagccgg

SEQ ID NO: 9179138 - DNA, 22 bp, Homo sapiens
agggcagcttccatagtctggc

SEQ ID NO: 9179139 - DNA, 22 bp, Homo sapiens
agggcagcttccatagtctggc

SEQ ID NO: 9179140 - DNA, 20 bp, Homo sapiens
agggcagcttgaggagccgg

SEQ ID NO: 9179141 - DNA, 20 bp, Homo sapiens
agggcagcttgaggagccgg

SEQ ID NO: 9179142 - DNA, 22 bp, Homo sapiens
acccacacctccgtatatcact

SEQ ID NO: 9179143 - DNA, 22 bp, Homo sapiens
acccaggcctgagagacaggag

SEQ ID NO: 9179144 - DNA, 22 bp, Homo sapiens
acccaggagcaggctgggcagt

SEQ ID NO: 9179145 - DNA, 22 bp, Homo sapiens
agggcatgaagcagtggacagc

SEQ ID NO: 9179146 - DNA, 22 bp, Homo sapiens
agggcatgaagcagtggacagc

SEQ ID NO: 9179147 - DNA, 22 bp, Homo sapiens
agggcagttcaacttcatagtg

SEQ ID NO: 9179148 - DNA, 22 bp, Homo sapiens
agggcatctctaacagtctcct

SEQ ID NO: 9179149 - DNA, 22 bp, Homo sapiens
agggcatctagttccctctctt

SEQ ID NO: 9179150 - DNA, 22 bp, Homo sapiens
agggcatctagttccctctctt

SEQ ID NO: 9179151 - DNA, 22 bp, Homo sapiens
agggcatctctaacagtctcct

SEQ ID NO: 9179152 - DNA, 23 bp, Homo sapiens
agggcatgaagcagaggacgtgg

SEQ ID NO: 9179153 - DNA, 22 bp, Homo sapiens
accattctttacacttatttct

SEQ ID NO: 9179154 - DNA, 22 bp, Homo sapiens
accattctttacatcagcacag

SEQ ID NO: 9179155 - DNA, 17 bp, Homo sapiens
accattctttttactgc

SEQ ID NO: 9179156 - DNA, 22 bp, Homo sapiens
accattctggttaagaacccat

SEQ ID NO: 9179157 - DNA, 22 bp, Homo sapiens
accattctgtctctttacaaat

SEQ ID NO: 9179158 - DNA, 22 bp, Homo sapiens
accattgccccctagtgtctgt

SEQ ID NO: 9179159 - DNA, 22 bp, Homo sapiens
accatttaaggaaaatgtatca

SEQ ID NO: 9179160 - DNA, 22 bp, Homo sapiens
accatttaaaattgatgccttc

SEQ ID NO: 9179161 - DNA, 22 bp, Homo sapiens
accatttaaggaaaatgtatca

SEQ ID NO: 9179162 - DNA, 22 bp, Homo sapiens
accatttaaggaaaatgtatca

SEQ ID NO: 9179163 - DNA, 22 bp, Homo sapiens
accatgttggccaagctggtct

SEQ ID NO: 9179164 - DNA, 22 bp, Homo sapiens
accatgttggccaagctggtct

SEQ ID NO: 9179165 - DNA, 22 bp, Homo sapiens
accattctggtccatactgttc

SEQ ID NO: 9179166 - DNA, 22 bp, Homo sapiens
accattctgagatgctgctggt

SEQ ID NO: 9179167 - DNA, 21 bp, Homo sapiens
accattctgcacatgctgtca

SEQ ID NO: 9179168 - DNA, 16 bp, Homo sapiens
accattctagccacat

SEQ ID NO: 9179169 - DNA, 22 bp, Homo sapiens
agggagctctaagtagagggac

SEQ ID NO: 9179170 - DNA, 22 bp, Homo sapiens
agggagctctaagtagagggac

SEQ ID NO: 9179171 - DNA, 22 bp, Homo sapiens
accatcaagaccttatctagtt

SEQ ID NO: 9179172 - DNA, 22 bp, Homo sapiens
accatgttggccaagctggtct

SEQ ID NO: 9179173 - DNA, 22 bp, Homo sapiens
accatcagtactggatgctgac

SEQ ID NO: 9179174 - DNA, 22 bp, Homo sapiens
acccggagtcggaggttgcagt

SEQ ID NO: 9179175 - DNA, 22 bp, Homo sapiens
acccggaggcgggggatgcagt

SEQ ID NO: 9179176 - DNA, 22 bp, Homo sapiens
acccgcgagtctcactgccgct

SEQ ID NO: 9179177 - DNA, 22 bp, Homo sapiens
acccggagtcggaggttgcagt

SEQ ID NO: 9179178 - DNA, 22 bp, Homo sapiens
acccgggaggcaggagtcatag

SEQ ID NO: 9179179 - DNA, 22 bp, Homo sapiens
accctcaacaaattcactctat

SEQ ID NO: 9179180 - DNA, 22 bp, Homo sapiens
agggcctggttctgtgtaggga

SEQ ID NO: 9179181 - DNA, 22 bp, Homo sapiens
accccagctctgagccacacca

SEQ ID NO: 9179182 - DNA, 22 bp, Homo sapiens
accccagctctgagccacacca

SEQ ID NO: 9179183 - DNA, 22 bp, Homo sapiens
agggcctggttctgtgtaggga

SEQ ID NO: 9179184 - DNA, 22 bp, Homo sapiens
accccttggagtccgcgcccag

SEQ ID NO: 9179185 - DNA, 22 bp, Homo sapiens
accccaggaagtggaggtcatg

SEQ ID NO: 9179186 - DNA, 22 bp, Homo sapiens
acccgccgcacgtccaggctga

SEQ ID NO: 9179187 - DNA, 22 bp, Homo sapiens
agggcctggtgacctgggtcct

SEQ ID NO: 9179188 - DNA, 22 bp, Homo sapiens
agggcctggtgacctgggtcct

SEQ ID NO: 9179189 - DNA, 22 bp, Homo sapiens
agggcctggtgacctgggtcct

SEQ ID NO: 9179190 - DNA, 22 bp, Homo sapiens
agggcctgggccagcacccttt

SEQ ID NO: 9179191 - DNA, 22 bp, Homo sapiens
agggcctgggatgtcctcctag

SEQ ID NO: 9179192 - DNA, 22 bp, Homo sapiens
agggcctgggatgtcctcctag

SEQ ID NO: 9179193 - DNA, 22 bp, Homo sapiens
agggcctgggccagcacccttt

SEQ ID NO: 9179194 - DNA, 22 bp, Homo sapiens
agggcctgggatgtcctcctag

SEQ ID NO: 9179195 - DNA, 22 bp, Homo sapiens
agggcctgggaagaggaaccct

SEQ ID NO: 9179196 - DNA, 17 bp, Homo sapiens
acccaggctctatcttg

SEQ ID NO: 9179197 - DNA, 18 bp, Homo sapiens
acccaggctcatggtcct

SEQ ID NO: 9179198 - DNA, 22 bp, Homo sapiens
agggaagaggaccagagtctct

SEQ ID NO: 9179199 - DNA, 22 bp, Homo sapiens
agggaagagcttgcaagaaacc

SEQ ID NO: 9179200 - DNA, 22 bp, Homo sapiens
agggaagaatcactgggatgtt

SEQ ID NO: 9179201 - DNA, 22 bp, Homo sapiens
aggctggcagccacctcagcag

SEQ ID NO: 9179202 - DNA, 22 bp, Homo sapiens
aggctggcaaggcagatgtgtg

SEQ ID NO: 9179203 - DNA, 22 bp, Homo sapiens
aggctggagtgtgcagtggcgc

SEQ ID NO: 9179204 - DNA, 22 bp, Homo sapiens
aggctggagtgtgcagtggcgc

SEQ ID NO: 9179205 - DNA, 22 bp, Homo sapiens
acatttttcacatttgtagggt

SEQ ID NO: 9179206 - DNA, 22 bp, Homo sapiens
acatttttctaggaggcaaggt

SEQ ID NO: 9179207 - DNA, 22 bp, Homo sapiens
acatttttctaggaggcaaggt

SEQ ID NO: 9179208 - DNA, 22 bp, Homo sapiens
acatttttattcatcaaagcag

SEQ ID NO: 9179209 - DNA, 22 bp, Homo sapiens
acatttttattcatcaaagcag

SEQ ID NO: 9179210 - DNA, 22 bp, Homo sapiens
acatttttatcctgagtgccag

SEQ ID NO: 9179211 - DNA, 22 bp, Homo sapiens
acatttttactgggcatctgca

SEQ ID NO: 9179212 - DNA, 22 bp, Homo sapiens
acatttttactgggcatctgca

SEQ ID NO: 9179213 - DNA, 20 bp, Homo sapiens
acattttggcatactctcaa

SEQ ID NO: 9179214 - DNA, 22 bp, Homo sapiens
acatttgtcttctttcagatta

SEQ ID NO: 9179215 - DNA, 18 bp, Homo sapiens
aggctgcactgtcttaaa

SEQ ID NO: 9179216 - DNA, 22 bp, Homo sapiens
acatttgtctggctagaaagtt

SEQ ID NO: 9179217 - DNA, 22 bp, Homo sapiens
acatttgtctggctagaaagtt

SEQ ID NO: 9179218 - DNA, 22 bp, Homo sapiens
acattttttagagtcccacatt

SEQ ID NO: 9179219 - DNA, 22 bp, Homo sapiens
acatttttgggttgatgtctga

SEQ ID NO: 9179220 - DNA, 22 bp, Homo sapiens
acatttttgggttgatgtctga

SEQ ID NO: 9179221 - DNA, 22 bp, Homo sapiens
acatttttgggttgatgtctga

SEQ ID NO: 9179222 - DNA, 21 bp, Homo sapiens
accaaaacctatactttctgt

SEQ ID NO: 9179223 - DNA, 22 bp, Homo sapiens
accaaagcgagtgatatgtcat

SEQ ID NO: 9179224 - DNA, 22 bp, Homo sapiens
accaaacaaaattgtgcactgt

SEQ ID NO: 9179225 - DNA, 20 bp, Homo sapiens
accaggcccggtgtctcctc

SEQ ID NO: 9179226 - DNA, 20 bp, Homo sapiens
accaggccccgggccctgca

SEQ ID NO: 9179227 - DNA, 23 bp, Homo sapiens
accaggagttgtctcaggaaaca

SEQ ID NO: 9179228 - DNA, 22 bp, Homo sapiens
accaggccctccagctgcgtgg

SEQ ID NO: 9179229 - DNA, 19 bp, Homo sapiens
accaggcctcagaggccct

SEQ ID NO: 9179230 - DNA, 22 bp, Homo sapiens
accaggcctagcaagtacatta

SEQ ID NO: 9179231 - DNA, 22 bp, Homo sapiens
agggagctaggatcctgaaggt

SEQ ID NO: 9179232 - DNA, 22 bp, Homo sapiens
agggagctaggatcctgaaggt

SEQ ID NO: 9179233 - DNA, 23 bp, Homo sapiens
agggagctaaaaggctggagcag

SEQ ID NO: 9179234 - DNA, 22 bp, Homo sapiens
agggaagcagcagccgcctgtc

SEQ ID NO: 9179235 - DNA, 22 bp, Homo sapiens
agggaagcaatattagatatca

SEQ ID NO: 9179236 - DNA, 22 bp, Homo sapiens
agggaagcaatgattattattc

SEQ ID NO: 9179237 - DNA, 22 bp, Homo sapiens
agggaagaggaccagagtctct

SEQ ID NO: 9179238 - DNA, 22 bp, Homo sapiens
agggaagaggaccagagtctct

SEQ ID NO: 9179239 - DNA, 22 bp, Homo sapiens
agggaagaggaccagagtctct

SEQ ID NO: 9179240 - DNA, 22 bp, Homo sapiens
agggaagaggcaaggtttatgg

SEQ ID NO: 9179241 - DNA, 22 bp, Homo sapiens
agggaagccaagccttagagaa

SEQ ID NO: 9179242 - DNA, 22 bp, Homo sapiens
agggaagcaggaatagctctga

SEQ ID NO: 9179243 - DNA, 22 bp, Homo sapiens
agggaagccccgaggaggcacc

SEQ ID NO: 9179244 - DNA, 22 bp, Homo sapiens
agggaagccccgaggaggcacc

SEQ ID NO: 9179245 - DNA, 22 bp, Homo sapiens
agggaagctgctgggtccacct

SEQ ID NO: 9179246 - DNA, 22 bp, Homo sapiens
agggaagccctggctgagaccc

SEQ ID NO: 9179247 - DNA, 22 bp, Homo sapiens
agggaattcactggaacgccct

SEQ ID NO: 9179248 - DNA, 22 bp, Homo sapiens
agggaatgtagcaagatgccaa

SEQ ID NO: 9179249 - DNA, 22 bp, Homo sapiens
agggacagatgaatgactgagt

SEQ ID NO: 9179250 - DNA, 22 bp, Homo sapiens
acatttattttcagctgggaaa

SEQ ID NO: 9179251 - DNA, 22 bp, Homo sapiens
acatttattttcagctgggaaa

SEQ ID NO: 9179252 - DNA, 22 bp, Homo sapiens
acatttattttcagctgggaaa

SEQ ID NO: 9179253 - DNA, 22 bp, Homo sapiens
acatttattactcaggttgttg

SEQ ID NO: 9179254 - DNA, 22 bp, Homo sapiens
acatttattactcaggttgttg

SEQ ID NO: 9179255 - DNA, 23 bp, Homo sapiens
acatttcaatactgagggtctga

SEQ ID NO: 9179256 - DNA, 22 bp, Homo sapiens
acatttattttggcacggcaca

SEQ ID NO: 9179257 - DNA, 22 bp, Homo sapiens
acatttattttggcacggcaca

SEQ ID NO: 9179258 - DNA, 22 bp, Homo sapiens
acatttatataactcactagga

SEQ ID NO: 9179259 - DNA, 22 bp, Homo sapiens
acatttatataactcactagga

SEQ ID NO: 9179260 - DNA, 22 bp, Homo sapiens
acatttatataactcactagga

SEQ ID NO: 9179261 - DNA, 22 bp, Homo sapiens
acatttatataactcactagga

SEQ ID NO: 9179262 - DNA, 22 bp, Homo sapiens
acatttatatttagtggggaat

SEQ ID NO: 9179263 - DNA, 22 bp, Homo sapiens
acatttatatttagtggggaat

SEQ ID NO: 9179264 - DNA, 22 bp, Homo sapiens
acatttattactcaggttgttg

SEQ ID NO: 9179265 - DNA, 22 bp, Homo sapiens
acatttagatggtgttatagta

SEQ ID NO: 9179266 - DNA, 22 bp, Homo sapiens
acatttagagttctttactcca

SEQ ID NO: 9179267 - DNA, 19 bp, Homo sapiens
acatttagaatgtacttgc

SEQ ID NO: 9179268 - DNA, 22 bp, Homo sapiens
acatttacttatcaaaagtcag

SEQ ID NO: 9179269 - DNA, 22 bp, Homo sapiens
acatttaggatgttttgagaga

SEQ ID NO: 9179270 - DNA, 22 bp, Homo sapiens
acatttagctgtacaatctatg

SEQ ID NO: 9179271 - DNA, 22 bp, Homo sapiens
acatttatataactcactagga

SEQ ID NO: 9179272 - DNA, 22 bp, Homo sapiens
acatttaatgatcctactgtga

SEQ ID NO: 9179273 - DNA, 22 bp, Homo sapiens
acatttacagtgctagacaatc

SEQ ID NO: 9179274 - DNA, 22 bp, Homo sapiens
acatttacctagttaagtcaat

SEQ ID NO: 9179275 - DNA, 22 bp, Homo sapiens
acatttaccctggaacattgga

SEQ ID NO: 9179276 - DNA, 22 bp, Homo sapiens
aggctgaggctggcagctccag

SEQ ID NO: 9179277 - DNA, 22 bp, Homo sapiens
aggctgaggatccctgtgttct

SEQ ID NO: 9179278 - DNA, 22 bp, Homo sapiens
aggctgaggctggcagctccag

SEQ ID NO: 9179279 - DNA, 22 bp, Homo sapiens
aggctgaggatccctgtgttct

SEQ ID NO: 9179280 - DNA, 22 bp, Homo sapiens
aggctgaggctttccttggaga

SEQ ID NO: 9179281 - DNA, 22 bp, Homo sapiens
aggctgagggctcctgagggca

SEQ ID NO: 9179282 - DNA, 20 bp, Homo sapiens
aggctgagttctatgcactt

SEQ ID NO: 9179283 - DNA, 22 bp, Homo sapiens
aggctgagggctcctgagggca

SEQ ID NO: 9179284 - DNA, 22 bp, Homo sapiens
aggctgatgctggctgaggctg

SEQ ID NO: 9179285 - DNA, 22 bp, Homo sapiens
aggctgatgctggctgaggctg

SEQ ID NO: 9179286 - DNA, 22 bp, Homo sapiens
aggctgagtttctcattctcgc

SEQ ID NO: 9179287 - DNA, 19 bp, Homo sapiens
aggctgcaaggtggtgggc

SEQ ID NO: 9179288 - DNA, 22 bp, Homo sapiens
aggctgcaaagtgcttgggtgc

SEQ ID NO: 9179289 - DNA, 22 bp, Homo sapiens
aggctgcaaagtgcttgggtgc

SEQ ID NO: 9179290 - DNA, 22 bp, Homo sapiens
aggctaggctgatgcctcttcc

SEQ ID NO: 9179291 - DNA, 22 bp, Homo sapiens
aggctagggccatggctggtga

SEQ ID NO: 9179292 - DNA, 22 bp, Homo sapiens
aggctaggccttgccctggaac

SEQ ID NO: 9179293 - DNA, 22 bp, Homo sapiens
aggctaggcatgtgctaccaca

SEQ ID NO: 9179294 - DNA, 22 bp, Homo sapiens
aggctagctttggctcagtaaa

SEQ ID NO: 9179295 - DNA, 22 bp, Homo sapiens
aggctaggggcagtgccagcat

SEQ ID NO: 9179296 - DNA, 22 bp, Homo sapiens
acatttaaccaaactgtttaat

SEQ ID NO: 9179297 - DNA, 19 bp, Homo sapiens
acatttaaattcagatctc

SEQ ID NO: 9179298 - DNA, 22 bp, Homo sapiens
acatttaagttaaaacctcagt

SEQ ID NO: 9179299 - DNA, 22 bp, Homo sapiens
acatttaagttaaaacctcagt

SEQ ID NO: 9179300 - DNA, 22 bp, Homo sapiens
acatttaagttaaaacctcagt

SEQ ID NO: 9179301 - DNA, 22 bp, Homo sapiens
acatttaagttaaaacctcagt

SEQ ID NO: 9179302 - DNA, 22 bp, Homo sapiens
acatttaaccctcaggtttctg

SEQ ID NO: 9179303 - DNA, 22 bp, Homo sapiens
acatttaacctttgaggaactg

SEQ ID NO: 9179304 - DNA, 22 bp, Homo sapiens
acatttaaccctcaggtttctg

SEQ ID NO: 9179305 - DNA, 22 bp, Homo sapiens
aggcctgttggcgtgggctcta

SEQ ID NO: 9179306 - DNA, 22 bp, Homo sapiens
aggcctgtttccttgggttgct

SEQ ID NO: 9179307 - DNA, 22 bp, Homo sapiens
aggccttaccatagctgtagca

SEQ ID NO: 9179308 - DNA, 22 bp, Homo sapiens
aggccttgaaccttgctgggtg

SEQ ID NO: 9179309 - DNA, 22 bp, Homo sapiens
aggccttggaagccagggagcc

SEQ ID NO: 9179310 - DNA, 22 bp, Homo sapiens
aggcgcctgcgggatccttgcc

SEQ ID NO: 9179311 - DNA, 22 bp, Homo sapiens
aggcgcctgcgggatccttgcc

SEQ ID NO: 9179312 - DNA, 22 bp, Homo sapiens
aggccttgtaatggaggggaaa

SEQ ID NO: 9179313 - DNA, 22 bp, Homo sapiens
aggcctttgtggagctcatggc

SEQ ID NO: 9179314 - DNA, 22 bp, Homo sapiens
aggcgcagacatacagggtctg

SEQ ID NO: 9179315 - DNA, 22 bp, Homo sapiens
aggcgcagacatacagggtctg

SEQ ID NO: 9179316 - DNA, 22 bp, Homo sapiens
aggcgcagaaggccaggggcct

SEQ ID NO: 9179317 - DNA, 22 bp, Homo sapiens
acatggagaccagatggaagta

SEQ ID NO: 9179318 - DNA, 21 bp, Homo sapiens
acatggatataggactgaatt

SEQ ID NO: 9179319 - DNA, 22 bp, Homo sapiens
acatggagactctaccagaaaa

SEQ ID NO: 9179320 - DNA, 19 bp, Homo sapiens
acatggcatcccaggaggt

SEQ ID NO: 9179321 - DNA, 22 bp, Homo sapiens
aggcctgcctggagcctggctg

SEQ ID NO: 9179322 - DNA, 22 bp, Homo sapiens
acatggaaagtactccacaatt

SEQ ID NO: 9179323 - DNA, 22 bp, Homo sapiens
acatggaagataaaaatactca

SEQ ID NO: 9179324 - DNA, 20 bp, Homo sapiens
acatggaaggtcaaactatc

SEQ ID NO: 9179325 - DNA, 20 bp, Homo sapiens
acatggaaggtcaaactatc

SEQ ID NO: 9179326 - DNA, 20 bp, Homo sapiens
acatggaaggtcaaactatc

SEQ ID NO: 9179327 - DNA, 22 bp, Homo sapiens
aggccctgttgtagcattttgg

SEQ ID NO: 9179328 - DNA, 22 bp, Homo sapiens
acatgcaggaaaatgcacagat

SEQ ID NO: 9179329 - DNA, 22 bp, Homo sapiens
acatgcataaactacttcttat

SEQ ID NO: 9179330 - DNA, 22 bp, Homo sapiens
aggcagggctcatttcttaggc

SEQ ID NO: 9179331 - DNA, 22 bp, Homo sapiens
aggcagggaccagttgttttct

SEQ ID NO: 9179332 - DNA, 22 bp, Homo sapiens
aggcaggctggtctgaagagtg

SEQ ID NO: 9179333 - DNA, 17 bp, Homo sapiens
aggcaggcagagcggga

SEQ ID NO: 9179334 - DNA, 22 bp, Homo sapiens
aggcaggcagggctcactgtct

SEQ ID NO: 9179335 - DNA, 22 bp, Homo sapiens
aggcaggcagctgtcaccactc

SEQ ID NO: 9179336 - DNA, 22 bp, Homo sapiens
aggcagggctgggattagactc

SEQ ID NO: 9179337 - DNA, 22 bp, Homo sapiens
aggcaggggagctggaagggta

SEQ ID NO: 9179338 - DNA, 22 bp, Homo sapiens
acatgaaagttattctgagttg

SEQ ID NO: 9179339 - DNA, 22 bp, Homo sapiens
acatgagaagctgcaacatgac

SEQ ID NO: 9179340 - DNA, 22 bp, Homo sapiens
acatgacttttctcttccagag

SEQ ID NO: 9179341 - DNA, 22 bp, Homo sapiens
acatgagaggctgtggagtaca

SEQ ID NO: 9179342 - DNA, 22 bp, Homo sapiens
acatgagatcacaaagataaat

SEQ ID NO: 9179343 - DNA, 22 bp, Homo sapiens
acatgagattagctcacccact

SEQ ID NO: 9179344 - DNA, 22 bp, Homo sapiens
acatgattaaaagattttaaag

SEQ ID NO: 9179345 - DNA, 22 bp, Homo sapiens
aggaggaaaaaggccacagcaa

SEQ ID NO: 9179346 - DNA, 22 bp, Homo sapiens
aggaggaaaaaggccacagcaa

SEQ ID NO: 9179347 - DNA, 22 bp, Homo sapiens
aggaggaaagaaggcccccagc

SEQ ID NO: 9179348 - DNA, 21 bp, Homo sapiens
aggaggaacccgtggctgggc

SEQ ID NO: 9179349 - DNA, 23 bp, Homo sapiens
aggaggaaaagttatctgctgag

SEQ ID NO: 9179350 - DNA, 21 bp, Homo sapiens
aggaggaacccgtggctgggc

SEQ ID NO: 9179351 - DNA, 22 bp, Homo sapiens
aggaggaactcagaaagaaggt

SEQ ID NO: 9179352 - DNA, 20 bp, Homo sapiens
aggaggaagaaagcacactg

SEQ ID NO: 9179353 - DNA, 22 bp, Homo sapiens
acagtaattgtgaacttaacgt

SEQ ID NO: 9179354 - DNA, 22 bp, Homo sapiens
acagtaacctctcctctgaagg

SEQ ID NO: 9179355 - DNA, 22 bp, Homo sapiens
acagtaactcttttaccctcct

SEQ ID NO: 9179356 - DNA, 22 bp, Homo sapiens
acagtaagcggggttggagggc

SEQ ID NO: 9179357 - DNA, 22 bp, Homo sapiens
acagtaacaaatggcctgagga

SEQ ID NO: 9179358 - DNA, 21 bp, Homo sapiens
acagtaaattccctgcaaaga

SEQ ID NO: 9179359 - DNA, 22 bp, Homo sapiens
acagtaacacctactctgtccc

SEQ ID NO: 9179360 - DNA, 22 bp, Homo sapiens
aggagtgccttttcatgagtgt

SEQ ID NO: 9179361 - DNA, 22 bp, Homo sapiens
aggagtgcaaatagtccagaga

SEQ ID NO: 9179362 - DNA, 22 bp, Homo sapiens
aggagtgagtgtcctcagcaga

SEQ ID NO: 9179363 - DNA, 22 bp, Homo sapiens
aggagtgagctttggggtcaga

SEQ ID NO: 9179364 - DNA, 22 bp, Homo sapiens
aggagtgagtgtcctcagcaga

SEQ ID NO: 9179365 - DNA, 22 bp, Homo sapiens
aggagtggaattactgggttct

SEQ ID NO: 9179366 - DNA, 17 bp, Homo sapiens
aggagtctcagatgagc

SEQ ID NO: 9179367 - DNA, 22 bp, Homo sapiens
aggagtctgttgaaatgtctat

SEQ ID NO: 9179368 - DNA, 22 bp, Homo sapiens
aggagtgagctttggggtcaga

SEQ ID NO: 9179369 - DNA, 22 bp, Homo sapiens
aggagtgagtgtcctcagcaga

SEQ ID NO: 9179370 - DNA, 22 bp, Homo sapiens
aggagtctgttgaaatgtctat

SEQ ID NO: 9179371 - DNA, 22 bp, Homo sapiens
aggagtcctcatgtctgtgcga

SEQ ID NO: 9179372 - DNA, 22 bp, Homo sapiens
aggagtccatgagcagctagag

SEQ ID NO: 9179373 - DNA, 22 bp, Homo sapiens
aggagtcattgagaggggtcct

SEQ ID NO: 9179374 - DNA, 22 bp, Homo sapiens
aggagtcattgagaggggtcct

SEQ ID NO: 9179375 - DNA, 22 bp, Homo sapiens
acagtacaagcaatgcattttt

SEQ ID NO: 9179376 - DNA, 22 bp, Homo sapiens
acagtacaaaacccaccagagg

SEQ ID NO: 9179377 - DNA, 22 bp, Homo sapiens
aggagggtgatccgggctggtc

SEQ ID NO: 9179378 - DNA, 22 bp, Homo sapiens
aggagggtcatgttgaagtgta

SEQ ID NO: 9179379 - DNA, 22 bp, Homo sapiens
aggagtcagattgtttgaatgt

SEQ ID NO: 9179380 - DNA, 15 bp, Homo sapiens
aggagtcactgtgct

SEQ ID NO: 9179381 - DNA, 19 bp, Homo sapiens
aggagtcaggaacttcctt

SEQ ID NO: 9179382 - DNA, 22 bp, Homo sapiens
aggagtcagattgtttgaatgt

SEQ ID NO: 9179383 - DNA, 22 bp, Homo sapiens
aggagtcagatatgggaaagtt

SEQ ID NO: 9179384 - DNA, 19 bp, Homo sapiens
aggagtcaggaacttcctt

SEQ ID NO: 9179385 - DNA, 22 bp, Homo sapiens
aggagtcaggaattatttatga

SEQ ID NO: 9179386 - DNA, 22 bp, Homo sapiens
aggagtcataaatgtgaacaaa

SEQ ID NO: 9179387 - DNA, 22 bp, Homo sapiens
aggagtcaggaccaaatggaaa

SEQ ID NO: 9179388 - DNA, 22 bp, Homo sapiens
aggagtcactcagggcttcatc

SEQ ID NO: 9179389 - DNA, 22 bp, Homo sapiens
aggagtcactcagggcttcatc

SEQ ID NO: 9179390 - DNA, 22 bp, Homo sapiens
acagggcaacctctgggagact

SEQ ID NO: 9179391 - DNA, 22 bp, Homo sapiens
acagggagtgcaattcatattg

SEQ ID NO: 9179392 - DNA, 22 bp, Homo sapiens
acagggattatgactgacagcc

SEQ ID NO: 9179393 - DNA, 18 bp, Homo sapiens
acagggagggcgctgggg

SEQ ID NO: 9179394 - DNA, 18 bp, Homo sapiens
acagggagggcgctgggg

SEQ ID NO: 9179395 - DNA, 18 bp, Homo sapiens
acagggagggcgctgggg

SEQ ID NO: 9179396 - DNA, 18 bp, Homo sapiens
acagggagggcgctgggg

SEQ ID NO: 9179397 - DNA, 22 bp, Homo sapiens
acagggagtctgaggggatagt

SEQ ID NO: 9179398 - DNA, 22 bp, Homo sapiens
acagggagtctgaggggatagt

SEQ ID NO: 9179399 - DNA, 22 bp, Homo sapiens
acaggtggcactgctgttactc

SEQ ID NO: 9179400 - DNA, 22 bp, Homo sapiens
acaggtggaaacatggtgttgg

SEQ ID NO: 9179401 - DNA, 22 bp, Homo sapiens
acagggttgccaaatactaatt

SEQ ID NO: 9179402 - DNA, 22 bp, Homo sapiens
acagggcaacctctgggagact

SEQ ID NO: 9179403 - DNA, 22 bp, Homo sapiens
aggagctgttttgttcagcaaa

SEQ ID NO: 9179404 - DNA, 22 bp, Homo sapiens
aggagctgttttgttcagcaaa

SEQ ID NO: 9179405 - DNA, 20 bp, Homo sapiens
aggaggaaaaaatgacgagc

SEQ ID NO: 9179406 - DNA, 22 bp, Homo sapiens
aggagctgttttgttcagcaaa

SEQ ID NO: 9179407 - DNA, 21 bp, Homo sapiens
aggagctgtgtgcttcctttc

SEQ ID NO: 9179408 - DNA, 21 bp, Homo sapiens
aggagctgtgttagctggtcg

SEQ ID NO: 9179409 - DNA, 22 bp, Homo sapiens
aggagctggagtccaggcaagt

SEQ ID NO: 9179410 - DNA, 22 bp, Homo sapiens
aggagctggagtccaggcaagt

SEQ ID NO: 9179411 - DNA, 22 bp, Homo sapiens
acaggtgtaaaacccaggatgg

SEQ ID NO: 9179412 - DNA, 22 bp, Homo sapiens
acaggtggcataggcagtttga

SEQ ID NO: 9179413 - DNA, 22 bp, Homo sapiens
acaggtggtagagtggaaagag

SEQ ID NO: 9179414 - DNA, 22 bp, Homo sapiens
aggcaggattgctgacaacaat

SEQ ID NO: 9179415 - DNA, 22 bp, Homo sapiens
aggcaggcaaccacctgggaag

SEQ ID NO: 9179416 - DNA, 22 bp, Homo sapiens
aggcaggcactccggaagtgtc

SEQ ID NO: 9179417 - DNA, 22 bp, Homo sapiens
aggcaggcactccggaagtgtc

SEQ ID NO: 9179418 - DNA, 22 bp, Homo sapiens
aggcagctggaggcagagacta

SEQ ID NO: 9179419 - DNA, 22 bp, Homo sapiens
aggcagctggaggcagagacta

SEQ ID NO: 9179420 - DNA, 22 bp, Homo sapiens
aggcagctggcaaattctagag

SEQ ID NO: 9179421 - DNA, 22 bp, Homo sapiens
acataaagtactgagagactct

SEQ ID NO: 9179422 - DNA, 22 bp, Homo sapiens
acataaatagattattgggagg

SEQ ID NO: 9179423 - DNA, 17 bp, Homo sapiens
acagtttgtcattctaa

SEQ ID NO: 9179424 - DNA, 22 bp, Homo sapiens
acataaaggtgactaacatctt

SEQ ID NO: 9179425 - DNA, 19 bp, Homo sapiens
acagtttgggaaatgagca

SEQ ID NO: 9179426 - DNA, 22 bp, Homo sapiens
acagtttggcgtgattgatagt

SEQ ID NO: 9179427 - DNA, 22 bp, Homo sapiens
aggcagcattcaggggtgatga

SEQ ID NO: 9179428 - DNA, 22 bp, Homo sapiens
acagtttgccctgacattctcc

SEQ ID NO: 9179429 - DNA, 22 bp, Homo sapiens
aggcagcatgggcccagagtcc

SEQ ID NO: 9179430 - DNA, 22 bp, Homo sapiens
aggcagcatgggcccagagtcc

SEQ ID NO: 9179431 - DNA, 22 bp, Homo sapiens
aggcagcattcaggggtgatga

SEQ ID NO: 9179432 - DNA, 22 bp, Homo sapiens
aggcagcattcaggggtgatga

SEQ ID NO: 9179433 - DNA, 22 bp, Homo sapiens
aggcagcatgggccccagctcc

SEQ ID NO: 9179434 - DNA, 22 bp, Homo sapiens
aggcagcatgggccccagctcc

SEQ ID NO: 9179435 - DNA, 22 bp, Homo sapiens
aggcagcatgggccccagctcc

SEQ ID NO: 9179436 - DNA, 22 bp, Homo sapiens
aggcagcatgggccccagctcc

SEQ ID NO: 9179437 - DNA, 22 bp, Homo sapiens
aggcagcagtgataagatagga

SEQ ID NO: 9179438 - DNA, 22 bp, Homo sapiens
aggcagcaattgaaatcattgt

SEQ ID NO: 9179439 - DNA, 22 bp, Homo sapiens
aggcagcaatgaatgaaatgga

SEQ ID NO: 9179440 - DNA, 22 bp, Homo sapiens
aggcagcaattgaaatcattgt

SEQ ID NO: 9179441 - DNA, 22 bp, Homo sapiens
aggcagcagtgataagatagga

SEQ ID NO: 9179442 - DNA, 22 bp, Homo sapiens
aggcagcagtgataagatagga

SEQ ID NO: 9179443 - DNA, 22 bp, Homo sapiens
aggcagcagtgataagatagga

SEQ ID NO: 9179444 - DNA, 22 bp, Homo sapiens
aggcagcagtgataagatagga

SEQ ID NO: 9179445 - DNA, 22 bp, Homo sapiens
aggcagcatccagaggagaatg

SEQ ID NO: 9179446 - DNA, 22 bp, Homo sapiens
aggcagcatccagaggagaatg

SEQ ID NO: 9179447 - DNA, 22 bp, Homo sapiens
aggcagcatgctctgcttctac

SEQ ID NO: 9179448 - DNA, 22 bp, Homo sapiens
aggcagcatccagaggagaatg

SEQ ID NO: 9179449 - DNA, 22 bp, Homo sapiens
aggcagcatccagaggagaatg

SEQ ID NO: 9179450 - DNA, 22 bp, Homo sapiens
aggcagcatccagaggagaatg

SEQ ID NO: 9179451 - DNA, 22 bp, Homo sapiens
aggcagcatccagaggagaatg

SEQ ID NO: 9179452 - DNA, 22 bp, Homo sapiens
acagttatctttgaaatagaga

SEQ ID NO: 9179453 - DNA, 22 bp, Homo sapiens
acagttattctttatgcaacca

SEQ ID NO: 9179454 - DNA, 22 bp, Homo sapiens
acagttagtgagatgtctgttt

SEQ ID NO: 9179455 - DNA, 23 bp, Homo sapiens
acagttatagctgtgaataacat

SEQ ID NO: 9179456 - DNA, 22 bp, Homo sapiens
acagttagggactataatcatt

SEQ ID NO: 9179457 - DNA, 22 bp, Homo sapiens
acagttaggtcctaaaattctg

SEQ ID NO: 9179458 - DNA, 22 bp, Homo sapiens
acagttaggcttatgtctgtag

SEQ ID NO: 9179459 - DNA, 22 bp, Homo sapiens
acagttagaaagtggcagaacc

SEQ ID NO: 9179460 - DNA, 22 bp, Homo sapiens
acagttaccacttagcagttac

SEQ ID NO: 9179461 - DNA, 22 bp, Homo sapiens
acagtgcaaataggactgtctt

SEQ ID NO: 9179462 - DNA, 22 bp, Homo sapiens
acagtgcacatcctgagtgatt

SEQ ID NO: 9179463 - DNA, 22 bp, Homo sapiens
acagtgcaaacttttgtctcct

SEQ ID NO: 9179464 - DNA, 22 bp, Homo sapiens
acagtgttttagaaaagcttga

SEQ ID NO: 9179465 - DNA, 22 bp, Homo sapiens
acagttaaatatttctactggg

SEQ ID NO: 9179466 - DNA, 22 bp, Homo sapiens
acagtgttttcttaaggagaaa

SEQ ID NO: 9179467 - DNA, 22 bp, Homo sapiens
acagtgcaaaccctcgggaaag

SEQ ID NO: 9179468 - DNA, 22 bp, Homo sapiens
aggagtggaattactgggttct

SEQ ID NO: 9179469 - DNA, 22 bp, Homo sapiens
acagctcctggggctttaatgg

SEQ ID NO: 9179470 - DNA, 22 bp, Homo sapiens
acagctcctactgaagccatgt

SEQ ID NO: 9179471 - DNA, 22 bp, Homo sapiens
acagctctgcatggcagttatt

SEQ ID NO: 9179472 - DNA, 22 bp, Homo sapiens
acagctgattggatcaaggaca

SEQ ID NO: 9179473 - DNA, 22 bp, Homo sapiens
acagctaacttaaactaaccta

SEQ ID NO: 9179474 - DNA, 21 bp, Homo sapiens
acagccttgtgatggagacag

SEQ ID NO: 9179475 - DNA, 22 bp, Homo sapiens
acagccttgtagcatcttagcc

SEQ ID NO: 9179476 - DNA, 22 bp, Homo sapiens
acagcctttaaccatttcttcc

SEQ ID NO: 9179477 - DNA, 22 bp, Homo sapiens
acagcgggaatgtggtaggtgg

SEQ ID NO: 9179478 - DNA, 22 bp, Homo sapiens
acagctacatcaaactcagaag

SEQ ID NO: 9179479 - DNA, 22 bp, Homo sapiens
acagctacatcaaactcagaag

SEQ ID NO: 9179480 - DNA, 22 bp, Homo sapiens
acagctactctgcagataaatc

SEQ ID NO: 9179481 - DNA, 22 bp, Homo sapiens
acagctactctgcagataaatc

SEQ ID NO: 9179482 - DNA, 22 bp, Homo sapiens
acagctcagacatcactgctct

SEQ ID NO: 9179483 - DNA, 22 bp, Homo sapiens
acagctcactcacagggctagt

SEQ ID NO: 9179484 - DNA, 22 bp, Homo sapiens
acagctcactcacagggctagt

SEQ ID NO: 9179485 - DNA, 22 bp, Homo sapiens
acagctgcacactgaacttggt

SEQ ID NO: 9179486 - DNA, 22 bp, Homo sapiens
acagctgcaaattgttagagga

SEQ ID NO: 9179487 - DNA, 22 bp, Homo sapiens
acagctgcacactgaacttggt

SEQ ID NO: 9179488 - DNA, 22 bp, Homo sapiens
acagctgcattcttaacaggaa

SEQ ID NO: 9179489 - DNA, 22 bp, Homo sapiens
acagctgcacttgaagcaggtt

SEQ ID NO: 9179490 - DNA, 22 bp, Homo sapiens
agctggggctgcagagaacagg

SEQ ID NO: 9179491 - DNA, 22 bp, Homo sapiens
agctggggctgcagagaacagg

SEQ ID NO: 9179492 - DNA, 22 bp, Homo sapiens
agctggggctgcagagaacagg

SEQ ID NO: 9179493 - DNA, 22 bp, Homo sapiens
agctggggctgcagagaacagg

SEQ ID NO: 9179494 - DNA, 22 bp, Homo sapiens
acagctgccaagacagagcagg

SEQ ID NO: 9179495 - DNA, 22 bp, Homo sapiens
acagctgccaagacagagcagg

SEQ ID NO: 9179496 - DNA, 22 bp, Homo sapiens
agctgggtacagcctgtgccta

SEQ ID NO: 9179497 - DNA, 22 bp, Homo sapiens
agctgggtacacgttgtcacaa

SEQ ID NO: 9179498 - DNA, 22 bp, Homo sapiens
agctggggttgcacacattttg

SEQ ID NO: 9179499 - DNA, 22 bp, Homo sapiens
agctggggttgcacacattttg

SEQ ID NO: 9179500 - DNA, 22 bp, Homo sapiens
agctgggggttggataagggta

SEQ ID NO: 9179501 - DNA, 22 bp, Homo sapiens
agctggggctgtggttgtgatt

SEQ ID NO: 9179502 - DNA, 22 bp, Homo sapiens
agctggggctgtggttgtgatt

SEQ ID NO: 9179503 - DNA, 22 bp, Homo sapiens
agctgggggttggataagggta

SEQ ID NO: 9179504 - DNA, 22 bp, Homo sapiens
agctgggggtagtgagaaataa

SEQ ID NO: 9179505 - DNA, 22 bp, Homo sapiens
agctgggggtagtgagaaataa

SEQ ID NO: 9179506 - DNA, 22 bp, Homo sapiens
acagcagacacaggcacgctgt

SEQ ID NO: 9179507 - DNA, 22 bp, Homo sapiens
acagcagacacaggcacgctgt

SEQ ID NO: 9179508 - DNA, 22 bp, Homo sapiens
acagcagacacaggcacgctgt

SEQ ID NO: 9179509 - DNA, 22 bp, Homo sapiens
acagcagaataatgagtaatag

SEQ ID NO: 9179510 - DNA, 22 bp, Homo sapiens
acagcagaataatgagtaatag

SEQ ID NO: 9179511 - DNA, 23 bp, Homo sapiens
acagcacccatgtcatctggctc

SEQ ID NO: 9179512 - DNA, 22 bp, Homo sapiens
acagcacaggagttgaatgggc

SEQ ID NO: 9179513 - DNA, 22 bp, Homo sapiens
agctgccagcaagtttcaaaca

SEQ ID NO: 9179514 - DNA, 21 bp, Homo sapiens
acagcagacaggcttaggacc

SEQ ID NO: 9179515 - DNA, 22 bp, Homo sapiens
acagcagacagtcggcttcctg

SEQ ID NO: 9179516 - DNA, 21 bp, Homo sapiens
acagcagacaggcttaggacc

SEQ ID NO: 9179517 - DNA, 22 bp, Homo sapiens
acagcagacattgggtgattga

SEQ ID NO: 9179518 - DNA, 22 bp, Homo sapiens
acagcagacagtcggcttcctg

SEQ ID NO: 9179519 - DNA, 22 bp, Homo sapiens
acagcagacattgggtgattga

SEQ ID NO: 9179520 - DNA, 22 bp, Homo sapiens
agctgccatggcctgaatttac

SEQ ID NO: 9179521 - DNA, 22 bp, Homo sapiens
agctgccatctgaagaactgca

SEQ ID NO: 9179522 - DNA, 22 bp, Homo sapiens
agctgcccaaggtcacagagct

SEQ ID NO: 9179523 - DNA, 22 bp, Homo sapiens
agctgcccagataggaggaggc

SEQ ID NO: 9179524 - DNA, 22 bp, Homo sapiens
agctgcccaggttcattgggcc

SEQ ID NO: 9179525 - DNA, 22 bp, Homo sapiens
agctgccatcagcctttggatg

SEQ ID NO: 9179526 - DNA, 22 bp, Homo sapiens
agctgccatcctgttcagcacc

SEQ ID NO: 9179527 - DNA, 22 bp, Homo sapiens
agctgccatccgaggtgtcaga

SEQ ID NO: 9179528 - DNA, 22 bp, Homo sapiens
agctgccagggactgggcatgg

SEQ ID NO: 9179529 - DNA, 22 bp, Homo sapiens
agctgcctgtaaaatgtgtgat

SEQ ID NO: 9179530 - DNA, 22 bp, Homo sapiens
agctgccccatgagaggcaggt

SEQ ID NO: 9179531 - DNA, 22 bp, Homo sapiens
agctgccccatgagaggcaggt

SEQ ID NO: 9179532 - DNA, 22 bp, Homo sapiens
agctgcccaggttcattgggcc

SEQ ID NO: 9179533 - DNA, 22 bp, Homo sapiens
agctgccccatgagaggcaggt

SEQ ID NO: 9179534 - DNA, 22 bp, Homo sapiens
agctgccccatgagaggcaggt

SEQ ID NO: 9179535 - DNA, 17 bp, Homo sapiens
agctgccttgcttgagc

SEQ ID NO: 9179536 - DNA, 20 bp, Homo sapiens
agctgccttcattttctaga

SEQ ID NO: 9179537 - DNA, 22 bp, Homo sapiens
agctgcctttgcatcactttaa

SEQ ID NO: 9179538 - DNA, 23 bp, Homo sapiens
acagccttctggggcttctgggc

SEQ ID NO: 9179539 - DNA, 22 bp, Homo sapiens
acagccttctgtgtgtgtacaa

SEQ ID NO: 9179540 - DNA, 22 bp, Homo sapiens
acagccttgagctcaaaaggaa

SEQ ID NO: 9179541 - DNA, 16 bp, Homo sapiens
acagccttcttctttg

SEQ ID NO: 9179542 - DNA, 22 bp, Homo sapiens
acagccttgatattaattgtct

SEQ ID NO: 9179543 - DNA, 22 bp, Homo sapiens
acagccttgcttatttgtctct

SEQ ID NO: 9179544 - DNA, 22 bp, Homo sapiens
acagccttgggttctctggggg

SEQ ID NO: 9179545 - DNA, 22 bp, Homo sapiens
acagctgtgttttataatcagc

SEQ ID NO: 9179546 - DNA, 22 bp, Homo sapiens
acagctgtgttttataatcagc

SEQ ID NO: 9179547 - DNA, 22 bp, Homo sapiens
acagctgtgttttataatcagc

SEQ ID NO: 9179548 - DNA, 22 bp, Homo sapiens
acagctgtggggactcttgccc

SEQ ID NO: 9179549 - DNA, 23 bp, Homo sapiens
acagcttcctactttgctgctgc

SEQ ID NO: 9179550 - DNA, 23 bp, Homo sapiens
acagcttcctactttgctgctgc

SEQ ID NO: 9179551 - DNA, 22 bp, Homo sapiens
acaggcaggtaatttacatatt

SEQ ID NO: 9179552 - DNA, 22 bp, Homo sapiens
acaggcaggtaatttacatatt

SEQ ID NO: 9179553 - DNA, 22 bp, Homo sapiens
acaggcaggtaatttacatatt

SEQ ID NO: 9179554 - DNA, 22 bp, Homo sapiens
agctgggtgaaggcagatggct

SEQ ID NO: 9179555 - DNA, 22 bp, Homo sapiens
agctgggtcttgggccaggaga

SEQ ID NO: 9179556 - DNA, 21 bp, Homo sapiens
acagctgtcttagcttgggct

SEQ ID NO: 9179557 - DNA, 22 bp, Homo sapiens
acagctgtgaaaatccacagga

SEQ ID NO: 9179558 - DNA, 22 bp, Homo sapiens
acagctgtggccacttgcatcc

SEQ ID NO: 9179559 - DNA, 22 bp, Homo sapiens
acagctgtgggctctgcatata

SEQ ID NO: 9179560 - DNA, 17 bp, Homo sapiens
acaggcctgcttgcact

SEQ ID NO: 9179561 - DNA, 22 bp, Homo sapiens
acaggcctgatgttatcctatt

SEQ ID NO: 9179562 - DNA, 22 bp, Homo sapiens
acaggcctgatgccttggctgg

SEQ ID NO: 9179563 - DNA, 22 bp, Homo sapiens
acaggcctgagattttgcattt

SEQ ID NO: 9179564 - DNA, 22 bp, Homo sapiens
acaggcctcccatccggagccc

SEQ ID NO: 9179565 - DNA, 18 bp, Homo sapiens
acaggcctcagtcctgca

SEQ ID NO: 9179566 - DNA, 22 bp, Homo sapiens
acaggcctgacacacagagggc

SEQ ID NO: 9179567 - DNA, 22 bp, Homo sapiens
acaggcctgacacacagagggc

SEQ ID NO: 9179568 - DNA, 22 bp, Homo sapiens
acaggcctcaaatagggtgcct

SEQ ID NO: 9179569 - DNA, 22 bp, Homo sapiens
acaggcctcaagacacccaggt

SEQ ID NO: 9179570 - DNA, 22 bp, Homo sapiens
acaggcctagggtcaatttcct

SEQ ID NO: 9179571 - DNA, 22 bp, Homo sapiens
acaggcctatgttccattgcag

SEQ ID NO: 9179572 - DNA, 22 bp, Homo sapiens
acaggcctagctaatgctttcc

SEQ ID NO: 9179573 - DNA, 22 bp, Homo sapiens
acaggcctacgaagtcaggtgc

SEQ ID NO: 9179574 - DNA, 22 bp, Homo sapiens
acaggcctacgaagtcaggtgc

SEQ ID NO: 9179575 - DNA, 22 bp, Homo sapiens
agctttatgcttcctacaagct

SEQ ID NO: 9179576 - DNA, 22 bp, Homo sapiens
acaggcctggaaaggaaggagt

SEQ ID NO: 9179577 - DNA, 22 bp, Homo sapiens
acaggcctggggtacaagttct

SEQ ID NO: 9179578 - DNA, 22 bp, Homo sapiens
acaggcctgggttcaaatttgg

SEQ ID NO: 9179579 - DNA, 22 bp, Homo sapiens
agctttatatttaatgaattct

SEQ ID NO: 9179580 - DNA, 22 bp, Homo sapiens
agctttatcacaatattggcta

SEQ ID NO: 9179581 - DNA, 22 bp, Homo sapiens
aggaagggctgtttctccaaga

SEQ ID NO: 9179582 - DNA, 22 bp, Homo sapiens
aggaagggctgtttctccaaga

SEQ ID NO: 9179583 - DNA, 22 bp, Homo sapiens
acaggctgttggggtccagggt

SEQ ID NO: 9179584 - DNA, 19 bp, Homo sapiens
aggaatggaattaattctg

SEQ ID NO: 9179585 - DNA, 22 bp, Homo sapiens
aggaatggtgctcagcagaaat

SEQ ID NO: 9179586 - DNA, 22 bp, Homo sapiens
aggaatggttatggggatagta

SEQ ID NO: 9179587 - DNA, 22 bp, Homo sapiens
aggaatggtgctcagcagaaat

SEQ ID NO: 9179588 - DNA, 22 bp, Homo sapiens
aggaatggtgctcagcagaaat

SEQ ID NO: 9179589 - DNA, 19 bp, Homo sapiens
aggaatggaattaattctg

SEQ ID NO: 9179590 - DNA, 22 bp, Homo sapiens
aggaatggttatggggatagta

SEQ ID NO: 9179591 - DNA, 22 bp, Homo sapiens
aggaatggttatggggatagta

SEQ ID NO: 9179592 - DNA, 22 bp, Homo sapiens
acaggctgggcgcttcctgcgg

SEQ ID NO: 9179593 - DNA, 22 bp, Homo sapiens
acaggctgggcgcttcctgcgg

SEQ ID NO: 9179594 - DNA, 22 bp, Homo sapiens
acaggctggtggtcctggccat

SEQ ID NO: 9179595 - DNA, 22 bp, Homo sapiens
acaggctggtggtcctggccat

SEQ ID NO: 9179596 - DNA, 22 bp, Homo sapiens
acaggctgctgggctccgtgct

SEQ ID NO: 9179597 - DNA, 22 bp, Homo sapiens
acaggctgctgggctccgtgct

SEQ ID NO: 9179598 - DNA, 22 bp, Homo sapiens
acaggctgctgggctccgtgct

SEQ ID NO: 9179599 - DNA, 22 bp, Homo sapiens
acaggctgctgggctccgtgct

SEQ ID NO: 9179600 - DNA, 22 bp, Homo sapiens
acaggctgcccgctccccacct

SEQ ID NO: 9179601 - DNA, 22 bp, Homo sapiens
acaggctgcctaccaagtatca

SEQ ID NO: 9179602 - DNA, 22 bp, Homo sapiens
acaggctgcccgctccccacct

SEQ ID NO: 9179603 - DNA, 22 bp, Homo sapiens
agctttatgggagcttagataa

SEQ ID NO: 9179604 - DNA, 22 bp, Homo sapiens
acatttctggagtttctcaaca

SEQ ID NO: 9179605 - DNA, 22 bp, Homo sapiens
acatttctggagtttctcaaca

SEQ ID NO: 9179606 - DNA, 22 bp, Homo sapiens
acatttctggagtttctcaaca

SEQ ID NO: 9179607 - DNA, 22 bp, Homo sapiens
acatttcttccctttagcagaa

SEQ ID NO: 9179608 - DNA, 22 bp, Homo sapiens
acatttcttccctttagcagaa

SEQ ID NO: 9179609 - DNA, 22 bp, Homo sapiens
acatttcttccacatgctgctg

SEQ ID NO: 9179610 - DNA, 22 bp, Homo sapiens
acattgttgcctagccatgagt

SEQ ID NO: 9179611 - DNA, 22 bp, Homo sapiens
acattgtttgagaatacagatg

SEQ ID NO: 9179612 - DNA, 22 bp, Homo sapiens
acattgtttctgaccatgatga

SEQ ID NO: 9179613 - DNA, 22 bp, Homo sapiens
acatttaaatatgccttatatt

SEQ ID NO: 9179614 - DNA, 22 bp, Homo sapiens
acatttaaatatgccttatatt

SEQ ID NO: 9179615 - DNA, 22 bp, Homo sapiens
acattgtttgagaatacagatg

SEQ ID NO: 9179616 - DNA, 22 bp, Homo sapiens
aaggctgcttttaacatgcata

SEQ ID NO: 9179617 - DNA, 21 bp, Homo sapiens
aaggctggagatgcaggtctg

SEQ ID NO: 9179618 - DNA, 21 bp, Homo sapiens
aaggctggagatgcaggtctg

SEQ ID NO: 9179619 - DNA, 22 bp, Homo sapiens
aaggccttgccgaaggatgcca

SEQ ID NO: 9179620 - DNA, 22 bp, Homo sapiens
aaggccttggttctgagcaata

SEQ ID NO: 9179621 - DNA, 21 bp, Homo sapiens
aaggcctgcttactgctagtt

SEQ ID NO: 9179622 - DNA, 22 bp, Homo sapiens
aaggcctgggagtactgggaca

SEQ ID NO: 9179623 - DNA, 18 bp, Homo sapiens
aaggcctagtccctctct

SEQ ID NO: 9179624 - DNA, 22 bp, Homo sapiens
aaggccctttagcagaggaggg

SEQ ID NO: 9179625 - DNA, 22 bp, Homo sapiens
aaggccctttagcagaggaggg

SEQ ID NO: 9179626 - DNA, 22 bp, Homo sapiens
aaggccaggggctggcgcctcc

SEQ ID NO: 9179627 - DNA, 22 bp, Homo sapiens
aaggctcaaagaagctaagtga

SEQ ID NO: 9179628 - DNA, 22 bp, Homo sapiens
aaggctcaaagaagctaagtga

SEQ ID NO: 9179629 - DNA, 22 bp, Homo sapiens
aaggctcagagcctggagctgc

SEQ ID NO: 9179630 - DNA, 22 bp, Homo sapiens
aaggctccagtgaatgctggca

SEQ ID NO: 9179631 - DNA, 22 bp, Homo sapiens
aaggctctccaaatgatataat

SEQ ID NO: 9179632 - DNA, 22 bp, Homo sapiens
aaggctcctttgtagttctttt

SEQ ID NO: 9179633 - DNA, 21 bp, Homo sapiens
aaggctcctcctctaggcctc

SEQ ID NO: 9179634 - DNA, 22 bp, Homo sapiens
aaggctccgtgactggggctga

SEQ ID NO: 9179635 - DNA, 22 bp, Homo sapiens
aaggctctgggtttcataggtg

SEQ ID NO: 9179636 - DNA, 22 bp, Homo sapiens
acattcttccagctggctgttg

SEQ ID NO: 9179637 - DNA, 22 bp, Homo sapiens
accaggcttgatgatttgctta

SEQ ID NO: 9179638 - DNA, 22 bp, Homo sapiens
accaggcttgatgatttgctta

SEQ ID NO: 9179639 - DNA, 21 bp, Homo sapiens
accaggcttgtgggagggagc

SEQ ID NO: 9179640 - DNA, 21 bp, Homo sapiens
accaggcttgtgggagggagc

SEQ ID NO: 9179641 - DNA, 22 bp, Homo sapiens
accagggaccgccacactgcaa

SEQ ID NO: 9179642 - DNA, 22 bp, Homo sapiens
accagggcaaatgtttgtactc

SEQ ID NO: 9179643 - DNA, 22 bp, Homo sapiens
aagggctgggtctggttaaccc

SEQ ID NO: 9179644 - DNA, 22 bp, Homo sapiens
aagggctggtctagaaagggag

SEQ ID NO: 9179645 - DNA, 22 bp, Homo sapiens
aagggctgtaagccaagtaaag

SEQ ID NO: 9179646 - DNA, 22 bp, Homo sapiens
aagggctgtaagccaagtaaag

SEQ ID NO: 9179647 - DNA, 19 bp, Homo sapiens
acccagagccctttgcagg

SEQ ID NO: 9179648 - DNA, 22 bp, Homo sapiens
aaggggaaaaagtgttaggagt

SEQ ID NO: 9179649 - DNA, 22 bp, Homo sapiens
accatgttggccaagctggtct

SEQ ID NO: 9179650 - DNA, 22 bp, Homo sapiens
aaggggaaaaagtgttaggagt

SEQ ID NO: 9179651 - DNA, 22 bp, Homo sapiens
aagggctgttatgtttttatac

SEQ ID NO: 9179652 - DNA, 22 bp, Homo sapiens
aagggctgtagtttgttgatca

SEQ ID NO: 9179653 - DNA, 22 bp, Homo sapiens
aagggctgtagacaagattgct

SEQ ID NO: 9179654 - DNA, 22 bp, Homo sapiens
accaggcttaatcctttgctat

SEQ ID NO: 9179655 - DNA, 19 bp, Homo sapiens
accaggcttatggtcagtg

SEQ ID NO: 9179656 - DNA, 22 bp, Homo sapiens
accaggcttgataccaagaaat

SEQ ID NO: 9179657 - DNA, 22 bp, Homo sapiens
acattttgaaagggaaattgtt

SEQ ID NO: 9179658 - DNA, 21 bp, Homo sapiens
acattttctgttttaggaagt

SEQ ID NO: 9179659 - DNA, 22 bp, Homo sapiens
accaggcccaccgcatgctcct

SEQ ID NO: 9179660 - DNA, 21 bp, Homo sapiens
accaggccaggaggctggcac

SEQ ID NO: 9179661 - DNA, 22 bp, Homo sapiens
acattttgagaaatgacaagct

SEQ ID NO: 9179662 - DNA, 22 bp, Homo sapiens
acattttacaccaagacttctt

SEQ ID NO: 9179663 - DNA, 22 bp, Homo sapiens
acattttacaccaagacttctt

SEQ ID NO: 9179664 - DNA, 22 bp, Homo sapiens
acattttaatatgcttagtgtg

SEQ ID NO: 9179665 - DNA, 22 bp, Homo sapiens
acattttacagttgtctggcta

SEQ ID NO: 9179666 - DNA, 21 bp, Homo sapiens
acattttctgttttaggaagt

SEQ ID NO: 9179667 - DNA, 21 bp, Homo sapiens
acattttctgttttaggaagt

SEQ ID NO: 9179668 - DNA, 22 bp, Homo sapiens
acatttgtttctctagagtagg

SEQ ID NO: 9179669 - DNA, 22 bp, Homo sapiens
acccagagtcatggcacttagc

SEQ ID NO: 9179670 - DNA, 22 bp, Homo sapiens
acccagaggcggaggttgcagt

SEQ ID NO: 9179671 - DNA, 22 bp, Homo sapiens
acccagagctgggcttggcaaa

SEQ ID NO: 9179672 - DNA, 22 bp, Homo sapiens
acccagaggtgtctagcaagct

SEQ ID NO: 9179673 - DNA, 22 bp, Homo sapiens
acccaggataatctgtgtatct

SEQ ID NO: 9179674 - DNA, 22 bp, Homo sapiens
acccaggaggtggaggctgcag

SEQ ID NO: 9179675 - DNA, 22 bp, Homo sapiens
acccaggagccgtgagaggtta

SEQ ID NO: 9179676 - DNA, 22 bp, Homo sapiens
acccaggaggcagaggttgcag

SEQ ID NO: 9179677 - DNA, 22 bp, Homo sapiens
acccaggaggcaaggttgcagt

SEQ ID NO: 9179678 - DNA, 22 bp, Homo sapiens
accccgccgtgacgtcacgcct

SEQ ID NO: 9179679 - DNA, 22 bp, Homo sapiens
acccaggatagagtgctgcagt

SEQ ID NO: 9179680 - DNA, 20 bp, Homo sapiens
accctgccaggcatgtgaat

SEQ ID NO: 9179681 - DNA, 22 bp, Homo sapiens
accctgccctctccagctcagg

SEQ ID NO: 9179682 - DNA, 22 bp, Homo sapiens
accctgccgtgggctgcttgtg

SEQ ID NO: 9179683 - DNA, 22 bp, Homo sapiens
accctgccgtgggctgcttgtg

SEQ ID NO: 9179684 - DNA, 22 bp, Homo sapiens
accgggaagtcctgcactgggc

SEQ ID NO: 9179685 - DNA, 22 bp, Homo sapiens
accgactgagaatacttggctt

SEQ ID NO: 9179686 - DNA, 22 bp, Homo sapiens
accctgcctctgcttcctgtag

SEQ ID NO: 9179687 - DNA, 22 bp, Homo sapiens
aagctaatgaggtgtgtttctg

SEQ ID NO: 9179688 - DNA, 22 bp, Homo sapiens
aagctacattaagcagatttac

SEQ ID NO: 9179689 - DNA, 22 bp, Homo sapiens
aagctatcagctactatcagct

SEQ ID NO: 9179690 - DNA, 22 bp, Homo sapiens
aagccctgggatgttcagcagt

SEQ ID NO: 9179691 - DNA, 22 bp, Homo sapiens
aagccctgggatgttcagcagt

SEQ ID NO: 9179692 - DNA, 22 bp, Homo sapiens
aagcatttttcacagcaacagc

SEQ ID NO: 9179693 - DNA, 22 bp, Homo sapiens
aagcatttttcacagcaacagc

SEQ ID NO: 9179694 - DNA, 22 bp, Homo sapiens
aagcattttgttttaagaatga

SEQ ID NO: 9179695 - DNA, 22 bp, Homo sapiens
aagcattttagataaagcatca

SEQ ID NO: 9179696 - DNA, 22 bp, Homo sapiens
aagcattttagataaagcatca

SEQ ID NO: 9179697 - DNA, 22 bp, Homo sapiens
acagccttcgaagtttcttcct

SEQ ID NO: 9179698 - DNA, 22 bp, Homo sapiens
acagccttctctattggcctca

SEQ ID NO: 9179699 - DNA, 22 bp, Homo sapiens
acagccttattgcgagcaaggc

SEQ ID NO: 9179700 - DNA, 22 bp, Homo sapiens
acagccttactatactaaacag

SEQ ID NO: 9179701 - DNA, 22 bp, Homo sapiens
acagccttattctttagtttac

SEQ ID NO: 9179702 - DNA, 22 bp, Homo sapiens
acagccttctcttcactgtgtc

SEQ ID NO: 9179703 - DNA, 22 bp, Homo sapiens
aagcatttgtgaaattcagatg

SEQ ID NO: 9179704 - DNA, 22 bp, Homo sapiens
aagcattttagataaagcatca

SEQ ID NO: 9179705 - DNA, 21 bp, Homo sapiens
acagcctgtcatctcatggtc

SEQ ID NO: 9179706 - DNA, 21 bp, Homo sapiens
acagcctgtcatctcatggtc

SEQ ID NO: 9179707 - DNA, 21 bp, Homo sapiens
acagcctgtcatctcatggtc

SEQ ID NO: 9179708 - DNA, 22 bp, Homo sapiens
acagcctggcctgagttaaggc

SEQ ID NO: 9179709 - DNA, 22 bp, Homo sapiens
acagcctgtgtaccagctggga

SEQ ID NO: 9179710 - DNA, 21 bp, Homo sapiens
acagccttacctggggtgtga

SEQ ID NO: 9179711 - DNA, 22 bp, Homo sapiens
acagcctgtttgatctggtgct

SEQ ID NO: 9179712 - DNA, 19 bp, Homo sapiens
acagcctgttggtggggct

SEQ ID NO: 9179713 - DNA, 22 bp, Homo sapiens
aagctcaaaccttggggctcag

SEQ ID NO: 9179714 - DNA, 22 bp, Homo sapiens
aagctccccgaaacccacctct

SEQ ID NO: 9179715 - DNA, 19 bp, Homo sapiens
aagctccagcagatccttt

SEQ ID NO: 9179716 - DNA, 19 bp, Homo sapiens
aagctccagcagatccttt

SEQ ID NO: 9179717 - DNA, 22 bp, Homo sapiens
aagctcttatgatatttattta

SEQ ID NO: 9179718 - DNA, 22 bp, Homo sapiens
aagctctgtctcttgggagtta

SEQ ID NO: 9179719 - DNA, 22 bp, Homo sapiens
acagggaaagggacagcagcag

SEQ ID NO: 9179720 - DNA, 22 bp, Homo sapiens
acagggaaagggacagcagcag

SEQ ID NO: 9179721 - DNA, 22 bp, Homo sapiens
acagggaacaggaatatacaaa

SEQ ID NO: 9179722 - DNA, 22 bp, Homo sapiens
acagggaacaggaatatacaaa

SEQ ID NO: 9179723 - DNA, 22 bp, Homo sapiens
acagggaaagggacagcagcag

SEQ ID NO: 9179724 - DNA, 22 bp, Homo sapiens
aagctctggttaaaaggcctgg

SEQ ID NO: 9179725 - DNA, 22 bp, Homo sapiens
aagctctgtagctcatgtgata

SEQ ID NO: 9179726 - DNA, 18 bp, Homo sapiens
aagctctggctaggaaaa

SEQ ID NO: 9179727 - DNA, 20 bp, Homo sapiens
aagctctgcttcatgtggtc

SEQ ID NO: 9179728 - DNA, 18 bp, Homo sapiens
aagctctggctaggaaaa

SEQ ID NO: 9179729 - DNA, 22 bp, Homo sapiens
acagggcagagaggcaggcttg

SEQ ID NO: 9179730 - DNA, 22 bp, Homo sapiens
acagggcagagggcagttggta

SEQ ID NO: 9179731 - DNA, 22 bp, Homo sapiens
acagggcagagaggcaggcttg

SEQ ID NO: 9179732 - DNA, 22 bp, Homo sapiens
aagctgcttggggctcctgcag

SEQ ID NO: 9179733 - DNA, 22 bp, Homo sapiens
aagctgcttggggctcctgcag

SEQ ID NO: 9179734 - DNA, 22 bp, Homo sapiens
aagctgccttccatgtgaggaa

SEQ ID NO: 9179735 - DNA, 22 bp, Homo sapiens
aaggaggaatttcagggtgaat

SEQ ID NO: 9179736 - DNA, 22 bp, Homo sapiens
acatagaacctggcacatagta

SEQ ID NO: 9179737 - DNA, 22 bp, Homo sapiens
acatagaacctggcacatagta

SEQ ID NO: 9179738 - DNA, 22 bp, Homo sapiens
aaggaggcactcgctctcaggg

SEQ ID NO: 9179739 - DNA, 20 bp, Homo sapiens
acatatgaatgatagagcca

SEQ ID NO: 9179740 - DNA, 22 bp, Homo sapiens
acatatctttactcatcatctc

SEQ ID NO: 9179741 - DNA, 22 bp, Homo sapiens
aaggaggagtggggtcctggaa

SEQ ID NO: 9179742 - DNA, 22 bp, Homo sapiens
aaggaggacacccaggactggg

SEQ ID NO: 9179743 - DNA, 22 bp, Homo sapiens
acatatgtgtctgcacatgccc

SEQ ID NO: 9179744 - DNA, 22 bp, Homo sapiens
acatatgtctatttcatgtaaa

SEQ ID NO: 9179745 - DNA, 22 bp, Homo sapiens
acatatgtctatttcatgtaaa

SEQ ID NO: 9179746 - DNA, 22 bp, Homo sapiens
acatatgtgcttatatccatga

SEQ ID NO: 9179747 - DNA, 19 bp, Homo sapiens
acatatgtggatatacatg

SEQ ID NO: 9179748 - DNA, 22 bp, Homo sapiens
acatatgtatatgtacacagtc

SEQ ID NO: 9179749 - DNA, 22 bp, Homo sapiens
acatatgctcatctgcattccc

SEQ ID NO: 9179750 - DNA, 22 bp, Homo sapiens
acatatgatattgaggatctca

SEQ ID NO: 9179751 - DNA, 22 bp, Homo sapiens
acatatgtgttgtacatgcatg

SEQ ID NO: 9179752 - DNA, 22 bp, Homo sapiens
aaggcagagattagcagaatga

SEQ ID NO: 9179753 - DNA, 22 bp, Homo sapiens
aaggcagaggaaggtctagttt

SEQ ID NO: 9179754 - DNA, 22 bp, Homo sapiens
aaggcagagggctggatcagag

SEQ ID NO: 9179755 - DNA, 22 bp, Homo sapiens
aaggcagagggctggatcagag

SEQ ID NO: 9179756 - DNA, 22 bp, Homo sapiens
acagtcttaatggataggagct

SEQ ID NO: 9179757 - DNA, 22 bp, Homo sapiens
acagtcttgctgtatggtcagg

SEQ ID NO: 9179758 - DNA, 22 bp, Homo sapiens
acagtcttcatgctagaatggc

SEQ ID NO: 9179759 - DNA, 22 bp, Homo sapiens
acagtcttgagcatcagccaga

SEQ ID NO: 9179760 - DNA, 22 bp, Homo sapiens
acagtcttcatgctagaatggc

SEQ ID NO: 9179761 - DNA, 22 bp, Homo sapiens
acagtgtttaaaaatcagatct

SEQ ID NO: 9179762 - DNA, 22 bp, Homo sapiens
aaggagagagctttgctggaac

SEQ ID NO: 9179763 - DNA, 21 bp, Homo sapiens
aaggagcctaggaggctcagg

SEQ ID NO: 9179764 - DNA, 22 bp, Homo sapiens
aaggagagtacaggagttggta

SEQ ID NO: 9179765 - DNA, 22 bp, Homo sapiens
aaggagagtacaggagttggta

SEQ ID NO: 9179766 - DNA, 21 bp, Homo sapiens
aaggagcctaggaggctcagg

SEQ ID NO: 9179767 - DNA, 22 bp, Homo sapiens
aaggagctcccggcagaccagg

SEQ ID NO: 9179768 - DNA, 22 bp, Homo sapiens
aaggagctgggagggacacatg

SEQ ID NO: 9179769 - DNA, 22 bp, Homo sapiens
aaggagctgggagggacacatg

SEQ ID NO: 9179770 - DNA, 22 bp, Homo sapiens
aaggagctgggagggacacatg

SEQ ID NO: 9179771 - DNA, 22 bp, Homo sapiens
aaggagctttcattacagcctt

SEQ ID NO: 9179772 - DNA, 22 bp, Homo sapiens
aaggagcttgttcgccttcctc

SEQ ID NO: 9179773 - DNA, 22 bp, Homo sapiens
aagctggagagttaggtgaata

SEQ ID NO: 9179774 - DNA, 22 bp, Homo sapiens
aaggacaggcacagtggtggag

SEQ ID NO: 9179775 - DNA, 22 bp, Homo sapiens
aagctggactctgccatttact

SEQ ID NO: 9179776 - DNA, 22 bp, Homo sapiens
aagctggacattgtagggggga

SEQ ID NO: 9179777 - DNA, 22 bp, Homo sapiens
aagctggacactgacccactgt

SEQ ID NO: 9179778 - DNA, 20 bp, Homo sapiens
aagctggaagaccagcattg

SEQ ID NO: 9179779 - DNA, 22 bp, Homo sapiens
aagctggacactgacccactgt

SEQ ID NO: 9179780 - DNA, 22 bp, Homo sapiens
aagctggaacatcttgaggaag

SEQ ID NO: 9179781 - DNA, 22 bp, Homo sapiens
aaggacaggctaacctgacatt

SEQ ID NO: 9179782 - DNA, 22 bp, Homo sapiens
aaggagacatttgcagagcacc

SEQ ID NO: 9179783 - DNA, 23 bp, Homo sapiens
actataaagttgttctgatttac

SEQ ID NO: 9179784 - DNA, 22 bp, Homo sapiens
actatacaccaaaatattaagg

SEQ ID NO: 9179785 - DNA, 22 bp, Homo sapiens
actcagaaccatttactctgag

SEQ ID NO: 9179786 - DNA, 22 bp, Homo sapiens
actcacttcttttactataaaa

SEQ ID NO: 9179787 - DNA, 22 bp, Homo sapiens
actcagaagatataatgactca

SEQ ID NO: 9179788 - DNA, 22 bp, Homo sapiens
actcagaatgactgatgctgtg

SEQ ID NO: 9179789 - DNA, 22 bp, Homo sapiens
actatacagtatgtacgtgcac

SEQ ID NO: 9179790 - DNA, 19 bp, Homo sapiens
actctacagtgtgtacaac

SEQ ID NO: 9179791 - DNA, 23 bp, Homo sapiens
actccccagtctcttcttgccaa

SEQ ID NO: 9179792 - DNA, 22 bp, Homo sapiens
actctccctgagagggaggcat

SEQ ID NO: 9179793 - DNA, 22 bp, Homo sapiens
actctccctgagagggaggcat

SEQ ID NO: 9179794 - DNA, 22 bp, Homo sapiens
actctcagggctccagggaaag

SEQ ID NO: 9179795 - DNA, 22 bp, Homo sapiens
actctcagggacagggtctggg

SEQ ID NO: 9179796 - DNA, 22 bp, Homo sapiens
acgtcttcgttggcagagattt

SEQ ID NO: 9179797 - DNA, 22 bp, Homo sapiens
acgtgcaggatctggttggcga

SEQ ID NO: 9179798 - DNA, 22 bp, Homo sapiens
acggtgctgggtattggggttc

SEQ ID NO: 9179799 - DNA, 22 bp, Homo sapiens
acggggctagagaaggtttctt

SEQ ID NO: 9179800 - DNA, 22 bp, Homo sapiens
acggggctagagaaggtttctt

SEQ ID NO: 9179801 - DNA, 22 bp, Homo sapiens
acggtaacagataccacagact

SEQ ID NO: 9179802 - DNA, 22 bp, Homo sapiens
acctagagtagtcaaattcata

SEQ ID NO: 9179803 - DNA, 22 bp, Homo sapiens
acggggctagagaaggtttctt

SEQ ID NO: 9179804 - DNA, 22 bp, Homo sapiens
acctttatgaaacagctgtcgt

SEQ ID NO: 9179805 - DNA, 22 bp, Homo sapiens
accgggctaatttttgtatctt

SEQ ID NO: 9179806 - DNA, 22 bp, Homo sapiens
accgtttacaccactaccgctt

SEQ ID NO: 9179807 - DNA, 22 bp, Homo sapiens
acctaaatctacctcatgtttt

SEQ ID NO: 9179808 - DNA, 22 bp, Homo sapiens
accgtggatttgtagtcatttc

SEQ ID NO: 9179809 - DNA, 22 bp, Homo sapiens
acctaaattctggctgattagg

SEQ ID NO: 9179810 - DNA, 22 bp, Homo sapiens
acctacatcaagggagtggtag

SEQ ID NO: 9179811 - DNA, 22 bp, Homo sapiens
acctaaattctggctgattagg

SEQ ID NO: 9179812 - DNA, 22 bp, Homo sapiens
acctacccttagatcacaaggg

SEQ ID NO: 9179813 - DNA, 22 bp, Homo sapiens
acctacagatctttgaatgtgt

SEQ ID NO: 9179814 - DNA, 22 bp, Homo sapiens
acctacatgttccacatagttg

SEQ ID NO: 9179815 - DNA, 20 bp, Homo sapiens
acctacatgtatagtgaggg

SEQ ID NO: 9179816 - DNA, 22 bp, Homo sapiens
acctagaatccatctgcttatt

SEQ ID NO: 9179817 - DNA, 22 bp, Homo sapiens
acgtggagagaatagggcacca

SEQ ID NO: 9179818 - DNA, 22 bp, Homo sapiens
acgtgctgaagttatccctgtt

SEQ ID NO: 9179819 - DNA, 22 bp, Homo sapiens
acgtgctggagaagagctcgcc

SEQ ID NO: 9179820 - DNA, 18 bp, Homo sapiens
acgtgctgtgccttttgc

SEQ ID NO: 9179821 - DNA, 18 bp, Homo sapiens
acgtgctgtgccttttgc

SEQ ID NO: 9179822 - DNA, 20 bp, Homo sapiens
acgtggccaccagtggctta

SEQ ID NO: 9179823 - DNA, 20 bp, Homo sapiens
acgtggccaccagtggctta

SEQ ID NO: 9179824 - DNA, 20 bp, Homo sapiens
acgtggccaccagtggctta

SEQ ID NO: 9179825 - DNA, 22 bp, Homo sapiens
aagtcctttaatatcacatagt

SEQ ID NO: 9179826 - DNA, 22 bp, Homo sapiens
actacactgccctggggatcaa

SEQ ID NO: 9179827 - DNA, 22 bp, Homo sapiens
actggccaggttcaaaatacag

SEQ ID NO: 9179828 - DNA, 22 bp, Homo sapiens
actggccatgggatttatattt

SEQ ID NO: 9179829 - DNA, 21 bp, Homo sapiens
actggccctgccttacaaata

SEQ ID NO: 9179830 - DNA, 22 bp, Homo sapiens
actggcctatcagcatgagtct

SEQ ID NO: 9179831 - DNA, 22 bp, Homo sapiens
actggctcagagttcctagaga

SEQ ID NO: 9179832 - DNA, 22 bp, Homo sapiens
actggctctgtgatctatgatt

SEQ ID NO: 9179833 - DNA, 22 bp, Homo sapiens
actggccaggttcaaaatacag

SEQ ID NO: 9179834 - DNA, 22 bp, Homo sapiens
actggccaggcagcagtagctt

SEQ ID NO: 9179835 - DNA, 22 bp, Homo sapiens
actggccaggcagcagtagctt

SEQ ID NO: 9179836 - DNA, 22 bp, Homo sapiens
aataccacctcattctggaggc

SEQ ID NO: 9179837 - DNA, 22 bp, Homo sapiens
aatacagaggaaacatttaata

SEQ ID NO: 9179838 - DNA, 22 bp, Homo sapiens
actggctgaggaagttgccact

SEQ ID NO: 9179839 - DNA, 22 bp, Homo sapiens
aatacagagaatgttatttgga

SEQ ID NO: 9179840 - DNA, 22 bp, Homo sapiens
aatacgtggttactctatagag

SEQ ID NO: 9179841 - DNA, 22 bp, Homo sapiens
aatacctttcctgccattcact

SEQ ID NO: 9179842 - DNA, 22 bp, Homo sapiens
aatacctttcctgccattcact

SEQ ID NO: 9179843 - DNA, 22 bp, Homo sapiens
aataccttccaacatcaagaca

SEQ ID NO: 9179844 - DNA, 22 bp, Homo sapiens
aataccatgcagaaataacata

SEQ ID NO: 9179845 - DNA, 22 bp, Homo sapiens
aataccatgataattaattcat

SEQ ID NO: 9179846 - DNA, 17 bp, Homo sapiens
aatacctgccaattcta

SEQ ID NO: 9179847 - DNA, 17 bp, Homo sapiens
aatacctgccaattcta

SEQ ID NO: 9179848 - DNA, 22 bp, Homo sapiens
aataccttccaacatcaagaca

SEQ ID NO: 9179849 - DNA, 22 bp, Homo sapiens
actggaggggaaaatggtagta

SEQ ID NO: 9179850 - DNA, 22 bp, Homo sapiens
actggagtaaaggtcacttgtg

SEQ ID NO: 9179851 - DNA, 20 bp, Homo sapiens
actggagtaccctagagaag

SEQ ID NO: 9179852 - DNA, 22 bp, Homo sapiens
actggagtacagtggcgtgaac

SEQ ID NO: 9179853 - DNA, 20 bp, Homo sapiens
actggagtaccctagagaag

SEQ ID NO: 9179854 - DNA, 22 bp, Homo sapiens
actggagtagatctgactgagt

SEQ ID NO: 9179855 - DNA, 22 bp, Homo sapiens
actggagtattgtttaatacca

SEQ ID NO: 9179856 - DNA, 22 bp, Homo sapiens
actggagtagatctgactgagt

SEQ ID NO: 9179857 - DNA, 22 bp, Homo sapiens
actggagtccagacccaagagg

SEQ ID NO: 9179858 - DNA, 22 bp, Homo sapiens
actggagtccagacccaagagg

SEQ ID NO: 9179859 - DNA, 22 bp, Homo sapiens
actggagtcagggaaaaagtgt

SEQ ID NO: 9179860 - DNA, 22 bp, Homo sapiens
actggagtgagtatcgatgaac

SEQ ID NO: 9179861 - DNA, 22 bp, Homo sapiens
actggagtgagtatcgatgaac

SEQ ID NO: 9179862 - DNA, 22 bp, Homo sapiens
actggagtgtttggaggatgca

SEQ ID NO: 9179863 - DNA, 16 bp, Homo sapiens
actggagtggggatgc

SEQ ID NO: 9179864 - DNA, 22 bp, Homo sapiens
actggagtgtttggaggatgca

SEQ ID NO: 9179865 - DNA, 22 bp, Homo sapiens
actggagttcatggtaaagtca

SEQ ID NO: 9179866 - DNA, 22 bp, Homo sapiens
actggagttattatttgcagct

SEQ ID NO: 9179867 - DNA, 20 bp, Homo sapiens
actggagttcatgctaagag

SEQ ID NO: 9179868 - DNA, 20 bp, Homo sapiens
actggagccatctcagccta

SEQ ID NO: 9179869 - DNA, 22 bp, Homo sapiens
actgctattgatgtcacacttt

SEQ ID NO: 9179870 - DNA, 22 bp, Homo sapiens
actgctaaatctccatcgatta

SEQ ID NO: 9179871 - DNA, 22 bp, Homo sapiens
actgagtggctggggagtggca

SEQ ID NO: 9179872 - DNA, 22 bp, Homo sapiens
actgagtgtccactatgagcca

SEQ ID NO: 9179873 - DNA, 22 bp, Homo sapiens
actgagtgtaggactttgagtt

SEQ ID NO: 9179874 - DNA, 22 bp, Homo sapiens
actgagtgggaggtttgtgtga

SEQ ID NO: 9179875 - DNA, 22 bp, Homo sapiens
actgcactccaacctgggtgac

SEQ ID NO: 9179876 - DNA, 22 bp, Homo sapiens
actgcactccaacctgggtgac

SEQ ID NO: 9179877 - DNA, 22 bp, Homo sapiens
actgcactccagcctcggggtc

SEQ ID NO: 9179878 - DNA, 22 bp, Homo sapiens
actgcactccagcctgggtaac

SEQ ID NO: 9179879 - DNA, 22 bp, Homo sapiens
actgcactccagcctgggtaac

SEQ ID NO: 9179880 - DNA, 22 bp, Homo sapiens
actgcactccagcctgggtaac

SEQ ID NO: 9179881 - DNA, 22 bp, Homo sapiens
actctggcaagcttccacttcc

SEQ ID NO: 9179882 - DNA, 22 bp, Homo sapiens
actctggcagcagaaccagtgt

SEQ ID NO: 9179883 - DNA, 22 bp, Homo sapiens
actctggcactgggtacctcag

SEQ ID NO: 9179884 - DNA, 22 bp, Homo sapiens
actctcccttggagcctcaggc

SEQ ID NO: 9179885 - DNA, 22 bp, Homo sapiens
actctgctctgtatttcactgt

SEQ ID NO: 9179886 - DNA, 22 bp, Homo sapiens
actctggccatcttggaccttg

SEQ ID NO: 9179887 - DNA, 22 bp, Homo sapiens
actctggccaggtgcggtatgt

SEQ ID NO: 9179888 - DNA, 22 bp, Homo sapiens
actctggccctcctgctgccag

SEQ ID NO: 9179889 - DNA, 22 bp, Homo sapiens
actctggccccaggatctgtgt

SEQ ID NO: 9179890 - DNA, 22 bp, Homo sapiens
actctggcgggcgggcgagcca

SEQ ID NO: 9179891 - DNA, 22 bp, Homo sapiens
actctggctattcactataata

SEQ ID NO: 9179892 - DNA, 22 bp, Homo sapiens
actctggctgccttgtgagcat

SEQ ID NO: 9179893 - DNA, 23 bp, Homo sapiens
actgaggtactgaggttgtgaca

SEQ ID NO: 9179894 - DNA, 22 bp, Homo sapiens
aatgatgtttttaaagaacata

SEQ ID NO: 9179895 - DNA, 22 bp, Homo sapiens
aatgattgtcattccaaaaagt

SEQ ID NO: 9179896 - DNA, 22 bp, Homo sapiens
aatgatgccctggagttttgca

SEQ ID NO: 9179897 - DNA, 22 bp, Homo sapiens
aatgatgagttctaatagaccc

SEQ ID NO: 9179898 - DNA, 22 bp, Homo sapiens
agaagcagaaggaagcagggcc

SEQ ID NO: 9179899 - DNA, 22 bp, Homo sapiens
agaagcagaaggaagcagggcc

SEQ ID NO: 9179900 - DNA, 22 bp, Homo sapiens
agaagcagaaaagggcactttt

SEQ ID NO: 9179901 - DNA, 22 bp, Homo sapiens
aatgatttcccctacacagaag

SEQ ID NO: 9179902 - DNA, 23 bp, Homo sapiens
aatgatttcatgatgatagcagc

SEQ ID NO: 9179903 - DNA, 22 bp, Homo sapiens
agaacaatgttaaattattaag

SEQ ID NO: 9179904 - DNA, 22 bp, Homo sapiens
aatgagttttagggccattaaa

SEQ ID NO: 9179905 - DNA, 22 bp, Homo sapiens
aatgatgacaggataaagaaca

SEQ ID NO: 9179906 - DNA, 20 bp, Homo sapiens
agaacaagtactaaaggaga

SEQ ID NO: 9179907 - DNA, 22 bp, Homo sapiens
agaaattcaattctaattagct

SEQ ID NO: 9179908 - DNA, 22 bp, Homo sapiens
agaaatgacaagactgatcagg

SEQ ID NO: 9179909 - DNA, 22 bp, Homo sapiens
agaaatgacacacatgagacat

SEQ ID NO: 9179910 - DNA, 22 bp, Homo sapiens
agaaatgacaagactgatcagg

SEQ ID NO: 9179911 - DNA, 22 bp, Homo sapiens
agaaatgacaagactgatcagg

SEQ ID NO: 9179912 - DNA, 22 bp, Homo sapiens
agaaatgaatatgtagtggtta

SEQ ID NO: 9179913 - DNA, 22 bp, Homo sapiens
agaaatgaatatgtagtggtta

SEQ ID NO: 9179914 - DNA, 22 bp, Homo sapiens
agaaatgaagcaggagttatta

SEQ ID NO: 9179915 - DNA, 22 bp, Homo sapiens
agaaatgaagcaggagttatta

SEQ ID NO: 9179916 - DNA, 22 bp, Homo sapiens
agaaatgaagcaggagttatta

SEQ ID NO: 9179917 - DNA, 22 bp, Homo sapiens
agaaatgaagcaggagttatta

SEQ ID NO: 9179918 - DNA, 22 bp, Homo sapiens
agaaatgaaaccaaagcctaga

SEQ ID NO: 9179919 - DNA, 22 bp, Homo sapiens
agaaatgaaaccaaagcctaga

SEQ ID NO: 9179920 - DNA, 22 bp, Homo sapiens
agaaatgaagagagtcaaggtt

SEQ ID NO: 9179921 - DNA, 22 bp, Homo sapiens
agaaatgaagagagtcaaggtt

SEQ ID NO: 9179922 - DNA, 22 bp, Homo sapiens
agaaatactttgtaaatctcac

SEQ ID NO: 9179923 - DNA, 22 bp, Homo sapiens
agaaatactttgtaaatctcac

SEQ ID NO: 9179924 - DNA, 22 bp, Homo sapiens
agaaatactttgtaaatctcac

SEQ ID NO: 9179925 - DNA, 22 bp, Homo sapiens
aatcagttgttcactctgaaaa

SEQ ID NO: 9179926 - DNA, 22 bp, Homo sapiens
aatcagttgtccaaagttcaca

SEQ ID NO: 9179927 - DNA, 22 bp, Homo sapiens
aatcagttagaaggaagagaat

SEQ ID NO: 9179928 - DNA, 22 bp, Homo sapiens
aatcaggccgaggacatcagcc

SEQ ID NO: 9179929 - DNA, 22 bp, Homo sapiens
aatcagtattggtatagaatga

SEQ ID NO: 9179930 - DNA, 22 bp, Homo sapiens
aatcagttaaatattgagtaca

SEQ ID NO: 9179931 - DNA, 22 bp, Homo sapiens
aatcaggacccactctacagtt

SEQ ID NO: 9179932 - DNA, 22 bp, Homo sapiens
aatcaggatgactgtcatttca

SEQ ID NO: 9179933 - DNA, 22 bp, Homo sapiens
aatcagctttagtgtccttggc

SEQ ID NO: 9179934 - DNA, 22 bp, Homo sapiens
aatcagcaaaggtcagctctaa

SEQ ID NO: 9179935 - DNA, 22 bp, Homo sapiens
aatactgcatacagtttctcat

SEQ ID NO: 9179936 - DNA, 22 bp, Homo sapiens
actgggctgcctggttcttcta

SEQ ID NO: 9179937 - DNA, 22 bp, Homo sapiens
aatactgcctgtgaggtaactc

SEQ ID NO: 9179938 - DNA, 22 bp, Homo sapiens
aatactgaattagttgagacaa

SEQ ID NO: 9179939 - DNA, 22 bp, Homo sapiens
aatactagttattaaagctttt

SEQ ID NO: 9179940 - DNA, 20 bp, Homo sapiens
aatactaaacacaaagcagt

SEQ ID NO: 9179941 - DNA, 20 bp, Homo sapiens
aatactaaacacaaagcagt

SEQ ID NO: 9179942 - DNA, 22 bp, Homo sapiens
aatactatgtagccaaaataat

SEQ ID NO: 9179943 - DNA, 22 bp, Homo sapiens
actgggctgcttgagtgccttc

SEQ ID NO: 9179944 - DNA, 22 bp, Homo sapiens
actgggctggggctcattctcc

SEQ ID NO: 9179945 - DNA, 22 bp, Homo sapiens
actgggctggttagttttacta

SEQ ID NO: 9179946 - DNA, 22 bp, Homo sapiens
actgggctgtaaagagaggcaa

SEQ ID NO: 9179947 - DNA, 22 bp, Homo sapiens
actgggctgtggacacccagcg

SEQ ID NO: 9179948 - DNA, 22 bp, Homo sapiens
actgggctgttccttatttcta

SEQ ID NO: 9179949 - DNA, 22 bp, Homo sapiens
actgggctgtaaagagaggcaa

SEQ ID NO: 9179950 - DNA, 22 bp, Homo sapiens
actgggctgttttttgagtgga

SEQ ID NO: 9179951 - DNA, 23 bp, Homo sapiens
actgggcttatgaggaggcttgt

SEQ ID NO: 9179952 - DNA, 22 bp, Homo sapiens
actgggcttatttcttgtgaac

SEQ ID NO: 9179953 - DNA, 22 bp, Homo sapiens
actgggcttatgctgtggagta

SEQ ID NO: 9179954 - DNA, 22 bp, Homo sapiens
actgttcatattcttagaaatt

SEQ ID NO: 9179955 - DNA, 22 bp, Homo sapiens
actgttcatctcttagaaagta

SEQ ID NO: 9179956 - DNA, 22 bp, Homo sapiens
actgttcatttggatttctctg

SEQ ID NO: 9179957 - DNA, 21 bp, Homo sapiens
actgttcatctgttcagaagc

SEQ ID NO: 9179958 - DNA, 22 bp, Homo sapiens
actgttcacagattagtcgatg

SEQ ID NO: 9179959 - DNA, 22 bp, Homo sapiens
aatataattttattcctagagt

SEQ ID NO: 9179960 - DNA, 22 bp, Homo sapiens
aatagtcctctccttggaattt

SEQ ID NO: 9179961 - DNA, 22 bp, Homo sapiens
aatagtcctgatttaatctggg

SEQ ID NO: 9179962 - DNA, 19 bp, Homo sapiens
actgggcttgtcctcgtgg

SEQ ID NO: 9179963 - DNA, 22 bp, Homo sapiens
actgggcttcacttggcacatc

SEQ ID NO: 9179964 - DNA, 22 bp, Homo sapiens
aatatagatttactcaagagaa

SEQ ID NO: 9179965 - DNA, 22 bp, Homo sapiens
actgttcatttgtcctgtatct

SEQ ID NO: 9179966 - DNA, 19 bp, Homo sapiens
actgttctaacttgcagct

SEQ ID NO: 9179967 - DNA, 18 bp, Homo sapiens
actgttctctcctgccct

SEQ ID NO: 9179968 - DNA, 23 bp, Homo sapiens
actttattgaccccaggtcagtt

SEQ ID NO: 9179969 - DNA, 23 bp, Homo sapiens
actttattgaccccaggtcagtt

SEQ ID NO: 9179970 - DNA, 23 bp, Homo sapiens
actttattgaccccaggtcagtt

SEQ ID NO: 9179971 - DNA, 23 bp, Homo sapiens
actttattgaccccaggtcagtt

SEQ ID NO: 9179972 - DNA, 23 bp, Homo sapiens
actttattgaccccaggtcagtt

SEQ ID NO: 9179973 - DNA, 22 bp, Homo sapiens
actttgaaatgtgtaagagaga

SEQ ID NO: 9179974 - DNA, 22 bp, Homo sapiens
actttgaaatgtgtaagagaga

SEQ ID NO: 9179975 - DNA, 22 bp, Homo sapiens
actttgaaggggaacattttaa

SEQ ID NO: 9179976 - DNA, 22 bp, Homo sapiens
actttgaaaagacagtagctct

SEQ ID NO: 9179977 - DNA, 22 bp, Homo sapiens
actttgaaactaaaattcatta

SEQ ID NO: 9179978 - DNA, 22 bp, Homo sapiens
actttgaaactaaaattcatta

SEQ ID NO: 9179979 - DNA, 22 bp, Homo sapiens
actttgaaactaaaattcatta

SEQ ID NO: 9179980 - DNA, 22 bp, Homo sapiens
actttcttaggctgtataaatg

SEQ ID NO: 9179981 - DNA, 22 bp, Homo sapiens
actttctgtcatctagacaagt

SEQ ID NO: 9179982 - DNA, 22 bp, Homo sapiens
actttcttcttatgcattaagg

SEQ ID NO: 9179983 - DNA, 22 bp, Homo sapiens
actttcttaggctgtataaatg

SEQ ID NO: 9179984 - DNA, 22 bp, Homo sapiens
actttcttaggctgtataaatg

SEQ ID NO: 9179985 - DNA, 22 bp, Homo sapiens
aatgtaaaatatcttgtacttg

SEQ ID NO: 9179986 - DNA, 22 bp, Homo sapiens
aatgtaaaatatcttgtacttg

SEQ ID NO: 9179987 - DNA, 22 bp, Homo sapiens
aatgtaaaatatcttgtacttg

SEQ ID NO: 9179988 - DNA, 22 bp, Homo sapiens
aatgtaaaatatcttgtacttg

SEQ ID NO: 9179989 - DNA, 18 bp, Homo sapiens
aatgtgaatatttacttc

SEQ ID NO: 9179990 - DNA, 22 bp, Homo sapiens
aatgtgactgaatatttactct

SEQ ID NO: 9179991 - DNA, 22 bp, Homo sapiens
aatgtcttccctggcaggccaa

SEQ ID NO: 9179992 - DNA, 22 bp, Homo sapiens
aatgtcttccctggcaggccaa

SEQ ID NO: 9179993 - DNA, 22 bp, Homo sapiens
aatgtcttcagttctgtattgt

SEQ ID NO: 9179994 - DNA, 22 bp, Homo sapiens
aatgtcttcagtgtatacatgg

SEQ ID NO: 9179995 - DNA, 22 bp, Homo sapiens
aatgtgagccaatgcccgtggg

SEQ ID NO: 9179996 - DNA, 22 bp, Homo sapiens
aatgtgagccaatgcccgtggg

SEQ ID NO: 9179997 - DNA, 22 bp, Homo sapiens
aatgtgaggccttggtagttat

SEQ ID NO: 9179998 - DNA, 22 bp, Homo sapiens
aatgtgaggccttggtagttat

SEQ ID NO: 9179999 - DNA, 22 bp, Homo sapiens
aatgtgcagtgcctgaagcatg

SEQ ID NO: 9180000 - DNA, 22 bp, Homo sapiens
aatgtgcagtgcctgaagcatg

SEQ ID NO: 9180001 - DNA, 22 bp, Homo sapiens
aatgtgcaggctcaaaccttgt

SEQ ID NO: 9180002 - DNA, 22 bp, Homo sapiens
aatgtgcagatgaataaacaaa

SEQ ID NO: 9180003 - DNA, 22 bp, Homo sapiens
aatgtggcattgtcattattgg

SEQ ID NO: 9180004 - DNA, 22 bp, Homo sapiens
aatggtaatatttcatagttgt

SEQ ID NO: 9180005 - DNA, 23 bp, Homo sapiens
aatgggtgcaactatccatgaca

SEQ ID NO: 9180006 - DNA, 22 bp, Homo sapiens
aatgggttgtagggaaagtcaa

SEQ ID NO: 9180007 - DNA, 23 bp, Homo sapiens
aatgggtgcaactatccatgaca

SEQ ID NO: 9180008 - DNA, 23 bp, Homo sapiens
aatgggtgcaactatccatgaca

SEQ ID NO: 9180009 - DNA, 22 bp, Homo sapiens
aatgggctttggccagtaggag

SEQ ID NO: 9180010 - DNA, 22 bp, Homo sapiens
aatgggctgaatttcatgaaat

SEQ ID NO: 9180011 - DNA, 20 bp, Homo sapiens
aatgggcagtgtgtgagata

SEQ ID NO: 9180012 - DNA, 22 bp, Homo sapiens
aatggtttaacatatgcttgag

SEQ ID NO: 9180013 - DNA, 22 bp, Homo sapiens
aatggtttgtacctgtccttgg

SEQ ID NO: 9180014 - DNA, 20 bp, Homo sapiens
agacaaaatgacttcatgca

SEQ ID NO: 9180015 - DNA, 22 bp, Homo sapiens
agaagcagctttcaaggtgatt

SEQ ID NO: 9180016 - DNA, 22 bp, Homo sapiens
agaagcagactctgaggcaagg

SEQ ID NO: 9180017 - DNA, 22 bp, Homo sapiens
agaagcagactctgaggcaagg

SEQ ID NO: 9180018 - DNA, 22 bp, Homo sapiens
agaagcagaaggaagcagggcc

SEQ ID NO: 9180019 - DNA, 22 bp, Homo sapiens
agaagcagaaggaagcagggcc

SEQ ID NO: 9180020 - DNA, 22 bp, Homo sapiens
agacaatgaatagatttgagaa

SEQ ID NO: 9180021 - DNA, 22 bp, Homo sapiens
agacaatatgtatattaagaat

SEQ ID NO: 9180022 - DNA, 22 bp, Homo sapiens
agacaatggaccaagcaccttc

SEQ ID NO: 9180023 - DNA, 22 bp, Homo sapiens
agacaattgttctaagtaaaaa

SEQ ID NO: 9180024 - DNA, 22 bp, Homo sapiens
agacaattgttctaagtaaaaa

SEQ ID NO: 9180025 - DNA, 22 bp, Homo sapiens
agacaatttcaaagtaatatta

SEQ ID NO: 9180026 - DNA, 22 bp, Homo sapiens
aatgggaggattttctctcttg

SEQ ID NO: 9180027 - DNA, 22 bp, Homo sapiens
aatgggattaagaaagatcttg

SEQ ID NO: 9180028 - DNA, 22 bp, Homo sapiens
aatgggataattgttcatggga

SEQ ID NO: 9180029 - DNA, 22 bp, Homo sapiens
aatgggattaagaaagatcttg

SEQ ID NO: 9180030 - DNA, 22 bp, Homo sapiens
aatgggcacacttagagagtaa

SEQ ID NO: 9180031 - DNA, 22 bp, Homo sapiens
aatgggaagtcactactgttac

SEQ ID NO: 9180032 - DNA, 22 bp, Homo sapiens
aatgggaagccagaagacaagg

SEQ ID NO: 9180033 - DNA, 22 bp, Homo sapiens
aatggcagaggcaaagatggta

SEQ ID NO: 9180034 - DNA, 22 bp, Homo sapiens
agaccccctttaatggaagtgc

SEQ ID NO: 9180035 - DNA, 22 bp, Homo sapiens
aatgtgtacatgacagatagaa

SEQ ID NO: 9180036 - DNA, 22 bp, Homo sapiens
aatgtggccacttttttctggg

SEQ ID NO: 9180037 - DNA, 22 bp, Homo sapiens
aatgtggttaacccatttaaga

SEQ ID NO: 9180038 - DNA, 22 bp, Homo sapiens
agaccctctcctcatggacatg

SEQ ID NO: 9180039 - DNA, 22 bp, Homo sapiens
agaccctggtaaacactccagg

SEQ ID NO: 9180040 - DNA, 22 bp, Homo sapiens
aattaaaaaaggagagcttgct

SEQ ID NO: 9180041 - DNA, 22 bp, Homo sapiens
aatgtttggctagatagatgga

SEQ ID NO: 9180042 - DNA, 22 bp, Homo sapiens
aattaacagagggcttattact

SEQ ID NO: 9180043 - DNA, 22 bp, Homo sapiens
agagacagatctgagggacctc

SEQ ID NO: 9180044 - DNA, 22 bp, Homo sapiens
agagacaggagttctgtttcca

SEQ ID NO: 9180045 - DNA, 22 bp, Homo sapiens
agagacaggagttctgtttcca

SEQ ID NO: 9180046 - DNA, 22 bp, Homo sapiens
aattaaaagataacccatgagt

SEQ ID NO: 9180047 - DNA, 22 bp, Homo sapiens
aattaaaaaaggagagcttgct

SEQ ID NO: 9180048 - DNA, 22 bp, Homo sapiens
aattaaaaaaggagagcttgct

SEQ ID NO: 9180049 - DNA, 23 bp, Homo sapiens
aattaaattgctagatccagggc

SEQ ID NO: 9180050 - DNA, 22 bp, Homo sapiens
aattaaattggtttagagagga

SEQ ID NO: 9180051 - DNA, 22 bp, Homo sapiens
agagcagtcaggctaggacact

SEQ ID NO: 9180052 - DNA, 22 bp, Homo sapiens
agagcagtcaggaacatgctta

SEQ ID NO: 9180053 - DNA, 22 bp, Homo sapiens
agagcaggtggcaactctggga

SEQ ID NO: 9180054 - DNA, 22 bp, Homo sapiens
agagcaggtggcaactctggga

SEQ ID NO: 9180055 - DNA, 22 bp, Homo sapiens
agagacaggatatctgctcatg

SEQ ID NO: 9180056 - DNA, 22 bp, Homo sapiens
agagacaggatatctgctcatg

SEQ ID NO: 9180057 - DNA, 22 bp, Homo sapiens
agagacagggttttgccatgtt

SEQ ID NO: 9180058 - DNA, 22 bp, Homo sapiens
agagccaggtgtagtctcggag

SEQ ID NO: 9180059 - DNA, 22 bp, Homo sapiens
agagccagttacaactgtggag

SEQ ID NO: 9180060 - DNA, 22 bp, Homo sapiens
agagccaggtgctgctgtttga

SEQ ID NO: 9180061 - DNA, 22 bp, Homo sapiens
aattccatccatttgtttcaac

SEQ ID NO: 9180062 - DNA, 22 bp, Homo sapiens
aattccatccatttgtttcaac

SEQ ID NO: 9180063 - DNA, 22 bp, Homo sapiens
agagcctggaggttctgctgaa

SEQ ID NO: 9180064 - DNA, 22 bp, Homo sapiens
agagcctggaggttctgctgaa

SEQ ID NO: 9180065 - DNA, 22 bp, Homo sapiens
agagcctggaggttctgctgaa

SEQ ID NO: 9180066 - DNA, 22 bp, Homo sapiens
agagcctggaggttctgctgaa

SEQ ID NO: 9180067 - DNA, 22 bp, Homo sapiens
agagcctggacttttctgagcc

SEQ ID NO: 9180068 - DNA, 22 bp, Homo sapiens
agagcctggacctgggctctga

SEQ ID NO: 9180069 - DNA, 22 bp, Homo sapiens
agagcctgcatctagcctcaga

SEQ ID NO: 9180070 - DNA, 22 bp, Homo sapiens
agagcctggacctgagctacaa

SEQ ID NO: 9180071 - DNA, 22 bp, Homo sapiens
agagcctggacctgggctctga

SEQ ID NO: 9180072 - DNA, 22 bp, Homo sapiens
agagcctggacctgagctacaa

SEQ ID NO: 9180073 - DNA, 22 bp, Homo sapiens
agagcctgcatctagcctcaga

SEQ ID NO: 9180074 - DNA, 20 bp, Homo sapiens
agagcctggaaaaagacatc

SEQ ID NO: 9180075 - DNA, 22 bp, Homo sapiens
acaagatagcttagaagattca

SEQ ID NO: 9180076 - DNA, 23 bp, Homo sapiens
acaagatagggataaaaagataa

SEQ ID NO: 9180077 - DNA, 22 bp, Homo sapiens
acaagcagagattaaatgtttt

SEQ ID NO: 9180078 - DNA, 22 bp, Homo sapiens
acaagcatgggctttgacatca

SEQ ID NO: 9180079 - DNA, 22 bp, Homo sapiens
acaagcttccaggtgatgctga

SEQ ID NO: 9180080 - DNA, 22 bp, Homo sapiens
acaagcttccaggtgatgctga

SEQ ID NO: 9180081 - DNA, 22 bp, Homo sapiens
acaagctcagatccctgtctct

SEQ ID NO: 9180082 - DNA, 22 bp, Homo sapiens
acaagcttattaagttatctgt

SEQ ID NO: 9180083 - DNA, 22 bp, Homo sapiens
acaatgaaaaaatttactgtgg

SEQ ID NO: 9180084 - DNA, 22 bp, Homo sapiens
acaatgaaaaaatttactgtgg

SEQ ID NO: 9180085 - DNA, 18 bp, Homo sapiens
acaatctgaaacctgtca

SEQ ID NO: 9180086 - DNA, 22 bp, Homo sapiens
acaatgaacgctttttaactgt

SEQ ID NO: 9180087 - DNA, 22 bp, Homo sapiens
acaatgaaccaaatttaccaat

SEQ ID NO: 9180088 - DNA, 22 bp, Homo sapiens
acaatgaaaggtattctgaact

SEQ ID NO: 9180089 - DNA, 22 bp, Homo sapiens
acaatgaaaggtattctgaact

SEQ ID NO: 9180090 - DNA, 22 bp, Homo sapiens
acaatgaatactaagcaccagg

SEQ ID NO: 9180091 - DNA, 19 bp, Homo sapiens
acaatgaatgtgttctctt

SEQ ID NO: 9180092 - DNA, 22 bp, Homo sapiens
acaatgaagggagacacttgct

SEQ ID NO: 9180093 - DNA, 22 bp, Homo sapiens
acaatgaagggagacacttgct

SEQ ID NO: 9180094 - DNA, 22 bp, Homo sapiens
acaatgaagataatgttgcagt

SEQ ID NO: 9180095 - DNA, 22 bp, Homo sapiens
acaatgcaataggagctagaaa

SEQ ID NO: 9180096 - DNA, 22 bp, Homo sapiens
acaatgaatttaataccttatt

SEQ ID NO: 9180097 - DNA, 22 bp, Homo sapiens
acaatgatgcagatgagtaaga

SEQ ID NO: 9180098 - DNA, 22 bp, Homo sapiens
acaacaaagacacttgaaatga

SEQ ID NO: 9180099 - DNA, 22 bp, Homo sapiens
acaacaatctaccctagcttct

SEQ ID NO: 9180100 - DNA, 22 bp, Homo sapiens
acaacaatctaccctagcttct

SEQ ID NO: 9180101 - DNA, 22 bp, Homo sapiens
agaggggtggtgctctcctgga

SEQ ID NO: 9180102 - DNA, 22 bp, Homo sapiens
acaacagagctggactgagagg

SEQ ID NO: 9180103 - DNA, 22 bp, Homo sapiens
agataactcattttgtatatcc

SEQ ID NO: 9180104 - DNA, 22 bp, Homo sapiens
agataactcattttgtatatcc

SEQ ID NO: 9180105 - DNA, 22 bp, Homo sapiens
agataacatttattgaatgtaa

SEQ ID NO: 9180106 - DNA, 22 bp, Homo sapiens
acaacacatgtgtatatgtgtg

SEQ ID NO: 9180107 - DNA, 17 bp, Homo sapiens
acaacagaaatgtattc

SEQ ID NO: 9180108 - DNA, 22 bp, Homo sapiens
acaagagtaatttcaacagagt

SEQ ID NO: 9180109 - DNA, 22 bp, Homo sapiens
acaagagtctgcatttctaaca

SEQ ID NO: 9180110 - DNA, 22 bp, Homo sapiens
acaagatagcttagaagattca

SEQ ID NO: 9180111 - DNA, 22 bp, Homo sapiens
acaagatactcagctacaagac

SEQ ID NO: 9180112 - DNA, 22 bp, Homo sapiens
agataatctctaggcttcatgt

SEQ ID NO: 9180113 - DNA, 22 bp, Homo sapiens
agataatgaatgccatgacatt

SEQ ID NO: 9180114 - DNA, 22 bp, Homo sapiens
agataatgattctgcatttcta

SEQ ID NO: 9180115 - DNA, 22 bp, Homo sapiens
acaagaatgtagattagttaag

SEQ ID NO: 9180116 - DNA, 22 bp, Homo sapiens
acaacctgttcgtttccacaga

SEQ ID NO: 9180117 - DNA, 23 bp, Homo sapiens
acaaccagcactggagggcacca

SEQ ID NO: 9180118 - DNA, 22 bp, Homo sapiens
agataagatagtccagcacaat

SEQ ID NO: 9180119 - DNA, 22 bp, Homo sapiens
agataagatagtccagcacaat

SEQ ID NO: 9180120 - DNA, 22 bp, Homo sapiens
agataacttttgggtattcatg

SEQ ID NO: 9180121 - DNA, 22 bp, Homo sapiens
agataacttttgggtattcatg

SEQ ID NO: 9180122 - DNA, 22 bp, Homo sapiens
agaggccctctctctcctgatg

SEQ ID NO: 9180123 - DNA, 22 bp, Homo sapiens
aattgcttgtcttcttccctac

SEQ ID NO: 9180124 - DNA, 17 bp, Homo sapiens
aattgcttgtactccca

SEQ ID NO: 9180125 - DNA, 22 bp, Homo sapiens
aattgcttgtttctttaactga

SEQ ID NO: 9180126 - DNA, 22 bp, Homo sapiens
aattgctttgaagaagggagcg

SEQ ID NO: 9180127 - DNA, 22 bp, Homo sapiens
aattgcttttatttagggccag

SEQ ID NO: 9180128 - DNA, 22 bp, Homo sapiens
aattgctttagttaccatagtg

SEQ ID NO: 9180129 - DNA, 22 bp, Homo sapiens
aattgctttacaagccgtttaa

SEQ ID NO: 9180130 - DNA, 22 bp, Homo sapiens
aattgcttgttttcggtcataa

SEQ ID NO: 9180131 - DNA, 22 bp, Homo sapiens
aattgcttagagaatccaggta

SEQ ID NO: 9180132 - DNA, 22 bp, Homo sapiens
aattgcttagttgcaactatgc

SEQ ID NO: 9180133 - DNA, 22 bp, Homo sapiens
aattgcttatcttgttgaatag

SEQ ID NO: 9180134 - DNA, 22 bp, Homo sapiens
aattgctcccattgtgcaccct

SEQ ID NO: 9180135 - DNA, 22 bp, Homo sapiens
aattgcttactgtttttcacct

SEQ ID NO: 9180136 - DNA, 22 bp, Homo sapiens
aattgcttgatgactagtaatt

SEQ ID NO: 9180137 - DNA, 16 bp, Homo sapiens
aattgcttcttgctgc

SEQ ID NO: 9180138 - DNA, 22 bp, Homo sapiens
aattgcttcccaagggaggtct

SEQ ID NO: 9180139 - DNA, 22 bp, Homo sapiens
aattgcttcattaacatttagg

SEQ ID NO: 9180140 - DNA, 22 bp, Homo sapiens
aattgcttatgccaggtgagag

SEQ ID NO: 9180141 - DNA, 22 bp, Homo sapiens
agaggctgaatgatgtcatcat

SEQ ID NO: 9180142 - DNA, 22 bp, Homo sapiens
agaggctgaatgatgtcatcat

SEQ ID NO: 9180143 - DNA, 22 bp, Homo sapiens
agaggctgaatgatgtcatcat

SEQ ID NO: 9180144 - DNA, 22 bp, Homo sapiens
agaggctgaatgatgtcatcat

SEQ ID NO: 9180145 - DNA, 22 bp, Homo sapiens
agaggctcttgcccttcccaca

SEQ ID NO: 9180146 - DNA, 20 bp, Homo sapiens
aattgaagcagaggagaggc

SEQ ID NO: 9180147 - DNA, 20 bp, Homo sapiens
aattgaagcagaggagaggc

SEQ ID NO: 9180148 - DNA, 22 bp, Homo sapiens
aattgacaaatcatacttgtat

SEQ ID NO: 9180149 - DNA, 21 bp, Homo sapiens
aattgaagatgtggagccatt

SEQ ID NO: 9180150 - DNA, 21 bp, Homo sapiens
aattgaagatgtggagccatt

SEQ ID NO: 9180151 - DNA, 22 bp, Homo sapiens
aattgaacttgatctttagcta

SEQ ID NO: 9180152 - DNA, 22 bp, Homo sapiens
aattgaaagaagtgggattgcc

SEQ ID NO: 9180153 - DNA, 22 bp, Homo sapiens
aattgaaattctttgtggtcca

SEQ ID NO: 9180154 - DNA, 22 bp, Homo sapiens
aattgaaattctttgtggtcca

SEQ ID NO: 9180155 - DNA, 22 bp, Homo sapiens
aattcttggtcctagtgtataa

SEQ ID NO: 9180156 - DNA, 22 bp, Homo sapiens
aattgaaagaagtgggattgcc

SEQ ID NO: 9180157 - DNA, 22 bp, Homo sapiens
aattgaaaatattgtagaccat

SEQ ID NO: 9180158 - DNA, 22 bp, Homo sapiens
aattgaaaatattgtagaccat

SEQ ID NO: 9180159 - DNA, 22 bp, Homo sapiens
aattctgttactaatgtgatgt

SEQ ID NO: 9180160 - DNA, 20 bp, Homo sapiens
aattctgtcttttctgctgc

SEQ ID NO: 9180161 - DNA, 22 bp, Homo sapiens
aattcttaatcccataaagtga

SEQ ID NO: 9180162 - DNA, 22 bp, Homo sapiens
aattcttaatcccataaagtga

SEQ ID NO: 9180163 - DNA, 22 bp, Homo sapiens
aattgagatgacagaggaatag

SEQ ID NO: 9180164 - DNA, 22 bp, Homo sapiens
aattgacagaaagtttacgagg

SEQ ID NO: 9180165 - DNA, 22 bp, Homo sapiens
aattgcccatatttgagaatga

SEQ ID NO: 9180166 - DNA, 18 bp, Homo sapiens
acaaaggtctgcaagacc

SEQ ID NO: 9180167 - DNA, 22 bp, Homo sapiens
acaaaggtgagcagaagacaca

SEQ ID NO: 9180168 - DNA, 22 bp, Homo sapiens
acaaagtagtcaaagtagatga

SEQ ID NO: 9180169 - DNA, 22 bp, Homo sapiens
agagggggtgttccagaagcat

SEQ ID NO: 9180170 - DNA, 22 bp, Homo sapiens
agaggggtgggcacagcgccca

SEQ ID NO: 9180171 - DNA, 22 bp, Homo sapiens
agagggggtgttccagaagcat

SEQ ID NO: 9180172 - DNA, 22 bp, Homo sapiens
agagggggtgtcagcactgcag

SEQ ID NO: 9180173 - DNA, 22 bp, Homo sapiens
agagggggtgtcagcactgcag

SEQ ID NO: 9180174 - DNA, 22 bp, Homo sapiens
agagggggtgtcagcactgcag

SEQ ID NO: 9180175 - DNA, 22 bp, Homo sapiens
agagggggcagcggaccagtga

SEQ ID NO: 9180176 - DNA, 22 bp, Homo sapiens
agagggggcagcggaccagtga

SEQ ID NO: 9180177 - DNA, 22 bp, Homo sapiens
agaggctgttacactcccagat

SEQ ID NO: 9180178 - DNA, 22 bp, Homo sapiens
agaggctgttacactcccagat

SEQ ID NO: 9180179 - DNA, 22 bp, Homo sapiens
agaggcttacaaagattgatga

SEQ ID NO: 9180180 - DNA, 18 bp, Homo sapiens
agaggcttaatgaatggc

SEQ ID NO: 9180181 - DNA, 22 bp, Homo sapiens
agaggctgtgcagagggagtgc

SEQ ID NO: 9180182 - DNA, 21 bp, Homo sapiens
acaaaggaagtctcttttaag

SEQ ID NO: 9180183 - DNA, 19 bp, Homo sapiens
acaaagctgtgagcagctt

SEQ ID NO: 9180184 - DNA, 22 bp, Homo sapiens
acaaagcttagacctaagagat

SEQ ID NO: 9180185 - DNA, 18 bp, Homo sapiens
acaaaggatcatgaggga

SEQ ID NO: 9180186 - DNA, 22 bp, Homo sapiens
acaaaggactgaaactggctgt

SEQ ID NO: 9180187 - DNA, 22 bp, Homo sapiens
acaaaggactgaaactggctgt

SEQ ID NO: 9180188 - DNA, 21 bp, Homo sapiens
acaaaggaagtctcttttaag

SEQ ID NO: 9180189 - DNA, 22 bp, Homo sapiens
agaggcttctttctgatttgcg

SEQ ID NO: 9180190 - DNA, 22 bp, Homo sapiens
agaggcttctcggatggggcag

SEQ ID NO: 9180191 - DNA, 20 bp, Homo sapiens
agaggcttccttgggaggag

SEQ ID NO: 9180192 - DNA, 22 bp, Homo sapiens
agaggcttcctgccacctgaga

SEQ ID NO: 9180193 - DNA, 22 bp, Homo sapiens
agaggcttcctgccacctgaga

SEQ ID NO: 9180194 - DNA, 23 bp, Homo sapiens
agaggcttatgtttatttcttcc

SEQ ID NO: 9180195 - DNA, 22 bp, Homo sapiens
acaaagaaggaattggtcttta

SEQ ID NO: 9180196 - DNA, 22 bp, Homo sapiens
agaggcttgacaatatgattgg

SEQ ID NO: 9180197 - DNA, 22 bp, Homo sapiens
acagacacaggcctgggctcct

SEQ ID NO: 9180198 - DNA, 22 bp, Homo sapiens
acagaattaatgaaaattacaa

SEQ ID NO: 9180199 - DNA, 22 bp, Homo sapiens
acagaaagaccttgtaacactt

SEQ ID NO: 9180200 - DNA, 20 bp, Homo sapiens
acagaaagagagaatgtcag

SEQ ID NO: 9180201 - DNA, 22 bp, Homo sapiens
agccaggggattcatcagggac

SEQ ID NO: 9180202 - DNA, 18 bp, Homo sapiens
acagacacttagtatgag

SEQ ID NO: 9180203 - DNA, 22 bp, Homo sapiens
acagaaaaatgagggagctgga

SEQ ID NO: 9180204 - DNA, 22 bp, Homo sapiens
acacttttgtttgaagtctcca

SEQ ID NO: 9180205 - DNA, 22 bp, Homo sapiens
acagaaacccagaaaacctctc

SEQ ID NO: 9180206 - DNA, 22 bp, Homo sapiens
acactttatctcatctcagaca

SEQ ID NO: 9180207 - DNA, 22 bp, Homo sapiens
acactttatcaatattcaaaaa

SEQ ID NO: 9180208 - DNA, 22 bp, Homo sapiens
acactttctggagctgcacata

SEQ ID NO: 9180209 - DNA, 23 bp, Homo sapiens
acactttcaaatatgcacagagc

SEQ ID NO: 9180210 - DNA, 22 bp, Homo sapiens
acactttatgtctagatctggg

SEQ ID NO: 9180211 - DNA, 22 bp, Homo sapiens
acactttatctcatctcagaca

SEQ ID NO: 9180212 - DNA, 22 bp, Homo sapiens
acacttttaagactttaatgaa

SEQ ID NO: 9180213 - DNA, 22 bp, Homo sapiens
acactttgtcctttttcattgt

SEQ ID NO: 9180214 - DNA, 22 bp, Homo sapiens
acactttgctacatttcatatt

SEQ ID NO: 9180215 - DNA, 22 bp, Homo sapiens
acagagaaagtgggctgaagat

SEQ ID NO: 9180216 - DNA, 23 bp, Homo sapiens
acagagacaatggtttcatcttg

SEQ ID NO: 9180217 - DNA, 23 bp, Homo sapiens
acagagacaatggtttcatcttg

SEQ ID NO: 9180218 - DNA, 22 bp, Homo sapiens
acagagacaatatttgtaaagt

SEQ ID NO: 9180219 - DNA, 22 bp, Homo sapiens
acagagacaggcagacagtctt

SEQ ID NO: 9180220 - DNA, 22 bp, Homo sapiens
acagagacaggcagacagtctt

SEQ ID NO: 9180221 - DNA, 22 bp, Homo sapiens
acagagaccagcatcttctgcc

SEQ ID NO: 9180222 - DNA, 22 bp, Homo sapiens
acagagagaggcccgaggctgc

SEQ ID NO: 9180223 - DNA, 22 bp, Homo sapiens
acagagagctgtgattgagtta

SEQ ID NO: 9180224 - DNA, 22 bp, Homo sapiens
acagagagctgtgattgagtta

SEQ ID NO: 9180225 - DNA, 22 bp, Homo sapiens
acagagactgggagcaagaggc

SEQ ID NO: 9180226 - DNA, 20 bp, Homo sapiens
acagagactgagacacttgc

SEQ ID NO: 9180227 - DNA, 23 bp, Homo sapiens
acagagactgccaagatattctc

SEQ ID NO: 9180228 - DNA, 22 bp, Homo sapiens
agccagggtgagagggctttgt

SEQ ID NO: 9180229 - DNA, 19 bp, Homo sapiens
agccagggtgagaaggagc

SEQ ID NO: 9180230 - DNA, 19 bp, Homo sapiens
agccagggtgagaaggagc

SEQ ID NO: 9180231 - DNA, 22 bp, Homo sapiens
agccagggtctctcgctctgtt

SEQ ID NO: 9180232 - DNA, 19 bp, Homo sapiens
agccagggtgagaaggagc

SEQ ID NO: 9180233 - DNA, 22 bp, Homo sapiens
agccagggtctctcgctctgtt

SEQ ID NO: 9180234 - DNA, 22 bp, Homo sapiens
agccagggggacgctttctggc

SEQ ID NO: 9180235 - DNA, 22 bp, Homo sapiens
agccagggtaaggtacttagta

SEQ ID NO: 9180236 - DNA, 22 bp, Homo sapiens
agccagggggacgctttctggc

SEQ ID NO: 9180237 - DNA, 22 bp, Homo sapiens
acagacattcatatcctcggta

SEQ ID NO: 9180238 - DNA, 22 bp, Homo sapiens
acagactgttggcctactgagc

SEQ ID NO: 9180239 - DNA, 22 bp, Homo sapiens
acagagaaactaaggagtttgg

SEQ ID NO: 9180240 - DNA, 21 bp, Homo sapiens
acagagaaagagcagcctcct

SEQ ID NO: 9180241 - DNA, 21 bp, Homo sapiens
acagagaaagagcagcctcct

SEQ ID NO: 9180242 - DNA, 17 bp, Homo sapiens
acagagctacatattct

SEQ ID NO: 9180243 - DNA, 22 bp, Homo sapiens
acagagctcccagccatctcct

SEQ ID NO: 9180244 - DNA, 22 bp, Homo sapiens
acagagctcccagccatctcct

SEQ ID NO: 9180245 - DNA, 22 bp, Homo sapiens
acagagctaatgttgcataggc

SEQ ID NO: 9180246 - DNA, 22 bp, Homo sapiens
acagagctaatgttgcataggc

SEQ ID NO: 9180247 - DNA, 22 bp, Homo sapiens
acagagcctccaggagtgctgg

SEQ ID NO: 9180248 - DNA, 22 bp, Homo sapiens
acagatgaggcccatcagtctg

SEQ ID NO: 9180249 - DNA, 22 bp, Homo sapiens
acagagctgggatctgaaccca

SEQ ID NO: 9180250 - DNA, 19 bp, Homo sapiens
acagagctctctgcttctg

SEQ ID NO: 9180251 - DNA, 19 bp, Homo sapiens
acagagctctctgcttctg

SEQ ID NO: 9180252 - DNA, 19 bp, Homo sapiens
acagagctctctgcttctg

SEQ ID NO: 9180253 - DNA, 22 bp, Homo sapiens
acagagctgggatctgaaccca

SEQ ID NO: 9180254 - DNA, 22 bp, Homo sapiens
acagatgatgtgcacagataga

SEQ ID NO: 9180255 - DNA, 20 bp, Homo sapiens
agccctgtttcctggagaga

SEQ ID NO: 9180256 - DNA, 22 bp, Homo sapiens
agccctgtttatgccacatcat

SEQ ID NO: 9180257 - DNA, 22 bp, Homo sapiens
agccctgtttatgccacatcat

SEQ ID NO: 9180258 - DNA, 22 bp, Homo sapiens
agcctctcagagtgctgggatt

SEQ ID NO: 9180259 - DNA, 22 bp, Homo sapiens
agcctctctgttagtcactggg

SEQ ID NO: 9180260 - DNA, 22 bp, Homo sapiens
acagagccactttggtgcctac

SEQ ID NO: 9180261 - DNA, 22 bp, Homo sapiens
agcctctctttctggtggctaa

SEQ ID NO: 9180262 - DNA, 22 bp, Homo sapiens
agcctctgactgtcagcaaggt

SEQ ID NO: 9180263 - DNA, 22 bp, Homo sapiens
acagatggttattgtcatttct

SEQ ID NO: 9180264 - DNA, 22 bp, Homo sapiens
acagatggtgagccgctgatgt

SEQ ID NO: 9180265 - DNA, 22 bp, Homo sapiens
acagatggtagcattatgttgg

SEQ ID NO: 9180266 - DNA, 21 bp, Homo sapiens
acagatgggatgagcacactg

SEQ ID NO: 9180267 - DNA, 22 bp, Homo sapiens
acagatggggcacaaagccaca

SEQ ID NO: 9180268 - DNA, 22 bp, Homo sapiens
acagatggtagcattatgttgg

SEQ ID NO: 9180269 - DNA, 22 bp, Homo sapiens
acagatggtactaaacccatat

SEQ ID NO: 9180270 - DNA, 22 bp, Homo sapiens
acagatggaggttattatgaac

SEQ ID NO: 9180271 - DNA, 19 bp, Homo sapiens
acagatggaggaatctggg

SEQ ID NO: 9180272 - DNA, 22 bp, Homo sapiens
acagatggagctactaggtaaa

SEQ ID NO: 9180273 - DNA, 22 bp, Homo sapiens
acagatggaatgtgttatggga

SEQ ID NO: 9180274 - DNA, 20 bp, Homo sapiens
acagatggcagttattacat

SEQ ID NO: 9180275 - DNA, 22 bp, Homo sapiens
acagatggccatattactatat

SEQ ID NO: 9180276 - DNA, 22 bp, Homo sapiens
acagatggcacctttttgctgt

SEQ ID NO: 9180277 - DNA, 22 bp, Homo sapiens
acagatggcactttttaggact

SEQ ID NO: 9180278 - DNA, 22 bp, Homo sapiens
acagattcactgcactggccat

SEQ ID NO: 9180279 - DNA, 22 bp, Homo sapiens
acagattcactgcactggccat

SEQ ID NO: 9180280 - DNA, 22 bp, Homo sapiens
acagatgtacactcatatataa

SEQ ID NO: 9180281 - DNA, 21 bp, Homo sapiens
acagattagcacaatgcaggc

SEQ ID NO: 9180282 - DNA, 22 bp, Homo sapiens
acagatgttacagtatgatctc

SEQ ID NO: 9180283 - DNA, 22 bp, Homo sapiens
acagatgttagcaatgatgatg

SEQ ID NO: 9180284 - DNA, 22 bp, Homo sapiens
agctcctgctctttgtccctaa

SEQ ID NO: 9180285 - DNA, 22 bp, Homo sapiens
agctcctgctctttgtccctaa

SEQ ID NO: 9180286 - DNA, 22 bp, Homo sapiens
agctcctgcgcacggtgcacac

SEQ ID NO: 9180287 - DNA, 22 bp, Homo sapiens
agctcctgctctttgtccctaa

SEQ ID NO: 9180288 - DNA, 17 bp, Homo sapiens
agctcctgcccatggct

SEQ ID NO: 9180289 - DNA, 22 bp, Homo sapiens
agctcctgcgcacggtgcacac

SEQ ID NO: 9180290 - DNA, 22 bp, Homo sapiens
agctcctgcagactcctgctca

SEQ ID NO: 9180291 - DNA, 22 bp, Homo sapiens
agctcctgcccaggaaggctct

SEQ ID NO: 9180292 - DNA, 22 bp, Homo sapiens
agctcctgcccaggaaggctct

SEQ ID NO: 9180293 - DNA, 22 bp, Homo sapiens
agctcctgcagactcctgctca

SEQ ID NO: 9180294 - DNA, 22 bp, Homo sapiens
agctcctgcacccagccttgag

SEQ ID NO: 9180295 - DNA, 22 bp, Homo sapiens
agctcctgcaccaggggcccct

SEQ ID NO: 9180296 - DNA, 19 bp, Homo sapiens
agctcctgattgtgcctcg

SEQ ID NO: 9180297 - DNA, 22 bp, Homo sapiens
agctcctgcaccaggggcccct

SEQ ID NO: 9180298 - DNA, 22 bp, Homo sapiens
acactgacgcttgacagtcacc

SEQ ID NO: 9180299 - DNA, 22 bp, Homo sapiens
acactgagctgagcattcttgt

SEQ ID NO: 9180300 - DNA, 22 bp, Homo sapiens
acactgagtattgagtagggta

SEQ ID NO: 9180301 - DNA, 22 bp, Homo sapiens
acactgagtgagaaaaggaaat

SEQ ID NO: 9180302 - DNA, 22 bp, Homo sapiens
acactgagtgagaaaaggaaat

SEQ ID NO: 9180303 - DNA, 22 bp, Homo sapiens
acactgagtgtagaaatagcca

SEQ ID NO: 9180304 - DNA, 22 bp, Homo sapiens
acactgagtgtagaaatagcca

SEQ ID NO: 9180305 - DNA, 22 bp, Homo sapiens
acactttagatattcccttctg

SEQ ID NO: 9180306 - DNA, 22 bp, Homo sapiens
acactttactcttacaccattg

SEQ ID NO: 9180307 - DNA, 22 bp, Homo sapiens
acactcttgcattacctgaata

SEQ ID NO: 9180308 - DNA, 22 bp, Homo sapiens
acactctagagggaagcgcttt

SEQ ID NO: 9180309 - DNA, 22 bp, Homo sapiens
acactctgtaatgtcacactcc

SEQ ID NO: 9180310 - DNA, 22 bp, Homo sapiens
acactcaccctcccactgcctg

SEQ ID NO: 9180311 - DNA, 22 bp, Homo sapiens
acacattataggcaatcaaaag

SEQ ID NO: 9180312 - DNA, 22 bp, Homo sapiens
acacattataggcaatcaaaag

SEQ ID NO: 9180313 - DNA, 22 bp, Homo sapiens
acacattatagagagtataata

SEQ ID NO: 9180314 - DNA, 22 bp, Homo sapiens
acacattatagagagtataata

SEQ ID NO: 9180315 - DNA, 22 bp, Homo sapiens
acacattatagagagtataata

SEQ ID NO: 9180316 - DNA, 22 bp, Homo sapiens
acacattaggcagtgcttaaat

SEQ ID NO: 9180317 - DNA, 22 bp, Homo sapiens
acacattaggcagtgcttaaat

SEQ ID NO: 9180318 - DNA, 22 bp, Homo sapiens
acactagtatttctataagtga

SEQ ID NO: 9180319 - DNA, 22 bp, Homo sapiens
acactagtggaaattgatttgt

SEQ ID NO: 9180320 - DNA, 22 bp, Homo sapiens
acacccaggctggcgtgcagtg

SEQ ID NO: 9180321 - DNA, 18 bp, Homo sapiens
acacaggctgacagcacc

SEQ ID NO: 9180322 - DNA, 22 bp, Homo sapiens
agcagctgtactttcatctgtt

SEQ ID NO: 9180323 - DNA, 22 bp, Homo sapiens
agcagctggttcccgagggcgt

SEQ ID NO: 9180324 - DNA, 22 bp, Homo sapiens
agcagctggttcccgagggcgt

SEQ ID NO: 9180325 - DNA, 22 bp, Homo sapiens
acacagggaggaggtgctgtgc

SEQ ID NO: 9180326 - DNA, 22 bp, Homo sapiens
acacagggatatttcaggtggt

SEQ ID NO: 9180327 - DNA, 22 bp, Homo sapiens
acacagggatatttcaggtggt

SEQ ID NO: 9180328 - DNA, 17 bp, Homo sapiens
acacagggagagggagc

SEQ ID NO: 9180329 - DNA, 17 bp, Homo sapiens
acacagggagagggagc

SEQ ID NO: 9180330 - DNA, 22 bp, Homo sapiens
acacagggcggaaagcatgaga

SEQ ID NO: 9180331 - DNA, 22 bp, Homo sapiens
acacagggcggaaagcatgaga

SEQ ID NO: 9180332 - DNA, 22 bp, Homo sapiens
acacatcttagactgaaatatg

SEQ ID NO: 9180333 - DNA, 19 bp, Homo sapiens
acacagggatcagagggtt

SEQ ID NO: 9180334 - DNA, 19 bp, Homo sapiens
acacagggatcagagggtt

SEQ ID NO: 9180335 - DNA, 22 bp, Homo sapiens
acacagggcagagagctggctc

SEQ ID NO: 9180336 - DNA, 22 bp, Homo sapiens
acacagggcagagagctggctc

SEQ ID NO: 9180337 - DNA, 22 bp, Homo sapiens
acacattaaaacgtctacaatg

SEQ ID NO: 9180338 - DNA, 22 bp, Homo sapiens
acacatgtatatgcttgtgtgt

SEQ ID NO: 9180339 - DNA, 19 bp, Homo sapiens
acacatgtaacagtttttc

SEQ ID NO: 9180340 - DNA, 22 bp, Homo sapiens
acacatgtatgttttgtatttg

SEQ ID NO: 9180341 - DNA, 22 bp, Homo sapiens
acacagaggaaagtgtgaaggg

SEQ ID NO: 9180342 - DNA, 21 bp, Homo sapiens
acacagaggcatcatcacttt

SEQ ID NO: 9180343 - DNA, 22 bp, Homo sapiens
acacagagtatttagaaggggt

SEQ ID NO: 9180344 - DNA, 22 bp, Homo sapiens
acacagagtccttactgaggta

SEQ ID NO: 9180345 - DNA, 20 bp, Homo sapiens
acacagagtgagtctgcttg

SEQ ID NO: 9180346 - DNA, 20 bp, Homo sapiens
acacagagtgagtctgcttg

SEQ ID NO: 9180347 - DNA, 22 bp, Homo sapiens
acacagagtttgacacatggga

SEQ ID NO: 9180348 - DNA, 22 bp, Homo sapiens
agcagctgggtccggcggagca

SEQ ID NO: 9180349 - DNA, 17 bp, Homo sapiens
agcagctgggttgatct

SEQ ID NO: 9180350 - DNA, 22 bp, Homo sapiens
agcagctggggcctgtgacgat

SEQ ID NO: 9180351 - DNA, 22 bp, Homo sapiens
agcagctggtaggagtggccac

SEQ ID NO: 9180352 - DNA, 22 bp, Homo sapiens
agcagctggtaggagtggccac

SEQ ID NO: 9180353 - DNA, 22 bp, Homo sapiens
agcagctggtaggagtggccac

SEQ ID NO: 9180354 - DNA, 22 bp, Homo sapiens
acacagagtttgacacatggga

SEQ ID NO: 9180355 - DNA, 22 bp, Homo sapiens
agcagctgggctcagagctggg

SEQ ID NO: 9180356 - DNA, 22 bp, Homo sapiens
agcagctgggctcagagctggg

SEQ ID NO: 9180357 - DNA, 22 bp, Homo sapiens
agcagctgagccccagctgtga

SEQ ID NO: 9180358 - DNA, 22 bp, Homo sapiens
agcagctgagccccagctgtga

SEQ ID NO: 9180359 - DNA, 22 bp, Homo sapiens
acacagatgcattacacatcta

SEQ ID NO: 9180360 - DNA, 22 bp, Homo sapiens
acaatgctgcagggaaattagg

SEQ ID NO: 9180361 - DNA, 22 bp, Homo sapiens
agcagagcagaatgtgaaggtg

SEQ ID NO: 9180362 - DNA, 19 bp, Homo sapiens
agcagagcaaagtggctga

SEQ ID NO: 9180363 - DNA, 18 bp, Homo sapiens
agcagagagtgaatggga

SEQ ID NO: 9180364 - DNA, 18 bp, Homo sapiens
agcagagagtgaatggga

SEQ ID NO: 9180365 - DNA, 22 bp, Homo sapiens
agcagagaggaggtggccctgt

SEQ ID NO: 9180366 - DNA, 18 bp, Homo sapiens
agcagagagtgaatggga

SEQ ID NO: 9180367 - DNA, 22 bp, Homo sapiens
agcagagcatggtgggaagggc

SEQ ID NO: 9180368 - DNA, 22 bp, Homo sapiens
agcagagcatggtgggaagggc

SEQ ID NO: 9180369 - DNA, 22 bp, Homo sapiens
agcagagcctgggctaggggtg

SEQ ID NO: 9180370 - DNA, 22 bp, Homo sapiens
agcagagtgtgaaggcagggct

SEQ ID NO: 9180371 - DNA, 20 bp, Homo sapiens
agcagatagcgggagagttt

SEQ ID NO: 9180372 - DNA, 22 bp, Homo sapiens
agcagatagtagaacatgtata

SEQ ID NO: 9180373 - DNA, 22 bp, Homo sapiens
agcagatgaatcccagataaag

SEQ ID NO: 9180374 - DNA, 22 bp, Homo sapiens
agcagatgtttcagagcaggct

SEQ ID NO: 9180375 - DNA, 22 bp, Homo sapiens
agcagatggtgtcatgggatgg

SEQ ID NO: 9180376 - DNA, 22 bp, Homo sapiens
aacagctgtctgcctatctctg

SEQ ID NO: 9180377 - DNA, 22 bp, Homo sapiens
aacagctgtatactgtagctgt

SEQ ID NO: 9180378 - DNA, 22 bp, Homo sapiens
aacatattcagatgccaagtcc

SEQ ID NO: 9180379 - DNA, 22 bp, Homo sapiens
aacatattcagatgccaagtcc

SEQ ID NO: 9180380 - DNA, 22 bp, Homo sapiens
aacataaatttgaagtggcaaa

SEQ ID NO: 9180381 - DNA, 22 bp, Homo sapiens
aacatcatcatgaacaactaat

SEQ ID NO: 9180382 - DNA, 22 bp, Homo sapiens
aacatcagaagtagaagactca

SEQ ID NO: 9180383 - DNA, 22 bp, Homo sapiens
aacatatttggctgatattccc

SEQ ID NO: 9180384 - DNA, 22 bp, Homo sapiens
aacatcaggatcttgttacagt

SEQ ID NO: 9180385 - DNA, 22 bp, Homo sapiens
aacatcagtattctcatctgta

SEQ ID NO: 9180386 - DNA, 22 bp, Homo sapiens
aacatcagaatatccatgttgg

SEQ ID NO: 9180387 - DNA, 22 bp, Homo sapiens
aacatcagcacacaatagcaag

SEQ ID NO: 9180388 - DNA, 22 bp, Homo sapiens
aacagcctcagtgagattagga

SEQ ID NO: 9180389 - DNA, 22 bp, Homo sapiens
aacagcctgagagaacaatgat

SEQ ID NO: 9180390 - DNA, 22 bp, Homo sapiens
aacagctaccttctcactgtgc

SEQ ID NO: 9180391 - DNA, 22 bp, Homo sapiens
aacagctattcactactatggg

SEQ ID NO: 9180392 - DNA, 20 bp, Homo sapiens
aacagctctcgacttatctt

SEQ ID NO: 9180393 - DNA, 22 bp, Homo sapiens
aacagctgcttctatcttttca

SEQ ID NO: 9180394 - DNA, 22 bp, Homo sapiens
aacagctgcttcagtacttgaa

SEQ ID NO: 9180395 - DNA, 22 bp, Homo sapiens
aacagctagaattctactggct

SEQ ID NO: 9180396 - DNA, 22 bp, Homo sapiens
aagtgcttctgggattaggagt

SEQ ID NO: 9180397 - DNA, 22 bp, Homo sapiens
aagtgcttctgggattaggagt

SEQ ID NO: 9180398 - DNA, 22 bp, Homo sapiens
aagtgcttggattgcaggtatg

SEQ ID NO: 9180399 - DNA, 22 bp, Homo sapiens
aagtgcttggattgcaggtatg

SEQ ID NO: 9180400 - DNA, 22 bp, Homo sapiens
aatagatactacttagatgtag

SEQ ID NO: 9180401 - DNA, 22 bp, Homo sapiens
aatagatactacttagatgtag

SEQ ID NO: 9180402 - DNA, 19 bp, Homo sapiens
aatagattaattatcctct

SEQ ID NO: 9180403 - DNA, 19 bp, Homo sapiens
aatagattaattatcctct

SEQ ID NO: 9180404 - DNA, 22 bp, Homo sapiens
aacatgtaaccagcattcatct

SEQ ID NO: 9180405 - DNA, 22 bp, Homo sapiens
aacatgtaaccagcattcatct

SEQ ID NO: 9180406 - DNA, 22 bp, Homo sapiens
aatagcaaacactggtaaagtt

SEQ ID NO: 9180407 - DNA, 19 bp, Homo sapiens
aatagattaattatcctct

SEQ ID NO: 9180408 - DNA, 22 bp, Homo sapiens
aatagattcatggttaagagca

SEQ ID NO: 9180409 - DNA, 22 bp, Homo sapiens
aacatgtatcgctttttaatat

SEQ ID NO: 9180410 - DNA, 22 bp, Homo sapiens
aacatgtctgggtattcacaag

SEQ ID NO: 9180411 - DNA, 22 bp, Homo sapiens
aacatgtagcagaaacgactaa

SEQ ID NO: 9180412 - DNA, 22 bp, Homo sapiens
aacatcttgtctaatgtcagct

SEQ ID NO: 9180413 - DNA, 22 bp, Homo sapiens
aacatcttgtcaaatgtccaca

SEQ ID NO: 9180414 - DNA, 22 bp, Homo sapiens
aacatcttaagatagaagggga

SEQ ID NO: 9180415 - DNA, 19 bp, Homo sapiens
aacatctgtaactattttc

SEQ ID NO: 9180416 - DNA, 22 bp, Homo sapiens
aacatctgggccctgattttgg

SEQ ID NO: 9180417 - DNA, 22 bp, Homo sapiens
aacatgaaaacctccacagcaa

SEQ ID NO: 9180418 - DNA, 22 bp, Homo sapiens
aacatgaaaactacctgtgatt

SEQ ID NO: 9180419 - DNA, 22 bp, Homo sapiens
aacatgaaaagcccagagaggt

SEQ ID NO: 9180420 - DNA, 22 bp, Homo sapiens
aatagaatttgtactgtgtttt

SEQ ID NO: 9180421 - DNA, 22 bp, Homo sapiens
aatagaatttgtactgtgtttt

SEQ ID NO: 9180422 - DNA, 22 bp, Homo sapiens
aacctggctcatgcagaaccct

SEQ ID NO: 9180423 - DNA, 22 bp, Homo sapiens
aacctggccctaatcccagtag

SEQ ID NO: 9180424 - DNA, 22 bp, Homo sapiens
aacctggccctaatcccagtag

SEQ ID NO: 9180425 - DNA, 22 bp, Homo sapiens
aacctggccccagattccccat

SEQ ID NO: 9180426 - DNA, 22 bp, Homo sapiens
aacctggccctaatcccagtag

SEQ ID NO: 9180427 - DNA, 22 bp, Homo sapiens
aacctggccccagattccccat

SEQ ID NO: 9180428 - DNA, 22 bp, Homo sapiens
aacctggccccagattccccat

SEQ ID NO: 9180429 - DNA, 22 bp, Homo sapiens
aacctggagtgctggtttcact

SEQ ID NO: 9180430 - DNA, 22 bp, Homo sapiens
aacctggaggactgcaatccat

SEQ ID NO: 9180431 - DNA, 22 bp, Homo sapiens
aacctggaggctgtgtagtctt

SEQ ID NO: 9180432 - DNA, 22 bp, Homo sapiens
aacctggagcaccctcatatct

SEQ ID NO: 9180433 - DNA, 22 bp, Homo sapiens
aacctggaccttttgggtattg

SEQ ID NO: 9180434 - DNA, 22 bp, Homo sapiens
aatgaacaacttgatttttgcc

SEQ ID NO: 9180435 - DNA, 22 bp, Homo sapiens
aatgaacaacttgatttttgcc

SEQ ID NO: 9180436 - DNA, 22 bp, Homo sapiens
aacgagctctccttctttcatt

SEQ ID NO: 9180437 - DNA, 22 bp, Homo sapiens
aacgacatctgtgtagggcatc

SEQ ID NO: 9180438 - DNA, 23 bp, Homo sapiens
aacgacagctacaggcatcccac

SEQ ID NO: 9180439 - DNA, 22 bp, Homo sapiens
aacgcccagccttgatcaaatg

SEQ ID NO: 9180440 - DNA, 22 bp, Homo sapiens
aacgcccgtggttgccaaggta

SEQ ID NO: 9180441 - DNA, 22 bp, Homo sapiens
aaccttatcatgcataagtaga

SEQ ID NO: 9180442 - DNA, 22 bp, Homo sapiens
aaccttcacttgcttcatttga

SEQ ID NO: 9180443 - DNA, 22 bp, Homo sapiens
aaccttttgcaagtgccttgac

SEQ ID NO: 9180444 - DNA, 23 bp, Homo sapiens
aacgacagctacaggcatcccac

SEQ ID NO: 9180445 - DNA, 22 bp, Homo sapiens
aacccgggaggcggaggttgtg

SEQ ID NO: 9180446 - DNA, 22 bp, Homo sapiens
aacatgttgagttgaaagtagc

SEQ ID NO: 9180447 - DNA, 22 bp, Homo sapiens
aacatgttgagttgaaagtagc

SEQ ID NO: 9180448 - DNA, 22 bp, Homo sapiens
aacatgttgagttgaaagtagc

SEQ ID NO: 9180449 - DNA, 22 bp, Homo sapiens
aaccatttgcagttactgagac

SEQ ID NO: 9180450 - DNA, 22 bp, Homo sapiens
aaccctctcttattctttgcca

SEQ ID NO: 9180451 - DNA, 22 bp, Homo sapiens
aaccctgggtcggcaccatttt

SEQ ID NO: 9180452 - DNA, 22 bp, Homo sapiens
aaccggagtgattcccacctct

SEQ ID NO: 9180453 - DNA, 22 bp, Homo sapiens
aacctagaagttagagtatcat

SEQ ID NO: 9180454 - DNA, 22 bp, Homo sapiens
aaccgttttaccatttgtaact

SEQ ID NO: 9180455 - DNA, 22 bp, Homo sapiens
aaccctggggctgctctgcctg

SEQ ID NO: 9180456 - DNA, 22 bp, Homo sapiens
aaccctggggcagctgctaggg

SEQ ID NO: 9180457 - DNA, 22 bp, Homo sapiens
aacctcgaatgccttcctgagg

SEQ ID NO: 9180458 - DNA, 22 bp, Homo sapiens
aacctcatttccttctttgtaa

SEQ ID NO: 9180459 - DNA, 22 bp, Homo sapiens
aacctaggactatagatatcat

SEQ ID NO: 9180460 - DNA, 22 bp, Homo sapiens
aactagaacctgcattttaaca

SEQ ID NO: 9180461 - DNA, 22 bp, Homo sapiens
aatgacataagtgcagatgcta

SEQ ID NO: 9180462 - DNA, 22 bp, Homo sapiens
aatgacatgctttttaattata

SEQ ID NO: 9180463 - DNA, 22 bp, Homo sapiens
aatgacatgctttttaattata

SEQ ID NO: 9180464 - DNA, 22 bp, Homo sapiens
aatgacaatattaatttggagg

SEQ ID NO: 9180465 - DNA, 22 bp, Homo sapiens
aatgacaatattaatttggagg

SEQ ID NO: 9180466 - DNA, 22 bp, Homo sapiens
aatgacaatggcagaggtagaa

SEQ ID NO: 9180467 - DNA, 22 bp, Homo sapiens
aatgacaatggcagaggtagaa

SEQ ID NO: 9180468 - DNA, 22 bp, Homo sapiens
aatgacagagcactgaacttgg

SEQ ID NO: 9180469 - DNA, 22 bp, Homo sapiens
aatgacaatggcagaggtagaa

SEQ ID NO: 9180470 - DNA, 22 bp, Homo sapiens
aatgacaagacatagtctctga

SEQ ID NO: 9180471 - DNA, 22 bp, Homo sapiens
aatgacaagacatagtctctga

SEQ ID NO: 9180472 - DNA, 22 bp, Homo sapiens
aatgacaataatcattaacttt

SEQ ID NO: 9180473 - DNA, 22 bp, Homo sapiens
aatgacaataatcattaacttt

SEQ ID NO: 9180474 - DNA, 22 bp, Homo sapiens
aatgacaataatcattaacttt

SEQ ID NO: 9180475 - DNA, 22 bp, Homo sapiens
aatgacaaccacaatggtgctg

SEQ ID NO: 9180476 - DNA, 22 bp, Homo sapiens
aatgacaaccacaatggtgctg

SEQ ID NO: 9180477 - DNA, 22 bp, Homo sapiens
aatgacaaatatggaagcctga

SEQ ID NO: 9180478 - DNA, 22 bp, Homo sapiens
aatgaattgcagtactgacttg

SEQ ID NO: 9180479 - DNA, 22 bp, Homo sapiens
aatggcctttgagatgaaaggg

SEQ ID NO: 9180480 - DNA, 22 bp, Homo sapiens
aatggctgaaacataatagaag

SEQ ID NO: 9180481 - DNA, 22 bp, Homo sapiens
aatggctgatgccaggtctagg

SEQ ID NO: 9180482 - DNA, 22 bp, Homo sapiens
aatggctgccagggcaggaggt

SEQ ID NO: 9180483 - DNA, 22 bp, Homo sapiens
aatggctgccagggcaggaggt

SEQ ID NO: 9180484 - DNA, 22 bp, Homo sapiens
aatggctgggagtgtattttgg

SEQ ID NO: 9180485 - DNA, 22 bp, Homo sapiens
aatggctgatgtttctgatgac

SEQ ID NO: 9180486 - DNA, 21 bp, Homo sapiens
aatggcttatacagaagtaag

SEQ ID NO: 9180487 - DNA, 22 bp, Homo sapiens
aatggcttagcagagttagaag

SEQ ID NO: 9180488 - DNA, 22 bp, Homo sapiens
aatggctgggtttcattttgta

SEQ ID NO: 9180489 - DNA, 18 bp, Homo sapiens
aatggctgggttgttgcc

SEQ ID NO: 9180490 - DNA, 22 bp, Homo sapiens
aatggctgggtttcattttgta

SEQ ID NO: 9180491 - DNA, 22 bp, Homo sapiens
aatggctgttatttcagcagat

SEQ ID NO: 9180492 - DNA, 22 bp, Homo sapiens
aatggcttaagtataagtgaga

SEQ ID NO: 9180493 - DNA, 22 bp, Homo sapiens
aatggctgttctctgtgattgg

SEQ ID NO: 9180494 - DNA, 22 bp, Homo sapiens
aactagttttagctctagcaac

SEQ ID NO: 9180495 - DNA, 22 bp, Homo sapiens
aactagttttagctctagcaac

SEQ ID NO: 9180496 - DNA, 22 bp, Homo sapiens
aatggccatatcattgcagagc

SEQ ID NO: 9180497 - DNA, 22 bp, Homo sapiens
aatggcctggagggaatacaga

SEQ ID NO: 9180498 - DNA, 22 bp, Homo sapiens
aatggcctgtatggaaagtgaa

SEQ ID NO: 9180499 - DNA, 22 bp, Homo sapiens
aatggcctggagggaatacaga

SEQ ID NO: 9180500 - DNA, 18 bp, Homo sapiens
aactagagggctgtcaat

SEQ ID NO: 9180501 - DNA, 22 bp, Homo sapiens
aactagtcagtgattctcagaa

SEQ ID NO: 9180502 - DNA, 22 bp, Homo sapiens
aaatgcattaagtcagaacaat

SEQ ID NO: 9180503 - DNA, 22 bp, Homo sapiens
aaatgcattctgttttcactag

SEQ ID NO: 9180504 - DNA, 22 bp, Homo sapiens
aaggaaagacaggacggaattc

SEQ ID NO: 9180505 - DNA, 22 bp, Homo sapiens
aaatgcatttttaattagaccc

SEQ ID NO: 9180506 - DNA, 22 bp, Homo sapiens
aaggaagagaatccttctcaga

SEQ ID NO: 9180507 - DNA, 22 bp, Homo sapiens
aaggaagagaatccttctcaga

SEQ ID NO: 9180508 - DNA, 22 bp, Homo sapiens
aaggaagagcaaagaattatgt

SEQ ID NO: 9180509 - DNA, 22 bp, Homo sapiens
aaggaagacttgagaaggttcc

SEQ ID NO: 9180510 - DNA, 22 bp, Homo sapiens
aaggaagactcgcaggtctatg

SEQ ID NO: 9180511 - DNA, 22 bp, Homo sapiens
aaggaagacacagatgaagtga

SEQ ID NO: 9180512 - DNA, 22 bp, Homo sapiens
aaggaagacacagatgaagtga

SEQ ID NO: 9180513 - DNA, 22 bp, Homo sapiens
aaggaagacacagatgaagtga

SEQ ID NO: 9180514 - DNA, 22 bp, Homo sapiens
aaggaagacacagatgaagtga

SEQ ID NO: 9180515 - DNA, 22 bp, Homo sapiens
aaggaaagacaggacggaattc

SEQ ID NO: 9180516 - DNA, 22 bp, Homo sapiens
aaggaagactcgcaggtctatg

SEQ ID NO: 9180517 - DNA, 22 bp, Homo sapiens
aaggaagacacagatgaagtga

SEQ ID NO: 9180518 - DNA, 22 bp, Homo sapiens
aaatgtcagaaaacatggagtg

SEQ ID NO: 9180519 - DNA, 22 bp, Homo sapiens
aaatgtcagaggaacatattga

SEQ ID NO: 9180520 - DNA, 22 bp, Homo sapiens
aaatgtcagaagctttacttct

SEQ ID NO: 9180521 - DNA, 22 bp, Homo sapiens
aaatgtcagaagctttacttct

SEQ ID NO: 9180522 - DNA, 22 bp, Homo sapiens
aaatgtcagaggaacatattga

SEQ ID NO: 9180523 - DNA, 22 bp, Homo sapiens
aaatgtcatatttaagtaggaa

SEQ ID NO: 9180524 - DNA, 22 bp, Homo sapiens
aaatgtctactcctgtgtttat

SEQ ID NO: 9180525 - DNA, 22 bp, Homo sapiens
aaggaagatatatcaagcttaa

SEQ ID NO: 9180526 - DNA, 22 bp, Homo sapiens
aaggaagatatatcaagcttaa

SEQ ID NO: 9180527 - DNA, 22 bp, Homo sapiens
aaggaagatgaaagtactgcta

SEQ ID NO: 9180528 - DNA, 22 bp, Homo sapiens
aaggaagagcaaagaattatgt

SEQ ID NO: 9180529 - DNA, 22 bp, Homo sapiens
aaggaagagtctagaacaggca

SEQ ID NO: 9180530 - DNA, 22 bp, Homo sapiens
aaggaagagtctagaacaggca

SEQ ID NO: 9180531 - DNA, 22 bp, Homo sapiens
aaggaagagtctagaacaggca

SEQ ID NO: 9180532 - DNA, 22 bp, Homo sapiens
aaggcagccctggctcagcctg

SEQ ID NO: 9180533 - DNA, 22 bp, Homo sapiens
aaggcagcatgaatccctgtac

SEQ ID NO: 9180534 - DNA, 22 bp, Homo sapiens
aaggcagatataaagactagag

SEQ ID NO: 9180535 - DNA, 22 bp, Homo sapiens
aaggcactgtactagttagtta

SEQ ID NO: 9180536 - DNA, 22 bp, Homo sapiens
aaggcagcaactaatggatctc

SEQ ID NO: 9180537 - DNA, 22 bp, Homo sapiens
aaggcagatataaagactagag

SEQ ID NO: 9180538 - DNA, 22 bp, Homo sapiens
aaggcagcaagaattccaggtt

SEQ ID NO: 9180539 - DNA, 22 bp, Homo sapiens
aaggcagcaagaattccaggtt

SEQ ID NO: 9180540 - DNA, 22 bp, Homo sapiens
aaggcagcacagcaactgctca

SEQ ID NO: 9180541 - DNA, 22 bp, Homo sapiens
aaggcagcagaggaaaggtgct

SEQ ID NO: 9180542 - DNA, 22 bp, Homo sapiens
aaggcagcaccgcctcctgaaa

SEQ ID NO: 9180543 - DNA, 18 bp, Homo sapiens
aaattattcttccttttc

SEQ ID NO: 9180544 - DNA, 22 bp, Homo sapiens
aaattattttcagaatggagaa

SEQ ID NO: 9180545 - DNA, 22 bp, Homo sapiens
aaattattttcagaatggagaa

SEQ ID NO: 9180546 - DNA, 22 bp, Homo sapiens
aaattcaatgatcactggctca

SEQ ID NO: 9180547 - DNA, 23 bp, Homo sapiens
aaattattgctcttcaattgcct

SEQ ID NO: 9180548 - DNA, 18 bp, Homo sapiens
aaattattcttccttttc

SEQ ID NO: 9180549 - DNA, 23 bp, Homo sapiens
aaattattgctcttcaattgcct

SEQ ID NO: 9180550 - DNA, 22 bp, Homo sapiens
aaattattctcatgtgtttctt

SEQ ID NO: 9180551 - DNA, 22 bp, Homo sapiens
aaggctgggtttgggatgtgat

SEQ ID NO: 9180552 - DNA, 22 bp, Homo sapiens
aaggctgagccagggcccctat

SEQ ID NO: 9180553 - DNA, 21 bp, Homo sapiens
aaattcacctagtaaaacttc

SEQ ID NO: 9180554 - DNA, 22 bp, Homo sapiens
aacacagctaatttctgtcaat

SEQ ID NO: 9180555 - DNA, 22 bp, Homo sapiens
aacacagatcaaaatatttcct

SEQ ID NO: 9180556 - DNA, 22 bp, Homo sapiens
aacacaggaaattggtaaatgg

SEQ ID NO: 9180557 - DNA, 20 bp, Homo sapiens
aacacagataccaaaggttg

SEQ ID NO: 9180558 - DNA, 22 bp, Homo sapiens
aacacagggggttacaaattgt

SEQ ID NO: 9180559 - DNA, 22 bp, Homo sapiens
aacacaggaggctatgttttct

SEQ ID NO: 9180560 - DNA, 22 bp, Homo sapiens
aacacagagtatttgaagcatt

SEQ ID NO: 9180561 - DNA, 20 bp, Homo sapiens
aacacactggtggcatcagg

SEQ ID NO: 9180562 - DNA, 22 bp, Homo sapiens
aaattttaaggctggaacttaa

SEQ ID NO: 9180563 - DNA, 22 bp, Homo sapiens
aaattttaaggctggaacttaa

SEQ ID NO: 9180564 - DNA, 22 bp, Homo sapiens
aaatttctgttgttttgagcca

SEQ ID NO: 9180565 - DNA, 22 bp, Homo sapiens
aaatttctgttgttttgagcca

SEQ ID NO: 9180566 - DNA, 22 bp, Homo sapiens
aaatttctaagtcaagaagaac

SEQ ID NO: 9180567 - DNA, 22 bp, Homo sapiens
aaatttctaagtcaagaagaac

SEQ ID NO: 9180568 - DNA, 22 bp, Homo sapiens
aaggctggttccatccctggtg

SEQ ID NO: 9180569 - DNA, 22 bp, Homo sapiens
aaggctggtcagatgtggtgaa

SEQ ID NO: 9180570 - DNA, 22 bp, Homo sapiens
aaggctggtcagatgtggtgaa

SEQ ID NO: 9180571 - DNA, 22 bp, Homo sapiens
aaggctggtggattatgaggtc

SEQ ID NO: 9180572 - DNA, 22 bp, Homo sapiens
aacagaacccgagtgtgaatct

SEQ ID NO: 9180573 - DNA, 22 bp, Homo sapiens
aacagaatagttgatgtacagt

SEQ ID NO: 9180574 - DNA, 22 bp, Homo sapiens
aagtgcttccatgtttgagtgt

SEQ ID NO: 9180575 - DNA, 22 bp, Homo sapiens
aagtgcttcgttctgtattggg

SEQ ID NO: 9180576 - DNA, 22 bp, Homo sapiens
aacagacatatttttaatatgc

SEQ ID NO: 9180577 - DNA, 22 bp, Homo sapiens
aacagacagaaaaatgtgatct

SEQ ID NO: 9180578 - DNA, 22 bp, Homo sapiens
aacagacaactcctgtggctca

SEQ ID NO: 9180579 - DNA, 22 bp, Homo sapiens
aacacagttttccaaaatagag

SEQ ID NO: 9180580 - DNA, 22 bp, Homo sapiens
aacacagttagtaagggaaata

SEQ ID NO: 9180581 - DNA, 22 bp, Homo sapiens
aacacaggtttgtggtaaataa

SEQ ID NO: 9180582 - DNA, 22 bp, Homo sapiens
aacacagtcctgctcacttatt

SEQ ID NO: 9180583 - DNA, 22 bp, Homo sapiens
aacactttgggcatggccttcc

SEQ ID NO: 9180584 - DNA, 22 bp, Homo sapiens
aacactttttagtaaagattga

SEQ ID NO: 9180585 - DNA, 22 bp, Homo sapiens
aacactttttatatattgtatc

SEQ ID NO: 9180586 - DNA, 22 bp, Homo sapiens
aacactttttatatattgtatc

SEQ ID NO: 9180587 - DNA, 22 bp, Homo sapiens
aacactttttatatattgtatc

SEQ ID NO: 9180588 - DNA, 22 bp, Homo sapiens
aacactttcctgcctttctgat

SEQ ID NO: 9180589 - DNA, 22 bp, Homo sapiens
aacactttctattattatggtt

SEQ ID NO: 9180590 - DNA, 22 bp, Homo sapiens
aacactttcttccttgctcagg

SEQ ID NO: 9180591 - DNA, 22 bp, Homo sapiens
aacactttggaatagagatagg

SEQ ID NO: 9180592 - DNA, 22 bp, Homo sapiens
aacactttggatgcagaaccaa

SEQ ID NO: 9180593 - DNA, 22 bp, Homo sapiens
aacactttcttccttgctcagg

SEQ ID NO: 9180594 - DNA, 22 bp, Homo sapiens
aacactttcttccttgctcagg

SEQ ID NO: 9180595 - DNA, 22 bp, Homo sapiens
aagatgaaaatttactgtgatg

SEQ ID NO: 9180596 - DNA, 22 bp, Homo sapiens
aagatgaatcagtatgtgtcct

SEQ ID NO: 9180597 - DNA, 22 bp, Homo sapiens
aagatgaaaatttactgtgatg

SEQ ID NO: 9180598 - DNA, 22 bp, Homo sapiens
acacatttctaaatttttaccg

SEQ ID NO: 9180599 - DNA, 22 bp, Homo sapiens
acacatttagcaccaggtttat

SEQ ID NO: 9180600 - DNA, 22 bp, Homo sapiens
acacatttagcaccaggtttat

SEQ ID NO: 9180601 - DNA, 22 bp, Homo sapiens
acacatttctaaatttttaccg

SEQ ID NO: 9180602 - DNA, 22 bp, Homo sapiens
acacatttattacatgcatgtg

SEQ ID NO: 9180603 - DNA, 22 bp, Homo sapiens
acacatttaaaaaggaacatat

SEQ ID NO: 9180604 - DNA, 22 bp, Homo sapiens
acacatttacatgtttacgtat

SEQ ID NO: 9180605 - DNA, 22 bp, Homo sapiens
acacatttacatgtttacgtat

SEQ ID NO: 9180606 - DNA, 21 bp, Homo sapiens
acacattatgagcatagactc

SEQ ID NO: 9180607 - DNA, 21 bp, Homo sapiens
acacattatgagcatagactc

SEQ ID NO: 9180608 - DNA, 22 bp, Homo sapiens
acacattatgagcagttgtctt

SEQ ID NO: 9180609 - DNA, 19 bp, Homo sapiens
acacatgctcctggagcct

SEQ ID NO: 9180610 - DNA, 22 bp, Homo sapiens
acacattatctcattaaatact

SEQ ID NO: 9180611 - DNA, 22 bp, Homo sapiens
acacatgacctccgcagcagca

SEQ ID NO: 9180612 - DNA, 22 bp, Homo sapiens
acacatgagaaacatcagttgt

SEQ ID NO: 9180613 - DNA, 22 bp, Homo sapiens
acacatgagttctcatcttgtg

SEQ ID NO: 9180614 - DNA, 20 bp, Homo sapiens
acacatgcattcatgtgggc

SEQ ID NO: 9180615 - DNA, 22 bp, Homo sapiens
acacatcttagactgaaatatg

SEQ ID NO: 9180616 - DNA, 22 bp, Homo sapiens
aagatggctgcagcaattccaa

SEQ ID NO: 9180617 - DNA, 22 bp, Homo sapiens
aagatggctgcagcaattccaa

SEQ ID NO: 9180618 - DNA, 22 bp, Homo sapiens
aagatggcaggaatcataagct

SEQ ID NO: 9180619 - DNA, 22 bp, Homo sapiens
aagatggcatctcctatagatg

SEQ ID NO: 9180620 - DNA, 22 bp, Homo sapiens
aagatggcttagagtcctggtg

SEQ ID NO: 9180621 - DNA, 22 bp, Homo sapiens
aagatgtgatgggttaagggcc

SEQ ID NO: 9180622 - DNA, 22 bp, Homo sapiens
aagatgtatcagttaagtcttc

SEQ ID NO: 9180623 - DNA, 22 bp, Homo sapiens
aagatgtaaaggcaatataaag

SEQ ID NO: 9180624 - DNA, 22 bp, Homo sapiens
aagatgcatgctgaagctggct

SEQ ID NO: 9180625 - DNA, 22 bp, Homo sapiens
aagatgcagcttccacttttgc

SEQ ID NO: 9180626 - DNA, 22 bp, Homo sapiens
aagatgcatgctgaagctggct

SEQ ID NO: 9180627 - DNA, 22 bp, Homo sapiens
aagatgcagcaaactacttttt

SEQ ID NO: 9180628 - DNA, 22 bp, Homo sapiens
aagatgcacaatgtggcaatta

SEQ ID NO: 9180629 - DNA, 22 bp, Homo sapiens
aagatgcacaatgtggcaatta

SEQ ID NO: 9180630 - DNA, 22 bp, Homo sapiens
aagatgatgttgtgttttcact

SEQ ID NO: 9180631 - DNA, 22 bp, Homo sapiens
aagatgataggacttgcttaag

SEQ ID NO: 9180632 - DNA, 22 bp, Homo sapiens
aagatgatagatctgtcaatgt

SEQ ID NO: 9180633 - DNA, 22 bp, Homo sapiens
aagatgactatttatctgtaag

SEQ ID NO: 9180634 - DNA, 22 bp, Homo sapiens
aagatgacagatgcttagagtc

SEQ ID NO: 9180635 - DNA, 22 bp, Homo sapiens
aagatgaccctgagggcaattg

SEQ ID NO: 9180636 - DNA, 22 bp, Homo sapiens
aagcaaagagataaccttttgg

SEQ ID NO: 9180637 - DNA, 22 bp, Homo sapiens
aagcaagagttggagtgatgtt

SEQ ID NO: 9180638 - DNA, 22 bp, Homo sapiens
aagcaagaggaaatgtggacct

SEQ ID NO: 9180639 - DNA, 22 bp, Homo sapiens
aagcaagacagaagttactgcc

SEQ ID NO: 9180640 - DNA, 22 bp, Homo sapiens
aagatgtgtctcatcagggtgt

SEQ ID NO: 9180641 - DNA, 22 bp, Homo sapiens
aagatgtgtctcatcagggtgt

SEQ ID NO: 9180642 - DNA, 22 bp, Homo sapiens
aagatgtgtccattctttgctc

SEQ ID NO: 9180643 - DNA, 22 bp, Homo sapiens
aagatgtgctgtcttgccactc

SEQ ID NO: 9180644 - DNA, 22 bp, Homo sapiens
aagatgtggacccagccaggct

SEQ ID NO: 9180645 - DNA, 22 bp, Homo sapiens
aagatgtgtcaccccatgactg

SEQ ID NO: 9180646 - DNA, 22 bp, Homo sapiens
aagatgtgcagttcatggcagg

SEQ ID NO: 9180647 - DNA, 22 bp, Homo sapiens
aagatgtgcatgggtatgcaat

SEQ ID NO: 9180648 - DNA, 22 bp, Homo sapiens
aagatgttagaggtcatgcaga

SEQ ID NO: 9180649 - DNA, 22 bp, Homo sapiens
aagcaataatcccaaagtgctg

SEQ ID NO: 9180650 - DNA, 22 bp, Homo sapiens
aagcaataaataatttttagta

SEQ ID NO: 9180651 - DNA, 22 bp, Homo sapiens
aagcaagtacaatagcaagtac

SEQ ID NO: 9180652 - DNA, 22 bp, Homo sapiens
aagcacattttccagcagctct

SEQ ID NO: 9180653 - DNA, 22 bp, Homo sapiens
aagcaccaccctcccaacctgt

SEQ ID NO: 9180654 - DNA, 22 bp, Homo sapiens
aagcacacctccctggcaggag

SEQ ID NO: 9180655 - DNA, 22 bp, Homo sapiens
aagcacacatctctggctgggt

SEQ ID NO: 9180656 - DNA, 22 bp, Homo sapiens
aagcacacagcaaaggggagct

SEQ ID NO: 9180657 - DNA, 22 bp, Homo sapiens
aagcacacagaggcggaaggac

SEQ ID NO: 9180658 - DNA, 22 bp, Homo sapiens
aagcaattgagtgaaacctctt

SEQ ID NO: 9180659 - DNA, 22 bp, Homo sapiens
aagcaattgtcctgtctctaca

SEQ ID NO: 9180660 - DNA, 22 bp, Homo sapiens
aagcaattggttttagtaaaat

SEQ ID NO: 9180661 - DNA, 22 bp, Homo sapiens
aagcaattggttttagtaaaat

SEQ ID NO: 9180662 - DNA, 22 bp, Homo sapiens
aagcaattcagcaaacctagaa

SEQ ID NO: 9180663 - DNA, 22 bp, Homo sapiens
aagcaattcacagttcacttaa

SEQ ID NO: 9180664 - DNA, 22 bp, Homo sapiens
aagcaatttgacagtacatatc

SEQ ID NO: 9180665 - DNA, 22 bp, Homo sapiens
aagcaatttgacagtacatatc

SEQ ID NO: 9180666 - DNA, 22 bp, Homo sapiens
aagcaatttgacagtacatatc

SEQ ID NO: 9180667 - DNA, 22 bp, Homo sapiens
aagcaattgtcctgtctctaca

SEQ ID NO: 9180668 - DNA, 22 bp, Homo sapiens
aagcaatagggtaatctactca

SEQ ID NO: 9180669 - DNA, 22 bp, Homo sapiens
aagcaatagggtaatctactca

SEQ ID NO: 9180670 - DNA, 22 bp, Homo sapiens
aagcaatagcaacaactttaca

SEQ ID NO: 9180671 - DNA, 22 bp, Homo sapiens
aagcaatatactgatatgatta

SEQ ID NO: 9180672 - DNA, 19 bp, Homo sapiens
aagcaatgttgtgaatcta

SEQ ID NO: 9180673 - DNA, 21 bp, Homo sapiens
aagcaattaccttcccatgtg

SEQ ID NO: 9180674 - DNA, 21 bp, Homo sapiens
aagcaattaccttcccatgtg

SEQ ID NO: 9180675 - DNA, 22 bp, Homo sapiens
aagcaatgtgttaatgaatgag

SEQ ID NO: 9180676 - DNA, 22 bp, Homo sapiens
aagcagagcaagcgtatttatt

SEQ ID NO: 9180677 - DNA, 22 bp, Homo sapiens
aagcagagccaccagctttgga

SEQ ID NO: 9180678 - DNA, 22 bp, Homo sapiens
aagcagagccaccagctttgga

SEQ ID NO: 9180679 - DNA, 22 bp, Homo sapiens
aagcagagccaccagctttgga

SEQ ID NO: 9180680 - DNA, 22 bp, Homo sapiens
aagcagagcctgagacagggat

SEQ ID NO: 9180681 - DNA, 22 bp, Homo sapiens
aagcagagcctgagacagggat

SEQ ID NO: 9180682 - DNA, 22 bp, Homo sapiens
aagcagagcctgagacagggat

SEQ ID NO: 9180683 - DNA, 22 bp, Homo sapiens
aagcagactcccggccagctca

SEQ ID NO: 9180684 - DNA, 19 bp, Homo sapiens
aagcagactctgagccagg

SEQ ID NO: 9180685 - DNA, 22 bp, Homo sapiens
aagcagagaatctgggagcgag

SEQ ID NO: 9180686 - DNA, 22 bp, Homo sapiens
aagcagagaccggctaatggag

SEQ ID NO: 9180687 - DNA, 22 bp, Homo sapiens
aagcagagagcagaattaagtt

SEQ ID NO: 9180688 - DNA, 22 bp, Homo sapiens
aagcagaagttgatctaccata

SEQ ID NO: 9180689 - DNA, 22 bp, Homo sapiens
aagcagaatagaggcccttccc

SEQ ID NO: 9180690 - DNA, 22 bp, Homo sapiens
aagcagaatttaatagaaaggt

SEQ ID NO: 9180691 - DNA, 22 bp, Homo sapiens
aagcagaactgggaagtagtgg

SEQ ID NO: 9180692 - DNA, 22 bp, Homo sapiens
aagcagaactgggaagtagtgg

SEQ ID NO: 9180693 - DNA, 22 bp, Homo sapiens
aagcagaactgggaagtagtgg

SEQ ID NO: 9180694 - DNA, 22 bp, Homo sapiens
aagcagaactgggaagtagtgg

SEQ ID NO: 9180695 - DNA, 20 bp, Homo sapiens
aagcagaagctgctctcagc

SEQ ID NO: 9180696 - DNA, 20 bp, Homo sapiens
aagcagaagctgctctcagc

SEQ ID NO: 9180697 - DNA, 20 bp, Homo sapiens
aagcagaagctgctctcagc

SEQ ID NO: 9180698 - DNA, 22 bp, Homo sapiens
aagcagaatttaatagaaaggt

SEQ ID NO: 9180699 - DNA, 22 bp, Homo sapiens
aagcagaatttcccactagttg

SEQ ID NO: 9180700 - DNA, 22 bp, Homo sapiens
aagcagaatttaatagaaaggt

SEQ ID NO: 9180701 - DNA, 22 bp, Homo sapiens
aagcagacagagaatgggtttg

SEQ ID NO: 9180702 - DNA, 22 bp, Homo sapiens
aagcagaatttcccactagttg

SEQ ID NO: 9180703 - DNA, 22 bp, Homo sapiens
acagcagaccccagtgccatgg

SEQ ID NO: 9180704 - DNA, 22 bp, Homo sapiens
acagcagaccccagtgccatgg

SEQ ID NO: 9180705 - DNA, 22 bp, Homo sapiens
acagcagaccccagtgccatgg

SEQ ID NO: 9180706 - DNA, 22 bp, Homo sapiens
aagcagaggtagggtgtgcagt

SEQ ID NO: 9180707 - DNA, 22 bp, Homo sapiens
aagcagaggtagggtgtgcagt

SEQ ID NO: 9180708 - DNA, 22 bp, Homo sapiens
aagcagagggtatggccaggtt

SEQ ID NO: 9180709 - DNA, 22 bp, Homo sapiens
aagcagagggtatggccaggtt

SEQ ID NO: 9180710 - DNA, 22 bp, Homo sapiens
aagcagaggccacagagtgggc

SEQ ID NO: 9180711 - DNA, 22 bp, Homo sapiens
aagcagaggccacagagtgggc

SEQ ID NO: 9180712 - DNA, 22 bp, Homo sapiens
aagcagaggccacagagtgggc

SEQ ID NO: 9180713 - DNA, 22 bp, Homo sapiens
aagcagaggaccgacggaggga

SEQ ID NO: 9180714 - DNA, 22 bp, Homo sapiens
acagcagagacactcaggaggc

SEQ ID NO: 9180715 - DNA, 22 bp, Homo sapiens
acagcagagacactcaggaggc

SEQ ID NO: 9180716 - DNA, 22 bp, Homo sapiens
acagcagagacactcaggaggc

SEQ ID NO: 9180717 - DNA, 22 bp, Homo sapiens
acagcagagacactcaggaggc

SEQ ID NO: 9180718 - DNA, 22 bp, Homo sapiens
acagcagactttctacagctca

SEQ ID NO: 9180719 - DNA, 22 bp, Homo sapiens
acagcagactttctacagctca

SEQ ID NO: 9180720 - DNA, 22 bp, Homo sapiens
acagcagactttctacagctca

SEQ ID NO: 9180721 - DNA, 22 bp, Homo sapiens
acagcagaccccagtgccatgg

SEQ ID NO: 9180722 - DNA, 22 bp, Homo sapiens
acagcagagacactcaggaggc

SEQ ID NO: 9180723 - DNA, 22 bp, Homo sapiens
acagcagagaactttagagggt

SEQ ID NO: 9180724 - DNA, 22 bp, Homo sapiens
acagcagagaactttagagggt

SEQ ID NO: 9180725 - DNA, 22 bp, Homo sapiens
acagcagagaactttagagggt

SEQ ID NO: 9180726 - DNA, 22 bp, Homo sapiens
acagcagagccagtggctctag

SEQ ID NO: 9180727 - DNA, 22 bp, Homo sapiens
acagcagagccagtggctctag

SEQ ID NO: 9180728 - DNA, 22 bp, Homo sapiens
acagcagagcaccagggccact

SEQ ID NO: 9180729 - DNA, 22 bp, Homo sapiens
acagcagagcaccagggccact

SEQ ID NO: 9180730 - DNA, 22 bp, Homo sapiens
acagcagagcaccagggccact

SEQ ID NO: 9180731 - DNA, 21 bp, Homo sapiens
acagcagagatcaagactaag

SEQ ID NO: 9180732 - DNA, 21 bp, Homo sapiens
acagcagagatcaagactaag

SEQ ID NO: 9180733 - DNA, 22 bp, Homo sapiens
aagcagcttaaattagagcctg

SEQ ID NO: 9180734 - DNA, 22 bp, Homo sapiens
aagcagcttaaattagagcctg

SEQ ID NO: 9180735 - DNA, 22 bp, Homo sapiens
aagcagcttaaattagagcctg

SEQ ID NO: 9180736 - DNA, 21 bp, Homo sapiens
aagcagcttaataaagtatgt

SEQ ID NO: 9180737 - DNA, 22 bp, Homo sapiens
aagcagctgcaggttcaaagga

SEQ ID NO: 9180738 - DNA, 22 bp, Homo sapiens
aagcagctggaagagtaagatg

SEQ ID NO: 9180739 - DNA, 22 bp, Homo sapiens
aagcagctgtgtgacataatct

SEQ ID NO: 9180740 - DNA, 22 bp, Homo sapiens
acagcagagtagttttccaact

SEQ ID NO: 9180741 - DNA, 22 bp, Homo sapiens
acagcagagtagttttccaact

SEQ ID NO: 9180742 - DNA, 22 bp, Homo sapiens
acagcagaggaaaagtctgata

SEQ ID NO: 9180743 - DNA, 22 bp, Homo sapiens
acagcagaggaaaagtctgata

SEQ ID NO: 9180744 - DNA, 22 bp, Homo sapiens
acagcagaggaaaagtctgata

SEQ ID NO: 9180745 - DNA, 22 bp, Homo sapiens
acagcagagcctagcttaatct

SEQ ID NO: 9180746 - DNA, 22 bp, Homo sapiens
acagcagagcctagcttaatct

SEQ ID NO: 9180747 - DNA, 22 bp, Homo sapiens
acagcagagcctagcttaatct

SEQ ID NO: 9180748 - DNA, 22 bp, Homo sapiens
acagcagagcctggtacttact

SEQ ID NO: 9180749 - DNA, 22 bp, Homo sapiens
acagcagagccagtggctctag

SEQ ID NO: 9180750 - DNA, 22 bp, Homo sapiens
acagcagagcctggtacttact

SEQ ID NO: 9180751 - DNA, 22 bp, Homo sapiens
acagcagagcctggtacttact

SEQ ID NO: 9180752 - DNA, 22 bp, Homo sapiens
aagcaggaagctcaggtccttg

SEQ ID NO: 9180753 - DNA, 22 bp, Homo sapiens
aagcaggaagctcaggtccttg

SEQ ID NO: 9180754 - DNA, 21 bp, Homo sapiens
aagcaggaacttcaaagggac

SEQ ID NO: 9180755 - DNA, 22 bp, Homo sapiens
acagcctgctgcctgcttcttg

SEQ ID NO: 9180756 - DNA, 22 bp, Homo sapiens
aagcagctttctttcctgtgaa

SEQ ID NO: 9180757 - DNA, 22 bp, Homo sapiens
aagcagctttctttcctgtgaa

SEQ ID NO: 9180758 - DNA, 22 bp, Homo sapiens
aagcagcttttgaagagtgagg

SEQ ID NO: 9180759 - DNA, 22 bp, Homo sapiens
aagcagcttccctggctcctgg

SEQ ID NO: 9180760 - DNA, 22 bp, Homo sapiens
aagcagcttccctggctcctgg

SEQ ID NO: 9180761 - DNA, 22 bp, Homo sapiens
aagcagcttccctggctcctgg

SEQ ID NO: 9180762 - DNA, 22 bp, Homo sapiens
aagcagcttccccaaagtgcct

SEQ ID NO: 9180763 - DNA, 22 bp, Homo sapiens
aagcagcttccccaaagtgcct

SEQ ID NO: 9180764 - DNA, 22 bp, Homo sapiens
aagaaacctagtctggagcagc

SEQ ID NO: 9180765 - DNA, 22 bp, Homo sapiens
aagaaactggaatatagagagc

SEQ ID NO: 9180766 - DNA, 22 bp, Homo sapiens
aagaaaccaaccctgccagcac

SEQ ID NO: 9180767 - DNA, 22 bp, Homo sapiens
aagaaaatcagttctggtcagt

SEQ ID NO: 9180768 - DNA, 22 bp, Homo sapiens
aagaaaacaatgacttgccagc

SEQ ID NO: 9180769 - DNA, 20 bp, Homo sapiens
aagaaaacgtcttcagggga

SEQ ID NO: 9180770 - DNA, 20 bp, Homo sapiens
aagaaaacgtcttcagggga

SEQ ID NO: 9180771 - DNA, 22 bp, Homo sapiens
aagaaaacgttttgaggagttt

SEQ ID NO: 9180772 - DNA, 22 bp, Homo sapiens
aagaaaatcagttctggtcagt

SEQ ID NO: 9180773 - DNA, 22 bp, Homo sapiens
aagaaaagatgtttggttttca

SEQ ID NO: 9180774 - DNA, 22 bp, Homo sapiens
aactggtatggtgagaagagag

SEQ ID NO: 9180775 - DNA, 22 bp, Homo sapiens
aactggtagctgattaagtata

SEQ ID NO: 9180776 - DNA, 22 bp, Homo sapiens
aactggtagaaagcagtaagtg

SEQ ID NO: 9180777 - DNA, 22 bp, Homo sapiens
aactggtatctcttcagtgtaa

SEQ ID NO: 9180778 - DNA, 22 bp, Homo sapiens
aactggtagaaagcagtaagtg

SEQ ID NO: 9180779 - DNA, 22 bp, Homo sapiens
aactttctggctttggggagag

SEQ ID NO: 9180780 - DNA, 22 bp, Homo sapiens
aactttctgttacgtccccaga

SEQ ID NO: 9180781 - DNA, 22 bp, Homo sapiens
aactgggcccagtctgagttgg

SEQ ID NO: 9180782 - DNA, 22 bp, Homo sapiens
aactggatttaggaacagagaa

SEQ ID NO: 9180783 - DNA, 22 bp, Homo sapiens
aactggattgacctagtttaag

SEQ ID NO: 9180784 - DNA, 22 bp, Homo sapiens
aactggattcttactgggctga

SEQ ID NO: 9180785 - DNA, 22 bp, Homo sapiens
aactggatttaggaacagagaa

SEQ ID NO: 9180786 - DNA, 22 bp, Homo sapiens
aactggattttgatgagcagtt

SEQ ID NO: 9180787 - DNA, 22 bp, Homo sapiens
aactggattttgatgagcagtt

SEQ ID NO: 9180788 - DNA, 22 bp, Homo sapiens
aactggatcagttgagggaggc

SEQ ID NO: 9180789 - DNA, 19 bp, Homo sapiens
aactggataatggccacat

SEQ ID NO: 9180790 - DNA, 22 bp, Homo sapiens
aactggatcagttgagggaggc

SEQ ID NO: 9180791 - DNA, 22 bp, Homo sapiens
aactggattattcagttgctgc

SEQ ID NO: 9180792 - DNA, 22 bp, Homo sapiens
aactggattaactggctcaaat

SEQ ID NO: 9180793 - DNA, 22 bp, Homo sapiens
aactggagcccctctgccactg

SEQ ID NO: 9180794 - DNA, 22 bp, Homo sapiens
aactggagcccctctgccactg

SEQ ID NO: 9180795 - DNA, 22 bp, Homo sapiens
aactggaactggtagtgttggt

SEQ ID NO: 9180796 - DNA, 22 bp, Homo sapiens
aatggcttttaaaaatagcatt

SEQ ID NO: 9180797 - DNA, 22 bp, Homo sapiens
aatgggaaagagactagatgct

SEQ ID NO: 9180798 - DNA, 22 bp, Homo sapiens
aagaaattaatgtgccattact

SEQ ID NO: 9180799 - DNA, 22 bp, Homo sapiens
aagaaattaaggaatgcaacga

SEQ ID NO: 9180800 - DNA, 22 bp, Homo sapiens
aagaaattaatgtgccattact

SEQ ID NO: 9180801 - DNA, 22 bp, Homo sapiens
aagaaattaatgtgccattact

SEQ ID NO: 9180802 - DNA, 22 bp, Homo sapiens
aagaaatggcttcatctgagta

SEQ ID NO: 9180803 - DNA, 22 bp, Homo sapiens
aagaaatggcttcatctgagta

SEQ ID NO: 9180804 - DNA, 22 bp, Homo sapiens
aagaaatggcttcatctgagta

SEQ ID NO: 9180805 - DNA, 22 bp, Homo sapiens
aagaaatgtagagcctagtaaa

SEQ ID NO: 9180806 - DNA, 22 bp, Homo sapiens
aagaaatggcttcatctgagta

SEQ ID NO: 9180807 - DNA, 22 bp, Homo sapiens
aagaaatgtgaatattgaatag

SEQ ID NO: 9180808 - DNA, 22 bp, Homo sapiens
aagaaatgtgaatattgaatag

SEQ ID NO: 9180809 - DNA, 22 bp, Homo sapiens
aagaacagattcagcctgaact

SEQ ID NO: 9180810 - DNA, 22 bp, Homo sapiens
aagaacaactgctttaaaagca

SEQ ID NO: 9180811 - DNA, 22 bp, Homo sapiens
aagaacaactgctttaaaagca

SEQ ID NO: 9180812 - DNA, 22 bp, Homo sapiens
aatttcacagtgaactttgagg

SEQ ID NO: 9180813 - DNA, 22 bp, Homo sapiens
aatttcactgataaagactcca

SEQ ID NO: 9180814 - DNA, 22 bp, Homo sapiens
aatttcactggaaaagataatt

SEQ ID NO: 9180815 - DNA, 22 bp, Homo sapiens
aattctaaatgtaatttagaat

SEQ ID NO: 9180816 - DNA, 22 bp, Homo sapiens
aattcctagttgtacttagtga

SEQ ID NO: 9180817 - DNA, 22 bp, Homo sapiens
aattcctctatctttcttcaag

SEQ ID NO: 9180818 - DNA, 21 bp, Homo sapiens
aattcgtttgcaacactgata

SEQ ID NO: 9180819 - DNA, 22 bp, Homo sapiens
aattctctccagggtaacatca

SEQ ID NO: 9180820 - DNA, 22 bp, Homo sapiens
aattctctccagggtaacatca

SEQ ID NO: 9180821 - DNA, 22 bp, Homo sapiens
aattctcaggtaaaagttaagt

SEQ ID NO: 9180822 - DNA, 22 bp, Homo sapiens
aattctctactgtttggtgctc

SEQ ID NO: 9180823 - DNA, 22 bp, Homo sapiens
aagaaagataaggtttgcttgg

SEQ ID NO: 9180824 - DNA, 22 bp, Homo sapiens
aagaaagataaggtttgcttgg

SEQ ID NO: 9180825 - DNA, 22 bp, Homo sapiens
aagaaagataaggtttgcttgg

SEQ ID NO: 9180826 - DNA, 22 bp, Homo sapiens
aagaaagataaggtttgcttgg

SEQ ID NO: 9180827 - DNA, 22 bp, Homo sapiens
aagaaagagatcactcctccat

SEQ ID NO: 9180828 - DNA, 22 bp, Homo sapiens
aagaaagagatcactcctccat

SEQ ID NO: 9180829 - DNA, 22 bp, Homo sapiens
aagaaagagatcactcctccat

SEQ ID NO: 9180830 - DNA, 22 bp, Homo sapiens
aattcccaccttctctcttttg

SEQ ID NO: 9180831 - DNA, 21 bp, Homo sapiens
aattcccagaaacagcacaag

SEQ ID NO: 9180832 - DNA, 22 bp, Homo sapiens
aattcccactatatgccaagca

SEQ ID NO: 9180833 - DNA, 22 bp, Homo sapiens
aattcccatttgcagaaaatca

SEQ ID NO: 9180834 - DNA, 22 bp, Homo sapiens
aagagaaagcagactttgtcat

SEQ ID NO: 9180835 - DNA, 22 bp, Homo sapiens
aagagaaagcagactttgtcat

SEQ ID NO: 9180836 - DNA, 22 bp, Homo sapiens
aagagaagaaagtgtctacaca

SEQ ID NO: 9180837 - DNA, 22 bp, Homo sapiens
aagagaagaaagtgtctacaca

SEQ ID NO: 9180838 - DNA, 22 bp, Homo sapiens
aagagaagaaagtgtctacaca

SEQ ID NO: 9180839 - DNA, 20 bp, Homo sapiens
aagagaagaagtctttgaaa

SEQ ID NO: 9180840 - DNA, 20 bp, Homo sapiens
aagagaagaagtctttgaaa

SEQ ID NO: 9180841 - DNA, 20 bp, Homo sapiens
aagagaagaagtctttgaaa

SEQ ID NO: 9180842 - DNA, 22 bp, Homo sapiens
aagactttcaagtatgcatgca

SEQ ID NO: 9180843 - DNA, 22 bp, Homo sapiens
aagaccattgctgtatttgtag

SEQ ID NO: 9180844 - DNA, 22 bp, Homo sapiens
aatttcagcaacgggagcctag

SEQ ID NO: 9180845 - DNA, 22 bp, Homo sapiens
aatttcagcttaagttgtttgg

SEQ ID NO: 9180846 - DNA, 22 bp, Homo sapiens
aatttcagctcaaacttgtgtt

SEQ ID NO: 9180847 - DNA, 22 bp, Homo sapiens
aatttcagatgtcataaatata

SEQ ID NO: 9180848 - DNA, 22 bp, Homo sapiens
aatttcagggtgaatggactga

SEQ ID NO: 9180849 - DNA, 22 bp, Homo sapiens
aatttcagtatgaagtttcaca

SEQ ID NO: 9180850 - DNA, 22 bp, Homo sapiens
aatttcagttgctaataagttc

SEQ ID NO: 9180851 - DNA, 22 bp, Homo sapiens
aatttcagtatgaagtttcaca

SEQ ID NO: 9180852 - DNA, 22 bp, Homo sapiens
aatttcagatattaaagaatga

SEQ ID NO: 9180853 - DNA, 21 bp, Homo sapiens
aatttcagacccattttgcct

SEQ ID NO: 9180854 - DNA, 22 bp, Homo sapiens
aatttcagaggtagagattcta

SEQ ID NO: 9180855 - DNA, 22 bp, Homo sapiens
aatttcagaactatctgggagt

SEQ ID NO: 9180856 - DNA, 22 bp, Homo sapiens
aatttcagaacccaaattagcg

SEQ ID NO: 9180857 - DNA, 22 bp, Homo sapiens
aatttcagaccatttgcaatta

SEQ ID NO: 9180858 - DNA, 22 bp, Homo sapiens
aattttactaatctgagtgtga

SEQ ID NO: 9180859 - DNA, 22 bp, Homo sapiens
aattttaatcagtggtgctgag

SEQ ID NO: 9180860 - DNA, 22 bp, Homo sapiens
aattttaagcatatgactggtt

SEQ ID NO: 9180861 - DNA, 22 bp, Homo sapiens
aatttccagaccccatccacag

SEQ ID NO: 9180862 - DNA, 22 bp, Homo sapiens
aagagaaggtgaggaagccggt

SEQ ID NO: 9180863 - DNA, 22 bp, Homo sapiens
aagagaaggccctgacccaccc

SEQ ID NO: 9180864 - DNA, 22 bp, Homo sapiens
aagagaatatcgatagcactct

SEQ ID NO: 9180865 - DNA, 22 bp, Homo sapiens
aagagaaggtgaggaagccggt

SEQ ID NO: 9180866 - DNA, 22 bp, Homo sapiens
aagagactatggtgtctatgaa

SEQ ID NO: 9180867 - DNA, 22 bp, Homo sapiens
aagagactggaaactagggtca

SEQ ID NO: 9180868 - DNA, 21 bp, Homo sapiens
aagagacatttctcatcagca

SEQ ID NO: 9180869 - DNA, 22 bp, Homo sapiens
aagagactttgcagtgtcccta

SEQ ID NO: 9180870 - DNA, 22 bp, Homo sapiens
aagagactttgcagtgtcccta

SEQ ID NO: 9180871 - DNA, 22 bp, Homo sapiens
acacaaagctattgagtgtcat

SEQ ID NO: 9180872 - DNA, 22 bp, Homo sapiens
acacaaagttggatgacaaaat

SEQ ID NO: 9180873 - DNA, 22 bp, Homo sapiens
acacaaaatcaaagtcctaggc

SEQ ID NO: 9180874 - DNA, 22 bp, Homo sapiens
acacaaacagtctatagcacca

SEQ ID NO: 9180875 - DNA, 22 bp, Homo sapiens
aagagcaagtgggtagtgaagc

SEQ ID NO: 9180876 - DNA, 22 bp, Homo sapiens
aagagcaagtgggtagtgaagc

SEQ ID NO: 9180877 - DNA, 22 bp, Homo sapiens
aagagcaagtgggtagtgaagc

SEQ ID NO: 9180878 - DNA, 22 bp, Homo sapiens
aagagcaccgcagcagcccaac

SEQ ID NO: 9180879 - DNA, 22 bp, Homo sapiens
aagagcactaacagagctgata

SEQ ID NO: 9180880 - DNA, 22 bp, Homo sapiens
aaaggcaggctttcacatctca

SEQ ID NO: 9180881 - DNA, 22 bp, Homo sapiens
aaaggcaggactgcagcatagg

SEQ ID NO: 9180882 - DNA, 22 bp, Homo sapiens
aaaggcagtgggtatgtggatc

SEQ ID NO: 9180883 - DNA, 19 bp, Homo sapiens
aaaggcagtgggtggcgtg

SEQ ID NO: 9180884 - DNA, 22 bp, Homo sapiens
aaaggcatgattaattctgtgt

SEQ ID NO: 9180885 - DNA, 22 bp, Homo sapiens
aaaggcagagtgctcagctggc

SEQ ID NO: 9180886 - DNA, 22 bp, Homo sapiens
aacccgggaggcagaggttgtg

SEQ ID NO: 9180887 - DNA, 22 bp, Homo sapiens
aaaggcaggactgcagcatagg

SEQ ID NO: 9180888 - DNA, 22 bp, Homo sapiens
aaagcctgggttcctcactatc

SEQ ID NO: 9180889 - DNA, 22 bp, Homo sapiens
aaagcctgggttcctcactatc

SEQ ID NO: 9180890 - DNA, 22 bp, Homo sapiens
aacccacaaaggatttcagctc

SEQ ID NO: 9180891 - DNA, 22 bp, Homo sapiens
aacatttgtgtttgctaaaaat

SEQ ID NO: 9180892 - DNA, 22 bp, Homo sapiens
aaagccttttatgatcagttaa

SEQ ID NO: 9180893 - DNA, 22 bp, Homo sapiens
aaagccttttatgatcagttaa

SEQ ID NO: 9180894 - DNA, 22 bp, Homo sapiens
aacccaccgtggtagggcacac

SEQ ID NO: 9180895 - DNA, 22 bp, Homo sapiens
aactgtgaggatgtgcaaattc

SEQ ID NO: 9180896 - DNA, 22 bp, Homo sapiens
aactgtcttgcctactcagcat

SEQ ID NO: 9180897 - DNA, 23 bp, Homo sapiens
aactgtcttgcaagtgtgatacc

SEQ ID NO: 9180898 - DNA, 22 bp, Homo sapiens
aactgtcttatttatatttctg

SEQ ID NO: 9180899 - DNA, 22 bp, Homo sapiens
aactgtcttaataacaaaagct

SEQ ID NO: 9180900 - DNA, 22 bp, Homo sapiens
aactgtctgaaactggggtttc

SEQ ID NO: 9180901 - DNA, 22 bp, Homo sapiens
aactgtctaaggagaatatgaa

SEQ ID NO: 9180902 - DNA, 22 bp, Homo sapiens
aactgtaagagaataaatgtgt

SEQ ID NO: 9180903 - DNA, 22 bp, Homo sapiens
aactgtaaaggttgagtggtaa

SEQ ID NO: 9180904 - DNA, 22 bp, Homo sapiens
aactgtaagacaaatgacttct

SEQ ID NO: 9180905 - DNA, 22 bp, Homo sapiens
aactgtaatttttacatagtaa

SEQ ID NO: 9180906 - DNA, 22 bp, Homo sapiens
aactgtaatttttacatagtaa

SEQ ID NO: 9180907 - DNA, 22 bp, Homo sapiens
aagaacatgaacacaatgttta

SEQ ID NO: 9180908 - DNA, 22 bp, Homo sapiens
aagaacatgaagtcacaaatgc

SEQ ID NO: 9180909 - DNA, 22 bp, Homo sapiens
aagaacataaacagaaggacag

SEQ ID NO: 9180910 - DNA, 22 bp, Homo sapiens
aagaacagttgggaggtgagcc

SEQ ID NO: 9180911 - DNA, 22 bp, Homo sapiens
aagaacataacagaagctgtgt

SEQ ID NO: 9180912 - DNA, 22 bp, Homo sapiens
aagaaataagacttctctgtcc

SEQ ID NO: 9180913 - DNA, 22 bp, Homo sapiens
aagaaataagacttctctgtcc

SEQ ID NO: 9180914 - DNA, 22 bp, Homo sapiens
aagaaataagacttctctgtcc

SEQ ID NO: 9180915 - DNA, 22 bp, Homo sapiens
aagaaataagacttctctgtcc

SEQ ID NO: 9180916 - DNA, 22 bp, Homo sapiens
aagaaataagacttctctgtcc

SEQ ID NO: 9180917 - DNA, 22 bp, Homo sapiens
aaagtaattgtggttcttgcca

SEQ ID NO: 9180918 - DNA, 22 bp, Homo sapiens
aaagtaattgcagtttctgcca

SEQ ID NO: 9180919 - DNA, 22 bp, Homo sapiens
aaagtaattaagaagctggaca

SEQ ID NO: 9180920 - DNA, 22 bp, Homo sapiens
aaaggtttttatttatcctgga

SEQ ID NO: 9180921 - DNA, 22 bp, Homo sapiens
aaagtaacaataaggttctatt

SEQ ID NO: 9180922 - DNA, 22 bp, Homo sapiens
aaagtaaagattgggaatgtgt

SEQ ID NO: 9180923 - DNA, 19 bp, Homo sapiens
aaagcagaggagcatctga

SEQ ID NO: 9180924 - DNA, 22 bp, Homo sapiens
aaagcagaggtgatatgactta

SEQ ID NO: 9180925 - DNA, 22 bp, Homo sapiens
aaagcagaggttgcagtgagct

SEQ ID NO: 9180926 - DNA, 22 bp, Homo sapiens
aaagcagaggttgcagtgagct

SEQ ID NO: 9180927 - DNA, 22 bp, Homo sapiens
aaagcagagcagggcacttatg

SEQ ID NO: 9180928 - DNA, 22 bp, Homo sapiens
aaagcagaactgagagagctgg

SEQ ID NO: 9180929 - DNA, 22 bp, Homo sapiens
aaagcacttgaaatctggcagt

SEQ ID NO: 9180930 - DNA, 22 bp, Homo sapiens
aacactttcctgcctttctgat

SEQ ID NO: 9180931 - DNA, 22 bp, Homo sapiens
aaagcccatgtggaagtacagg

SEQ ID NO: 9180932 - DNA, 22 bp, Homo sapiens
aacatagacccagttcaacaaa

SEQ ID NO: 9180933 - DNA, 23 bp, Homo sapiens
aacatagcattccattcattagt

SEQ ID NO: 9180934 - DNA, 22 bp, Homo sapiens
aacatagagacaggaagtgctt

SEQ ID NO: 9180935 - DNA, 22 bp, Homo sapiens
aacatataaactcttaagttca

SEQ ID NO: 9180936 - DNA, 22 bp, Homo sapiens
aacatataaactcttaagttca

SEQ ID NO: 9180937 - DNA, 22 bp, Homo sapiens
aacatataaactcttaagttca

SEQ ID NO: 9180938 - DNA, 21 bp, Homo sapiens
aaagatgtttcttttcctcac

SEQ ID NO: 9180939 - DNA, 22 bp, Homo sapiens
aaagatgttttataagttatgg

SEQ ID NO: 9180940 - DNA, 22 bp, Homo sapiens
aaagatgttttataagttatgg

SEQ ID NO: 9180941 - DNA, 22 bp, Homo sapiens
aaagattaaatcaaattggtca

SEQ ID NO: 9180942 - DNA, 22 bp, Homo sapiens
aaagattagataagatagattt

SEQ ID NO: 9180943 - DNA, 22 bp, Homo sapiens
aaagattaggcggcaactgggc

SEQ ID NO: 9180944 - DNA, 22 bp, Homo sapiens
aaagattatggcattgaaatac

SEQ ID NO: 9180945 - DNA, 22 bp, Homo sapiens
aaagatttgagttctgcttata

SEQ ID NO: 9180946 - DNA, 22 bp, Homo sapiens
aaagatttgagttctgcttata

SEQ ID NO: 9180947 - DNA, 22 bp, Homo sapiens
aaagatttgagttctgcttata

SEQ ID NO: 9180948 - DNA, 22 bp, Homo sapiens
aaagatttatgaagttcaatta

SEQ ID NO: 9180949 - DNA, 22 bp, Homo sapiens
aaagatttcagaagcctgtgcc

SEQ ID NO: 9180950 - DNA, 22 bp, Homo sapiens
aaagatttcagaagcctgtgcc

SEQ ID NO: 9180951 - DNA, 22 bp, Homo sapiens
aaagatttaagaataatttgtg

SEQ ID NO: 9180952 - DNA, 22 bp, Homo sapiens
aaagatttatgaagttcaatta

SEQ ID NO: 9180953 - DNA, 22 bp, Homo sapiens
aaagatttaagaataatttgtg

SEQ ID NO: 9180954 - DNA, 22 bp, Homo sapiens
aaagattatggcattgaaatac

SEQ ID NO: 9180955 - DNA, 22 bp, Homo sapiens
aacacttatccacatttgaaag

SEQ ID NO: 9180956 - DNA, 22 bp, Homo sapiens
aacacttcccatcagagggaca

SEQ ID NO: 9180957 - DNA, 22 bp, Homo sapiens
aacacttctgttgataataagc

SEQ ID NO: 9180958 - DNA, 22 bp, Homo sapiens
aacactgtggtcttttcagtaa

SEQ ID NO: 9180959 - DNA, 22 bp, Homo sapiens
aacactgtcttatacttcaatg

SEQ ID NO: 9180960 - DNA, 22 bp, Homo sapiens
aaagcaaacagaaccccaagct

SEQ ID NO: 9180961 - DNA, 23 bp, Homo sapiens
aaagcaaggaattggcaacagag

SEQ ID NO: 9180962 - DNA, 22 bp, Homo sapiens
aacactgtcagcctttgatgga

SEQ ID NO: 9180963 - DNA, 22 bp, Homo sapiens
aacacattttgcctaggcaata

SEQ ID NO: 9180964 - DNA, 23 bp, Homo sapiens
aacaccaaggctcagagagataa

SEQ ID NO: 9180965 - DNA, 22 bp, Homo sapiens
aagacagagggaagcaatgatg

SEQ ID NO: 9180966 - DNA, 22 bp, Homo sapiens
aaagtctttctcattggccatg

SEQ ID NO: 9180967 - DNA, 22 bp, Homo sapiens
aagaacatggtaggataacaaa

SEQ ID NO: 9180968 - DNA, 22 bp, Homo sapiens
aaagtgacaaccatttattaag

SEQ ID NO: 9180969 - DNA, 22 bp, Homo sapiens
aagaacatgagttatgatgatt

SEQ ID NO: 9180970 - DNA, 22 bp, Homo sapiens
aagaacatgctataattatctt

SEQ ID NO: 9180971 - DNA, 22 bp, Homo sapiens
aagaacatgctataattatctt

SEQ ID NO: 9180972 - DNA, 22 bp, Homo sapiens
aagaacatgctataattatctt

SEQ ID NO: 9180973 - DNA, 22 bp, Homo sapiens
aagaacatgggtgtgggcattc

SEQ ID NO: 9180974 - DNA, 22 bp, Homo sapiens
aagaacatggtaggataacaaa

SEQ ID NO: 9180975 - DNA, 22 bp, Homo sapiens
aagactgagttcaaatcacagc

SEQ ID NO: 9180976 - DNA, 22 bp, Homo sapiens
aagactgtatgagacaatataa

SEQ ID NO: 9180977 - DNA, 22 bp, Homo sapiens
aagactgtacattttccagtct

SEQ ID NO: 9180978 - DNA, 22 bp, Homo sapiens
aagactgtacattttccagtct

SEQ ID NO: 9180979 - DNA, 22 bp, Homo sapiens
aagactgtgtctatggctactc

SEQ ID NO: 9180980 - DNA, 22 bp, Homo sapiens
aagactgtctgggacaagatga

SEQ ID NO: 9180981 - DNA, 22 bp, Homo sapiens
aagactgtcttttctgagtgac

SEQ ID NO: 9180982 - DNA, 22 bp, Homo sapiens
aagactcaaggaacaacacagt

SEQ ID NO: 9180983 - DNA, 22 bp, Homo sapiens
aagactataccatcttagttac

SEQ ID NO: 9180984 - DNA, 22 bp, Homo sapiens
aagacctgccagcctcatcctg

SEQ ID NO: 9180985 - DNA, 22 bp, Homo sapiens
aagaccctatactcagtgaccc

SEQ ID NO: 9180986 - DNA, 22 bp, Homo sapiens
aagacccttctctgaggaggaa

SEQ ID NO: 9180987 - DNA, 22 bp, Homo sapiens
aagacctctgaggtagaagttc

SEQ ID NO: 9180988 - DNA, 18 bp, Homo sapiens
aagaggaggagcaggttg

SEQ ID NO: 9180989 - DNA, 22 bp, Homo sapiens
aagaggaggatgctttacagct

SEQ ID NO: 9180990 - DNA, 22 bp, Homo sapiens
aagagggagggcaaaggcactg

SEQ ID NO: 9180991 - DNA, 22 bp, Homo sapiens
aagagggagggcaaaggcactg

SEQ ID NO: 9180992 - DNA, 22 bp, Homo sapiens
aagagggaaattgttggctgct

SEQ ID NO: 9180993 - DNA, 22 bp, Homo sapiens
aagagggaagtcacctggaggt

SEQ ID NO: 9180994 - DNA, 22 bp, Homo sapiens
aagagggcagcacaggtgggtc

SEQ ID NO: 9180995 - DNA, 22 bp, Homo sapiens
aagagggaggtgcgggtgcaga

SEQ ID NO: 9180996 - DNA, 22 bp, Homo sapiens
aaagtttgttatatgataagga

SEQ ID NO: 9180997 - DNA, 17 bp, Homo sapiens
aagaggtaactgtacta

SEQ ID NO: 9180998 - DNA, 22 bp, Homo sapiens
aaatacatttacagtcgtggct

SEQ ID NO: 9180999 - DNA, 23 bp, Homo sapiens
aaatacctgaattagatattatc

SEQ ID NO: 9181000 - DNA, 23 bp, Homo sapiens
aaatacctgaattagatattatc

SEQ ID NO: 9181001 - DNA, 22 bp, Homo sapiens
aaatactagaattcagagttga

SEQ ID NO: 9181002 - DNA, 22 bp, Homo sapiens
aaatactctcaataaagaaagt

SEQ ID NO: 9181003 - DNA, 22 bp, Homo sapiens
aaatactcatcccaggaactgg

SEQ ID NO: 9181004 - DNA, 22 bp, Homo sapiens
aaatactagaattcagagttga

SEQ ID NO: 9181005 - DNA, 22 bp, Homo sapiens
aaatactattgaccaggtctct

SEQ ID NO: 9181006 - DNA, 22 bp, Homo sapiens
aaatactggcaagtgctaattc

SEQ ID NO: 9181007 - DNA, 22 bp, Homo sapiens
aaatactggcaagtgctaattc

SEQ ID NO: 9181008 - DNA, 22 bp, Homo sapiens
aaatactgctgctattcctttt

SEQ ID NO: 9181009 - DNA, 19 bp, Homo sapiens
aaatactgaagttgttcat

SEQ ID NO: 9181010 - DNA, 22 bp, Homo sapiens
aagataaactcttgatttctga

SEQ ID NO: 9181011 - DNA, 22 bp, Homo sapiens
aagataaactcttgatttctga

SEQ ID NO: 9181012 - DNA, 22 bp, Homo sapiens
aagataaactcttgatttctga

SEQ ID NO: 9181013 - DNA, 21 bp, Homo sapiens
aaatactgggcagtgacttga

SEQ ID NO: 9181014 - DNA, 21 bp, Homo sapiens
aaatactgggcagtgacttga

SEQ ID NO: 9181015 - DNA, 22 bp, Homo sapiens
aaatactgggctcaaaagggtt

SEQ ID NO: 9181016 - DNA, 22 bp, Homo sapiens
aagatcctgtactttcctcact

SEQ ID NO: 9181017 - DNA, 22 bp, Homo sapiens
aagatccatgggaatgtttggc

SEQ ID NO: 9181018 - DNA, 22 bp, Homo sapiens
aagatgtttagatttatacaat

SEQ ID NO: 9181019 - DNA, 22 bp, Homo sapiens
aagatgtttaggtaaaaagttt

SEQ ID NO: 9181020 - DNA, 22 bp, Homo sapiens
aagatattttagaacattcact

SEQ ID NO: 9181021 - DNA, 22 bp, Homo sapiens
aagatattttagaacattcact

SEQ ID NO: 9181022 - DNA, 22 bp, Homo sapiens
aagatattcaaagatttattag

SEQ ID NO: 9181023 - DNA, 22 bp, Homo sapiens
aagatattcaaagatttattag

SEQ ID NO: 9181024 - DNA, 22 bp, Homo sapiens
aagatcagaactttatacagga

SEQ ID NO: 9181025 - DNA, 22 bp, Homo sapiens
aagatcagctcccgagtctgag

SEQ ID NO: 9181026 - DNA, 22 bp, Homo sapiens
aagatcaagtgtactttatgta

SEQ ID NO: 9181027 - DNA, 14 bp, Homo sapiens
aagatcaccttcct

SEQ ID NO: 9181028 - DNA, 22 bp, Homo sapiens
aagcaggagagcctgggtgagc

SEQ ID NO: 9181029 - DNA, 22 bp, Homo sapiens
aagcaggagagcctgggtgagc

SEQ ID NO: 9181030 - DNA, 22 bp, Homo sapiens
aagcaggagagcctgggcgagc

SEQ ID NO: 9181031 - DNA, 22 bp, Homo sapiens
aagcaggagagcctgggcgagc

SEQ ID NO: 9181032 - DNA, 22 bp, Homo sapiens
aagcaggagatgcaggaatgta

SEQ ID NO: 9181033 - DNA, 22 bp, Homo sapiens
aagcaggagatgggtgcttttc

SEQ ID NO: 9181034 - DNA, 22 bp, Homo sapiens
aagcaggatggaggttgagtta

SEQ ID NO: 9181035 - DNA, 22 bp, Homo sapiens
aagcaggagatgggtgcttttc

SEQ ID NO: 9181036 - DNA, 22 bp, Homo sapiens
aagcaggatggaggttgagtta

SEQ ID NO: 9181037 - DNA, 22 bp, Homo sapiens
aagcaggatggatctagtgttc

SEQ ID NO: 9181038 - DNA, 22 bp, Homo sapiens
aagattatggcagataacaatt

SEQ ID NO: 9181039 - DNA, 22 bp, Homo sapiens
aagattatggcagataacaatt

SEQ ID NO: 9181040 - DNA, 22 bp, Homo sapiens
aagattcacagagtgaatgaaa

SEQ ID NO: 9181041 - DNA, 22 bp, Homo sapiens
aagattatttaagacaggaacc

SEQ ID NO: 9181042 - DNA, 22 bp, Homo sapiens
aagcagcatatgacagcatcca

SEQ ID NO: 9181043 - DNA, 22 bp, Homo sapiens
aagcagcatagctcccttagtt

SEQ ID NO: 9181044 - DNA, 22 bp, Homo sapiens
aagcagcatatgacagcatcca

SEQ ID NO: 9181045 - DNA, 22 bp, Homo sapiens
aagcagcatatgacagcatcca

SEQ ID NO: 9181046 - DNA, 22 bp, Homo sapiens
aagcagcatatgacagcatcca

SEQ ID NO: 9181047 - DNA, 22 bp, Homo sapiens
aagcaggccctgggccagggga

SEQ ID NO: 9181048 - DNA, 22 bp, Homo sapiens
aagcaggccctgggccagggga

SEQ ID NO: 9181049 - DNA, 22 bp, Homo sapiens
aagcaggcattccagagacaat

SEQ ID NO: 9181050 - DNA, 22 bp, Homo sapiens
aaatctcaggcctctatttact

SEQ ID NO: 9181051 - DNA, 22 bp, Homo sapiens
aagcccagatgtgagaactgag

SEQ ID NO: 9181052 - DNA, 22 bp, Homo sapiens
aagcccagatgagatccctgga

SEQ ID NO: 9181053 - DNA, 22 bp, Homo sapiens
aaatcttcctgaaatttgttca

SEQ ID NO: 9181054 - DNA, 22 bp, Homo sapiens
aaatctgtttcaggtatatttg

SEQ ID NO: 9181055 - DNA, 22 bp, Homo sapiens
aaatctggttcagtaagtcctc

SEQ ID NO: 9181056 - DNA, 22 bp, Homo sapiens
aaatctggccccttgcctattt

SEQ ID NO: 9181057 - DNA, 22 bp, Homo sapiens
aaatctctggtcacagaactta

SEQ ID NO: 9181058 - DNA, 22 bp, Homo sapiens
aaatctctggcagaaataaact

SEQ ID NO: 9181059 - DNA, 22 bp, Homo sapiens
aagcctggcacattggagtctg

SEQ ID NO: 9181060 - DNA, 22 bp, Homo sapiens
aagcctcaccttttagaagcta

SEQ ID NO: 9181061 - DNA, 22 bp, Homo sapiens
aagcctgagcaacctgctggcg

SEQ ID NO: 9181062 - DNA, 22 bp, Homo sapiens
aagcctgagggtgttgctagat

SEQ ID NO: 9181063 - DNA, 22 bp, Homo sapiens
aaatgcatgtagaataatagag

SEQ ID NO: 9181064 - DNA, 22 bp, Homo sapiens
aagcctaaatgatgctattatg

SEQ ID NO: 9181065 - DNA, 21 bp, Homo sapiens
aagcctcaagcagaagacaga

SEQ ID NO: 9181066 - DNA, 22 bp, Homo sapiens
aagcctagcactgaggaaaaga

SEQ ID NO: 9181067 - DNA, 22 bp, Homo sapiens
aagccggctgggccgaggctgc

SEQ ID NO: 9181068 - DNA, 22 bp, Homo sapiens
aagccggctgggccgaggctgc

SEQ ID NO: 9181069 - DNA, 22 bp, Homo sapiens
aagccggctgggccgaggctgc

SEQ ID NO: 9181070 - DNA, 22 bp, Homo sapiens
aagccggctgggccgaggctgc

SEQ ID NO: 9181071 - DNA, 22 bp, Homo sapiens
aagcccttggcgcacaccgggc

SEQ ID NO: 9181072 - DNA, 22 bp, Homo sapiens
aagccctgttctttctctcacc

SEQ ID NO: 9181073 - DNA, 22 bp, Homo sapiens
aagccctgtccggggggaagaa

SEQ ID NO: 9181074 - DNA, 22 bp, Homo sapiens
aagccctgtcaccctgacttca

SEQ ID NO: 9181075 - DNA, 22 bp, Homo sapiens
aagccctgtcaccctgacttca

SEQ ID NO: 9181076 - DNA, 22 bp, Homo sapiens
aagccctgtaaattgcccttaa

SEQ ID NO: 9181077 - DNA, 22 bp, Homo sapiens
aagccctggggttgcacaaggc

SEQ ID NO: 9181078 - DNA, 22 bp, Homo sapiens
aagccctgttctttctctcacc

SEQ ID NO: 9181079 - DNA, 22 bp, Homo sapiens
aagccctgttaggcactgggga

SEQ ID NO: 9181080 - DNA, 22 bp, Homo sapiens
aagccctgttaggcactgggga

SEQ ID NO: 9181081 - DNA, 22 bp, Homo sapiens
aaaatattttagggccaggaga

SEQ ID NO: 9181082 - DNA, 22 bp, Homo sapiens
aaactgcacatgaggctggtgc

SEQ ID NO: 9181083 - DNA, 22 bp, Homo sapiens
aaactgcacacgatgtgcctga

SEQ ID NO: 9181084 - DNA, 22 bp, Homo sapiens
aaactgcacaagggtgcatagc

SEQ ID NO: 9181085 - DNA, 22 bp, Homo sapiens
aaaatattttagggccaggaga

SEQ ID NO: 9181086 - DNA, 20 bp, Homo sapiens
aaaatatgtataactcttct

SEQ ID NO: 9181087 - DNA, 22 bp, Homo sapiens
aaactggtaataaaatggatta

SEQ ID NO: 9181088 - DNA, 22 bp, Homo sapiens
aaactggtaatcggcaagtgag

SEQ ID NO: 9181089 - DNA, 22 bp, Homo sapiens
aaactggtagcaatttaagggt

SEQ ID NO: 9181090 - DNA, 18 bp, Homo sapiens
aaactggcttggcctgtg

SEQ ID NO: 9181091 - DNA, 22 bp, Homo sapiens
aaactgctttccacagtggcta

SEQ ID NO: 9181092 - DNA, 22 bp, Homo sapiens
aaactgctgggcatatatttct

SEQ ID NO: 9181093 - DNA, 22 bp, Homo sapiens
aaactgctgggcatatatttct

SEQ ID NO: 9181094 - DNA, 22 bp, Homo sapiens
aaactgcctcctgggcaactaa

SEQ ID NO: 9181095 - DNA, 22 bp, Homo sapiens
aaactgccacaagagggacatc

SEQ ID NO: 9181096 - DNA, 22 bp, Homo sapiens
aaactgctggttgctggccagc

SEQ ID NO: 9181097 - DNA, 23 bp, Homo sapiens
aaactgcttccaattcctgccat

SEQ ID NO: 9181098 - DNA, 22 bp, Homo sapiens
aaactgcagagccatggttcaa

SEQ ID NO: 9181099 - DNA, 22 bp, Homo sapiens
aaactgcaggtcatgacccatt

SEQ ID NO: 9181100 - DNA, 22 bp, Homo sapiens
aaactgccaaaagaccttggat

SEQ ID NO: 9181101 - DNA, 23 bp, Homo sapiens
aaactgcatctctgagcctcagc

SEQ ID NO: 9181102 - DNA, 22 bp, Homo sapiens
aaaatactgtggagtgttgaaa

SEQ ID NO: 9181103 - DNA, 22 bp, Homo sapiens
aaaatactgtggagtgttgaaa

SEQ ID NO: 9181104 - DNA, 22 bp, Homo sapiens
aaaatactgtggagtgttgaaa

SEQ ID NO: 9181105 - DNA, 22 bp, Homo sapiens
aaaatactgtggagtgttgaaa

SEQ ID NO: 9181106 - DNA, 22 bp, Homo sapiens
aaaatatgactgtgctccttaa

SEQ ID NO: 9181107 - DNA, 22 bp, Homo sapiens
aaaatatgaagttgtcagtatg

SEQ ID NO: 9181108 - DNA, 22 bp, Homo sapiens
aaaatatggggtgagcccagag

SEQ ID NO: 9181109 - DNA, 22 bp, Homo sapiens
aaaatatggggtgagcccagag

SEQ ID NO: 9181110 - DNA, 20 bp, Homo sapiens
aaaatatgtataactcttct

SEQ ID NO: 9181111 - DNA, 22 bp, Homo sapiens
aaacagtagaagtgtattttat

SEQ ID NO: 9181112 - DNA, 22 bp, Homo sapiens
aaacagtactcgatttttgtag

SEQ ID NO: 9181113 - DNA, 22 bp, Homo sapiens
aaacaggagttgaccaagtaca

SEQ ID NO: 9181114 - DNA, 22 bp, Homo sapiens
aaacaggcacatagtaacattt

SEQ ID NO: 9181115 - DNA, 22 bp, Homo sapiens
aaacaggagttgaccaagtaca

SEQ ID NO: 9181116 - DNA, 19 bp, Homo sapiens
aaacaggccgagtgcctaa

SEQ ID NO: 9181117 - DNA, 22 bp, Homo sapiens
aaacaggcatcactcagcaaag

SEQ ID NO: 9181118 - DNA, 22 bp, Homo sapiens
aaacaggcatcactcagcaaag

SEQ ID NO: 9181119 - DNA, 22 bp, Homo sapiens
aaacaggcttgcaacatgtttt

SEQ ID NO: 9181120 - DNA, 22 bp, Homo sapiens
aaacaggcttgcaacatgtttt

SEQ ID NO: 9181121 - DNA, 22 bp, Homo sapiens
aaacaggcttttaagtcaatag

SEQ ID NO: 9181122 - DNA, 22 bp, Homo sapiens
aaacaggctctgcgggatgctc

SEQ ID NO: 9181123 - DNA, 22 bp, Homo sapiens
aaacaggcgcttactaagaaaa

SEQ ID NO: 9181124 - DNA, 22 bp, Homo sapiens
aaacaggcttccattagagcaa

SEQ ID NO: 9181125 - DNA, 22 bp, Homo sapiens
aaacaggcttatattttgctct

SEQ ID NO: 9181126 - DNA, 22 bp, Homo sapiens
aaaattgaagtgatcaggaact

SEQ ID NO: 9181127 - DNA, 22 bp, Homo sapiens
aaaattctgtcattaaattgtg

SEQ ID NO: 9181128 - DNA, 17 bp, Homo sapiens
aaaattctgtaaagagg

SEQ ID NO: 9181129 - DNA, 17 bp, Homo sapiens
aaaattctgtaaagagg

SEQ ID NO: 9181130 - DNA, 22 bp, Homo sapiens
aaaattctcttgatcttgacag

SEQ ID NO: 9181131 - DNA, 22 bp, Homo sapiens
aaaattgaggctcatgttaaat

SEQ ID NO: 9181132 - DNA, 19 bp, Homo sapiens
aaaattgcgtattttgagg

SEQ ID NO: 9181133 - DNA, 19 bp, Homo sapiens
aaaattgcgtattttgagg

SEQ ID NO: 9181134 - DNA, 22 bp, Homo sapiens
aaagagctaacattgccgagat

SEQ ID NO: 9181135 - DNA, 22 bp, Homo sapiens
aaagagctaacattgccgagat

SEQ ID NO: 9181136 - DNA, 22 bp, Homo sapiens
aaagagcccttccatgactctt

SEQ ID NO: 9181137 - DNA, 22 bp, Homo sapiens
aaaattggttcctttctgaggc

SEQ ID NO: 9181138 - DNA, 22 bp, Homo sapiens
aaacacatcattcatgtcgtca

SEQ ID NO: 9181139 - DNA, 22 bp, Homo sapiens
aaacacatcattcatgtcgtca

SEQ ID NO: 9181140 - DNA, 22 bp, Homo sapiens
aaagagctgggacttaaagtgc

SEQ ID NO: 9181141 - DNA, 22 bp, Homo sapiens
aaagagctgggacttaaagtgc

SEQ ID NO: 9181142 - DNA, 22 bp, Homo sapiens
aaagagcttcatttccatttat

SEQ ID NO: 9181143 - DNA, 22 bp, Homo sapiens
aaagagcttcatttccatttat

SEQ ID NO: 9181144 - DNA, 22 bp, Homo sapiens
aaagagcttcatttccatttat

SEQ ID NO: 9181145 - DNA, 22 bp, Homo sapiens
aaagagcttgcttgctttatat

SEQ ID NO: 9181146 - DNA, 22 bp, Homo sapiens
aaagagctcacagtccactgga

SEQ ID NO: 9181147 - DNA, 22 bp, Homo sapiens
aaagagctatacaaccatgtcc

SEQ ID NO: 9181148 - DNA, 22 bp, Homo sapiens
aaagagctcacagtccactgga

SEQ ID NO: 9181149 - DNA, 22 bp, Homo sapiens
aaagagctcggaaagtgttgaa

SEQ ID NO: 9181150 - DNA, 22 bp, Homo sapiens
aaagagctcggaaagtgttgaa

SEQ ID NO: 9181151 - DNA, 22 bp, Homo sapiens
aaagagctgatagcatctgttt

SEQ ID NO: 9181152 - DNA, 22 bp, Homo sapiens
aaagagctggcatttatagtct

SEQ ID NO: 9181153 - DNA, 22 bp, Homo sapiens
aaagagctggcatttatagtct

SEQ ID NO: 9181154 - DNA, 22 bp, Homo sapiens
aaagagctcttactctagtgta

SEQ ID NO: 9181155 - DNA, 22 bp, Homo sapiens
aaagagctgagacctggtggag

SEQ ID NO: 9181156 - DNA, 22 bp, Homo sapiens
aaagagctgatagcatctgttt

SEQ ID NO: 9181157 - DNA, 22 bp, Homo sapiens
aaacacaagatggcctcttctg

SEQ ID NO: 9181158 - DNA, 22 bp, Homo sapiens
aaacacattagccctgtggaaa

SEQ ID NO: 9181159 - DNA, 22 bp, Homo sapiens
aaacacattttaggaaaatcta

SEQ ID NO: 9181160 - DNA, 22 bp, Homo sapiens
aaacaccaagagctagctatta

SEQ ID NO: 9181161 - DNA, 22 bp, Homo sapiens
aaacaccaagagctagctatta

SEQ ID NO: 9181162 - DNA, 22 bp, Homo sapiens
aaacactagcaggaagcactga

SEQ ID NO: 9181163 - DNA, 22 bp, Homo sapiens
aaaaggaggtcactttattcct

SEQ ID NO: 9181164 - DNA, 22 bp, Homo sapiens
aaaaggaggtcactttattcct

SEQ ID NO: 9181165 - DNA, 22 bp, Homo sapiens
aaaaatacttcacttctgggtg

SEQ ID NO: 9181166 - DNA, 22 bp, Homo sapiens
aaaaatacttcacttctgggtg

SEQ ID NO: 9181167 - DNA, 22 bp, Homo sapiens
aaaaatacttcacttctgggtg

SEQ ID NO: 9181168 - DNA, 22 bp, Homo sapiens
aaaaatacttcacttctgggtg

SEQ ID NO: 9181169 - DNA, 22 bp, Homo sapiens
aaaaagtattggccatggttga

SEQ ID NO: 9181170 - DNA, 22 bp, Homo sapiens
aaaaagtattggccatggttga

SEQ ID NO: 9181171 - DNA, 22 bp, Homo sapiens
aaaaactgcaattacttttgtc

SEQ ID NO: 9181172 - DNA, 22 bp, Homo sapiens
aaaaactgcaattacttttgtc

SEQ ID NO: 9181173 - DNA, 22 bp, Homo sapiens
aaaaactgcaattacttttgtc

SEQ ID NO: 9181174 - DNA, 21 bp, Homo sapiens
aaaaagctggggcatgcatgc

SEQ ID NO: 9181175 - DNA, 22 bp, Homo sapiens
aaaaagcttaaatgagcagttc

SEQ ID NO: 9181176 - DNA, 22 bp, Homo sapiens
aaaaagcttaaatgagcagttc

SEQ ID NO: 9181177 - DNA, 22 bp, Homo sapiens
aaaaactgcaattacttttgtc

SEQ ID NO: 9181178 - DNA, 21 bp, Homo sapiens
aaaaagctggggcatgcatgc

SEQ ID NO: 9181179 - DNA, 21 bp, Homo sapiens
aaaaagctggggcatgcatgc

SEQ ID NO: 9181180 - DNA, 22 bp, Homo sapiens
aaaaagggatttgtgatccagg

SEQ ID NO: 9181181 - DNA, 22 bp, Homo sapiens
aaaaaggctaagcatcttgtgc

SEQ ID NO: 9181182 - DNA, 22 bp, Homo sapiens
aaaaagcttaaatgagcagttc

SEQ ID NO: 9181183 - DNA, 22 bp, Homo sapiens
aaaaaggctaagcatcttgtgc

SEQ ID NO: 9181184 - DNA, 22 bp, Homo sapiens
aaaaggcattttgtcaaccata

SEQ ID NO: 9181185 - DNA, 22 bp, Homo sapiens
aaaaggctaatccagagcaact

SEQ ID NO: 9181186 - DNA, 22 bp, Homo sapiens
aaaaggatgttttcatgaaaca

SEQ ID NO: 9181187 - DNA, 22 bp, Homo sapiens
aaaaggcatggaggttgatagt

SEQ ID NO: 9181188 - DNA, 22 bp, Homo sapiens
aaaaggcagtgcaagagagggt

SEQ ID NO: 9181189 - DNA, 22 bp, Homo sapiens
aaaaggcagtgcaagagagggt

SEQ ID NO: 9181190 - DNA, 22 bp, Homo sapiens
aaaactctgcagttagtttcta

SEQ ID NO: 9181191 - DNA, 22 bp, Homo sapiens
aaaaccttctagactttatatt

SEQ ID NO: 9181192 - DNA, 22 bp, Homo sapiens
aaaaccaggtagcaaaggagac

SEQ ID NO: 9181193 - DNA, 22 bp, Homo sapiens
aaaaccatgtatctatttcctt

SEQ ID NO: 9181194 - DNA, 22 bp, Homo sapiens
aaaaccaggcttgctgtgctcg

SEQ ID NO: 9181195 - DNA, 22 bp, Homo sapiens
aaaacccttctgcagactctga

SEQ ID NO: 9181196 - DNA, 22 bp, Homo sapiens
aaaacctgattgaattctattt

SEQ ID NO: 9181197 - DNA, 22 bp, Homo sapiens
aaaacctgattgaattctattt

SEQ ID NO: 9181198 - DNA, 22 bp, Homo sapiens
aaaaccttcaggtttggagttt

SEQ ID NO: 9181199 - DNA, 22 bp, Homo sapiens
aaaacctgtgaatagttaactc

SEQ ID NO: 9181200 - DNA, 22 bp, Homo sapiens
aaaattaagtgtctgggaagcc

SEQ ID NO: 9181201 - DNA, 22 bp, Homo sapiens
aaaattaagtgtctgggaagcc

SEQ ID NO: 9181202 - DNA, 22 bp, Homo sapiens
aaaattaagtgtctgggaagcc

SEQ ID NO: 9181203 - DNA, 22 bp, Homo sapiens
aaaattattcatggcttttgga

SEQ ID NO: 9181204 - DNA, 22 bp, Homo sapiens
aaaattattcatggcttttgga

SEQ ID NO: 9181205 - DNA, 22 bp, Homo sapiens
aaaattattcatggcttttgga

SEQ ID NO: 9181206 - DNA, 22 bp, Homo sapiens
aaaactttcagggatacagaaa

SEQ ID NO: 9181207 - DNA, 22 bp, Homo sapiens
aaaacttagctaggcaagtttt

SEQ ID NO: 9181208 - DNA, 22 bp, Homo sapiens
aaaactgcccagtcagtaagca

SEQ ID NO: 9181209 - DNA, 22 bp, Homo sapiens
aaaatgtgtttatgcatttcgt

SEQ ID NO: 9181210 - DNA, 22 bp, Homo sapiens
aaaatgttcaagcatgctggtt

SEQ ID NO: 9181211 - DNA, 21 bp, Homo sapiens
aaaatgtttccttgttggtta

SEQ ID NO: 9181212 - DNA, 21 bp, Homo sapiens
aaaatgtttccttgttggtta

SEQ ID NO: 9181213 - DNA, 22 bp, Homo sapiens
aaaagtaattgcagttttgtca

SEQ ID NO: 9181214 - DNA, 22 bp, Homo sapiens
aaaagtaattgcagtttttgcc

SEQ ID NO: 9181215 - DNA, 22 bp, Homo sapiens
aaaagtaattgcagttttgtca

SEQ ID NO: 9181216 - DNA, 22 bp, Homo sapiens
aaaagtaattgcagttttgtca

SEQ ID NO: 9181217 - DNA, 22 bp, Homo sapiens
aaaagtaattgcagttttcgcc

SEQ ID NO: 9181218 - DNA, 22 bp, Homo sapiens
aaaagtaattgcagttttgcca

SEQ ID NO: 9181219 - DNA, 22 bp, Homo sapiens
aaaagtaattgcagtttttgcc

SEQ ID NO: 9181220 - DNA, 22 bp, Homo sapiens
aaaagtaattgcggtttttgcc

SEQ ID NO: 9181221 - DNA, 22 bp, Homo sapiens
aaaagtaattgcggtttttgcc

SEQ ID NO: 9181222 - DNA, 22 bp, Homo sapiens
aaaagtaattgcggtttttgct

SEQ ID NO: 9181223 - DNA, 22 bp, Homo sapiens
aaaagtaattgcggtttttgct

SEQ ID NO: 9181224 - DNA, 22 bp, Homo sapiens
aaaagtaattgtggtttttgcc

SEQ ID NO: 9181225 - DNA, 22 bp, Homo sapiens
aaaagtaatcgcagtttttgcc

SEQ ID NO: 9181226 - DNA, 22 bp, Homo sapiens
aaaagtaattgatgcaatcgta

SEQ ID NO: 9181227 - DNA, 22 bp, Homo sapiens
aaaagtaatcgcagtttttgcc

SEQ ID NO: 9181228 - DNA, 22 bp, Homo sapiens
aaaagtaattgcaattttgtag

SEQ ID NO: 9181229 - DNA, 22 bp, Homo sapiens
aaaaggtagttgccaaataagg

SEQ ID NO: 9181230 - DNA, 19 bp, Homo sapiens
aaaaggagagatcagagtt

SEQ ID NO: 9181231 - DNA, 22 bp, Homo sapiens
aaatagttcagccacggtgact

SEQ ID NO: 9181232 - DNA, 22 bp, Homo sapiens
aaatagttagccctgcatatat

SEQ ID NO: 9181233 - DNA, 22 bp, Homo sapiens
aaatagttcagcttgtaaaccc

SEQ ID NO: 9181234 - DNA, 22 bp, Homo sapiens
aaatagttcagcttgtaaaccc

SEQ ID NO: 9181235 - DNA, 22 bp, Homo sapiens
aaatagttacttctgctgtctt

SEQ ID NO: 9181236 - DNA, 22 bp, Homo sapiens
aaactgtcctcccgaggtttcc

SEQ ID NO: 9181237 - DNA, 22 bp, Homo sapiens
aaatagtcctgggaatagtact

SEQ ID NO: 9181238 - DNA, 22 bp, Homo sapiens
aaatagttgtttggatcaataa

SEQ ID NO: 9181239 - DNA, 22 bp, Homo sapiens
aaatagtttagctctcatttca

SEQ ID NO: 9181240 - DNA, 22 bp, Homo sapiens
aaatagtttagctctcatttca

SEQ ID NO: 9181241 - DNA, 22 bp, Homo sapiens
aaatagtttagctctcatttca

SEQ ID NO: 9181242 - DNA, 22 bp, Homo sapiens
aaacttctctccctactttgtg

SEQ ID NO: 9181243 - DNA, 22 bp, Homo sapiens
aaacttctctccctactttgtg

SEQ ID NO: 9181244 - DNA, 22 bp, Homo sapiens
aaacttcattttcaactgcaaa

SEQ ID NO: 9181245 - DNA, 22 bp, Homo sapiens
aaactttgtagagaatgctggc

SEQ ID NO: 9181246 - DNA, 22 bp, Homo sapiens
aaactttgttcgtccagactca

SEQ ID NO: 9181247 - DNA, 22 bp, Homo sapiens
aaactttgttcgtctgatgtgg

SEQ ID NO: 9181248 - DNA, 22 bp, Homo sapiens
aaactttgttcgtctgatgtgg

SEQ ID NO: 9181249 - DNA, 22 bp, Homo sapiens
aaactttaggaaggaatttaca

SEQ ID NO: 9181250 - DNA, 22 bp, Homo sapiens
aaactttggtatgtagcaaaac

SEQ ID NO: 9181251 - DNA, 22 bp, Homo sapiens
aaactttggtatgtagcaaaac

SEQ ID NO: 9181252 - DNA, 22 bp, Homo sapiens
aaactttggattgtgattgtgc

SEQ ID NO: 9181253 - DNA, 22 bp, Homo sapiens
aaactttcatgtatctctttca

SEQ ID NO: 9181254 - DNA, 22 bp, Homo sapiens
aaactttggattgtgattgtgc

SEQ ID NO: 9181255 - DNA, 22 bp, Homo sapiens
aaagaaacctatcagccacatg

SEQ ID NO: 9181256 - DNA, 22 bp, Homo sapiens
aaagaaatacctttctcagctt

SEQ ID NO: 9181257 - DNA, 22 bp, Homo sapiens
aaagaaacctatcagccacatg

SEQ ID NO: 9181258 - DNA, 22 bp, Homo sapiens
aaacttttttaggttcataggc

SEQ ID NO: 9181259 - DNA, 22 bp, Homo sapiens
aaactttttcttaggtatgtct

SEQ ID NO: 9181260 - DNA, 22 bp, Homo sapiens
aaacttttggtcctcatgggtt

SEQ ID NO: 9181261 - DNA, 22 bp, Homo sapiens
aaagaaatacctttctcagctt

SEQ ID NO: 9181262 - DNA, 22 bp, Homo sapiens
aaagaaatacctttctcagctt

SEQ ID NO: 9181263 - DNA, 22 bp, Homo sapiens
aaagaaatagatggcatttaaa

SEQ ID NO: 9181264 - DNA, 22 bp, Homo sapiens
aaagaaatagatggcatttaaa

SEQ ID NO: 9181265 - DNA, 22 bp, Homo sapiens
aaagaaatagatggcatttaaa

SEQ ID NO: 9181266 - DNA, 22 bp, Homo sapiens
aaagaacaaatgatatatggtt

SEQ ID NO: 9181267 - DNA, 21 bp, Homo sapiens
aaagaaatctcccattggtag

SEQ ID NO: 9181268 - DNA, 21 bp, Homo sapiens
aaagaaatctcccattggtag

SEQ ID NO: 9181269 - DNA, 22 bp, Homo sapiens
aaagaaatagatggcatttaaa

SEQ ID NO: 9181270 - DNA, 21 bp, Homo sapiens
aaagaaatctcccattggtag

SEQ ID NO: 9181271 - DNA, 21 bp, Homo sapiens
aaagaaatctcccattggtag

SEQ ID NO: 9181272 - DNA, 22 bp, Homo sapiens
aaagatgttatgaaataactat

SEQ ID NO: 9181273 - DNA, 23 bp, Homo sapiens
aaagatgttcccaaagttcacgt

SEQ ID NO: 9181274 - DNA, 22 bp, Homo sapiens
aaagatgtgtaagaaataaaca

SEQ ID NO: 9181275 - DNA, 22 bp, Homo sapiens
aaagatgtgtaagaaataaaca

SEQ ID NO: 9181276 - DNA, 22 bp, Homo sapiens
aaagatcagtctgaagcaacat

SEQ ID NO: 9181277 - DNA, 22 bp, Homo sapiens
aaagatcagtctgaagcaacat

SEQ ID NO: 9181278 - DNA, 22 bp, Homo sapiens
aaagagaacttttacccaagaa

SEQ ID NO: 9181279 - DNA, 22 bp, Homo sapiens
aaagagaaacttagaagcctga

SEQ ID NO: 9181280 - DNA, 20 bp, Homo sapiens
aaagagaagcctcaccttgt

SEQ ID NO: 9181281 - DNA, 20 bp, Homo sapiens
aaagagaagcctcaccttgt

SEQ ID NO: 9181282 - DNA, 20 bp, Homo sapiens
aaagagaagcctcaccttgt

SEQ ID NO: 9181283 - DNA, 20 bp, Homo sapiens
aaagagaagcctcaccttgt

SEQ ID NO: 9181284 - DNA, 22 bp, Homo sapiens
aaagagaaaatgatctgtacat

SEQ ID NO: 9181285 - DNA, 22 bp, Homo sapiens
aaagagaaaatgatctgtacat

SEQ ID NO: 9181286 - DNA, 22 bp, Homo sapiens
aaagactttcacctagcaaaga

SEQ ID NO: 9181287 - DNA, 22 bp, Homo sapiens
aaagagaaacttagaagcctga

SEQ ID NO: 9181288 - DNA, 22 bp, Homo sapiens
aaagagaaacttagaagcctga

SEQ ID NO: 9181289 - DNA, 22 bp, Homo sapiens
aaagagaaacttagaagcctga

SEQ ID NO: 9181290 - DNA, 22 bp, Homo sapiens
aaagactttcacctagcaaaga

SEQ ID NO: 9181291 - DNA, 22 bp, Homo sapiens
aaagactttaggttagaggcat

SEQ ID NO: 9181292 - DNA, 22 bp, Homo sapiens
aaagacttggcttatgatttgc

SEQ ID NO: 9181293 - DNA, 22 bp, Homo sapiens
aaagacttgggagcagtatgct

SEQ ID NO: 9181294 - DNA, 22 bp, Homo sapiens
aaagacttgggtgaagtaattt

SEQ ID NO: 9181295 - DNA, 22 bp, Homo sapiens
aaagacttgggtgaagtaattt

SEQ ID NO: 9181296 - DNA, 23 bp, Homo sapiens
aaagactgaggaaagtctctgtc

SEQ ID NO: 9181297 - DNA, 22 bp, Homo sapiens
aaagactggttggggtgggcag

SEQ ID NO: 9181298 - DNA, 22 bp, Homo sapiens
aaagactgggactgcagcaggc

SEQ ID NO: 9181299 - DNA, 22 bp, Homo sapiens
aaagactggaaggtgaggctgt

SEQ ID NO: 9181300 - DNA, 22 bp, Homo sapiens
aaagactgggactgcagcaggc

SEQ ID NO: 9181301 - DNA, 22 bp, Homo sapiens
aaagaacaatgtggaatctcct

SEQ ID NO: 9181302 - DNA, 22 bp, Homo sapiens
aaagactcttaactccctagcg

SEQ ID NO: 9181303 - DNA, 22 bp, Homo sapiens
aaagactcaattgttccctaat

SEQ ID NO: 9181304 - DNA, 22 bp, Homo sapiens
aaagacatggaactagagatgg

SEQ ID NO: 9181305 - DNA, 22 bp, Homo sapiens
aaacattgatgggaagtttaat

SEQ ID NO: 9181306 - DNA, 22 bp, Homo sapiens
aaacattctcagccctgcttgc

SEQ ID NO: 9181307 - DNA, 22 bp, Homo sapiens
aaactgcaatgacaggtaggag

SEQ ID NO: 9181308 - DNA, 22 bp, Homo sapiens
aaactgtaagagaataaactac

SEQ ID NO: 9181309 - DNA, 22 bp, Homo sapiens
aaactgtaagagaataaactac

SEQ ID NO: 9181310 - DNA, 18 bp, Homo sapiens
aaactgtatttctttcta

SEQ ID NO: 9181311 - DNA, 22 bp, Homo sapiens
aaactgtatgttgagatgacag

SEQ ID NO: 9181312 - DNA, 22 bp, Homo sapiens
aaactgtatagggaaaagtaga

SEQ ID NO: 9181313 - DNA, 22 bp, Homo sapiens
aaactgtagtgcttcgatctga

SEQ ID NO: 9181314 - DNA, 22 bp, Homo sapiens
aaacatgtaattctgcttaaga

SEQ ID NO: 9181315 - DNA, 22 bp, Homo sapiens
aaacatgatgtcatatatgcca

SEQ ID NO: 9181316 - DNA, 22 bp, Homo sapiens
aaacatgatgtcatatatgcca

SEQ ID NO: 9181317 - DNA, 22 bp, Homo sapiens
aaacattcacatttgctagtaa

SEQ ID NO: 9181318 - DNA, 22 bp, Homo sapiens
aaacattagacaccatatgctc

SEQ ID NO: 9181319 - DNA, 20 bp, Homo sapiens
aaacattcatgtacaagtga

SEQ ID NO: 9181320 - DNA, 22 bp, Homo sapiens
aaacattccatttctatgtaag

SEQ ID NO: 9181321 - DNA, 22 bp, Homo sapiens
aaacagatgagttataatagcc

SEQ ID NO: 9181322 - DNA, 22 bp, Homo sapiens
aaacagcaatggagaagccagg

SEQ ID NO: 9181323 - DNA, 22 bp, Homo sapiens
aaacagcaattacttttgcacc

SEQ ID NO: 9181324 - DNA, 22 bp, Homo sapiens
aaacagcaatggagaagccagg

SEQ ID NO: 9181325 - DNA, 22 bp, Homo sapiens
aaacagcaatggagaagccagg

SEQ ID NO: 9181326 - DNA, 22 bp, Homo sapiens
aaacagcaggaacatcttgcca

SEQ ID NO: 9181327 - DNA, 22 bp, Homo sapiens
aaacagcagctgtttaatttgc

SEQ ID NO: 9181328 - DNA, 20 bp, Homo sapiens
aaacagctaaaccagctctc

SEQ ID NO: 9181329 - DNA, 22 bp, Homo sapiens
aaacagccatgtcagctttgca

SEQ ID NO: 9181330 - DNA, 22 bp, Homo sapiens
aaacagctaatggccaggaata

SEQ ID NO: 9181331 - DNA, 22 bp, Homo sapiens
aaacatgatgcctgtactaaga

SEQ ID NO: 9181332 - DNA, 22 bp, Homo sapiens
aaacatgatgcctgtactaaga

SEQ ID NO: 9181333 - DNA, 22 bp, Homo sapiens
aaacagctgcagtacacggcct

SEQ ID NO: 9181334 - DNA, 22 bp, Homo sapiens
aaacagctgggaggtagaggcg

SEQ ID NO: 9181335 - DNA, 22 bp, Homo sapiens
aaacagataagggacaatttca

SEQ ID NO: 9181336 - DNA, 22 bp, Homo sapiens
aaacactgtctctggtattgaa

SEQ ID NO: 9181337 - DNA, 22 bp, Homo sapiens
aaacagataagggacaatttca

SEQ ID NO: 9181338 - DNA, 22 bp, Homo sapiens
aaacagataagggacaatttca

SEQ ID NO: 9181339 - DNA, 22 bp, Homo sapiens
aaacagataatgctataaatgg

SEQ ID NO: 9181340 - DNA, 22 bp, Homo sapiens
aaacagataatgctataaatgg

SEQ ID NO: 9181341 - DNA, 22 bp, Homo sapiens
aaacactgtctctggtattgaa

SEQ ID NO: 9181342 - DNA, 22 bp, Homo sapiens
aaagccagctctgagctgcacc

SEQ ID NO: 9181343 - DNA, 22 bp, Homo sapiens
aaacactgaagacctatctggt

SEQ ID NO: 9181344 - DNA, 20 bp, Homo sapiens
aaagccactggcaagagact

SEQ ID NO: 9181345 - DNA, 22 bp, Homo sapiens
aaagccactgcatgtgtagtat

SEQ ID NO: 9181346 - DNA, 22 bp, Homo sapiens
aaacactgaagacctatctggt

SEQ ID NO: 9181347 - DNA, 22 bp, Homo sapiens
aaacactgaaaattttggtcat

SEQ ID NO: 9181348 - DNA, 22 bp, Homo sapiens
aaagccagaattcgtccagcct

SEQ ID NO: 9181349 - DNA, 22 bp, Homo sapiens
aaagccagagcaagctgtcaca

SEQ ID NO: 9181350 - DNA, 22 bp, Homo sapiens
aaagccagagtgtgttagagac

SEQ ID NO: 9181351 - DNA, 22 bp, Homo sapiens
aaagccagctctgagctgcacc

SEQ ID NO: 9181352 - DNA, 22 bp, Homo sapiens
aaagccagcaaggtgagtttca

SEQ ID NO: 9181353 - DNA, 23 bp, Homo sapiens
gtaaaatacgcagtgcagtgtga

SEQ ID NO: 9181354 - DNA, 22 bp, Homo sapiens
ggtgtcctcatgattttctaga

SEQ ID NO: 9181355 - DNA, 22 bp, Homo sapiens
gtaaaatagaataacgtggcta

SEQ ID NO: 9181356 - DNA, 22 bp, Homo sapiens
gtaaaatagaataacgtggcta

SEQ ID NO: 9181357 - DNA, 22 bp, Homo sapiens
gtaaacattttcatctgtgccc

SEQ ID NO: 9181358 - DNA, 22 bp, Homo sapiens
gtaaagtacatacatgaactca

SEQ ID NO: 9181359 - DNA, 22 bp, Homo sapiens
gtaaagaagtttttgaatgcat

SEQ ID NO: 9181360 - DNA, 22 bp, Homo sapiens
gtaaactgtgttaaaggttgac

SEQ ID NO: 9181361 - DNA, 22 bp, Homo sapiens
gtaaagaaggcaacctggttat

SEQ ID NO: 9181362 - DNA, 22 bp, Homo sapiens
gtaaactatgggctttggagga

SEQ ID NO: 9181363 - DNA, 22 bp, Homo sapiens
gtaaactgtccacatgtggcac

SEQ ID NO: 9181364 - DNA, 22 bp, Homo sapiens
gtaaactgtctactctgtgcta

SEQ ID NO: 9181365 - DNA, 22 bp, Homo sapiens
gtaaactgattgttggagttac

SEQ ID NO: 9181366 - DNA, 22 bp, Homo sapiens
gtacaggacatagacagagtag

SEQ ID NO: 9181367 - DNA, 22 bp, Homo sapiens
gtacagctaagaatttcatctt

SEQ ID NO: 9181368 - DNA, 22 bp, Homo sapiens
gtacaggatgtgtaaacttggg

SEQ ID NO: 9181369 - DNA, 22 bp, Homo sapiens
gtacaggatgtgtaaacttggg

SEQ ID NO: 9181370 - DNA, 22 bp, Homo sapiens
gtacaggccaccactgaatttt

SEQ ID NO: 9181371 - DNA, 21 bp, Homo sapiens
gtacacacaggtggatgggct

SEQ ID NO: 9181372 - DNA, 22 bp, Homo sapiens
gtacacacaatctctggtcagt

SEQ ID NO: 9181373 - DNA, 22 bp, Homo sapiens
gtaaataactggtaattggggt

SEQ ID NO: 9181374 - DNA, 22 bp, Homo sapiens
gtaaataactggtaattggggt

SEQ ID NO: 9181375 - DNA, 22 bp, Homo sapiens
gtaaataactggtaattggggt

SEQ ID NO: 9181376 - DNA, 22 bp, Homo sapiens
gtaaatataaatgctagctgcc

SEQ ID NO: 9181377 - DNA, 22 bp, Homo sapiens
gtaaatataaatgctagctgcc

SEQ ID NO: 9181378 - DNA, 22 bp, Homo sapiens
gtaaatattaaaggctgctaga

SEQ ID NO: 9181379 - DNA, 22 bp, Homo sapiens
gtaaatataaatgctagctgcc

SEQ ID NO: 9181380 - DNA, 22 bp, Homo sapiens
gtacatttactgatgaaaagta

SEQ ID NO: 9181381 - DNA, 22 bp, Homo sapiens
gtacatttactgatgaaaagta

SEQ ID NO: 9181382 - DNA, 22 bp, Homo sapiens
gtatacatagatgatgaacaag

SEQ ID NO: 9181383 - DNA, 22 bp, Homo sapiens
gtatacatttattacaggtctt

SEQ ID NO: 9181384 - DNA, 22 bp, Homo sapiens
gtatacatgtggtaaaatgcac

SEQ ID NO: 9181385 - DNA, 22 bp, Homo sapiens
gtatacatgtggtaaaatgcac

SEQ ID NO: 9181386 - DNA, 22 bp, Homo sapiens
gtatacatagatgatgaacaag

SEQ ID NO: 9181387 - DNA, 22 bp, Homo sapiens
gtacatctttaaattgttcagt

SEQ ID NO: 9181388 - DNA, 22 bp, Homo sapiens
gtacatgtatgagatatgtgta

SEQ ID NO: 9181389 - DNA, 22 bp, Homo sapiens
gtacatgtcaaaaaatgcataa

SEQ ID NO: 9181390 - DNA, 22 bp, Homo sapiens
gtacatgtgcacaacatgcatg

SEQ ID NO: 9181391 - DNA, 22 bp, Homo sapiens
gtacatgtgcacaatgtgcagg

SEQ ID NO: 9181392 - DNA, 19 bp, Homo sapiens
gtacagtggtaagctatga

SEQ ID NO: 9181393 - DNA, 22 bp, Homo sapiens
gtacataagaaattactacaga

SEQ ID NO: 9181394 - DNA, 22 bp, Homo sapiens
gtacataaaatactgccatgta

SEQ ID NO: 9181395 - DNA, 22 bp, Homo sapiens
gtacataattttcagccagttt

SEQ ID NO: 9181396 - DNA, 22 bp, Homo sapiens
gtatatcttcagaaattatagg

SEQ ID NO: 9181397 - DNA, 22 bp, Homo sapiens
gtatatatgtgtgaacatgtat

SEQ ID NO: 9181398 - DNA, 22 bp, Homo sapiens
gtatatcaccccaagcagctga

SEQ ID NO: 9181399 - DNA, 22 bp, Homo sapiens
gtatatcagacactcatatgta

SEQ ID NO: 9181400 - DNA, 22 bp, Homo sapiens
gtatatatgtgtgaacatgtat

SEQ ID NO: 9181401 - DNA, 22 bp, Homo sapiens
gtatagaaacccagaaagatag

SEQ ID NO: 9181402 - DNA, 22 bp, Homo sapiens
ggtgcaggacgaagtgggggtt

SEQ ID NO: 9181403 - DNA, 22 bp, Homo sapiens
ggtgatgtttgagttgagacag

SEQ ID NO: 9181404 - DNA, 22 bp, Homo sapiens
ggtggcagaggtgcatcagccc

SEQ ID NO: 9181405 - DNA, 22 bp, Homo sapiens
ggtgcaggagcggggtgctcgg

SEQ ID NO: 9181406 - DNA, 22 bp, Homo sapiens
gggtggggcccaggaaatctat

SEQ ID NO: 9181407 - DNA, 22 bp, Homo sapiens
gggtgggcctgtctggccatgt

SEQ ID NO: 9181408 - DNA, 22 bp, Homo sapiens
gggtggggcccaggaaatctat

SEQ ID NO: 9181409 - DNA, 22 bp, Homo sapiens
gggtggggtgtatcggatccta

SEQ ID NO: 9181410 - DNA, 22 bp, Homo sapiens
gggtggggttcaggaatcttca

SEQ ID NO: 9181411 - DNA, 22 bp, Homo sapiens
ggtgagggtaaatataggcaaa

SEQ ID NO: 9181412 - DNA, 22 bp, Homo sapiens
ggtgaggggcgcctctgcccgg

SEQ ID NO: 9181413 - DNA, 22 bp, Homo sapiens
ggtgaggggctcctctgcccgg

SEQ ID NO: 9181414 - DNA, 22 bp, Homo sapiens
ggtgaggggagagtgaaagaaa

SEQ ID NO: 9181415 - DNA, 22 bp, Homo sapiens
ggtgaggggcgcctctgcccag

SEQ ID NO: 9181416 - DNA, 22 bp, Homo sapiens
ggtgaggggcacctctgcccgg

SEQ ID NO: 9181417 - DNA, 21 bp, Homo sapiens
ggtgtccagaggagtccccag

SEQ ID NO: 9181418 - DNA, 22 bp, Homo sapiens
ggtgtccatcaggctgtgcttc

SEQ ID NO: 9181419 - DNA, 22 bp, Homo sapiens
ggtgtccattggcctaacctag

SEQ ID NO: 9181420 - DNA, 22 bp, Homo sapiens
ggtgtccacattccctggcagg

SEQ ID NO: 9181421 - DNA, 22 bp, Homo sapiens
ggtgtccactcagcccgtcctg

SEQ ID NO: 9181422 - DNA, 22 bp, Homo sapiens
ggtgtcagtgaaggtagagttt

SEQ ID NO: 9181423 - DNA, 22 bp, Homo sapiens
ggtgtcagttgctcatcagagt

SEQ ID NO: 9181424 - DNA, 22 bp, Homo sapiens
ggtgtagctctgtgtcccactg

SEQ ID NO: 9181425 - DNA, 22 bp, Homo sapiens
ggtgtatacctacacatttttg

SEQ ID NO: 9181426 - DNA, 22 bp, Homo sapiens
ggtgtatacctacacatttttg

SEQ ID NO: 9181427 - DNA, 22 bp, Homo sapiens
ggtgtcacaggaggccgtgtgg

SEQ ID NO: 9181428 - DNA, 22 bp, Homo sapiens
ggtgtcagaagtgggatattac

SEQ ID NO: 9181429 - DNA, 22 bp, Homo sapiens
ggtggttcacgcctataatccc

SEQ ID NO: 9181430 - DNA, 22 bp, Homo sapiens
ggtggccataggaccagcctgg

SEQ ID NO: 9181431 - DNA, 22 bp, Homo sapiens
ggtggcagttacaggggcaaat

SEQ ID NO: 9181432 - DNA, 22 bp, Homo sapiens
ggtggcagttacaggggcaaat

SEQ ID NO: 9181433 - DNA, 22 bp, Homo sapiens
gtatgtctgagtaataatgtgt

SEQ ID NO: 9181434 - DNA, 22 bp, Homo sapiens
gtatgtctatagtttttaaata

SEQ ID NO: 9181435 - DNA, 22 bp, Homo sapiens
gtatgtctatttcaaatagctg

SEQ ID NO: 9181436 - DNA, 22 bp, Homo sapiens
gtatgtgaggttggtttccagg

SEQ ID NO: 9181437 - DNA, 22 bp, Homo sapiens
gtatgtcttagggttcagtaac

SEQ ID NO: 9181438 - DNA, 18 bp, Homo sapiens
gtcagaggatggggaaat

SEQ ID NO: 9181439 - DNA, 22 bp, Homo sapiens
gtcagaggaggctgagtaggaa

SEQ ID NO: 9181440 - DNA, 22 bp, Homo sapiens
gtcagaggggacaagacacaga

SEQ ID NO: 9181441 - DNA, 20 bp, Homo sapiens
gtattacaggcttagaacca

SEQ ID NO: 9181442 - DNA, 22 bp, Homo sapiens
gtattacatttagtaattaggc

SEQ ID NO: 9181443 - DNA, 20 bp, Homo sapiens
gtattacaggcttagaacca

SEQ ID NO: 9181444 - DNA, 22 bp, Homo sapiens
gtattacaaataaatgttactg

SEQ ID NO: 9181445 - DNA, 22 bp, Homo sapiens
gtattacaaataaatgttactg

SEQ ID NO: 9181446 - DNA, 22 bp, Homo sapiens
gtcagaggggacaagacacaga

SEQ ID NO: 9181447 - DNA, 22 bp, Homo sapiens
gtcagctactgcagggaacttt

SEQ ID NO: 9181448 - DNA, 22 bp, Homo sapiens
gtcagctgcagtgggcacagcc

SEQ ID NO: 9181449 - DNA, 22 bp, Homo sapiens
gtcagctgcagtgggcacagcc

SEQ ID NO: 9181450 - DNA, 22 bp, Homo sapiens
gtcagctgcagtgggcacagcc

SEQ ID NO: 9181451 - DNA, 22 bp, Homo sapiens
gtcaggaaaacccgggttgact

SEQ ID NO: 9181452 - DNA, 22 bp, Homo sapiens
gtcaggaaaaattgataatttt

SEQ ID NO: 9181453 - DNA, 21 bp, Homo sapiens
gtcagctgtgtgtgaggaccc

SEQ ID NO: 9181454 - DNA, 21 bp, Homo sapiens
gtcagctgtgtgtgaggaccc

SEQ ID NO: 9181455 - DNA, 22 bp, Homo sapiens
gtcagctgggcatctgcagatg

SEQ ID NO: 9181456 - DNA, 22 bp, Homo sapiens
gtcagctgggcatctgcagatg

SEQ ID NO: 9181457 - DNA, 21 bp, Homo sapiens
gtcagctgtgtgtgaggaccc

SEQ ID NO: 9181458 - DNA, 22 bp, Homo sapiens
gtcaggattaatgggagtatgc

SEQ ID NO: 9181459 - DNA, 22 bp, Homo sapiens
gtcaggatgagggatgaggagt

SEQ ID NO: 9181460 - DNA, 22 bp, Homo sapiens
gtcaggaagcaaggttgggcat

SEQ ID NO: 9181461 - DNA, 22 bp, Homo sapiens
gtcaggaagtggcattggagaa

SEQ ID NO: 9181462 - DNA, 22 bp, Homo sapiens
gtcaggacaggctctggactga

SEQ ID NO: 9181463 - DNA, 22 bp, Homo sapiens
gtcaggattggggtcatgagtc

SEQ ID NO: 9181464 - DNA, 19 bp, Homo sapiens
gtcaggcacgtgagagcat

SEQ ID NO: 9181465 - DNA, 19 bp, Homo sapiens
gtcaggcacgtgagagcat

SEQ ID NO: 9181466 - DNA, 22 bp, Homo sapiens
gtcaggcagcctggagattcag

SEQ ID NO: 9181467 - DNA, 22 bp, Homo sapiens
gtcaggcatttaggatgagttc

SEQ ID NO: 9181468 - DNA, 22 bp, Homo sapiens
gtccagggccccgagcaccagg

SEQ ID NO: 9181469 - DNA, 22 bp, Homo sapiens
gtccagggctaaatcaggttcc

SEQ ID NO: 9181470 - DNA, 22 bp, Homo sapiens
gtccagggctaaatcaggttcc

SEQ ID NO: 9181471 - DNA, 22 bp, Homo sapiens
gtccagggggcttaagcaaact

SEQ ID NO: 9181472 - DNA, 22 bp, Homo sapiens
gtccatccggccacctccagcc

SEQ ID NO: 9181473 - DNA, 22 bp, Homo sapiens
gtccatccgtggtagcatggat

SEQ ID NO: 9181474 - DNA, 22 bp, Homo sapiens
gtccagttgtatgtccagtgtc

SEQ ID NO: 9181475 - DNA, 22 bp, Homo sapiens
gtccagtgtcttctacataaca

SEQ ID NO: 9181476 - DNA, 22 bp, Homo sapiens
gtcccagggaagaaggcagcac

SEQ ID NO: 9181477 - DNA, 22 bp, Homo sapiens
gtccattttattcagagacttt

SEQ ID NO: 9181478 - DNA, 18 bp, Homo sapiens
gtccatggcctccaccca

SEQ ID NO: 9181479 - DNA, 22 bp, Homo sapiens
gtccatctagaatttatttcta

SEQ ID NO: 9181480 - DNA, 22 bp, Homo sapiens
gtcccagggatgcagacatgag

SEQ ID NO: 9181481 - DNA, 22 bp, Homo sapiens
gtcccagggaggttcagggctt

SEQ ID NO: 9181482 - DNA, 22 bp, Homo sapiens
gtcccagggatgcagacatgag

SEQ ID NO: 9181483 - DNA, 22 bp, Homo sapiens
gtcccagggatgcagacatgag

SEQ ID NO: 9181484 - DNA, 22 bp, Homo sapiens
gtcccagggcaaggctgtttct

SEQ ID NO: 9181485 - DNA, 22 bp, Homo sapiens
gtcccagggccaccatatatag

SEQ ID NO: 9181486 - DNA, 22 bp, Homo sapiens
gtcccaggtgcccagtgggcag

SEQ ID NO: 9181487 - DNA, 22 bp, Homo sapiens
gtcccaggtgcccagtgggcag

SEQ ID NO: 9181488 - DNA, 22 bp, Homo sapiens
gtcccaggtcccagcacatctg

SEQ ID NO: 9181489 - DNA, 22 bp, Homo sapiens
gtcccaggtgcccagtgggcag

SEQ ID NO: 9181490 - DNA, 22 bp, Homo sapiens
gtccttcaagagtcccctactg

SEQ ID NO: 9181491 - DNA, 22 bp, Homo sapiens
gtcctgtgtgacttcccaaatg

SEQ ID NO: 9181492 - DNA, 22 bp, Homo sapiens
gtcctgggtccccgcaggtcag

SEQ ID NO: 9181493 - DNA, 22 bp, Homo sapiens
gtcctgggtccccgcaggtcag

SEQ ID NO: 9181494 - DNA, 22 bp, Homo sapiens
gtccttccccagccagctctgg

SEQ ID NO: 9181495 - DNA, 22 bp, Homo sapiens
gtccttcctgcagggatggatg

SEQ ID NO: 9181496 - DNA, 22 bp, Homo sapiens
gtccttccccagccagctctgg

SEQ ID NO: 9181497 - DNA, 22 bp, Homo sapiens
gtccttgcttgagacaggcagt

SEQ ID NO: 9181498 - DNA, 22 bp, Homo sapiens
gtccttcatttcctgatctcta

SEQ ID NO: 9181499 - DNA, 21 bp, Homo sapiens
gtccttcagcaagttagtggc

SEQ ID NO: 9181500 - DNA, 22 bp, Homo sapiens
gtccttcagcacctccctcggc

SEQ ID NO: 9181501 - DNA, 22 bp, Homo sapiens
gtccttcaaggtccttggtgtg

SEQ ID NO: 9181502 - DNA, 22 bp, Homo sapiens
gtccttcaagtaacctgggacc

SEQ ID NO: 9181503 - DNA, 20 bp, Homo sapiens
gtcgaaaaagataaacaggc

SEQ ID NO: 9181504 - DNA, 22 bp, Homo sapiens
gtcctttcttaaattcctgctt

SEQ ID NO: 9181505 - DNA, 22 bp, Homo sapiens
gtcggccacgcaggtgcggtag

SEQ ID NO: 9181506 - DNA, 22 bp, Homo sapiens
gtcggccacgcaggtgcggtag

SEQ ID NO: 9181507 - DNA, 22 bp, Homo sapiens
gtctgagactttttctgtgtgg

SEQ ID NO: 9181508 - DNA, 22 bp, Homo sapiens
gtctgaaagtagggctgatcta

SEQ ID NO: 9181509 - DNA, 22 bp, Homo sapiens
gtctgaaatggaggtgggaact

SEQ ID NO: 9181510 - DNA, 22 bp, Homo sapiens
gtctgaaacgcattgttatcga

SEQ ID NO: 9181511 - DNA, 22 bp, Homo sapiens
gtctgacacctagagtccagga

SEQ ID NO: 9181512 - DNA, 22 bp, Homo sapiens
gtctgaattctgtgtaactcta

SEQ ID NO: 9181513 - DNA, 19 bp, Homo sapiens
gtctctggatttcaggtcc

SEQ ID NO: 9181514 - DNA, 22 bp, Homo sapiens
gtctgaaaatgccctacgattg

SEQ ID NO: 9181515 - DNA, 22 bp, Homo sapiens
gtctgaaaatatgattttgcct

SEQ ID NO: 9181516 - DNA, 22 bp, Homo sapiens
gtctcttttatggtgagttgat

SEQ ID NO: 9181517 - DNA, 22 bp, Homo sapiens
gtctctgagctctgagctggct

SEQ ID NO: 9181518 - DNA, 22 bp, Homo sapiens
gtctgagcaccctggcctgtca

SEQ ID NO: 9181519 - DNA, 20 bp, Homo sapiens
gtctgaggagcagtgggaaa

SEQ ID NO: 9181520 - DNA, 22 bp, Homo sapiens
gtctgccatgtggagaaagcca

SEQ ID NO: 9181521 - DNA, 18 bp, Homo sapiens
gtctgccaacaactatca

SEQ ID NO: 9181522 - DNA, 22 bp, Homo sapiens
gtctgccagcaccataaattag

SEQ ID NO: 9181523 - DNA, 22 bp, Homo sapiens
gtctggagtggtggatttaaag

SEQ ID NO: 9181524 - DNA, 22 bp, Homo sapiens
gtctgcagagggaaggcttcag

SEQ ID NO: 9181525 - DNA, 22 bp, Homo sapiens
gtctgatatcagaaaaagtaaa

SEQ ID NO: 9181526 - DNA, 22 bp, Homo sapiens
gtctgaggtcattagctctctt

SEQ ID NO: 9181527 - DNA, 22 bp, Homo sapiens
gtctggctgtccagcttatcta

SEQ ID NO: 9181528 - DNA, 20 bp, Homo sapiens
gtctggcttcgtgattctgg

SEQ ID NO: 9181529 - DNA, 22 bp, Homo sapiens
gtctggctccgaggagtggcag

SEQ ID NO: 9181530 - DNA, 22 bp, Homo sapiens
gtctggccatttgcccattgtg

SEQ ID NO: 9181531 - DNA, 22 bp, Homo sapiens
gtctggcatatgcaaagtgcat

SEQ ID NO: 9181532 - DNA, 22 bp, Homo sapiens
gtctggcattcttcctggagaa

SEQ ID NO: 9181533 - DNA, 22 bp, Homo sapiens
gtctggctccaggatctcatga

SEQ ID NO: 9181534 - DNA, 22 bp, Homo sapiens
gtctggctcccactcttacaaa

SEQ ID NO: 9181535 - DNA, 22 bp, Homo sapiens
gtctgggacaggactggggaac

SEQ ID NO: 9181536 - DNA, 22 bp, Homo sapiens
gtctggctttgctcagatgctg

SEQ ID NO: 9181537 - DNA, 22 bp, Homo sapiens
gtctggctttatatttgctatt

SEQ ID NO: 9181538 - DNA, 22 bp, Homo sapiens
gtctgggcaggaatctgcattc

SEQ ID NO: 9181539 - DNA, 22 bp, Homo sapiens
gtctgggcagcagcatttctta

SEQ ID NO: 9181540 - DNA, 22 bp, Homo sapiens
gtctgggcagcagcatttctta

SEQ ID NO: 9181541 - DNA, 22 bp, Homo sapiens
gtctgggcatcagactgcgggc

SEQ ID NO: 9181542 - DNA, 22 bp, Homo sapiens
gtctgggccaggcgagccgagg

SEQ ID NO: 9181543 - DNA, 22 bp, Homo sapiens
gtctgggcaagggagatggcgc

SEQ ID NO: 9181544 - DNA, 22 bp, Homo sapiens
gtctgggcaagggagatggcgc

SEQ ID NO: 9181545 - DNA, 22 bp, Homo sapiens
gtctgggcacctggcctgggaa

SEQ ID NO: 9181546 - DNA, 22 bp, Homo sapiens
gtctgggctcctggcaggcagc

SEQ ID NO: 9181547 - DNA, 22 bp, Homo sapiens
gtctgggcttagggacatggca

SEQ ID NO: 9181548 - DNA, 22 bp, Homo sapiens
gtctgggcttcagagttagaga

SEQ ID NO: 9181549 - DNA, 22 bp, Homo sapiens
gtctgggcttagggacatggca

SEQ ID NO: 9181550 - DNA, 22 bp, Homo sapiens
gtctgggctcccagggtcggcg

SEQ ID NO: 9181551 - DNA, 17 bp, Homo sapiens
gtctgggctttagagac

SEQ ID NO: 9181552 - DNA, 22 bp, Homo sapiens
gtctggggaagtcagggcatca

SEQ ID NO: 9181553 - DNA, 22 bp, Homo sapiens
gtctggggaagtcagggcatca

SEQ ID NO: 9181554 - DNA, 22 bp, Homo sapiens
gtctgggggtccgggtgcctgc

SEQ ID NO: 9181555 - DNA, 22 bp, Homo sapiens
gtctggggcagcaaggcgcgcg

SEQ ID NO: 9181556 - DNA, 22 bp, Homo sapiens
gtggaggagaggcgccttgcgg

SEQ ID NO: 9181557 - DNA, 22 bp, Homo sapiens
gtggaggacaaaagaagccttt

SEQ ID NO: 9181558 - DNA, 18 bp, Homo sapiens
gtggagggttctcagaat

SEQ ID NO: 9181559 - DNA, 22 bp, Homo sapiens
gtggagggtttgcaatgtgcag

SEQ ID NO: 9181560 - DNA, 22 bp, Homo sapiens
gtggagggtgattgccggctgt

SEQ ID NO: 9181561 - DNA, 22 bp, Homo sapiens
gtggaggtcccgggcaggagca

SEQ ID NO: 9181562 - DNA, 22 bp, Homo sapiens
gtggaggtcccgggcaggagca

SEQ ID NO: 9181563 - DNA, 22 bp, Homo sapiens
gtggaggtcccgggcaggagca

SEQ ID NO: 9181564 - DNA, 22 bp, Homo sapiens
gtggagtgcaacggttggagtt

SEQ ID NO: 9181565 - DNA, 22 bp, Homo sapiens
gtggagtgcaacggttggagtt

SEQ ID NO: 9181566 - DNA, 22 bp, Homo sapiens
gtggagtggtgatggataggtt

SEQ ID NO: 9181567 - DNA, 22 bp, Homo sapiens
gtggagtggtgatggataggtt

SEQ ID NO: 9181568 - DNA, 22 bp, Homo sapiens
gtggagtggtgatggataggtt

SEQ ID NO: 9181569 - DNA, 22 bp, Homo sapiens
gtggaggaaaagaagttgggtg

SEQ ID NO: 9181570 - DNA, 22 bp, Homo sapiens
gtggaggacaaaagaagccttt

SEQ ID NO: 9181571 - DNA, 22 bp, Homo sapiens
gtggaggaagggattcagacca

SEQ ID NO: 9181572 - DNA, 22 bp, Homo sapiens
gtggagaggaacccagctctgt

SEQ ID NO: 9181573 - DNA, 22 bp, Homo sapiens
gtggagagcaaataattggaat

SEQ ID NO: 9181574 - DNA, 22 bp, Homo sapiens
gtggacagcttctaggtgccag

SEQ ID NO: 9181575 - DNA, 22 bp, Homo sapiens
gtggcacattggtagggtctgt

SEQ ID NO: 9181576 - DNA, 22 bp, Homo sapiens
gtggcacagtgggagagcccca

SEQ ID NO: 9181577 - DNA, 22 bp, Homo sapiens
gtggcacagtctgaaattttga

SEQ ID NO: 9181578 - DNA, 22 bp, Homo sapiens
gtggcacagtgggagagcccca

SEQ ID NO: 9181579 - DNA, 22 bp, Homo sapiens
gtggcacaaggcttacacagca

SEQ ID NO: 9181580 - DNA, 22 bp, Homo sapiens
gtggcacacaggagagagctca

SEQ ID NO: 9181581 - DNA, 22 bp, Homo sapiens
gtggatggattgaggcagtggg

SEQ ID NO: 9181582 - DNA, 22 bp, Homo sapiens
gtggatggattgaggcagtggg

SEQ ID NO: 9181583 - DNA, 22 bp, Homo sapiens
gtggatggattttgaggaatgg

SEQ ID NO: 9181584 - DNA, 22 bp, Homo sapiens
gtggatggagctggaagccatt

SEQ ID NO: 9181585 - DNA, 22 bp, Homo sapiens
gtggcagagggtgagctggact

SEQ ID NO: 9181586 - DNA, 22 bp, Homo sapiens
gtgacagctccttggttagatg

SEQ ID NO: 9181587 - DNA, 22 bp, Homo sapiens
gtgacaggcatggggtcatgca

SEQ ID NO: 9181588 - DNA, 22 bp, Homo sapiens
gtgacaggcccagtgggatgca

SEQ ID NO: 9181589 - DNA, 22 bp, Homo sapiens
gtgacagagctgggatttgaag

SEQ ID NO: 9181590 - DNA, 22 bp, Homo sapiens
gtgacagagctgggatttgaag

SEQ ID NO: 9181591 - DNA, 22 bp, Homo sapiens
gtgacagcatgaggaatcaatg

SEQ ID NO: 9181592 - DNA, 22 bp, Homo sapiens
gtgacaaaaacactgattattt

SEQ ID NO: 9181593 - DNA, 22 bp, Homo sapiens
gtgacaaaggtcaagcttttga

SEQ ID NO: 9181594 - DNA, 22 bp, Homo sapiens
gtgaaggcttgacgtcatcagg

SEQ ID NO: 9181595 - DNA, 22 bp, Homo sapiens
gtctggggtactttcatctgat

SEQ ID NO: 9181596 - DNA, 22 bp, Homo sapiens
gtctggggtactttcatctgat

SEQ ID NO: 9181597 - DNA, 22 bp, Homo sapiens
gtgcctgagccagctgcagctc

SEQ ID NO: 9181598 - DNA, 22 bp, Homo sapiens
gtgcctggaactgggtaggctg

SEQ ID NO: 9181599 - DNA, 22 bp, Homo sapiens
gtgcctggaactgggtaggctg

SEQ ID NO: 9181600 - DNA, 22 bp, Homo sapiens
gtgcctggaccctctttccgga

SEQ ID NO: 9181601 - DNA, 22 bp, Homo sapiens
gtgcctggaatgcgcctcggcg

SEQ ID NO: 9181602 - DNA, 22 bp, Homo sapiens
gtgcctggaatgcgcctcggcg

SEQ ID NO: 9181603 - DNA, 22 bp, Homo sapiens
gtgacagtcaaagacatgactt

SEQ ID NO: 9181604 - DNA, 22 bp, Homo sapiens
gtgacagtggtcacttgtagtt

SEQ ID NO: 9181605 - DNA, 22 bp, Homo sapiens
gtggaagaggcaagatagctct

SEQ ID NO: 9181606 - DNA, 22 bp, Homo sapiens
gtggaacagcctgtgcaaacct

SEQ ID NO: 9181607 - DNA, 19 bp, Homo sapiens
gtgctttttaagagctcag

SEQ ID NO: 9181608 - DNA, 22 bp, Homo sapiens
gtggaaggtgaaggagcagcga

SEQ ID NO: 9181609 - DNA, 20 bp, Homo sapiens
gtggaatgcactctgtgctg

SEQ ID NO: 9181610 - DNA, 22 bp, Homo sapiens
gtggaatggccatgggatcctt

SEQ ID NO: 9181611 - DNA, 22 bp, Homo sapiens
gtggaatgtccttgatcataag

SEQ ID NO: 9181612 - DNA, 22 bp, Homo sapiens
gtggaattatgcatttcttcac

SEQ ID NO: 9181613 - DNA, 22 bp, Homo sapiens
gtgctaaatattgtgtttgtct

SEQ ID NO: 9181614 - DNA, 22 bp, Homo sapiens
gtgctacagactgagtacactt

SEQ ID NO: 9181615 - DNA, 22 bp, Homo sapiens
gtgcgggcctgggggtttctct

SEQ ID NO: 9181616 - DNA, 22 bp, Homo sapiens
gtgcgggggttcccagcagccg

SEQ ID NO: 9181617 - DNA, 22 bp, Homo sapiens
gtgcgtggttctagatcctgtc

SEQ ID NO: 9181618 - DNA, 22 bp, Homo sapiens
gtgcctggcatgcgccggtgct

SEQ ID NO: 9181619 - DNA, 22 bp, Homo sapiens
gtgcctggcagggtcagctgct

SEQ ID NO: 9181620 - DNA, 22 bp, Homo sapiens
gtgcctggcatgcgccggtgct

SEQ ID NO: 9181621 - DNA, 22 bp, Homo sapiens
gtgcctggcagggtcagctgct

SEQ ID NO: 9181622 - DNA, 20 bp, Homo sapiens
gtgcctggagaagaggctgt

SEQ ID NO: 9181623 - DNA, 22 bp, Homo sapiens
gtggccagcaagtgctgcctct

SEQ ID NO: 9181624 - DNA, 22 bp, Homo sapiens
gtggccagcaagtgctgcctct

SEQ ID NO: 9181625 - DNA, 22 bp, Homo sapiens
gtggccagccagggtgctgatg

SEQ ID NO: 9181626 - DNA, 22 bp, Homo sapiens
gtggccagaggtcccatgtgtc

SEQ ID NO: 9181627 - DNA, 22 bp, Homo sapiens
gtggccagcaagtgctgcctct

SEQ ID NO: 9181628 - DNA, 18 bp, Homo sapiens
gtggccagcctggtcttg

SEQ ID NO: 9181629 - DNA, 18 bp, Homo sapiens
gtggccagcctggtcttg

SEQ ID NO: 9181630 - DNA, 22 bp, Homo sapiens
gtggccagaggtcccatgtgtc

SEQ ID NO: 9181631 - DNA, 22 bp, Homo sapiens
gtggccagaggtcccatgtgtc

SEQ ID NO: 9181632 - DNA, 22 bp, Homo sapiens
gtggccagaggtcccatgtgtc

SEQ ID NO: 9181633 - DNA, 22 bp, Homo sapiens
gtggccagaatcttgaggcctt

SEQ ID NO: 9181634 - DNA, 22 bp, Homo sapiens
gtggccagaatcttgaggcctt

SEQ ID NO: 9181635 - DNA, 22 bp, Homo sapiens
gtggccagaagttaagtggtta

SEQ ID NO: 9181636 - DNA, 22 bp, Homo sapiens
gtggccaccctcggcacacaca

SEQ ID NO: 9181637 - DNA, 22 bp, Homo sapiens
gtggccaccctcggcacacaca

SEQ ID NO: 9181638 - DNA, 22 bp, Homo sapiens
gtggccagctgtcagcaccctt

SEQ ID NO: 9181639 - DNA, 22 bp, Homo sapiens
gtggccaggagaccttgggcat

SEQ ID NO: 9181640 - DNA, 22 bp, Homo sapiens
gtggccaggacattgccaggca

SEQ ID NO: 9181641 - DNA, 22 bp, Homo sapiens
gtggccaggacattgccaggca

SEQ ID NO: 9181642 - DNA, 22 bp, Homo sapiens
gtggccaggccgactgccaggc

SEQ ID NO: 9181643 - DNA, 22 bp, Homo sapiens
gtggccctggagttgtgacact

SEQ ID NO: 9181644 - DNA, 21 bp, Homo sapiens
gtggccctgccgcagtgtcca

SEQ ID NO: 9181645 - DNA, 22 bp, Homo sapiens
gtggcccaggcaccctgatgac

SEQ ID NO: 9181646 - DNA, 22 bp, Homo sapiens
gtggccccagggccctgtctgg

SEQ ID NO: 9181647 - DNA, 22 bp, Homo sapiens
gtggcccaggcttggcgctggc

SEQ ID NO: 9181648 - DNA, 22 bp, Homo sapiens
gtggcaggggtattccagctga

SEQ ID NO: 9181649 - DNA, 22 bp, Homo sapiens
gtggcaggggcgggctgttccg

SEQ ID NO: 9181650 - DNA, 22 bp, Homo sapiens
gtggcattctcggcaccatctg

SEQ ID NO: 9181651 - DNA, 22 bp, Homo sapiens
gtggcatgacagtgaatgggca

SEQ ID NO: 9181652 - DNA, 22 bp, Homo sapiens
gtggcattaggccaggtgcata

SEQ ID NO: 9181653 - DNA, 22 bp, Homo sapiens
gtggccaaggtgcagagcagct

SEQ ID NO: 9181654 - DNA, 22 bp, Homo sapiens
gtggcagctgtgggacactggt

SEQ ID NO: 9181655 - DNA, 22 bp, Homo sapiens
gtggcagctggtatgcagacag

SEQ ID NO: 9181656 - DNA, 22 bp, Homo sapiens
gtggcagctggtatgcagacag

SEQ ID NO: 9181657 - DNA, 22 bp, Homo sapiens
gtggcaggagagacacagccat

SEQ ID NO: 9181658 - DNA, 22 bp, Homo sapiens
gtggcaggagtgggccttgaag

SEQ ID NO: 9181659 - DNA, 22 bp, Homo sapiens
gtggcagggcaatgctccctct

SEQ ID NO: 9181660 - DNA, 22 bp, Homo sapiens
gtggcagggctttgctgttctt

SEQ ID NO: 9181661 - DNA, 22 bp, Homo sapiens
gtggcagggagaagccattggg

SEQ ID NO: 9181662 - DNA, 22 bp, Homo sapiens
gtggctgctgtcctctctggtt

SEQ ID NO: 9181663 - DNA, 22 bp, Homo sapiens
gtggctggccctggaccctaag

SEQ ID NO: 9181664 - DNA, 22 bp, Homo sapiens
gtggctggagtatgaggaaagg

SEQ ID NO: 9181665 - DNA, 22 bp, Homo sapiens
gtggctgggctccgagcggctt

SEQ ID NO: 9181666 - DNA, 22 bp, Homo sapiens
gtggctgggctccgagcggctt

SEQ ID NO: 9181667 - DNA, 22 bp, Homo sapiens
gtggctggtttcctgcatgcaa

SEQ ID NO: 9181668 - DNA, 22 bp, Homo sapiens
gtggcttcacatggcatttggc

SEQ ID NO: 9181669 - DNA, 22 bp, Homo sapiens
gtggctggtttcctgcatgcaa

SEQ ID NO: 9181670 - DNA, 22 bp, Homo sapiens
gtggctgcagagggcacagcat

SEQ ID NO: 9181671 - DNA, 22 bp, Homo sapiens
gtggctgctcgggctccggccc

SEQ ID NO: 9181672 - DNA, 22 bp, Homo sapiens
gtggctgctaagtctccttcct

SEQ ID NO: 9181673 - DNA, 22 bp, Homo sapiens
gtggctgctaagtctccttcct

SEQ ID NO: 9181674 - DNA, 22 bp, Homo sapiens
gtggctgctcgggctccggccc

SEQ ID NO: 9181675 - DNA, 22 bp, Homo sapiens
gtggctgctcgggctccggccc

SEQ ID NO: 9181676 - DNA, 22 bp, Homo sapiens
gtgggagctgctacctccttcc

SEQ ID NO: 9181677 - DNA, 22 bp, Homo sapiens
gtgggagtggggaagcagagtg

SEQ ID NO: 9181678 - DNA, 22 bp, Homo sapiens
gtgggagaagccctgttcgtag

SEQ ID NO: 9181679 - DNA, 22 bp, Homo sapiens
gtgggagcatggtcccagtgcc

SEQ ID NO: 9181680 - DNA, 22 bp, Homo sapiens
gtggcttcatcaactgtgctta

SEQ ID NO: 9181681 - DNA, 22 bp, Homo sapiens
gtgggagaagatttggtcatct

SEQ ID NO: 9181682 - DNA, 20 bp, Homo sapiens
gtggcctctcacattctgag

SEQ ID NO: 9181683 - DNA, 22 bp, Homo sapiens
gtggcctctgtgctcctgccta

SEQ ID NO: 9181684 - DNA, 21 bp, Homo sapiens
gtggccctggtgtggctgcac

SEQ ID NO: 9181685 - DNA, 21 bp, Homo sapiens
gtggccctggtgtggctgcac

SEQ ID NO: 9181686 - DNA, 20 bp, Homo sapiens
gtggcccttaaagagggaag

SEQ ID NO: 9181687 - DNA, 22 bp, Homo sapiens
gtggcccttggagttgtgacct

SEQ ID NO: 9181688 - DNA, 22 bp, Homo sapiens
gtggcctggaaaggctggtctg

SEQ ID NO: 9181689 - DNA, 22 bp, Homo sapiens
gtggctgagcagcagagagctg

SEQ ID NO: 9181690 - DNA, 22 bp, Homo sapiens
gtggctgacaaccactggagga

SEQ ID NO: 9181691 - DNA, 22 bp, Homo sapiens
gtggctgagtggtcgagtcaga

SEQ ID NO: 9181692 - DNA, 22 bp, Homo sapiens
gtggctccttttcaggaggctg

SEQ ID NO: 9181693 - DNA, 22 bp, Homo sapiens
gtggctccttttcaggaggctg

SEQ ID NO: 9181694 - DNA, 22 bp, Homo sapiens
gtggctccgcaggctccattct

SEQ ID NO: 9181695 - DNA, 22 bp, Homo sapiens
gtggcctggcgagctggcgcgg

SEQ ID NO: 9181696 - DNA, 22 bp, Homo sapiens
gtggcctggcgagctggcgcgg

SEQ ID NO: 9181697 - DNA, 22 bp, Homo sapiens
gtggcctggcgagctggcgcgg

SEQ ID NO: 9181698 - DNA, 22 bp, Homo sapiens
taagaaatttagttatagaatg

SEQ ID NO: 9181699 - DNA, 22 bp, Homo sapiens
taagaaatttagttatagaatg

SEQ ID NO: 9181700 - DNA, 21 bp, Homo sapiens
taacagcagggaaatacgtgc

SEQ ID NO: 9181701 - DNA, 22 bp, Homo sapiens
taacagcagggttacaggcatt

SEQ ID NO: 9181702 - DNA, 22 bp, Homo sapiens
taacagcagggttacaggcatt

SEQ ID NO: 9181703 - DNA, 22 bp, Homo sapiens
taacactgtggtgttctttgtc

SEQ ID NO: 9181704 - DNA, 22 bp, Homo sapiens
taacagagatagaaatgtaaag

SEQ ID NO: 9181705 - DNA, 22 bp, Homo sapiens
taacagcaactgagggcctttt

SEQ ID NO: 9181706 - DNA, 22 bp, Homo sapiens
taacagcactggcaggcactgt

SEQ ID NO: 9181707 - DNA, 22 bp, Homo sapiens
taacagcactggcaggcactgt

SEQ ID NO: 9181708 - DNA, 22 bp, Homo sapiens
taacagcaaccacagtgctggt

SEQ ID NO: 9181709 - DNA, 22 bp, Homo sapiens
taacactgtccaaagaattcca

SEQ ID NO: 9181710 - DNA, 22 bp, Homo sapiens
taacactgtgcccagagtccca

SEQ ID NO: 9181711 - DNA, 22 bp, Homo sapiens
taacactggttatccctgtgca

SEQ ID NO: 9181712 - DNA, 22 bp, Homo sapiens
taacactgtaaacctagatgtt

SEQ ID NO: 9181713 - DNA, 22 bp, Homo sapiens
taacactgtggtgttctttgtc

SEQ ID NO: 9181714 - DNA, 22 bp, Homo sapiens
taacagaatagcagaaacagaa

SEQ ID NO: 9181715 - DNA, 22 bp, Homo sapiens
taacagaatcctgttattgcca

SEQ ID NO: 9181716 - DNA, 20 bp, Homo sapiens
taagaacaagactaggaagc

SEQ ID NO: 9181717 - DNA, 22 bp, Homo sapiens
taacactggtatttcatttagt

SEQ ID NO: 9181718 - DNA, 22 bp, Homo sapiens
taacactggtatttcatttagt

SEQ ID NO: 9181719 - DNA, 22 bp, Homo sapiens
taacactggagagttggttgtg

SEQ ID NO: 9181720 - DNA, 22 bp, Homo sapiens
taacactgcttcattttggaga

SEQ ID NO: 9181721 - DNA, 22 bp, Homo sapiens
taacactggcttttgctgaggc

SEQ ID NO: 9181722 - DNA, 22 bp, Homo sapiens
taacactgaaaatgatgcatgt

SEQ ID NO: 9181723 - DNA, 22 bp, Homo sapiens
taacactgatttgttctcaggg

SEQ ID NO: 9181724 - DNA, 22 bp, Homo sapiens
taacactgaaaatgatgcatgt

SEQ ID NO: 9181725 - DNA, 22 bp, Homo sapiens
taacactgccatgctggagtca

SEQ ID NO: 9181726 - DNA, 22 bp, Homo sapiens
taaatgacattcttaagtcttg

SEQ ID NO: 9181727 - DNA, 22 bp, Homo sapiens
taaatgacccatgctgacctca

SEQ ID NO: 9181728 - DNA, 22 bp, Homo sapiens
taaatgaagaaatggagattgt

SEQ ID NO: 9181729 - DNA, 22 bp, Homo sapiens
taaatgacaacacctgcttttg

SEQ ID NO: 9181730 - DNA, 22 bp, Homo sapiens
taaatgaagctcatgggccaca

SEQ ID NO: 9181731 - DNA, 22 bp, Homo sapiens
taaatgaagctcatgggccaca

SEQ ID NO: 9181732 - DNA, 22 bp, Homo sapiens
taaatgagggctgacatgattg

SEQ ID NO: 9181733 - DNA, 22 bp, Homo sapiens
taacactatccagatatgataa

SEQ ID NO: 9181734 - DNA, 22 bp, Homo sapiens
taaatccagcttctaatttaga

SEQ ID NO: 9181735 - DNA, 22 bp, Homo sapiens
taaatagaatctaaactgctca

SEQ ID NO: 9181736 - DNA, 22 bp, Homo sapiens
taaatacttttactccactgat

SEQ ID NO: 9181737 - DNA, 22 bp, Homo sapiens
taaatacttttactccactgat

SEQ ID NO: 9181738 - DNA, 22 bp, Homo sapiens
taaatcactcctaataatcagt

SEQ ID NO: 9181739 - DNA, 22 bp, Homo sapiens
taaatacttttactccactgat

SEQ ID NO: 9181740 - DNA, 22 bp, Homo sapiens
taaatgaaagggtttaatttat

SEQ ID NO: 9181741 - DNA, 22 bp, Homo sapiens
taaatgaaagggtttaatttat

SEQ ID NO: 9181742 - DNA, 22 bp, Homo sapiens
taaatgaagaaatggagattgt

SEQ ID NO: 9181743 - DNA, 22 bp, Homo sapiens
taaatgaagaaatggagattgt

SEQ ID NO: 9181744 - DNA, 22 bp, Homo sapiens
taaatctcctgtttttcatcta

SEQ ID NO: 9181745 - DNA, 18 bp, Homo sapiens
taaatctctctttagtca

SEQ ID NO: 9181746 - DNA, 22 bp, Homo sapiens
taaatctctcagtggccagaga

SEQ ID NO: 9181747 - DNA, 22 bp, Homo sapiens
taaatctcagggaatatattga

SEQ ID NO: 9181748 - DNA, 22 bp, Homo sapiens
taaatctcactgggtatattgg

SEQ ID NO: 9181749 - DNA, 22 bp, Homo sapiens
taaatccagcttctaatttaga

SEQ ID NO: 9181750 - DNA, 22 bp, Homo sapiens
taaatccttatcttctttgaat

SEQ ID NO: 9181751 - DNA, 22 bp, Homo sapiens
taaagctgcaggctcagaaaac

SEQ ID NO: 9181752 - DNA, 22 bp, Homo sapiens
taaagctgaaatgattatgaca

SEQ ID NO: 9181753 - DNA, 22 bp, Homo sapiens
taaagcttgtattgcaatattt

SEQ ID NO: 9181754 - DNA, 22 bp, Homo sapiens
taaaggaacagaggactcattt

SEQ ID NO: 9181755 - DNA, 22 bp, Homo sapiens
taaaggaactgctgctatggaa

SEQ ID NO: 9181756 - DNA, 22 bp, Homo sapiens
taaagctatgcttaatttatca

SEQ ID NO: 9181757 - DNA, 22 bp, Homo sapiens
taaaacagcagggcagagaagt

SEQ ID NO: 9181758 - DNA, 22 bp, Homo sapiens
taaaaccattcctgctttcatg

SEQ ID NO: 9181759 - DNA, 22 bp, Homo sapiens
taaagcaggcatctctctcctc

SEQ ID NO: 9181760 - DNA, 22 bp, Homo sapiens
taaagcaggccacatatgtgat

SEQ ID NO: 9181761 - DNA, 22 bp, Homo sapiens
taaaactagtggttgggactaa

SEQ ID NO: 9181762 - DNA, 22 bp, Homo sapiens
taaaactagaccgtgagtctaa

SEQ ID NO: 9181763 - DNA, 22 bp, Homo sapiens
taaatactttacaggatgtctc

SEQ ID NO: 9181764 - DNA, 22 bp, Homo sapiens
taaatactttacaggatgtctc

SEQ ID NO: 9181765 - DNA, 22 bp, Homo sapiens
taaatactttacaggatgtctc

SEQ ID NO: 9181766 - DNA, 22 bp, Homo sapiens
taaaggcatgcaggtgaatgta

SEQ ID NO: 9181767 - DNA, 22 bp, Homo sapiens
taaaggcagttggagttgagga

SEQ ID NO: 9181768 - DNA, 22 bp, Homo sapiens
taaaggcagccactgagctcaa

SEQ ID NO: 9181769 - DNA, 22 bp, Homo sapiens
taaaggcagcctaggaagtgtt

SEQ ID NO: 9181770 - DNA, 22 bp, Homo sapiens
taaaggcagtaattcctgagtt

SEQ ID NO: 9181771 - DNA, 22 bp, Homo sapiens
taaaggcagtaattcctgagtt

SEQ ID NO: 9181772 - DNA, 22 bp, Homo sapiens
taaaggcagttctgattaggtc

SEQ ID NO: 9181773 - DNA, 19 bp, Homo sapiens
taaaggaagaagggaggat

SEQ ID NO: 9181774 - DNA, 19 bp, Homo sapiens
taaaggaagaggaagggaa

SEQ ID NO: 9181775 - DNA, 22 bp, Homo sapiens
taaaggaagaattctctgtgat

SEQ ID NO: 9181776 - DNA, 18 bp, Homo sapiens
taaaggaagtgggagagg

SEQ ID NO: 9181777 - DNA, 22 bp, Homo sapiens
taaaggaatcagttttagagat

SEQ ID NO: 9181778 - DNA, 22 bp, Homo sapiens
taaaggcaaactctccaaggat

SEQ ID NO: 9181779 - DNA, 22 bp, Homo sapiens
taaaggattttgtataatataa

SEQ ID NO: 9181780 - DNA, 22 bp, Homo sapiens
taaaggataactttcaagaatt

SEQ ID NO: 9181781 - DNA, 22 bp, Homo sapiens
taaaggcactgcgtccctcaaa

SEQ ID NO: 9181782 - DNA, 22 bp, Homo sapiens
taaaggcacggagttgttatgg

SEQ ID NO: 9181783 - DNA, 22 bp, Homo sapiens
taaaggcacggagttgttatgg

SEQ ID NO: 9181784 - DNA, 22 bp, Homo sapiens
taaaggcaaatgtgtgtttgtg

SEQ ID NO: 9181785 - DNA, 22 bp, Homo sapiens
taaaggcaattcagcaagccac

SEQ ID NO: 9181786 - DNA, 22 bp, Homo sapiens
taaaggcaattcagcaagccac

SEQ ID NO: 9181787 - DNA, 22 bp, Homo sapiens
gtttttctctgaaatagttgac

SEQ ID NO: 9181788 - DNA, 22 bp, Homo sapiens
gtttttctgtgagcggtaaagg

SEQ ID NO: 9181789 - DNA, 20 bp, Homo sapiens
gtttttctctcttgccacta

SEQ ID NO: 9181790 - DNA, 22 bp, Homo sapiens
gtttttctagactgggagtttg

SEQ ID NO: 9181791 - DNA, 22 bp, Homo sapiens
gtttttctagaaatctcctcct

SEQ ID NO: 9181792 - DNA, 22 bp, Homo sapiens
gtttttctagaaatctcctcct

SEQ ID NO: 9181793 - DNA, 22 bp, Homo sapiens
gtttttctaggaccatgtgatt

SEQ ID NO: 9181794 - DNA, 22 bp, Homo sapiens
gtttttctaggaccatgtgatt

SEQ ID NO: 9181795 - DNA, 22 bp, Homo sapiens
gtttttctaggaccatgtgatt

SEQ ID NO: 9181796 - DNA, 20 bp, Homo sapiens
gtttttcttgggcgagctat

SEQ ID NO: 9181797 - DNA, 22 bp, Homo sapiens
gtttttctttgtgtgaagacaa

SEQ ID NO: 9181798 - DNA, 22 bp, Homo sapiens
gtttttctttgtgtgaagacaa

SEQ ID NO: 9181799 - DNA, 22 bp, Homo sapiens
gtttttgtcgagttccttgacc

SEQ ID NO: 9181800 - DNA, 22 bp, Homo sapiens
gtttttgtcgagttccttgacc

SEQ ID NO: 9181801 - DNA, 22 bp, Homo sapiens
gtttttctaagtagcgatattt

SEQ ID NO: 9181802 - DNA, 22 bp, Homo sapiens
gtttttccttgctgaggacccg

SEQ ID NO: 9181803 - DNA, 22 bp, Homo sapiens
gtttttcctgctgacttgggtc

SEQ ID NO: 9181804 - DNA, 22 bp, Homo sapiens
gtttaattcccacacctgccct

SEQ ID NO: 9181805 - DNA, 19 bp, Homo sapiens
gtttttcccagacgaggca

SEQ ID NO: 9181806 - DNA, 22 bp, Homo sapiens
gtttaaccaagagcattgtgca

SEQ ID NO: 9181807 - DNA, 22 bp, Homo sapiens
gtttaaccattgcatatccata

SEQ ID NO: 9181808 - DNA, 22 bp, Homo sapiens
gtttaactgggagtgtgggaaa

SEQ ID NO: 9181809 - DNA, 22 bp, Homo sapiens
gtttaataatgttgaattacta

SEQ ID NO: 9181810 - DNA, 22 bp, Homo sapiens
gtttaataatgttgaattacta

SEQ ID NO: 9181811 - DNA, 22 bp, Homo sapiens
gttgtttttgttctctatagct

SEQ ID NO: 9181812 - DNA, 22 bp, Homo sapiens
gttgtttttgttctctatagct

SEQ ID NO: 9181813 - DNA, 22 bp, Homo sapiens
gttgttttcagcagtttatgac

SEQ ID NO: 9181814 - DNA, 22 bp, Homo sapiens
gttgttttgcaggatccttaca

SEQ ID NO: 9181815 - DNA, 22 bp, Homo sapiens
gttgttttgcaggatccttaca

SEQ ID NO: 9181816 - DNA, 22 bp, Homo sapiens
gttgtttttgaacggtggtggc

SEQ ID NO: 9181817 - DNA, 19 bp, Homo sapiens
gttgtttttcttattatgg

SEQ ID NO: 9181818 - DNA, 22 bp, Homo sapiens
gttgttttgctgtctgtcttag

SEQ ID NO: 9181819 - DNA, 22 bp, Homo sapiens
gttgttttgctgtctgtcttag

SEQ ID NO: 9181820 - DNA, 22 bp, Homo sapiens
gtgggcagcaccagggaagtgt

SEQ ID NO: 9181821 - DNA, 20 bp, Homo sapiens
gtgggcagcaggcatactgg

SEQ ID NO: 9181822 - DNA, 20 bp, Homo sapiens
gtgggcagcaggcatactgg

SEQ ID NO: 9181823 - DNA, 22 bp, Homo sapiens
gtgggcagacagtgctttgcag

SEQ ID NO: 9181824 - DNA, 22 bp, Homo sapiens
gtgggcagaacatttgtaggct

SEQ ID NO: 9181825 - DNA, 22 bp, Homo sapiens
gtgggcagacagtgctttgcag

SEQ ID NO: 9181826 - DNA, 22 bp, Homo sapiens
gtgggcagacatgatagaagga

SEQ ID NO: 9181827 - DNA, 22 bp, Homo sapiens
gtgggcagagcaagggaactca

SEQ ID NO: 9181828 - DNA, 22 bp, Homo sapiens
gtgggcagagcaagggaactca

SEQ ID NO: 9181829 - DNA, 22 bp, Homo sapiens
gtgggcagagcaagggaactca

SEQ ID NO: 9181830 - DNA, 22 bp, Homo sapiens
gtgggcagtgtgtcagtatctt

SEQ ID NO: 9181831 - DNA, 22 bp, Homo sapiens
gtgggcagttcaattctgggag

SEQ ID NO: 9181832 - DNA, 22 bp, Homo sapiens
gtgggcagcctgtccggagacc

SEQ ID NO: 9181833 - DNA, 22 bp, Homo sapiens
gtgggcagccccttcaaggcca

SEQ ID NO: 9181834 - DNA, 22 bp, Homo sapiens
gtgggccagcttttctcctggg

SEQ ID NO: 9181835 - DNA, 22 bp, Homo sapiens
gtgggccactgggaggcaaggg

SEQ ID NO: 9181836 - DNA, 19 bp, Homo sapiens
gtgggccaggcagaaggct

SEQ ID NO: 9181837 - DNA, 22 bp, Homo sapiens
gtgggccaggccggagtgcaga

SEQ ID NO: 9181838 - DNA, 22 bp, Homo sapiens
gtgggccacatcccagggctct

SEQ ID NO: 9181839 - DNA, 22 bp, Homo sapiens
gtggggaggcctaagcaagttg

SEQ ID NO: 9181840 - DNA, 22 bp, Homo sapiens
gtggggaggcctaagcaagttg

SEQ ID NO: 9181841 - DNA, 22 bp, Homo sapiens
gtggggaggcattcttctccct

SEQ ID NO: 9181842 - DNA, 22 bp, Homo sapiens
gtggggaggcattcttctccct

SEQ ID NO: 9181843 - DNA, 22 bp, Homo sapiens
gtggggaggcctaagcaagttg

SEQ ID NO: 9181844 - DNA, 22 bp, Homo sapiens
gtggggaggcctaagcaagttg

SEQ ID NO: 9181845 - DNA, 22 bp, Homo sapiens
gtggggagcagccttagcccct

SEQ ID NO: 9181846 - DNA, 22 bp, Homo sapiens
gtggggagcagccttagcccct

SEQ ID NO: 9181847 - DNA, 22 bp, Homo sapiens
gtggggagcagccttagcccct

SEQ ID NO: 9181848 - DNA, 22 bp, Homo sapiens
gtggggaaaggagtggggctca

SEQ ID NO: 9181849 - DNA, 22 bp, Homo sapiens
gtgggggctggaaatcttgcca

SEQ ID NO: 9181850 - DNA, 22 bp, Homo sapiens
gtgggggctggaaatcttgcca

SEQ ID NO: 9181851 - DNA, 22 bp, Homo sapiens
gtgggggcagtgggcttcgagc

SEQ ID NO: 9181852 - DNA, 22 bp, Homo sapiens
gtgggggcaggcagtgctagga

SEQ ID NO: 9181853 - DNA, 22 bp, Homo sapiens
gtgggggcaggcagtgctagga

SEQ ID NO: 9181854 - DNA, 22 bp, Homo sapiens
gtgggggacccaggtgctgtcc

SEQ ID NO: 9181855 - DNA, 22 bp, Homo sapiens
gtgggggacccaggtgctgtcc

SEQ ID NO: 9181856 - DNA, 22 bp, Homo sapiens
gtgggccagttcctcacaggta

SEQ ID NO: 9181857 - DNA, 22 bp, Homo sapiens
gtgggcctcttgagggtggcta

SEQ ID NO: 9181858 - DNA, 22 bp, Homo sapiens
gtgggccttgcagggtgcaggg

SEQ ID NO: 9181859 - DNA, 22 bp, Homo sapiens
gtgggccttgcagggtgcaggg

SEQ ID NO: 9181860 - DNA, 22 bp, Homo sapiens
gtgggctgaggggacaccaagg

SEQ ID NO: 9181861 - DNA, 22 bp, Homo sapiens
gtgggctgcccttgaggtcagc

SEQ ID NO: 9181862 - DNA, 22 bp, Homo sapiens
gtgggctggaccctcctgctcc

SEQ ID NO: 9181863 - DNA, 22 bp, Homo sapiens
gtgggctgcttcctccttccac

SEQ ID NO: 9181864 - DNA, 22 bp, Homo sapiens
gtgggctgcttcctccttccac

SEQ ID NO: 9181865 - DNA, 22 bp, Homo sapiens
gtgggctgcccttgaggtcagc

SEQ ID NO: 9181866 - DNA, 22 bp, Homo sapiens
gtgggctggaccctcctgctcc

SEQ ID NO: 9181867 - DNA, 22 bp, Homo sapiens
gtgggctggaccctcctgctcc

SEQ ID NO: 9181868 - DNA, 22 bp, Homo sapiens
gtgggctggatttgcttgcaga

SEQ ID NO: 9181869 - DNA, 22 bp, Homo sapiens
gtggggtagatctttctcagga

SEQ ID NO: 9181870 - DNA, 22 bp, Homo sapiens
gtggggtagatctttctcagga

SEQ ID NO: 9181871 - DNA, 22 bp, Homo sapiens
gtgggggtggaaaggcaagttg

SEQ ID NO: 9181872 - DNA, 22 bp, Homo sapiens
gtgggggtttcattaagacaat

SEQ ID NO: 9181873 - DNA, 22 bp, Homo sapiens
gtgggggctggctcgtcctgtg

SEQ ID NO: 9181874 - DNA, 22 bp, Homo sapiens
gtgggggctggctcgtcctgtg

SEQ ID NO: 9181875 - DNA, 22 bp, Homo sapiens
gtgggggctggctcgtcctgtg

SEQ ID NO: 9181876 - DNA, 22 bp, Homo sapiens
gtggggggagctgcaagctgga

SEQ ID NO: 9181877 - DNA, 22 bp, Homo sapiens
gtggggtctgtcctcttctggg

SEQ ID NO: 9181878 - DNA, 22 bp, Homo sapiens
gtggggtgcagcagtactgtgt

SEQ ID NO: 9181879 - DNA, 22 bp, Homo sapiens
gtggggtctctctgtacctccc

SEQ ID NO: 9181880 - DNA, 22 bp, Homo sapiens
gtggggtgtccagcagcgagct

SEQ ID NO: 9181881 - DNA, 22 bp, Homo sapiens
gtggggtgtccagcagcgagct

SEQ ID NO: 9181882 - DNA, 18 bp, Homo sapiens
gtggggtgttgtgaggat

SEQ ID NO: 9181883 - DNA, 22 bp, Homo sapiens
gtgggtgatgtactggaggcca

SEQ ID NO: 9181884 - DNA, 22 bp, Homo sapiens
gtgggtgcggggagccgaggcg

SEQ ID NO: 9181885 - DNA, 22 bp, Homo sapiens
gtgggtgctgtcaggcagggaa

SEQ ID NO: 9181886 - DNA, 22 bp, Homo sapiens
gtgggtggagactgggtgcaag

SEQ ID NO: 9181887 - DNA, 22 bp, Homo sapiens
gtgggtggaggcgtcgagggca

SEQ ID NO: 9181888 - DNA, 22 bp, Homo sapiens
gtggtcagcagcagtgggagtg

SEQ ID NO: 9181889 - DNA, 22 bp, Homo sapiens
gtggtcaggcagtgggagagaa

SEQ ID NO: 9181890 - DNA, 22 bp, Homo sapiens
gtggtcaggggctgaggtgccc

SEQ ID NO: 9181891 - DNA, 22 bp, Homo sapiens
gtggtcagcagcagtgggagtg

SEQ ID NO: 9181892 - DNA, 22 bp, Homo sapiens
gtggtcagaaatctcagtggca

SEQ ID NO: 9181893 - DNA, 19 bp, Homo sapiens
gtgtacacttggccatggt

SEQ ID NO: 9181894 - DNA, 22 bp, Homo sapiens
gtgtacacttgaactgacggtt

SEQ ID NO: 9181895 - DNA, 22 bp, Homo sapiens
gtgtaagtatctttgtatcttt

SEQ ID NO: 9181896 - DNA, 22 bp, Homo sapiens
gtgtaattatataaagatctac

SEQ ID NO: 9181897 - DNA, 17 bp, Homo sapiens
gtgtacaagcagaaggc

SEQ ID NO: 9181898 - DNA, 22 bp, Homo sapiens
gtgtaaaaacatactatttcta

SEQ ID NO: 9181899 - DNA, 17 bp, Homo sapiens
gtgtaactatgagccat

SEQ ID NO: 9181900 - DNA, 22 bp, Homo sapiens
gtggttttctccaacccagaac

SEQ ID NO: 9181901 - DNA, 22 bp, Homo sapiens
gtggttttgccattacaagtaa

SEQ ID NO: 9181902 - DNA, 22 bp, Homo sapiens
gtggttttgccattacaagtaa

SEQ ID NO: 9181903 - DNA, 22 bp, Homo sapiens
gtgtaaaaacatactatttcta

SEQ ID NO: 9181904 - DNA, 22 bp, Homo sapiens
gtgtaaaaacatactatttcta

SEQ ID NO: 9181905 - DNA, 22 bp, Homo sapiens
gtggtgaagccccatctctgct

SEQ ID NO: 9181906 - DNA, 22 bp, Homo sapiens
gtggtcctggcaaccatggtga

SEQ ID NO: 9181907 - DNA, 22 bp, Homo sapiens
gtggtcctcataattcagtgag

SEQ ID NO: 9181908 - DNA, 22 bp, Homo sapiens
gtggtcccttctggccctggtc

SEQ ID NO: 9181909 - DNA, 22 bp, Homo sapiens
gtggtcctgcacccgcttggcc

SEQ ID NO: 9181910 - DNA, 22 bp, Homo sapiens
gtggtgcatccttgagtaagct

SEQ ID NO: 9181911 - DNA, 22 bp, Homo sapiens
gtggttgtatagttaaggttca

SEQ ID NO: 9181912 - DNA, 22 bp, Homo sapiens
gtggttccgaatatttatttct

SEQ ID NO: 9181913 - DNA, 22 bp, Homo sapiens
gtggttcagtgtcatattaacg

SEQ ID NO: 9181914 - DNA, 22 bp, Homo sapiens
gtggtgtttttggggcagagga

SEQ ID NO: 9181915 - DNA, 22 bp, Homo sapiens
gttgtatagagggcatgaatct

SEQ ID NO: 9181916 - DNA, 22 bp, Homo sapiens
gttgtacatatgaggataagtt

SEQ ID NO: 9181917 - DNA, 22 bp, Homo sapiens
gttgtatttgcctgaatgcagt

SEQ ID NO: 9181918 - DNA, 22 bp, Homo sapiens
gttctgagtcctcctttgaagg

SEQ ID NO: 9181919 - DNA, 22 bp, Homo sapiens
gttctgagtcctcctttgaagg

SEQ ID NO: 9181920 - DNA, 22 bp, Homo sapiens
gttgtacaggcagggaaactga

SEQ ID NO: 9181921 - DNA, 22 bp, Homo sapiens
gttctgcagggatccagctggg

SEQ ID NO: 9181922 - DNA, 22 bp, Homo sapiens
gttgttttataattgattgcaa

SEQ ID NO: 9181923 - DNA, 22 bp, Homo sapiens
gttgttttaaaatactccagaa

SEQ ID NO: 9181924 - DNA, 22 bp, Homo sapiens
gttgttttcacaaacccatgat

SEQ ID NO: 9181925 - DNA, 22 bp, Homo sapiens
gttgttttattgtgagtcccat

SEQ ID NO: 9181926 - DNA, 22 bp, Homo sapiens
gttgttttataggctcatgcct

SEQ ID NO: 9181927 - DNA, 22 bp, Homo sapiens
gttgtgaatagtgccgcaataa

SEQ ID NO: 9181928 - DNA, 22 bp, Homo sapiens
gttgtcttagtcagaaatatgc

SEQ ID NO: 9181929 - DNA, 22 bp, Homo sapiens
gttctatttcagtaagcaggca

SEQ ID NO: 9181930 - DNA, 22 bp, Homo sapiens
gttctccactgcagagtctctc

SEQ ID NO: 9181931 - DNA, 22 bp, Homo sapiens
gttctccactgcagagtctctc

SEQ ID NO: 9181932 - DNA, 22 bp, Homo sapiens
gttctccattcagcttcctgtg

SEQ ID NO: 9181933 - DNA, 22 bp, Homo sapiens
gttctcctcttagctgtgccac

SEQ ID NO: 9181934 - DNA, 22 bp, Homo sapiens
gttctccaggggctgttcatct

SEQ ID NO: 9181935 - DNA, 22 bp, Homo sapiens
gttctccaggggctgttcatct

SEQ ID NO: 9181936 - DNA, 22 bp, Homo sapiens
gttctccactgcagagtctctc

SEQ ID NO: 9181937 - DNA, 22 bp, Homo sapiens
gttctctgccggcacctacccg

SEQ ID NO: 9181938 - DNA, 22 bp, Homo sapiens
gttctctgccacttaccagcta

SEQ ID NO: 9181939 - DNA, 22 bp, Homo sapiens
gttctctgccacttaccagcta

SEQ ID NO: 9181940 - DNA, 22 bp, Homo sapiens
gttctctctgcttccaagatgg

SEQ ID NO: 9181941 - DNA, 22 bp, Homo sapiens
gttctcctcttgtcccaggctg

SEQ ID NO: 9181942 - DNA, 22 bp, Homo sapiens
gttctcctggctcccaccctgc

SEQ ID NO: 9181943 - DNA, 22 bp, Homo sapiens
gttcaaattgattttggtaaag

SEQ ID NO: 9181944 - DNA, 22 bp, Homo sapiens
gttcaagaccagcctggccaac

SEQ ID NO: 9181945 - DNA, 22 bp, Homo sapiens
gttcaagaccagcctggccaac

SEQ ID NO: 9181946 - DNA, 22 bp, Homo sapiens
gttcaagaccagcctggccaac

SEQ ID NO: 9181947 - DNA, 21 bp, Homo sapiens
gttcaaatgggtagattcaca

SEQ ID NO: 9181948 - DNA, 22 bp, Homo sapiens
gttcaaattgagatggtataaa

SEQ ID NO: 9181949 - DNA, 22 bp, Homo sapiens
gttcaaattctatgaaatatgt

SEQ ID NO: 9181950 - DNA, 22 bp, Homo sapiens
gttcaaatctcaggacttcaga

SEQ ID NO: 9181951 - DNA, 18 bp, Homo sapiens
gttcaaggtcaagagaga

SEQ ID NO: 9181952 - DNA, 22 bp, Homo sapiens
gttcaaggaagggaggaaagcc

SEQ ID NO: 9181953 - DNA, 22 bp, Homo sapiens
gttcaaggttttacagagtgta

SEQ ID NO: 9181954 - DNA, 22 bp, Homo sapiens
gttctaataggagaaaagacag

SEQ ID NO: 9181955 - DNA, 22 bp, Homo sapiens
gttctaagggcttgaaatgtat

SEQ ID NO: 9181956 - DNA, 22 bp, Homo sapiens
gttctaatattttaaaagccaa

SEQ ID NO: 9181957 - DNA, 22 bp, Homo sapiens
gttctaggttagaaggacagat

SEQ ID NO: 9181958 - DNA, 22 bp, Homo sapiens
gtgtgtccaaggccacaatagc

SEQ ID NO: 9181959 - DNA, 22 bp, Homo sapiens
gtgtgtccacacatacatacat

SEQ ID NO: 9181960 - DNA, 22 bp, Homo sapiens
gtgtgtccaaggcacggatgac

SEQ ID NO: 9181961 - DNA, 22 bp, Homo sapiens
gtgtgtccctcctctcctgagt

SEQ ID NO: 9181962 - DNA, 22 bp, Homo sapiens
gtgtgtcccttggaacctcagc

SEQ ID NO: 9181963 - DNA, 23 bp, Homo sapiens
gtgtgtccattcgcactcttagg

SEQ ID NO: 9181964 - DNA, 22 bp, Homo sapiens
gtgtgtccaggcgggagtcaag

SEQ ID NO: 9181965 - DNA, 22 bp, Homo sapiens
gtgtgtccctacaacagcttca

SEQ ID NO: 9181966 - DNA, 22 bp, Homo sapiens
gtgtgtcctcagtagtggcatg

SEQ ID NO: 9181967 - DNA, 22 bp, Homo sapiens
gttattttaacttctcagtaat

SEQ ID NO: 9181968 - DNA, 21 bp, Homo sapiens
gttattttaagtgagctttgc

SEQ ID NO: 9181969 - DNA, 22 bp, Homo sapiens
gttattttcattggctcagact

SEQ ID NO: 9181970 - DNA, 22 bp, Homo sapiens
gttattttcattggctcagact

SEQ ID NO: 9181971 - DNA, 22 bp, Homo sapiens
gttcaaaattcaaatggtatac

SEQ ID NO: 9181972 - DNA, 22 bp, Homo sapiens
gttcaaaattcaaatggtatac

SEQ ID NO: 9181973 - DNA, 21 bp, Homo sapiens
gttattttaagtgagctttgc

SEQ ID NO: 9181974 - DNA, 22 bp, Homo sapiens
gttattttatctctgagaggtt

SEQ ID NO: 9181975 - DNA, 22 bp, Homo sapiens
gtgtgagcatcaaagcctgtca

SEQ ID NO: 9181976 - DNA, 22 bp, Homo sapiens
gtgtcgtgcttgccatgggtac

SEQ ID NO: 9181977 - DNA, 22 bp, Homo sapiens
gtgtcctgggggacttcaggtt

SEQ ID NO: 9181978 - DNA, 22 bp, Homo sapiens
gtgtcctgagtgaggcctggcc

SEQ ID NO: 9181979 - DNA, 22 bp, Homo sapiens
gtgtcccaggagaggagacaat

SEQ ID NO: 9181980 - DNA, 22 bp, Homo sapiens
gtgtcctcttattgctcttggc

SEQ ID NO: 9181981 - DNA, 22 bp, Homo sapiens
gtgtcctgccaccctgggcttt

SEQ ID NO: 9181982 - DNA, 18 bp, Homo sapiens
gtgtcctggctgcggcgc

SEQ ID NO: 9181983 - DNA, 22 bp, Homo sapiens
gtgtcctgcacagcaccttgca

SEQ ID NO: 9181984 - DNA, 22 bp, Homo sapiens
gtgtccagagaaactcacagct

SEQ ID NO: 9181985 - DNA, 22 bp, Homo sapiens
gtgtcatacagaatgcataagt

SEQ ID NO: 9181986 - DNA, 22 bp, Homo sapiens
gtgtcacatggtttactgcagc

SEQ ID NO: 9181987 - DNA, 19 bp, Homo sapiens
gtgtcaggatgtgcagggg

SEQ ID NO: 9181988 - DNA, 22 bp, Homo sapiens
gtgtcaggcagtcagcatggag

SEQ ID NO: 9181989 - DNA, 22 bp, Homo sapiens
gtgtccagagaactgtgggagc

SEQ ID NO: 9181990 - DNA, 22 bp, Homo sapiens
gtgtccagcctgcacagggtgc

SEQ ID NO: 9181991 - DNA, 22 bp, Homo sapiens
gtgtccagcgtggaatgagggt

SEQ ID NO: 9181992 - DNA, 22 bp, Homo sapiens
gtgtccagagccgggctgaatg

SEQ ID NO: 9181993 - DNA, 22 bp, Homo sapiens
gtgtccagatgaggagacgatg

SEQ ID NO: 9181994 - DNA, 17 bp, Homo sapiens
gtgtccaggccgatggc

SEQ ID NO: 9181995 - DNA, 22 bp, Homo sapiens
gtgtccagcgtggaatgagggt

SEQ ID NO: 9181996 - DNA, 22 bp, Homo sapiens
gtgtccagggggtatcccagct

SEQ ID NO: 9181997 - DNA, 22 bp, Homo sapiens
gtgtccagggccgtgttgtctt

SEQ ID NO: 9181998 - DNA, 22 bp, Homo sapiens
gtgtccagggctggaagtgagg

SEQ ID NO: 9181999 - DNA, 22 bp, Homo sapiens
gtgtccagtcatagcccagggc

SEQ ID NO: 9182000 - DNA, 22 bp, Homo sapiens
gtgtccagttttttctctgctg

SEQ ID NO: 9182001 - DNA, 22 bp, Homo sapiens
gtgtggggaggagagagccctt

SEQ ID NO: 9182002 - DNA, 22 bp, Homo sapiens
gtgtgcagtagagaaagagcag

SEQ ID NO: 9182003 - DNA, 22 bp, Homo sapiens
gtgtgcagtctgctaggcaggg

SEQ ID NO: 9182004 - DNA, 22 bp, Homo sapiens
gtgtgggctgcagaggcacagc

SEQ ID NO: 9182005 - DNA, 22 bp, Homo sapiens
gtgtgggtgtactgttctagat

SEQ ID NO: 9182006 - DNA, 22 bp, Homo sapiens
gtgtgcaggccacaggccaggg

SEQ ID NO: 9182007 - DNA, 22 bp, Homo sapiens
gtgtgcaggcttgaggattagg

SEQ ID NO: 9182008 - DNA, 22 bp, Homo sapiens
gtgtgcagcagagacaggactc

SEQ ID NO: 9182009 - DNA, 22 bp, Homo sapiens
gtgtgcaggccacaggccaggg

SEQ ID NO: 9182010 - DNA, 22 bp, Homo sapiens
gtgtgcagggatgagtgcaggt

SEQ ID NO: 9182011 - DNA, 22 bp, Homo sapiens
gtgtgcagggatgagtgcaggt

SEQ ID NO: 9182012 - DNA, 22 bp, Homo sapiens
gtgtgcagggatgagtgcaggt

SEQ ID NO: 9182013 - DNA, 22 bp, Homo sapiens
gtgtgcagggctgcctgtgccg

SEQ ID NO: 9182014 - DNA, 22 bp, Homo sapiens
gtgtgcaggtgtcagtgcagct

SEQ ID NO: 9182015 - DNA, 22 bp, Homo sapiens
gtgtgcaggtgtcagtgcagct

SEQ ID NO: 9182016 - DNA, 22 bp, Homo sapiens
gtgtgcaggtgtcagtgcagct

SEQ ID NO: 9182017 - DNA, 22 bp, Homo sapiens
gtgtgcaggggcttggtggagc

SEQ ID NO: 9182018 - DNA, 22 bp, Homo sapiens
gtgtgcagggctgcctgtgccg

SEQ ID NO: 9182019 - DNA, 22 bp, Homo sapiens
gtgtgcagggggccagcgcagc

SEQ ID NO: 9182020 - DNA, 22 bp, Homo sapiens
gtgtgagctccctctcctcctg

SEQ ID NO: 9182021 - DNA, 22 bp, Homo sapiens
gtgtgagggcaacacagcaaac

SEQ ID NO: 9182022 - DNA, 22 bp, Homo sapiens
gtgtgcagaacagggagtgggt

SEQ ID NO: 9182023 - DNA, 22 bp, Homo sapiens
gtgtgataacagggcatgacgg

SEQ ID NO: 9182024 - DNA, 22 bp, Homo sapiens
gtgtgcagcagagacaggactc

SEQ ID NO: 9182025 - DNA, 22 bp, Homo sapiens
gtgtgcagcagagacaggactc

SEQ ID NO: 9182026 - DNA, 22 bp, Homo sapiens
gtgtgcagaggcaggaggtgct

SEQ ID NO: 9182027 - DNA, 22 bp, Homo sapiens
gtgtgcagaagacacaagacat

SEQ ID NO: 9182028 - DNA, 22 bp, Homo sapiens
ggcagctgtgaagtgcctcaca

SEQ ID NO: 9182029 - DNA, 22 bp, Homo sapiens
ggcagctgtgaagtgcctcaca

SEQ ID NO: 9182030 - DNA, 22 bp, Homo sapiens
ggcaggcagatggctgcaccaa

SEQ ID NO: 9182031 - DNA, 22 bp, Homo sapiens
ggcagctgtctctgagttagca

SEQ ID NO: 9182032 - DNA, 22 bp, Homo sapiens
ggcagctgtctctgagttagca

SEQ ID NO: 9182033 - DNA, 22 bp, Homo sapiens
ggcagctgtgaagtgcctcaca

SEQ ID NO: 9182034 - DNA, 22 bp, Homo sapiens
ggcagctgtctctgagttagca

SEQ ID NO: 9182035 - DNA, 22 bp, Homo sapiens
ggcagctgtaagatgagtgaat

SEQ ID NO: 9182036 - DNA, 22 bp, Homo sapiens
ggcagctgtaagatgagtgaat

SEQ ID NO: 9182037 - DNA, 22 bp, Homo sapiens
ggcagctggttctttccattaa

SEQ ID NO: 9182038 - DNA, 22 bp, Homo sapiens
ggcagctggttctttccattaa

SEQ ID NO: 9182039 - DNA, 22 bp, Homo sapiens
ggcagctggggcagtgccctgt

SEQ ID NO: 9182040 - DNA, 22 bp, Homo sapiens
ggcagctggggcagtgccctgt

SEQ ID NO: 9182041 - DNA, 22 bp, Homo sapiens
ggcagctggggcagtgccctgt

SEQ ID NO: 9182042 - DNA, 22 bp, Homo sapiens
ggcagctggggcagtgccctgt

SEQ ID NO: 9182043 - DNA, 23 bp, Homo sapiens
ggcagctgggcagcactcatggg

SEQ ID NO: 9182044 - DNA, 23 bp, Homo sapiens
ggcagctgggcagcactcatggg

SEQ ID NO: 9182045 - DNA, 22 bp, Homo sapiens
ggcagctgggttggccagaaac

SEQ ID NO: 9182046 - DNA, 22 bp, Homo sapiens
ggcagctgggttggccagaaac

SEQ ID NO: 9182047 - DNA, 22 bp, Homo sapiens
ggcagaggaagctggaagtggg

SEQ ID NO: 9182048 - DNA, 22 bp, Homo sapiens
ggcagaggaagctggaagtggg

SEQ ID NO: 9182049 - DNA, 22 bp, Homo sapiens
ggcagaggaagctggaagtggg

SEQ ID NO: 9182050 - DNA, 22 bp, Homo sapiens
ggcagaggaagctggaagtggg

SEQ ID NO: 9182051 - DNA, 22 bp, Homo sapiens
ggcagaggaagctggaagtggg

SEQ ID NO: 9182052 - DNA, 22 bp, Homo sapiens
ggcagaggaagctggaagtggg

SEQ ID NO: 9182053 - DNA, 22 bp, Homo sapiens
ggcagaggaagctggaagtggg

SEQ ID NO: 9182054 - DNA, 22 bp, Homo sapiens
ggcagctgctgcattacgttgt

SEQ ID NO: 9182055 - DNA, 22 bp, Homo sapiens
ggcagctgctgcattacgttgt

SEQ ID NO: 9182056 - DNA, 19 bp, Homo sapiens
ggcagctggacgctgttca

SEQ ID NO: 9182057 - DNA, 19 bp, Homo sapiens
ggcagctggacgctgttca

SEQ ID NO: 9182058 - DNA, 22 bp, Homo sapiens
ggcagctggcctcctcgcccac

SEQ ID NO: 9182059 - DNA, 22 bp, Homo sapiens
ggcagctggcctcctcgcccac

SEQ ID NO: 9182060 - DNA, 22 bp, Homo sapiens
ggcagctgcacgttgtcccgtc

SEQ ID NO: 9182061 - DNA, 22 bp, Homo sapiens
ggcagctgcaaatctgctctgt

SEQ ID NO: 9182062 - DNA, 22 bp, Homo sapiens
ggcagctctgctaattgagcct

SEQ ID NO: 9182063 - DNA, 22 bp, Homo sapiens
ggcaggcattagagattcccag

SEQ ID NO: 9182064 - DNA, 22 bp, Homo sapiens
ggcaggcctgagaggcagggct

SEQ ID NO: 9182065 - DNA, 22 bp, Homo sapiens
ggcaggctagcactgatgtcct

SEQ ID NO: 9182066 - DNA, 22 bp, Homo sapiens
ggcaggcgtggtggcctcagaa

SEQ ID NO: 9182067 - DNA, 22 bp, Homo sapiens
ggcaggctccaagcatcctatg

SEQ ID NO: 9182068 - DNA, 22 bp, Homo sapiens
ggcaggctccagagccctctcc

SEQ ID NO: 9182069 - DNA, 22 bp, Homo sapiens
ggcaggctgcttgggtcatgtc

SEQ ID NO: 9182070 - DNA, 22 bp, Homo sapiens
ggcaggctgcttgggtcatgtc

SEQ ID NO: 9182071 - DNA, 18 bp, Homo sapiens
ggcaggctctctgggtca

SEQ ID NO: 9182072 - DNA, 22 bp, Homo sapiens
ggcaggtgctaagagaggtaaa

SEQ ID NO: 9182073 - DNA, 22 bp, Homo sapiens
ggcaggctgcttgggtcatgtc

SEQ ID NO: 9182074 - DNA, 22 bp, Homo sapiens
ggcaggtgaggcatgtgcctgg

SEQ ID NO: 9182075 - DNA, 22 bp, Homo sapiens
ggcaggtgaggcatgtgcctgg

SEQ ID NO: 9182076 - DNA, 22 bp, Homo sapiens
ggagttgacggccgacacccag

SEQ ID NO: 9182077 - DNA, 22 bp, Homo sapiens
ggagttgatcagagtaggaggt

SEQ ID NO: 9182078 - DNA, 22 bp, Homo sapiens
ggagttcaggaatgaaaatgtt

SEQ ID NO: 9182079 - DNA, 22 bp, Homo sapiens
ggagttccagaccagactggcc

SEQ ID NO: 9182080 - DNA, 22 bp, Homo sapiens
ggagttgattttggatatatta

SEQ ID NO: 9182081 - DNA, 22 bp, Homo sapiens
ggagttgattttggatatatta

SEQ ID NO: 9182082 - DNA, 22 bp, Homo sapiens
ggcaaggcctgcagctcagtgt

SEQ ID NO: 9182083 - DNA, 22 bp, Homo sapiens
ggcaaggcctgcagctcagtgt

SEQ ID NO: 9182084 - DNA, 22 bp, Homo sapiens
ggcacacagcttggcaggagat

SEQ ID NO: 9182085 - DNA, 22 bp, Homo sapiens
ggcaagggacggccgtgagaca

SEQ ID NO: 9182086 - DNA, 22 bp, Homo sapiens
ggcacacatagatctgcactgg

SEQ ID NO: 9182087 - DNA, 22 bp, Homo sapiens
ggcacagacttttgcttgcgtt

SEQ ID NO: 9182088 - DNA, 22 bp, Homo sapiens
ggcacagacctgctgcgatatc

SEQ ID NO: 9182089 - DNA, 22 bp, Homo sapiens
ggagtggcactctgaggcgggg

SEQ ID NO: 9182090 - DNA, 22 bp, Homo sapiens
ggagtgctttgaagccttcatt

SEQ ID NO: 9182091 - DNA, 22 bp, Homo sapiens
ggagtgctgggccgctgccaac

SEQ ID NO: 9182092 - DNA, 22 bp, Homo sapiens
ggagtaggccccgggagagagt

SEQ ID NO: 9182093 - DNA, 22 bp, Homo sapiens
ggagtggcagcgaggatcagat

SEQ ID NO: 9182094 - DNA, 22 bp, Homo sapiens
ggagtggcagcgaggatcagat

SEQ ID NO: 9182095 - DNA, 22 bp, Homo sapiens
ggagtggcctctcctgtgcagg

SEQ ID NO: 9182096 - DNA, 22 bp, Homo sapiens
ggagtggccacgactgggagat

SEQ ID NO: 9182097 - DNA, 22 bp, Homo sapiens
ggagtggccacgactgggagat

SEQ ID NO: 9182098 - DNA, 22 bp, Homo sapiens
ggagtgggcagcactgccctgt

SEQ ID NO: 9182099 - DNA, 22 bp, Homo sapiens
ggagtgggcagcactgccctgt

SEQ ID NO: 9182100 - DNA, 19 bp, Homo sapiens
ggagtgggtagttagtggt

SEQ ID NO: 9182101 - DNA, 19 bp, Homo sapiens
ggagtgggtagttagtggt

SEQ ID NO: 9182102 - DNA, 22 bp, Homo sapiens
ggagtgggaacaatgacatggt

SEQ ID NO: 9182103 - DNA, 22 bp, Homo sapiens
ggagtgggaacaatgacatggt

SEQ ID NO: 9182104 - DNA, 22 bp, Homo sapiens
ggagtggctgtttctgccccca

SEQ ID NO: 9182105 - DNA, 22 bp, Homo sapiens
ggagtgggaacaatgacatggt

SEQ ID NO: 9182106 - DNA, 22 bp, Homo sapiens
ggagtgggaacaatgacatggt

SEQ ID NO: 9182107 - DNA, 21 bp, Homo sapiens
ggcagagaagctggaagttgg

SEQ ID NO: 9182108 - DNA, 21 bp, Homo sapiens
ggcagagaagctggaagttgg

SEQ ID NO: 9182109 - DNA, 21 bp, Homo sapiens
ggcagagaagctggaagttgg

SEQ ID NO: 9182110 - DNA, 21 bp, Homo sapiens
ggcagagaagctggaagttgg

SEQ ID NO: 9182111 - DNA, 19 bp, Homo sapiens
ggcagacacagttgacatg

SEQ ID NO: 9182112 - DNA, 22 bp, Homo sapiens
ggcagacctctccagccccaca

SEQ ID NO: 9182113 - DNA, 22 bp, Homo sapiens
ggcagacctctccagccccaca

SEQ ID NO: 9182114 - DNA, 22 bp, Homo sapiens
ggcagacctctccagccccaca

SEQ ID NO: 9182115 - DNA, 22 bp, Homo sapiens
ggcagacctctccagccccaca

SEQ ID NO: 9182116 - DNA, 22 bp, Homo sapiens
ggcagacctctccagccccaca

SEQ ID NO: 9182117 - DNA, 22 bp, Homo sapiens
ggcagagactgggttggcagag

SEQ ID NO: 9182118 - DNA, 22 bp, Homo sapiens
ggcagagactgggttggcagag

SEQ ID NO: 9182119 - DNA, 22 bp, Homo sapiens
ggcagagactgggttggcagag

SEQ ID NO: 9182120 - DNA, 22 bp, Homo sapiens
ggcagagactgggttggcagag

SEQ ID NO: 9182121 - DNA, 22 bp, Homo sapiens
ggcagagacaccgaatgactct

SEQ ID NO: 9182122 - DNA, 22 bp, Homo sapiens
ggcagagaatctggctgtttac

SEQ ID NO: 9182123 - DNA, 23 bp, Homo sapiens
ggcagagagcatggctggggccc

SEQ ID NO: 9182124 - DNA, 23 bp, Homo sapiens
ggcagagagcatggctggggccc

SEQ ID NO: 9182125 - DNA, 23 bp, Homo sapiens
ggcagagagcatggctggggccc

SEQ ID NO: 9182126 - DNA, 22 bp, Homo sapiens
ggcacagagctttgtcccagtt

SEQ ID NO: 9182127 - DNA, 22 bp, Homo sapiens
ggcacagagctccagccttggc

SEQ ID NO: 9182128 - DNA, 22 bp, Homo sapiens
ggcacagagttggcagagctgc

SEQ ID NO: 9182129 - DNA, 22 bp, Homo sapiens
ggcacagagttggcagagctgc

SEQ ID NO: 9182130 - DNA, 22 bp, Homo sapiens
ggcacagagttggcagagctgc

SEQ ID NO: 9182131 - DNA, 22 bp, Homo sapiens
ggcacagagttggcagagctgc

SEQ ID NO: 9182132 - DNA, 23 bp, Homo sapiens
ggcacagatgctgagcatgtgca

SEQ ID NO: 9182133 - DNA, 22 bp, Homo sapiens
ggcacagatagatcaagtgtct

SEQ ID NO: 9182134 - DNA, 22 bp, Homo sapiens
ggcacagcaccttttcacattg

SEQ ID NO: 9182135 - DNA, 22 bp, Homo sapiens
ggcacagcaccttttcacattg

SEQ ID NO: 9182136 - DNA, 22 bp, Homo sapiens
ggcacagcactgtaggcctggg

SEQ ID NO: 9182137 - DNA, 22 bp, Homo sapiens
ggcacagcactgtaggcctggg

SEQ ID NO: 9182138 - DNA, 22 bp, Homo sapiens
ggcacagcactgtaggcctggg

SEQ ID NO: 9182139 - DNA, 22 bp, Homo sapiens
ggcacagcacagtggacccagg

SEQ ID NO: 9182140 - DNA, 22 bp, Homo sapiens
ggcacagcacagtggacccagg

SEQ ID NO: 9182141 - DNA, 22 bp, Homo sapiens
ggcacagcacagtggacccagg

SEQ ID NO: 9182142 - DNA, 22 bp, Homo sapiens
ggcacagcacagagcacatgta

SEQ ID NO: 9182143 - DNA, 22 bp, Homo sapiens
ggcacagcacagagcacatgta

SEQ ID NO: 9182144 - DNA, 22 bp, Homo sapiens
ggcacagcaagaagggaaatga

SEQ ID NO: 9182145 - DNA, 22 bp, Homo sapiens
ggcacagcaagaagggaaatga

SEQ ID NO: 9182146 - DNA, 22 bp, Homo sapiens
ggcacagcacagagcacatgta

SEQ ID NO: 9182147 - DNA, 22 bp, Homo sapiens
ggcacagcacagagcacatgta

SEQ ID NO: 9182148 - DNA, 22 bp, Homo sapiens
ggcacagcacagagcacatgta

SEQ ID NO: 9182149 - DNA, 22 bp, Homo sapiens
ggaggtcaaatggagggctggg

SEQ ID NO: 9182150 - DNA, 22 bp, Homo sapiens
ggaggtcatagctgtgcaggta

SEQ ID NO: 9182151 - DNA, 22 bp, Homo sapiens
ggaggtcccaggcctggcagca

SEQ ID NO: 9182152 - DNA, 22 bp, Homo sapiens
ggaggtggaggttgcagtgagc

SEQ ID NO: 9182153 - DNA, 22 bp, Homo sapiens
ggaggtggaggttgcagtgagc

SEQ ID NO: 9182154 - DNA, 22 bp, Homo sapiens
ggaggtggaggttgcagtgagc

SEQ ID NO: 9182155 - DNA, 22 bp, Homo sapiens
ggaggtggcagagggacattct

SEQ ID NO: 9182156 - DNA, 22 bp, Homo sapiens
ggagggtggcagcgtcctgggc

SEQ ID NO: 9182157 - DNA, 20 bp, Homo sapiens
ggaggtcaaatgatgagaag

SEQ ID NO: 9182158 - DNA, 22 bp, Homo sapiens
ggaggtagcctcaaaagcagct

SEQ ID NO: 9182159 - DNA, 22 bp, Homo sapiens
ggagggttagcaaaggcacaga

SEQ ID NO: 9182160 - DNA, 22 bp, Homo sapiens
ggaggtgggattaggacctaaa

SEQ ID NO: 9182161 - DNA, 22 bp, Homo sapiens
ggaggtgggattaggacctaaa

SEQ ID NO: 9182162 - DNA, 22 bp, Homo sapiens
ggaggtgggagcctccagtggt

SEQ ID NO: 9182163 - DNA, 22 bp, Homo sapiens
ggaggtgggagcctccagtggt

SEQ ID NO: 9182164 - DNA, 22 bp, Homo sapiens
ggaggtgggctaaggactctct

SEQ ID NO: 9182165 - DNA, 22 bp, Homo sapiens
ggaggtgggctaaggactctct

SEQ ID NO: 9182166 - DNA, 22 bp, Homo sapiens
ggaggtgggctaaggactctct

SEQ ID NO: 9182167 - DNA, 22 bp, Homo sapiens
ggaggtgggctaaggactctct

SEQ ID NO: 9182168 - DNA, 22 bp, Homo sapiens
ggagtagctgcattccgagcac

SEQ ID NO: 9182169 - DNA, 22 bp, Homo sapiens
ggagtagctgcattccgagcac

SEQ ID NO: 9182170 - DNA, 22 bp, Homo sapiens
ggaggttctctctttgcagagc

SEQ ID NO: 9182171 - DNA, 22 bp, Homo sapiens
ggagggggaattcagccccagc

SEQ ID NO: 9182172 - DNA, 22 bp, Homo sapiens
ggagggggaattcagccccagc

SEQ ID NO: 9182173 - DNA, 22 bp, Homo sapiens
ggagggggaagaagctaaagac

SEQ ID NO: 9182174 - DNA, 22 bp, Homo sapiens
ggagggggaagaagctaaagac

SEQ ID NO: 9182175 - DNA, 22 bp, Homo sapiens
ggagggggaattcagccccagc

SEQ ID NO: 9182176 - DNA, 22 bp, Homo sapiens
ggagggggaaactttggctgcc

SEQ ID NO: 9182177 - DNA, 22 bp, Homo sapiens
ggagggggaaactttggctgcc

SEQ ID NO: 9182178 - DNA, 22 bp, Homo sapiens
ggagggggaaactttggctgcc

SEQ ID NO: 9182179 - DNA, 22 bp, Homo sapiens
ggaggggagtctcccaaagccg

SEQ ID NO: 9182180 - DNA, 22 bp, Homo sapiens
ggaggggaggtccagctgatct

SEQ ID NO: 9182181 - DNA, 22 bp, Homo sapiens
ggaggggaggtccagctgatct

SEQ ID NO: 9182182 - DNA, 22 bp, Homo sapiens
ggaggggaggattaatgacaaa

SEQ ID NO: 9182183 - DNA, 22 bp, Homo sapiens
ggaggggagatgtttgggctca

SEQ ID NO: 9182184 - DNA, 22 bp, Homo sapiens
ggagggtctaagggagaactga

SEQ ID NO: 9182185 - DNA, 22 bp, Homo sapiens
ggagggtccatcttgtgaaaag

SEQ ID NO: 9182186 - DNA, 22 bp, Homo sapiens
ggagggtctaagggagaactga

SEQ ID NO: 9182187 - DNA, 22 bp, Homo sapiens
ggaggggtggaaggagtgcctg

SEQ ID NO: 9182188 - DNA, 22 bp, Homo sapiens
ggaggggtggaaggagtgcctg

SEQ ID NO: 9182189 - DNA, 22 bp, Homo sapiens
ggaggggtggtcacctggcagg

SEQ ID NO: 9182190 - DNA, 22 bp, Homo sapiens
ggagggtccactgtgaggcaga

SEQ ID NO: 9182191 - DNA, 22 bp, Homo sapiens
ggaggggtggtcgcgaagagca

SEQ ID NO: 9182192 - DNA, 22 bp, Homo sapiens
ggagggggactgacactgattt

SEQ ID NO: 9182193 - DNA, 22 bp, Homo sapiens
ggaggggtctctagcgaggaga

SEQ ID NO: 9182194 - DNA, 22 bp, Homo sapiens
ggaggggtctctagcgaggaga

SEQ ID NO: 9182195 - DNA, 22 bp, Homo sapiens
ggaggggtctctagcgaggaga

SEQ ID NO: 9182196 - DNA, 22 bp, Homo sapiens
ggaggggtgagaatggctgcct

SEQ ID NO: 9182197 - DNA, 22 bp, Homo sapiens
ggaggggtgctcagctgtcacg

SEQ ID NO: 9182198 - DNA, 22 bp, Homo sapiens
ggaggggtggaaggagtgcctg

SEQ ID NO: 9182199 - DNA, 23 bp, Homo sapiens
ggaggctcaagtatcacgggcag

SEQ ID NO: 9182200 - DNA, 22 bp, Homo sapiens
ggaggcggaggttgcagtgagc

SEQ ID NO: 9182201 - DNA, 22 bp, Homo sapiens
ggaggcggaggttgcagtgagc

SEQ ID NO: 9182202 - DNA, 22 bp, Homo sapiens
ggaggcggaggttgcagtgagt

SEQ ID NO: 9182203 - DNA, 22 bp, Homo sapiens
ggaggcggaggttgcagtgagt

SEQ ID NO: 9182204 - DNA, 22 bp, Homo sapiens
ggaggcctaaggtacagtttgc

SEQ ID NO: 9182205 - DNA, 22 bp, Homo sapiens
ggaggcctaaggtacagtttgc

SEQ ID NO: 9182206 - DNA, 22 bp, Homo sapiens
ggaggcccagaaggaagcccag

SEQ ID NO: 9182207 - DNA, 22 bp, Homo sapiens
ggaggccatgaggctctaggtg

SEQ ID NO: 9182208 - DNA, 22 bp, Homo sapiens
ggaggcccagagaggtgaagtg

SEQ ID NO: 9182209 - DNA, 22 bp, Homo sapiens
ggaggcctagccagctccagtt

SEQ ID NO: 9182210 - DNA, 22 bp, Homo sapiens
ggaggcctcctgggggaggttc

SEQ ID NO: 9182211 - DNA, 22 bp, Homo sapiens
ggaggctgagaagtccaagatc

SEQ ID NO: 9182212 - DNA, 22 bp, Homo sapiens
ggaggctgaggcaggcggatca

SEQ ID NO: 9182213 - DNA, 22 bp, Homo sapiens
ggaggctgaggcaggcggatca

SEQ ID NO: 9182214 - DNA, 22 bp, Homo sapiens
ggaggctgaggcaggcggatca

SEQ ID NO: 9182215 - DNA, 22 bp, Homo sapiens
ggaggctgaggcccctcacagg

SEQ ID NO: 9182216 - DNA, 19 bp, Homo sapiens
ggaggcttcttggggtcgg

SEQ ID NO: 9182217 - DNA, 22 bp, Homo sapiens
ggaggcttcctggctcttgatt

SEQ ID NO: 9182218 - DNA, 22 bp, Homo sapiens
ggaggggaactaatcccgtgac

SEQ ID NO: 9182219 - DNA, 22 bp, Homo sapiens
ggaggggaactaatcccgtgac

SEQ ID NO: 9182220 - DNA, 18 bp, Homo sapiens
ggagggctttggggactg

SEQ ID NO: 9182221 - DNA, 22 bp, Homo sapiens
ggagggctgccaggtggagcgg

SEQ ID NO: 9182222 - DNA, 22 bp, Homo sapiens
ggagggctgccaggtggagcgg

SEQ ID NO: 9182223 - DNA, 22 bp, Homo sapiens
ggagggctgccaggtggagcgg

SEQ ID NO: 9182224 - DNA, 22 bp, Homo sapiens
ggagggctgtagaggagacctg

SEQ ID NO: 9182225 - DNA, 22 bp, Homo sapiens
ggagggctccctgggagtggat

SEQ ID NO: 9182226 - DNA, 22 bp, Homo sapiens
ggagggctccctgggagtggat

SEQ ID NO: 9182227 - DNA, 22 bp, Homo sapiens
ggagggctccctgggagtggat

SEQ ID NO: 9182228 - DNA, 22 bp, Homo sapiens
ggagggctgagactggggtctg

SEQ ID NO: 9182229 - DNA, 22 bp, Homo sapiens
ggagggctgagactggggtctg

SEQ ID NO: 9182230 - DNA, 22 bp, Homo sapiens
ggaggcttgatgatcttggata

SEQ ID NO: 9182231 - DNA, 22 bp, Homo sapiens
ggagggaaccttggctggattg

SEQ ID NO: 9182232 - DNA, 22 bp, Homo sapiens
ggagggaagtgagttctcagct

SEQ ID NO: 9182233 - DNA, 22 bp, Homo sapiens
ggagggacccactctagaggtg

SEQ ID NO: 9182234 - DNA, 22 bp, Homo sapiens
ggagggacccactctagaggtg

SEQ ID NO: 9182235 - DNA, 22 bp, Homo sapiens
ggagggagagtgaccctaccaa

SEQ ID NO: 9182236 - DNA, 22 bp, Homo sapiens
ggagggacccactgcggtgacc

SEQ ID NO: 9182237 - DNA, 22 bp, Homo sapiens
ggagggagagtgaccctaccaa

SEQ ID NO: 9182238 - DNA, 22 bp, Homo sapiens
ggagggcccctccagtgggcag

SEQ ID NO: 9182239 - DNA, 22 bp, Homo sapiens
ggagggccctgggtgcagctct

SEQ ID NO: 9182240 - DNA, 22 bp, Homo sapiens
ggaaactgcttacactagaggg

SEQ ID NO: 9182241 - DNA, 22 bp, Homo sapiens
ggaaactgtagtttgctgacat

SEQ ID NO: 9182242 - DNA, 22 bp, Homo sapiens
ggaaacttgttattgtattttc

SEQ ID NO: 9182243 - DNA, 19 bp, Homo sapiens
ggaaacaggggccagagga

SEQ ID NO: 9182244 - DNA, 19 bp, Homo sapiens
ggaaacaggggccagagga

SEQ ID NO: 9182245 - DNA, 22 bp, Homo sapiens
ggaaacagctctttggggctgt

SEQ ID NO: 9182246 - DNA, 19 bp, Homo sapiens
ggaaacaggggccagagga

SEQ ID NO: 9182247 - DNA, 22 bp, Homo sapiens
ggaaacagcaaattatggcaat

SEQ ID NO: 9182248 - DNA, 19 bp, Homo sapiens
ggaaacagcacacttttga

SEQ ID NO: 9182249 - DNA, 22 bp, Homo sapiens
ggaaacagctctttggggctgt

SEQ ID NO: 9182250 - DNA, 22 bp, Homo sapiens
ggaaacagagggcacctgagcc

SEQ ID NO: 9182251 - DNA, 22 bp, Homo sapiens
ggaaacagagggcacctgagcc

SEQ ID NO: 9182252 - DNA, 22 bp, Homo sapiens
ggaaacagagggcacctgagcc

SEQ ID NO: 9182253 - DNA, 22 bp, Homo sapiens
ggaaaacagcgattggtatcat

SEQ ID NO: 9182254 - DNA, 22 bp, Homo sapiens
ggaaacacacccagagaagcag

SEQ ID NO: 9182255 - DNA, 22 bp, Homo sapiens
ggaaacacagaggctgagctca

SEQ ID NO: 9182256 - DNA, 22 bp, Homo sapiens
ggaaaacaagagaatgatgttt

SEQ ID NO: 9182257 - DNA, 22 bp, Homo sapiens
gcttctggggttctggcatgct

SEQ ID NO: 9182258 - DNA, 22 bp, Homo sapiens
gcttctggaggagctgggctga

SEQ ID NO: 9182259 - DNA, 22 bp, Homo sapiens
ggaaagagctaaaagggtgaga

SEQ ID NO: 9182260 - DNA, 22 bp, Homo sapiens
ggaaagagctaaaagggtgaga

SEQ ID NO: 9182261 - DNA, 22 bp, Homo sapiens
ggaaagagggacccagcttggt

SEQ ID NO: 9182262 - DNA, 22 bp, Homo sapiens
ggaaagaggatagtgggtaggt

SEQ ID NO: 9182263 - DNA, 22 bp, Homo sapiens
ggaactcctgctccaagcagct

SEQ ID NO: 9182264 - DNA, 22 bp, Homo sapiens
ggaactcctgctccaagcagct

SEQ ID NO: 9182265 - DNA, 22 bp, Homo sapiens
ggaaagccaggtgctctggtgt

SEQ ID NO: 9182266 - DNA, 22 bp, Homo sapiens
ggaaagcatccaggtgccccca

SEQ ID NO: 9182267 - DNA, 22 bp, Homo sapiens
ggaaagatttgtcacatgaatg

SEQ ID NO: 9182268 - DNA, 22 bp, Homo sapiens
ggaaagccaggtgctctggtgt

SEQ ID NO: 9182269 - DNA, 22 bp, Homo sapiens
ggaaagagcccagcagtgcttg

SEQ ID NO: 9182270 - DNA, 22 bp, Homo sapiens
ggaaagaatagagactttatca

SEQ ID NO: 9182271 - DNA, 22 bp, Homo sapiens
ggaaagaatcaagtgatcctgt

SEQ ID NO: 9182272 - DNA, 22 bp, Homo sapiens
ggaaagacctgagataggaata

SEQ ID NO: 9182273 - DNA, 22 bp, Homo sapiens
ggaaagaatcaagtgatcctgt

SEQ ID NO: 9182274 - DNA, 22 bp, Homo sapiens
ggaaagagaagttgggaggaat

SEQ ID NO: 9182275 - DNA, 22 bp, Homo sapiens
ggaaagaaccctggatggctgg

SEQ ID NO: 9182276 - DNA, 22 bp, Homo sapiens
ggaaagaaagtgtgaacaactt

SEQ ID NO: 9182277 - DNA, 22 bp, Homo sapiens
ggaaagaatagagactttatca

SEQ ID NO: 9182278 - DNA, 21 bp, Homo sapiens
ggaaagaaggcaaggctcagg

SEQ ID NO: 9182279 - DNA, 21 bp, Homo sapiens
ggaaagaaggcaaggctcagg

SEQ ID NO: 9182280 - DNA, 21 bp, Homo sapiens
ggaaagaaggcaaggctcagg

SEQ ID NO: 9182281 - DNA, 22 bp, Homo sapiens
ggaagaaagcacacaaacttga

SEQ ID NO: 9182282 - DNA, 22 bp, Homo sapiens
ggaagaaagcacacaaacttga

SEQ ID NO: 9182283 - DNA, 22 bp, Homo sapiens
ggaagaaaatgggcaacaggtg

SEQ ID NO: 9182284 - DNA, 22 bp, Homo sapiens
ggaagaaaggtggacaacaggt

SEQ ID NO: 9182285 - DNA, 22 bp, Homo sapiens
ggaagaaaggtggacaacaggt

SEQ ID NO: 9182286 - DNA, 22 bp, Homo sapiens
ggaagaaatctggttaagagat

SEQ ID NO: 9182287 - DNA, 22 bp, Homo sapiens
ggaagaaagtagaaaaccgtgg

SEQ ID NO: 9182288 - DNA, 18 bp, Homo sapiens
ggaagaaaaggaactcag

SEQ ID NO: 9182289 - DNA, 18 bp, Homo sapiens
ggaagaaaaggaactcag

SEQ ID NO: 9182290 - DNA, 17 bp, Homo sapiens
ggaagaaaaggatcatc

SEQ ID NO: 9182291 - DNA, 17 bp, Homo sapiens
ggaagaaaaggatcatc

SEQ ID NO: 9182292 - DNA, 22 bp, Homo sapiens
ggaactggagaatgccctcttt

SEQ ID NO: 9182293 - DNA, 22 bp, Homo sapiens
ggaactgagcaatggcatgaaa

SEQ ID NO: 9182294 - DNA, 22 bp, Homo sapiens
ggaactgaatgtctcggtataa

SEQ ID NO: 9182295 - DNA, 22 bp, Homo sapiens
ggaactgagaagcagctatgcc

SEQ ID NO: 9182296 - DNA, 22 bp, Homo sapiens
ggaacttgcaacctctggtcac

SEQ ID NO: 9182297 - DNA, 22 bp, Homo sapiens
ggaacttgaaaatcaaggtggt

SEQ ID NO: 9182298 - DNA, 22 bp, Homo sapiens
ggaactgggttagggtctcttc

SEQ ID NO: 9182299 - DNA, 19 bp, Homo sapiens
ggaacttggcctttaccca

SEQ ID NO: 9182300 - DNA, 22 bp, Homo sapiens
ggaactttaggatcctggctca

SEQ ID NO: 9182301 - DNA, 22 bp, Homo sapiens
ggaagaaatgctcttctatgcg

SEQ ID NO: 9182302 - DNA, 22 bp, Homo sapiens
ggaagggagtagttggaatgca

SEQ ID NO: 9182303 - DNA, 22 bp, Homo sapiens
ggaagggagtagttggaatgca

SEQ ID NO: 9182304 - DNA, 22 bp, Homo sapiens
ggaagggagtagttggaatgca

SEQ ID NO: 9182305 - DNA, 22 bp, Homo sapiens
ggaagaaatgctcttctatgcg

SEQ ID NO: 9182306 - DNA, 22 bp, Homo sapiens
ggaagaaatctggttaagagat

SEQ ID NO: 9182307 - DNA, 22 bp, Homo sapiens
ggaagggcaaaagagatgaact

SEQ ID NO: 9182308 - DNA, 22 bp, Homo sapiens
ggaagggcaaaagagatgaact

SEQ ID NO: 9182309 - DNA, 22 bp, Homo sapiens
ggaagggcaataaaatctcagg

SEQ ID NO: 9182310 - DNA, 22 bp, Homo sapiens
ggaaggggtgggtgagcctcag

SEQ ID NO: 9182311 - DNA, 22 bp, Homo sapiens
ggaaggggtgggtgagcctcag

SEQ ID NO: 9182312 - DNA, 22 bp, Homo sapiens
ggaaggggtgggtgagcctcag

SEQ ID NO: 9182313 - DNA, 21 bp, Homo sapiens
ggaaggggtcctcccaacagt

SEQ ID NO: 9182314 - DNA, 22 bp, Homo sapiens
ggaaggggtgggtgagcctcag

SEQ ID NO: 9182315 - DNA, 19 bp, Homo sapiens
ggaaggtgacagtggtgaa

SEQ ID NO: 9182316 - DNA, 19 bp, Homo sapiens
ggaaggtgacagtggtgaa

SEQ ID NO: 9182317 - DNA, 22 bp, Homo sapiens
ggaaggtcgagctgcatctggc

SEQ ID NO: 9182318 - DNA, 19 bp, Homo sapiens
ggaaggtgacagtggtgaa

SEQ ID NO: 9182319 - DNA, 22 bp, Homo sapiens
ggaaggtgctccctggacagag

SEQ ID NO: 9182320 - DNA, 18 bp, Homo sapiens
ggaaggtgatgtgaaaag

SEQ ID NO: 9182321 - DNA, 22 bp, Homo sapiens
ggaaggggttaggggtccctga

SEQ ID NO: 9182322 - DNA, 22 bp, Homo sapiens
ggaaggggtgtcgcccatggat

SEQ ID NO: 9182323 - DNA, 22 bp, Homo sapiens
ggaaggggtgtcgcccatggat

SEQ ID NO: 9182324 - DNA, 22 bp, Homo sapiens
gcttcacagaatcaatagttgg

SEQ ID NO: 9182325 - DNA, 22 bp, Homo sapiens
gcttcagattcttttcatgtct

SEQ ID NO: 9182326 - DNA, 22 bp, Homo sapiens
gcttcagatttatgtatcattg

SEQ ID NO: 9182327 - DNA, 22 bp, Homo sapiens
gcttcagacctgaaaggaaaaa

SEQ ID NO: 9182328 - DNA, 22 bp, Homo sapiens
gcttcagacctgaaaggaaaaa

SEQ ID NO: 9182329 - DNA, 22 bp, Homo sapiens
gcttcctgggacaggctatgtg

SEQ ID NO: 9182330 - DNA, 22 bp, Homo sapiens
gcttcctggagggagagagctg

SEQ ID NO: 9182331 - DNA, 22 bp, Homo sapiens
gcttcatacaatggtatatgca

SEQ ID NO: 9182332 - DNA, 22 bp, Homo sapiens
gcttcagtttaggggttaattg

SEQ ID NO: 9182333 - DNA, 22 bp, Homo sapiens
gcttcaggctgaattcctccta

SEQ ID NO: 9182334 - DNA, 22 bp, Homo sapiens
gcttcagggttatgcaagagtg

SEQ ID NO: 9182335 - DNA, 22 bp, Homo sapiens
gcttctggaagcatatgcaaga

SEQ ID NO: 9182336 - DNA, 22 bp, Homo sapiens
gcttcctgtatcctcctgtacc

SEQ ID NO: 9182337 - DNA, 22 bp, Homo sapiens
gcttccttccttacattggtgg

SEQ ID NO: 9182338 - DNA, 22 bp, Homo sapiens
gcttccttattgttgccatagt

SEQ ID NO: 9182339 - DNA, 22 bp, Homo sapiens
gcttccttctaccacatcatgc

SEQ ID NO: 9182340 - DNA, 22 bp, Homo sapiens
gcttcggggtccaagcgcgtgt

SEQ ID NO: 9182341 - DNA, 22 bp, Homo sapiens
gcttccttggtcctggtctaag

SEQ ID NO: 9182342 - DNA, 22 bp, Homo sapiens
gctgggctcatttgtgtgtctg

SEQ ID NO: 9182343 - DNA, 22 bp, Homo sapiens
gctgggctcatttgtgtgtctg

SEQ ID NO: 9182344 - DNA, 22 bp, Homo sapiens
gctgggctccaccctcaactgt

SEQ ID NO: 9182345 - DNA, 22 bp, Homo sapiens
gctgggctcatttgtgtgtctg

SEQ ID NO: 9182346 - DNA, 22 bp, Homo sapiens
gctgggctccaggccagggtga

SEQ ID NO: 9182347 - DNA, 22 bp, Homo sapiens
gctgggctccaggccagggtga

SEQ ID NO: 9182348 - DNA, 22 bp, Homo sapiens
gctgggctccaccctcaactgt

SEQ ID NO: 9182349 - DNA, 22 bp, Homo sapiens
gctgggctccaccctcaactgt

SEQ ID NO: 9182350 - DNA, 22 bp, Homo sapiens
gctgggctcagacctagtgaac

SEQ ID NO: 9182351 - DNA, 22 bp, Homo sapiens
gctgggctcagacctagtgaac

SEQ ID NO: 9182352 - DNA, 22 bp, Homo sapiens
gctgggctgagaagttaagcaa

SEQ ID NO: 9182353 - DNA, 22 bp, Homo sapiens
gctgggctcttatcacctgtac

SEQ ID NO: 9182354 - DNA, 22 bp, Homo sapiens
gctgggctctttacccctgtac

SEQ ID NO: 9182355 - DNA, 22 bp, Homo sapiens
gctgggctctttacccctgtac

SEQ ID NO: 9182356 - DNA, 22 bp, Homo sapiens
gctgggctctttacccctgtac

SEQ ID NO: 9182357 - DNA, 21 bp, Homo sapiens
gctgggctccagtctgccgct

SEQ ID NO: 9182358 - DNA, 22 bp, Homo sapiens
gctgggctcgttcccacacgcg

SEQ ID NO: 9182359 - DNA, 21 bp, Homo sapiens
gctgggctccagtctgccgct

SEQ ID NO: 9182360 - DNA, 22 bp, Homo sapiens
gctgggctcgttcccacacgcg

SEQ ID NO: 9182361 - DNA, 22 bp, Homo sapiens
gctgggctctgtcatgccttcc

SEQ ID NO: 9182362 - DNA, 22 bp, Homo sapiens
gctgggctcttatcacctgtac

SEQ ID NO: 9182363 - DNA, 16 bp, Homo sapiens
gcttagtgagagcaac

SEQ ID NO: 9182364 - DNA, 22 bp, Homo sapiens
gcttagtggtgtgcaaaggggt

SEQ ID NO: 9182365 - DNA, 22 bp, Homo sapiens
gcttagtgtaggacctggaata

SEQ ID NO: 9182366 - DNA, 22 bp, Homo sapiens
gcttagtccccaagagagacca

SEQ ID NO: 9182367 - DNA, 22 bp, Homo sapiens
gcttagtgaaacaacctttggc

SEQ ID NO: 9182368 - DNA, 20 bp, Homo sapiens
gcttagcaggcatagtagct

SEQ ID NO: 9182369 - DNA, 22 bp, Homo sapiens
gcttagcagtcacacattgttc

SEQ ID NO: 9182370 - DNA, 22 bp, Homo sapiens
gcttacaggtgaggcagcaaga

SEQ ID NO: 9182371 - DNA, 22 bp, Homo sapiens
gcttagaaagtgattgatacat

SEQ ID NO: 9182372 - DNA, 22 bp, Homo sapiens
gctgggctgcccaacctctgac

SEQ ID NO: 9182373 - DNA, 22 bp, Homo sapiens
gctgggctgcccaacctctgac

SEQ ID NO: 9182374 - DNA, 22 bp, Homo sapiens
gctgggctgcgtcggggaagcc

SEQ ID NO: 9182375 - DNA, 22 bp, Homo sapiens
gctgggctgagctagacttggc

SEQ ID NO: 9182376 - DNA, 22 bp, Homo sapiens
gctgggctgagctagacttggc

SEQ ID NO: 9182377 - DNA, 22 bp, Homo sapiens
gcttacaagatcgtgctccagt

SEQ ID NO: 9182378 - DNA, 22 bp, Homo sapiens
gctgggctgcgtcggggaagcc

SEQ ID NO: 9182379 - DNA, 22 bp, Homo sapiens
gctgggctgcgtcggggaagcc

SEQ ID NO: 9182380 - DNA, 22 bp, Homo sapiens
gctgggctgcgtcggggaagcc

SEQ ID NO: 9182381 - DNA, 22 bp, Homo sapiens
gctgggctgcgtcggggaagcc

SEQ ID NO: 9182382 - DNA, 22 bp, Homo sapiens
ggaggaaaggctccctccctct

SEQ ID NO: 9182383 - DNA, 22 bp, Homo sapiens
ggaggaaaggctccctccctct

SEQ ID NO: 9182384 - DNA, 22 bp, Homo sapiens
ggagctgatgacgtcaccatgg

SEQ ID NO: 9182385 - DNA, 22 bp, Homo sapiens
ggagctgatggtagaagaatga

SEQ ID NO: 9182386 - DNA, 22 bp, Homo sapiens
ggagctgagcagcgatggcgga

SEQ ID NO: 9182387 - DNA, 22 bp, Homo sapiens
ggagctgagagtagtccctttt

SEQ ID NO: 9182388 - DNA, 22 bp, Homo sapiens
ggagctgaggacactacatttt

SEQ ID NO: 9182389 - DNA, 22 bp, Homo sapiens
ggagctgaggctgaggcctcac

SEQ ID NO: 9182390 - DNA, 22 bp, Homo sapiens
ggagctgaggaatagctttgat

SEQ ID NO: 9182391 - DNA, 22 bp, Homo sapiens
ggagctgagttcttcagccggg

SEQ ID NO: 9182392 - DNA, 22 bp, Homo sapiens
ggagctgagtgggtttattgat

SEQ ID NO: 9182393 - DNA, 22 bp, Homo sapiens
ggagctgaggtaacagtgagtg

SEQ ID NO: 9182394 - DNA, 22 bp, Homo sapiens
ggagctcagtggggggactgtg

SEQ ID NO: 9182395 - DNA, 22 bp, Homo sapiens
ggagctctgtgtctctcctgcc

SEQ ID NO: 9182396 - DNA, 22 bp, Homo sapiens
ggagctctctcagggggtccaa

SEQ ID NO: 9182397 - DNA, 22 bp, Homo sapiens
ggagctgaaccccatcgtgctg

SEQ ID NO: 9182398 - DNA, 22 bp, Homo sapiens
ggagctgaaggggtgggctcag

SEQ ID NO: 9182399 - DNA, 22 bp, Homo sapiens
ggagctgagacccagtggctga

SEQ ID NO: 9182400 - DNA, 22 bp, Homo sapiens
ggaggaagggtagcataatgta

SEQ ID NO: 9182401 - DNA, 22 bp, Homo sapiens
ggaggaagtgcagttctactac

SEQ ID NO: 9182402 - DNA, 22 bp, Homo sapiens
ggaggaagcacacggcttgtat

SEQ ID NO: 9182403 - DNA, 22 bp, Homo sapiens
ggaggaagaggttgttctctca

SEQ ID NO: 9182404 - DNA, 22 bp, Homo sapiens
ggaggaaatgaaaggagggttt

SEQ ID NO: 9182405 - DNA, 22 bp, Homo sapiens
ggaggagcccactcaaagggga

SEQ ID NO: 9182406 - DNA, 22 bp, Homo sapiens
ggaggccagggtgggtggatcg

SEQ ID NO: 9182407 - DNA, 22 bp, Homo sapiens
ggaggccagggacccagtcagc

SEQ ID NO: 9182408 - DNA, 22 bp, Homo sapiens
ggaggccagggacccagtcagc

SEQ ID NO: 9182409 - DNA, 22 bp, Homo sapiens
ggaggccaggaaggctcggaga

SEQ ID NO: 9182410 - DNA, 22 bp, Homo sapiens
ggaggccagcctgaggctgagg

SEQ ID NO: 9182411 - DNA, 22 bp, Homo sapiens
ggaggccaggaagagccgccct

SEQ ID NO: 9182412 - DNA, 22 bp, Homo sapiens
ggaggccatgaggctctaggtg

SEQ ID NO: 9182413 - DNA, 22 bp, Homo sapiens
ggaggccatctggctggaggct

SEQ ID NO: 9182414 - DNA, 22 bp, Homo sapiens
ggaggccagtcctggccgggct

SEQ ID NO: 9182415 - DNA, 22 bp, Homo sapiens
ggaggccatagtttgggagtca

SEQ ID NO: 9182416 - DNA, 22 bp, Homo sapiens
ggaggaggcggcagaagttcct

SEQ ID NO: 9182417 - DNA, 22 bp, Homo sapiens
ggaggagctgctgtgggggccc

SEQ ID NO: 9182418 - DNA, 22 bp, Homo sapiens
ggaggaggcaagtaccagatgc

SEQ ID NO: 9182419 - DNA, 22 bp, Homo sapiens
ggaggcagaatagagtgtgggt

SEQ ID NO: 9182420 - DNA, 22 bp, Homo sapiens
ggaggccagaatctgtgttgga

SEQ ID NO: 9182421 - DNA, 22 bp, Homo sapiens
ggaggccacggtttagcaccga

SEQ ID NO: 9182422 - DNA, 22 bp, Homo sapiens
ggaggccacctgacctgctgtt

SEQ ID NO: 9182423 - DNA, 22 bp, Homo sapiens
ggaggccaattttctaactgca

SEQ ID NO: 9182424 - DNA, 22 bp, Homo sapiens
ggaggccaagtcactgacctgg

SEQ ID NO: 9182425 - DNA, 22 bp, Homo sapiens
ggaggccaaggtgggcggatca

SEQ ID NO: 9182426 - DNA, 17 bp, Homo sapiens
ggagacagggtctttaa

SEQ ID NO: 9182427 - DNA, 22 bp, Homo sapiens
ggagaaggtggctcagcaaagg

SEQ ID NO: 9182428 - DNA, 21 bp, Homo sapiens
ggagaaggacaatgttgagta

SEQ ID NO: 9182429 - DNA, 22 bp, Homo sapiens
ggagaaggaatattggagtagg

SEQ ID NO: 9182430 - DNA, 21 bp, Homo sapiens
ggagaaggacaatgttgagta

SEQ ID NO: 9182431 - DNA, 22 bp, Homo sapiens
ggagaaggaatattggagtagg

SEQ ID NO: 9182432 - DNA, 22 bp, Homo sapiens
ggagaaggaatattggagtagg

SEQ ID NO: 9182433 - DNA, 22 bp, Homo sapiens
ggagaaggaagaaagctactat

SEQ ID NO: 9182434 - DNA, 22 bp, Homo sapiens
ggagaaggaagaaagctactat

SEQ ID NO: 9182435 - DNA, 18 bp, Homo sapiens
ggaaggtgctggagtgca

SEQ ID NO: 9182436 - DNA, 23 bp, Homo sapiens
ggaagtcagcggagaggtggctg

SEQ ID NO: 9182437 - DNA, 22 bp, Homo sapiens
ggaagttgtatgatcggggaat

SEQ ID NO: 9182438 - DNA, 22 bp, Homo sapiens
ggaagtttattgagttcaagta

SEQ ID NO: 9182439 - DNA, 22 bp, Homo sapiens
ggaagtttcaggaatctgcatt

SEQ ID NO: 9182440 - DNA, 22 bp, Homo sapiens
ggaagtgaggaattaggtttat

SEQ ID NO: 9182441 - DNA, 22 bp, Homo sapiens
ggaagtggtagagccatgagtg

SEQ ID NO: 9182442 - DNA, 22 bp, Homo sapiens
ggaagtgaggaaatattttgtt

SEQ ID NO: 9182443 - DNA, 22 bp, Homo sapiens
ggaagtctcagcaacagagtta

SEQ ID NO: 9182444 - DNA, 22 bp, Homo sapiens
ggaagtgaggaattaggtttat

SEQ ID NO: 9182445 - DNA, 22 bp, Homo sapiens
ggaagtttgtagatgtttctta

SEQ ID NO: 9182446 - DNA, 22 bp, Homo sapiens
ggaagtttgtatactggcctct

SEQ ID NO: 9182447 - DNA, 22 bp, Homo sapiens
ggaagtttctggtgaggacgag

SEQ ID NO: 9182448 - DNA, 18 bp, Homo sapiens
ggaagtttgggtcccctg

SEQ ID NO: 9182449 - DNA, 22 bp, Homo sapiens
ggaagtttgagcatctgtttcc

SEQ ID NO: 9182450 - DNA, 22 bp, Homo sapiens
ggaagtttgggagctggtaatc

SEQ ID NO: 9182451 - DNA, 22 bp, Homo sapiens
ggaatagcttcaccttccttgc

SEQ ID NO: 9182452 - DNA, 19 bp, Homo sapiens
ggagaagcccaggaatcct

SEQ ID NO: 9182453 - DNA, 22 bp, Homo sapiens
ggagaagcaggtgctttgggtc

SEQ ID NO: 9182454 - DNA, 22 bp, Homo sapiens
ggagaagccacacattgggtgt

SEQ ID NO: 9182455 - DNA, 19 bp, Homo sapiens
ggagaagcatctagaaata

SEQ ID NO: 9182456 - DNA, 22 bp, Homo sapiens
ggagaggtgcaggtcagtggca

SEQ ID NO: 9182457 - DNA, 22 bp, Homo sapiens
ggagaggtgagaggtacaagtt

SEQ ID NO: 9182458 - DNA, 22 bp, Homo sapiens
ggagaggtgtattcagtgggtc

SEQ ID NO: 9182459 - DNA, 22 bp, Homo sapiens
ggagaggtgtattcagtgggtc

SEQ ID NO: 9182460 - DNA, 22 bp, Homo sapiens
ggagagggtgtggaaagttatc

SEQ ID NO: 9182461 - DNA, 22 bp, Homo sapiens
ggagaggtgaatggctgctcta

SEQ ID NO: 9182462 - DNA, 22 bp, Homo sapiens
ggagagggtaggggtcctgccc

SEQ ID NO: 9182463 - DNA, 22 bp, Homo sapiens
ggagagggtaggggtcctgccc

SEQ ID NO: 9182464 - DNA, 22 bp, Homo sapiens
ggagagggtaggggtcctgccc

SEQ ID NO: 9182465 - DNA, 22 bp, Homo sapiens
ggagaggggaacttgttgcttg

SEQ ID NO: 9182466 - DNA, 22 bp, Homo sapiens
ggagaggggaacttgttgcttg

SEQ ID NO: 9182467 - DNA, 22 bp, Homo sapiens
ggagaggggcaagtttatctag

SEQ ID NO: 9182468 - DNA, 22 bp, Homo sapiens
ggagagggggctccctgcttgg

SEQ ID NO: 9182469 - DNA, 22 bp, Homo sapiens
ggagagggggctccctgcttgg

SEQ ID NO: 9182470 - DNA, 23 bp, Homo sapiens
ggagaggggtgtgggcatcttta

SEQ ID NO: 9182471 - DNA, 23 bp, Homo sapiens
ggagaggggtgtgggcatcttta

SEQ ID NO: 9182472 - DNA, 23 bp, Homo sapiens
ggagaggggtgtgggcatcttta

SEQ ID NO: 9182473 - DNA, 22 bp, Homo sapiens
ggagagggtaggggtcctgccc

SEQ ID NO: 9182474 - DNA, 22 bp, Homo sapiens
ggagcctggttactagagcctg

SEQ ID NO: 9182475 - DNA, 22 bp, Homo sapiens
ggagcctgtgcccaagcccaga

SEQ ID NO: 9182476 - DNA, 22 bp, Homo sapiens
ggagcctgtgcccaagcccaga

SEQ ID NO: 9182477 - DNA, 22 bp, Homo sapiens
ggagcctggtcaggttggctcc

SEQ ID NO: 9182478 - DNA, 22 bp, Homo sapiens
ggagcctggtcaggttggctcc

SEQ ID NO: 9182479 - DNA, 22 bp, Homo sapiens
ggagatgctttccagtggggat

SEQ ID NO: 9182480 - DNA, 22 bp, Homo sapiens
ggagatgctttccagtggggat

SEQ ID NO: 9182481 - DNA, 22 bp, Homo sapiens
ggagatgctatgtagtttggtt

SEQ ID NO: 9182482 - DNA, 22 bp, Homo sapiens
ggagatgctatgtagtttggtt

SEQ ID NO: 9182483 - DNA, 20 bp, Homo sapiens
ggagatgcctctcagtccat

SEQ ID NO: 9182484 - DNA, 22 bp, Homo sapiens
ggagatgccttgtttcaggaac

SEQ ID NO: 9182485 - DNA, 22 bp, Homo sapiens
ggagatgccagaattgcaaatt

SEQ ID NO: 9182486 - DNA, 20 bp, Homo sapiens
ggagatgcagcccaggtgcc

SEQ ID NO: 9182487 - DNA, 20 bp, Homo sapiens
ggagatgcagcccaggtgcc

SEQ ID NO: 9182488 - DNA, 22 bp, Homo sapiens
ggagatgacacaatttatttat

SEQ ID NO: 9182489 - DNA, 22 bp, Homo sapiens
ggagcctgtggctgcttgaagc

SEQ ID NO: 9182490 - DNA, 22 bp, Homo sapiens
ggagcctgtggccgtcacgact

SEQ ID NO: 9182491 - DNA, 22 bp, Homo sapiens
ggagcctgtgggatgagatgtg

SEQ ID NO: 9182492 - DNA, 22 bp, Homo sapiens
ggagcctgtgggatgagatgtg

SEQ ID NO: 9182493 - DNA, 22 bp, Homo sapiens
ggagcctgttagttgagtgctc

SEQ ID NO: 9182494 - DNA, 22 bp, Homo sapiens
gggcagcccagaactgctgcag

SEQ ID NO: 9182495 - DNA, 22 bp, Homo sapiens
gggcagcccagaactgctgcag

SEQ ID NO: 9182496 - DNA, 22 bp, Homo sapiens
gggcagcagaattggacagaaa

SEQ ID NO: 9182497 - DNA, 22 bp, Homo sapiens
gggcagcagagccctgccgagt

SEQ ID NO: 9182498 - DNA, 22 bp, Homo sapiens
gggcagcagaattggacagaaa

SEQ ID NO: 9182499 - DNA, 22 bp, Homo sapiens
gggcagcccagaactgctgcag

SEQ ID NO: 9182500 - DNA, 20 bp, Homo sapiens
gggcagcctcgggagtgggt

SEQ ID NO: 9182501 - DNA, 22 bp, Homo sapiens
gggcagcacgtttcaggaggat

SEQ ID NO: 9182502 - DNA, 22 bp, Homo sapiens
gggcagcacgtttcaggaggat

SEQ ID NO: 9182503 - DNA, 21 bp, Homo sapiens
gggcagcacgtcattcctgtg

SEQ ID NO: 9182504 - DNA, 22 bp, Homo sapiens
gggcagcacagacagtgaaggc

SEQ ID NO: 9182505 - DNA, 18 bp, Homo sapiens
gggcagcacagcagcctc

SEQ ID NO: 9182506 - DNA, 22 bp, Homo sapiens
gggcagcaaatctgagtctggt

SEQ ID NO: 9182507 - DNA, 22 bp, Homo sapiens
gggcagcaaatctgagtctggt

SEQ ID NO: 9182508 - DNA, 22 bp, Homo sapiens
gggcagcaaatctgagtctggt

SEQ ID NO: 9182509 - DNA, 20 bp, Homo sapiens
gggcagcaagacatttgaca

SEQ ID NO: 9182510 - DNA, 20 bp, Homo sapiens
gggcagcaagacatttgaca

SEQ ID NO: 9182511 - DNA, 22 bp, Homo sapiens
gggcagaggttcaacttcaaca

SEQ ID NO: 9182512 - DNA, 22 bp, Homo sapiens
gggcagaggttcaacttcaaca

SEQ ID NO: 9182513 - DNA, 22 bp, Homo sapiens
gggcagatcacctgaggtcagg

SEQ ID NO: 9182514 - DNA, 21 bp, Homo sapiens
gggccacaccttctgcagacc

SEQ ID NO: 9182515 - DNA, 21 bp, Homo sapiens
gggccacaccttctgcagacc

SEQ ID NO: 9182516 - DNA, 22 bp, Homo sapiens
gggcagctctcacagcagccaa

SEQ ID NO: 9182517 - DNA, 22 bp, Homo sapiens
gggccacaggagaggctgtcag

SEQ ID NO: 9182518 - DNA, 22 bp, Homo sapiens
gggcagctcctgtggaatccac

SEQ ID NO: 9182519 - DNA, 22 bp, Homo sapiens
gggcagctcggaagtgggaaag

SEQ ID NO: 9182520 - DNA, 22 bp, Homo sapiens
gggcagcctcggtgcctgctgc

SEQ ID NO: 9182521 - DNA, 22 bp, Homo sapiens
gggcagcctcggtgcctgctgc

SEQ ID NO: 9182522 - DNA, 22 bp, Homo sapiens
gggcagctagccctctagccca

SEQ ID NO: 9182523 - DNA, 22 bp, Homo sapiens
gggccaggtggaccccagcctc

SEQ ID NO: 9182524 - DNA, 22 bp, Homo sapiens
gggccagtagcacctgtgtgga

SEQ ID NO: 9182525 - DNA, 22 bp, Homo sapiens
gggccacattgaagggtgggta

SEQ ID NO: 9182526 - DNA, 22 bp, Homo sapiens
gggccacaggagaggctgtcag

SEQ ID NO: 9182527 - DNA, 22 bp, Homo sapiens
gggccacaggccttgcccgcag

SEQ ID NO: 9182528 - DNA, 22 bp, Homo sapiens
gggccagtgagtcgggagagct

SEQ ID NO: 9182529 - DNA, 22 bp, Homo sapiens
gggccagttctccgcctctttt

SEQ ID NO: 9182530 - DNA, 22 bp, Homo sapiens
gggccatgagaggttcatcaac

SEQ ID NO: 9182531 - DNA, 22 bp, Homo sapiens
gggcccagcactggctgggatc

SEQ ID NO: 9182532 - DNA, 22 bp, Homo sapiens
gggcccagcactggctgggatc

SEQ ID NO: 9182533 - DNA, 22 bp, Homo sapiens
gggccatgagaggttcatcaac

SEQ ID NO: 9182534 - DNA, 23 bp, Homo sapiens
gggcccagcacaggacctggcag

SEQ ID NO: 9182535 - DNA, 22 bp, Homo sapiens
gggcctggtgcttctgactcct

SEQ ID NO: 9182536 - DNA, 22 bp, Homo sapiens
gggcctggtgcttctgactcct

SEQ ID NO: 9182537 - DNA, 22 bp, Homo sapiens
gggcccagcgtggttccatctg

SEQ ID NO: 9182538 - DNA, 19 bp, Homo sapiens
gggcccagcatggagggtt

SEQ ID NO: 9182539 - DNA, 22 bp, Homo sapiens
gggcccagccctctgctcactg

SEQ ID NO: 9182540 - DNA, 19 bp, Homo sapiens
gggcccagcatggagggtt

SEQ ID NO: 9182541 - DNA, 22 bp, Homo sapiens
gggcggcgtcggcgaggccatc

SEQ ID NO: 9182542 - DNA, 22 bp, Homo sapiens
gggcggggggagctggaatgaa

SEQ ID NO: 9182543 - DNA, 22 bp, Homo sapiens
gggcggggggagctggaatgaa

SEQ ID NO: 9182544 - DNA, 22 bp, Homo sapiens
gggcggggggagctggaatgaa

SEQ ID NO: 9182545 - DNA, 22 bp, Homo sapiens
gggcgtggatggtcagtgcagg

SEQ ID NO: 9182546 - DNA, 22 bp, Homo sapiens
gggcgtggatggtcagtgcagg

SEQ ID NO: 9182547 - DNA, 22 bp, Homo sapiens
gggagaaggaggactgtgctgt

SEQ ID NO: 9182548 - DNA, 20 bp, Homo sapiens
gggagaagggctgatgagag

SEQ ID NO: 9182549 - DNA, 22 bp, Homo sapiens
gggagaaggagctagttcttga

SEQ ID NO: 9182550 - DNA, 22 bp, Homo sapiens
gggagaaggaggactgtgctgt

SEQ ID NO: 9182551 - DNA, 22 bp, Homo sapiens
gggaggcgccgagggtagctaa

SEQ ID NO: 9182552 - DNA, 20 bp, Homo sapiens
gggaggcgagggctgagcag

SEQ ID NO: 9182553 - DNA, 18 bp, Homo sapiens
gggaggccccagcaggag

SEQ ID NO: 9182554 - DNA, 22 bp, Homo sapiens
gggaggctgccatccttcagga

SEQ ID NO: 9182555 - DNA, 22 bp, Homo sapiens
gggaggctgccatccttcagga

SEQ ID NO: 9182556 - DNA, 22 bp, Homo sapiens
gggaggctctgctcagcccccg

SEQ ID NO: 9182557 - DNA, 22 bp, Homo sapiens
gggaggctcagtggtgtcctct

SEQ ID NO: 9182558 - DNA, 22 bp, Homo sapiens
gggaggctcagtggtgtcctct

SEQ ID NO: 9182559 - DNA, 22 bp, Homo sapiens
gggagaagaatgtgtcaattgt

SEQ ID NO: 9182560 - DNA, 22 bp, Homo sapiens
gggagaaggagctagttcttga

SEQ ID NO: 9182561 - DNA, 22 bp, Homo sapiens
gggacgagatcttggcagtgtg

SEQ ID NO: 9182562 - DNA, 22 bp, Homo sapiens
gggacgggcagtccaaggggtc

SEQ ID NO: 9182563 - DNA, 22 bp, Homo sapiens
gggaccaggtcagggctctgac

SEQ ID NO: 9182564 - DNA, 22 bp, Homo sapiens
gggaccagtgtctgtgagaaaa

SEQ ID NO: 9182565 - DNA, 22 bp, Homo sapiens
gggaccctgggaggctggcgca

SEQ ID NO: 9182566 - DNA, 22 bp, Homo sapiens
gggacctgcgccactcactgtc

SEQ ID NO: 9182567 - DNA, 22 bp, Homo sapiens
gggacctgaggccctgctccac

SEQ ID NO: 9182568 - DNA, 22 bp, Homo sapiens
gggacctgaggccctgctccac

SEQ ID NO: 9182569 - DNA, 22 bp, Homo sapiens
gggatggggagctggaaagggg

SEQ ID NO: 9182570 - DNA, 22 bp, Homo sapiens
gggatggggagctggaaagggg

SEQ ID NO: 9182571 - DNA, 22 bp, Homo sapiens
gggcagaggggcgcttccctct

SEQ ID NO: 9182572 - DNA, 22 bp, Homo sapiens
gggcagaggggcgcttccctct

SEQ ID NO: 9182573 - DNA, 22 bp, Homo sapiens
gggatggggagctggaaagggg

SEQ ID NO: 9182574 - DNA, 22 bp, Homo sapiens
gggatgggagagcatttagaga

SEQ ID NO: 9182575 - DNA, 22 bp, Homo sapiens
gggatggggagctggaaagggg

SEQ ID NO: 9182576 - DNA, 22 bp, Homo sapiens
gggatggctcaaaggagtcagg

SEQ ID NO: 9182577 - DNA, 22 bp, Homo sapiens
gggatggctgcctgcatcagga

SEQ ID NO: 9182578 - DNA, 22 bp, Homo sapiens
gggatggctttgtggctgactc

SEQ ID NO: 9182579 - DNA, 22 bp, Homo sapiens
gggatggctgcctgcatcagga

SEQ ID NO: 9182580 - DNA, 22 bp, Homo sapiens
gggatggagggtagagcaagtg

SEQ ID NO: 9182581 - DNA, 22 bp, Homo sapiens
gggagggaaggtacctgtgtga

SEQ ID NO: 9182582 - DNA, 22 bp, Homo sapiens
gggagggaaagcttgatctgtc

SEQ ID NO: 9182583 - DNA, 22 bp, Homo sapiens
gggagggaaagcttgatctgtc

SEQ ID NO: 9182584 - DNA, 22 bp, Homo sapiens
gggaggcttgagccatactgcc

SEQ ID NO: 9182585 - DNA, 22 bp, Homo sapiens
gggaggctggctctggccacag

SEQ ID NO: 9182586 - DNA, 22 bp, Homo sapiens
gggatctgagttgtcaggaagg

SEQ ID NO: 9182587 - DNA, 22 bp, Homo sapiens
gggatctgagtaggcagaagct

SEQ ID NO: 9182588 - DNA, 22 bp, Homo sapiens
gggatctgatgcactgctgaaa

SEQ ID NO: 9182589 - DNA, 22 bp, Homo sapiens
gggatctgacttgctggtgggt

SEQ ID NO: 9182590 - DNA, 21 bp, Homo sapiens
gggatctgaggcaagtctcct

SEQ ID NO: 9182591 - DNA, 22 bp, Homo sapiens
gggatgataatgccagagttaa

SEQ ID NO: 9182592 - DNA, 22 bp, Homo sapiens
gggatgatggaaaagtctgtta

SEQ ID NO: 9182593 - DNA, 22 bp, Homo sapiens
gggatgctggtgcctgtggcac

SEQ ID NO: 9182594 - DNA, 22 bp, Homo sapiens
gggatgctggtgcctgtggcac

SEQ ID NO: 9182595 - DNA, 22 bp, Homo sapiens
gggtctgggcaggcgcttcctc

SEQ ID NO: 9182596 - DNA, 22 bp, Homo sapiens
gggtgaagctcctgcaggggcc

SEQ ID NO: 9182597 - DNA, 22 bp, Homo sapiens
gggtctggagggcagcccttct

SEQ ID NO: 9182598 - DNA, 22 bp, Homo sapiens
gggtctggcatgctgagatgga

SEQ ID NO: 9182599 - DNA, 22 bp, Homo sapiens
gggtctctctcggctccacgcg

SEQ ID NO: 9182600 - DNA, 22 bp, Homo sapiens
gggtctctgagcttccaagata

SEQ ID NO: 9182601 - DNA, 21 bp, Homo sapiens
gggtctgaatatctggtgctg

SEQ ID NO: 9182602 - DNA, 22 bp, Homo sapiens
gggtctgacctgggcacaccat

SEQ ID NO: 9182603 - DNA, 22 bp, Homo sapiens
gggtctctccctttagttattt

SEQ ID NO: 9182604 - DNA, 22 bp, Homo sapiens
gggtctctcctccccagctgtg

SEQ ID NO: 9182605 - DNA, 22 bp, Homo sapiens
gggtctctcctccccagctgtg

SEQ ID NO: 9182606 - DNA, 22 bp, Homo sapiens
gggtctccatgttaacatcact

SEQ ID NO: 9182607 - DNA, 22 bp, Homo sapiens
gggtctctcatgcagttgctgt

SEQ ID NO: 9182608 - DNA, 22 bp, Homo sapiens
gggtctctcatgcagttgctgt

SEQ ID NO: 9182609 - DNA, 22 bp, Homo sapiens
gggtctctcagaaggctgcaat

SEQ ID NO: 9182610 - DNA, 22 bp, Homo sapiens
gggtctcctaatggaggatgac

SEQ ID NO: 9182611 - DNA, 22 bp, Homo sapiens
gggtctggacggctgcaggaag

SEQ ID NO: 9182612 - DNA, 22 bp, Homo sapiens
gggtctggagatccgggtgaag

SEQ ID NO: 9182613 - DNA, 22 bp, Homo sapiens
gggtctgaggagtaccattgtc

SEQ ID NO: 9182614 - DNA, 22 bp, Homo sapiens
gggtctgagctgaggggaaatc

SEQ ID NO: 9182615 - DNA, 22 bp, Homo sapiens
gggtctgagggccttaccactc

SEQ ID NO: 9182616 - DNA, 20 bp, Homo sapiens
gggtgagatgtaggagaggg

SEQ ID NO: 9182617 - DNA, 22 bp, Homo sapiens
gggtgaggagctgccagtcatg

SEQ ID NO: 9182618 - DNA, 22 bp, Homo sapiens
gggtgggaaggctaagggattg

SEQ ID NO: 9182619 - DNA, 22 bp, Homo sapiens
gggtgggaacaggatgccagga

SEQ ID NO: 9182620 - DNA, 22 bp, Homo sapiens
gggtgggaacaggatgccagga

SEQ ID NO: 9182621 - DNA, 22 bp, Homo sapiens
gggtgggcccagcccagagaag

SEQ ID NO: 9182622 - DNA, 17 bp, Homo sapiens
gggtgggcactgctggc

SEQ ID NO: 9182623 - DNA, 22 bp, Homo sapiens
ggggactgaggcactgaaggtg

SEQ ID NO: 9182624 - DNA, 22 bp, Homo sapiens
gggggctccaggcgagaatgtg

SEQ ID NO: 9182625 - DNA, 22 bp, Homo sapiens
gggggctgaggctgttctgagg

SEQ ID NO: 9182626 - DNA, 22 bp, Homo sapiens
ggggaccctcaggactgcgtct

SEQ ID NO: 9182627 - DNA, 22 bp, Homo sapiens
gggggctgatcatttactgggc

SEQ ID NO: 9182628 - DNA, 22 bp, Homo sapiens
gggggctgtcctgtgcattgta

SEQ ID NO: 9182629 - DNA, 20 bp, Homo sapiens
ggggggcttcagggcctgtg

SEQ ID NO: 9182630 - DNA, 22 bp, Homo sapiens
ggggggctgttctggacaggaa

SEQ ID NO: 9182631 - DNA, 22 bp, Homo sapiens
ggggggtgacaagtagaggttg

SEQ ID NO: 9182632 - DNA, 22 bp, Homo sapiens
ggggggtgacaagtagaggttg

SEQ ID NO: 9182633 - DNA, 22 bp, Homo sapiens
ggggggtgctgatcagtggagc

SEQ ID NO: 9182634 - DNA, 22 bp, Homo sapiens
ggggggtgctgatcagtggagc

SEQ ID NO: 9182635 - DNA, 22 bp, Homo sapiens
ggggggtgctgatcagtggagc

SEQ ID NO: 9182636 - DNA, 22 bp, Homo sapiens
gggggtaggcagacaaggacat

SEQ ID NO: 9182637 - DNA, 22 bp, Homo sapiens
gggggtgacgatggcagctggt

SEQ ID NO: 9182638 - DNA, 22 bp, Homo sapiens
gggggtgacgatggcagctggt

SEQ ID NO: 9182639 - DNA, 22 bp, Homo sapiens
gggggtgacgatggcagctggt

SEQ ID NO: 9182640 - DNA, 22 bp, Homo sapiens
gggggtggttctaagtcctata

SEQ ID NO: 9182641 - DNA, 22 bp, Homo sapiens
gggggtttctgggctgagcaga

SEQ ID NO: 9182642 - DNA, 22 bp, Homo sapiens
gggggtgaggacaggagcactg

SEQ ID NO: 9182643 - DNA, 22 bp, Homo sapiens
gggggtgacgatggcagctggt

SEQ ID NO: 9182644 - DNA, 22 bp, Homo sapiens
gggggtgagcctgccaggccca

SEQ ID NO: 9182645 - DNA, 22 bp, Homo sapiens
gggggtgagcctgccaggccca

SEQ ID NO: 9182646 - DNA, 22 bp, Homo sapiens
ggggtaggcaggtgatctgatc

SEQ ID NO: 9182647 - DNA, 22 bp, Homo sapiens
gggtccagggacgtttctgcag

SEQ ID NO: 9182648 - DNA, 22 bp, Homo sapiens
gggtccagggccagtggctgag

SEQ ID NO: 9182649 - DNA, 23 bp, Homo sapiens
ggggacagttcccactggggtct

SEQ ID NO: 9182650 - DNA, 23 bp, Homo sapiens
ggggaagtggcagtgagtgaggc

SEQ ID NO: 9182651 - DNA, 20 bp, Homo sapiens
ggggaagtcactgcagtcag

SEQ ID NO: 9182652 - DNA, 22 bp, Homo sapiens
ggggaagggagtccaagtgtta

SEQ ID NO: 9182653 - DNA, 16 bp, Homo sapiens
ggggaaggcaagaggg

SEQ ID NO: 9182654 - DNA, 22 bp, Homo sapiens
ggggaagggagtccaagtgtta

SEQ ID NO: 9182655 - DNA, 22 bp, Homo sapiens
gggctggagccagctgtggctg

SEQ ID NO: 9182656 - DNA, 22 bp, Homo sapiens
gggctggaccgcgacccctgag

SEQ ID NO: 9182657 - DNA, 22 bp, Homo sapiens
gggctggactgcattgcctcgc

SEQ ID NO: 9182658 - DNA, 21 bp, Homo sapiens
gggctggacatggtggctcat

SEQ ID NO: 9182659 - DNA, 17 bp, Homo sapiens
gggctggatggccatgg

SEQ ID NO: 9182660 - DNA, 22 bp, Homo sapiens
gggctggcatcagttgccgaga

SEQ ID NO: 9182661 - DNA, 22 bp, Homo sapiens
gggctggcaggacctgggctga

SEQ ID NO: 9182662 - DNA, 22 bp, Homo sapiens
gggctctggtacttcctggctc

SEQ ID NO: 9182663 - DNA, 22 bp, Homo sapiens
gggctctggtacttcctggctc

SEQ ID NO: 9182664 - DNA, 22 bp, Homo sapiens
gggctctggtacttcctggctc

SEQ ID NO: 9182665 - DNA, 22 bp, Homo sapiens
gggctctggtgccttcacagaa

SEQ ID NO: 9182666 - DNA, 22 bp, Homo sapiens
gggctctgtgcaccccagcacc

SEQ ID NO: 9182667 - DNA, 22 bp, Homo sapiens
gggctagcctcttccctgctcc

SEQ ID NO: 9182668 - DNA, 18 bp, Homo sapiens
gggctaggcaaggaccac

SEQ ID NO: 9182669 - DNA, 22 bp, Homo sapiens
gggctagcagattctacctaat

SEQ ID NO: 9182670 - DNA, 22 bp, Homo sapiens
gggctagcctcttccctgctcc

SEQ ID NO: 9182671 - DNA, 22 bp, Homo sapiens
gggctaggcttggccagcactg

SEQ ID NO: 9182672 - DNA, 20 bp, Homo sapiens
gggctaggtagccatttggc

SEQ ID NO: 9182673 - DNA, 22 bp, Homo sapiens
gggctctgggtcgtgtctccat

SEQ ID NO: 9182674 - DNA, 22 bp, Homo sapiens
gggctgcttttaagggtctcag

SEQ ID NO: 9182675 - DNA, 22 bp, Homo sapiens
gggctgcttggaggaggcgctc

SEQ ID NO: 9182676 - DNA, 21 bp, Homo sapiens
gggctggacatggtggctcat

SEQ ID NO: 9182677 - DNA, 22 bp, Homo sapiens
gggctggacatctaaggtagct

SEQ ID NO: 9182678 - DNA, 22 bp, Homo sapiens
gggctgcttttaagggtctcag

SEQ ID NO: 9182679 - DNA, 22 bp, Homo sapiens
gggctgagaattcagctttcct

SEQ ID NO: 9182680 - DNA, 22 bp, Homo sapiens
gggctgagacgatggggtcttc

SEQ ID NO: 9182681 - DNA, 22 bp, Homo sapiens
gggctctgtgttctagctctcg

SEQ ID NO: 9182682 - DNA, 22 bp, Homo sapiens
gggctctgtggttgtgctttgt

SEQ ID NO: 9182683 - DNA, 22 bp, Homo sapiens
gggctgagaagttgatcccaag

SEQ ID NO: 9182684 - DNA, 22 bp, Homo sapiens
gggctgagaattcagctttcct

SEQ ID NO: 9182685 - DNA, 22 bp, Homo sapiens
gggctgagaagttgatcccaag

SEQ ID NO: 9182686 - DNA, 22 bp, Homo sapiens
ggccccagattctgggctgggt

SEQ ID NO: 9182687 - DNA, 22 bp, Homo sapiens
ggccccagattctgggctgggt

SEQ ID NO: 9182688 - DNA, 22 bp, Homo sapiens
ggccccaggtctgaacacgctg

SEQ ID NO: 9182689 - DNA, 22 bp, Homo sapiens
ggccccagcagaccctcctctg

SEQ ID NO: 9182690 - DNA, 22 bp, Homo sapiens
ggcccagcctcagacatgccct

SEQ ID NO: 9182691 - DNA, 22 bp, Homo sapiens
ggcccctcttgtggcacatacg

SEQ ID NO: 9182692 - DNA, 22 bp, Homo sapiens
ggcccctgcggactgcctagag

SEQ ID NO: 9182693 - DNA, 19 bp, Homo sapiens
ggcccctctcacaggagtt

SEQ ID NO: 9182694 - DNA, 22 bp, Homo sapiens
ggcccctcagcatctgagtcag

SEQ ID NO: 9182695 - DNA, 22 bp, Homo sapiens
ggcccctcagcatctgagtcag

SEQ ID NO: 9182696 - DNA, 22 bp, Homo sapiens
ggccccagttcactcctggccg

SEQ ID NO: 9182697 - DNA, 22 bp, Homo sapiens
ggccccagttcactcctggccg

SEQ ID NO: 9182698 - DNA, 22 bp, Homo sapiens
ggccccagttcactcctggccg

SEQ ID NO: 9182699 - DNA, 21 bp, Homo sapiens
ggccccgcagacccagcacgt

SEQ ID NO: 9182700 - DNA, 17 bp, Homo sapiens
ggccccggagcctgaca

SEQ ID NO: 9182701 - DNA, 22 bp, Homo sapiens
ggcccagcccgagtcagccttc

SEQ ID NO: 9182702 - DNA, 22 bp, Homo sapiens
ggcccacttgaaatggagctca

SEQ ID NO: 9182703 - DNA, 22 bp, Homo sapiens
ggcccacttgaaatggagctca

SEQ ID NO: 9182704 - DNA, 22 bp, Homo sapiens
ggccatttttgttcttatctct

SEQ ID NO: 9182705 - DNA, 21 bp, Homo sapiens
ggccattttcactcattccat

SEQ ID NO: 9182706 - DNA, 22 bp, Homo sapiens
ggccatttgctttattcacttc

SEQ ID NO: 9182707 - DNA, 22 bp, Homo sapiens
ggccatttcttccttctcaaca

SEQ ID NO: 9182708 - DNA, 22 bp, Homo sapiens
ggccatggtggtttgagcacct

SEQ ID NO: 9182709 - DNA, 22 bp, Homo sapiens
ggccatggtcatgggtgagctt

SEQ ID NO: 9182710 - DNA, 20 bp, Homo sapiens
ggccatgggttgcctgaggt

SEQ ID NO: 9182711 - DNA, 22 bp, Homo sapiens
ggccatggggacagagggtgaa

SEQ ID NO: 9182712 - DNA, 22 bp, Homo sapiens
ggccagaagttggaaaagagcc

SEQ ID NO: 9182713 - DNA, 22 bp, Homo sapiens
ggccagacatatcgctcccaaa

SEQ ID NO: 9182714 - DNA, 22 bp, Homo sapiens
ggccagactgagtgaggtcaag

SEQ ID NO: 9182715 - DNA, 22 bp, Homo sapiens
ggccagagaagtcagacccttg

SEQ ID NO: 9182716 - DNA, 22 bp, Homo sapiens
ggccagagaagtcagacccttg

SEQ ID NO: 9182717 - DNA, 22 bp, Homo sapiens
ggccaccttccagttgcctgca

SEQ ID NO: 9182718 - DNA, 22 bp, Homo sapiens
ggccaccttccagttgcctgca

SEQ ID NO: 9182719 - DNA, 22 bp, Homo sapiens
ggccacctctgccctactgagt

SEQ ID NO: 9182720 - DNA, 22 bp, Homo sapiens
ggccacctggctgtgggggcag

SEQ ID NO: 9182721 - DNA, 22 bp, Homo sapiens
ggccacctgggatctcatcctg

SEQ ID NO: 9182722 - DNA, 22 bp, Homo sapiens
ggcaggtgctctgtgggcctgg

SEQ ID NO: 9182723 - DNA, 22 bp, Homo sapiens
ggcaggtgctctgtgggcctgg

SEQ ID NO: 9182724 - DNA, 22 bp, Homo sapiens
ggcaggtggaagttggcagagc

SEQ ID NO: 9182725 - DNA, 18 bp, Homo sapiens
ggccagagggagggtccc

SEQ ID NO: 9182726 - DNA, 22 bp, Homo sapiens
ggccagaggtggtacatagctt

SEQ ID NO: 9182727 - DNA, 22 bp, Homo sapiens
ggccatgggaagaggtggagag

SEQ ID NO: 9182728 - DNA, 22 bp, Homo sapiens
ggccagagggagggcacaaatc

SEQ ID NO: 9182729 - DNA, 22 bp, Homo sapiens
ggccagagggagggcacaaatc

SEQ ID NO: 9182730 - DNA, 17 bp, Homo sapiens
ggccagaggcggggctg

SEQ ID NO: 9182731 - DNA, 22 bp, Homo sapiens
ggccagaggccatcctcctgct

SEQ ID NO: 9182732 - DNA, 22 bp, Homo sapiens
ggccagagagcagccaggattc

SEQ ID NO: 9182733 - DNA, 22 bp, Homo sapiens
ggccagagagcagccaggattc

SEQ ID NO: 9182734 - DNA, 22 bp, Homo sapiens
ggccagagctcaaacagtcgca

SEQ ID NO: 9182735 - DNA, 22 bp, Homo sapiens
ggccagagagccgctgttagga

SEQ ID NO: 9182736 - DNA, 22 bp, Homo sapiens
ggccagagctgacctatcaatg

SEQ ID NO: 9182737 - DNA, 18 bp, Homo sapiens
ggctcagcaggctctctc

SEQ ID NO: 9182738 - DNA, 22 bp, Homo sapiens
ggctcagcacagggctggcatc

SEQ ID NO: 9182739 - DNA, 22 bp, Homo sapiens
ggctcagcacagggctggcatc

SEQ ID NO: 9182740 - DNA, 20 bp, Homo sapiens
ggccttggcctctttgcagc

SEQ ID NO: 9182741 - DNA, 22 bp, Homo sapiens
ggctcagcttatctgggcaggc

SEQ ID NO: 9182742 - DNA, 22 bp, Homo sapiens
ggctcaggacctgggattgcca

SEQ ID NO: 9182743 - DNA, 22 bp, Homo sapiens
ggctcaggacctgggattgcca

SEQ ID NO: 9182744 - DNA, 22 bp, Homo sapiens
ggctcaggccagaccacgactc

SEQ ID NO: 9182745 - DNA, 22 bp, Homo sapiens
ggctccacaattacacactgga

SEQ ID NO: 9182746 - DNA, 22 bp, Homo sapiens
ggctcctgatgctcagatttca

SEQ ID NO: 9182747 - DNA, 22 bp, Homo sapiens
ggctcctgatttgagggggctg

SEQ ID NO: 9182748 - DNA, 22 bp, Homo sapiens
ggctcctgcacctgtccctctg

SEQ ID NO: 9182749 - DNA, 22 bp, Homo sapiens
ggctcctgccgtcttttctgag

SEQ ID NO: 9182750 - DNA, 22 bp, Homo sapiens
ggctcctgcacctgtccctctg

SEQ ID NO: 9182751 - DNA, 22 bp, Homo sapiens
ggctcctgctgtcctttgaagc

SEQ ID NO: 9182752 - DNA, 21 bp, Homo sapiens
ggctcctgctttgtgaggggc

SEQ ID NO: 9182753 - DNA, 23 bp, Homo sapiens
ggctcctgcttcatgtcccacct

SEQ ID NO: 9182754 - DNA, 23 bp, Homo sapiens
ggctcctgcttcatgtcccacct

SEQ ID NO: 9182755 - DNA, 22 bp, Homo sapiens
ggctcagtaagtcaggttcatt

SEQ ID NO: 9182756 - DNA, 22 bp, Homo sapiens
ggctcaggtttccttcccagct

SEQ ID NO: 9182757 - DNA, 22 bp, Homo sapiens
ggctcaggtttccttcccagct

SEQ ID NO: 9182758 - DNA, 22 bp, Homo sapiens
ggctcaggtttaaagtgcttta

SEQ ID NO: 9182759 - DNA, 22 bp, Homo sapiens
ggctcaggtttaaagtgcttta

SEQ ID NO: 9182760 - DNA, 22 bp, Homo sapiens
ggctcaggtttaaagtgcttta

SEQ ID NO: 9182761 - DNA, 22 bp, Homo sapiens
ggctcaggccagaccacgactc

SEQ ID NO: 9182762 - DNA, 19 bp, Homo sapiens
ggctcagtggcaccatcct

SEQ ID NO: 9182763 - DNA, 22 bp, Homo sapiens
ggctcatatcccggccatcatt

SEQ ID NO: 9182764 - DNA, 22 bp, Homo sapiens
ggctcatgtatgaaagggtgtg

SEQ ID NO: 9182765 - DNA, 22 bp, Homo sapiens
ggcccctgtaaaatgtacatgt

SEQ ID NO: 9182766 - DNA, 22 bp, Homo sapiens
ggccctctgctcacttcctatt

SEQ ID NO: 9182767 - DNA, 22 bp, Homo sapiens
ggccctctgcctgtgctggcga

SEQ ID NO: 9182768 - DNA, 22 bp, Homo sapiens
ggccctctgcctgtgctggcga

SEQ ID NO: 9182769 - DNA, 22 bp, Homo sapiens
ggccctctccaactctgttcca

SEQ ID NO: 9182770 - DNA, 22 bp, Homo sapiens
ggccctctgtggctgccatgga

SEQ ID NO: 9182771 - DNA, 22 bp, Homo sapiens
ggccctctggcttccgcatggg

SEQ ID NO: 9182772 - DNA, 22 bp, Homo sapiens
ggccctctgctcacttcctatt

SEQ ID NO: 9182773 - DNA, 22 bp, Homo sapiens
ggccctcttttatccatcataa

SEQ ID NO: 9182774 - DNA, 22 bp, Homo sapiens
ggccctgaagtgattgtgagtt

SEQ ID NO: 9182775 - DNA, 22 bp, Homo sapiens
ggccctgagctgaagtactgtg

SEQ ID NO: 9182776 - DNA, 22 bp, Homo sapiens
ggccctgatacaagtaaggtct

SEQ ID NO: 9182777 - DNA, 22 bp, Homo sapiens
ggcctggctggttcagtaccct

SEQ ID NO: 9182778 - DNA, 22 bp, Homo sapiens
ggccttgcttctgggcatggtt

SEQ ID NO: 9182779 - DNA, 19 bp, Homo sapiens
ggccttgctctgtggcagc

SEQ ID NO: 9182780 - DNA, 22 bp, Homo sapiens
ggccttgagcagggagaaacca

SEQ ID NO: 9182781 - DNA, 22 bp, Homo sapiens
ggccttgatcctccagagcact

SEQ ID NO: 9182782 - DNA, 22 bp, Homo sapiens
ggccttctgcctttcagcaatg

SEQ ID NO: 9182783 - DNA, 22 bp, Homo sapiens
ggccttgcagccacagaacaca

SEQ ID NO: 9182784 - DNA, 22 bp, Homo sapiens
ggccttgcctcaatagctccac

SEQ ID NO: 9182785 - DNA, 23 bp, Homo sapiens
ggcctgtgttttgtctgaagtac

SEQ ID NO: 9182786 - DNA, 22 bp, Homo sapiens
ggccttcacgtgacctggcgtg

SEQ ID NO: 9182787 - DNA, 22 bp, Homo sapiens
ggccttccatctgcctctgttt

SEQ ID NO: 9182788 - DNA, 21 bp, Homo sapiens
ggccttcccctgcagtctccg

SEQ ID NO: 9182789 - DNA, 22 bp, Homo sapiens
ggccttcctgttgtgtccaccg

SEQ ID NO: 9182790 - DNA, 22 bp, Homo sapiens
ggctggcctgtgtggccgccac

SEQ ID NO: 9182791 - DNA, 22 bp, Homo sapiens
ggctggcctctacagggaggca

SEQ ID NO: 9182792 - DNA, 23 bp, Homo sapiens
ggctggcccggggctgctcctga

SEQ ID NO: 9182793 - DNA, 23 bp, Homo sapiens
ggctggcccggggctgctcctga

SEQ ID NO: 9182794 - DNA, 23 bp, Homo sapiens
ggctggcccggggctgctcctga

SEQ ID NO: 9182795 - DNA, 22 bp, Homo sapiens
ggctgctgaacaagggaaccct

SEQ ID NO: 9182796 - DNA, 23 bp, Homo sapiens
ggctgctcttttcatgctgtttc

SEQ ID NO: 9182797 - DNA, 22 bp, Homo sapiens
ggctgctgaacaagggaaccct

SEQ ID NO: 9182798 - DNA, 23 bp, Homo sapiens
ggctgctcttttcatgctgtttc

SEQ ID NO: 9182799 - DNA, 22 bp, Homo sapiens
ggctgctcggcagctcctgagc

SEQ ID NO: 9182800 - DNA, 22 bp, Homo sapiens
ggctgctcggcagctcctgagc

SEQ ID NO: 9182801 - DNA, 22 bp, Homo sapiens
ggctgctcggagcctcctgtga

SEQ ID NO: 9182802 - DNA, 22 bp, Homo sapiens
ggctgctcggagcctcctgtga

SEQ ID NO: 9182803 - DNA, 19 bp, Homo sapiens
ggctgccttctgctcatct

SEQ ID NO: 9182804 - DNA, 22 bp, Homo sapiens
ggctgccttccctgagccccgg

SEQ ID NO: 9182805 - DNA, 22 bp, Homo sapiens
ggctgcctgtgcccaggcacac

SEQ ID NO: 9182806 - DNA, 22 bp, Homo sapiens
ggctgcctgtgcccaggcacac

SEQ ID NO: 9182807 - DNA, 22 bp, Homo sapiens
ggctgcctggtttagtgctgac

SEQ ID NO: 9182808 - DNA, 21 bp, Homo sapiens
ggctgcctgggaagaagaaga

SEQ ID NO: 9182809 - DNA, 22 bp, Homo sapiens
ggctgcctgggagccctcctct

SEQ ID NO: 9182810 - DNA, 22 bp, Homo sapiens
ggctgcctgggagccctcctct

SEQ ID NO: 9182811 - DNA, 20 bp, Homo sapiens
ggctgcaggactcattggct

SEQ ID NO: 9182812 - DNA, 22 bp, Homo sapiens
ggctgcaggatgcccagccgtg

SEQ ID NO: 9182813 - DNA, 22 bp, Homo sapiens
ggctgcaggcagggtatccact

SEQ ID NO: 9182814 - DNA, 22 bp, Homo sapiens
ggctgcaggcagaggctgtctg

SEQ ID NO: 9182815 - DNA, 22 bp, Homo sapiens
ggctgcaggatgcccagccgtg

SEQ ID NO: 9182816 - DNA, 23 bp, Homo sapiens
ggctcctggattcaaatcctgcc

SEQ ID NO: 9182817 - DNA, 22 bp, Homo sapiens
ggctcctggcaatgtaacttta

SEQ ID NO: 9182818 - DNA, 22 bp, Homo sapiens
ggctcctggcatctggtgggta

SEQ ID NO: 9182819 - DNA, 23 bp, Homo sapiens
ggctcctggattcaaatcctgcc

SEQ ID NO: 9182820 - DNA, 22 bp, Homo sapiens
ggctcctggaggcaccactggt

SEQ ID NO: 9182821 - DNA, 22 bp, Homo sapiens
ggctcctggaaagccctcgctc

SEQ ID NO: 9182822 - DNA, 22 bp, Homo sapiens
ggctcctgggcagctgctccct

SEQ ID NO: 9182823 - DNA, 22 bp, Homo sapiens
ggctcctgggcagctgctccct

SEQ ID NO: 9182824 - DNA, 22 bp, Homo sapiens
ggctcctgggcgtcttcgaaca

SEQ ID NO: 9182825 - DNA, 22 bp, Homo sapiens
ggctcctgggatgggactgagc

SEQ ID NO: 9182826 - DNA, 22 bp, Homo sapiens
ggctcctgggatgggactgagc

SEQ ID NO: 9182827 - DNA, 22 bp, Homo sapiens
ggctcctgggagatagaggtca

SEQ ID NO: 9182828 - DNA, 22 bp, Homo sapiens
ggctcctgggagaagttttatt

SEQ ID NO: 9182829 - DNA, 22 bp, Homo sapiens
ggctcctggggaggtgagcttg

SEQ ID NO: 9182830 - DNA, 22 bp, Homo sapiens
ggctccttatctctcctatgcc

SEQ ID NO: 9182831 - DNA, 22 bp, Homo sapiens
ggctcctgttatttaatgagga

SEQ ID NO: 9182832 - DNA, 22 bp, Homo sapiens
ggctcctgttttaaaaggtgaa

SEQ ID NO: 9182833 - DNA, 19 bp, Homo sapiens
ggctcctgtggctgcagcc

SEQ ID NO: 9182834 - DNA, 22 bp, Homo sapiens
ggctccttcaaagcacctggct

SEQ ID NO: 9182835 - DNA, 20 bp, Homo sapiens
ggctccttctttcatggccc

SEQ ID NO: 9182836 - DNA, 22 bp, Homo sapiens
ggctccttcaagcctgtcactg

SEQ ID NO: 9182837 - DNA, 22 bp, Homo sapiens
ggctccttgccaccagctctgc

SEQ ID NO: 9182838 - DNA, 22 bp, Homo sapiens
ggctctagagactctagagaaa

SEQ ID NO: 9182839 - DNA, 22 bp, Homo sapiens
ggctgagttgagaggattactt

SEQ ID NO: 9182840 - DNA, 22 bp, Homo sapiens
ggctctccactatggatgagaa

SEQ ID NO: 9182841 - DNA, 22 bp, Homo sapiens
ggctgcagaagtacttccggat

SEQ ID NO: 9182842 - DNA, 22 bp, Homo sapiens
ggctgcagaggcccccagtggg

SEQ ID NO: 9182843 - DNA, 22 bp, Homo sapiens
ggctgcagagctggtgccctgg

SEQ ID NO: 9182844 - DNA, 22 bp, Homo sapiens
ggctgcagaggcgatctgaggt

SEQ ID NO: 9182845 - DNA, 19 bp, Homo sapiens
ggctgcagagccccggcgc

SEQ ID NO: 9182846 - DNA, 22 bp, Homo sapiens
gggaacagggcctgagctgggg

SEQ ID NO: 9182847 - DNA, 22 bp, Homo sapiens
gggaacagggcctgagctgggg

SEQ ID NO: 9182848 - DNA, 22 bp, Homo sapiens
gggaacttcagaaagtcgctgc

SEQ ID NO: 9182849 - DNA, 22 bp, Homo sapiens
gggaacttgccccagaggaatt

SEQ ID NO: 9182850 - DNA, 22 bp, Homo sapiens
gggaacagagtgccagactgac

SEQ ID NO: 9182851 - DNA, 22 bp, Homo sapiens
gggaacagagtgccagactgac

SEQ ID NO: 9182852 - DNA, 22 bp, Homo sapiens
gggaacagcttgggctctgcca

SEQ ID NO: 9182853 - DNA, 22 bp, Homo sapiens
gggaacagcctcaccagccctg

SEQ ID NO: 9182854 - DNA, 22 bp, Homo sapiens
gggaacagcatatctgaagggt

SEQ ID NO: 9182855 - DNA, 22 bp, Homo sapiens
gggaacagcatatctgaagggt

SEQ ID NO: 9182856 - DNA, 22 bp, Homo sapiens
gggaagagatttccacatcatt

SEQ ID NO: 9182857 - DNA, 22 bp, Homo sapiens
gggaagagatttccacatcatt

SEQ ID NO: 9182858 - DNA, 18 bp, Homo sapiens
gggaagaggatctggccc

SEQ ID NO: 9182859 - DNA, 23 bp, Homo sapiens
gggaccaggcccttcctggtttg

SEQ ID NO: 9182860 - DNA, 22 bp, Homo sapiens
gggaagaagacatggtgaaggc

SEQ ID NO: 9182861 - DNA, 22 bp, Homo sapiens
gggaagagaccgtaccctggcc

SEQ ID NO: 9182862 - DNA, 22 bp, Homo sapiens
gggaagagaccgtaccctggcc

SEQ ID NO: 9182863 - DNA, 22 bp, Homo sapiens
ggctttgggccctcaagtctcc

SEQ ID NO: 9182864 - DNA, 22 bp, Homo sapiens
ggctttgggggtgtccaagaaa

SEQ ID NO: 9182865 - DNA, 18 bp, Homo sapiens
ggctttggctcttaccgc

SEQ ID NO: 9182866 - DNA, 19 bp, Homo sapiens
ggcttcgaggctggggaag

SEQ ID NO: 9182867 - DNA, 22 bp, Homo sapiens
ggcttcctttcactaccctcag

SEQ ID NO: 9182868 - DNA, 22 bp, Homo sapiens
ggcttcctaatactccctacac

SEQ ID NO: 9182869 - DNA, 22 bp, Homo sapiens
ggcttcctccttcctgctgtca

SEQ ID NO: 9182870 - DNA, 22 bp, Homo sapiens
ggcttcctggagaaggtctgag

SEQ ID NO: 9182871 - DNA, 22 bp, Homo sapiens
ggcttcctggggcctcctgcaa

SEQ ID NO: 9182872 - DNA, 22 bp, Homo sapiens
gggaaatctcgtcctctattta

SEQ ID NO: 9182873 - DNA, 22 bp, Homo sapiens
gggaaattaatgactggttgga

SEQ ID NO: 9182874 - DNA, 22 bp, Homo sapiens
gggaaaggatcagtgggaggct

SEQ ID NO: 9182875 - DNA, 22 bp, Homo sapiens
ggctttggggtgtgcagagatg

SEQ ID NO: 9182876 - DNA, 22 bp, Homo sapiens
ggctttggtagacacagattga

SEQ ID NO: 9182877 - DNA, 23 bp, Homo sapiens
ggcttcagtgagagtccctgctg

SEQ ID NO: 9182878 - DNA, 22 bp, Homo sapiens
ggctgtgtcctgtatgattatt

SEQ ID NO: 9182879 - DNA, 19 bp, Homo sapiens
ggctgtggtggtgccttgc

SEQ ID NO: 9182880 - DNA, 22 bp, Homo sapiens
ggctgtgtccccacctgagcag

SEQ ID NO: 9182881 - DNA, 22 bp, Homo sapiens
ggctgtgtggccgtgggctcta

SEQ ID NO: 9182882 - DNA, 21 bp, Homo sapiens
ggctgtgttcagggcatgcgg

SEQ ID NO: 9182883 - DNA, 22 bp, Homo sapiens
ggcttcaggggtctgtctgcac

SEQ ID NO: 9182884 - DNA, 22 bp, Homo sapiens
ggcttcagtgactggtgccctc

SEQ ID NO: 9182885 - DNA, 22 bp, Homo sapiens
ggcttcccagtccctgctctca

SEQ ID NO: 9182886 - DNA, 22 bp, Homo sapiens
ggcttccagctgggccttggag

SEQ ID NO: 9182887 - DNA, 17 bp, Homo sapiens
ggcttccaggtggctct

SEQ ID NO: 9182888 - DNA, 17 bp, Homo sapiens
ggcttccaggtggctct

SEQ ID NO: 9182889 - DNA, 22 bp, Homo sapiens
ggctggctcttaccgacagcgt

SEQ ID NO: 9182890 - DNA, 22 bp, Homo sapiens
ggctgtggtggcatccctgagc

SEQ ID NO: 9182891 - DNA, 19 bp, Homo sapiens
ggctgtggtggtgccttgc

SEQ ID NO: 9182892 - DNA, 22 bp, Homo sapiens
ggctggcttgccaagctcaggg

SEQ ID NO: 9182893 - DNA, 22 bp, Homo sapiens
ggctggcttgccaagctcaggg

SEQ ID NO: 9182894 - DNA, 22 bp, Homo sapiens
ggctggctgtgccctgtactct

SEQ ID NO: 9182895 - DNA, 22 bp, Homo sapiens
ggctggctggctggtagacaag

SEQ ID NO: 9182896 - DNA, 22 bp, Homo sapiens
gatttcaagcccccagagattc

SEQ ID NO: 9182897 - DNA, 22 bp, Homo sapiens
gatttcttgagcaagttgctta

SEQ ID NO: 9182898 - DNA, 22 bp, Homo sapiens
gatttcttgacccctgtctcag

SEQ ID NO: 9182899 - DNA, 22 bp, Homo sapiens
gatttcttgataagtagtgtga

SEQ ID NO: 9182900 - DNA, 22 bp, Homo sapiens
gatttcttcatttgtggtgaat

SEQ ID NO: 9182901 - DNA, 22 bp, Homo sapiens
gatttgcagctagagcaaaggt

SEQ ID NO: 9182902 - DNA, 21 bp, Homo sapiens
gatttgcagaaactagacagg

SEQ ID NO: 9182903 - DNA, 20 bp, Homo sapiens
gatttgctgaacttttatga

SEQ ID NO: 9182904 - DNA, 22 bp, Homo sapiens
gatttctttgcaagctgtgttc

SEQ ID NO: 9182905 - DNA, 22 bp, Homo sapiens
gatttgacaaccaattaggttt

SEQ ID NO: 9182906 - DNA, 22 bp, Homo sapiens
gatttgacacctggggcatata

SEQ ID NO: 9182907 - DNA, 22 bp, Homo sapiens
gatttgactttgtcctacctca

SEQ ID NO: 9182908 - DNA, 22 bp, Homo sapiens
gatttgaccttctcccgtcttt

SEQ ID NO: 9182909 - DNA, 22 bp, Homo sapiens
gatttctttgcaagctgtgttc

SEQ ID NO: 9182910 - DNA, 22 bp, Homo sapiens
gatttctttaggtgtaatagtg

SEQ ID NO: 9182911 - DNA, 22 bp, Homo sapiens
gatttctttatgaagtacagaa

SEQ ID NO: 9182912 - DNA, 22 bp, Homo sapiens
gatttcttgataattcaaatcc

SEQ ID NO: 9182913 - DNA, 22 bp, Homo sapiens
gattttcatgataaacttgtga

SEQ ID NO: 9182914 - DNA, 22 bp, Homo sapiens
gattttcattatagctagtttc

SEQ ID NO: 9182915 - DNA, 22 bp, Homo sapiens
gattttcattatagctagtttc

SEQ ID NO: 9182916 - DNA, 22 bp, Homo sapiens
gattttacaaactgcaggaccc

SEQ ID NO: 9182917 - DNA, 22 bp, Homo sapiens
gattttaattataggaggtcct

SEQ ID NO: 9182918 - DNA, 21 bp, Homo sapiens
gattttaaagagactgccaca

SEQ ID NO: 9182919 - DNA, 22 bp, Homo sapiens
gatttgtccacagagtgatgaa

SEQ ID NO: 9182920 - DNA, 22 bp, Homo sapiens
gatttgtcacggttgagagcca

SEQ ID NO: 9182921 - DNA, 22 bp, Homo sapiens
gatttgtttcaagttagcatct

SEQ ID NO: 9182922 - DNA, 19 bp, Homo sapiens
gcaatccacccacctcagc

SEQ ID NO: 9182923 - DNA, 22 bp, Homo sapiens
gcaatccaggaaaaaccaggga

SEQ ID NO: 9182924 - DNA, 22 bp, Homo sapiens
gcaattattatgtgacttttac

SEQ ID NO: 9182925 - DNA, 22 bp, Homo sapiens
gcaattatatcaccagagatct

SEQ ID NO: 9182926 - DNA, 19 bp, Homo sapiens
gcaattcagaagcacctgt

SEQ ID NO: 9182927 - DNA, 22 bp, Homo sapiens
gcaattatatcaccagagatct

SEQ ID NO: 9182928 - DNA, 20 bp, Homo sapiens
gcaatggcgtgctagttctg

SEQ ID NO: 9182929 - DNA, 22 bp, Homo sapiens
gcacaaaggtggaaggaggaag

SEQ ID NO: 9182930 - DNA, 17 bp, Homo sapiens
gcacaaatcaattacta

SEQ ID NO: 9182931 - DNA, 23 bp, Homo sapiens
gcacaagacctggcagcttccat

SEQ ID NO: 9182932 - DNA, 22 bp, Homo sapiens
gcacaaagatgaatacagaatg

SEQ ID NO: 9182933 - DNA, 22 bp, Homo sapiens
gcaatagattatgatctacagt

SEQ ID NO: 9182934 - DNA, 22 bp, Homo sapiens
gcaaacatgtgctcattttgtg

SEQ ID NO: 9182935 - DNA, 22 bp, Homo sapiens
gcaaacatcttagccatagagt

SEQ ID NO: 9182936 - DNA, 22 bp, Homo sapiens
gcaaaaaatgcttgttgcttag

SEQ ID NO: 9182937 - DNA, 22 bp, Homo sapiens
gcaaacagaaatgcaggacgct

SEQ ID NO: 9182938 - DNA, 22 bp, Homo sapiens
gattttgaatattaaagaagag

SEQ ID NO: 9182939 - DNA, 22 bp, Homo sapiens
gattttgtcaaattccaaatgt

SEQ ID NO: 9182940 - DNA, 22 bp, Homo sapiens
gcacttttcaaagcttcctgtg

SEQ ID NO: 9182941 - DNA, 22 bp, Homo sapiens
gcactttgtggattgtatttcc

SEQ ID NO: 9182942 - DNA, 22 bp, Homo sapiens
gcactttcagcaggcagacaga

SEQ ID NO: 9182943 - DNA, 23 bp, Homo sapiens
gcagaaattctcacactgaggcc

SEQ ID NO: 9182944 - DNA, 22 bp, Homo sapiens
gcagaaatatgatgcataaagg

SEQ ID NO: 9182945 - DNA, 22 bp, Homo sapiens
gcagaagcccggtcagcgcacg

SEQ ID NO: 9182946 - DNA, 22 bp, Homo sapiens
gcagaagcccggtcagcgcacg

SEQ ID NO: 9182947 - DNA, 22 bp, Homo sapiens
gcagaagctgggagaagggatt

SEQ ID NO: 9182948 - DNA, 22 bp, Homo sapiens
gcagaagcagggcaggggcaaa

SEQ ID NO: 9182949 - DNA, 22 bp, Homo sapiens
gcagaagcagggcaggggcaaa

SEQ ID NO: 9182950 - DNA, 22 bp, Homo sapiens
gcagaacaacgtaggagtggag

SEQ ID NO: 9182951 - DNA, 22 bp, Homo sapiens
gcagaagaccatggtggaaaga

SEQ ID NO: 9182952 - DNA, 22 bp, Homo sapiens
gcagaagaccatggtggaaaga

SEQ ID NO: 9182953 - DNA, 22 bp, Homo sapiens
gcagagccagaatggccaggac

SEQ ID NO: 9182954 - DNA, 22 bp, Homo sapiens
gcagagccaggagagacccttg

SEQ ID NO: 9182955 - DNA, 22 bp, Homo sapiens
gcagagccccattgctggcggg

SEQ ID NO: 9182956 - DNA, 22 bp, Homo sapiens
gcagagccccattgctggcggg

SEQ ID NO: 9182957 - DNA, 22 bp, Homo sapiens
gcagagccaggctggggcaggt

SEQ ID NO: 9182958 - DNA, 22 bp, Homo sapiens
gcagagcagtgcttgcccagcg

SEQ ID NO: 9182959 - DNA, 22 bp, Homo sapiens
gcagagcattggagggaccctg

SEQ ID NO: 9182960 - DNA, 22 bp, Homo sapiens
gcagagccagaatggccaggac

SEQ ID NO: 9182961 - DNA, 22 bp, Homo sapiens
gcagaagctgggcagcgaggtg

SEQ ID NO: 9182962 - DNA, 22 bp, Homo sapiens
gcagaagctgggcagcgaggtg

SEQ ID NO: 9182963 - DNA, 22 bp, Homo sapiens
gcagaaggatccgcaggtgcaa

SEQ ID NO: 9182964 - DNA, 22 bp, Homo sapiens
gcagaagctgttcgaaggccgc

SEQ ID NO: 9182965 - DNA, 22 bp, Homo sapiens
gcacctccaggggccgcccacc

SEQ ID NO: 9182966 - DNA, 22 bp, Homo sapiens
gcacctcattttgcaggtagaa

SEQ ID NO: 9182967 - DNA, 22 bp, Homo sapiens
gcaccgttcactctccgccaga

SEQ ID NO: 9182968 - DNA, 22 bp, Homo sapiens
gcacctgctggaatcagtctgt

SEQ ID NO: 9182969 - DNA, 22 bp, Homo sapiens
gcacctgattgatttcactgct

SEQ ID NO: 9182970 - DNA, 22 bp, Homo sapiens
gcacctggacagtgaccctagc

SEQ ID NO: 9182971 - DNA, 22 bp, Homo sapiens
gcacctggctgcccaggtggag

SEQ ID NO: 9182972 - DNA, 21 bp, Homo sapiens
gcacttggggattcagggagg

SEQ ID NO: 9182973 - DNA, 22 bp, Homo sapiens
gcaccgccttggaccgcccgct

SEQ ID NO: 9182974 - DNA, 22 bp, Homo sapiens
gcaccgagaaggaagcatgcct

SEQ ID NO: 9182975 - DNA, 22 bp, Homo sapiens
gcaccgccttggaccgcccgct

SEQ ID NO: 9182976 - DNA, 22 bp, Homo sapiens
gcaccgccttggaccgcccgct

SEQ ID NO: 9182977 - DNA, 22 bp, Homo sapiens
gcacacactgttttcctcacat

SEQ ID NO: 9182978 - DNA, 22 bp, Homo sapiens
gcacacacatgtgagtacatgc

SEQ ID NO: 9182979 - DNA, 16 bp, Homo sapiens
gcacacacatcaatga

SEQ ID NO: 9182980 - DNA, 22 bp, Homo sapiens
gcacaataacagccaaggttat

SEQ ID NO: 9182981 - DNA, 22 bp, Homo sapiens
gcacaattccatgggacagccc

SEQ ID NO: 9182982 - DNA, 22 bp, Homo sapiens
gattaggagggagaggcaagta

SEQ ID NO: 9182983 - DNA, 22 bp, Homo sapiens
gattacccgactcccttcaatg

SEQ ID NO: 9182984 - DNA, 22 bp, Homo sapiens
gattagaatgggaagatacaag

SEQ ID NO: 9182985 - DNA, 22 bp, Homo sapiens
gattatataatggaagctcttg

SEQ ID NO: 9182986 - DNA, 22 bp, Homo sapiens
gattatgactgtcctagaaaaa

SEQ ID NO: 9182987 - DNA, 22 bp, Homo sapiens
gattatgattaagatggacctg

SEQ ID NO: 9182988 - DNA, 22 bp, Homo sapiens
gattattttgtgcaataatcgg

SEQ ID NO: 9182989 - DNA, 22 bp, Homo sapiens
gattgaaacataggcagtcgag

SEQ ID NO: 9182990 - DNA, 22 bp, Homo sapiens
gattctttggcctttattgaca

SEQ ID NO: 9182991 - DNA, 22 bp, Homo sapiens
gattgaaaggtctttaaattgg

SEQ ID NO: 9182992 - DNA, 22 bp, Homo sapiens
gattgaaaggtctttaaattgg

SEQ ID NO: 9182993 - DNA, 22 bp, Homo sapiens
gattgaaaggaaaaccagagtg

SEQ ID NO: 9182994 - DNA, 22 bp, Homo sapiens
gattgaaatataaatatgtgtt

SEQ ID NO: 9182995 - DNA, 22 bp, Homo sapiens
gattgaaatataaatatgtgtt

SEQ ID NO: 9182996 - DNA, 22 bp, Homo sapiens
gattgaaacataggcagtcgag

SEQ ID NO: 9182997 - DNA, 21 bp, Homo sapiens
gattgaaaccatggcagtgag

SEQ ID NO: 9182998 - DNA, 21 bp, Homo sapiens
gattgaaaccatggcagtgag

SEQ ID NO: 9182999 - DNA, 22 bp, Homo sapiens
gattgaaagactgtttgggaga

SEQ ID NO: 9183000 - DNA, 22 bp, Homo sapiens
gattgaaagactgtttgggaga

SEQ ID NO: 9183001 - DNA, 22 bp, Homo sapiens
gattgaaaggaaaaccagagtg

SEQ ID NO: 9183002 - DNA, 22 bp, Homo sapiens
gattcaaagttaatgaagatgc

SEQ ID NO: 9183003 - DNA, 22 bp, Homo sapiens
gattcaaagttaatgaagatgc

SEQ ID NO: 9183004 - DNA, 22 bp, Homo sapiens
gatgtgtttccaggatttgttt

SEQ ID NO: 9183005 - DNA, 22 bp, Homo sapiens
gatgtgtttccaggatttgttt

SEQ ID NO: 9183006 - DNA, 22 bp, Homo sapiens
gatgtttcccgttaagagaaaa

SEQ ID NO: 9183007 - DNA, 22 bp, Homo sapiens
gatgtttctgggaaggaaaagt

SEQ ID NO: 9183008 - DNA, 22 bp, Homo sapiens
gatgttgaggaagaaagggcag

SEQ ID NO: 9183009 - DNA, 22 bp, Homo sapiens
gatgttgctcagcgttcttggg

SEQ ID NO: 9183010 - DNA, 22 bp, Homo sapiens
gatgtttcatgctagcatgtgt

SEQ ID NO: 9183011 - DNA, 21 bp, Homo sapiens
gattaaatttaagctacatgc

SEQ ID NO: 9183012 - DNA, 22 bp, Homo sapiens
gattaaaaataacccatgctga

SEQ ID NO: 9183013 - DNA, 22 bp, Homo sapiens
gattacaattcaggttgataag

SEQ ID NO: 9183014 - DNA, 20 bp, Homo sapiens
gattacaaaatgaaatgcat

SEQ ID NO: 9183015 - DNA, 22 bp, Homo sapiens
gattacaaaggtccttttctct

SEQ ID NO: 9183016 - DNA, 22 bp, Homo sapiens
gattaatagtacaggttcttag

SEQ ID NO: 9183017 - DNA, 22 bp, Homo sapiens
gattacaaaactcatctatgac

SEQ ID NO: 9183018 - DNA, 22 bp, Homo sapiens
gattaatagacacaaccaagct

SEQ ID NO: 9183019 - DNA, 22 bp, Homo sapiens
gattaagtaactgaacactttg

SEQ ID NO: 9183020 - DNA, 21 bp, Homo sapiens
gatttataagccttaagccta

SEQ ID NO: 9183021 - DNA, 22 bp, Homo sapiens
gatttataaaggttgcactgga

SEQ ID NO: 9183022 - DNA, 22 bp, Homo sapiens
gatttattggtctttcattggt

SEQ ID NO: 9183023 - DNA, 22 bp, Homo sapiens
gatttatagtatgtgctttcag

SEQ ID NO: 9183024 - DNA, 22 bp, Homo sapiens
gatttattgtccctgtcctgct

SEQ ID NO: 9183025 - DNA, 22 bp, Homo sapiens
gatttattgtccctgtcctgct

SEQ ID NO: 9183026 - DNA, 22 bp, Homo sapiens
gatttcaacctaacagtatgac

SEQ ID NO: 9183027 - DNA, 22 bp, Homo sapiens
gatttatttttaatcagcaggg

SEQ ID NO: 9183028 - DNA, 22 bp, Homo sapiens
gatttatttttaatcagcaggg

SEQ ID NO: 9183029 - DNA, 22 bp, Homo sapiens
gatttattgtccctgtcctgct

SEQ ID NO: 9183030 - DNA, 22 bp, Homo sapiens
gatttatttttaatcagcaggg

SEQ ID NO: 9183031 - DNA, 22 bp, Homo sapiens
gatttatttttaatcagcaggg

SEQ ID NO: 9183032 - DNA, 22 bp, Homo sapiens
gattgagtctgaggatgctgca

SEQ ID NO: 9183033 - DNA, 22 bp, Homo sapiens
gattgagtctgaggatgctgca

SEQ ID NO: 9183034 - DNA, 22 bp, Homo sapiens
gattgagtctgaggatgctgca

SEQ ID NO: 9183035 - DNA, 22 bp, Homo sapiens
gattgctgaagaaagtgagtga

SEQ ID NO: 9183036 - DNA, 22 bp, Homo sapiens
gattgctgccagcgtgtccgtg

SEQ ID NO: 9183037 - DNA, 22 bp, Homo sapiens
gattgtaattttcaagaggtaa

SEQ ID NO: 9183038 - DNA, 22 bp, Homo sapiens
gattgtcactccctatatggta

SEQ ID NO: 9183039 - DNA, 22 bp, Homo sapiens
gattgtaattctactttccgct

SEQ ID NO: 9183040 - DNA, 22 bp, Homo sapiens
gattgtaaaacagatcattatc

SEQ ID NO: 9183041 - DNA, 22 bp, Homo sapiens
gatttaaagtagacctttgttt

SEQ ID NO: 9183042 - DNA, 22 bp, Homo sapiens
gatttaaagtagacctttgttt

SEQ ID NO: 9183043 - DNA, 22 bp, Homo sapiens
gattgtgatacctagagcagca

SEQ ID NO: 9183044 - DNA, 19 bp, Homo sapiens
gatttaaacgtggctctat

SEQ ID NO: 9183045 - DNA, 19 bp, Homo sapiens
gatttaaacgtggctctat

SEQ ID NO: 9183046 - DNA, 22 bp, Homo sapiens
gatggcccagtcttgggacagt

SEQ ID NO: 9183047 - DNA, 22 bp, Homo sapiens
gatggaggagatggcagggtgc

SEQ ID NO: 9183048 - DNA, 22 bp, Homo sapiens
gatggaagaaaaatgcatgtct

SEQ ID NO: 9183049 - DNA, 22 bp, Homo sapiens
gatggcggtggccacctccttg

SEQ ID NO: 9183050 - DNA, 22 bp, Homo sapiens
gatggcctcatggctgcaggcc

SEQ ID NO: 9183051 - DNA, 22 bp, Homo sapiens
gatggcctgggtccccttccgg

SEQ ID NO: 9183052 - DNA, 18 bp, Homo sapiens
gatggccatttcaatgtt

SEQ ID NO: 9183053 - DNA, 22 bp, Homo sapiens
gatggcttctctctagcttggt

SEQ ID NO: 9183054 - DNA, 22 bp, Homo sapiens
gatggcttgcttagtgacagca

SEQ ID NO: 9183055 - DNA, 20 bp, Homo sapiens
gatggctttagaagctggta

SEQ ID NO: 9183056 - DNA, 22 bp, Homo sapiens
gatgggcacggcagtctgagag

SEQ ID NO: 9183057 - DNA, 22 bp, Homo sapiens
gatgggaggaacctgggtccct

SEQ ID NO: 9183058 - DNA, 22 bp, Homo sapiens
gatgggaggaacctgggtccct

SEQ ID NO: 9183059 - DNA, 22 bp, Homo sapiens
gatgcattacaaaagtgattat

SEQ ID NO: 9183060 - DNA, 22 bp, Homo sapiens
gatgcgggcccgctccactgcc

SEQ ID NO: 9183061 - DNA, 19 bp, Homo sapiens
gatgctcattcaggtggaa

SEQ ID NO: 9183062 - DNA, 22 bp, Homo sapiens
gatgctcatctgtcctttgatg

SEQ ID NO: 9183063 - DNA, 22 bp, Homo sapiens
gatgctggcctggccatctggg

SEQ ID NO: 9183064 - DNA, 22 bp, Homo sapiens
gatgctggaagtgctgatcttg

SEQ ID NO: 9183065 - DNA, 22 bp, Homo sapiens
gatgctgtagatgagaacattg

SEQ ID NO: 9183066 - DNA, 22 bp, Homo sapiens
gatgctgtaaaatgctaaacat

SEQ ID NO: 9183067 - DNA, 22 bp, Homo sapiens
gatgctttctcctttctccacc

SEQ ID NO: 9183068 - DNA, 22 bp, Homo sapiens
gatgctttggccccatcatgag

SEQ ID NO: 9183069 - DNA, 22 bp, Homo sapiens
gatgcttaccgacttacagtgc

SEQ ID NO: 9183070 - DNA, 22 bp, Homo sapiens
gatgctttccaagaaatcctca

SEQ ID NO: 9183071 - DNA, 22 bp, Homo sapiens
gatgctgtggtaagccccaccg

SEQ ID NO: 9183072 - DNA, 22 bp, Homo sapiens
gatgctgtgctatgtctacaga

SEQ ID NO: 9183073 - DNA, 22 bp, Homo sapiens
gatgctgtggggttgaccctgg

SEQ ID NO: 9183074 - DNA, 22 bp, Homo sapiens
gatggggctggctttgagggtt

SEQ ID NO: 9183075 - DNA, 22 bp, Homo sapiens
gatgggggccagggcctgcttt

SEQ ID NO: 9183076 - DNA, 22 bp, Homo sapiens
gatggggatgagaagtgagcag

SEQ ID NO: 9183077 - DNA, 22 bp, Homo sapiens
gatgtaaaacctatggagctga

SEQ ID NO: 9183078 - DNA, 22 bp, Homo sapiens
gatggtgcaggtgaagtgctgg

SEQ ID NO: 9183079 - DNA, 22 bp, Homo sapiens
gatggtggagtaacattgccta

SEQ ID NO: 9183080 - DNA, 22 bp, Homo sapiens
gatggtggcaagagccaagtct

SEQ ID NO: 9183081 - DNA, 22 bp, Homo sapiens
gatgtccagcgtctggctgcct

SEQ ID NO: 9183082 - DNA, 18 bp, Homo sapiens
gatgtcaaggactggaca

SEQ ID NO: 9183083 - DNA, 22 bp, Homo sapiens
gatgtagagggaagattttaaa

SEQ ID NO: 9183084 - DNA, 22 bp, Homo sapiens
gatgtactttaaaatacttcag

SEQ ID NO: 9183085 - DNA, 22 bp, Homo sapiens
gatgtacttgccttatctatcc

SEQ ID NO: 9183086 - DNA, 21 bp, Homo sapiens
gatgtacatcaagcactttgc

SEQ ID NO: 9183087 - DNA, 22 bp, Homo sapiens
gatgtcttaggtaacattctat

SEQ ID NO: 9183088 - DNA, 22 bp, Homo sapiens
gatgtcttactaactagccttt

SEQ ID NO: 9183089 - DNA, 22 bp, Homo sapiens
gatgtctgggtcttcctggctt

SEQ ID NO: 9183090 - DNA, 22 bp, Homo sapiens
gatgtctgtctgagccgctgga

SEQ ID NO: 9183091 - DNA, 22 bp, Homo sapiens
gatgtcttaagcccagaagttc

SEQ ID NO: 9183092 - DNA, 22 bp, Homo sapiens
gatgtgtctccatacaccaccc

SEQ ID NO: 9183093 - DNA, 22 bp, Homo sapiens
gccagcagcccagaaggacttt

SEQ ID NO: 9183094 - DNA, 22 bp, Homo sapiens
gccagcagcccagaaggacttt

SEQ ID NO: 9183095 - DNA, 22 bp, Homo sapiens
gccagcagctcttgggcgggca

SEQ ID NO: 9183096 - DNA, 22 bp, Homo sapiens
gccagcagctcttgggcgggca

SEQ ID NO: 9183097 - DNA, 22 bp, Homo sapiens
gccagcagctcttgggcgggca

SEQ ID NO: 9183098 - DNA, 22 bp, Homo sapiens
gccagcagctcttgggcgggca

SEQ ID NO: 9183099 - DNA, 22 bp, Homo sapiens
gccagcagcgagagtttaacct

SEQ ID NO: 9183100 - DNA, 22 bp, Homo sapiens
gccagcagcgagagtttaacct

SEQ ID NO: 9183101 - DNA, 22 bp, Homo sapiens
gccagcagggaagccttgggct

SEQ ID NO: 9183102 - DNA, 22 bp, Homo sapiens
gccagcagggaagccttgggct

SEQ ID NO: 9183103 - DNA, 22 bp, Homo sapiens
gccagcagggaagccttgggct

SEQ ID NO: 9183104 - DNA, 22 bp, Homo sapiens
gccagcagcttcttctcatcct

SEQ ID NO: 9183105 - DNA, 22 bp, Homo sapiens
gccagcagcttcttctcatcct

SEQ ID NO: 9183106 - DNA, 22 bp, Homo sapiens
gccagcagctgtggggtggcca

SEQ ID NO: 9183107 - DNA, 22 bp, Homo sapiens
gccagcagctgtggggtggcca

SEQ ID NO: 9183108 - DNA, 22 bp, Homo sapiens
gccagcagctgtggggtggcca

SEQ ID NO: 9183109 - DNA, 22 bp, Homo sapiens
gccagcagctgtggggtggcca

SEQ ID NO: 9183110 - DNA, 22 bp, Homo sapiens
gccagcaaagcaagttgtcagc

SEQ ID NO: 9183111 - DNA, 22 bp, Homo sapiens
gccagcaagggtccactgtcac

SEQ ID NO: 9183112 - DNA, 22 bp, Homo sapiens
gccagcaactaggagctgaatt

SEQ ID NO: 9183113 - DNA, 22 bp, Homo sapiens
gccagcaccagctactagtcac

SEQ ID NO: 9183114 - DNA, 19 bp, Homo sapiens
gccagcacatgtcttctag

SEQ ID NO: 9183115 - DNA, 19 bp, Homo sapiens
gccagcacatgtcttctag

SEQ ID NO: 9183116 - DNA, 22 bp, Homo sapiens
gccagcaccttctcatatgttt

SEQ ID NO: 9183117 - DNA, 22 bp, Homo sapiens
gccagcaccttagcatgaatca

SEQ ID NO: 9183118 - DNA, 22 bp, Homo sapiens
gccagcagccacagaagtcact

SEQ ID NO: 9183119 - DNA, 22 bp, Homo sapiens
gccagcagccacagaagtcact

SEQ ID NO: 9183120 - DNA, 19 bp, Homo sapiens
gccagcagaatgatgaggc

SEQ ID NO: 9183121 - DNA, 22 bp, Homo sapiens
gccagcagccacagaagtcact

SEQ ID NO: 9183122 - DNA, 19 bp, Homo sapiens
gccagcagaatgatgaggc

SEQ ID NO: 9183123 - DNA, 19 bp, Homo sapiens
gccagcagaatgatgaggc

SEQ ID NO: 9183124 - DNA, 22 bp, Homo sapiens
gccacagcggggccgctagagc

SEQ ID NO: 9183125 - DNA, 22 bp, Homo sapiens
gccacagcggggccgctagagc

SEQ ID NO: 9183126 - DNA, 22 bp, Homo sapiens
gccacagctccagtcaggtgac

SEQ ID NO: 9183127 - DNA, 22 bp, Homo sapiens
gccacaggaaagcaccctggag

SEQ ID NO: 9183128 - DNA, 19 bp, Homo sapiens
gccacaggatgaagtttgg

SEQ ID NO: 9183129 - DNA, 19 bp, Homo sapiens
gccacaggatgaagtttgg

SEQ ID NO: 9183130 - DNA, 22 bp, Homo sapiens
gccacagcttagatcacagcct

SEQ ID NO: 9183131 - DNA, 22 bp, Homo sapiens
gccacagcttagatcacagcct

SEQ ID NO: 9183132 - DNA, 22 bp, Homo sapiens
gccacagcttagatcacagcct

SEQ ID NO: 9183133 - DNA, 22 bp, Homo sapiens
gccagatgtagatagcaaggta

SEQ ID NO: 9183134 - DNA, 22 bp, Homo sapiens
gccagatctgacatagtggaag

SEQ ID NO: 9183135 - DNA, 22 bp, Homo sapiens
gccagaggctcaggttgccatg

SEQ ID NO: 9183136 - DNA, 22 bp, Homo sapiens
gccacaggcacttaagggctgg

SEQ ID NO: 9183137 - DNA, 22 bp, Homo sapiens
gccacaggctccagcatcagta

SEQ ID NO: 9183138 - DNA, 20 bp, Homo sapiens
gccagaggccggcaggggct

SEQ ID NO: 9183139 - DNA, 22 bp, Homo sapiens
gccacaggctccagcatcagta

SEQ ID NO: 9183140 - DNA, 22 bp, Homo sapiens
gccacagcccgagcaccatgag

SEQ ID NO: 9183141 - DNA, 22 bp, Homo sapiens
gccacagccgaacccttgggcc

SEQ ID NO: 9183142 - DNA, 22 bp, Homo sapiens
gccacagccgaacccttgggcc

SEQ ID NO: 9183143 - DNA, 22 bp, Homo sapiens
gccacagccgaacccttgggcc

SEQ ID NO: 9183144 - DNA, 22 bp, Homo sapiens
gccacagcagggccctctcagg

SEQ ID NO: 9183145 - DNA, 22 bp, Homo sapiens
gccaatcaggaggctgtacatc

SEQ ID NO: 9183146 - DNA, 22 bp, Homo sapiens
gccaataggaagagaaagatgg

SEQ ID NO: 9183147 - DNA, 22 bp, Homo sapiens
gccaatcagcgctcagacgacc

SEQ ID NO: 9183148 - DNA, 22 bp, Homo sapiens
gccaatagcaatttctaggccc

SEQ ID NO: 9183149 - DNA, 22 bp, Homo sapiens
gccaataaatggaaaagatgga

SEQ ID NO: 9183150 - DNA, 22 bp, Homo sapiens
gccaatggctcatgagcaggac

SEQ ID NO: 9183151 - DNA, 22 bp, Homo sapiens
gccaatgacagtctcagttctg

SEQ ID NO: 9183152 - DNA, 22 bp, Homo sapiens
gccaatgacagtctcagttctg

SEQ ID NO: 9183153 - DNA, 22 bp, Homo sapiens
gccaatgacagtctcagttctg

SEQ ID NO: 9183154 - DNA, 22 bp, Homo sapiens
gccaatgacagtctcagttctg

SEQ ID NO: 9183155 - DNA, 22 bp, Homo sapiens
gcatgttttgcaacaagtgacc

SEQ ID NO: 9183156 - DNA, 22 bp, Homo sapiens
gcatggtggggagatggcagcc

SEQ ID NO: 9183157 - DNA, 22 bp, Homo sapiens
gcatgtggaatctctccatggt

SEQ ID NO: 9183158 - DNA, 22 bp, Homo sapiens
gcatggtggagtctgagcaggg

SEQ ID NO: 9183159 - DNA, 22 bp, Homo sapiens
gcatggtggccttagggtagcc

SEQ ID NO: 9183160 - DNA, 22 bp, Homo sapiens
gcatgggaggacagtctgggct

SEQ ID NO: 9183161 - DNA, 22 bp, Homo sapiens
gcatgggcaagaggactggggg

SEQ ID NO: 9183162 - DNA, 22 bp, Homo sapiens
gcatgtgtctccccagtggagg

SEQ ID NO: 9183163 - DNA, 22 bp, Homo sapiens
gcatgtggccttcaggctggaa

SEQ ID NO: 9183164 - DNA, 22 bp, Homo sapiens
gcagtggggcgctgggagttgg

SEQ ID NO: 9183165 - DNA, 22 bp, Homo sapiens
gcagtggggcgctgggagttgg

SEQ ID NO: 9183166 - DNA, 22 bp, Homo sapiens
gcagtggggaatgctggggaga

SEQ ID NO: 9183167 - DNA, 22 bp, Homo sapiens
gcagtggggaatgctggggaga

SEQ ID NO: 9183168 - DNA, 22 bp, Homo sapiens
gcagtgggcctgaggaagggtg

SEQ ID NO: 9183169 - DNA, 22 bp, Homo sapiens
gcagtgggcctgaggaagggtg

SEQ ID NO: 9183170 - DNA, 22 bp, Homo sapiens
gcagtgggcaacaagagctgga

SEQ ID NO: 9183171 - DNA, 22 bp, Homo sapiens
gcagtagtcgctggagatgagg

SEQ ID NO: 9183172 - DNA, 22 bp, Homo sapiens
gcagtaggggctggagggctgt

SEQ ID NO: 9183173 - DNA, 22 bp, Homo sapiens
gcagtagaacgtgttgaatcaa

SEQ ID NO: 9183174 - DNA, 22 bp, Homo sapiens
gcagtagaactgtcatgatgtt

SEQ ID NO: 9183175 - DNA, 22 bp, Homo sapiens
gcagtagagaagccaggctgta

SEQ ID NO: 9183176 - DNA, 19 bp, Homo sapiens
gcaggtggatgtggtcagc

SEQ ID NO: 9183177 - DNA, 19 bp, Homo sapiens
gcaggtggatgtggtcagc

SEQ ID NO: 9183178 - DNA, 22 bp, Homo sapiens
gcaggtggagcagtagtctggt

SEQ ID NO: 9183179 - DNA, 22 bp, Homo sapiens
gcaggtggagcagtagtctggt

SEQ ID NO: 9183180 - DNA, 22 bp, Homo sapiens
gcaggtggaagcagcagactca

SEQ ID NO: 9183181 - DNA, 22 bp, Homo sapiens
gcagggtgatagtgaggctcag

SEQ ID NO: 9183182 - DNA, 22 bp, Homo sapiens
gcagggtgatagtgaggctcag

SEQ ID NO: 9183183 - DNA, 19 bp, Homo sapiens
gcagggtggcagagctctt

SEQ ID NO: 9183184 - DNA, 22 bp, Homo sapiens
gcaggtggtccccgtggagtgg

SEQ ID NO: 9183185 - DNA, 22 bp, Homo sapiens
gcaggcagaggtggaggagaca

SEQ ID NO: 9183186 - DNA, 22 bp, Homo sapiens
gcaggcagagaggggtttccag

SEQ ID NO: 9183187 - DNA, 21 bp, Homo sapiens
gcaggcactctagaggagctg

SEQ ID NO: 9183188 - DNA, 22 bp, Homo sapiens
gcaggcactcctaggaccatca

SEQ ID NO: 9183189 - DNA, 22 bp, Homo sapiens
gcaggcactcctaggaccatca

SEQ ID NO: 9183190 - DNA, 21 bp, Homo sapiens
gcaggcactctagaggagctg

SEQ ID NO: 9183191 - DNA, 22 bp, Homo sapiens
gcaggctgctgagatccttagg

SEQ ID NO: 9183192 - DNA, 22 bp, Homo sapiens
gcaggctgctgagatccttagg

SEQ ID NO: 9183193 - DNA, 22 bp, Homo sapiens
gcaggctggtctgaccatccct

SEQ ID NO: 9183194 - DNA, 21 bp, Homo sapiens
gcaggctggtcaaacctcagt

SEQ ID NO: 9183195 - DNA, 21 bp, Homo sapiens
gcaggctggtcaaacctcagt

SEQ ID NO: 9183196 - DNA, 22 bp, Homo sapiens
gcaggctggggtagccccactt

SEQ ID NO: 9183197 - DNA, 22 bp, Homo sapiens
gcaggctggggtagccccactt

SEQ ID NO: 9183198 - DNA, 22 bp, Homo sapiens
gcagggaagacccggagcagcg

SEQ ID NO: 9183199 - DNA, 22 bp, Homo sapiens
gcagggaccttgcccaccctcc

SEQ ID NO: 9183200 - DNA, 22 bp, Homo sapiens
gcagggacgcagcactctccgt

SEQ ID NO: 9183201 - DNA, 20 bp, Homo sapiens
gcagggcaagggatatgaaa

SEQ ID NO: 9183202 - DNA, 22 bp, Homo sapiens
gcagggcaaatgtggaaaggag

SEQ ID NO: 9183203 - DNA, 22 bp, Homo sapiens
gcagggcaaatgtggaaaggag

SEQ ID NO: 9183204 - DNA, 22 bp, Homo sapiens
gcagggcaaacccaggtgttca

SEQ ID NO: 9183205 - DNA, 22 bp, Homo sapiens
gcagggcaaatgtggaaaggag

SEQ ID NO: 9183206 - DNA, 22 bp, Homo sapiens
gcagggcacaaggacgcacagg

SEQ ID NO: 9183207 - DNA, 20 bp, Homo sapiens
gcagggcaagggatatgaaa

SEQ ID NO: 9183208 - DNA, 22 bp, Homo sapiens
gcagggcacaaggacgcacagg

SEQ ID NO: 9183209 - DNA, 22 bp, Homo sapiens
gcagggcacaaggacgcacagg

SEQ ID NO: 9183210 - DNA, 22 bp, Homo sapiens
gcagggcacacaagaatgataa

SEQ ID NO: 9183211 - DNA, 22 bp, Homo sapiens
gcagggcagaaggtgctgagga

SEQ ID NO: 9183212 - DNA, 22 bp, Homo sapiens
gcagggcagaaggtgctgagga

SEQ ID NO: 9183213 - DNA, 22 bp, Homo sapiens
gcagggcacagacagtgccaag

SEQ ID NO: 9183214 - DNA, 22 bp, Homo sapiens
gcagggcacagacagtgccaag

SEQ ID NO: 9183215 - DNA, 22 bp, Homo sapiens
gcagggcagaaggtgctgagga

SEQ ID NO: 9183216 - DNA, 22 bp, Homo sapiens
gcagggcagaaggtgctgagga

SEQ ID NO: 9183217 - DNA, 22 bp, Homo sapiens
gcagggcagacctccagcctat

SEQ ID NO: 9183218 - DNA, 22 bp, Homo sapiens
gcaggggctaaggacacagaga

SEQ ID NO: 9183219 - DNA, 22 bp, Homo sapiens
gcaggggcggctgggtttccag

SEQ ID NO: 9183220 - DNA, 22 bp, Homo sapiens
gcaggggctactctgagcttcc

SEQ ID NO: 9183221 - DNA, 22 bp, Homo sapiens
gcaggggctactctgagcttcc

SEQ ID NO: 9183222 - DNA, 22 bp, Homo sapiens
gcaggggcaggagatctcaggc

SEQ ID NO: 9183223 - DNA, 22 bp, Homo sapiens
gcaggggcaggagatctcaggc

SEQ ID NO: 9183224 - DNA, 22 bp, Homo sapiens
gcagggcagagggagaatctct

SEQ ID NO: 9183225 - DNA, 22 bp, Homo sapiens
gcagggggtcattcacgctggc

SEQ ID NO: 9183226 - DNA, 22 bp, Homo sapiens
gcagggtgaaggtcacatagaa

SEQ ID NO: 9183227 - DNA, 22 bp, Homo sapiens
gcagggggatggagttgaaatg

SEQ ID NO: 9183228 - DNA, 22 bp, Homo sapiens
gcaggggctgctgggaactcgg

SEQ ID NO: 9183229 - DNA, 22 bp, Homo sapiens
gcaggggctgagcaccagcggg

SEQ ID NO: 9183230 - DNA, 19 bp, Homo sapiens
gcaggcacagccctgggtg

SEQ ID NO: 9183231 - DNA, 19 bp, Homo sapiens
gcaggcacagccctgggtg

SEQ ID NO: 9183232 - DNA, 22 bp, Homo sapiens
gcaggcaccacggctcaggtct

SEQ ID NO: 9183233 - DNA, 22 bp, Homo sapiens
gcaggcaccgggttgctcccct

SEQ ID NO: 9183234 - DNA, 22 bp, Homo sapiens
gcaggagccacttcagggatgc

SEQ ID NO: 9183235 - DNA, 22 bp, Homo sapiens
gcaggagagccagcaggcttcc

SEQ ID NO: 9183236 - DNA, 22 bp, Homo sapiens
gcaggagctcgtttccaggctg

SEQ ID NO: 9183237 - DNA, 22 bp, Homo sapiens
gcaggagctcgtttccaggctg

SEQ ID NO: 9183238 - DNA, 22 bp, Homo sapiens
gcaggagctgctctcctgacga

SEQ ID NO: 9183239 - DNA, 22 bp, Homo sapiens
gcagctgagcgtgaggaagagt

SEQ ID NO: 9183240 - DNA, 22 bp, Homo sapiens
gcaggacagacccaagcagtct

SEQ ID NO: 9183241 - DNA, 22 bp, Homo sapiens
gcaggacagcaggatgcttaga

SEQ ID NO: 9183242 - DNA, 22 bp, Homo sapiens
gcaggacagcaggatgcttaga

SEQ ID NO: 9183243 - DNA, 22 bp, Homo sapiens
gcagctgagagaagaacagggc

SEQ ID NO: 9183244 - DNA, 22 bp, Homo sapiens
gcagctgagagaagaacagggc

SEQ ID NO: 9183245 - DNA, 22 bp, Homo sapiens
gcaggacattcagtgaatgggc

SEQ ID NO: 9183246 - DNA, 22 bp, Homo sapiens
gcaggacattcagtgaatgggc

SEQ ID NO: 9183247 - DNA, 22 bp, Homo sapiens
gcaggacaggcgttggtccagt

SEQ ID NO: 9183248 - DNA, 22 bp, Homo sapiens
gcaggacaggcgttggtccagt

SEQ ID NO: 9183249 - DNA, 22 bp, Homo sapiens
gcaggagagccagcaggcttcc

SEQ ID NO: 9183250 - DNA, 22 bp, Homo sapiens
gcaggagagccagcaggcttcc

SEQ ID NO: 9183251 - DNA, 22 bp, Homo sapiens
gcaggagactggctgtggtagt

SEQ ID NO: 9183252 - DNA, 22 bp, Homo sapiens
gcaggagaaatgaagattgggt

SEQ ID NO: 9183253 - DNA, 22 bp, Homo sapiens
gcaggagaaatgaagattgggt

SEQ ID NO: 9183254 - DNA, 22 bp, Homo sapiens
gcaggagaacaaagcaagctgc

SEQ ID NO: 9183255 - DNA, 22 bp, Homo sapiens
gcagagcctgtgtctgagcaaa

SEQ ID NO: 9183256 - DNA, 22 bp, Homo sapiens
gcagagcctgtgtctgagcaaa

SEQ ID NO: 9183257 - DNA, 22 bp, Homo sapiens
gcagagcctgtgtctgagcaaa

SEQ ID NO: 9183258 - DNA, 20 bp, Homo sapiens
gcagagcctcactgcaaggg

SEQ ID NO: 9183259 - DNA, 20 bp, Homo sapiens
gcagagcctcactgcaaggg

SEQ ID NO: 9183260 - DNA, 21 bp, Homo sapiens
gcagagccggggcgagaaggc

SEQ ID NO: 9183261 - DNA, 22 bp, Homo sapiens
gcagcgtggggctgagtcagct

SEQ ID NO: 9183262 - DNA, 22 bp, Homo sapiens
gcagcgtggggacaggagctca

SEQ ID NO: 9183263 - DNA, 22 bp, Homo sapiens
gcagcgtggggacaggagctca

SEQ ID NO: 9183264 - DNA, 18 bp, Homo sapiens
gcagctagccaggggggc

SEQ ID NO: 9183265 - DNA, 22 bp, Homo sapiens
gcagctaccacccaggaaggac

SEQ ID NO: 9183266 - DNA, 22 bp, Homo sapiens
gcagagctccccaagacaccaa

SEQ ID NO: 9183267 - DNA, 22 bp, Homo sapiens
gcagagctcaaggtgttcagct

SEQ ID NO: 9183268 - DNA, 16 bp, Homo sapiens
gcagagctcagggact

SEQ ID NO: 9183269 - DNA, 22 bp, Homo sapiens
gcagagctcatgcctgcacctc

SEQ ID NO: 9183270 - DNA, 16 bp, Homo sapiens
gcagagctcagggact

SEQ ID NO: 9183271 - DNA, 22 bp, Homo sapiens
gcagagctcaaggtgttcagct

SEQ ID NO: 9183272 - DNA, 22 bp, Homo sapiens
gcagagctcatgcctgcacctc

SEQ ID NO: 9183273 - DNA, 22 bp, Homo sapiens
gcagagctccccaagacaccaa

SEQ ID NO: 9183274 - DNA, 22 bp, Homo sapiens
gcagagctcatgcctgcacctc

SEQ ID NO: 9183275 - DNA, 22 bp, Homo sapiens
gcagagctcatgcctgcacctc

SEQ ID NO: 9183276 - DNA, 22 bp, Homo sapiens
gcagctgaaagggatctctaca

SEQ ID NO: 9183277 - DNA, 22 bp, Homo sapiens
gcagctgaatgtccattgctgc

SEQ ID NO: 9183278 - DNA, 18 bp, Homo sapiens
gcagctgacactggagtt

SEQ ID NO: 9183279 - DNA, 22 bp, Homo sapiens
gcagctctggggcaggcctgag

SEQ ID NO: 9183280 - DNA, 22 bp, Homo sapiens
gcagctcctttaggctgcaaag

SEQ ID NO: 9183281 - DNA, 22 bp, Homo sapiens
gcagctcctcctgggctggaga

SEQ ID NO: 9183282 - DNA, 22 bp, Homo sapiens
gcagctcccatcagggcacaga

SEQ ID NO: 9183283 - DNA, 22 bp, Homo sapiens
gcagctccctggctgcaaatga

SEQ ID NO: 9183284 - DNA, 22 bp, Homo sapiens
gcagctcaagagaggtgctatg

SEQ ID NO: 9183285 - DNA, 22 bp, Homo sapiens
gcagctcacacagcaagttttg

SEQ ID NO: 9183286 - DNA, 22 bp, Homo sapiens
gcagctattgtctcctgggccc

SEQ ID NO: 9183287 - DNA, 22 bp, Homo sapiens
gcagctattgtctcctgggccc

SEQ ID NO: 9183288 - DNA, 22 bp, Homo sapiens
gcagctattgtctcctgggccc

SEQ ID NO: 9183289 - DNA, 22 bp, Homo sapiens
gctgctctggctctgcagtgtc

SEQ ID NO: 9183290 - DNA, 19 bp, Homo sapiens
gctgctctgggtctcatct

SEQ ID NO: 9183291 - DNA, 22 bp, Homo sapiens
gctgctctggctctgcagtgtc

SEQ ID NO: 9183292 - DNA, 19 bp, Homo sapiens
gctgctctgggtctcatct

SEQ ID NO: 9183293 - DNA, 22 bp, Homo sapiens
gctgctctgaaaatgactgttg

SEQ ID NO: 9183294 - DNA, 22 bp, Homo sapiens
gctgctctctccctaagttggg

SEQ ID NO: 9183295 - DNA, 20 bp, Homo sapiens
gctgctctccacggtctgca

SEQ ID NO: 9183296 - DNA, 22 bp, Homo sapiens
gctgctctccaagcctccttga

SEQ ID NO: 9183297 - DNA, 22 bp, Homo sapiens
gctgctctcagagctcatgctg

SEQ ID NO: 9183298 - DNA, 22 bp, Homo sapiens
gctgctctcagagctcatgctg

SEQ ID NO: 9183299 - DNA, 22 bp, Homo sapiens
gctgctctcatagatggcttca

SEQ ID NO: 9183300 - DNA, 21 bp, Homo sapiens
gctgctcgagatccagtgctt

SEQ ID NO: 9183301 - DNA, 21 bp, Homo sapiens
gctgctcgagatccagtgctt

SEQ ID NO: 9183302 - DNA, 21 bp, Homo sapiens
gctgctcgagatccagtgctt

SEQ ID NO: 9183303 - DNA, 22 bp, Homo sapiens
gctgctctacccatgcatctgt

SEQ ID NO: 9183304 - DNA, 22 bp, Homo sapiens
gctgcctgggcaggaggcgctg

SEQ ID NO: 9183305 - DNA, 22 bp, Homo sapiens
gctgcctggtttctcagctgca

SEQ ID NO: 9183306 - DNA, 22 bp, Homo sapiens
gctgcctggtttctcagctgca

SEQ ID NO: 9183307 - DNA, 22 bp, Homo sapiens
gctgcctggtttctcagctgca

SEQ ID NO: 9183308 - DNA, 21 bp, Homo sapiens
gctggagagccaggcaggggc

SEQ ID NO: 9183309 - DNA, 16 bp, Homo sapiens
gctgctgcttcctgct

SEQ ID NO: 9183310 - DNA, 22 bp, Homo sapiens
gctgctgccgcggccgctggga

SEQ ID NO: 9183311 - DNA, 22 bp, Homo sapiens
gctgctgcctgtagccagggtg

SEQ ID NO: 9183312 - DNA, 22 bp, Homo sapiens
gctgctgcctgtagccagggtg

SEQ ID NO: 9183313 - DNA, 19 bp, Homo sapiens
gctgctgctcctccctcgc

SEQ ID NO: 9183314 - DNA, 19 bp, Homo sapiens
gctgctgctcctccctcgc

SEQ ID NO: 9183315 - DNA, 22 bp, Homo sapiens
gctgctgcgcttgtctactgtt

SEQ ID NO: 9183316 - DNA, 22 bp, Homo sapiens
gctgctgcatgaacagcggtca

SEQ ID NO: 9183317 - DNA, 22 bp, Homo sapiens
gctgctgcaagagccagctctt

SEQ ID NO: 9183318 - DNA, 22 bp, Homo sapiens
gctgctgccgcggccgctggga

SEQ ID NO: 9183319 - DNA, 22 bp, Homo sapiens
gctgctgagctgcaggagtagg

SEQ ID NO: 9183320 - DNA, 22 bp, Homo sapiens
gctgctgagctgcaggagtagg

SEQ ID NO: 9183321 - DNA, 22 bp, Homo sapiens
gctgctgatgggcagggagtcg

SEQ ID NO: 9183322 - DNA, 22 bp, Homo sapiens
gctgctgcaagagccagctctt

SEQ ID NO: 9183323 - DNA, 22 bp, Homo sapiens
gctgctctgggtctgcccagct

SEQ ID NO: 9183324 - DNA, 22 bp, Homo sapiens
gctgctctgggtctgcccagct

SEQ ID NO: 9183325 - DNA, 22 bp, Homo sapiens
gctgctctgtgacagcctccgg

SEQ ID NO: 9183326 - DNA, 22 bp, Homo sapiens
gctgctctgttaattgctgtaa

SEQ ID NO: 9183327 - DNA, 22 bp, Homo sapiens
gctgctcttgaggggctcactg

SEQ ID NO: 9183328 - DNA, 22 bp, Homo sapiens
gctgaggattacttgaagtcag

SEQ ID NO: 9183329 - DNA, 20 bp, Homo sapiens
gctgaggattcctggcccct

SEQ ID NO: 9183330 - DNA, 22 bp, Homo sapiens
gctgaggattgaagagttgcca

SEQ ID NO: 9183331 - DNA, 22 bp, Homo sapiens
gctgaggattgaagagttgcca

SEQ ID NO: 9183332 - DNA, 20 bp, Homo sapiens
gctgaggattcctggcccct

SEQ ID NO: 9183333 - DNA, 22 bp, Homo sapiens
gctgaggattacttgaagtcag

SEQ ID NO: 9183334 - DNA, 22 bp, Homo sapiens
gctgaggatatagcaggaacaa

SEQ ID NO: 9183335 - DNA, 22 bp, Homo sapiens
gctgaggatatagcaggaacaa

SEQ ID NO: 9183336 - DNA, 22 bp, Homo sapiens
gctgaggatatagcaggaacaa

SEQ ID NO: 9183337 - DNA, 22 bp, Homo sapiens
gctgcctgatcatacaccaggg

SEQ ID NO: 9183338 - DNA, 22 bp, Homo sapiens
gctgaggattgaagagttgcca

SEQ ID NO: 9183339 - DNA, 22 bp, Homo sapiens
gctgaggattgaagagttgcca

SEQ ID NO: 9183340 - DNA, 22 bp, Homo sapiens
gctgagccacaggcagtgcact

SEQ ID NO: 9183341 - DNA, 22 bp, Homo sapiens
gctgagcccccctgcgtgggtc

SEQ ID NO: 9183342 - DNA, 22 bp, Homo sapiens
gctgagcctagctgtctcctgt

SEQ ID NO: 9183343 - DNA, 22 bp, Homo sapiens
gctgagccctcatccctagttt

SEQ ID NO: 9183344 - DNA, 22 bp, Homo sapiens
gctgagccatgaggcctcttgc

SEQ ID NO: 9183345 - DNA, 22 bp, Homo sapiens
gctgagctagctatctcagtct

SEQ ID NO: 9183346 - DNA, 22 bp, Homo sapiens
gctgaggaggtgtggttaggtg

SEQ ID NO: 9183347 - DNA, 22 bp, Homo sapiens
gctgaggaggtgtggttaggtg

SEQ ID NO: 9183348 - DNA, 22 bp, Homo sapiens
gctgcctgatgtccagcaggac

SEQ ID NO: 9183349 - DNA, 22 bp, Homo sapiens
gctgcctgccttgcctggagga

SEQ ID NO: 9183350 - DNA, 22 bp, Homo sapiens
gctgcctgccttgcctggagga

SEQ ID NO: 9183351 - DNA, 22 bp, Homo sapiens
gctgcctgctcacccggcctgg

SEQ ID NO: 9183352 - DNA, 22 bp, Homo sapiens
gctgcctgctcggctcctggga

SEQ ID NO: 9183353 - DNA, 22 bp, Homo sapiens
gctgcctgctcggctcctggga

SEQ ID NO: 9183354 - DNA, 22 bp, Homo sapiens
gctgcctggaataacggctggc

SEQ ID NO: 9183355 - DNA, 22 bp, Homo sapiens
gctgcctgctcggctcctggga

SEQ ID NO: 9183356 - DNA, 22 bp, Homo sapiens
gctgcctggagctcagcctgcc

SEQ ID NO: 9183357 - DNA, 22 bp, Homo sapiens
gctgcctggagaggcagggatg

SEQ ID NO: 9183358 - DNA, 22 bp, Homo sapiens
gctgcctggctttagtccactt

SEQ ID NO: 9183359 - DNA, 22 bp, Homo sapiens
gctgcctggagctcagcctgcc

SEQ ID NO: 9183360 - DNA, 22 bp, Homo sapiens
gctgggcagcctggccgctgcc

SEQ ID NO: 9183361 - DNA, 22 bp, Homo sapiens
gctgggcagctgaggcctctca

SEQ ID NO: 9183362 - DNA, 22 bp, Homo sapiens
gctgggcagctgaggcctctca

SEQ ID NO: 9183363 - DNA, 22 bp, Homo sapiens
gctgggcagctgaggcctctca

SEQ ID NO: 9183364 - DNA, 22 bp, Homo sapiens
gctgggcaggcctcgtgagggc

SEQ ID NO: 9183365 - DNA, 22 bp, Homo sapiens
gctgggcaccggagagacccca

SEQ ID NO: 9183366 - DNA, 22 bp, Homo sapiens
gctggcctgtctagagccttac

SEQ ID NO: 9183367 - DNA, 22 bp, Homo sapiens
gctggcctgtctagagccttac

SEQ ID NO: 9183368 - DNA, 22 bp, Homo sapiens
gctggcctgggcagcctgtcgg

SEQ ID NO: 9183369 - DNA, 22 bp, Homo sapiens
gctggccttgtgtctgaggaag

SEQ ID NO: 9183370 - DNA, 22 bp, Homo sapiens
gctggcctgctgggcaccaccg

SEQ ID NO: 9183371 - DNA, 22 bp, Homo sapiens
gctggcctgcgagggcaggctg

SEQ ID NO: 9183372 - DNA, 22 bp, Homo sapiens
gctggcctgcgagggcaggctg

SEQ ID NO: 9183373 - DNA, 22 bp, Homo sapiens
gctggcctgcgagggcaggctg

SEQ ID NO: 9183374 - DNA, 22 bp, Homo sapiens
gctgggagttactgtctccttt

SEQ ID NO: 9183375 - DNA, 22 bp, Homo sapiens
gctgggagttactgtctccttt

SEQ ID NO: 9183376 - DNA, 22 bp, Homo sapiens
gctggcggcagtggtgtctctg

SEQ ID NO: 9183377 - DNA, 22 bp, Homo sapiens
gctgggagtgggcaagatgaga

SEQ ID NO: 9183378 - DNA, 22 bp, Homo sapiens
gctgggagtgggcaagatgaga

SEQ ID NO: 9183379 - DNA, 22 bp, Homo sapiens
gctgggagtgggcaagatgaga

SEQ ID NO: 9183380 - DNA, 22 bp, Homo sapiens
gctgggagtgggcaagatgaga

SEQ ID NO: 9183381 - DNA, 22 bp, Homo sapiens
gctggcctctacaggccggcca

SEQ ID NO: 9183382 - DNA, 22 bp, Homo sapiens
gctggcctctacaggccggcca

SEQ ID NO: 9183383 - DNA, 22 bp, Homo sapiens
gctggcctcgcaggcaggatgt

SEQ ID NO: 9183384 - DNA, 22 bp, Homo sapiens
gctggcctcgcaggcaggatgt

SEQ ID NO: 9183385 - DNA, 22 bp, Homo sapiens
gctggcctctacaggccggcca

SEQ ID NO: 9183386 - DNA, 22 bp, Homo sapiens
gctggcctctggagaagggctt

SEQ ID NO: 9183387 - DNA, 22 bp, Homo sapiens
gctggcctgagggccgaggctc

SEQ ID NO: 9183388 - DNA, 22 bp, Homo sapiens
gctggcctgacctgaggctggg

SEQ ID NO: 9183389 - DNA, 22 bp, Homo sapiens
gctggcctgacctgaggctggg

SEQ ID NO: 9183390 - DNA, 22 bp, Homo sapiens
gctggcctgaccagccacaggc

SEQ ID NO: 9183391 - DNA, 22 bp, Homo sapiens
gctggccagtgtcccagggatc

SEQ ID NO: 9183392 - DNA, 22 bp, Homo sapiens
gctggccagtgtcccagggatc

SEQ ID NO: 9183393 - DNA, 22 bp, Homo sapiens
gctggagctgcagcctgggcct

SEQ ID NO: 9183394 - DNA, 22 bp, Homo sapiens
gctggcccagtgacccacagtg

SEQ ID NO: 9183395 - DNA, 22 bp, Homo sapiens
gctggcccagggtcacctagga

SEQ ID NO: 9183396 - DNA, 22 bp, Homo sapiens
gctggcccagggtcacctagga

SEQ ID NO: 9183397 - DNA, 22 bp, Homo sapiens
gctggccccgagtgctacgctc

SEQ ID NO: 9183398 - DNA, 19 bp, Homo sapiens
gctggcccctgggatccag

SEQ ID NO: 9183399 - DNA, 22 bp, Homo sapiens
gctggccgaacggtgccctggc

SEQ ID NO: 9183400 - DNA, 22 bp, Homo sapiens
gctggagatgctatgcagaggg

SEQ ID NO: 9183401 - DNA, 22 bp, Homo sapiens
gctggagatgctatgcagaggg

SEQ ID NO: 9183402 - DNA, 22 bp, Homo sapiens
gctggagatgctatgcagaggg

SEQ ID NO: 9183403 - DNA, 22 bp, Homo sapiens
gctggagctgagttccctgggc

SEQ ID NO: 9183404 - DNA, 22 bp, Homo sapiens
gctggagcgggttcgggccgct

SEQ ID NO: 9183405 - DNA, 22 bp, Homo sapiens
gctggagagtgaggggagcaag

SEQ ID NO: 9183406 - DNA, 22 bp, Homo sapiens
gctggagaggggtcactctgag

SEQ ID NO: 9183407 - DNA, 22 bp, Homo sapiens
gctggagagtagtaagcagtta

SEQ ID NO: 9183408 - DNA, 22 bp, Homo sapiens
gctggagatactgctcagtatc

SEQ ID NO: 9183409 - DNA, 22 bp, Homo sapiens
gctggagatagtaggatccata

SEQ ID NO: 9183410 - DNA, 22 bp, Homo sapiens
gctcagagcatcccagtgaatg

SEQ ID NO: 9183411 - DNA, 22 bp, Homo sapiens
gctcatgactgtaatcccagca

SEQ ID NO: 9183412 - DNA, 22 bp, Homo sapiens
gctcagagatgttcagtagctt

SEQ ID NO: 9183413 - DNA, 22 bp, Homo sapiens
gctcagagatgttcagtagctt

SEQ ID NO: 9183414 - DNA, 22 bp, Homo sapiens
gctcagagatgtctgctgcctt

SEQ ID NO: 9183415 - DNA, 22 bp, Homo sapiens
gcctgtttgtttgcaaaggagc

SEQ ID NO: 9183416 - DNA, 22 bp, Homo sapiens
gccttaaacaattgcctgttaa

SEQ ID NO: 9183417 - DNA, 22 bp, Homo sapiens
gctccagatgaaaggccagagg

SEQ ID NO: 9183418 - DNA, 22 bp, Homo sapiens
gctccaggagagggaagcagat

SEQ ID NO: 9183419 - DNA, 22 bp, Homo sapiens
gctccaggaagggaaatctcca

SEQ ID NO: 9183420 - DNA, 22 bp, Homo sapiens
gctccaggaagggaaatctcca

SEQ ID NO: 9183421 - DNA, 22 bp, Homo sapiens
gctccagagcagagactaggtt

SEQ ID NO: 9183422 - DNA, 22 bp, Homo sapiens
gctccacttgcagctaggcttg

SEQ ID NO: 9183423 - DNA, 22 bp, Homo sapiens
gctccacttgcagctaggcttg

SEQ ID NO: 9183424 - DNA, 22 bp, Homo sapiens
gctccacttgattgttacagca

SEQ ID NO: 9183425 - DNA, 22 bp, Homo sapiens
gctccactgtcccatgggactt

SEQ ID NO: 9183426 - DNA, 22 bp, Homo sapiens
gctccactaggaatctgctctt

SEQ ID NO: 9183427 - DNA, 22 bp, Homo sapiens
gctccactgcccctgggcaccg

SEQ ID NO: 9183428 - DNA, 22 bp, Homo sapiens
gctcatttctgtttcttgcaac

SEQ ID NO: 9183429 - DNA, 22 bp, Homo sapiens
gctcatgtgtgattacagtttt

SEQ ID NO: 9183430 - DNA, 22 bp, Homo sapiens
gctcctctcccagagctgcagg

SEQ ID NO: 9183431 - DNA, 22 bp, Homo sapiens
gctcctctcccagagctgcagg

SEQ ID NO: 9183432 - DNA, 22 bp, Homo sapiens
gctccaggaggatgaccttcct

SEQ ID NO: 9183433 - DNA, 22 bp, Homo sapiens
gctcctctgtcaaatgagagtg

SEQ ID NO: 9183434 - DNA, 22 bp, Homo sapiens
gctcctcttatttcatcagggc

SEQ ID NO: 9183435 - DNA, 22 bp, Homo sapiens
gctcctcttatttcatcagggc

SEQ ID NO: 9183436 - DNA, 22 bp, Homo sapiens
gctccaggagagggaagcagat

SEQ ID NO: 9183437 - DNA, 22 bp, Homo sapiens
gctccaggagagggaagcagat

SEQ ID NO: 9183438 - DNA, 22 bp, Homo sapiens
gctccaggagagggaagcagat

SEQ ID NO: 9183439 - DNA, 22 bp, Homo sapiens
gctccaggagctcacagctcgc

SEQ ID NO: 9183440 - DNA, 22 bp, Homo sapiens
gctccaggagctcacagctcgc

SEQ ID NO: 9183441 - DNA, 22 bp, Homo sapiens
gctccaggaggatgaccttcct

SEQ ID NO: 9183442 - DNA, 22 bp, Homo sapiens
gctccaggagctcacagctcgc

SEQ ID NO: 9183443 - DNA, 22 bp, Homo sapiens
gctcctggctccaggcagccaa

SEQ ID NO: 9183444 - DNA, 22 bp, Homo sapiens
gctcctggctccaggcagccaa

SEQ ID NO: 9183445 - DNA, 22 bp, Homo sapiens
gctcctggctccaggcagccaa

SEQ ID NO: 9183446 - DNA, 22 bp, Homo sapiens
gctcctggctctctgagggctg

SEQ ID NO: 9183447 - DNA, 22 bp, Homo sapiens
gctcctggccagcacagggccc

SEQ ID NO: 9183448 - DNA, 22 bp, Homo sapiens
gctcctggccagcacagggccc

SEQ ID NO: 9183449 - DNA, 22 bp, Homo sapiens
gctcctggccagcacagggccc

SEQ ID NO: 9183450 - DNA, 22 bp, Homo sapiens
gctcctggctccaggcagccaa

SEQ ID NO: 9183451 - DNA, 22 bp, Homo sapiens
gctctctttaaactgcatggct

SEQ ID NO: 9183452 - DNA, 22 bp, Homo sapiens
gctcctgggtgtggctgcccct

SEQ ID NO: 9183453 - DNA, 19 bp, Homo sapiens
gctcctgggcctcactcat

SEQ ID NO: 9183454 - DNA, 22 bp, Homo sapiens
gctcctgggctctaccttgcta

SEQ ID NO: 9183455 - DNA, 22 bp, Homo sapiens
gctcctgggtgtggctgcccct

SEQ ID NO: 9183456 - DNA, 22 bp, Homo sapiens
gctctctttccatgtggaggat

SEQ ID NO: 9183457 - DNA, 22 bp, Homo sapiens
gctctctttcacagaggtagga

SEQ ID NO: 9183458 - DNA, 22 bp, Homo sapiens
gctctctttttccagtggtggt

SEQ ID NO: 9183459 - DNA, 22 bp, Homo sapiens
gctctgagcactgtgcggctgg

SEQ ID NO: 9183460 - DNA, 19 bp, Homo sapiens
gctcctgggcctcactcat

SEQ ID NO: 9183461 - DNA, 22 bp, Homo sapiens
gctcctggctctggccaaggga

SEQ ID NO: 9183462 - DNA, 22 bp, Homo sapiens
gctcctggctctggccaaggga

SEQ ID NO: 9183463 - DNA, 22 bp, Homo sapiens
gctcctggctctggccaaggga

SEQ ID NO: 9183464 - DNA, 22 bp, Homo sapiens
gctcctggctctctgagggctg

SEQ ID NO: 9183465 - DNA, 18 bp, Homo sapiens
gctctgcagctgaggctt

SEQ ID NO: 9183466 - DNA, 22 bp, Homo sapiens
gctctgagtaaatgaaagcatt

SEQ ID NO: 9183467 - DNA, 22 bp, Homo sapiens
gctctgagccgggggcctgtcc

SEQ ID NO: 9183468 - DNA, 22 bp, Homo sapiens
gctcttgaggaagtgcagggca

SEQ ID NO: 9183469 - DNA, 22 bp, Homo sapiens
gctcttgatacatcaagaactt

SEQ ID NO: 9183470 - DNA, 22 bp, Homo sapiens
gctcttgactcccagttctgtg

SEQ ID NO: 9183471 - DNA, 22 bp, Homo sapiens
gctcttgaccttggagaactcg

SEQ ID NO: 9183472 - DNA, 22 bp, Homo sapiens
gctcttgaagtactgggtgttg

SEQ ID NO: 9183473 - DNA, 21 bp, Homo sapiens
gctcttgaataagcataataa

SEQ ID NO: 9183474 - DNA, 22 bp, Homo sapiens
gctcttgaatatgggtttcatg

SEQ ID NO: 9183475 - DNA, 22 bp, Homo sapiens
gctcttgacagctacatctggc

SEQ ID NO: 9183476 - DNA, 22 bp, Homo sapiens
gctcttgatttccaggagctag

SEQ ID NO: 9183477 - DNA, 22 bp, Homo sapiens
gctcttgatgttcattgacttg

SEQ ID NO: 9183478 - DNA, 22 bp, Homo sapiens
gctgaaatgccttgtaaatatt

SEQ ID NO: 9183479 - DNA, 22 bp, Homo sapiens
gctgaaatgggcactgaaggcc

SEQ ID NO: 9183480 - DNA, 22 bp, Homo sapiens
gctgaaatgccttgtaaatatt

SEQ ID NO: 9183481 - DNA, 22 bp, Homo sapiens
gctgaaatgggcactgaaggcc

SEQ ID NO: 9183482 - DNA, 22 bp, Homo sapiens
gctgaaatgccttgtaaatatt

SEQ ID NO: 9183483 - DNA, 18 bp, Homo sapiens
gctgaaattctaaacaaa

SEQ ID NO: 9183484 - DNA, 22 bp, Homo sapiens
gctgaaattcagattcctaggc

SEQ ID NO: 9183485 - DNA, 18 bp, Homo sapiens
gctgaaattctaaacaaa

SEQ ID NO: 9183486 - DNA, 22 bp, Homo sapiens
gctgaaattggaacctgggcct

SEQ ID NO: 9183487 - DNA, 22 bp, Homo sapiens
gctgaaattcagattcctaggc

SEQ ID NO: 9183488 - DNA, 22 bp, Homo sapiens
gctgaaattagactgcagaagt

SEQ ID NO: 9183489 - DNA, 22 bp, Homo sapiens
gctgaaattagactgcagaagt

SEQ ID NO: 9183490 - DNA, 22 bp, Homo sapiens
gctgaaatgtttaatttgggag

SEQ ID NO: 9183491 - DNA, 22 bp, Homo sapiens
gctgaaatgtctttagcagtgt

SEQ ID NO: 9183492 - DNA, 22 bp, Homo sapiens
gctgaaatgtctttagcagtgt

SEQ ID NO: 9183493 - DNA, 22 bp, Homo sapiens
gctgagattacgggcatgagcc

SEQ ID NO: 9183494 - DNA, 22 bp, Homo sapiens
gctgagagtgtgagatcagatt

SEQ ID NO: 9183495 - DNA, 22 bp, Homo sapiens
gctctgtgttgtcagaggcacc

SEQ ID NO: 9183496 - DNA, 22 bp, Homo sapiens
gctcttcagacaacgactccat

SEQ ID NO: 9183497 - DNA, 22 bp, Homo sapiens
gctcttctaaagaatgtacagg

SEQ ID NO: 9183498 - DNA, 22 bp, Homo sapiens
gctcttcagacaacgactccat

SEQ ID NO: 9183499 - DNA, 22 bp, Homo sapiens
gctcttgaaataatggctaatg

SEQ ID NO: 9183500 - DNA, 22 bp, Homo sapiens
gctcttgaaaatcaaaagggaa

SEQ ID NO: 9183501 - DNA, 22 bp, Homo sapiens
gctcttgaaactggggtttcca

SEQ ID NO: 9183502 - DNA, 22 bp, Homo sapiens
gctcttctaaagaatgtacagg

SEQ ID NO: 9183503 - DNA, 22 bp, Homo sapiens
gctctgtgtccacagctggaaa

SEQ ID NO: 9183504 - DNA, 20 bp, Homo sapiens
gctctgccacttagaagctg

SEQ ID NO: 9183505 - DNA, 20 bp, Homo sapiens
gctctgccacttagaagctg

SEQ ID NO: 9183506 - DNA, 22 bp, Homo sapiens
gccaggctctcagtgactgccc

SEQ ID NO: 9183507 - DNA, 19 bp, Homo sapiens
gccaggctcttattctgtg

SEQ ID NO: 9183508 - DNA, 22 bp, Homo sapiens
gccaggctcttggttatgtttt

SEQ ID NO: 9183509 - DNA, 22 bp, Homo sapiens
gccaggctcttccatttgggtc

SEQ ID NO: 9183510 - DNA, 22 bp, Homo sapiens
gccaggctcttggttatgtttt

SEQ ID NO: 9183511 - DNA, 22 bp, Homo sapiens
gccaggctgactcccccggcct

SEQ ID NO: 9183512 - DNA, 22 bp, Homo sapiens
gccaggctcttggttatgtttt

SEQ ID NO: 9183513 - DNA, 22 bp, Homo sapiens
gccaggctgactcccccggcct

SEQ ID NO: 9183514 - DNA, 22 bp, Homo sapiens
gccaggctgaggctctggaaga

SEQ ID NO: 9183515 - DNA, 22 bp, Homo sapiens
gccaggctgctccagggaggcc

SEQ ID NO: 9183516 - DNA, 22 bp, Homo sapiens
gccaggctgccttatctctagc

SEQ ID NO: 9183517 - DNA, 22 bp, Homo sapiens
gccaggctgctggctgctgtcc

SEQ ID NO: 9183518 - DNA, 22 bp, Homo sapiens
gccaggctgctggctgctgtcc

SEQ ID NO: 9183519 - DNA, 22 bp, Homo sapiens
gccaggctgctggctgctgtcc

SEQ ID NO: 9183520 - DNA, 22 bp, Homo sapiens
gccaggctggtgtcacaactct

SEQ ID NO: 9183521 - DNA, 22 bp, Homo sapiens
gccaggctggtgtcacaactct

SEQ ID NO: 9183522 - DNA, 22 bp, Homo sapiens
gccaggctggttatttaatgag

SEQ ID NO: 9183523 - DNA, 22 bp, Homo sapiens
gccaggctggttatttaatgag

SEQ ID NO: 9183524 - DNA, 22 bp, Homo sapiens
gccaggctgtggggaacttgaa

SEQ ID NO: 9183525 - DNA, 22 bp, Homo sapiens
gccaggctgtggggaacttgaa

SEQ ID NO: 9183526 - DNA, 22 bp, Homo sapiens
gccaggctgtttttattactgt

SEQ ID NO: 9183527 - DNA, 22 bp, Homo sapiens
gccaggctgtttttattactgt

SEQ ID NO: 9183528 - DNA, 22 bp, Homo sapiens
gccagtgggacccgctgtgggc

SEQ ID NO: 9183529 - DNA, 22 bp, Homo sapiens
gccagtgggtagttggagctgg

SEQ ID NO: 9183530 - DNA, 22 bp, Homo sapiens
gccagtggtcactgaggaagaa

SEQ ID NO: 9183531 - DNA, 22 bp, Homo sapiens
gccagttacccacaactactga

SEQ ID NO: 9183532 - DNA, 22 bp, Homo sapiens
gccagtttccacctaggcaatt

SEQ ID NO: 9183533 - DNA, 22 bp, Homo sapiens
gccataaattgctggtcaaaat

SEQ ID NO: 9183534 - DNA, 22 bp, Homo sapiens
gccatcacatccaggctacctc

SEQ ID NO: 9183535 - DNA, 22 bp, Homo sapiens
gccataggcagcgtggccagca

SEQ ID NO: 9183536 - DNA, 22 bp, Homo sapiens
gccattcttaacagtcatcact

SEQ ID NO: 9183537 - DNA, 18 bp, Homo sapiens
gccattcttctaagtact

SEQ ID NO: 9183538 - DNA, 22 bp, Homo sapiens
gccattctaaattatgctgtgt

SEQ ID NO: 9183539 - DNA, 22 bp, Homo sapiens
gccattcattcagaattccaga

SEQ ID NO: 9183540 - DNA, 22 bp, Homo sapiens
gcccaggaggagaggctgcagt

SEQ ID NO: 9183541 - DNA, 22 bp, Homo sapiens
gcccaggaggagaggctgcagt

SEQ ID NO: 9183542 - DNA, 22 bp, Homo sapiens
gccatttaggaggtggaaagga

SEQ ID NO: 9183543 - DNA, 22 bp, Homo sapiens
gcccaggaggcagaggttgtgg

SEQ ID NO: 9183544 - DNA, 22 bp, Homo sapiens
gcccaggagttggaggctgcag

SEQ ID NO: 9183545 - DNA, 22 bp, Homo sapiens
gcccaggagttgaatgcagcag

SEQ ID NO: 9183546 - DNA, 22 bp, Homo sapiens
gccatgggcaaatgcagagctg

SEQ ID NO: 9183547 - DNA, 23 bp, Homo sapiens
gccatggctgccccacaggcctc

SEQ ID NO: 9183548 - DNA, 22 bp, Homo sapiens
gccatgtcctgggcatctgcca

SEQ ID NO: 9183549 - DNA, 22 bp, Homo sapiens
gcccaggctggagtgcagtggc

SEQ ID NO: 9183550 - DNA, 22 bp, Homo sapiens
gcccaggctagcgtagagtgca

SEQ ID NO: 9183551 - DNA, 22 bp, Homo sapiens
gcccaggctggagtgcagtagc

SEQ ID NO: 9183552 - DNA, 22 bp, Homo sapiens
gcccaggctggagtgcagtagc

SEQ ID NO: 9183553 - DNA, 22 bp, Homo sapiens
gcccaggctggagtgcagtagc

SEQ ID NO: 9183554 - DNA, 22 bp, Homo sapiens
gcccaggatggctggaggtgct

SEQ ID NO: 9183555 - DNA, 22 bp, Homo sapiens
gcccaggatggctggaggtgct

SEQ ID NO: 9183556 - DNA, 22 bp, Homo sapiens
gcccaggatggctggaggtgct

SEQ ID NO: 9183557 - DNA, 22 bp, Homo sapiens
gcccaggctagcgtagagtgca

SEQ ID NO: 9183558 - DNA, 22 bp, Homo sapiens
gcccaggagttggaggctgcag

SEQ ID NO: 9183559 - DNA, 22 bp, Homo sapiens
gcccaggagttggtggctgcag

SEQ ID NO: 9183560 - DNA, 20 bp, Homo sapiens
gcccaggatctctgaggcat

SEQ ID NO: 9183561 - DNA, 20 bp, Homo sapiens
gcccaggatctctgaggcat

SEQ ID NO: 9183562 - DNA, 22 bp, Homo sapiens
gccgccgctgtgcaatttagca

SEQ ID NO: 9183563 - DNA, 22 bp, Homo sapiens
gccgccatatcatctgcctctt

SEQ ID NO: 9183564 - DNA, 22 bp, Homo sapiens
gccgaggctctgcccagctgct

SEQ ID NO: 9183565 - DNA, 22 bp, Homo sapiens
gccgagcacagtgcagctgcct

SEQ ID NO: 9183566 - DNA, 22 bp, Homo sapiens
gccggaagatgaagtttggtca

SEQ ID NO: 9183567 - DNA, 22 bp, Homo sapiens
gccggggctggggagagacatg

SEQ ID NO: 9183568 - DNA, 19 bp, Homo sapiens
gccgggggcgccccgctct

SEQ ID NO: 9183569 - DNA, 22 bp, Homo sapiens
gccggggctggggagagacatg

SEQ ID NO: 9183570 - DNA, 22 bp, Homo sapiens
gccggggctggggagagacatg

SEQ ID NO: 9183571 - DNA, 22 bp, Homo sapiens
gccggggctggggagagacatg

SEQ ID NO: 9183572 - DNA, 22 bp, Homo sapiens
gccggggctggggagagacatg

SEQ ID NO: 9183573 - DNA, 22 bp, Homo sapiens
gccgtggcttctccagctggct

SEQ ID NO: 9183574 - DNA, 22 bp, Homo sapiens
gccgtggcttctccagctggct

SEQ ID NO: 9183575 - DNA, 22 bp, Homo sapiens
gcctcctgtcccaggctgagga

SEQ ID NO: 9183576 - DNA, 22 bp, Homo sapiens
gcctcctgtcccaggctgagga

SEQ ID NO: 9183577 - DNA, 22 bp, Homo sapiens
gcctctgcatcatcactccagc

SEQ ID NO: 9183578 - DNA, 22 bp, Homo sapiens
gcctctgcatcatcactccagc

SEQ ID NO: 9183579 - DNA, 22 bp, Homo sapiens
gcctctgcatgctcagcaccca

SEQ ID NO: 9183580 - DNA, 22 bp, Homo sapiens
gcctctgccaagggggctgcgg

SEQ ID NO: 9183581 - DNA, 22 bp, Homo sapiens
gcctctgccaagggggctgcgg

SEQ ID NO: 9183582 - DNA, 22 bp, Homo sapiens
gcctctgcaactccgccttggt

SEQ ID NO: 9183583 - DNA, 22 bp, Homo sapiens
gcctctgcaccagtactgtgcc

SEQ ID NO: 9183584 - DNA, 22 bp, Homo sapiens
gcctctgcactgtggcacacca

SEQ ID NO: 9183585 - DNA, 22 bp, Homo sapiens
gcctctgcactgtggcacacca

SEQ ID NO: 9183586 - DNA, 22 bp, Homo sapiens
gcctctgcatcatcactccagc

SEQ ID NO: 9183587 - DNA, 22 bp, Homo sapiens
gcctctgcaggtgcggttatcc

SEQ ID NO: 9183588 - DNA, 22 bp, Homo sapiens
gcctctgctgacaagatggaca

SEQ ID NO: 9183589 - DNA, 21 bp, Homo sapiens
gcctctgctgtcttattgtga

SEQ ID NO: 9183590 - DNA, 19 bp, Homo sapiens
gcctctgctggggacaggc

SEQ ID NO: 9183591 - DNA, 22 bp, Homo sapiens
gcctctgcggggcccgagcccg

SEQ ID NO: 9183592 - DNA, 22 bp, Homo sapiens
gcctctgcggggcccgagcccg

SEQ ID NO: 9183593 - DNA, 22 bp, Homo sapiens
gcctctgcggagctgtacatca

SEQ ID NO: 9183594 - DNA, 22 bp, Homo sapiens
gcctctgcgcctcagccgacct

SEQ ID NO: 9183595 - DNA, 22 bp, Homo sapiens
gcctctgccctcctgggactgc

SEQ ID NO: 9183596 - DNA, 22 bp, Homo sapiens
gcctctgcccatccaccatcag

SEQ ID NO: 9183597 - DNA, 22 bp, Homo sapiens
gccctcctttgcttctcctagt

SEQ ID NO: 9183598 - DNA, 22 bp, Homo sapiens
gccctctcttctgcagcctcca

SEQ ID NO: 9183599 - DNA, 22 bp, Homo sapiens
gccctcagctcctggacacatg

SEQ ID NO: 9183600 - DNA, 22 bp, Homo sapiens
gccctcagagttccccacagtg

SEQ ID NO: 9183601 - DNA, 22 bp, Homo sapiens
gcccaggctggagtgcagtggc

SEQ ID NO: 9183602 - DNA, 22 bp, Homo sapiens
gcccaggctggagtgcagtggc

SEQ ID NO: 9183603 - DNA, 22 bp, Homo sapiens
gcccaggctggagtgcagtggt

SEQ ID NO: 9183604 - DNA, 22 bp, Homo sapiens
gcccttccttagacagcaggat

SEQ ID NO: 9183605 - DNA, 22 bp, Homo sapiens
gcccttcacgatggtatcttag

SEQ ID NO: 9183606 - DNA, 22 bp, Homo sapiens
gcccttataaacaaggcttcag

SEQ ID NO: 9183607 - DNA, 22 bp, Homo sapiens
gcccttagggccactgtcactg

SEQ ID NO: 9183608 - DNA, 22 bp, Homo sapiens
gcccttagtcagcactttcact

SEQ ID NO: 9183609 - DNA, 22 bp, Homo sapiens
gcccttcatttatagttggaat

SEQ ID NO: 9183610 - DNA, 22 bp, Homo sapiens
gcccttccaacccagagggcaa

SEQ ID NO: 9183611 - DNA, 22 bp, Homo sapiens
gcccttcagttactccttgatg

SEQ ID NO: 9183612 - DNA, 22 bp, Homo sapiens
gcccttggaagcggcaggtagc

SEQ ID NO: 9183613 - DNA, 16 bp, Homo sapiens
gccctttccttggctg

SEQ ID NO: 9183614 - DNA, 22 bp, Homo sapiens
gccctttcttcttctggactgg

SEQ ID NO: 9183615 - DNA, 22 bp, Homo sapiens
gccctttattagagctgccatt

SEQ ID NO: 9183616 - DNA, 22 bp, Homo sapiens
gcccttggaaagccaaggcagc

SEQ ID NO: 9183617 - DNA, 22 bp, Homo sapiens
gcccttggaacagcctcctgct

SEQ ID NO: 9183618 - DNA, 22 bp, Homo sapiens
gcccttggaagcggcaggtagc

SEQ ID NO: 9183619 - DNA, 22 bp, Homo sapiens
gcccttgggaggttccactggg

SEQ ID NO: 9183620 - DNA, 22 bp, Homo sapiens
gcccttgggaggttccactggg

SEQ ID NO: 9183621 - DNA, 22 bp, Homo sapiens
gccctctggcacagagatgcag

SEQ ID NO: 9183622 - DNA, 22 bp, Homo sapiens
gccctctggcacagagatgcag

SEQ ID NO: 9183623 - DNA, 22 bp, Homo sapiens
gcccttagccttatagcctcta

SEQ ID NO: 9183624 - DNA, 22 bp, Homo sapiens
gccctctgccacaggacgccag

SEQ ID NO: 9183625 - DNA, 20 bp, Homo sapiens
gccctctgcctccctcagcg

SEQ ID NO: 9183626 - DNA, 22 bp, Homo sapiens
gccctctgcacagctctgagca

SEQ ID NO: 9183627 - DNA, 22 bp, Homo sapiens
gccctctgatgctcaccgagga

SEQ ID NO: 9183628 - DNA, 23 bp, Homo sapiens
gcctgccatatacctggaaacag

SEQ ID NO: 9183629 - DNA, 22 bp, Homo sapiens
gcctgccagtgtttgaggattg

SEQ ID NO: 9183630 - DNA, 19 bp, Homo sapiens
gcctgccagcctgaatctg

SEQ ID NO: 9183631 - DNA, 22 bp, Homo sapiens
gcctgccagccacagtggcagc

SEQ ID NO: 9183632 - DNA, 23 bp, Homo sapiens
gcctctggagccccagtgctcag

SEQ ID NO: 9183633 - DNA, 17 bp, Homo sapiens
gcctctgcttgtgtcat

SEQ ID NO: 9183634 - DNA, 22 bp, Homo sapiens
gcctgcctgaaggctgtaccag

SEQ ID NO: 9183635 - DNA, 22 bp, Homo sapiens
gcctgcctgaaggctgtaccag

SEQ ID NO: 9183636 - DNA, 22 bp, Homo sapiens
gcctgcctcaaaatcccagttc

SEQ ID NO: 9183637 - DNA, 23 bp, Homo sapiens
gcctgcctgacctgtgcaaagtc

SEQ ID NO: 9183638 - DNA, 22 bp, Homo sapiens
gcctgcctgctgtcatctgcct

SEQ ID NO: 9183639 - DNA, 22 bp, Homo sapiens
gcctgcctggagcttgaggtga

SEQ ID NO: 9183640 - DNA, 22 bp, Homo sapiens
gcctgcctgttggctgaggtgc

SEQ ID NO: 9183641 - DNA, 22 bp, Homo sapiens
gcctgccttcggtgcgcagcgg

SEQ ID NO: 9183642 - DNA, 22 bp, Homo sapiens
gcctgcctttgtatgaccctga

SEQ ID NO: 9183643 - DNA, 22 bp, Homo sapiens
gcctgccttcggtgcgcagcgg

SEQ ID NO: 9183644 - DNA, 22 bp, Homo sapiens
gcctgctctccggatccctgat

SEQ ID NO: 9183645 - DNA, 22 bp, Homo sapiens
gcctgctcccagttggcgcctc

SEQ ID NO: 9183646 - DNA, 22 bp, Homo sapiens
gcctgctcccagttggcgcctc

SEQ ID NO: 9183647 - DNA, 22 bp, Homo sapiens
gcctgctcagacctagcaggcc

SEQ ID NO: 9183648 - DNA, 22 bp, Homo sapiens
gcctgctcagacctagcaggcc

SEQ ID NO: 9183649 - DNA, 22 bp, Homo sapiens
gcctgctcagacctagcaggcc

SEQ ID NO: 9183650 - DNA, 22 bp, Homo sapiens
gcctgctctgacatccatccca

SEQ ID NO: 9183651 - DNA, 22 bp, Homo sapiens
gcctgctgggagacacccccag

SEQ ID NO: 9183652 - DNA, 23 bp, Homo sapiens
gcctgctgtcacagcgggcccag

SEQ ID NO: 9183653 - DNA, 23 bp, Homo sapiens
gcctgctgtcacagcgggcccag

SEQ ID NO: 9183654 - DNA, 23 bp, Homo sapiens
gcctgctggtcacctaatctgcc

SEQ ID NO: 9183655 - DNA, 22 bp, Homo sapiens
gcctgccttttggaggcacatt

SEQ ID NO: 9183656 - DNA, 22 bp, Homo sapiens
gcctgccttttggaggcacatt

SEQ ID NO: 9183657 - DNA, 22 bp, Homo sapiens
gcctgctgttaactgcaggaat

SEQ ID NO: 9183658 - DNA, 21 bp, Homo sapiens
gcctgctgttcaccctgccac

SEQ ID NO: 9183659 - DNA, 22 bp, Homo sapiens
gcctgctgtcctgattcccatg

SEQ ID NO: 9183660 - DNA, 22 bp, Homo sapiens
gcctgctgtcctgattcccatg

SEQ ID NO: 9183661 - DNA, 22 bp, Homo sapiens
gcctgctgttaactgcaggaat

SEQ ID NO: 9183662 - DNA, 22 bp, Homo sapiens
gcctgctgttgagggaagagct

SEQ ID NO: 9183663 - DNA, 21 bp, Homo sapiens
gcctgctgttcaccctgccac

SEQ ID NO: 9183664 - DNA, 21 bp, Homo sapiens
gcctgctgttcaccctgccac

SEQ ID NO: 9183665 - DNA, 21 bp, Homo sapiens
gcctgctgttcaccctgccac

SEQ ID NO: 9183666 - DNA, 22 bp, Homo sapiens
gcctgctgttgagggaagagct

SEQ ID NO: 9183667 - DNA, 22 bp, Homo sapiens
gcctggaggggccagggtggta

SEQ ID NO: 9183668 - DNA, 22 bp, Homo sapiens
gcctggaggggccagggtggta

SEQ ID NO: 9183669 - DNA, 22 bp, Homo sapiens
gcctggagggtccctctctgga

SEQ ID NO: 9183670 - DNA, 22 bp, Homo sapiens
gcctggaggggacagtctctgg

SEQ ID NO: 9183671 - DNA, 22 bp, Homo sapiens
gcctggagggctctagagaggc

SEQ ID NO: 9183672 - DNA, 22 bp, Homo sapiens
gcctggaggcgagaacccaatg

SEQ ID NO: 9183673 - DNA, 22 bp, Homo sapiens
gcctggagggatagaatgcaag

SEQ ID NO: 9183674 - DNA, 20 bp, Homo sapiens
gcctggaggcagagataaag

SEQ ID NO: 9183675 - DNA, 20 bp, Homo sapiens
gcctggaggcaatgggaaga

SEQ ID NO: 9183676 - DNA, 20 bp, Homo sapiens
gcctggaggcaatgggaaga

SEQ ID NO: 9183677 - DNA, 22 bp, Homo sapiens
gcctggagcctcagcaaggagg

SEQ ID NO: 9183678 - DNA, 22 bp, Homo sapiens
gcctggagcctcagcaaggagg

SEQ ID NO: 9183679 - DNA, 22 bp, Homo sapiens
gcctggacaccgcccttgcaga

SEQ ID NO: 9183680 - DNA, 21 bp, Homo sapiens
gcctgggaaatctgggaagcc

SEQ ID NO: 9183681 - DNA, 22 bp, Homo sapiens
gcctgggaaagagtagggaaat

SEQ ID NO: 9183682 - DNA, 22 bp, Homo sapiens
gcctggcttttgcctcatgttc

SEQ ID NO: 9183683 - DNA, 22 bp, Homo sapiens
gcctggcttttgcctcatgttc

SEQ ID NO: 9183684 - DNA, 22 bp, Homo sapiens
gcctggcttttgcctcatgttc

SEQ ID NO: 9183685 - DNA, 22 bp, Homo sapiens
gcctggcttttgcctcatgttc

SEQ ID NO: 9183686 - DNA, 22 bp, Homo sapiens
gcctggcctgaactaggaggtg

SEQ ID NO: 9183687 - DNA, 22 bp, Homo sapiens
gcctggccgctccgagctccgc

SEQ ID NO: 9183688 - DNA, 17 bp, Homo sapiens
gcctggcccagcctggc

SEQ ID NO: 9183689 - DNA, 23 bp, Homo sapiens
gcctggccaccccagggctgctt

SEQ ID NO: 9183690 - DNA, 17 bp, Homo sapiens
gcctggcccagcctggc

SEQ ID NO: 9183691 - DNA, 23 bp, Homo sapiens
gcctggccaccccagggctgctt

SEQ ID NO: 9183692 - DNA, 23 bp, Homo sapiens
gcctggccaccccagggctgctt

SEQ ID NO: 9183693 - DNA, 22 bp, Homo sapiens
gcctggccgctccgagctccgc

SEQ ID NO: 9183694 - DNA, 22 bp, Homo sapiens
gcctggcccagggctcttgttg

SEQ ID NO: 9183695 - DNA, 22 bp, Homo sapiens
gcctggcccagggctccgcagg

SEQ ID NO: 9183696 - DNA, 21 bp, Homo sapiens
gcctggcaggtggaagggctc

SEQ ID NO: 9183697 - DNA, 22 bp, Homo sapiens
gcctggagtagcatggcaagcc

SEQ ID NO: 9183698 - DNA, 22 bp, Homo sapiens
gcctggagggttgaggttttgt

SEQ ID NO: 9183699 - DNA, 22 bp, Homo sapiens
gcctggagtactccttgaagtg

SEQ ID NO: 9183700 - DNA, 22 bp, Homo sapiens
gcctggagggttgaggttttgt

SEQ ID NO: 9183701 - DNA, 22 bp, Homo sapiens
gcctgggaagactaagtgggag

SEQ ID NO: 9183702 - DNA, 21 bp, Homo sapiens
gcctgggaagagaaaggtaag

SEQ ID NO: 9183703 - DNA, 22 bp, Homo sapiens
gcctgggacccttagctcttgg

SEQ ID NO: 9183704 - DNA, 23 bp, Homo sapiens
gcctgggactcaggaggagctca

SEQ ID NO: 9183705 - DNA, 23 bp, Homo sapiens
gcctgggactggtagtgtgacct

SEQ ID NO: 9183706 - DNA, 22 bp, Homo sapiens
gcctgggattctcaaaggggtg

SEQ ID NO: 9183707 - DNA, 22 bp, Homo sapiens
gcctgggattcccagaggggca

SEQ ID NO: 9183708 - DNA, 19 bp, Homo sapiens
gcctgggatgggcagaact

SEQ ID NO: 9183709 - DNA, 22 bp, Homo sapiens
gcctgggatagaggcaatgcat

SEQ ID NO: 9183710 - DNA, 21 bp, Homo sapiens
gcctgggatagtggcctccgg

SEQ ID NO: 9183711 - DNA, 22 bp, Homo sapiens
gcctgtggttgctttgggatcc

SEQ ID NO: 9183712 - DNA, 22 bp, Homo sapiens
gcctgtggttgctttgggatcc

SEQ ID NO: 9183713 - DNA, 22 bp, Homo sapiens
gcctgtggtttgattaagcatt

SEQ ID NO: 9183714 - DNA, 22 bp, Homo sapiens
gcctgtgggttggagcttggcc

SEQ ID NO: 9183715 - DNA, 22 bp, Homo sapiens
gcctgtgggttggagcttggcc

SEQ ID NO: 9183716 - DNA, 22 bp, Homo sapiens
gcctgtgtccttcccagtgggg

SEQ ID NO: 9183717 - DNA, 22 bp, Homo sapiens
gcctgtggccactgcgtctgca

SEQ ID NO: 9183718 - DNA, 22 bp, Homo sapiens
gcctgtggcccaactgtctgtc

SEQ ID NO: 9183719 - DNA, 22 bp, Homo sapiens
gcctgtggccactgcgtctgca

SEQ ID NO: 9183720 - DNA, 21 bp, Homo sapiens
gcctgtggagcccaagggccc

SEQ ID NO: 9183721 - DNA, 22 bp, Homo sapiens
gcctgtggccgactgagagcct

SEQ ID NO: 9183722 - DNA, 22 bp, Homo sapiens
gcctgtggcccaactgtctgtc

SEQ ID NO: 9183723 - DNA, 19 bp, Homo sapiens
gcctgtggcttgatgttgg

SEQ ID NO: 9183724 - DNA, 22 bp, Homo sapiens
gcctgtggggctgaggctgcct

SEQ ID NO: 9183725 - DNA, 22 bp, Homo sapiens
gcctgtggggctgaggctgcct

SEQ ID NO: 9183726 - DNA, 19 bp, Homo sapiens
gcctgtggcttgatgttgg

SEQ ID NO: 9183727 - DNA, 22 bp, Homo sapiens
gcctggtgtccagaggcgagtg

SEQ ID NO: 9183728 - DNA, 22 bp, Homo sapiens
gcctgggattgtgtaagtgaat

SEQ ID NO: 9183729 - DNA, 21 bp, Homo sapiens
gagtgggacatgggagtggtt

SEQ ID NO: 9183730 - DNA, 22 bp, Homo sapiens
gagtggcttttttatggtaatg

SEQ ID NO: 9183731 - DNA, 21 bp, Homo sapiens
gagtgggacatgggagtggtt

SEQ ID NO: 9183732 - DNA, 22 bp, Homo sapiens
gagtggggctttaaaggctcag

SEQ ID NO: 9183733 - DNA, 22 bp, Homo sapiens
gagtgggcaccgtgggcacact

SEQ ID NO: 9183734 - DNA, 22 bp, Homo sapiens
gagtggggctttaaaggctcag

SEQ ID NO: 9183735 - DNA, 22 bp, Homo sapiens
gagtggctgtgtacatgcccag

SEQ ID NO: 9183736 - DNA, 22 bp, Homo sapiens
gagtggagcaaaagaggtagat

SEQ ID NO: 9183737 - DNA, 22 bp, Homo sapiens
gagtggagcaaaagaggtagat

SEQ ID NO: 9183738 - DNA, 22 bp, Homo sapiens
gagtggagatcgtgccactgca

SEQ ID NO: 9183739 - DNA, 21 bp, Homo sapiens
gagtggaacgctcttcacacc

SEQ ID NO: 9183740 - DNA, 22 bp, Homo sapiens
gagtgcttgcatatttattgtc

SEQ ID NO: 9183741 - DNA, 22 bp, Homo sapiens
gagtgcagttggggtgagggga

SEQ ID NO: 9183742 - DNA, 22 bp, Homo sapiens
gagtgcagtatgagaggctgct

SEQ ID NO: 9183743 - DNA, 23 bp, Homo sapiens
gagtgcagaatagacatgcagtg

SEQ ID NO: 9183744 - DNA, 22 bp, Homo sapiens
gagtgcagtatgagaggctgct

SEQ ID NO: 9183745 - DNA, 22 bp, Homo sapiens
gagtgcagtatgagaggctgct

SEQ ID NO: 9183746 - DNA, 17 bp, Homo sapiens
gagtgctggtggagctc

SEQ ID NO: 9183747 - DNA, 22 bp, Homo sapiens
gagtgctggaggtgtgagtggg

SEQ ID NO: 9183748 - DNA, 22 bp, Homo sapiens
gagtgcaagttcttccttcttc

SEQ ID NO: 9183749 - DNA, 22 bp, Homo sapiens
gagtgatttaagctatttttaa

SEQ ID NO: 9183750 - DNA, 22 bp, Homo sapiens
gagtgcaataaactgttttcta

SEQ ID NO: 9183751 - DNA, 22 bp, Homo sapiens
gagtgcaatggcatgatctggg

SEQ ID NO: 9183752 - DNA, 22 bp, Homo sapiens
gagtgcagaaattcccttcctg

SEQ ID NO: 9183753 - DNA, 22 bp, Homo sapiens
gagtgagtggccaggaggcaga

SEQ ID NO: 9183754 - DNA, 22 bp, Homo sapiens
gagtgagggcagcaggggctgc

SEQ ID NO: 9183755 - DNA, 22 bp, Homo sapiens
gagtgagggcagcaggggctgc

SEQ ID NO: 9183756 - DNA, 22 bp, Homo sapiens
gagtctgagagcctaatgacct

SEQ ID NO: 9183757 - DNA, 22 bp, Homo sapiens
gagtctggactattctggtctt

SEQ ID NO: 9183758 - DNA, 22 bp, Homo sapiens
gagtctggccctgatgcatcat

SEQ ID NO: 9183759 - DNA, 18 bp, Homo sapiens
gagtctttgttactgctg

SEQ ID NO: 9183760 - DNA, 22 bp, Homo sapiens
gagtctttggtaaagtctgctg

SEQ ID NO: 9183761 - DNA, 22 bp, Homo sapiens
gagtgaaaaaggaagggccata

SEQ ID NO: 9183762 - DNA, 17 bp, Homo sapiens
gagtctgtgttcatcag

SEQ ID NO: 9183763 - DNA, 22 bp, Homo sapiens
gagtcctgttgtcccagatggg

SEQ ID NO: 9183764 - DNA, 22 bp, Homo sapiens
gagtcctgttgtcccagatggg

SEQ ID NO: 9183765 - DNA, 22 bp, Homo sapiens
gagtcctgttgtcccagatggg

SEQ ID NO: 9183766 - DNA, 19 bp, Homo sapiens
gagtcctgtgctccttgtt

SEQ ID NO: 9183767 - DNA, 22 bp, Homo sapiens
gagtcctgttttgaggacttga

SEQ ID NO: 9183768 - DNA, 21 bp, Homo sapiens
gagtccttccaatgtcctcag

SEQ ID NO: 9183769 - DNA, 22 bp, Homo sapiens
gagtcctgtaactttcttccta

SEQ ID NO: 9183770 - DNA, 22 bp, Homo sapiens
gagtcctgggtcacggcctctt

SEQ ID NO: 9183771 - DNA, 21 bp, Homo sapiens
gagtcctggctagggtggcag

SEQ ID NO: 9183772 - DNA, 22 bp, Homo sapiens
gagtcctggcgtccaatttcct

SEQ ID NO: 9183773 - DNA, 22 bp, Homo sapiens
gagtcctggagaaacgcaggtg

SEQ ID NO: 9183774 - DNA, 22 bp, Homo sapiens
gagtcctggagagcccgagcgc

SEQ ID NO: 9183775 - DNA, 22 bp, Homo sapiens
gagtcctggcgtccaatttcct

SEQ ID NO: 9183776 - DNA, 22 bp, Homo sapiens
gagtcctggaaccctgaatgct

SEQ ID NO: 9183777 - DNA, 22 bp, Homo sapiens
gagtcctgctttcaattctttt

SEQ ID NO: 9183778 - DNA, 22 bp, Homo sapiens
gagtcctgctttcaattctttt

SEQ ID NO: 9183779 - DNA, 22 bp, Homo sapiens
gagtcctgcccttgtgtagtcc

SEQ ID NO: 9183780 - DNA, 22 bp, Homo sapiens
gagtcctgaatcctgtggcaac

SEQ ID NO: 9183781 - DNA, 22 bp, Homo sapiens
gagtcctgatccttagctctcc

SEQ ID NO: 9183782 - DNA, 22 bp, Homo sapiens
gagtcctgatccttagctctcc

SEQ ID NO: 9183783 - DNA, 22 bp, Homo sapiens
gagtcggaggcaggagacctgg

SEQ ID NO: 9183784 - DNA, 22 bp, Homo sapiens
gagtcgagcagaaagccgtcgg

SEQ ID NO: 9183785 - DNA, 22 bp, Homo sapiens
gagtccttttctctgtccactg

SEQ ID NO: 9183786 - DNA, 22 bp, Homo sapiens
gagtccttttgtgccacaggga

SEQ ID NO: 9183787 - DNA, 22 bp, Homo sapiens
gagtccttctggctggcaggat

SEQ ID NO: 9183788 - DNA, 22 bp, Homo sapiens
gagtcctttgttccttgccaca

SEQ ID NO: 9183789 - DNA, 22 bp, Homo sapiens
gagttgactcctccagaggagt

SEQ ID NO: 9183790 - DNA, 22 bp, Homo sapiens
gagttgactacatagatgcaga

SEQ ID NO: 9183791 - DNA, 22 bp, Homo sapiens
gagttgacaggccaaggcccat

SEQ ID NO: 9183792 - DNA, 22 bp, Homo sapiens
gagttctgtgagccatcctagc

SEQ ID NO: 9183793 - DNA, 22 bp, Homo sapiens
gagttctgttacgtgtcaccaa

SEQ ID NO: 9183794 - DNA, 22 bp, Homo sapiens
gagttctgttccttgggagttt

SEQ ID NO: 9183795 - DNA, 19 bp, Homo sapiens
gagtttatctcctagccct

SEQ ID NO: 9183796 - DNA, 22 bp, Homo sapiens
gagtttatgtctttcattgttc

SEQ ID NO: 9183797 - DNA, 22 bp, Homo sapiens
gagtttatgtctttcattgttc

SEQ ID NO: 9183798 - DNA, 22 bp, Homo sapiens
gagtttattcaggaaatagcca

SEQ ID NO: 9183799 - DNA, 22 bp, Homo sapiens
gagtttgatagagaggaaccgg

SEQ ID NO: 9183800 - DNA, 23 bp, Homo sapiens
gagtttcttccaggagccctggg

SEQ ID NO: 9183801 - DNA, 23 bp, Homo sapiens
gagtttcttccaggagccctggg

SEQ ID NO: 9183802 - DNA, 23 bp, Homo sapiens
gagtttcttccaggagccctggg

SEQ ID NO: 9183803 - DNA, 22 bp, Homo sapiens
gagtttctgattcagtctgtgt

SEQ ID NO: 9183804 - DNA, 22 bp, Homo sapiens
gagtttctccagtgctagttgt

SEQ ID NO: 9183805 - DNA, 22 bp, Homo sapiens
gagtttctaggatggaggtgag

SEQ ID NO: 9183806 - DNA, 22 bp, Homo sapiens
gagtttctgatttagtaggtct

SEQ ID NO: 9183807 - DNA, 22 bp, Homo sapiens
gagtttctgctctaggtctggt

SEQ ID NO: 9183808 - DNA, 22 bp, Homo sapiens
gagtttcttaacaggtggaagc

SEQ ID NO: 9183809 - DNA, 22 bp, Homo sapiens
gagtttctgattcagtctgtgt

SEQ ID NO: 9183810 - DNA, 22 bp, Homo sapiens
gagtttctgctctaggtctggt

SEQ ID NO: 9183811 - DNA, 22 bp, Homo sapiens
gagtttcttcatggtgcagagg

SEQ ID NO: 9183812 - DNA, 22 bp, Homo sapiens
gagtttcttaacaggtggaagc

SEQ ID NO: 9183813 - DNA, 22 bp, Homo sapiens
gagtttatttgactggattctc

SEQ ID NO: 9183814 - DNA, 22 bp, Homo sapiens
gagtttctaggatggaggtgag

SEQ ID NO: 9183815 - DNA, 22 bp, Homo sapiens
gagtttattgtcttccaggctt

SEQ ID NO: 9183816 - DNA, 22 bp, Homo sapiens
gagtttattcaggaaatagcca

SEQ ID NO: 9183817 - DNA, 22 bp, Homo sapiens
gataaatggctgaagaaatagt

SEQ ID NO: 9183818 - DNA, 22 bp, Homo sapiens
gataacatacttgcatgtgtat

SEQ ID NO: 9183819 - DNA, 22 bp, Homo sapiens
gataacaatatgaagtagatat

SEQ ID NO: 9183820 - DNA, 22 bp, Homo sapiens
gataaaatatgtggcctttagt

SEQ ID NO: 9183821 - DNA, 22 bp, Homo sapiens
gataaaataactatggaatact

SEQ ID NO: 9183822 - DNA, 22 bp, Homo sapiens
gataaaattcttattttacccg

SEQ ID NO: 9183823 - DNA, 22 bp, Homo sapiens
gataaacattcttgcacatgtg

SEQ ID NO: 9183824 - DNA, 22 bp, Homo sapiens
gagttctgaactgtgaaatgca

SEQ ID NO: 9183825 - DNA, 22 bp, Homo sapiens
gagttctggccggttcttggac

SEQ ID NO: 9183826 - DNA, 22 bp, Homo sapiens
gagttctcagtaaagttctttg

SEQ ID NO: 9183827 - DNA, 22 bp, Homo sapiens
gagttctgtgagccatcctagc

SEQ ID NO: 9183828 - DNA, 22 bp, Homo sapiens
gagttctgtagggtgaaatagt

SEQ ID NO: 9183829 - DNA, 22 bp, Homo sapiens
gagttaaaagccctctcagcag

SEQ ID NO: 9183830 - DNA, 22 bp, Homo sapiens
gagttaaagtacctttgtatgt

SEQ ID NO: 9183831 - DNA, 22 bp, Homo sapiens
gagttaaagtacctttgtatgt

SEQ ID NO: 9183832 - DNA, 22 bp, Homo sapiens
gagttaaaagccctctcagcag

SEQ ID NO: 9183833 - DNA, 22 bp, Homo sapiens
gagttaaaagccctctcagcag

SEQ ID NO: 9183834 - DNA, 22 bp, Homo sapiens
gagtgtggtgaacaggagcacc

SEQ ID NO: 9183835 - DNA, 22 bp, Homo sapiens
gagtgtgggcacgggggccttg

SEQ ID NO: 9183836 - DNA, 22 bp, Homo sapiens
gagtgtcagtgcttggggctac

SEQ ID NO: 9183837 - DNA, 22 bp, Homo sapiens
gagtgtcagtgcctggcttgtt

SEQ ID NO: 9183838 - DNA, 22 bp, Homo sapiens
gagtgtcagcagggcagagcac

SEQ ID NO: 9183839 - DNA, 22 bp, Homo sapiens
gagtgggtgacagaaggaggta

SEQ ID NO: 9183840 - DNA, 22 bp, Homo sapiens
gagtgggtgaatgtgctcataa

SEQ ID NO: 9183841 - DNA, 22 bp, Homo sapiens
gagtgggtgagagacttggcac

SEQ ID NO: 9183842 - DNA, 22 bp, Homo sapiens
gagtgggtccacagaggtgaca

SEQ ID NO: 9183843 - DNA, 22 bp, Homo sapiens
gagtgggtgacagaaggaggta

SEQ ID NO: 9183844 - DNA, 22 bp, Homo sapiens
gagtgtcacttgatgcagggca

SEQ ID NO: 9183845 - DNA, 22 bp, Homo sapiens
gagtgtcaaggctctctttggc

SEQ ID NO: 9183846 - DNA, 22 bp, Homo sapiens
gagtggggtctgggcatcagtc

SEQ ID NO: 9183847 - DNA, 22 bp, Homo sapiens
gagtggggggtccgtctcagtg

SEQ ID NO: 9183848 - DNA, 22 bp, Homo sapiens
gagtgggtaccggagcaggtgc

SEQ ID NO: 9183849 - DNA, 22 bp, Homo sapiens
gagtgggtaccggagcaggtgc

SEQ ID NO: 9183850 - DNA, 22 bp, Homo sapiens
gagtgggtccacagaggtgaca

SEQ ID NO: 9183851 - DNA, 22 bp, Homo sapiens
gagtgggtaccggagcaggtgc

SEQ ID NO: 9183852 - DNA, 22 bp, Homo sapiens
gagtggggtctgggcatcagtc

SEQ ID NO: 9183853 - DNA, 22 bp, Homo sapiens
gatgaaattgttttgatacttt

SEQ ID NO: 9183854 - DNA, 22 bp, Homo sapiens
gatgaaattcagaattgagggg

SEQ ID NO: 9183855 - DNA, 22 bp, Homo sapiens
gatgaaatgtgaaagttctggg

SEQ ID NO: 9183856 - DNA, 22 bp, Homo sapiens
gatgaaatgctgagcctgagtt

SEQ ID NO: 9183857 - DNA, 17 bp, Homo sapiens
gatgaaatgatgcacac

SEQ ID NO: 9183858 - DNA, 22 bp, Homo sapiens
gatgaaatagcaaaggcatttg

SEQ ID NO: 9183859 - DNA, 22 bp, Homo sapiens
gatgaaatagaattaatttagg

SEQ ID NO: 9183860 - DNA, 22 bp, Homo sapiens
gatgaaatccagatcacaggtg

SEQ ID NO: 9183861 - DNA, 17 bp, Homo sapiens
gatgaaatgatgcacac

SEQ ID NO: 9183862 - DNA, 20 bp, Homo sapiens
gatgaaatcactgggcagcc

SEQ ID NO: 9183863 - DNA, 22 bp, Homo sapiens
gatgaaatagaattaatttagg

SEQ ID NO: 9183864 - DNA, 22 bp, Homo sapiens
gatgaaaaattgctgtgtcata

SEQ ID NO: 9183865 - DNA, 19 bp, Homo sapiens
gatctttgccaatttaagc

SEQ ID NO: 9183866 - DNA, 22 bp, Homo sapiens
gatcatttgcaggaaacattaa

SEQ ID NO: 9183867 - DNA, 22 bp, Homo sapiens
gatctggtacaggcctgcagcc

SEQ ID NO: 9183868 - DNA, 22 bp, Homo sapiens
gatctgggagcctcatggagac

SEQ ID NO: 9183869 - DNA, 22 bp, Homo sapiens
gatccgaatcattgctctttta

SEQ ID NO: 9183870 - DNA, 22 bp, Homo sapiens
gatccgtttatactgagtttga

SEQ ID NO: 9183871 - DNA, 22 bp, Homo sapiens
gatccgttgcaaccaattagca

SEQ ID NO: 9183872 - DNA, 22 bp, Homo sapiens
gatccgttccaccagtctttat

SEQ ID NO: 9183873 - DNA, 22 bp, Homo sapiens
gatccgttttaacaatgggagt

SEQ ID NO: 9183874 - DNA, 22 bp, Homo sapiens
gatccgtttgtgtgggagtatt

SEQ ID NO: 9183875 - DNA, 22 bp, Homo sapiens
gatctggtttcatcatggactt

SEQ ID NO: 9183876 - DNA, 22 bp, Homo sapiens
gatctggtctttgattagacac

SEQ ID NO: 9183877 - DNA, 22 bp, Homo sapiens
gatctgtcctggcagttaacac

SEQ ID NO: 9183878 - DNA, 22 bp, Homo sapiens
gatctgttataatctcttttat

SEQ ID NO: 9183879 - DNA, 22 bp, Homo sapiens
gatctgtttcaattgtcttagt

SEQ ID NO: 9183880 - DNA, 22 bp, Homo sapiens
gatcttctctttagtagaaaca

SEQ ID NO: 9183881 - DNA, 22 bp, Homo sapiens
gatcttctgaactggagtatct

SEQ ID NO: 9183882 - DNA, 22 bp, Homo sapiens
gatcttctttctctgtagaggt

SEQ ID NO: 9183883 - DNA, 22 bp, Homo sapiens
gatcttctagcagaagtaattt

SEQ ID NO: 9183884 - DNA, 22 bp, Homo sapiens
gatctgtttcattcacagtctg

SEQ ID NO: 9183885 - DNA, 22 bp, Homo sapiens
gatcttctatgtaatgaagtgt

SEQ ID NO: 9183886 - DNA, 22 bp, Homo sapiens
gatgacttatgtttacaaatgt

SEQ ID NO: 9183887 - DNA, 22 bp, Homo sapiens
gatgaggaaaccaaggctcagg

SEQ ID NO: 9183888 - DNA, 22 bp, Homo sapiens
gatgatggtggacagctggtta

SEQ ID NO: 9183889 - DNA, 22 bp, Homo sapiens
gatgaagaggcactgacatatt

SEQ ID NO: 9183890 - DNA, 22 bp, Homo sapiens
gatgaaatttgggcaggttaaa

SEQ ID NO: 9183891 - DNA, 22 bp, Homo sapiens
gatgaaatttgaaaatagtgtt

SEQ ID NO: 9183892 - DNA, 22 bp, Homo sapiens
gatgacaacttgtttctgttat

SEQ ID NO: 9183893 - DNA, 22 bp, Homo sapiens
gatgacaaaacttttgccagca

SEQ ID NO: 9183894 - DNA, 22 bp, Homo sapiens
gatgacaaaagagtaagtaatg

SEQ ID NO: 9183895 - DNA, 22 bp, Homo sapiens
gatgacaagcatatgacacgtc

SEQ ID NO: 9183896 - DNA, 22 bp, Homo sapiens
gatgacaagatctggatttgaa

SEQ ID NO: 9183897 - DNA, 22 bp, Homo sapiens
gatgattttgttggtgattcaa

SEQ ID NO: 9183898 - DNA, 22 bp, Homo sapiens
gatgcaaaccttacatggacct

SEQ ID NO: 9183899 - DNA, 21 bp, Homo sapiens
gatgcacaatgggtaagtaca

SEQ ID NO: 9183900 - DNA, 22 bp, Homo sapiens
gatgcagaaagtagacaccatc

SEQ ID NO: 9183901 - DNA, 22 bp, Homo sapiens
gatgcagggaacttagtgggct

SEQ ID NO: 9183902 - DNA, 22 bp, Homo sapiens
gatgcagggaacttagtgggct

SEQ ID NO: 9183903 - DNA, 22 bp, Homo sapiens
gatgcagggcagctctgggaca

SEQ ID NO: 9183904 - DNA, 22 bp, Homo sapiens
gatgcagggctggcaggagctt

SEQ ID NO: 9183905 - DNA, 22 bp, Homo sapiens
gatgcaggtgtgccacagagct

SEQ ID NO: 9183906 - DNA, 22 bp, Homo sapiens
gatacagctctggccagatgtg

SEQ ID NO: 9183907 - DNA, 22 bp, Homo sapiens
gatacagtatttaaagagcaac

SEQ ID NO: 9183908 - DNA, 22 bp, Homo sapiens
gatacactggccaagtggagga

SEQ ID NO: 9183909 - DNA, 22 bp, Homo sapiens
gatacactggagcttcctgaca

SEQ ID NO: 9183910 - DNA, 23 bp, Homo sapiens
gatacactccctgctgggcactg

SEQ ID NO: 9183911 - DNA, 22 bp, Homo sapiens
gataataagcacagcaggatgt

SEQ ID NO: 9183912 - DNA, 19 bp, Homo sapiens
gataagtttccaggtaact

SEQ ID NO: 9183913 - DNA, 22 bp, Homo sapiens
gataatatctggtttattcacc

SEQ ID NO: 9183914 - DNA, 22 bp, Homo sapiens
gataatacttattaagcactta

SEQ ID NO: 9183915 - DNA, 22 bp, Homo sapiens
gataagcactatataagtattt

SEQ ID NO: 9183916 - DNA, 21 bp, Homo sapiens
gataaggcaggaggataagta

SEQ ID NO: 9183917 - DNA, 22 bp, Homo sapiens
gataaggactttggggtctaca

SEQ ID NO: 9183918 - DNA, 20 bp, Homo sapiens
gatacacagcacagagggcc

SEQ ID NO: 9183919 - DNA, 22 bp, Homo sapiens
gatagaaagaatatagattcca

SEQ ID NO: 9183920 - DNA, 22 bp, Homo sapiens
gatagcagctctggggtcagac

SEQ ID NO: 9183921 - DNA, 22 bp, Homo sapiens
gatagataaaactatattttca

SEQ ID NO: 9183922 - DNA, 22 bp, Homo sapiens
gatagagaaacacagataaatg

SEQ ID NO: 9183923 - DNA, 22 bp, Homo sapiens
gatactgtgtcattctcacatg

SEQ ID NO: 9183924 - DNA, 22 bp, Homo sapiens
gatactgtatcctaaaagcttt

SEQ ID NO: 9183925 - DNA, 22 bp, Homo sapiens
gatactgtggtgcatctggagt

SEQ ID NO: 9183926 - DNA, 22 bp, Homo sapiens
gatactgtaggtgaaagtgttt

SEQ ID NO: 9183927 - DNA, 22 bp, Homo sapiens
gatactgttagtaaaaggtact

SEQ ID NO: 9183928 - DNA, 22 bp, Homo sapiens
gatactgttttgtttgtgaggt

SEQ ID NO: 9183929 - DNA, 19 bp, Homo sapiens
gatataaagagatggtgaa

SEQ ID NO: 9183930 - DNA, 22 bp, Homo sapiens
gatagcaacatagaacagaatt

SEQ ID NO: 9183931 - DNA, 22 bp, Homo sapiens
gatatacaatccacagttgatt

SEQ ID NO: 9183932 - DNA, 22 bp, Homo sapiens
gatataaattaatcaagtgcaa

SEQ ID NO: 9183933 - DNA, 22 bp, Homo sapiens
gatataaattaatcaagtgcaa

SEQ ID NO: 9183934 - DNA, 22 bp, Homo sapiens
gatcagtttattaattttctag

SEQ ID NO: 9183935 - DNA, 22 bp, Homo sapiens
gatcagtttaatcttcaggggt

SEQ ID NO: 9183936 - DNA, 22 bp, Homo sapiens
gatcaggaatattggaaagtac

SEQ ID NO: 9183937 - DNA, 22 bp, Homo sapiens
gatcaaaagctgggttctaaaa

SEQ ID NO: 9183938 - DNA, 22 bp, Homo sapiens
gatcaaaggaattttttacatg

SEQ ID NO: 9183939 - DNA, 22 bp, Homo sapiens
gatcaaagcctagttccaagat

SEQ ID NO: 9183940 - DNA, 22 bp, Homo sapiens
gatcacataatttggaaacagc

SEQ ID NO: 9183941 - DNA, 22 bp, Homo sapiens
gatcacatgagttatctaactt

SEQ ID NO: 9183942 - DNA, 22 bp, Homo sapiens
gatcacatgaatggaatagaag

SEQ ID NO: 9183943 - DNA, 22 bp, Homo sapiens
gatataggttcatagtgttaca

SEQ ID NO: 9183944 - DNA, 22 bp, Homo sapiens
gatatacagagcattctttgat

SEQ ID NO: 9183945 - DNA, 22 bp, Homo sapiens
gatatacataggtttctatgca

SEQ ID NO: 9183946 - DNA, 22 bp, Homo sapiens
gatatatgtaaaagtagacaga

SEQ ID NO: 9183947 - DNA, 22 bp, Homo sapiens
gatattttgagaaatcctatga

SEQ ID NO: 9183948 - DNA, 22 bp, Homo sapiens
gagtcacaaaagatgcccaggg

SEQ ID NO: 9183949 - DNA, 20 bp, Homo sapiens
gagtcacagaagaagctgaa

SEQ ID NO: 9183950 - DNA, 22 bp, Homo sapiens
gagtcacatactatgtaataga

SEQ ID NO: 9183951 - DNA, 22 bp, Homo sapiens
gagtcactgtttcccggctctg

SEQ ID NO: 9183952 - DNA, 22 bp, Homo sapiens
gagtcagaaagtagtgtgccta

SEQ ID NO: 9183953 - DNA, 22 bp, Homo sapiens
gagtcacttcccgaataaaccc

SEQ ID NO: 9183954 - DNA, 22 bp, Homo sapiens
gaggtggtggtggaggcatagc

SEQ ID NO: 9183955 - DNA, 22 bp, Homo sapiens
gaggtggttcaggtagagccca

SEQ ID NO: 9183956 - DNA, 22 bp, Homo sapiens
gagtcccatgatgatagccaca

SEQ ID NO: 9183957 - DNA, 22 bp, Homo sapiens
gagtcagatgaagataaaaggg

SEQ ID NO: 9183958 - DNA, 22 bp, Homo sapiens
gagtcaggcatgaaggtaatta

SEQ ID NO: 9183959 - DNA, 19 bp, Homo sapiens
gaggtcagcaagaagtatt

SEQ ID NO: 9183960 - DNA, 22 bp, Homo sapiens
gaggtcaaggtcaagagacaga

SEQ ID NO: 9183961 - DNA, 22 bp, Homo sapiens
gaggtaacactgttcagtgggc

SEQ ID NO: 9183962 - DNA, 22 bp, Homo sapiens
gaggtaggtgtaggaggcctgc

SEQ ID NO: 9183963 - DNA, 22 bp, Homo sapiens
gaggtagtaagcagagtggggt

SEQ ID NO: 9183964 - DNA, 22 bp, Homo sapiens
gaggggcctggcactgagctgg

SEQ ID NO: 9183965 - DNA, 22 bp, Homo sapiens
gaggggcctggcactgagctgg

SEQ ID NO: 9183966 - DNA, 22 bp, Homo sapiens
gaggggcgtcctgagtgggcct

SEQ ID NO: 9183967 - DNA, 22 bp, Homo sapiens
gaggtcaggctcaagctgggcc

SEQ ID NO: 9183968 - DNA, 22 bp, Homo sapiens
gaggtcaggctcaagctgggcc

SEQ ID NO: 9183969 - DNA, 22 bp, Homo sapiens
gaggtcaggggagaggctgatg

SEQ ID NO: 9183970 - DNA, 22 bp, Homo sapiens
gaggtgggcggatcacaaggtc

SEQ ID NO: 9183971 - DNA, 22 bp, Homo sapiens
gaggctggaggtcaaagatgaa

SEQ ID NO: 9183972 - DNA, 22 bp, Homo sapiens
gaggctggaggtcaaagatgaa

SEQ ID NO: 9183973 - DNA, 22 bp, Homo sapiens
gaggctggcagaaaagcacagg

SEQ ID NO: 9183974 - DNA, 22 bp, Homo sapiens
gaggctggaggtcaaagatgaa

SEQ ID NO: 9183975 - DNA, 22 bp, Homo sapiens
gaggctgcccaactggagtgga

SEQ ID NO: 9183976 - DNA, 22 bp, Homo sapiens
gaggcctggaattccagcctgg

SEQ ID NO: 9183977 - DNA, 22 bp, Homo sapiens
gaggcctgcagcgtggtccctg

SEQ ID NO: 9183978 - DNA, 22 bp, Homo sapiens
gaggctggaatattagaaatgt

SEQ ID NO: 9183979 - DNA, 22 bp, Homo sapiens
gaggctgcccaactggagtgga

SEQ ID NO: 9183980 - DNA, 22 bp, Homo sapiens
gaggctgcccacacctgcgccg

SEQ ID NO: 9183981 - DNA, 22 bp, Homo sapiens
gaggctgcccaactggagtgga

SEQ ID NO: 9183982 - DNA, 16 bp, Homo sapiens
gaggctggcagatgtc

SEQ ID NO: 9183983 - DNA, 22 bp, Homo sapiens
gaggctgggggctgccttcctc

SEQ ID NO: 9183984 - DNA, 22 bp, Homo sapiens
gaggctgggaagtccaagatca

SEQ ID NO: 9183985 - DNA, 22 bp, Homo sapiens
gagggatgcagaaacagaggcc

SEQ ID NO: 9183986 - DNA, 22 bp, Homo sapiens
gagggatggtagttgacactga

SEQ ID NO: 9183987 - DNA, 22 bp, Homo sapiens
gaggctgggggctgccttcctc

SEQ ID NO: 9183988 - DNA, 16 bp, Homo sapiens
gagggcagaggcggaa

SEQ ID NO: 9183989 - DNA, 22 bp, Homo sapiens
gagggcagagacagtgattcac

SEQ ID NO: 9183990 - DNA, 16 bp, Homo sapiens
gagggcagaggcggaa

SEQ ID NO: 9183991 - DNA, 22 bp, Homo sapiens
gagggcagagacagtgattcac

SEQ ID NO: 9183992 - DNA, 22 bp, Homo sapiens
gagggcagtgaattttgaagct

SEQ ID NO: 9183993 - DNA, 22 bp, Homo sapiens
gagggccaatgtgtccctgagc

SEQ ID NO: 9183994 - DNA, 22 bp, Homo sapiens
gagggccaactagcaccacttt

SEQ ID NO: 9183995 - DNA, 22 bp, Homo sapiens
gaggggaaagtgtgaggctgcg

SEQ ID NO: 9183996 - DNA, 20 bp, Homo sapiens
gagggcaggcacccatttca

SEQ ID NO: 9183997 - DNA, 22 bp, Homo sapiens
gagggcagagtctaatgatgca

SEQ ID NO: 9183998 - DNA, 22 bp, Homo sapiens
gagggcagagtctaatgatgca

SEQ ID NO: 9183999 - DNA, 22 bp, Homo sapiens
gagggcagtagcctcgtaccct

SEQ ID NO: 9184000 - DNA, 22 bp, Homo sapiens
gagggcagtagcctcgtaccct

SEQ ID NO: 9184001 - DNA, 22 bp, Homo sapiens
gagggcaggggtcttgcacggt

SEQ ID NO: 9184002 - DNA, 22 bp, Homo sapiens
gagggcaggggtcttgcacggt

SEQ ID NO: 9184003 - DNA, 22 bp, Homo sapiens
gaggggcacagtaaagggtccc

SEQ ID NO: 9184004 - DNA, 22 bp, Homo sapiens
gaggggcagaatgtgatcaggg

SEQ ID NO: 9184005 - DNA, 22 bp, Homo sapiens
gaggggcacagtaaagggtccc

SEQ ID NO: 9184006 - DNA, 21 bp, Homo sapiens
gaggggcagctcttagcatta

SEQ ID NO: 9184007 - DNA, 22 bp, Homo sapiens
gaggggcaggattattgggatt

SEQ ID NO: 9184008 - DNA, 22 bp, Homo sapiens
gaggggcagaggtagagaacaa

SEQ ID NO: 9184009 - DNA, 22 bp, Homo sapiens
gaggggcaatgagggaaagagt

SEQ ID NO: 9184010 - DNA, 22 bp, Homo sapiens
gaggggcaatgagggaaagagt

SEQ ID NO: 9184011 - DNA, 22 bp, Homo sapiens
gaggggcaatgagggaaagagt

SEQ ID NO: 9184012 - DNA, 22 bp, Homo sapiens
gaggggattggaaggaacaccc

SEQ ID NO: 9184013 - DNA, 22 bp, Homo sapiens
gaggggattggaaggaacaccc

SEQ ID NO: 9184014 - DNA, 22 bp, Homo sapiens
gaggggagtaaagtcatgttac

SEQ ID NO: 9184015 - DNA, 22 bp, Homo sapiens
gaggggagtgtcctccgggccc

SEQ ID NO: 9184016 - DNA, 22 bp, Homo sapiens
gaggggagtgtcctccgggccc

SEQ ID NO: 9184017 - DNA, 22 bp, Homo sapiens
gaggggatgcagagaggcttat

SEQ ID NO: 9184018 - DNA, 22 bp, Homo sapiens
gaggcagcagaacatggaagag

SEQ ID NO: 9184019 - DNA, 22 bp, Homo sapiens
gaggcagcaggctgaggaggat

SEQ ID NO: 9184020 - DNA, 22 bp, Homo sapiens
gaggcagcagaacatggaagag

SEQ ID NO: 9184021 - DNA, 22 bp, Homo sapiens
gaggcagcaggctgaggaggat

SEQ ID NO: 9184022 - DNA, 22 bp, Homo sapiens
gaggcagcaggctgaggaggat

SEQ ID NO: 9184023 - DNA, 22 bp, Homo sapiens
gaggcagcgggtcaggaccgtg

SEQ ID NO: 9184024 - DNA, 18 bp, Homo sapiens
gaggcagctagcaatttt

SEQ ID NO: 9184025 - DNA, 22 bp, Homo sapiens
gaggcagctcttctgaatgggg

SEQ ID NO: 9184026 - DNA, 23 bp, Homo sapiens
gaggcagctcctgcagtgccctg

SEQ ID NO: 9184027 - DNA, 23 bp, Homo sapiens
gaggcagctcctgcagtgccctg

SEQ ID NO: 9184028 - DNA, 22 bp, Homo sapiens
gaggcagctcttctgaatgggg

SEQ ID NO: 9184029 - DNA, 18 bp, Homo sapiens
gaggcagctagcaatttt

SEQ ID NO: 9184030 - DNA, 18 bp, Homo sapiens
gaggcagctagcaatttt

SEQ ID NO: 9184031 - DNA, 22 bp, Homo sapiens
gaggcagctgaaggagtgacag

SEQ ID NO: 9184032 - DNA, 22 bp, Homo sapiens
gaggcagctgaagcttcaaaga

SEQ ID NO: 9184033 - DNA, 22 bp, Homo sapiens
gaggcccaggtcaagcagccac

SEQ ID NO: 9184034 - DNA, 22 bp, Homo sapiens
gaggcagctgggctggtggttt

SEQ ID NO: 9184035 - DNA, 20 bp, Homo sapiens
gaggcctcagcctcagctcc

SEQ ID NO: 9184036 - DNA, 22 bp, Homo sapiens
gaggccctggtaggtcagagtg

SEQ ID NO: 9184037 - DNA, 22 bp, Homo sapiens
gaggccctgaagacagctgggg

SEQ ID NO: 9184038 - DNA, 22 bp, Homo sapiens
gaggcagaggttgcagtgagct

SEQ ID NO: 9184039 - DNA, 22 bp, Homo sapiens
gaggcagaggttgcagtgagct

SEQ ID NO: 9184040 - DNA, 22 bp, Homo sapiens
gaggaggtggaattccaggaat

SEQ ID NO: 9184041 - DNA, 22 bp, Homo sapiens
gaggaggtcccccgacatgcct

SEQ ID NO: 9184042 - DNA, 22 bp, Homo sapiens
gaggaggtcccccgacatgcct

SEQ ID NO: 9184043 - DNA, 22 bp, Homo sapiens
gaggaggtcgctgctgagcccc

SEQ ID NO: 9184044 - DNA, 22 bp, Homo sapiens
gaggaggtcgctgctgagcccc

SEQ ID NO: 9184045 - DNA, 22 bp, Homo sapiens
gaggagggttggccttaggtag

SEQ ID NO: 9184046 - DNA, 22 bp, Homo sapiens
gaggcagcaataaaaagaattt

SEQ ID NO: 9184047 - DNA, 22 bp, Homo sapiens
gaggcagcagaacatggaagag

SEQ ID NO: 9184048 - DNA, 22 bp, Homo sapiens
gaggcagcaataaaaagaattt

SEQ ID NO: 9184049 - DNA, 22 bp, Homo sapiens
gaggcagagtgcaccccaggag

SEQ ID NO: 9184050 - DNA, 22 bp, Homo sapiens
gaggcagagtcacaaagagtct

SEQ ID NO: 9184051 - DNA, 22 bp, Homo sapiens
gaggcagaggttgttgcagtga

SEQ ID NO: 9184052 - DNA, 22 bp, Homo sapiens
gaggcagaggttgcagtgagct

SEQ ID NO: 9184053 - DNA, 22 bp, Homo sapiens
gaggaggcttccgggaggcacg

SEQ ID NO: 9184054 - DNA, 19 bp, Homo sapiens
gaggaggcttcagctttct

SEQ ID NO: 9184055 - DNA, 22 bp, Homo sapiens
gaggaggctgtttctctgcatt

SEQ ID NO: 9184056 - DNA, 22 bp, Homo sapiens
gaggaggcttccgggaggcacg

SEQ ID NO: 9184057 - DNA, 22 bp, Homo sapiens
gaggaggctgtttctctgcatt

SEQ ID NO: 9184058 - DNA, 22 bp, Homo sapiens
gaggaggctgaacaatgccctg

SEQ ID NO: 9184059 - DNA, 22 bp, Homo sapiens
gaggaggctgaacaatgccctg

SEQ ID NO: 9184060 - DNA, 22 bp, Homo sapiens
gaggaggctggcgccgcctgcc

SEQ ID NO: 9184061 - DNA, 23 bp, Homo sapiens
gaggagggtctgacaagtgtagc

SEQ ID NO: 9184062 - DNA, 22 bp, Homo sapiens
gaggagggagctggaagctctt

SEQ ID NO: 9184063 - DNA, 22 bp, Homo sapiens
gaggagggagaattaggcttaa

SEQ ID NO: 9184064 - DNA, 22 bp, Homo sapiens
gaggagggagctggaagctctt

SEQ ID NO: 9184065 - DNA, 22 bp, Homo sapiens
gaggaagggactttattatctg

SEQ ID NO: 9184066 - DNA, 22 bp, Homo sapiens
gaggaagggctgcctgccgggc

SEQ ID NO: 9184067 - DNA, 22 bp, Homo sapiens
gaggaagggctgcctgccgggc

SEQ ID NO: 9184068 - DNA, 22 bp, Homo sapiens
gaggaagggctgcctgccgggc

SEQ ID NO: 9184069 - DNA, 22 bp, Homo sapiens
gaggaagagcatggccagtttc

SEQ ID NO: 9184070 - DNA, 22 bp, Homo sapiens
gaggaagagagctctgccttgt

SEQ ID NO: 9184071 - DNA, 22 bp, Homo sapiens
gagctgggattcatctatgtct

SEQ ID NO: 9184072 - DNA, 22 bp, Homo sapiens
gaggaagaattggttattggag

SEQ ID NO: 9184073 - DNA, 23 bp, Homo sapiens
gagctgggatacaggcttactgc

SEQ ID NO: 9184074 - DNA, 23 bp, Homo sapiens
gagctgggatacaggcttactgc

SEQ ID NO: 9184075 - DNA, 22 bp, Homo sapiens
gagctgggagttatagcatgtt

SEQ ID NO: 9184076 - DNA, 22 bp, Homo sapiens
gagctgggacttggaatccaca

SEQ ID NO: 9184077 - DNA, 22 bp, Homo sapiens
gagctgggacttggaatccaca

SEQ ID NO: 9184078 - DNA, 18 bp, Homo sapiens
gagctgggagaaggaagg

SEQ ID NO: 9184079 - DNA, 22 bp, Homo sapiens
gagctgggagctgggatttgga

SEQ ID NO: 9184080 - DNA, 22 bp, Homo sapiens
gagctgggagctgggatttgga

SEQ ID NO: 9184081 - DNA, 22 bp, Homo sapiens
gagctgggagttatagcatgtt

SEQ ID NO: 9184082 - DNA, 22 bp, Homo sapiens
gagctgggagttatagcatgtt

SEQ ID NO: 9184083 - DNA, 22 bp, Homo sapiens
gagctgggagttatagcatgtt

SEQ ID NO: 9184084 - DNA, 22 bp, Homo sapiens
gagctgggaggactgggaactt

SEQ ID NO: 9184085 - DNA, 22 bp, Homo sapiens
gaggacagcttagggcttcctg

SEQ ID NO: 9184086 - DNA, 22 bp, Homo sapiens
gaggacagctctaactaaagtc

SEQ ID NO: 9184087 - DNA, 22 bp, Homo sapiens
gaggacacctcacagcctcaca

SEQ ID NO: 9184088 - DNA, 22 bp, Homo sapiens
gaggacacctcacagcctcaca

SEQ ID NO: 9184089 - DNA, 22 bp, Homo sapiens
gaggacagagccgcctggcaag

SEQ ID NO: 9184090 - DNA, 22 bp, Homo sapiens
gaggacagagccgcctggcaag

SEQ ID NO: 9184091 - DNA, 22 bp, Homo sapiens
gaggacaaagcccaggtgctgg

SEQ ID NO: 9184092 - DNA, 22 bp, Homo sapiens
gaggacaaggccttgcaattct

SEQ ID NO: 9184093 - DNA, 22 bp, Homo sapiens
gaggacacaaagtggctgagat

SEQ ID NO: 9184094 - DNA, 22 bp, Homo sapiens
gaggacacatgactccagcagg

SEQ ID NO: 9184095 - DNA, 22 bp, Homo sapiens
gaggaatgtcagcacaggcctc

SEQ ID NO: 9184096 - DNA, 22 bp, Homo sapiens
gaggaatgggtgtctcgtgatt

SEQ ID NO: 9184097 - DNA, 22 bp, Homo sapiens
gaggaagtttacaaagcatctg

SEQ ID NO: 9184098 - DNA, 21 bp, Homo sapiens
gaggaatggtttgcaaagcac

SEQ ID NO: 9184099 - DNA, 22 bp, Homo sapiens
gaggaagtctctctacaagaaa

SEQ ID NO: 9184100 - DNA, 22 bp, Homo sapiens
gaggaagttctatgattacatc

SEQ ID NO: 9184101 - DNA, 22 bp, Homo sapiens
gaggaaggtcccatcagaattt

SEQ ID NO: 9184102 - DNA, 22 bp, Homo sapiens
gaggaaggtcccatcagaattt

SEQ ID NO: 9184103 - DNA, 22 bp, Homo sapiens
gagagtgaggcctgggaatcta

SEQ ID NO: 9184104 - DNA, 22 bp, Homo sapiens
gagagtggaaagcaagctgagt

SEQ ID NO: 9184105 - DNA, 22 bp, Homo sapiens
gagagtgctgaacggcaagggt

SEQ ID NO: 9184106 - DNA, 22 bp, Homo sapiens
gagagtgaggcctgggaatcta

SEQ ID NO: 9184107 - DNA, 22 bp, Homo sapiens
gagagtgaggcatcaggggcag

SEQ ID NO: 9184108 - DNA, 22 bp, Homo sapiens
gagagtgagatcctcctgggga

SEQ ID NO: 9184109 - DNA, 22 bp, Homo sapiens
gagagtctagtgcacctagttt

SEQ ID NO: 9184110 - DNA, 22 bp, Homo sapiens
gagagtctagtgcacctagttt

SEQ ID NO: 9184111 - DNA, 22 bp, Homo sapiens
gagagtctagtgcacctagttt

SEQ ID NO: 9184112 - DNA, 22 bp, Homo sapiens
gagatatgttggcagctggtat

SEQ ID NO: 9184113 - DNA, 22 bp, Homo sapiens
gagataaagctaccatgttgat

SEQ ID NO: 9184114 - DNA, 22 bp, Homo sapiens
gagatacagttggctgcaggct

SEQ ID NO: 9184115 - DNA, 22 bp, Homo sapiens
gagctggcctcaggcacaggag

SEQ ID NO: 9184116 - DNA, 22 bp, Homo sapiens
gagctggcctcaggcacaggag

SEQ ID NO: 9184117 - DNA, 22 bp, Homo sapiens
gagctggctccgccatgctgct

SEQ ID NO: 9184118 - DNA, 22 bp, Homo sapiens
gagctgggaagatagcttgagc

SEQ ID NO: 9184119 - DNA, 22 bp, Homo sapiens
gagctgggacatgggtcctctc

SEQ ID NO: 9184120 - DNA, 22 bp, Homo sapiens
gagctgggaagatagcttgagc

SEQ ID NO: 9184121 - DNA, 22 bp, Homo sapiens
gagctgggacatgggtcctctc

SEQ ID NO: 9184122 - DNA, 22 bp, Homo sapiens
gagctgggacatgggtcctctc

SEQ ID NO: 9184123 - DNA, 22 bp, Homo sapiens
gagctgggacatgggtcctctc

SEQ ID NO: 9184124 - DNA, 22 bp, Homo sapiens
gagctggactttcagatacatc

SEQ ID NO: 9184125 - DNA, 22 bp, Homo sapiens
gagctggactttcagatacatc

SEQ ID NO: 9184126 - DNA, 22 bp, Homo sapiens
gagctggcacagaaggatctta

SEQ ID NO: 9184127 - DNA, 22 bp, Homo sapiens
gaccaggcttccccagacctca

SEQ ID NO: 9184128 - DNA, 22 bp, Homo sapiens
gacaggcaggccagggctgtgg

SEQ ID NO: 9184129 - DNA, 22 bp, Homo sapiens
gaccatgtgaaaatagaggaga

SEQ ID NO: 9184130 - DNA, 22 bp, Homo sapiens
gaccatcctggccaacgtggta

SEQ ID NO: 9184131 - DNA, 22 bp, Homo sapiens
gaccagtcattactcatgccct

SEQ ID NO: 9184132 - DNA, 22 bp, Homo sapiens
gaccagggtcactcacagggct

SEQ ID NO: 9184133 - DNA, 22 bp, Homo sapiens
gaccaggcttccccagacctca

SEQ ID NO: 9184134 - DNA, 22 bp, Homo sapiens
gaccagtcattactcatgccct

SEQ ID NO: 9184135 - DNA, 20 bp, Homo sapiens
gacaggagagttaggtaggt

SEQ ID NO: 9184136 - DNA, 22 bp, Homo sapiens
gacaggaggcagagctcaggtg

SEQ ID NO: 9184137 - DNA, 22 bp, Homo sapiens
gacaggaggcagagctcaggtg

SEQ ID NO: 9184138 - DNA, 22 bp, Homo sapiens
gacaggaggcagagctcaggtg

SEQ ID NO: 9184139 - DNA, 22 bp, Homo sapiens
gacaggcacgaaattgggctgg

SEQ ID NO: 9184140 - DNA, 21 bp, Homo sapiens
gacaggcaaggagtcacttag

SEQ ID NO: 9184141 - DNA, 22 bp, Homo sapiens
gacccagggtatccagagctgc

SEQ ID NO: 9184142 - DNA, 22 bp, Homo sapiens
gacccagggtatccagagctgc

SEQ ID NO: 9184143 - DNA, 22 bp, Homo sapiens
gacccaggggtccatttctcct

SEQ ID NO: 9184144 - DNA, 22 bp, Homo sapiens
gacccaggcccaaggctgccag

SEQ ID NO: 9184145 - DNA, 22 bp, Homo sapiens
gacccaggcctggggcttaagg

SEQ ID NO: 9184146 - DNA, 22 bp, Homo sapiens
gacccaggcaatgaacttactt

SEQ ID NO: 9184147 - DNA, 22 bp, Homo sapiens
gacccaggagtgcagagagtgg

SEQ ID NO: 9184148 - DNA, 18 bp, Homo sapiens
gacccaggaaagagtcct

SEQ ID NO: 9184149 - DNA, 22 bp, Homo sapiens
gacccagcttaagtcacatgtt

SEQ ID NO: 9184150 - DNA, 18 bp, Homo sapiens
gacccaggaaagagtcct

SEQ ID NO: 9184151 - DNA, 22 bp, Homo sapiens
gaccatttttacagagcattca

SEQ ID NO: 9184152 - DNA, 22 bp, Homo sapiens
gaccatttctaggaatcagact

SEQ ID NO: 9184153 - DNA, 22 bp, Homo sapiens
gacccacctcaccaagcatgtg

SEQ ID NO: 9184154 - DNA, 22 bp, Homo sapiens
gaccatttgctagtaaattgca

SEQ ID NO: 9184155 - DNA, 22 bp, Homo sapiens
gacttctgttaacttgtaagag

SEQ ID NO: 9184156 - DNA, 22 bp, Homo sapiens
gacttctgagctatccagctgt

SEQ ID NO: 9184157 - DNA, 22 bp, Homo sapiens
gactgtggtctgttctccaggt

SEQ ID NO: 9184158 - DNA, 22 bp, Homo sapiens
gactgtttaatactgtgagttc

SEQ ID NO: 9184159 - DNA, 22 bp, Homo sapiens
gacttaagtggtgtgataagtg

SEQ ID NO: 9184160 - DNA, 22 bp, Homo sapiens
gacttcaaagcgtgataaagat

SEQ ID NO: 9184161 - DNA, 22 bp, Homo sapiens
gacttcatgacattcaggtcag

SEQ ID NO: 9184162 - DNA, 22 bp, Homo sapiens
gacttcatgtgcaagcgctttg

SEQ ID NO: 9184163 - DNA, 20 bp, Homo sapiens
gacttcccatatcttcttca

SEQ ID NO: 9184164 - DNA, 21 bp, Homo sapiens
gacttcatgggtcaaccaatt

SEQ ID NO: 9184165 - DNA, 22 bp, Homo sapiens
gactgtctctgtgaatggtagg

SEQ ID NO: 9184166 - DNA, 22 bp, Homo sapiens
gactgtccagaattcctaggtg

SEQ ID NO: 9184167 - DNA, 22 bp, Homo sapiens
gactgtctcctgtcatgaggga

SEQ ID NO: 9184168 - DNA, 22 bp, Homo sapiens
gactgtcttttgaataaaaatg

SEQ ID NO: 9184169 - DNA, 22 bp, Homo sapiens
gactgtcttgtttctaagatga

SEQ ID NO: 9184170 - DNA, 22 bp, Homo sapiens
gactggtaaggtattggaattc

SEQ ID NO: 9184171 - DNA, 22 bp, Homo sapiens
gacccagggtttctgcacaggg

SEQ ID NO: 9184172 - DNA, 22 bp, Homo sapiens
gactgcttctccttggtaggtt

SEQ ID NO: 9184173 - DNA, 22 bp, Homo sapiens
gactgcttgagaaggaacaaat

SEQ ID NO: 9184174 - DNA, 22 bp, Homo sapiens
gactgctttaaccaagaaagca

SEQ ID NO: 9184175 - DNA, 22 bp, Homo sapiens
gactggtaaggtattggaattc

SEQ ID NO: 9184176 - DNA, 22 bp, Homo sapiens
gactggtaaggaaattcactaa

SEQ ID NO: 9184177 - DNA, 22 bp, Homo sapiens
gactggaaagcctgtcctcaga

SEQ ID NO: 9184178 - DNA, 22 bp, Homo sapiens
gactggggtaaggtgaggaggt

SEQ ID NO: 9184179 - DNA, 22 bp, Homo sapiens
gagagctgggaaagccgtggag

SEQ ID NO: 9184180 - DNA, 22 bp, Homo sapiens
gagagctgggaaagccgtggag

SEQ ID NO: 9184181 - DNA, 22 bp, Homo sapiens
gagagctgggaaagccgtggag

SEQ ID NO: 9184182 - DNA, 20 bp, Homo sapiens
gagagctggggatgaggctg

SEQ ID NO: 9184183 - DNA, 22 bp, Homo sapiens
gagagctgggctttgggtgaag

SEQ ID NO: 9184184 - DNA, 22 bp, Homo sapiens
gagagctgggctttgggtgaag

SEQ ID NO: 9184185 - DNA, 22 bp, Homo sapiens
gagagctggccagcttcagtat

SEQ ID NO: 9184186 - DNA, 22 bp, Homo sapiens
gagagctggattctggataggt

SEQ ID NO: 9184187 - DNA, 22 bp, Homo sapiens
gagagctggattctggataggt

SEQ ID NO: 9184188 - DNA, 22 bp, Homo sapiens
gagagctggattctggataggt

SEQ ID NO: 9184189 - DNA, 22 bp, Homo sapiens
gagagctggagttatttctctg

SEQ ID NO: 9184190 - DNA, 20 bp, Homo sapiens
gagagctggaaataaagtcc

SEQ ID NO: 9184191 - DNA, 20 bp, Homo sapiens
gagagctggaaataaagtcc

SEQ ID NO: 9184192 - DNA, 22 bp, Homo sapiens
gagagctgggggactgtggatg

SEQ ID NO: 9184193 - DNA, 22 bp, Homo sapiens
gagagctgggggactgtggatg

SEQ ID NO: 9184194 - DNA, 20 bp, Homo sapiens
gagagctggggatgaggctg

SEQ ID NO: 9184195 - DNA, 22 bp, Homo sapiens
gagagctgggggactgtggatg

SEQ ID NO: 9184196 - DNA, 22 bp, Homo sapiens
gagagctgggttcaagtagctg

SEQ ID NO: 9184197 - DNA, 22 bp, Homo sapiens
gagagctgggttcaagtagctg

SEQ ID NO: 9184198 - DNA, 22 bp, Homo sapiens
gagagctgggttcaagtagctg

SEQ ID NO: 9184199 - DNA, 22 bp, Homo sapiens
gagagtctaggaacctcatata

SEQ ID NO: 9184200 - DNA, 22 bp, Homo sapiens
gagacagagatcttgctgagtc

SEQ ID NO: 9184201 - DNA, 23 bp, Homo sapiens
gagagctgactgtcaagactgtt

SEQ ID NO: 9184202 - DNA, 23 bp, Homo sapiens
gagagctgactgtcaagactgtt

SEQ ID NO: 9184203 - DNA, 22 bp, Homo sapiens
gagagcctttgaagggaagtga

SEQ ID NO: 9184204 - DNA, 22 bp, Homo sapiens
gagagctgaggggcctggcact

SEQ ID NO: 9184205 - DNA, 22 bp, Homo sapiens
gagagctgaggggcctggcact

SEQ ID NO: 9184206 - DNA, 22 bp, Homo sapiens
gagagctgatagatgagctact

SEQ ID NO: 9184207 - DNA, 22 bp, Homo sapiens
gagagctgatagatgagctact

SEQ ID NO: 9184208 - DNA, 22 bp, Homo sapiens
gagagctgcaaggtagggcggg

SEQ ID NO: 9184209 - DNA, 17 bp, Homo sapiens
gagagctgctgcttccg

SEQ ID NO: 9184210 - DNA, 17 bp, Homo sapiens
gagagctgctgcttccg

SEQ ID NO: 9184211 - DNA, 18 bp, Homo sapiens
gagagctgctacctagct

SEQ ID NO: 9184212 - DNA, 22 bp, Homo sapiens
gagagctgcagccgagaggggg

SEQ ID NO: 9184213 - DNA, 22 bp, Homo sapiens
gagagctgcattctcagacaca

SEQ ID NO: 9184214 - DNA, 22 bp, Homo sapiens
gagagctgcattctcagacaca

SEQ ID NO: 9184215 - DNA, 20 bp, Homo sapiens
gactttacatcagcactctt

SEQ ID NO: 9184216 - DNA, 22 bp, Homo sapiens
gactttatttccttatttgtga

SEQ ID NO: 9184217 - DNA, 22 bp, Homo sapiens
gactttatttccttatttgtga

SEQ ID NO: 9184218 - DNA, 22 bp, Homo sapiens
gactttggtataccttgcttta

SEQ ID NO: 9184219 - DNA, 22 bp, Homo sapiens
gactttattcgttaactgttaa

SEQ ID NO: 9184220 - DNA, 22 bp, Homo sapiens
gagaaaagcgaaggacctggag

SEQ ID NO: 9184221 - DNA, 22 bp, Homo sapiens
gagaaaatagcatgtgtagtat

SEQ ID NO: 9184222 - DNA, 22 bp, Homo sapiens
gacttttctgagacaatgcttt

SEQ ID NO: 9184223 - DNA, 22 bp, Homo sapiens
gacttttccatcatccccctta

SEQ ID NO: 9184224 - DNA, 22 bp, Homo sapiens
gagaaacaacacttgatgcctt

SEQ ID NO: 9184225 - DNA, 22 bp, Homo sapiens
gagaaaatcttgggtcaagaat

SEQ ID NO: 9184226 - DNA, 22 bp, Homo sapiens
gagaaaatcttgggtcaagaat

SEQ ID NO: 9184227 - DNA, 22 bp, Homo sapiens
gagaaaatgtcagacttggtcg

SEQ ID NO: 9184228 - DNA, 22 bp, Homo sapiens
gagacagagaggtactcaacat

SEQ ID NO: 9184229 - DNA, 22 bp, Homo sapiens
gaattacattgttagccttcct

SEQ ID NO: 9184230 - DNA, 22 bp, Homo sapiens
gaattataggcaaagcagtcat

SEQ ID NO: 9184231 - DNA, 22 bp, Homo sapiens
gaattataaactagtgacttca

SEQ ID NO: 9184232 - DNA, 22 bp, Homo sapiens
gaattaccattttaatggtgct

SEQ ID NO: 9184233 - DNA, 20 bp, Homo sapiens
gaattcctgcagcatttagt

SEQ ID NO: 9184234 - DNA, 22 bp, Homo sapiens
gaattccttaggctcttgactg

SEQ ID NO: 9184235 - DNA, 22 bp, Homo sapiens
gaattataggtttgcatgctaa

SEQ ID NO: 9184236 - DNA, 22 bp, Homo sapiens
gaagttatcaggattaaagttg

SEQ ID NO: 9184237 - DNA, 22 bp, Homo sapiens
gaagttatttcctggtgttgga

SEQ ID NO: 9184238 - DNA, 22 bp, Homo sapiens
gaagttagtgtggatgcaggga

SEQ ID NO: 9184239 - DNA, 22 bp, Homo sapiens
gaattctggttttgaaatgaat

SEQ ID NO: 9184240 - DNA, 22 bp, Homo sapiens
gaattgaattcatttactcaaa

SEQ ID NO: 9184241 - DNA, 22 bp, Homo sapiens
gaattgaattcatttactcaaa

SEQ ID NO: 9184242 - DNA, 22 bp, Homo sapiens
gaattgactgcgtttgcttcct

SEQ ID NO: 9184243 - DNA, 22 bp, Homo sapiens
gaattgctaaccaattcaaaat

SEQ ID NO: 9184244 - DNA, 22 bp, Homo sapiens
gaattgctgaatcatatgttta

SEQ ID NO: 9184245 - DNA, 22 bp, Homo sapiens
gaattgctaatccaagtgactg

SEQ ID NO: 9184246 - DNA, 22 bp, Homo sapiens
gaatttaaatttaaatctacca

SEQ ID NO: 9184247 - DNA, 22 bp, Homo sapiens
gaatttaaggaccaagcatttt

SEQ ID NO: 9184248 - DNA, 22 bp, Homo sapiens
gaatttaagaggatgaatctgt

SEQ ID NO: 9184249 - DNA, 22 bp, Homo sapiens
gacacagagggcaccagatatg

SEQ ID NO: 9184250 - DNA, 22 bp, Homo sapiens
gacacagagctcacagtctcct

SEQ ID NO: 9184251 - DNA, 22 bp, Homo sapiens
gacacagctaatggcttaggac

SEQ ID NO: 9184252 - DNA, 22 bp, Homo sapiens
gacacagatatctctgagatta

SEQ ID NO: 9184253 - DNA, 18 bp, Homo sapiens
gacacaggagagagtccc

SEQ ID NO: 9184254 - DNA, 23 bp, Homo sapiens
gacacaggagcacccagctgagc

SEQ ID NO: 9184255 - DNA, 22 bp, Homo sapiens
gacagctgtgcaggagaagggg

SEQ ID NO: 9184256 - DNA, 22 bp, Homo sapiens
gacacagggggatgtgtggacg

SEQ ID NO: 9184257 - DNA, 22 bp, Homo sapiens
gacaggaagtctgaaggaggga

SEQ ID NO: 9184258 - DNA, 22 bp, Homo sapiens
gacaggaagtctgaaggaggga

SEQ ID NO: 9184259 - DNA, 19 bp, Homo sapiens
gacaggaaggctaccagta

SEQ ID NO: 9184260 - DNA, 19 bp, Homo sapiens
gacaggaaggctaccagta

SEQ ID NO: 9184261 - DNA, 22 bp, Homo sapiens
gacaggaatgtgtggatgcgga

SEQ ID NO: 9184262 - DNA, 20 bp, Homo sapiens
gacaggagagttaggtaggt

SEQ ID NO: 9184263 - DNA, 20 bp, Homo sapiens
gacaggagagttaggtaggt

SEQ ID NO: 9184264 - DNA, 22 bp, Homo sapiens
gaaggagaggattgtgaggctg

SEQ ID NO: 9184265 - DNA, 22 bp, Homo sapiens
gaaggagaggattgtgaggctg

SEQ ID NO: 9184266 - DNA, 22 bp, Homo sapiens
gaaggagaggattgtgaggctg

SEQ ID NO: 9184267 - DNA, 22 bp, Homo sapiens
gaaggagagagacatcgtccct

SEQ ID NO: 9184268 - DNA, 22 bp, Homo sapiens
gaaggagaccctgaagatgctg

SEQ ID NO: 9184269 - DNA, 22 bp, Homo sapiens
gaaggagagaaaggcaattctg

SEQ ID NO: 9184270 - DNA, 22 bp, Homo sapiens
gaaggagaccctgaagatgctg

SEQ ID NO: 9184271 - DNA, 22 bp, Homo sapiens
gaaggagaccctgaagatgctg

SEQ ID NO: 9184272 - DNA, 21 bp, Homo sapiens
gaaggagaaagcaagtgctgc

SEQ ID NO: 9184273 - DNA, 22 bp, Homo sapiens
gaaggcccgccctgagcaaggg

SEQ ID NO: 9184274 - DNA, 22 bp, Homo sapiens
gaaggcctaggaaggaagcctt

SEQ ID NO: 9184275 - DNA, 22 bp, Homo sapiens
gaaggagagggtcaaggataat

SEQ ID NO: 9184276 - DNA, 22 bp, Homo sapiens
gaaggagagggtcaaggataat

SEQ ID NO: 9184277 - DNA, 22 bp, Homo sapiens
gaaggagaggattgtgaggctg

SEQ ID NO: 9184278 - DNA, 22 bp, Homo sapiens
gaaggagagggtcaaggataat

SEQ ID NO: 9184279 - DNA, 22 bp, Homo sapiens
gaaggagagggtcaaggataat

SEQ ID NO: 9184280 - DNA, 22 bp, Homo sapiens
gaactgttccctcacaggctgg

SEQ ID NO: 9184281 - DNA, 22 bp, Homo sapiens
gaactgtgtttgtttctaggtc

SEQ ID NO: 9184282 - DNA, 22 bp, Homo sapiens
gaaggaagccgtttctctccag

SEQ ID NO: 9184283 - DNA, 22 bp, Homo sapiens
gaaggaagggctggctgtcttg

SEQ ID NO: 9184284 - DNA, 22 bp, Homo sapiens
gaaggaagtcattagtgcagac

SEQ ID NO: 9184285 - DNA, 20 bp, Homo sapiens
gaaggaagggggcaaggtga

SEQ ID NO: 9184286 - DNA, 22 bp, Homo sapiens
gaaggaccctctggggtctcag

SEQ ID NO: 9184287 - DNA, 21 bp, Homo sapiens
gaaggagaaagcaagtgctgc

SEQ ID NO: 9184288 - DNA, 21 bp, Homo sapiens
gaaggagaaagcaagtgctgc

SEQ ID NO: 9184289 - DNA, 21 bp, Homo sapiens
gaaggagaaagcaagtgctgc

SEQ ID NO: 9184290 - DNA, 22 bp, Homo sapiens
gaaggaagtgctcatactagtt

SEQ ID NO: 9184291 - DNA, 22 bp, Homo sapiens
gaaggctctgatttcttgcaaa

SEQ ID NO: 9184292 - DNA, 22 bp, Homo sapiens
gaaggctcttgaggccaggtaa

SEQ ID NO: 9184293 - DNA, 19 bp, Homo sapiens
gaaggctgaaatgaagcac

SEQ ID NO: 9184294 - DNA, 19 bp, Homo sapiens
gaaggctgaaatgaagcac

SEQ ID NO: 9184295 - DNA, 22 bp, Homo sapiens
gaaggctaaaggggcagaggtt

SEQ ID NO: 9184296 - DNA, 22 bp, Homo sapiens
gaaggctgagtgggtacggagg

SEQ ID NO: 9184297 - DNA, 22 bp, Homo sapiens
gaaggctgagcagacaggccaa

SEQ ID NO: 9184298 - DNA, 22 bp, Homo sapiens
gaaggctgcgaggggagtgccg

SEQ ID NO: 9184299 - DNA, 22 bp, Homo sapiens
gaaggctgcgaggggagtgccg

SEQ ID NO: 9184300 - DNA, 22 bp, Homo sapiens
gaaggctgccagtggccctctt

SEQ ID NO: 9184301 - DNA, 22 bp, Homo sapiens
gaaggctgcatggaggctgtgg

SEQ ID NO: 9184302 - DNA, 22 bp, Homo sapiens
gaaggcttattttctttgtaaa

SEQ ID NO: 9184303 - DNA, 22 bp, Homo sapiens
gaaggctgcgaggggagtgccg

SEQ ID NO: 9184304 - DNA, 22 bp, Homo sapiens
gaagtgaagagattagaaatca

SEQ ID NO: 9184305 - DNA, 22 bp, Homo sapiens
gaagtgcaaaaccacatggtaa

SEQ ID NO: 9184306 - DNA, 22 bp, Homo sapiens
gaagtggaagccatcggcagtc

SEQ ID NO: 9184307 - DNA, 22 bp, Homo sapiens
gaagtgacagaagggatgggca

SEQ ID NO: 9184308 - DNA, 22 bp, Homo sapiens
gaagtgatcttccagaagaata

SEQ ID NO: 9184309 - DNA, 22 bp, Homo sapiens
gaagtgacaagatgctaggatc

SEQ ID NO: 9184310 - DNA, 22 bp, Homo sapiens
gaagtcttttcttccacccaaa

SEQ ID NO: 9184311 - DNA, 22 bp, Homo sapiens
gaagggaaggaaagaaccagca

SEQ ID NO: 9184312 - DNA, 22 bp, Homo sapiens
gaagttactctcgttaaatatg

SEQ ID NO: 9184313 - DNA, 22 bp, Homo sapiens
gaagtgttgacttctgtgaatt

SEQ ID NO: 9184314 - DNA, 22 bp, Homo sapiens
gaagtggaattactgggtcata

SEQ ID NO: 9184315 - DNA, 22 bp, Homo sapiens
ctttgttaggggctcagggtgg

SEQ ID NO: 9184316 - DNA, 22 bp, Homo sapiens
ctttgttatctgtaaatggtta

SEQ ID NO: 9184317 - DNA, 22 bp, Homo sapiens
ctttgtttatatttctcctcga

SEQ ID NO: 9184318 - DNA, 22 bp, Homo sapiens
ctttgtttatatttctcctcga

SEQ ID NO: 9184319 - DNA, 22 bp, Homo sapiens
ctttgtggctcctgcaggccat

SEQ ID NO: 9184320 - DNA, 22 bp, Homo sapiens
ctttgtgtctgttaataattat

SEQ ID NO: 9184321 - DNA, 22 bp, Homo sapiens
ctttgtgtctgttaataattat

SEQ ID NO: 9184322 - DNA, 22 bp, Homo sapiens
ctttgtgtctgttaataattat

SEQ ID NO: 9184323 - DNA, 22 bp, Homo sapiens
ctttgtggctcctgcaggccat

SEQ ID NO: 9184324 - DNA, 22 bp, Homo sapiens
ctttgttactgatttcagtggg

SEQ ID NO: 9184325 - DNA, 22 bp, Homo sapiens
ctttgttagcagccaatttgtt

SEQ ID NO: 9184326 - DNA, 22 bp, Homo sapiens
ctttgtgccacagcttgactac

SEQ ID NO: 9184327 - DNA, 22 bp, Homo sapiens
ctttgtgcaaaccctagaatca

SEQ ID NO: 9184328 - DNA, 22 bp, Homo sapiens
ctttgtccattgattcgttcaa

SEQ ID NO: 9184329 - DNA, 22 bp, Homo sapiens
ctttgttttactcagaggcatg

SEQ ID NO: 9184330 - DNA, 23 bp, Homo sapiens
cttttaactagagtatcagctgc

SEQ ID NO: 9184331 - DNA, 23 bp, Homo sapiens
cttttaacttgatctgagaccag

SEQ ID NO: 9184332 - DNA, 22 bp, Homo sapiens
cttttaatgggagcagtatttg

SEQ ID NO: 9184333 - DNA, 22 bp, Homo sapiens
gaaaagagtcctgtgtgaggag

SEQ ID NO: 9184334 - DNA, 21 bp, Homo sapiens
gaaaagcaagggagtagaaca

SEQ ID NO: 9184335 - DNA, 21 bp, Homo sapiens
gaaaagcaagggagtagaaca

SEQ ID NO: 9184336 - DNA, 22 bp, Homo sapiens
gaaaagctaggccagttcagct

SEQ ID NO: 9184337 - DNA, 22 bp, Homo sapiens
gaaaaggaaatttatagagatc

SEQ ID NO: 9184338 - DNA, 22 bp, Homo sapiens
gaaaaggcagagttccggggaa

SEQ ID NO: 9184339 - DNA, 22 bp, Homo sapiens
gaaaaggccactcctaggagct

SEQ ID NO: 9184340 - DNA, 22 bp, Homo sapiens
gaaaaggccactcctaggagct

SEQ ID NO: 9184341 - DNA, 22 bp, Homo sapiens
gaaaaggcctccccataggaat

SEQ ID NO: 9184342 - DNA, 22 bp, Homo sapiens
gaaaagggcaagagagagggca

SEQ ID NO: 9184343 - DNA, 22 bp, Homo sapiens
gaaaagtaaacactaggggtca

SEQ ID NO: 9184344 - DNA, 22 bp, Homo sapiens
gaaaagtacacagcccaaacat

SEQ ID NO: 9184345 - DNA, 22 bp, Homo sapiens
gaaaaggctgcccacttattga

SEQ ID NO: 9184346 - DNA, 22 bp, Homo sapiens
gaaaaggctctcactccctccg

SEQ ID NO: 9184347 - DNA, 22 bp, Homo sapiens
gaaaaggcctggggcaaagtgt

SEQ ID NO: 9184348 - DNA, 22 bp, Homo sapiens
gaaagggcatgggcatgacaac

SEQ ID NO: 9184349 - DNA, 22 bp, Homo sapiens
gaaagggcatgggcatgacaac

SEQ ID NO: 9184350 - DNA, 22 bp, Homo sapiens
gaaagggagtggacaacaggca

SEQ ID NO: 9184351 - DNA, 22 bp, Homo sapiens
gaaaggggcatgtagggatcac

SEQ ID NO: 9184352 - DNA, 22 bp, Homo sapiens
gaaaggttgggtgaatggtgga

SEQ ID NO: 9184353 - DNA, 22 bp, Homo sapiens
gaaagtttataggttatataat

SEQ ID NO: 9184354 - DNA, 22 bp, Homo sapiens
gaaagtttataggttatataat

SEQ ID NO: 9184355 - DNA, 22 bp, Homo sapiens
gaaagggagtgaagatggtata

SEQ ID NO: 9184356 - DNA, 22 bp, Homo sapiens
gaaaggccacgtgccaagatta

SEQ ID NO: 9184357 - DNA, 22 bp, Homo sapiens
gaaaggcatcttcagtctctga

SEQ ID NO: 9184358 - DNA, 21 bp, Homo sapiens
gaaaatacaatgagcttgacc

SEQ ID NO: 9184359 - DNA, 21 bp, Homo sapiens
gaaaatacaatgagcttgacc

SEQ ID NO: 9184360 - DNA, 21 bp, Homo sapiens
gaaaatacaatgagcttgacc

SEQ ID NO: 9184361 - DNA, 18 bp, Homo sapiens
gaaaatactctgggctca

SEQ ID NO: 9184362 - DNA, 18 bp, Homo sapiens
gaaaatactctgggctca

SEQ ID NO: 9184363 - DNA, 18 bp, Homo sapiens
gaaaatactctgggctca

SEQ ID NO: 9184364 - DNA, 22 bp, Homo sapiens
gaaaggcagtacagctgagcct

SEQ ID NO: 9184365 - DNA, 22 bp, Homo sapiens
gaaaggcagtacagctgagcct

SEQ ID NO: 9184366 - DNA, 22 bp, Homo sapiens
gaaaatacaaatagccttgaaa

SEQ ID NO: 9184367 - DNA, 22 bp, Homo sapiens
gaaaatacaaatagccttgaaa

SEQ ID NO: 9184368 - DNA, 22 bp, Homo sapiens
gaaaatacaaatagccttgaaa

SEQ ID NO: 9184369 - DNA, 22 bp, Homo sapiens
gaaaatacaaatagccttgaaa

SEQ ID NO: 9184370 - DNA, 22 bp, Homo sapiens
gaaataattctgtgtctgaaca

SEQ ID NO: 9184371 - DNA, 22 bp, Homo sapiens
gaaataatttagaaggtattcc

SEQ ID NO: 9184372 - DNA, 22 bp, Homo sapiens
gaaataattctgtgtctgaaca

SEQ ID NO: 9184373 - DNA, 22 bp, Homo sapiens
gaaatacaaatgcctagatcct

SEQ ID NO: 9184374 - DNA, 22 bp, Homo sapiens
gaaatacaaagccagccatttt

SEQ ID NO: 9184375 - DNA, 22 bp, Homo sapiens
gaaatacaaagccagccatttt

SEQ ID NO: 9184376 - DNA, 22 bp, Homo sapiens
gaaatacaaagccagccatttt

SEQ ID NO: 9184377 - DNA, 22 bp, Homo sapiens
gaaagttttctcacacagtaat

SEQ ID NO: 9184378 - DNA, 22 bp, Homo sapiens
gaaagtttgcctctctcttgag

SEQ ID NO: 9184379 - DNA, 22 bp, Homo sapiens
gaaagttttcatatataccaaa

SEQ ID NO: 9184380 - DNA, 22 bp, Homo sapiens
gaaagtttcttcattaagatgt

SEQ ID NO: 9184381 - DNA, 22 bp, Homo sapiens
gaaagtttgcctctctcttgag

SEQ ID NO: 9184382 - DNA, 22 bp, Homo sapiens
gaaagtttcttcattaagatgt

SEQ ID NO: 9184383 - DNA, 22 bp, Homo sapiens
gaaataacagctctggaagagt

SEQ ID NO: 9184384 - DNA, 22 bp, Homo sapiens
gaaataacctcatgcaccatga

SEQ ID NO: 9184385 - DNA, 22 bp, Homo sapiens
gaaataagagtccatgccaggt

SEQ ID NO: 9184386 - DNA, 22 bp, Homo sapiens
gaaataagagtccatgccaggt

SEQ ID NO: 9184387 - DNA, 22 bp, Homo sapiens
gaaataatacagtgctcttctc

SEQ ID NO: 9184388 - DNA, 22 bp, Homo sapiens
gaaatacaaatgcctagatcct

SEQ ID NO: 9184389 - DNA, 22 bp, Homo sapiens
gaaatacaaatgcctagatcct

SEQ ID NO: 9184390 - DNA, 22 bp, Homo sapiens
gaaatacaattttgtcccagct

SEQ ID NO: 9184391 - DNA, 22 bp, Homo sapiens
gaaatttacaactttctcatgg

SEQ ID NO: 9184392 - DNA, 22 bp, Homo sapiens
gaaatacagaaagggctgaatg

SEQ ID NO: 9184393 - DNA, 22 bp, Homo sapiens
gaaatttacaactttctcatgg

SEQ ID NO: 9184394 - DNA, 22 bp, Homo sapiens
gaacacaggtggcccggcaggg

SEQ ID NO: 9184395 - DNA, 22 bp, Homo sapiens
gaacacagtgtgatcgtatgtc

SEQ ID NO: 9184396 - DNA, 22 bp, Homo sapiens
gaacactgacattttcctgact

SEQ ID NO: 9184397 - DNA, 22 bp, Homo sapiens
gaacactgagaaagtcagcttt

SEQ ID NO: 9184398 - DNA, 22 bp, Homo sapiens
gaacactgagaaagtcagcttt

SEQ ID NO: 9184399 - DNA, 22 bp, Homo sapiens
gaacacatttctctgactgtag

SEQ ID NO: 9184400 - DNA, 22 bp, Homo sapiens
gaacacctgggtcccctggggc

SEQ ID NO: 9184401 - DNA, 18 bp, Homo sapiens
gaacagcaatttcatgtt

SEQ ID NO: 9184402 - DNA, 18 bp, Homo sapiens
gaacagcaatttcatgtt

SEQ ID NO: 9184403 - DNA, 22 bp, Homo sapiens
gaacagacttggaggagtgatc

SEQ ID NO: 9184404 - DNA, 22 bp, Homo sapiens
gaacagaattaccgaagatctg

SEQ ID NO: 9184405 - DNA, 22 bp, Homo sapiens
gaacagagctgactacaaggca

SEQ ID NO: 9184406 - DNA, 22 bp, Homo sapiens
gaacactgctgttgggttctga

SEQ ID NO: 9184407 - DNA, 22 bp, Homo sapiens
gaacactggggtatcattgagc

SEQ ID NO: 9184408 - DNA, 22 bp, Homo sapiens
gaacactgctgttgggttctga

SEQ ID NO: 9184409 - DNA, 22 bp, Homo sapiens
gaacactgaggacactgagaat

SEQ ID NO: 9184410 - DNA, 22 bp, Homo sapiens
gaacactgagagagatgggcag

SEQ ID NO: 9184411 - DNA, 22 bp, Homo sapiens
gaacagaattaccgaagatctg

SEQ ID NO: 9184412 - DNA, 22 bp, Homo sapiens
gaacagaattaccgaagatctg

SEQ ID NO: 9184413 - DNA, 22 bp, Homo sapiens
gaacagaattaccgaagatctg

SEQ ID NO: 9184414 - DNA, 22 bp, Homo sapiens
gaacacttggctttggatttaa

SEQ ID NO: 9184415 - DNA, 22 bp, Homo sapiens
gaacactgtttcttcgtgaaca

SEQ ID NO: 9184416 - DNA, 22 bp, Homo sapiens
gaacgggtgcagccatgggccc

SEQ ID NO: 9184417 - DNA, 22 bp, Homo sapiens
gaactacaggtgcagcaagtga

SEQ ID NO: 9184418 - DNA, 20 bp, Homo sapiens
gaacctggggaaggagtagg

SEQ ID NO: 9184419 - DNA, 22 bp, Homo sapiens
gaacctggcagccctatatctg

SEQ ID NO: 9184420 - DNA, 22 bp, Homo sapiens
gaacctgcttccttttatatta

SEQ ID NO: 9184421 - DNA, 22 bp, Homo sapiens
gaacctggaatctattacaagg

SEQ ID NO: 9184422 - DNA, 22 bp, Homo sapiens
gaacctggaatgtggcgcccaa

SEQ ID NO: 9184423 - DNA, 22 bp, Homo sapiens
gaactatatgtcttaaagcttt

SEQ ID NO: 9184424 - DNA, 22 bp, Homo sapiens
gaactgaagacttttactgtac

SEQ ID NO: 9184425 - DNA, 22 bp, Homo sapiens
gaactgagatttttgtctggct

SEQ ID NO: 9184426 - DNA, 22 bp, Homo sapiens
gaactggtcttttaggttttct

SEQ ID NO: 9184427 - DNA, 22 bp, Homo sapiens
gaactggtgaagtgaagggcag

SEQ ID NO: 9184428 - DNA, 22 bp, Homo sapiens
gaactggtcagtttagcccact

SEQ ID NO: 9184429 - DNA, 22 bp, Homo sapiens
gaactggtgagagttcacggga

SEQ ID NO: 9184430 - DNA, 22 bp, Homo sapiens
gaactggttacagagggatgtt

SEQ ID NO: 9184431 - DNA, 22 bp, Homo sapiens
cttctctgacagtctgtttcac

SEQ ID NO: 9184432 - DNA, 22 bp, Homo sapiens
cttctctctgcataggcatggg

SEQ ID NO: 9184433 - DNA, 22 bp, Homo sapiens
cttctctctgcataggcatggg

SEQ ID NO: 9184434 - DNA, 22 bp, Homo sapiens
cttctctctgcataggcatggg

SEQ ID NO: 9184435 - DNA, 22 bp, Homo sapiens
cttctcttcctttgtcaactga

SEQ ID NO: 9184436 - DNA, 22 bp, Homo sapiens
cttctcttcctttgtcaactga

SEQ ID NO: 9184437 - DNA, 22 bp, Homo sapiens
cttctcttcccagggacacagg

SEQ ID NO: 9184438 - DNA, 22 bp, Homo sapiens
cttctctgtgtagagattcaga

SEQ ID NO: 9184439 - DNA, 22 bp, Homo sapiens
cttctctggctcctcagcgccc

SEQ ID NO: 9184440 - DNA, 22 bp, Homo sapiens
cttctcttgggtgtggtgtctt

SEQ ID NO: 9184441 - DNA, 19 bp, Homo sapiens
cttgaaatgagactgaagg

SEQ ID NO: 9184442 - DNA, 22 bp, Homo sapiens
cttgaactcaatgtgaggaaga

SEQ ID NO: 9184443 - DNA, 19 bp, Homo sapiens
cttgaaatgagactgaagg

SEQ ID NO: 9184444 - DNA, 22 bp, Homo sapiens
cttgaaatccagatttcagagg

SEQ ID NO: 9184445 - DNA, 22 bp, Homo sapiens
cttgaaatgacaggagcacatc

SEQ ID NO: 9184446 - DNA, 22 bp, Homo sapiens
cttgaaatgacaggagcacatc

SEQ ID NO: 9184447 - DNA, 22 bp, Homo sapiens
cttgaaaataagaaagactttc

SEQ ID NO: 9184448 - DNA, 22 bp, Homo sapiens
cttcttttgaagggcgttgtgt

SEQ ID NO: 9184449 - DNA, 22 bp, Homo sapiens
cttgaaaaatatgccttgcttc

SEQ ID NO: 9184450 - DNA, 22 bp, Homo sapiens
cttcttttgaagggcgttgtgt

SEQ ID NO: 9184451 - DNA, 22 bp, Homo sapiens
cttcttttcatggcttgggaag

SEQ ID NO: 9184452 - DNA, 22 bp, Homo sapiens
cttcttttcatggcttgggaag

SEQ ID NO: 9184453 - DNA, 22 bp, Homo sapiens
cttctttcaagaatggattagg

SEQ ID NO: 9184454 - DNA, 22 bp, Homo sapiens
cttctttactttctagaaataa

SEQ ID NO: 9184455 - DNA, 22 bp, Homo sapiens
cttctttcccaggcatgtttta

SEQ ID NO: 9184456 - DNA, 22 bp, Homo sapiens
cttctttccttcctccagtggc

SEQ ID NO: 9184457 - DNA, 22 bp, Homo sapiens
cttctttcccaggcatgtttta

SEQ ID NO: 9184458 - DNA, 22 bp, Homo sapiens
cttctttcttttgatcacaggt

SEQ ID NO: 9184459 - DNA, 22 bp, Homo sapiens
cttctttgaaaaaggcagtcag

SEQ ID NO: 9184460 - DNA, 22 bp, Homo sapiens
cttctttcttttgatcacaggt

SEQ ID NO: 9184461 - DNA, 22 bp, Homo sapiens
cttcttttacaggtcttgggtt

SEQ ID NO: 9184462 - DNA, 22 bp, Homo sapiens
cttctttgaaaaaggcagtcag

SEQ ID NO: 9184463 - DNA, 22 bp, Homo sapiens
ctggctctgtgggacctggcct

SEQ ID NO: 9184464 - DNA, 22 bp, Homo sapiens
ctggctggagctgttgtaggct

SEQ ID NO: 9184465 - DNA, 22 bp, Homo sapiens
ctggctggagctgttgtaggct

SEQ ID NO: 9184466 - DNA, 22 bp, Homo sapiens
ctggctgggagctcgcctgcgg

SEQ ID NO: 9184467 - DNA, 22 bp, Homo sapiens
ctggctggaggtgagtcactga

SEQ ID NO: 9184468 - DNA, 22 bp, Homo sapiens
ctggctggaggtgagtcactga

SEQ ID NO: 9184469 - DNA, 22 bp, Homo sapiens
ctggctggagtgcaggtgagtg

SEQ ID NO: 9184470 - DNA, 22 bp, Homo sapiens
ctggctggggccttagataaga

SEQ ID NO: 9184471 - DNA, 22 bp, Homo sapiens
ctggctggggaagtcatttgat

SEQ ID NO: 9184472 - DNA, 22 bp, Homo sapiens
ctggctggggtaccagttgaac

SEQ ID NO: 9184473 - DNA, 22 bp, Homo sapiens
ctggctggggtaccagttgaac

SEQ ID NO: 9184474 - DNA, 22 bp, Homo sapiens
ctggctgggccatttctttagg

SEQ ID NO: 9184475 - DNA, 22 bp, Homo sapiens
ctggctgggcagacagaatgct

SEQ ID NO: 9184476 - DNA, 22 bp, Homo sapiens
ctggctgggcagacagaatgct

SEQ ID NO: 9184477 - DNA, 22 bp, Homo sapiens
ctggctgggattttaaagagca

SEQ ID NO: 9184478 - DNA, 22 bp, Homo sapiens
ctggctgggattttaaagagca

SEQ ID NO: 9184479 - DNA, 22 bp, Homo sapiens
ctggctggtcctcggggacagc

SEQ ID NO: 9184480 - DNA, 22 bp, Homo sapiens
ctggctggtcctcggggacagc

SEQ ID NO: 9184481 - DNA, 22 bp, Homo sapiens
ctggctggtcctcggggacagc

SEQ ID NO: 9184482 - DNA, 22 bp, Homo sapiens
ctggctggtcctcggggacagc

SEQ ID NO: 9184483 - DNA, 22 bp, Homo sapiens
ctggctggtcatgtcatgagcc

SEQ ID NO: 9184484 - DNA, 22 bp, Homo sapiens
ctggctggtcatcagcagtacg

SEQ ID NO: 9184485 - DNA, 22 bp, Homo sapiens
ctggctggtcatgtcatgagcc

SEQ ID NO: 9184486 - DNA, 22 bp, Homo sapiens
ctggctggtcatgtcatgagcc

SEQ ID NO: 9184487 - DNA, 22 bp, Homo sapiens
ctggctggtcatcagcagtacg

SEQ ID NO: 9184488 - DNA, 22 bp, Homo sapiens
ctggctggtagaattgtgacct

SEQ ID NO: 9184489 - DNA, 22 bp, Homo sapiens
ctggctggtagaattgtgacct

SEQ ID NO: 9184490 - DNA, 22 bp, Homo sapiens
ctggctggtaatggaacgacag

SEQ ID NO: 9184491 - DNA, 22 bp, Homo sapiens
ctggctggtaatggaacgacag

SEQ ID NO: 9184492 - DNA, 22 bp, Homo sapiens
ctggctgggttccaggattcca

SEQ ID NO: 9184493 - DNA, 22 bp, Homo sapiens
ctggctgggttccaggattcca

SEQ ID NO: 9184494 - DNA, 22 bp, Homo sapiens
ctggctggggtccatcctctaa

SEQ ID NO: 9184495 - DNA, 22 bp, Homo sapiens
ctggctggggtccatcctctaa

SEQ ID NO: 9184496 - DNA, 22 bp, Homo sapiens
cttctcagttgcaagtgtcaga

SEQ ID NO: 9184497 - DNA, 22 bp, Homo sapiens
cttctcagttgcaagtgtcaga

SEQ ID NO: 9184498 - DNA, 22 bp, Homo sapiens
cttctcagtcttggttagagag

SEQ ID NO: 9184499 - DNA, 22 bp, Homo sapiens
cttctcagtcacctgtgagtct

SEQ ID NO: 9184500 - DNA, 22 bp, Homo sapiens
cttctcggggttcccgcgccct

SEQ ID NO: 9184501 - DNA, 22 bp, Homo sapiens
cttctctatgatgttctaaggt

SEQ ID NO: 9184502 - DNA, 22 bp, Homo sapiens
cttctctccctggcactcagac

SEQ ID NO: 9184503 - DNA, 22 bp, Homo sapiens
cttctctcggtgcatccctcac

SEQ ID NO: 9184504 - DNA, 22 bp, Homo sapiens
cttctctcggtgcatccctcac

SEQ ID NO: 9184505 - DNA, 22 bp, Homo sapiens
ctggctggttccctgctccagg

SEQ ID NO: 9184506 - DNA, 22 bp, Homo sapiens
ctggctggttccctgctccagg

SEQ ID NO: 9184507 - DNA, 22 bp, Homo sapiens
ctggctggttccctgctccagg

SEQ ID NO: 9184508 - DNA, 22 bp, Homo sapiens
ctggctggttactatttctggt

SEQ ID NO: 9184509 - DNA, 22 bp, Homo sapiens
ctggctggttactatttctggt

SEQ ID NO: 9184510 - DNA, 22 bp, Homo sapiens
ctggctggtctgagcagtcgca

SEQ ID NO: 9184511 - DNA, 22 bp, Homo sapiens
ctggctggtctgagcagtcgca

SEQ ID NO: 9184512 - DNA, 22 bp, Homo sapiens
ctggctggtctgagcagtcgca

SEQ ID NO: 9184513 - DNA, 22 bp, Homo sapiens
ctggctggtttttaaagctagg

SEQ ID NO: 9184514 - DNA, 22 bp, Homo sapiens
ctggctgtaagcgtgtttccta

SEQ ID NO: 9184515 - DNA, 22 bp, Homo sapiens
ctggctggttggggagaagaca

SEQ ID NO: 9184516 - DNA, 22 bp, Homo sapiens
ctggctggttggggagaagaca

SEQ ID NO: 9184517 - DNA, 22 bp, Homo sapiens
ctggctggttgtctcaatccag

SEQ ID NO: 9184518 - DNA, 22 bp, Homo sapiens
ctggctgtattagtttgatcct

SEQ ID NO: 9184519 - DNA, 22 bp, Homo sapiens
ctggctgtattagtttgatcct

SEQ ID NO: 9184520 - DNA, 22 bp, Homo sapiens
ctttatatccagatgtttggtg

SEQ ID NO: 9184521 - DNA, 22 bp, Homo sapiens
ctttatatattcccaggctgcc

SEQ ID NO: 9184522 - DNA, 19 bp, Homo sapiens
ctttgtcagaacatgcttc

SEQ ID NO: 9184523 - DNA, 19 bp, Homo sapiens
ctttgtcagaacatgcttc

SEQ ID NO: 9184524 - DNA, 22 bp, Homo sapiens
ctttgtaagtctttctccaaga

SEQ ID NO: 9184525 - DNA, 22 bp, Homo sapiens
ctttgtagctgcttctgattta

SEQ ID NO: 9184526 - DNA, 22 bp, Homo sapiens
ctttggcagcctctgctattga

SEQ ID NO: 9184527 - DNA, 22 bp, Homo sapiens
ctttggcagcctcagctgcagg

SEQ ID NO: 9184528 - DNA, 22 bp, Homo sapiens
ctttagttgttatttcttcaca

SEQ ID NO: 9184529 - DNA, 22 bp, Homo sapiens
ctttagtgttgttgtgaggatt

SEQ ID NO: 9184530 - DNA, 20 bp, Homo sapiens
ctttagttacacgtttcctc

SEQ ID NO: 9184531 - DNA, 21 bp, Homo sapiens
ctttagtgaaaaggggctaac

SEQ ID NO: 9184532 - DNA, 18 bp, Homo sapiens
ctttagctgtcatctttg

SEQ ID NO: 9184533 - DNA, 22 bp, Homo sapiens
ctttagaatttgatataatcaa

SEQ ID NO: 9184534 - DNA, 22 bp, Homo sapiens
ctttagaatttcatgtttggtc

SEQ ID NO: 9184535 - DNA, 22 bp, Homo sapiens
ctttagaatttgatataatcaa

SEQ ID NO: 9184536 - DNA, 22 bp, Homo sapiens
cttggctgaactccaggatgca

SEQ ID NO: 9184537 - DNA, 22 bp, Homo sapiens
cttggctgaactccaggatgca

SEQ ID NO: 9184538 - DNA, 22 bp, Homo sapiens
cttggctgtaaaatcagaggct

SEQ ID NO: 9184539 - DNA, 22 bp, Homo sapiens
cttggctggaactcctgagaaa

SEQ ID NO: 9184540 - DNA, 22 bp, Homo sapiens
cttggctggaactcctgagaaa

SEQ ID NO: 9184541 - DNA, 22 bp, Homo sapiens
cttggctgcttttgtgcacatt

SEQ ID NO: 9184542 - DNA, 22 bp, Homo sapiens
cttggctgcttttgtgcacatt

SEQ ID NO: 9184543 - DNA, 22 bp, Homo sapiens
cttgggaatgctaacagatgac

SEQ ID NO: 9184544 - DNA, 22 bp, Homo sapiens
cttgggaagtgtttaaagctga

SEQ ID NO: 9184545 - DNA, 22 bp, Homo sapiens
cttggctgttgggcattgagaa

SEQ ID NO: 9184546 - DNA, 22 bp, Homo sapiens
cttggctttagaacatgggagc

SEQ ID NO: 9184547 - DNA, 19 bp, Homo sapiens
cttggcttagcttcttagc

SEQ ID NO: 9184548 - DNA, 22 bp, Homo sapiens
cttggctgtcataaggtcctgg

SEQ ID NO: 9184549 - DNA, 22 bp, Homo sapiens
cttggctgtctataggaaagag

SEQ ID NO: 9184550 - DNA, 22 bp, Homo sapiens
cttggctgtcataaggtcctgg

SEQ ID NO: 9184551 - DNA, 22 bp, Homo sapiens
cttggattcattgtgggaggga

SEQ ID NO: 9184552 - DNA, 22 bp, Homo sapiens
cttgaagtttgcttagattcct

SEQ ID NO: 9184553 - DNA, 22 bp, Homo sapiens
cttgaatgtaaataatgtacag

SEQ ID NO: 9184554 - DNA, 22 bp, Homo sapiens
cttgaatggtatgagagtaatt

SEQ ID NO: 9184555 - DNA, 22 bp, Homo sapiens
cttgaatctggctttgccactt

SEQ ID NO: 9184556 - DNA, 22 bp, Homo sapiens
cttgaagttgcaaaacattaat

SEQ ID NO: 9184557 - DNA, 22 bp, Homo sapiens
cttgaagtggatgttggtataa

SEQ ID NO: 9184558 - DNA, 22 bp, Homo sapiens
cttgaagtgcctgagtcttatc

SEQ ID NO: 9184559 - DNA, 22 bp, Homo sapiens
cttgaagtaagacagctctgga

SEQ ID NO: 9184560 - DNA, 22 bp, Homo sapiens
cttgaagtggagcttttgaaat

SEQ ID NO: 9184561 - DNA, 22 bp, Homo sapiens
cttgaaggacagcatctccgag

SEQ ID NO: 9184562 - DNA, 22 bp, Homo sapiens
cttggggaagccactgatccct

SEQ ID NO: 9184563 - DNA, 22 bp, Homo sapiens
cttggggaggacgcagtgtcct

SEQ ID NO: 9184564 - DNA, 22 bp, Homo sapiens
cttggggatgcaaagccagtgt

SEQ ID NO: 9184565 - DNA, 22 bp, Homo sapiens
cttgggggccattaaggggcct

SEQ ID NO: 9184566 - DNA, 22 bp, Homo sapiens
cttgggagtagaggcaggagca

SEQ ID NO: 9184567 - DNA, 22 bp, Homo sapiens
cttgggagacacaagaagacat

SEQ ID NO: 9184568 - DNA, 22 bp, Homo sapiens
cttgggaggagaacaaagctcc

SEQ ID NO: 9184569 - DNA, 22 bp, Homo sapiens
tgcatcagaggatagctgcagt

SEQ ID NO: 9184570 - DNA, 22 bp, Homo sapiens
tgcatcagaggatagctgcagt

SEQ ID NO: 9184571 - DNA, 22 bp, Homo sapiens
tgcatcacttagctgcacaact

SEQ ID NO: 9184572 - DNA, 20 bp, Homo sapiens
tgcattaagtggcattgagc

SEQ ID NO: 9184573 - DNA, 22 bp, Homo sapiens
cccagctgtggcagaggccggg

SEQ ID NO: 9184574 - DNA, 22 bp, Homo sapiens
cccaggaaaagcagtgccagca

SEQ ID NO: 9184575 - DNA, 22 bp, Homo sapiens
cccaggaaaagcagtgccagca

SEQ ID NO: 9184576 - DNA, 22 bp, Homo sapiens
cccaggaaacccgaaggcgacc

SEQ ID NO: 9184577 - DNA, 22 bp, Homo sapiens
cccaggaaacccgaaggcgacc

SEQ ID NO: 9184578 - DNA, 22 bp, Homo sapiens
tgcatcaaattctgaaattagc

SEQ ID NO: 9184579 - DNA, 22 bp, Homo sapiens
cccaggaaagagactgctgggt

SEQ ID NO: 9184580 - DNA, 22 bp, Homo sapiens
cccagctcttttagcggcatct

SEQ ID NO: 9184581 - DNA, 22 bp, Homo sapiens
cccagctcttcctgggagctaa

SEQ ID NO: 9184582 - DNA, 22 bp, Homo sapiens
cccagctcttcaagtcaccccc

SEQ ID NO: 9184583 - DNA, 22 bp, Homo sapiens
cccagctgatttttgcagagat

SEQ ID NO: 9184584 - DNA, 18 bp, Homo sapiens
cccagctggtgggtcagt

SEQ ID NO: 9184585 - DNA, 18 bp, Homo sapiens
cccagctggtgggtcagt

SEQ ID NO: 9184586 - DNA, 18 bp, Homo sapiens
cccagctggtgggtcagt

SEQ ID NO: 9184587 - DNA, 22 bp, Homo sapiens
cccagctggccaggtggctttg

SEQ ID NO: 9184588 - DNA, 23 bp, Homo sapiens
cccagctggaagttagaggacca

SEQ ID NO: 9184589 - DNA, 23 bp, Homo sapiens
cccagctgcagacaagggagggt

SEQ ID NO: 9184590 - DNA, 23 bp, Homo sapiens
cccagctgcagacaagggagggt

SEQ ID NO: 9184591 - DNA, 22 bp, Homo sapiens
tgcagggagctctggggtgcag

SEQ ID NO: 9184592 - DNA, 22 bp, Homo sapiens
tgcagggaccccgaggctctct

SEQ ID NO: 9184593 - DNA, 22 bp, Homo sapiens
tgcagggagctctggggtgcag

SEQ ID NO: 9184594 - DNA, 22 bp, Homo sapiens
tgcagggacacgaagacaaata

SEQ ID NO: 9184595 - DNA, 22 bp, Homo sapiens
tgcagggacaggctctggggat

SEQ ID NO: 9184596 - DNA, 22 bp, Homo sapiens
tgcagggacaggctctggggat

SEQ ID NO: 9184597 - DNA, 22 bp, Homo sapiens
tgcagggaccccgaggctctct

SEQ ID NO: 9184598 - DNA, 22 bp, Homo sapiens
tgcagggaccccgaggctctct

SEQ ID NO: 9184599 - DNA, 22 bp, Homo sapiens
tgcagggaccccgaggctctct

SEQ ID NO: 9184600 - DNA, 22 bp, Homo sapiens
tgcagggagggcccagcaatct

SEQ ID NO: 9184601 - DNA, 22 bp, Homo sapiens
tgcagggaggccccgcagccct

SEQ ID NO: 9184602 - DNA, 22 bp, Homo sapiens
tgcagggaggccccgcagccct

SEQ ID NO: 9184603 - DNA, 22 bp, Homo sapiens
tgcagggaggccccgcagccct

SEQ ID NO: 9184604 - DNA, 22 bp, Homo sapiens
tgcagggaatgcttgcagcatg

SEQ ID NO: 9184605 - DNA, 22 bp, Homo sapiens
tgcagggaatctgtggctggac

SEQ ID NO: 9184606 - DNA, 22 bp, Homo sapiens
tgcagggaatctgtggctggac

SEQ ID NO: 9184607 - DNA, 22 bp, Homo sapiens
tgcagggacacgaagacaaata

SEQ ID NO: 9184608 - DNA, 22 bp, Homo sapiens
tgcagggacacgaagacaaata

SEQ ID NO: 9184609 - DNA, 22 bp, Homo sapiens
tgcagggaatgcttgcagcatg

SEQ ID NO: 9184610 - DNA, 22 bp, Homo sapiens
tgcagggaatgcttgcagcatg

SEQ ID NO: 9184611 - DNA, 22 bp, Homo sapiens
tgcagggaatgcttgcagcatg

SEQ ID NO: 9184612 - DNA, 23 bp, Homo sapiens
cccagcgctgagccctgcaggca

SEQ ID NO: 9184613 - DNA, 22 bp, Homo sapiens
cccagctcaagcagagagctaa

SEQ ID NO: 9184614 - DNA, 22 bp, Homo sapiens
cccagcgagtttgccggtgaac

SEQ ID NO: 9184615 - DNA, 22 bp, Homo sapiens
tctgtggcccaagtgatggctg

SEQ ID NO: 9184616 - DNA, 22 bp, Homo sapiens
tctgtggcctccttccacttac

SEQ ID NO: 9184617 - DNA, 22 bp, Homo sapiens
tctgtggcatgttgcacttgta

SEQ ID NO: 9184618 - DNA, 19 bp, Homo sapiens
tctgtggccttccctgatg

SEQ ID NO: 9184619 - DNA, 22 bp, Homo sapiens
tctgtggcctgcctcctcattt

SEQ ID NO: 9184620 - DNA, 22 bp, Homo sapiens
tctgtggcctgtgtccaagtgc

SEQ ID NO: 9184621 - DNA, 21 bp, Homo sapiens
tctgtggcggactctaggccc

SEQ ID NO: 9184622 - DNA, 22 bp, Homo sapiens
cccagccttccaccctggacta

SEQ ID NO: 9184623 - DNA, 22 bp, Homo sapiens
cccagcctttgcttcctggttc

SEQ ID NO: 9184624 - DNA, 22 bp, Homo sapiens
cccagcctttgcttcctggttc

SEQ ID NO: 9184625 - DNA, 22 bp, Homo sapiens
cccagccttccaccctggacta

SEQ ID NO: 9184626 - DNA, 22 bp, Homo sapiens
cccaggagggtggcctctgccc

SEQ ID NO: 9184627 - DNA, 22 bp, Homo sapiens
cccaggagggtggcctctgccc

SEQ ID NO: 9184628 - DNA, 22 bp, Homo sapiens
cccaggaggtggaggctgcagt

SEQ ID NO: 9184629 - DNA, 22 bp, Homo sapiens
cccaggaggtggaggctgcagt

SEQ ID NO: 9184630 - DNA, 22 bp, Homo sapiens
cccaggaggtggaggttgcagc

SEQ ID NO: 9184631 - DNA, 22 bp, Homo sapiens
cccaggaggtggaggttgcagt

SEQ ID NO: 9184632 - DNA, 22 bp, Homo sapiens
tgccaggcctcaggagtctcca

SEQ ID NO: 9184633 - DNA, 22 bp, Homo sapiens
tgccaggcctcaggagtctcca

SEQ ID NO: 9184634 - DNA, 22 bp, Homo sapiens
tgcattatcatctggaagcttg

SEQ ID NO: 9184635 - DNA, 22 bp, Homo sapiens
tgccaagataacacagctagta

SEQ ID NO: 9184636 - DNA, 22 bp, Homo sapiens
tgccaagattatcgaagtctta

SEQ ID NO: 9184637 - DNA, 22 bp, Homo sapiens
tgccaaggagctggatcagggc

SEQ ID NO: 9184638 - DNA, 22 bp, Homo sapiens
tgcattcaatgtgccagggaaa

SEQ ID NO: 9184639 - DNA, 22 bp, Homo sapiens
tgccaagtttctctcagggact

SEQ ID NO: 9184640 - DNA, 22 bp, Homo sapiens
tgccaatcagctttgcaacttg

SEQ ID NO: 9184641 - DNA, 22 bp, Homo sapiens
tgccaatctttgtgataattgc

SEQ ID NO: 9184642 - DNA, 22 bp, Homo sapiens
tgccaatccactgcagccacag

SEQ ID NO: 9184643 - DNA, 22 bp, Homo sapiens
tgccaatcagctttgcaacttg

SEQ ID NO: 9184644 - DNA, 22 bp, Homo sapiens
tgccaatctggtgggtgcaaat

SEQ ID NO: 9184645 - DNA, 23 bp, Homo sapiens
tgccacaagatctgtgaataaga

SEQ ID NO: 9184646 - DNA, 22 bp, Homo sapiens
tgccaagtggagctcaggaatc

SEQ ID NO: 9184647 - DNA, 22 bp, Homo sapiens
tgccaagggtatgggcaagata

SEQ ID NO: 9184648 - DNA, 22 bp, Homo sapiens
tgccacagagactttcattgta

SEQ ID NO: 9184649 - DNA, 22 bp, Homo sapiens
tgccacactcccctgctgcagt

SEQ ID NO: 9184650 - DNA, 22 bp, Homo sapiens
tgccacactcacttctgtggac

SEQ ID NO: 9184651 - DNA, 22 bp, Homo sapiens
tgccacacaattactgctgcta

SEQ ID NO: 9184652 - DNA, 22 bp, Homo sapiens
tgccacacaattactgctgcta

SEQ ID NO: 9184653 - DNA, 22 bp, Homo sapiens
cccaggcagccccagaagcttg

SEQ ID NO: 9184654 - DNA, 22 bp, Homo sapiens
cccaggcagcccttctgacgca

SEQ ID NO: 9184655 - DNA, 22 bp, Homo sapiens
cccaggcagccccagaagcttg

SEQ ID NO: 9184656 - DNA, 22 bp, Homo sapiens
cccaggcagcggggtctccttg

SEQ ID NO: 9184657 - DNA, 22 bp, Homo sapiens
cccaggcagcggggtctccttg

SEQ ID NO: 9184658 - DNA, 22 bp, Homo sapiens
cccaggcagcctgcagggaagg

SEQ ID NO: 9184659 - DNA, 22 bp, Homo sapiens
cccaggcagcctgcagggaagg

SEQ ID NO: 9184660 - DNA, 16 bp, Homo sapiens
tgcctgctctgatctc

SEQ ID NO: 9184661 - DNA, 19 bp, Homo sapiens
tgcctgctcctggcttcca

SEQ ID NO: 9184662 - DNA, 22 bp, Homo sapiens
cccaggcagtgctgatccctca

SEQ ID NO: 9184663 - DNA, 22 bp, Homo sapiens
cccaggcagtagaaagaagagg

SEQ ID NO: 9184664 - DNA, 22 bp, Homo sapiens
cccaggcagggacgtgctctgg

SEQ ID NO: 9184665 - DNA, 22 bp, Homo sapiens
cccaggcagtagaaagaagagg

SEQ ID NO: 9184666 - DNA, 22 bp, Homo sapiens
cccaggcagtagaaagaagagg

SEQ ID NO: 9184667 - DNA, 22 bp, Homo sapiens
cccaggcaggagtgtggtggct

SEQ ID NO: 9184668 - DNA, 22 bp, Homo sapiens
cccaggcaggagtgtggtggct

SEQ ID NO: 9184669 - DNA, 22 bp, Homo sapiens
cccaggcagaattagtgtttca

SEQ ID NO: 9184670 - DNA, 22 bp, Homo sapiens
cccaggcactcttggtcatttt

SEQ ID NO: 9184671 - DNA, 22 bp, Homo sapiens
cccaggcactcttggtcatttt

SEQ ID NO: 9184672 - DNA, 22 bp, Homo sapiens
cccaggcagagagctggtgagc

SEQ ID NO: 9184673 - DNA, 22 bp, Homo sapiens
cccaggcagagagctggtgagc

SEQ ID NO: 9184674 - DNA, 22 bp, Homo sapiens
cccaggcagagagctggtgagc

SEQ ID NO: 9184675 - DNA, 22 bp, Homo sapiens
cccaggcacatccactctgtga

SEQ ID NO: 9184676 - DNA, 22 bp, Homo sapiens
cccaggatgtcgaggctgcagt

SEQ ID NO: 9184677 - DNA, 21 bp, Homo sapiens
tgccaggcctgagctggggtc

SEQ ID NO: 9184678 - DNA, 22 bp, Homo sapiens
tgccaggcgattgctatcagca

SEQ ID NO: 9184679 - DNA, 22 bp, Homo sapiens
tgccaggcgtggtggtgcgcac

SEQ ID NO: 9184680 - DNA, 22 bp, Homo sapiens
tgccaggcgtggtggtgcgcac

SEQ ID NO: 9184681 - DNA, 22 bp, Homo sapiens
tgccaggcgtggtggtgcgcac

SEQ ID NO: 9184682 - DNA, 22 bp, Homo sapiens
tgccaggctaagtggaggactt

SEQ ID NO: 9184683 - DNA, 22 bp, Homo sapiens
ccccagggaagctttgcttact

SEQ ID NO: 9184684 - DNA, 22 bp, Homo sapiens
tgctggagcatctgagagcatc

SEQ ID NO: 9184685 - DNA, 22 bp, Homo sapiens
tgctggagaggaaggtggggtc

SEQ ID NO: 9184686 - DNA, 22 bp, Homo sapiens
tgctggagagctagttctgcag

SEQ ID NO: 9184687 - DNA, 22 bp, Homo sapiens
tgctggagagctagttctgcag

SEQ ID NO: 9184688 - DNA, 22 bp, Homo sapiens
tgctggagaggaaggtggggtc

SEQ ID NO: 9184689 - DNA, 22 bp, Homo sapiens
ccccagcccacaagcatattaa

SEQ ID NO: 9184690 - DNA, 22 bp, Homo sapiens
ccccagcccacaagcatattaa

SEQ ID NO: 9184691 - DNA, 22 bp, Homo sapiens
ccccagcccacaagcatattaa

SEQ ID NO: 9184692 - DNA, 22 bp, Homo sapiens
ccccagccttccatgggaattg

SEQ ID NO: 9184693 - DNA, 22 bp, Homo sapiens
ccccagccttccatgggaattg

SEQ ID NO: 9184694 - DNA, 23 bp, Homo sapiens
tgctggagacaagtgtgagaagg

SEQ ID NO: 9184695 - DNA, 22 bp, Homo sapiens
tgctggagacctgcttgcacca

SEQ ID NO: 9184696 - DNA, 22 bp, Homo sapiens
tgctggagacctgcttgcacca

SEQ ID NO: 9184697 - DNA, 22 bp, Homo sapiens
tgctggagactcactcaggtgc

SEQ ID NO: 9184698 - DNA, 22 bp, Homo sapiens
tgctggagactcactcaggtgc

SEQ ID NO: 9184699 - DNA, 22 bp, Homo sapiens
tgctggagacatagcaggcagc

SEQ ID NO: 9184700 - DNA, 22 bp, Homo sapiens
ccccagcagactcagggcaggt

SEQ ID NO: 9184701 - DNA, 22 bp, Homo sapiens
ccccagccagcttgtagtagaa

SEQ ID NO: 9184702 - DNA, 22 bp, Homo sapiens
ccccagccagcttgtagtagaa

SEQ ID NO: 9184703 - DNA, 22 bp, Homo sapiens
ccccagccagcaggacctctga

SEQ ID NO: 9184704 - DNA, 22 bp, Homo sapiens
ccccagccagcaggacctctga

SEQ ID NO: 9184705 - DNA, 22 bp, Homo sapiens
ccccagccagcttgtagtagaa

SEQ ID NO: 9184706 - DNA, 22 bp, Homo sapiens
ccccagccagcaggacctctga

SEQ ID NO: 9184707 - DNA, 22 bp, Homo sapiens
ccccagcatatcatggtttcgt

SEQ ID NO: 9184708 - DNA, 22 bp, Homo sapiens
tgctgcagcggcatggtctttg

SEQ ID NO: 9184709 - DNA, 22 bp, Homo sapiens
tgctgcagcggcatggtctttg

SEQ ID NO: 9184710 - DNA, 22 bp, Homo sapiens
tgctgcagatcagctgagtcct

SEQ ID NO: 9184711 - DNA, 22 bp, Homo sapiens
tgctgcagagaatgttttggcc

SEQ ID NO: 9184712 - DNA, 17 bp, Homo sapiens
tgctgcagacccacccc

SEQ ID NO: 9184713 - DNA, 22 bp, Homo sapiens
tgctgcaggaattctcaaggga

SEQ ID NO: 9184714 - DNA, 22 bp, Homo sapiens
tgctgcagctttgtcacatgca

SEQ ID NO: 9184715 - DNA, 22 bp, Homo sapiens
cccccaggggctccgcctcgtg

SEQ ID NO: 9184716 - DNA, 22 bp, Homo sapiens
cccccaggggctccgcctcgtg

SEQ ID NO: 9184717 - DNA, 22 bp, Homo sapiens
cccccaggggctccgcctcgtg

SEQ ID NO: 9184718 - DNA, 22 bp, Homo sapiens
ccccctgcgcccggcacgtcat

SEQ ID NO: 9184719 - DNA, 21 bp, Homo sapiens
cccctcatacactctccttgc

SEQ ID NO: 9184720 - DNA, 22 bp, Homo sapiens
cccctcaggtacccgtgcagca

SEQ ID NO: 9184721 - DNA, 22 bp, Homo sapiens
cccccaccgtgttcctgctcgg

SEQ ID NO: 9184722 - DNA, 18 bp, Homo sapiens
cccccagccaaattctct

SEQ ID NO: 9184723 - DNA, 22 bp, Homo sapiens
cccccagccagcagtgctcagc

SEQ ID NO: 9184724 - DNA, 22 bp, Homo sapiens
cccccagctctgctgggtcccg

SEQ ID NO: 9184725 - DNA, 22 bp, Homo sapiens
cccccagctctgctgggtcccg

SEQ ID NO: 9184726 - DNA, 22 bp, Homo sapiens
cccccaggctctgacacaggag

SEQ ID NO: 9184727 - DNA, 22 bp, Homo sapiens
cccccagccagcagtgctcagc

SEQ ID NO: 9184728 - DNA, 22 bp, Homo sapiens
cccccacctgaggacagtctta

SEQ ID NO: 9184729 - DNA, 22 bp, Homo sapiens
cccccaaagtttgcacggataa

SEQ ID NO: 9184730 - DNA, 22 bp, Homo sapiens
cccctcctgcagcacctttctt

SEQ ID NO: 9184731 - DNA, 22 bp, Homo sapiens
cccctcctggccacactgtcag

SEQ ID NO: 9184732 - DNA, 22 bp, Homo sapiens
cccctcctggccacactgtcag

SEQ ID NO: 9184733 - DNA, 22 bp, Homo sapiens
cccctctccctcacttatcaat

SEQ ID NO: 9184734 - DNA, 22 bp, Homo sapiens
cccctctccctcacttatcaat

SEQ ID NO: 9184735 - DNA, 22 bp, Homo sapiens
cccctctccctcacttatcaat

SEQ ID NO: 9184736 - DNA, 20 bp, Homo sapiens
ccctaggaacgcagcaggag

SEQ ID NO: 9184737 - DNA, 22 bp, Homo sapiens
ccctcagggaccactgacttca

SEQ ID NO: 9184738 - DNA, 22 bp, Homo sapiens
ccctcaggagatgtcagctgga

SEQ ID NO: 9184739 - DNA, 22 bp, Homo sapiens
ccctcagcttctccctgcagct

SEQ ID NO: 9184740 - DNA, 22 bp, Homo sapiens
ccctcagcttctccctgcagct

SEQ ID NO: 9184741 - DNA, 22 bp, Homo sapiens
ccctcagcttctccctgcagct

SEQ ID NO: 9184742 - DNA, 22 bp, Homo sapiens
ccctcagctccaccctcagcag

SEQ ID NO: 9184743 - DNA, 21 bp, Homo sapiens
ccctcaggaaacagaatgcac

SEQ ID NO: 9184744 - DNA, 22 bp, Homo sapiens
ccctcagcttctccctgcagct

SEQ ID NO: 9184745 - DNA, 21 bp, Homo sapiens
ccctcaggaaacagaatgcac

SEQ ID NO: 9184746 - DNA, 22 bp, Homo sapiens
tgcctgctcttaccactctccc

SEQ ID NO: 9184747 - DNA, 22 bp, Homo sapiens
tgcctgctctgtgccacagttg

SEQ ID NO: 9184748 - DNA, 22 bp, Homo sapiens
tgcctgctcttaccactctccc

SEQ ID NO: 9184749 - DNA, 22 bp, Homo sapiens
tgcctgggagtgaccaagactc

SEQ ID NO: 9184750 - DNA, 22 bp, Homo sapiens
tgcctgggacatgctgtggact

SEQ ID NO: 9184751 - DNA, 22 bp, Homo sapiens
tgcctgggcctctgaggaaggc

SEQ ID NO: 9184752 - DNA, 22 bp, Homo sapiens
tgcctgggcctctgaggaaggc

SEQ ID NO: 9184753 - DNA, 22 bp, Homo sapiens
tgcctgggatctgtgccctttg

SEQ ID NO: 9184754 - DNA, 22 bp, Homo sapiens
cccaggctcctagaggcccaga

SEQ ID NO: 9184755 - DNA, 22 bp, Homo sapiens
cccaggctcctagaggcccaga

SEQ ID NO: 9184756 - DNA, 22 bp, Homo sapiens
cccaggctcctagaggcccaga

SEQ ID NO: 9184757 - DNA, 22 bp, Homo sapiens
tgctccagtgcctgccccacag

SEQ ID NO: 9184758 - DNA, 22 bp, Homo sapiens
tgctccatgcgctcggccggcg

SEQ ID NO: 9184759 - DNA, 22 bp, Homo sapiens
tgctcccaaacctgacaggctc

SEQ ID NO: 9184760 - DNA, 22 bp, Homo sapiens
tgctccattctctagccagtgc

SEQ ID NO: 9184761 - DNA, 22 bp, Homo sapiens
tgctccagtgagctggccatcc

SEQ ID NO: 9184762 - DNA, 22 bp, Homo sapiens
tgctccagtgagctggccatcc

SEQ ID NO: 9184763 - DNA, 22 bp, Homo sapiens
tgctccagggctgccagaccct

SEQ ID NO: 9184764 - DNA, 22 bp, Homo sapiens
cccaggctcctgctgtgttgac

SEQ ID NO: 9184765 - DNA, 22 bp, Homo sapiens
cccaggctcctgactcattcta

SEQ ID NO: 9184766 - DNA, 22 bp, Homo sapiens
cccaggctcctgactcattcta

SEQ ID NO: 9184767 - DNA, 22 bp, Homo sapiens
cccaggctcctgactcattcta

SEQ ID NO: 9184768 - DNA, 22 bp, Homo sapiens
cccaggctcttatgtgacttgc

SEQ ID NO: 9184769 - DNA, 21 bp, Homo sapiens
cccaggctgaattaaaaatat

SEQ ID NO: 9184770 - DNA, 22 bp, Homo sapiens
tgctgagataagctatgaccag

SEQ ID NO: 9184771 - DNA, 21 bp, Homo sapiens
tgctgacatcaggtctgctat

SEQ ID NO: 9184772 - DNA, 22 bp, Homo sapiens
tgctgaatggtaaagaagtata

SEQ ID NO: 9184773 - DNA, 17 bp, Homo sapiens
tgctgacagctgtgtgt

SEQ ID NO: 9184774 - DNA, 17 bp, Homo sapiens
tgctgacagctgtgtgt

SEQ ID NO: 9184775 - DNA, 22 bp, Homo sapiens
tgctgaagttactagagactat

SEQ ID NO: 9184776 - DNA, 22 bp, Homo sapiens
tgctgaagttactagagactat

SEQ ID NO: 9184777 - DNA, 22 bp, Homo sapiens
tgctgaagttcttcccctaatg

SEQ ID NO: 9184778 - DNA, 19 bp, Homo sapiens
tgctgaagttgtcagtctg

SEQ ID NO: 9184779 - DNA, 22 bp, Homo sapiens
tgctcccacactactcggaggc

SEQ ID NO: 9184780 - DNA, 22 bp, Homo sapiens
tgctcccaaacgacctactgtg

SEQ ID NO: 9184781 - DNA, 22 bp, Homo sapiens
tgctcccagctgtaggaatgtt

SEQ ID NO: 9184782 - DNA, 22 bp, Homo sapiens
tgctcccagctgtaggaatgtt

SEQ ID NO: 9184783 - DNA, 22 bp, Homo sapiens
tgctcccagctcctgcagcaac

SEQ ID NO: 9184784 - DNA, 22 bp, Homo sapiens
tgctcccagctcctgcagcaac

SEQ ID NO: 9184785 - DNA, 20 bp, Homo sapiens
cccagggacctgagctccat

SEQ ID NO: 9184786 - DNA, 22 bp, Homo sapiens
cccagggagcttggagaacggg

SEQ ID NO: 9184787 - DNA, 22 bp, Homo sapiens
cccagggagcttggagaacggg

SEQ ID NO: 9184788 - DNA, 22 bp, Homo sapiens
cccagggagagcgcggaggcgg

SEQ ID NO: 9184789 - DNA, 22 bp, Homo sapiens
cccagggagcttggagaacggg

SEQ ID NO: 9184790 - DNA, 22 bp, Homo sapiens
cccagggaggcccaggctctgc

SEQ ID NO: 9184791 - DNA, 20 bp, Homo sapiens
cccagggacctgagctccat

SEQ ID NO: 9184792 - DNA, 22 bp, Homo sapiens
cccagggagagcgcggaggcgg

SEQ ID NO: 9184793 - DNA, 22 bp, Homo sapiens
cccagggagagcgcggaggcgg

SEQ ID NO: 9184794 - DNA, 22 bp, Homo sapiens
cccagggactcgggattctagg

SEQ ID NO: 9184795 - DNA, 22 bp, Homo sapiens
tgctgaagtccatctgtttgac

SEQ ID NO: 9184796 - DNA, 22 bp, Homo sapiens
tgctgaagtccatctgtttgac

SEQ ID NO: 9184797 - DNA, 23 bp, Homo sapiens
tgctgaagtgttggccctgccca

SEQ ID NO: 9184798 - DNA, 22 bp, Homo sapiens
tgctgaagtccaagagctccaa

SEQ ID NO: 9184799 - DNA, 22 bp, Homo sapiens
tgctgaagtccaagagctccaa

SEQ ID NO: 9184800 - DNA, 22 bp, Homo sapiens
cccagggatgtggcagatgtta

SEQ ID NO: 9184801 - DNA, 22 bp, Homo sapiens
cccagggattataaaggtgaaa

SEQ ID NO: 9184802 - DNA, 22 bp, Homo sapiens
cccagggaggtagcaggagaaa

SEQ ID NO: 9184803 - DNA, 22 bp, Homo sapiens
cccagggaggtagcaggagaaa

SEQ ID NO: 9184804 - DNA, 22 bp, Homo sapiens
cccagggatgtggcagatgtta

SEQ ID NO: 9184805 - DNA, 22 bp, Homo sapiens
cccagggaggtagcaggagaaa

SEQ ID NO: 9184806 - DNA, 22 bp, Homo sapiens
cccagggaggcccaggctctgc

SEQ ID NO: 9184807 - DNA, 21 bp, Homo sapiens
tggccagctggagtctccaca

SEQ ID NO: 9184808 - DNA, 22 bp, Homo sapiens
tggccacacccacctagaggag

SEQ ID NO: 9184809 - DNA, 22 bp, Homo sapiens
tggccacaaagagaacgaggtc

SEQ ID NO: 9184810 - DNA, 22 bp, Homo sapiens
tggccaggaggctgcttctgac

SEQ ID NO: 9184811 - DNA, 22 bp, Homo sapiens
tggccaggaggctgcttctgac

SEQ ID NO: 9184812 - DNA, 22 bp, Homo sapiens
tggccagctttttgtagtgctc

SEQ ID NO: 9184813 - DNA, 23 bp, Homo sapiens
tggcagctgtgtaagagaaagca

SEQ ID NO: 9184814 - DNA, 22 bp, Homo sapiens
tggcagctggctctgcgcaggc

SEQ ID NO: 9184815 - DNA, 22 bp, Homo sapiens
tggcagctgtgtccaggtagaa

SEQ ID NO: 9184816 - DNA, 22 bp, Homo sapiens
tggcagcttcctgctcatagga

SEQ ID NO: 9184817 - DNA, 22 bp, Homo sapiens
cctaggccctcaaagagcataa

SEQ ID NO: 9184818 - DNA, 22 bp, Homo sapiens
cctaggccctcaaagagcataa

SEQ ID NO: 9184819 - DNA, 20 bp, Homo sapiens
cctaggccctccggctgccc

SEQ ID NO: 9184820 - DNA, 22 bp, Homo sapiens
cctaggcccattaattcccctt

SEQ ID NO: 9184821 - DNA, 22 bp, Homo sapiens
tggccaggcaggtagaacggcc

SEQ ID NO: 9184822 - DNA, 22 bp, Homo sapiens
tggccaggcaggtagaacggcc

SEQ ID NO: 9184823 - DNA, 22 bp, Homo sapiens
cctaggcttgttttcatcagct

SEQ ID NO: 9184824 - DNA, 22 bp, Homo sapiens
cctaggcttgttttcatcagct

SEQ ID NO: 9184825 - DNA, 22 bp, Homo sapiens
cctaggctggctgtcttcaggt

SEQ ID NO: 9184826 - DNA, 22 bp, Homo sapiens
cctaggctaattcagtccagta

SEQ ID NO: 9184827 - DNA, 22 bp, Homo sapiens
cctaggctggctgtcttcaggt

SEQ ID NO: 9184828 - DNA, 22 bp, Homo sapiens
cctaggccttactttcctgtgc

SEQ ID NO: 9184829 - DNA, 22 bp, Homo sapiens
cctaggccgcccggtgcgtggg

SEQ ID NO: 9184830 - DNA, 22 bp, Homo sapiens
tggcacaggaatttagatgcag

SEQ ID NO: 9184831 - DNA, 22 bp, Homo sapiens
tggcaaggccacaggtgcagtt

SEQ ID NO: 9184832 - DNA, 22 bp, Homo sapiens
tggcacaggatctcagcggcca

SEQ ID NO: 9184833 - DNA, 22 bp, Homo sapiens
tggcacaggatctcagcggcca

SEQ ID NO: 9184834 - DNA, 22 bp, Homo sapiens
tggcacaggagcactgccctgg

SEQ ID NO: 9184835 - DNA, 22 bp, Homo sapiens
tggcacaggatctcagcggcca

SEQ ID NO: 9184836 - DNA, 22 bp, Homo sapiens
tggcacagtcctgggtgcctgc

SEQ ID NO: 9184837 - DNA, 22 bp, Homo sapiens
tggcagaggtaattcaaatccc

SEQ ID NO: 9184838 - DNA, 22 bp, Homo sapiens
tggcacagggcttggtcgctca

SEQ ID NO: 9184839 - DNA, 22 bp, Homo sapiens
tggcacagggcttggtcgctca

SEQ ID NO: 9184840 - DNA, 22 bp, Homo sapiens
tggcacagggcttggtcgctca

SEQ ID NO: 9184841 - DNA, 22 bp, Homo sapiens
tggcacagtatgggattaaaga

SEQ ID NO: 9184842 - DNA, 22 bp, Homo sapiens
tggcacagtatgggattaaaga

SEQ ID NO: 9184843 - DNA, 22 bp, Homo sapiens
tggcagcacaaggtggcccatg

SEQ ID NO: 9184844 - DNA, 22 bp, Homo sapiens
tggcagcaatagaaatataatc

SEQ ID NO: 9184845 - DNA, 22 bp, Homo sapiens
tggcagcaagttcttgggaggt

SEQ ID NO: 9184846 - DNA, 22 bp, Homo sapiens
tggcagcaaaaccagaatcaga

SEQ ID NO: 9184847 - DNA, 22 bp, Homo sapiens
tggcagcaaaaccagaatcaga

SEQ ID NO: 9184848 - DNA, 22 bp, Homo sapiens
tggcagcaaaaccagaatcaga

SEQ ID NO: 9184849 - DNA, 22 bp, Homo sapiens
tggcagaggtatattgggagga

SEQ ID NO: 9184850 - DNA, 20 bp, Homo sapiens
ccctccagcaaccaggactt

SEQ ID NO: 9184851 - DNA, 22 bp, Homo sapiens
ccctccagccatggacccaggt

SEQ ID NO: 9184852 - DNA, 22 bp, Homo sapiens
ccctccagagcttgacctgctg

SEQ ID NO: 9184853 - DNA, 22 bp, Homo sapiens
ccctccagagcttgacctgctg

SEQ ID NO: 9184854 - DNA, 19 bp, Homo sapiens
ccctcaggtctgagcagtc

SEQ ID NO: 9184855 - DNA, 22 bp, Homo sapiens
ccctccagagcctggacattct

SEQ ID NO: 9184856 - DNA, 22 bp, Homo sapiens
ccctccagagcctggacattct

SEQ ID NO: 9184857 - DNA, 22 bp, Homo sapiens
ccctccacagacaggacttgtc

SEQ ID NO: 9184858 - DNA, 22 bp, Homo sapiens
ccctccaggcactgccctcttc

SEQ ID NO: 9184859 - DNA, 22 bp, Homo sapiens
ccctccagctcaaagcaaccgg

SEQ ID NO: 9184860 - DNA, 22 bp, Homo sapiens
ccctccaggcctgtcatgttcc

SEQ ID NO: 9184861 - DNA, 22 bp, Homo sapiens
ccctccaggcctgtcatgttcc

SEQ ID NO: 9184862 - DNA, 22 bp, Homo sapiens
ccctccagggagccatgctggg

SEQ ID NO: 9184863 - DNA, 22 bp, Homo sapiens
ccctccagggagccatgctggg

SEQ ID NO: 9184864 - DNA, 22 bp, Homo sapiens
ccctggactgttcagggcctga

SEQ ID NO: 9184865 - DNA, 22 bp, Homo sapiens
ccctgctgcagagagctttcca

SEQ ID NO: 9184866 - DNA, 22 bp, Homo sapiens
ccctggactgttcagggcctga

SEQ ID NO: 9184867 - DNA, 22 bp, Homo sapiens
ccctggagaaggggacgcggag

SEQ ID NO: 9184868 - DNA, 22 bp, Homo sapiens
ccctgctgacaacttgattttg

SEQ ID NO: 9184869 - DNA, 22 bp, Homo sapiens
ccctgctgatgccttgattttg

SEQ ID NO: 9184870 - DNA, 22 bp, Homo sapiens
tggagctgactcacaccagcta

SEQ ID NO: 9184871 - DNA, 22 bp, Homo sapiens
ccctggagctagtctgagcaga

SEQ ID NO: 9184872 - DNA, 22 bp, Homo sapiens
tggagctgagagccaggctggc

SEQ ID NO: 9184873 - DNA, 22 bp, Homo sapiens
tggagctgagaagtggagctct

SEQ ID NO: 9184874 - DNA, 22 bp, Homo sapiens
tggagctgagaagtggagctct

SEQ ID NO: 9184875 - DNA, 22 bp, Homo sapiens
tggagctgagaagtggagctct

SEQ ID NO: 9184876 - DNA, 22 bp, Homo sapiens
ccctggagctagtctgagcaga

SEQ ID NO: 9184877 - DNA, 22 bp, Homo sapiens
ccctggagcatctctgctgtct

SEQ ID NO: 9184878 - DNA, 22 bp, Homo sapiens
ccctggagcatctctgctgtct

SEQ ID NO: 9184879 - DNA, 22 bp, Homo sapiens
ccctggagcatctctgctgtct

SEQ ID NO: 9184880 - DNA, 22 bp, Homo sapiens
ccctggagcatctctgctgtct

SEQ ID NO: 9184881 - DNA, 22 bp, Homo sapiens
ccctggagatcgggagaggaag

SEQ ID NO: 9184882 - DNA, 22 bp, Homo sapiens
ccctggagatcgggagaggaag

SEQ ID NO: 9184883 - DNA, 20 bp, Homo sapiens
ccctggagagaagctccacg

SEQ ID NO: 9184884 - DNA, 20 bp, Homo sapiens
ccctggagagaagctccacg

SEQ ID NO: 9184885 - DNA, 20 bp, Homo sapiens
ccctggagagaagctccacg

SEQ ID NO: 9184886 - DNA, 22 bp, Homo sapiens
ccctggagaggactcacccctg

SEQ ID NO: 9184887 - DNA, 19 bp, Homo sapiens
ccctggagaataccctgga

SEQ ID NO: 9184888 - DNA, 22 bp, Homo sapiens
tggcaagagggatgcaaggttt

SEQ ID NO: 9184889 - DNA, 17 bp, Homo sapiens
tggcaagaatggaaatg

SEQ ID NO: 9184890 - DNA, 17 bp, Homo sapiens
tggcaagacagctcagg

SEQ ID NO: 9184891 - DNA, 22 bp, Homo sapiens
tggcaagaatattggaccagaa

SEQ ID NO: 9184892 - DNA, 22 bp, Homo sapiens
tggatgagtctgagattgggca

SEQ ID NO: 9184893 - DNA, 18 bp, Homo sapiens
tggatctttatgaggctg

SEQ ID NO: 9184894 - DNA, 22 bp, Homo sapiens
tggatcttcacaagagagggcg

SEQ ID NO: 9184895 - DNA, 22 bp, Homo sapiens
tggatcttgatgctccaagagt

SEQ ID NO: 9184896 - DNA, 18 bp, Homo sapiens
tggatctttatgaggctg

SEQ ID NO: 9184897 - DNA, 22 bp, Homo sapiens
tggatctgactggcttttcttc

SEQ ID NO: 9184898 - DNA, 22 bp, Homo sapiens
tggatctcggcaatgcgggact

SEQ ID NO: 9184899 - DNA, 22 bp, Homo sapiens
tggatctgacaaggacgggaaa

SEQ ID NO: 9184900 - DNA, 22 bp, Homo sapiens
tggatctggttccctgagcctt

SEQ ID NO: 9184901 - DNA, 21 bp, Homo sapiens
tggatctgtgatctggggcac

SEQ ID NO: 9184902 - DNA, 22 bp, Homo sapiens
tggatctgattaggggagccag

SEQ ID NO: 9184903 - DNA, 22 bp, Homo sapiens
tggatccagctgctcctatgag

SEQ ID NO: 9184904 - DNA, 22 bp, Homo sapiens
tggatctcggcaatgcgggact

SEQ ID NO: 9184905 - DNA, 22 bp, Homo sapiens
ccctggctgccagtcaccagac

SEQ ID NO: 9184906 - DNA, 22 bp, Homo sapiens
ccctggctcttcaccacctgcc

SEQ ID NO: 9184907 - DNA, 22 bp, Homo sapiens
ccctggctcaggcagctttgtt

SEQ ID NO: 9184908 - DNA, 17 bp, Homo sapiens
ccctggctctaggtgga

SEQ ID NO: 9184909 - DNA, 17 bp, Homo sapiens
ccctggctctaggtgga

SEQ ID NO: 9184910 - DNA, 22 bp, Homo sapiens
tggagctgagcacctccagggc

SEQ ID NO: 9184911 - DNA, 22 bp, Homo sapiens
tggagctgagcacctccagggc

SEQ ID NO: 9184912 - DNA, 20 bp, Homo sapiens
ccctggcctgtttcatgccc

SEQ ID NO: 9184913 - DNA, 23 bp, Homo sapiens
ccctggccttggggcacaggctg

SEQ ID NO: 9184914 - DNA, 22 bp, Homo sapiens
ccctggcctccaggcagtcctg

SEQ ID NO: 9184915 - DNA, 22 bp, Homo sapiens
ccctggcctccaggcagtcctg

SEQ ID NO: 9184916 - DNA, 22 bp, Homo sapiens
cctccagactttggccatcctc

SEQ ID NO: 9184917 - DNA, 22 bp, Homo sapiens
cctccagagggtttcccatgaa

SEQ ID NO: 9184918 - DNA, 22 bp, Homo sapiens
cctccagactttggccatcctc

SEQ ID NO: 9184919 - DNA, 22 bp, Homo sapiens
cctccagcattactggcccatg

SEQ ID NO: 9184920 - DNA, 22 bp, Homo sapiens
cctccactctggcctctcaggt

SEQ ID NO: 9184921 - DNA, 22 bp, Homo sapiens
cctccactctggcctctcaggt

SEQ ID NO: 9184922 - DNA, 22 bp, Homo sapiens
cctccacaggagctgcagtgct

SEQ ID NO: 9184923 - DNA, 22 bp, Homo sapiens
cctccaagtttgactcaggaca

SEQ ID NO: 9184924 - DNA, 22 bp, Homo sapiens
cctccagcgcgatccactccgg

SEQ ID NO: 9184925 - DNA, 22 bp, Homo sapiens
cctccagcgcgatccactccgg

SEQ ID NO: 9184926 - DNA, 22 bp, Homo sapiens
cctccagccttcctgaagagcc

SEQ ID NO: 9184927 - DNA, 22 bp, Homo sapiens
tggctgagggggcagttcagga

SEQ ID NO: 9184928 - DNA, 22 bp, Homo sapiens
tggctgagggggcagttcagga

SEQ ID NO: 9184929 - DNA, 22 bp, Homo sapiens
tggctgagagcaattgactctg

SEQ ID NO: 9184930 - DNA, 23 bp, Homo sapiens
tggctgaggtccaggtagtttca

SEQ ID NO: 9184931 - DNA, 22 bp, Homo sapiens
tggctgaggtctggggcttctg

SEQ ID NO: 9184932 - DNA, 22 bp, Homo sapiens
tggctgagggggctctgctcag

SEQ ID NO: 9184933 - DNA, 22 bp, Homo sapiens
tggctgagggggcagttcagga

SEQ ID NO: 9184934 - DNA, 22 bp, Homo sapiens
tggctgaggtaactatgaataa

SEQ ID NO: 9184935 - DNA, 22 bp, Homo sapiens
cctcccttcagtagagcccaat

SEQ ID NO: 9184936 - DNA, 22 bp, Homo sapiens
cctccctgggtgctgggattgc

SEQ ID NO: 9184937 - DNA, 22 bp, Homo sapiens
cctccctgggtgacgggctcct

SEQ ID NO: 9184938 - DNA, 22 bp, Homo sapiens
cctcctctgggaagattcagag

SEQ ID NO: 9184939 - DNA, 22 bp, Homo sapiens
cctcctctgggaagattcagag

SEQ ID NO: 9184940 - DNA, 23 bp, Homo sapiens
cctcctcatatctttgactagtg

SEQ ID NO: 9184941 - DNA, 22 bp, Homo sapiens
cctcggctgggccttggccact

SEQ ID NO: 9184942 - DNA, 22 bp, Homo sapiens
cctcggagaaaggcagctccac

SEQ ID NO: 9184943 - DNA, 22 bp, Homo sapiens
tggccccattttacagatgaaa

SEQ ID NO: 9184944 - DNA, 22 bp, Homo sapiens
tggcccatcatggaaaataaag

SEQ ID NO: 9184945 - DNA, 22 bp, Homo sapiens
tggccccacagggccttttcag

SEQ ID NO: 9184946 - DNA, 22 bp, Homo sapiens
tggccccatcaagggatgagtt

SEQ ID NO: 9184947 - DNA, 22 bp, Homo sapiens
tggcccagtgcttatgctctga

SEQ ID NO: 9184948 - DNA, 22 bp, Homo sapiens
tggcccagtgcttatgctctga

SEQ ID NO: 9184949 - DNA, 21 bp, Homo sapiens
cctatgtcgcactcctaggat

SEQ ID NO: 9184950 - DNA, 22 bp, Homo sapiens
tggcccctgaggagcatcagcc

SEQ ID NO: 9184951 - DNA, 22 bp, Homo sapiens
tggcccctgaggagcgtcagcc

SEQ ID NO: 9184952 - DNA, 18 bp, Homo sapiens
tggccccttatcagtcct

SEQ ID NO: 9184953 - DNA, 22 bp, Homo sapiens
tggcccctggcacacggaggat

SEQ ID NO: 9184954 - DNA, 22 bp, Homo sapiens
tggccctgctatgatcctgcaa

SEQ ID NO: 9184955 - DNA, 22 bp, Homo sapiens
tggctcagtttgggggattgaa

SEQ ID NO: 9184956 - DNA, 22 bp, Homo sapiens
tggctcagtttcagtcctggtt

SEQ ID NO: 9184957 - DNA, 22 bp, Homo sapiens
cctctctgtcacaccagtggcc

SEQ ID NO: 9184958 - DNA, 22 bp, Homo sapiens
cctctctgtgtggcctctccat

SEQ ID NO: 9184959 - DNA, 22 bp, Homo sapiens
cctctctgtgtggcctctccat

SEQ ID NO: 9184960 - DNA, 22 bp, Homo sapiens
cctctctgtgtggcctctccat

SEQ ID NO: 9184961 - DNA, 22 bp, Homo sapiens
cctctctgtagcagcccccagt

SEQ ID NO: 9184962 - DNA, 22 bp, Homo sapiens
cctctctgtagcagcccccagt

SEQ ID NO: 9184963 - DNA, 22 bp, Homo sapiens
cctctctgtagcagcccccagt

SEQ ID NO: 9184964 - DNA, 22 bp, Homo sapiens
cctctctgtaagggtccctccc

SEQ ID NO: 9184965 - DNA, 22 bp, Homo sapiens
cctctctgtaagggtccctccc

SEQ ID NO: 9184966 - DNA, 22 bp, Homo sapiens
cctctctgtaagggtccctccc

SEQ ID NO: 9184967 - DNA, 22 bp, Homo sapiens
cctctctgtaagggtccctccc

SEQ ID NO: 9184968 - DNA, 20 bp, Homo sapiens
cctctctgccctgcaaggcc

SEQ ID NO: 9184969 - DNA, 20 bp, Homo sapiens
cctctctgcatgctccctga

SEQ ID NO: 9184970 - DNA, 20 bp, Homo sapiens
cctctctgcatgctccctga

SEQ ID NO: 9184971 - DNA, 20 bp, Homo sapiens
cctctctgcatgctccctga

SEQ ID NO: 9184972 - DNA, 20 bp, Homo sapiens
cctctctgcatgctccctga

SEQ ID NO: 9184973 - DNA, 22 bp, Homo sapiens
cctctctcttgtagtccctgcc

SEQ ID NO: 9184974 - DNA, 20 bp, Homo sapiens
cctctctgaagaggtcatct

SEQ ID NO: 9184975 - DNA, 22 bp, Homo sapiens
tggctgccttccctgctggagg

SEQ ID NO: 9184976 - DNA, 22 bp, Homo sapiens
tggctgcctgatcgagcaggtg

SEQ ID NO: 9184977 - DNA, 22 bp, Homo sapiens
cctctcccgggtgccgctgggc

SEQ ID NO: 9184978 - DNA, 22 bp, Homo sapiens
tggctgcctttcacctcatctc

SEQ ID NO: 9184979 - DNA, 22 bp, Homo sapiens
tggctgcctttcacctcatctc

SEQ ID NO: 9184980 - DNA, 22 bp, Homo sapiens
cctctctcttgtagtccctgcc

SEQ ID NO: 9184981 - DNA, 19 bp, Homo sapiens
cctctccgcccaccagccc

SEQ ID NO: 9184982 - DNA, 22 bp, Homo sapiens
cctctcagccggactgtcaggc

SEQ ID NO: 9184983 - DNA, 22 bp, Homo sapiens
cctctcagcgattcctcttgga

SEQ ID NO: 9184984 - DNA, 22 bp, Homo sapiens
cctctaggatgtggctggagga

SEQ ID NO: 9184985 - DNA, 22 bp, Homo sapiens
cctctaggatgtggctggagga

SEQ ID NO: 9184986 - DNA, 22 bp, Homo sapiens
tggctgcctgatcgagcaggtg

SEQ ID NO: 9184987 - DNA, 22 bp, Homo sapiens
tggctgcctgaatgcaagacag

SEQ ID NO: 9184988 - DNA, 21 bp, Homo sapiens
tggctgcctacatgctgcagg

SEQ ID NO: 9184989 - DNA, 22 bp, Homo sapiens
cctctggctcacagcaccaact

SEQ ID NO: 9184990 - DNA, 22 bp, Homo sapiens
cctctggctgtaccactggcac

SEQ ID NO: 9184991 - DNA, 22 bp, Homo sapiens
cctctgggctggaaaattaatg

SEQ ID NO: 9184992 - DNA, 22 bp, Homo sapiens
cctctgggctgcctgcacgggt

SEQ ID NO: 9184993 - DNA, 22 bp, Homo sapiens
cctctgggctgcctgcacgggt

SEQ ID NO: 9184994 - DNA, 22 bp, Homo sapiens
cctctgggctgcctgcacgggt

SEQ ID NO: 9184995 - DNA, 22 bp, Homo sapiens
cctctgggctgcctgcacgggt

SEQ ID NO: 9184996 - DNA, 22 bp, Homo sapiens
cctctgggctgcctgcacgggt

SEQ ID NO: 9184997 - DNA, 22 bp, Homo sapiens
cctctgggggcttccttaccct

SEQ ID NO: 9184998 - DNA, 22 bp, Homo sapiens
cctctggggcatcagacaaagg

SEQ ID NO: 9184999 - DNA, 22 bp, Homo sapiens
cctctgtagtaagagaacatat

SEQ ID NO: 9185000 - DNA, 22 bp, Homo sapiens
cctctgggttagtttagggagc

SEQ ID NO: 9185001 - DNA, 22 bp, Homo sapiens
cctctgggtgggaggccgggcg

SEQ ID NO: 9185002 - DNA, 18 bp, Homo sapiens
cctctgggttttgttccc

SEQ ID NO: 9185003 - DNA, 22 bp, Homo sapiens
cctctgggttagtttagggagc

SEQ ID NO: 9185004 - DNA, 22 bp, Homo sapiens
cctctgtagtaagagaacatat

SEQ ID NO: 9185005 - DNA, 22 bp, Homo sapiens
cctctgggtgggaggccgggcg

SEQ ID NO: 9185006 - DNA, 22 bp, Homo sapiens
cctctgggtgggaggccgggcg

SEQ ID NO: 9185007 - DNA, 22 bp, Homo sapiens
cctctgggtgacagactcttgg

SEQ ID NO: 9185008 - DNA, 22 bp, Homo sapiens
cctctgggtgacagactcttgg

SEQ ID NO: 9185009 - DNA, 22 bp, Homo sapiens
cctctgggtatctgtggaagta

SEQ ID NO: 9185010 - DNA, 22 bp, Homo sapiens
cctctgggtatctgtggaagta

SEQ ID NO: 9185011 - DNA, 22 bp, Homo sapiens
cctctggggtctagcaatagca

SEQ ID NO: 9185012 - DNA, 22 bp, Homo sapiens
cctctgggggtcctcagagtct

SEQ ID NO: 9185013 - DNA, 22 bp, Homo sapiens
cctctgggggtcctcagagtct

SEQ ID NO: 9185014 - DNA, 22 bp, Homo sapiens
cctctgggggtcctcagagtct

SEQ ID NO: 9185015 - DNA, 22 bp, Homo sapiens
cctctgggggtcctcagagtct

SEQ ID NO: 9185016 - DNA, 22 bp, Homo sapiens
cctctggggtgagtgggccact

SEQ ID NO: 9185017 - DNA, 22 bp, Homo sapiens
cctctggggtgagtgggccact

SEQ ID NO: 9185018 - DNA, 22 bp, Homo sapiens
cctctggggtctagcaatagca

SEQ ID NO: 9185019 - DNA, 19 bp, Homo sapiens
tgtgtgggtttagagtagt

SEQ ID NO: 9185020 - DNA, 22 bp, Homo sapiens
cctgggcctggcgggtcggctc

SEQ ID NO: 9185021 - DNA, 19 bp, Homo sapiens
cctgggcctccatcacccc

SEQ ID NO: 9185022 - DNA, 22 bp, Homo sapiens
tgtgtgtcatttagggtggagc

SEQ ID NO: 9185023 - DNA, 22 bp, Homo sapiens
cctgggccttgacctcgtgggc

SEQ ID NO: 9185024 - DNA, 22 bp, Homo sapiens
cctgggccttgacctcgtgggc

SEQ ID NO: 9185025 - DNA, 22 bp, Homo sapiens
cctgggccttgacctcgtgggc

SEQ ID NO: 9185026 - DNA, 20 bp, Homo sapiens
cctgggctcaaagcatcctc

SEQ ID NO: 9185027 - DNA, 22 bp, Homo sapiens
cctgggctttgctggcaaggcc

SEQ ID NO: 9185028 - DNA, 22 bp, Homo sapiens
cctgggcttccacgagcagagg

SEQ ID NO: 9185029 - DNA, 22 bp, Homo sapiens
cctgggcttccacgagcagagg

SEQ ID NO: 9185030 - DNA, 22 bp, Homo sapiens
cctgggcttccacgagcagagg

SEQ ID NO: 9185031 - DNA, 22 bp, Homo sapiens
cctgggctcaagcgatcttgtc

SEQ ID NO: 9185032 - DNA, 22 bp, Homo sapiens
cctggggaagtcacttctcttt

SEQ ID NO: 9185033 - DNA, 22 bp, Homo sapiens
cctggggaaaagcaggcattta

SEQ ID NO: 9185034 - DNA, 22 bp, Homo sapiens
cctggggaaaagcaggcattta

SEQ ID NO: 9185035 - DNA, 22 bp, Homo sapiens
cctgggctttggaacagtactt

SEQ ID NO: 9185036 - DNA, 22 bp, Homo sapiens
cctggggaaaagcaggcattta

SEQ ID NO: 9185037 - DNA, 22 bp, Homo sapiens
cctgggctttgctggcaaggcc

SEQ ID NO: 9185038 - DNA, 22 bp, Homo sapiens
cctgggctttgctggcaaggcc

SEQ ID NO: 9185039 - DNA, 22 bp, Homo sapiens
cctggggaatcttgcaggggaa

SEQ ID NO: 9185040 - DNA, 22 bp, Homo sapiens
cctggggaatcttgcaggggaa

SEQ ID NO: 9185041 - DNA, 22 bp, Homo sapiens
cctggggaatcttgcaggggaa

SEQ ID NO: 9185042 - DNA, 22 bp, Homo sapiens
cctgggtcccagccaggctttg

SEQ ID NO: 9185043 - DNA, 19 bp, Homo sapiens
cctgggtccactcagacta

SEQ ID NO: 9185044 - DNA, 22 bp, Homo sapiens
cctgggtccaccctgtgaagta

SEQ ID NO: 9185045 - DNA, 19 bp, Homo sapiens
cctgggtccactcagacta

SEQ ID NO: 9185046 - DNA, 22 bp, Homo sapiens
cctgggtccaccctgtgaagta

SEQ ID NO: 9185047 - DNA, 22 bp, Homo sapiens
cctggggctcaagatggcgccg

SEQ ID NO: 9185048 - DNA, 19 bp, Homo sapiens
tgtgttccatccaccaccc

SEQ ID NO: 9185049 - DNA, 22 bp, Homo sapiens
tgtgttcatcatgatatcaggt

SEQ ID NO: 9185050 - DNA, 22 bp, Homo sapiens
tgtgttcagtatgacattcaca

SEQ ID NO: 9185051 - DNA, 22 bp, Homo sapiens
tgtgttcaatgacttcatcttt

SEQ ID NO: 9185052 - DNA, 22 bp, Homo sapiens
cctgggtcctggcagcctcctg

SEQ ID NO: 9185053 - DNA, 22 bp, Homo sapiens
cctgggtctatagacttcaaga

SEQ ID NO: 9185054 - DNA, 22 bp, Homo sapiens
cctgggtctcctcctgctggct

SEQ ID NO: 9185055 - DNA, 22 bp, Homo sapiens
cctgggtctcctcctgctggct

SEQ ID NO: 9185056 - DNA, 22 bp, Homo sapiens
cctgggtctcctcctgctggct

SEQ ID NO: 9185057 - DNA, 22 bp, Homo sapiens
cctgggtcctggcagcctcctg

SEQ ID NO: 9185058 - DNA, 22 bp, Homo sapiens
cctgggtccctgagagatgatt

SEQ ID NO: 9185059 - DNA, 22 bp, Homo sapiens
cctgggtcccatcccagagtga

SEQ ID NO: 9185060 - DNA, 22 bp, Homo sapiens
cctgggtcccatcccagagtga

SEQ ID NO: 9185061 - DNA, 22 bp, Homo sapiens
cctgggtcccagccaggctttg

SEQ ID NO: 9185062 - DNA, 22 bp, Homo sapiens
cctgggtctgtattggtaggta

SEQ ID NO: 9185063 - DNA, 22 bp, Homo sapiens
cctgggtctgtattggtaggta

SEQ ID NO: 9185064 - DNA, 22 bp, Homo sapiens
cctgggtctggtcactaagtca

SEQ ID NO: 9185065 - DNA, 22 bp, Homo sapiens
cctgggtctggtcactaagtca

SEQ ID NO: 9185066 - DNA, 19 bp, Homo sapiens
cctgggtctgcagcattca

SEQ ID NO: 9185067 - DNA, 19 bp, Homo sapiens
cctgggtctgcagcattca

SEQ ID NO: 9185068 - DNA, 22 bp, Homo sapiens
cctgggtcttcagtctgctggt

SEQ ID NO: 9185069 - DNA, 22 bp, Homo sapiens
cctgggtcttggttcatgctct

SEQ ID NO: 9185070 - DNA, 22 bp, Homo sapiens
cctgggtcttggttcatgctct

SEQ ID NO: 9185071 - DNA, 22 bp, Homo sapiens
cctgggtgaaatagtcctcaag

SEQ ID NO: 9185072 - DNA, 22 bp, Homo sapiens
cctgggtgaaatagtcctcaag

SEQ ID NO: 9185073 - DNA, 22 bp, Homo sapiens
cctgggtgacagagtgagacct

SEQ ID NO: 9185074 - DNA, 22 bp, Homo sapiens
cctgggtgacagagtgagacct

SEQ ID NO: 9185075 - DNA, 22 bp, Homo sapiens
cctgggtgaatgatattctaaa

SEQ ID NO: 9185076 - DNA, 22 bp, Homo sapiens
cctgggtgacagagtgagacct

SEQ ID NO: 9185077 - DNA, 22 bp, Homo sapiens
cctgggtgacccgtgagcgtcc

SEQ ID NO: 9185078 - DNA, 22 bp, Homo sapiens
cctgggtgcccggcccttctct

SEQ ID NO: 9185079 - DNA, 22 bp, Homo sapiens
cctgggtggcagaggttgcagt

SEQ ID NO: 9185080 - DNA, 22 bp, Homo sapiens
cctgggaggcggaggttgcagt

SEQ ID NO: 9185081 - DNA, 22 bp, Homo sapiens
cctgggaggcggaggttgcagt

SEQ ID NO: 9185082 - DNA, 22 bp, Homo sapiens
cctgggcataaatcactccaag

SEQ ID NO: 9185083 - DNA, 22 bp, Homo sapiens
cctgggaggcggaggttgcagg

SEQ ID NO: 9185084 - DNA, 22 bp, Homo sapiens
cctgggaggcggaggttgcagt

SEQ ID NO: 9185085 - DNA, 22 bp, Homo sapiens
cctgggaggcggaggttgcagg

SEQ ID NO: 9185086 - DNA, 22 bp, Homo sapiens
cctgggaggcggaggttgcagg

SEQ ID NO: 9185087 - DNA, 21 bp, Homo sapiens
cctgggccaaattccctggac

SEQ ID NO: 9185088 - DNA, 21 bp, Homo sapiens
cctgggccaaattccctggac

SEQ ID NO: 9185089 - DNA, 22 bp, Homo sapiens
cctgggccaggcttgggaatgc

SEQ ID NO: 9185090 - DNA, 22 bp, Homo sapiens
tgtgtgggtacagatgattgtt

SEQ ID NO: 9185091 - DNA, 22 bp, Homo sapiens
tgtgtggggaaggaaggagctg

SEQ ID NO: 9185092 - DNA, 23 bp, Homo sapiens
tgtgtctgtttagggaggatgtg

SEQ ID NO: 9185093 - DNA, 22 bp, Homo sapiens
tgtggggtgtggtccaggcatc

SEQ ID NO: 9185094 - DNA, 22 bp, Homo sapiens
tgtggggctgtggtgttcttct

SEQ ID NO: 9185095 - DNA, 22 bp, Homo sapiens
tgtggggccaaagcccagccac

SEQ ID NO: 9185096 - DNA, 22 bp, Homo sapiens
tgtggggatcttctagcttttc

SEQ ID NO: 9185097 - DNA, 22 bp, Homo sapiens
cctgggcctcacccagctcttg

SEQ ID NO: 9185098 - DNA, 22 bp, Homo sapiens
cctgggcctcacccagctcttg

SEQ ID NO: 9185099 - DNA, 22 bp, Homo sapiens
tgtggggatcttctagcttttc

SEQ ID NO: 9185100 - DNA, 19 bp, Homo sapiens
tgtggggagtcagggggct

SEQ ID NO: 9185101 - DNA, 22 bp, Homo sapiens
cctgggcctcacccagctcttg

SEQ ID NO: 9185102 - DNA, 22 bp, Homo sapiens
cctgggaggcagaggttgcagt

SEQ ID NO: 9185103 - DNA, 19 bp, Homo sapiens
cctgggaggcggaggttgc

SEQ ID NO: 9185104 - DNA, 22 bp, Homo sapiens
cctgggaggcagaggttgcagt

SEQ ID NO: 9185105 - DNA, 22 bp, Homo sapiens
cctgggaggcagaggttgcagt

SEQ ID NO: 9185106 - DNA, 22 bp, Homo sapiens
cctgggagctgtggaaaggctg

SEQ ID NO: 9185107 - DNA, 22 bp, Homo sapiens
tgtggctgttgaggaccccaag

SEQ ID NO: 9185108 - DNA, 22 bp, Homo sapiens
tgtggctgtgccgtcacacgtg

SEQ ID NO: 9185109 - DNA, 22 bp, Homo sapiens
tgtggctgtgccgtcacacgtg

SEQ ID NO: 9185110 - DNA, 22 bp, Homo sapiens
tgtggctgtctgttctcctagg

SEQ ID NO: 9185111 - DNA, 22 bp, Homo sapiens
tgtggctgtctgttctcctagg

SEQ ID NO: 9185112 - DNA, 22 bp, Homo sapiens
tgtggctggtctccgagcgtcg

SEQ ID NO: 9185113 - DNA, 22 bp, Homo sapiens
tgtggctgtgtccacctgctgc

SEQ ID NO: 9185114 - DNA, 22 bp, Homo sapiens
tgtggctgtggttttcataaat

SEQ ID NO: 9185115 - DNA, 22 bp, Homo sapiens
tgtggctgtggatgctttccag

SEQ ID NO: 9185116 - DNA, 15 bp, Homo sapiens
tgtggctggctcctg

SEQ ID NO: 9185117 - DNA, 22 bp, Homo sapiens
tgtggctggattgattttacct

SEQ ID NO: 9185118 - DNA, 22 bp, Homo sapiens
tgtggctgctcctgggtggtca

SEQ ID NO: 9185119 - DNA, 22 bp, Homo sapiens
tgtggctgggctaataggcaaa

SEQ ID NO: 9185120 - DNA, 22 bp, Homo sapiens
tgtggctgggaagaaggtaact

SEQ ID NO: 9185121 - DNA, 18 bp, Homo sapiens
tgtggctggtccacactg

SEQ ID NO: 9185122 - DNA, 22 bp, Homo sapiens
tgtggctgggctaataggcaaa

SEQ ID NO: 9185123 - DNA, 18 bp, Homo sapiens
tgtggctggtccacactg

SEQ ID NO: 9185124 - DNA, 22 bp, Homo sapiens
tgtggctgctcaggtgcagacc

SEQ ID NO: 9185125 - DNA, 21 bp, Homo sapiens
tgtggctgcctctggccctgg

SEQ ID NO: 9185126 - DNA, 22 bp, Homo sapiens
tgtggcaggcaagatgtacaga

SEQ ID NO: 9185127 - DNA, 22 bp, Homo sapiens
tgtggcaggaagagcttctgag

SEQ ID NO: 9185128 - DNA, 20 bp, Homo sapiens
tgtggcaggatgagggcgga

SEQ ID NO: 9185129 - DNA, 22 bp, Homo sapiens
tgtggcagctggaggtggagaa

SEQ ID NO: 9185130 - DNA, 22 bp, Homo sapiens
tgtgcttttctctgctcctgga

SEQ ID NO: 9185131 - DNA, 22 bp, Homo sapiens
tgtgctttggttttacaggatg

SEQ ID NO: 9185132 - DNA, 22 bp, Homo sapiens
tgtctttacttaataaatatac

SEQ ID NO: 9185133 - DNA, 22 bp, Homo sapiens
tgtctttacttaataaatatac

SEQ ID NO: 9185134 - DNA, 22 bp, Homo sapiens
tgtctttacttagaagttcagg

SEQ ID NO: 9185135 - DNA, 21 bp, Homo sapiens
tgtctttaggacctgttaaat

SEQ ID NO: 9185136 - DNA, 22 bp, Homo sapiens
tgtctttagttgcttagatttg

SEQ ID NO: 9185137 - DNA, 22 bp, Homo sapiens
tgtctttagttgcttagatttg

SEQ ID NO: 9185138 - DNA, 22 bp, Homo sapiens
tgtctttagttttactgtctgg

SEQ ID NO: 9185139 - DNA, 22 bp, Homo sapiens
tgtctttagaaagaagcagaca

SEQ ID NO: 9185140 - DNA, 22 bp, Homo sapiens
tgtctttagagtcacaaaacca

SEQ ID NO: 9185141 - DNA, 22 bp, Homo sapiens
tgtctttagccacttgcctctt

SEQ ID NO: 9185142 - DNA, 22 bp, Homo sapiens
tgtctttagccagcagtcttct

SEQ ID NO: 9185143 - DNA, 22 bp, Homo sapiens
tgtctggtgggttgacaggcag

SEQ ID NO: 9185144 - DNA, 22 bp, Homo sapiens
tgtctggtgggttgacaggcag

SEQ ID NO: 9185145 - DNA, 20 bp, Homo sapiens
tgtctgtatgcagtcatata

SEQ ID NO: 9185146 - DNA, 22 bp, Homo sapiens
tgtctgtcagcagtgggtcagg

SEQ ID NO: 9185147 - DNA, 22 bp, Homo sapiens
tgtctgtctgcacagctcatgg

SEQ ID NO: 9185148 - DNA, 23 bp, Homo sapiens
tgtctggggcgccagaagagaga

SEQ ID NO: 9185149 - DNA, 23 bp, Homo sapiens
tgtctggggcgccagaagagaga

SEQ ID NO: 9185150 - DNA, 22 bp, Homo sapiens
cctggctgaggggccaaggacc

SEQ ID NO: 9185151 - DNA, 22 bp, Homo sapiens
cctggctgaggggccaaggacc

SEQ ID NO: 9185152 - DNA, 22 bp, Homo sapiens
cctggctgagggacctcgggta

SEQ ID NO: 9185153 - DNA, 22 bp, Homo sapiens
cctggctgagggacctcgggta

SEQ ID NO: 9185154 - DNA, 22 bp, Homo sapiens
cctggctgagggacctcgggta

SEQ ID NO: 9185155 - DNA, 22 bp, Homo sapiens
cctggctgagcctccaggaaga

SEQ ID NO: 9185156 - DNA, 22 bp, Homo sapiens
cctggctgaaccaatgaagtgg

SEQ ID NO: 9185157 - DNA, 22 bp, Homo sapiens
cctggctgaacaaagtccctcc

SEQ ID NO: 9185158 - DNA, 22 bp, Homo sapiens
cctggctgaacaaagtccctcc

SEQ ID NO: 9185159 - DNA, 22 bp, Homo sapiens
cctggctcttctgtgtcagccc

SEQ ID NO: 9185160 - DNA, 22 bp, Homo sapiens
cctggctcttctgtgtcagccc

SEQ ID NO: 9185161 - DNA, 22 bp, Homo sapiens
cctggctctgaagtccacatca

SEQ ID NO: 9185162 - DNA, 22 bp, Homo sapiens
cctggctctgaagtccacatca

SEQ ID NO: 9185163 - DNA, 22 bp, Homo sapiens
cctggctcttcgggagtttgtt

SEQ ID NO: 9185164 - DNA, 22 bp, Homo sapiens
cctggctcttcagaggttccta

SEQ ID NO: 9185165 - DNA, 22 bp, Homo sapiens
cctggctcttcgggagtttgtt

SEQ ID NO: 9185166 - DNA, 22 bp, Homo sapiens
tgtgaggaggcggccagaagag

SEQ ID NO: 9185167 - DNA, 20 bp, Homo sapiens
tgtgaggagcatggccgctg

SEQ ID NO: 9185168 - DNA, 22 bp, Homo sapiens
tgtgaggagaggcccagctccc

SEQ ID NO: 9185169 - DNA, 22 bp, Homo sapiens
tgtgaggacattggaggactca

SEQ ID NO: 9185170 - DNA, 22 bp, Homo sapiens
tgtgaggaacccggaatgtggg

SEQ ID NO: 9185171 - DNA, 22 bp, Homo sapiens
tgtgaggaacaggactagagca

SEQ ID NO: 9185172 - DNA, 22 bp, Homo sapiens
tgtgagcttaggacagggctat

SEQ ID NO: 9185173 - DNA, 20 bp, Homo sapiens
tgtgagcagatgctgagtga

SEQ ID NO: 9185174 - DNA, 22 bp, Homo sapiens
tgtgaggatgtaaccagaagtc

SEQ ID NO: 9185175 - DNA, 22 bp, Homo sapiens
tgtgaggcctctgcaggagcag

SEQ ID NO: 9185176 - DNA, 23 bp, Homo sapiens
tgtctttgaatgggctgtagaca

SEQ ID NO: 9185177 - DNA, 22 bp, Homo sapiens
tgtctttctgcaccacctcaca

SEQ ID NO: 9185178 - DNA, 22 bp, Homo sapiens
tgtctttctgacccaaggtagt

SEQ ID NO: 9185179 - DNA, 22 bp, Homo sapiens
tgtctttctgacccaaggtagt

SEQ ID NO: 9185180 - DNA, 22 bp, Homo sapiens
tgtctttctatctctagattta

SEQ ID NO: 9185181 - DNA, 22 bp, Homo sapiens
tgtctttatgcacactgacttg

SEQ ID NO: 9185182 - DNA, 20 bp, Homo sapiens
tgtctttccatggctggatc

SEQ ID NO: 9185183 - DNA, 22 bp, Homo sapiens
tgtctttatatatttggaaaat

SEQ ID NO: 9185184 - DNA, 22 bp, Homo sapiens
tgtctttatatatttggaaaat

SEQ ID NO: 9185185 - DNA, 22 bp, Homo sapiens
tgtctttagttttactgtctgg

SEQ ID NO: 9185186 - DNA, 22 bp, Homo sapiens
tgtctttggaatatttagctga

SEQ ID NO: 9185187 - DNA, 22 bp, Homo sapiens
tgtctttggaatatttagctga

SEQ ID NO: 9185188 - DNA, 22 bp, Homo sapiens
tgtgaagatttggcatgcagaa

SEQ ID NO: 9185189 - DNA, 22 bp, Homo sapiens
tgtgaaggagcatgcagagggg

SEQ ID NO: 9185190 - DNA, 22 bp, Homo sapiens
tgtgaaggcagagccagtgaaa

SEQ ID NO: 9185191 - DNA, 22 bp, Homo sapiens
tgtgaaggagatgaagggagtg

SEQ ID NO: 9185192 - DNA, 22 bp, Homo sapiens
tgtgaaggtaaggaggggcaag

SEQ ID NO: 9185193 - DNA, 23 bp, Homo sapiens
tgtgaaggtgggtccaagggctg

SEQ ID NO: 9185194 - DNA, 23 bp, Homo sapiens
cctggctgtggatttgggcctgc

SEQ ID NO: 9185195 - DNA, 23 bp, Homo sapiens
cctggctgtggatttgggcctgc

SEQ ID NO: 9185196 - DNA, 22 bp, Homo sapiens
cctggctgtgcattgccggccc

SEQ ID NO: 9185197 - DNA, 22 bp, Homo sapiens
cctggctgtgcattgccggccc

SEQ ID NO: 9185198 - DNA, 22 bp, Homo sapiens
cctggctgctctgatgagcgcc

SEQ ID NO: 9185199 - DNA, 22 bp, Homo sapiens
cctggctgctatagcagcatgt

SEQ ID NO: 9185200 - DNA, 22 bp, Homo sapiens
cctggctgctatagcagcatgt

SEQ ID NO: 9185201 - DNA, 22 bp, Homo sapiens
cctggctgccgagtgtgcagcg

SEQ ID NO: 9185202 - DNA, 22 bp, Homo sapiens
cctggctgccgagtgtgcagcg

SEQ ID NO: 9185203 - DNA, 22 bp, Homo sapiens
cctggctgccgagtgtgcagcg

SEQ ID NO: 9185204 - DNA, 22 bp, Homo sapiens
cctggctgcattttgctggatg

SEQ ID NO: 9185205 - DNA, 20 bp, Homo sapiens
cctggctgcattcaggacgg

SEQ ID NO: 9185206 - DNA, 22 bp, Homo sapiens
cctggcttagaggttgcctttc

SEQ ID NO: 9185207 - DNA, 21 bp, Homo sapiens
cctggcttcagggtgcactgg

SEQ ID NO: 9185208 - DNA, 22 bp, Homo sapiens
cctggcttcagcattgccctct

SEQ ID NO: 9185209 - DNA, 22 bp, Homo sapiens
cctggcttatttttatagcagt

SEQ ID NO: 9185210 - DNA, 22 bp, Homo sapiens
cctggcttcctggagctcacaa

SEQ ID NO: 9185211 - DNA, 18 bp, Homo sapiens
cctggcttccatcttggt

SEQ ID NO: 9185212 - DNA, 22 bp, Homo sapiens
cctggcttccatatggcacata

SEQ ID NO: 9185213 - DNA, 23 bp, Homo sapiens
cctggcttcattctcttagggtg

SEQ ID NO: 9185214 - DNA, 21 bp, Homo sapiens
cctggcttcagggtgcactgg

SEQ ID NO: 9185215 - DNA, 22 bp, Homo sapiens
cctggctgtgtgaccttggcaa

SEQ ID NO: 9185216 - DNA, 22 bp, Homo sapiens
cctggctgtgtgaccttggcaa

SEQ ID NO: 9185217 - DNA, 22 bp, Homo sapiens
cctggctgtttgagcggggaat

SEQ ID NO: 9185218 - DNA, 22 bp, Homo sapiens
cctggctgtggcggtgctctca

SEQ ID NO: 9185219 - DNA, 22 bp, Homo sapiens
cctggctgtggcggtgctctca

SEQ ID NO: 9185220 - DNA, 20 bp, Homo sapiens
cctggctttgcatctgtgat

SEQ ID NO: 9185221 - DNA, 22 bp, Homo sapiens
cctggctttgcggatttacagg

SEQ ID NO: 9185222 - DNA, 22 bp, Homo sapiens
cctggcttttgtttataaattc

SEQ ID NO: 9185223 - DNA, 22 bp, Homo sapiens
cctggcttttgttcccggcgtc

SEQ ID NO: 9185224 - DNA, 18 bp, Homo sapiens
cctggcttttctacttgc

SEQ ID NO: 9185225 - DNA, 22 bp, Homo sapiens
cctggcttttgtttataaattc

SEQ ID NO: 9185226 - DNA, 22 bp, Homo sapiens
cctggcttccttcatgacctgg

SEQ ID NO: 9185227 - DNA, 22 bp, Homo sapiens
cctggcttctataccaccaggt

SEQ ID NO: 9185228 - DNA, 22 bp, Homo sapiens
cctggcttctataccaccaggt

SEQ ID NO: 9185229 - DNA, 22 bp, Homo sapiens
cctggcttctctgcattgttct

SEQ ID NO: 9185230 - DNA, 22 bp, Homo sapiens
cctggcttctcaccttgttctg

SEQ ID NO: 9185231 - DNA, 22 bp, Homo sapiens
cctggctttagctgccttccct

SEQ ID NO: 9185232 - DNA, 22 bp, Homo sapiens
cctggcttctgggtctgtgaga

SEQ ID NO: 9185233 - DNA, 20 bp, Homo sapiens
cctggctttgcagcatgaga

SEQ ID NO: 9185234 - DNA, 20 bp, Homo sapiens
cctggctttgcagcatgaga

SEQ ID NO: 9185235 - DNA, 22 bp, Homo sapiens
cctggctttgaccttgctgttt

SEQ ID NO: 9185236 - DNA, 22 bp, Homo sapiens
cctggctttctcatttacaggc

SEQ ID NO: 9185237 - DNA, 22 bp, Homo sapiens
tgtgccaggcacttgcccaggc

SEQ ID NO: 9185238 - DNA, 22 bp, Homo sapiens
tgtgccagcctctggctgtgtc

SEQ ID NO: 9185239 - DNA, 22 bp, Homo sapiens
cctgggagccgactgactgtgc

SEQ ID NO: 9185240 - DNA, 22 bp, Homo sapiens
tgtgccagcctctggctgtgtc

SEQ ID NO: 9185241 - DNA, 22 bp, Homo sapiens
tgtgccagaaaatatgctgagg

SEQ ID NO: 9185242 - DNA, 21 bp, Homo sapiens
cctgggagatcagctgccttc

SEQ ID NO: 9185243 - DNA, 21 bp, Homo sapiens
cctgggagatcagctgccttc

SEQ ID NO: 9185244 - DNA, 21 bp, Homo sapiens
cctgggagatcagctgccttc

SEQ ID NO: 9185245 - DNA, 22 bp, Homo sapiens
cctgggagccaagcctctgtgt

SEQ ID NO: 9185246 - DNA, 22 bp, Homo sapiens
cctgggagccaagcctctgtgt

SEQ ID NO: 9185247 - DNA, 22 bp, Homo sapiens
cctgggaagaccggcagtgggg

SEQ ID NO: 9185248 - DNA, 22 bp, Homo sapiens
cctgggagagtctgtggtctcc

SEQ ID NO: 9185249 - DNA, 22 bp, Homo sapiens
tgtgccagtcatccagatgtgt

SEQ ID NO: 9185250 - DNA, 22 bp, Homo sapiens
tgtgccaggggccgcttgcctt

SEQ ID NO: 9185251 - DNA, 22 bp, Homo sapiens
tgtgccatttctattctgcagc

SEQ ID NO: 9185252 - DNA, 22 bp, Homo sapiens
tgtgcccatctcccagcttgac

SEQ ID NO: 9185253 - DNA, 22 bp, Homo sapiens
tgtgcccagactgcctcagtga

SEQ ID NO: 9185254 - DNA, 22 bp, Homo sapiens
tgtgctggggtccagctgagcc

SEQ ID NO: 9185255 - DNA, 22 bp, Homo sapiens
tgtgcttctctttctcacttaa

SEQ ID NO: 9185256 - DNA, 22 bp, Homo sapiens
tgtgcttcatcacttctcagtt

SEQ ID NO: 9185257 - DNA, 22 bp, Homo sapiens
tgtagtaaacactattctgatc

SEQ ID NO: 9185258 - DNA, 22 bp, Homo sapiens
tgtagggaggaagggttggaaa

SEQ ID NO: 9185259 - DNA, 23 bp, Homo sapiens
tgtaggctaagtcccataaatca

SEQ ID NO: 9185260 - DNA, 22 bp, Homo sapiens
tgtagggactgaggctggagag

SEQ ID NO: 9185261 - DNA, 22 bp, Homo sapiens
tgtaaagaaagacgcagagtta

SEQ ID NO: 9185262 - DNA, 22 bp, Homo sapiens
tgtaccagatgtctaaagccat

SEQ ID NO: 9185263 - DNA, 22 bp, Homo sapiens
tgtaccagatggaaaacgtgag

SEQ ID NO: 9185264 - DNA, 22 bp, Homo sapiens
tgtaccagatgtctaaagccat

SEQ ID NO: 9185265 - DNA, 22 bp, Homo sapiens
tgtaccaggaggaggacaaatt

SEQ ID NO: 9185266 - DNA, 22 bp, Homo sapiens
tgtaaacatatgtatgtatgta

SEQ ID NO: 9185267 - DNA, 23 bp, Homo sapiens
tgtaaacatcaccccctggagtt

SEQ ID NO: 9185268 - DNA, 22 bp, Homo sapiens
cctggagaggcgctgcagagga

SEQ ID NO: 9185269 - DNA, 22 bp, Homo sapiens
cctggagaggcgctgcagagga

SEQ ID NO: 9185270 - DNA, 22 bp, Homo sapiens
cctggagagctcgggccaggca

SEQ ID NO: 9185271 - DNA, 22 bp, Homo sapiens
cctggagaggagaaagggccca

SEQ ID NO: 9185272 - DNA, 22 bp, Homo sapiens
cctggagaggagaaagggccca

SEQ ID NO: 9185273 - DNA, 22 bp, Homo sapiens
tgtagtgtttctcagatatttg

SEQ ID NO: 9185274 - DNA, 22 bp, Homo sapiens
tgtagtaagtgcgcaataaata

SEQ ID NO: 9185275 - DNA, 22 bp, Homo sapiens
cctggagcacagcccagtccca

SEQ ID NO: 9185276 - DNA, 22 bp, Homo sapiens
cctggagcacagcccagtccca

SEQ ID NO: 9185277 - DNA, 22 bp, Homo sapiens
cctggagcacagcccagtccca

SEQ ID NO: 9185278 - DNA, 22 bp, Homo sapiens
cctggagcacatggcaggaggc

SEQ ID NO: 9185279 - DNA, 22 bp, Homo sapiens
cctggagattatttggtccaat

SEQ ID NO: 9185280 - DNA, 22 bp, Homo sapiens
cctggagattatttggtccaat

SEQ ID NO: 9185281 - DNA, 22 bp, Homo sapiens
cctggagcaaaaatctaaggag

SEQ ID NO: 9185282 - DNA, 22 bp, Homo sapiens
cctggagatttcttcaagcttt

SEQ ID NO: 9185283 - DNA, 19 bp, Homo sapiens
cctggaggtgaaggttctc

SEQ ID NO: 9185284 - DNA, 19 bp, Homo sapiens
cctggaggtgaaggttctc

SEQ ID NO: 9185285 - DNA, 22 bp, Homo sapiens
cctggagcacatggcaggaggc

SEQ ID NO: 9185286 - DNA, 22 bp, Homo sapiens
cctggcacatagtgggcatgca

SEQ ID NO: 9185287 - DNA, 22 bp, Homo sapiens
cctggcacatagtaagtactag

SEQ ID NO: 9185288 - DNA, 22 bp, Homo sapiens
tgtattcagggacatatatgta

SEQ ID NO: 9185289 - DNA, 22 bp, Homo sapiens
tgtattcaacttcttaaaaatt

SEQ ID NO: 9185290 - DNA, 21 bp, Homo sapiens
tgtcagctccctgtcctgtgt

SEQ ID NO: 9185291 - DNA, 22 bp, Homo sapiens
tgtcagctggagatggcatggg

SEQ ID NO: 9185292 - DNA, 22 bp, Homo sapiens
tgtcaggacattttatgaatca

SEQ ID NO: 9185293 - DNA, 22 bp, Homo sapiens
tgtattatcaagtaaatacatg

SEQ ID NO: 9185294 - DNA, 22 bp, Homo sapiens
tgtattagagcagtagaattat

SEQ ID NO: 9185295 - DNA, 22 bp, Homo sapiens
tgtattaggttgatgcgaaagt

SEQ ID NO: 9185296 - DNA, 22 bp, Homo sapiens
tgtattagagcatataatttga

SEQ ID NO: 9185297 - DNA, 22 bp, Homo sapiens
tgtattaacattaataaaatgg

SEQ ID NO: 9185298 - DNA, 22 bp, Homo sapiens
tgtattaacattaataaaatgg

SEQ ID NO: 9185299 - DNA, 22 bp, Homo sapiens
tgtcatgcccaggagcaaggta

SEQ ID NO: 9185300 - DNA, 22 bp, Homo sapiens
tgtcatggtagctgaaggatgt

SEQ ID NO: 9185301 - DNA, 22 bp, Homo sapiens
tgtcatgtgagggaacttgttc

SEQ ID NO: 9185302 - DNA, 22 bp, Homo sapiens
tgtcatgtaaagagtaaatggt

SEQ ID NO: 9185303 - DNA, 22 bp, Homo sapiens
tgtcatgtagcattttatgtct

SEQ ID NO: 9185304 - DNA, 22 bp, Homo sapiens
tgtcatgtaacctttctgagcc

SEQ ID NO: 9185305 - DNA, 22 bp, Homo sapiens
tgtcatgtataagacactgtgt

SEQ ID NO: 9185306 - DNA, 22 bp, Homo sapiens
cctggcagacagcactgaagct

SEQ ID NO: 9185307 - DNA, 22 bp, Homo sapiens
cctggcagacagcactgaagct

SEQ ID NO: 9185308 - DNA, 22 bp, Homo sapiens
tgtatgtctgtgaattcatatt

SEQ ID NO: 9185309 - DNA, 22 bp, Homo sapiens
tgtatgtgcttgagaaggtggg

SEQ ID NO: 9185310 - DNA, 22 bp, Homo sapiens
tgtatgtgcaatgtttatatgt

SEQ ID NO: 9185311 - DNA, 22 bp, Homo sapiens
cctggcacgaagggctgaggtt

SEQ ID NO: 9185312 - DNA, 22 bp, Homo sapiens
cctggcacgaagggctgaggtt

SEQ ID NO: 9185313 - DNA, 22 bp, Homo sapiens
cctggcacatgatagatgctca

SEQ ID NO: 9185314 - DNA, 22 bp, Homo sapiens
cctggcacatctaactcactct

SEQ ID NO: 9185315 - DNA, 22 bp, Homo sapiens
cctggcagaaagagttacacct

SEQ ID NO: 9185316 - DNA, 22 bp, Homo sapiens
cctggcactgaccaggcactga

SEQ ID NO: 9185317 - DNA, 22 bp, Homo sapiens
cctggcactgaccaggcactga

SEQ ID NO: 9185318 - DNA, 22 bp, Homo sapiens
cctggcactgaccaggcactga

SEQ ID NO: 9185319 - DNA, 22 bp, Homo sapiens
cctggcactgctgaagtcctgg

SEQ ID NO: 9185320 - DNA, 22 bp, Homo sapiens
cctggaaaatgccactttcaca

SEQ ID NO: 9185321 - DNA, 22 bp, Homo sapiens
cctggactgtgtcctgtggtca

SEQ ID NO: 9185322 - DNA, 22 bp, Homo sapiens
cctggagaccagaggatacttc

SEQ ID NO: 9185323 - DNA, 21 bp, Homo sapiens
cctggagacaaagacagggtg

SEQ ID NO: 9185324 - DNA, 22 bp, Homo sapiens
cctggagaccagaggatacttc

SEQ ID NO: 9185325 - DNA, 22 bp, Homo sapiens
tgtaaacagccccatggagagc

SEQ ID NO: 9185326 - DNA, 22 bp, Homo sapiens
tgtaaacataccagagccaagt

SEQ ID NO: 9185327 - DNA, 22 bp, Homo sapiens
tgtaaacatatcagactttctt

SEQ ID NO: 9185328 - DNA, 22 bp, Homo sapiens
tgtaaacagtaggactaaagag

SEQ ID NO: 9185329 - DNA, 22 bp, Homo sapiens
cctggagacgaggctggaccat

SEQ ID NO: 9185330 - DNA, 22 bp, Homo sapiens
cctggagagagaggccaactgc

SEQ ID NO: 9185331 - DNA, 22 bp, Homo sapiens
cctggagacctgatggcagcgg

SEQ ID NO: 9185332 - DNA, 22 bp, Homo sapiens
tggtggcgggcagggccgtcac

SEQ ID NO: 9185333 - DNA, 17 bp, Homo sapiens
tggtggctggagtcagg

SEQ ID NO: 9185334 - DNA, 22 bp, Homo sapiens
tggtggctgttgcagaactgag

SEQ ID NO: 9185335 - DNA, 23 bp, Homo sapiens
tggtggcttgtggtggccaccag

SEQ ID NO: 9185336 - DNA, 22 bp, Homo sapiens
tggtgctgataatggcaggatt

SEQ ID NO: 9185337 - DNA, 22 bp, Homo sapiens
tggtccgctcctattcgccgca

SEQ ID NO: 9185338 - DNA, 22 bp, Homo sapiens
cctgccagtgaagctgacgggc

SEQ ID NO: 9185339 - DNA, 22 bp, Homo sapiens
cctgccagtgcctcccactggt

SEQ ID NO: 9185340 - DNA, 22 bp, Homo sapiens
cctgcccacagagagggtgcat

SEQ ID NO: 9185341 - DNA, 22 bp, Homo sapiens
tggtgccttgggcctacagcgc

SEQ ID NO: 9185342 - DNA, 22 bp, Homo sapiens
tggtctttgagagaagttgatt

SEQ ID NO: 9185343 - DNA, 22 bp, Homo sapiens
cctgcccactgcccggtcagcc

SEQ ID NO: 9185344 - DNA, 17 bp, Homo sapiens
cctgcccagagacagat

SEQ ID NO: 9185345 - DNA, 17 bp, Homo sapiens
cctgcccagagacagat

SEQ ID NO: 9185346 - DNA, 22 bp, Homo sapiens
tggtcttagctggaaggaggga

SEQ ID NO: 9185347 - DNA, 22 bp, Homo sapiens
tggtctttaaggtagctgtcat

SEQ ID NO: 9185348 - DNA, 22 bp, Homo sapiens
tggtcttgtactatgttgcatt

SEQ ID NO: 9185349 - DNA, 19 bp, Homo sapiens
tggtcccatactgctggcc

SEQ ID NO: 9185350 - DNA, 22 bp, Homo sapiens
tggtccatgtcctccatctctc

SEQ ID NO: 9185351 - DNA, 22 bp, Homo sapiens
tggtccctagcacagctgtcct

SEQ ID NO: 9185352 - DNA, 21 bp, Homo sapiens
tggtccctttcagagtctgga

SEQ ID NO: 9185353 - DNA, 21 bp, Homo sapiens
cctctgtgctaaagggctccc

SEQ ID NO: 9185354 - DNA, 22 bp, Homo sapiens
cctctgtgcctcgtgtcctctg

SEQ ID NO: 9185355 - DNA, 22 bp, Homo sapiens
tgtcctccagcagcatggtatg

SEQ ID NO: 9185356 - DNA, 22 bp, Homo sapiens
tgtcccagatcacaggagggga

SEQ ID NO: 9185357 - DNA, 22 bp, Homo sapiens
tgtcctcaggacctggcacagt

SEQ ID NO: 9185358 - DNA, 22 bp, Homo sapiens
tgtcccagacataagtggacat

SEQ ID NO: 9185359 - DNA, 22 bp, Homo sapiens
tgtcccagacataagtggacat

SEQ ID NO: 9185360 - DNA, 23 bp, Homo sapiens
tgtcccagagggagggataggct

SEQ ID NO: 9185361 - DNA, 22 bp, Homo sapiens
tgtccatggagaagctcagggc

SEQ ID NO: 9185362 - DNA, 22 bp, Homo sapiens
tgtccagttttctataaggttc

SEQ ID NO: 9185363 - DNA, 22 bp, Homo sapiens
tgtccatacaatgtaacatctt

SEQ ID NO: 9185364 - DNA, 22 bp, Homo sapiens
tgtccaggttagcttcaaacac

SEQ ID NO: 9185365 - DNA, 22 bp, Homo sapiens
cctggccatagggcccaggaaa

SEQ ID NO: 9185366 - DNA, 22 bp, Homo sapiens
cctggcagttttgcccaggatt

SEQ ID NO: 9185367 - DNA, 22 bp, Homo sapiens
cctggcagttcatcaaatggca

SEQ ID NO: 9185368 - DNA, 22 bp, Homo sapiens
cctggccaggctctcagcactg

SEQ ID NO: 9185369 - DNA, 22 bp, Homo sapiens
cctggccaggctccaagtactg

SEQ ID NO: 9185370 - DNA, 22 bp, Homo sapiens
cctggccagctaattgcccatc

SEQ ID NO: 9185371 - DNA, 22 bp, Homo sapiens
cctggcagcattggtagagatt

SEQ ID NO: 9185372 - DNA, 22 bp, Homo sapiens
cctggcagcaggtgggcccgtg

SEQ ID NO: 9185373 - DNA, 18 bp, Homo sapiens
cctggcagccatgcgcgc

SEQ ID NO: 9185374 - DNA, 22 bp, Homo sapiens
cctggcagcaggtgggcccgtg

SEQ ID NO: 9185375 - DNA, 23 bp, Homo sapiens
cctggcagcaaacgaggaggtta

SEQ ID NO: 9185376 - DNA, 22 bp, Homo sapiens
cctggcagactgtgagggcagg

SEQ ID NO: 9185377 - DNA, 22 bp, Homo sapiens
cctggcagactgtgagggcagg

SEQ ID NO: 9185378 - DNA, 22 bp, Homo sapiens
tgtcattaagtagggatttgtg

SEQ ID NO: 9185379 - DNA, 22 bp, Homo sapiens
tgtcattaagtcctttggcgga

SEQ ID NO: 9185380 - DNA, 22 bp, Homo sapiens
tgtcatgtttcatgtttgtagg

SEQ ID NO: 9185381 - DNA, 22 bp, Homo sapiens
tgtcatgtttcatgtttgtagg

SEQ ID NO: 9185382 - DNA, 22 bp, Homo sapiens
tgtcattattagagttgtgctt

SEQ ID NO: 9185383 - DNA, 22 bp, Homo sapiens
tgtcattatttgcctactgact

SEQ ID NO: 9185384 - DNA, 22 bp, Homo sapiens
tgtcattatgaggattacaata

SEQ ID NO: 9185385 - DNA, 22 bp, Homo sapiens
cctggcaggctggggacagtgc

SEQ ID NO: 9185386 - DNA, 22 bp, Homo sapiens
cctggcaggcaagaggaaggga

SEQ ID NO: 9185387 - DNA, 22 bp, Homo sapiens
cctggcaggcaagaggaaggga

SEQ ID NO: 9185388 - DNA, 22 bp, Homo sapiens
cctggcaggcccctcctggatt

SEQ ID NO: 9185389 - DNA, 22 bp, Homo sapiens
cctggcaggcccctcctggatt

SEQ ID NO: 9185390 - DNA, 22 bp, Homo sapiens
cctggcagtcaggggagtcctt

SEQ ID NO: 9185391 - DNA, 22 bp, Homo sapiens
cctggcaggtggcgccctcggc

SEQ ID NO: 9185392 - DNA, 22 bp, Homo sapiens
cctggcaggtggcgccctcggc

SEQ ID NO: 9185393 - DNA, 22 bp, Homo sapiens
cctggctctgaagtccacatca

SEQ ID NO: 9185394 - DNA, 22 bp, Homo sapiens
cctggctctagaggccactcct

SEQ ID NO: 9185395 - DNA, 22 bp, Homo sapiens
cctggctctctgcagatcctgg

SEQ ID NO: 9185396 - DNA, 22 bp, Homo sapiens
cctggctctctgcagatcctgg

SEQ ID NO: 9185397 - DNA, 22 bp, Homo sapiens
cctggctctagaggccactcct

SEQ ID NO: 9185398 - DNA, 22 bp, Homo sapiens
cctggctctagaggccactcct

SEQ ID NO: 9185399 - DNA, 22 bp, Homo sapiens
cctggctctagaggccactcct

SEQ ID NO: 9185400 - DNA, 22 bp, Homo sapiens
cctggctcgctgacctcagggg

SEQ ID NO: 9185401 - DNA, 22 bp, Homo sapiens
cctggctcgctgacctcagggg

SEQ ID NO: 9185402 - DNA, 22 bp, Homo sapiens
cctggctcgctgacctcagggg

SEQ ID NO: 9185403 - DNA, 22 bp, Homo sapiens
cctggctcctgcctctgcaggg

SEQ ID NO: 9185404 - DNA, 22 bp, Homo sapiens
cctggctcctgcctctgcaggg

SEQ ID NO: 9185405 - DNA, 22 bp, Homo sapiens
cctggctcctgcctctgcaggg

SEQ ID NO: 9185406 - DNA, 22 bp, Homo sapiens
cctggctcctgcacagatcttt

SEQ ID NO: 9185407 - DNA, 22 bp, Homo sapiens
cctggctccgtgtcacgtgccc

SEQ ID NO: 9185408 - DNA, 22 bp, Homo sapiens
cctggctccgtgtcacgtgccc

SEQ ID NO: 9185409 - DNA, 22 bp, Homo sapiens
cctggctcctgcctctgcaggg

SEQ ID NO: 9185410 - DNA, 22 bp, Homo sapiens
cctggctcctgcacagatcttt

SEQ ID NO: 9185411 - DNA, 22 bp, Homo sapiens
cctggctccggttcaagggaaa

SEQ ID NO: 9185412 - DNA, 22 bp, Homo sapiens
cctggctccctggacctcatta

SEQ ID NO: 9185413 - DNA, 22 bp, Homo sapiens
cctggctccctgcacagggctc

SEQ ID NO: 9185414 - DNA, 22 bp, Homo sapiens
cctggctcccggaacagggtct

SEQ ID NO: 9185415 - DNA, 22 bp, Homo sapiens
cctggctcccggaacagggtct

SEQ ID NO: 9185416 - DNA, 22 bp, Homo sapiens
cctggcctgctcggctcttaag

SEQ ID NO: 9185417 - DNA, 21 bp, Homo sapiens
cctggctccagaacttccggt

SEQ ID NO: 9185418 - DNA, 22 bp, Homo sapiens
cctggctccaaagctgtgactc

SEQ ID NO: 9185419 - DNA, 22 bp, Homo sapiens
cctggctccagctgcctgtcct

SEQ ID NO: 9185420 - DNA, 22 bp, Homo sapiens
cctggctcccccatcatagctg

SEQ ID NO: 9185421 - DNA, 22 bp, Homo sapiens
cctggctccagctgcctgtcct

SEQ ID NO: 9185422 - DNA, 22 bp, Homo sapiens
cctggctcccccatcatagctg

SEQ ID NO: 9185423 - DNA, 22 bp, Homo sapiens
cctggccctggaatagggcagg

SEQ ID NO: 9185424 - DNA, 22 bp, Homo sapiens
cctggccctggaatagggcagg

SEQ ID NO: 9185425 - DNA, 19 bp, Homo sapiens
cctggccctgctgcgcggg

SEQ ID NO: 9185426 - DNA, 22 bp, Homo sapiens
cctggcccacatggcttctccc

SEQ ID NO: 9185427 - DNA, 22 bp, Homo sapiens
cctggcccagggactttcgcct

SEQ ID NO: 9185428 - DNA, 19 bp, Homo sapiens
cctggccctgctgcgcggg

SEQ ID NO: 9185429 - DNA, 22 bp, Homo sapiens
cctggcccagggactttcgcct

SEQ ID NO: 9185430 - DNA, 16 bp, Homo sapiens
cctggcccggcttcct

SEQ ID NO: 9185431 - DNA, 19 bp, Homo sapiens
cctggccctgctgcgcggg

SEQ ID NO: 9185432 - DNA, 18 bp, Homo sapiens
tgtctcaggctgaaacag

SEQ ID NO: 9185433 - DNA, 22 bp, Homo sapiens
tgtctcagaggcaggaagagcc

SEQ ID NO: 9185434 - DNA, 22 bp, Homo sapiens
tgtctatttttactggaccatg

SEQ ID NO: 9185435 - DNA, 22 bp, Homo sapiens
tgtcctctccaacagcctctgt

SEQ ID NO: 9185436 - DNA, 22 bp, Homo sapiens
tgtcctgcaagccctaatgaat

SEQ ID NO: 9185437 - DNA, 22 bp, Homo sapiens
tgtcctgccatttccatagcct

SEQ ID NO: 9185438 - DNA, 22 bp, Homo sapiens
tgtcctggaaaaatggagagtt

SEQ ID NO: 9185439 - DNA, 22 bp, Homo sapiens
tgtctcatctcttaaccccact

SEQ ID NO: 9185440 - DNA, 22 bp, Homo sapiens
tgtctcatctcttaaccccact

SEQ ID NO: 9185441 - DNA, 22 bp, Homo sapiens
tgtctcagtatacgaaacactt

SEQ ID NO: 9185442 - DNA, 22 bp, Homo sapiens
tgtctcagtacactccgatgtt

SEQ ID NO: 9185443 - DNA, 22 bp, Homo sapiens
tgtctcagtatacgaaacactt

SEQ ID NO: 9185444 - DNA, 22 bp, Homo sapiens
tgtctctggctgcagcctgttc

SEQ ID NO: 9185445 - DNA, 22 bp, Homo sapiens
tgtctctggcccatgagcagag

SEQ ID NO: 9185446 - DNA, 22 bp, Homo sapiens
tgtctcttctgcctccagctgt

SEQ ID NO: 9185447 - DNA, 22 bp, Homo sapiens
tgtctcttctgcctccagctgt

SEQ ID NO: 9185448 - DNA, 22 bp, Homo sapiens
tgtctcttactttgattcttgg

SEQ ID NO: 9185449 - DNA, 22 bp, Homo sapiens
tgtctcttcagcccatggcttc

SEQ ID NO: 9185450 - DNA, 22 bp, Homo sapiens
tgtctcttactttgattcttgg

SEQ ID NO: 9185451 - DNA, 22 bp, Homo sapiens
tgtctcttggagggtctagtga

SEQ ID NO: 9185452 - DNA, 22 bp, Homo sapiens
tgtctcttgagtttgttttaat

SEQ ID NO: 9185453 - DNA, 22 bp, Homo sapiens
tgtctcttgagtttgttttaat

SEQ ID NO: 9185454 - DNA, 18 bp, Homo sapiens
tgtctcttcttatgtggg

SEQ ID NO: 9185455 - DNA, 22 bp, Homo sapiens
tgtctcttggctctatcactta

SEQ ID NO: 9185456 - DNA, 22 bp, Homo sapiens
tgtctcttggctctatcactta

SEQ ID NO: 9185457 - DNA, 22 bp, Homo sapiens
ctctgggagtggccacttctca

SEQ ID NO: 9185458 - DNA, 22 bp, Homo sapiens
ctctgggatagagcctcggtct

SEQ ID NO: 9185459 - DNA, 22 bp, Homo sapiens
ctctgggatgaggcctaggcac

SEQ ID NO: 9185460 - DNA, 22 bp, Homo sapiens
ctctgggcaaagatgcctcatc

SEQ ID NO: 9185461 - DNA, 22 bp, Homo sapiens
ctctgggcaagtatgatagaaa

SEQ ID NO: 9185462 - DNA, 22 bp, Homo sapiens
ctctgggcaagtatgatagaaa

SEQ ID NO: 9185463 - DNA, 22 bp, Homo sapiens
ctctgggcaaagatgcctcatc

SEQ ID NO: 9185464 - DNA, 19 bp, Homo sapiens
ctctgggcaagtcacttaa

SEQ ID NO: 9185465 - DNA, 22 bp, Homo sapiens
ctctgggcaagtttcttcatga

SEQ ID NO: 9185466 - DNA, 22 bp, Homo sapiens
ctctgggcaggacgccaggcct

SEQ ID NO: 9185467 - DNA, 22 bp, Homo sapiens
ctctgggcaggacgccaggcct

SEQ ID NO: 9185468 - DNA, 22 bp, Homo sapiens
ctctgggccaccgctggtgtat

SEQ ID NO: 9185469 - DNA, 22 bp, Homo sapiens
ctctgggcaggaccagtggacc

SEQ ID NO: 9185470 - DNA, 22 bp, Homo sapiens
ctctgggcacattttccaggac

SEQ ID NO: 9185471 - DNA, 22 bp, Homo sapiens
ctctgggcaccaaagagcagct

SEQ ID NO: 9185472 - DNA, 22 bp, Homo sapiens
ctctgggcaccaaagagcagct

SEQ ID NO: 9185473 - DNA, 22 bp, Homo sapiens
ctctgggcactgtatgggttct

SEQ ID NO: 9185474 - DNA, 17 bp, Homo sapiens
ctctgggcagcctgggg

SEQ ID NO: 9185475 - DNA, 17 bp, Homo sapiens
ctctgggcagcctgggg

SEQ ID NO: 9185476 - DNA, 22 bp, Homo sapiens
ttttattctaagtatgatggga

SEQ ID NO: 9185477 - DNA, 22 bp, Homo sapiens
ttttattctcaagacaatggga

SEQ ID NO: 9185478 - DNA, 22 bp, Homo sapiens
ttttattcatagggatggagag

SEQ ID NO: 9185479 - DNA, 22 bp, Homo sapiens
ttttattcaaatagttcacact

SEQ ID NO: 9185480 - DNA, 23 bp, Homo sapiens
ttttattgatatgtagctgttgt

SEQ ID NO: 9185481 - DNA, 22 bp, Homo sapiens
ttttattctcagctccagagag

SEQ ID NO: 9185482 - DNA, 22 bp, Homo sapiens
ttttattctcagctccagagag

SEQ ID NO: 9185483 - DNA, 22 bp, Homo sapiens
ttttattctcaagacaatggga

SEQ ID NO: 9185484 - DNA, 22 bp, Homo sapiens
ttttattctcagctccagagag

SEQ ID NO: 9185485 - DNA, 23 bp, Homo sapiens
ctctgggcgggcaggtcagcctc

SEQ ID NO: 9185486 - DNA, 23 bp, Homo sapiens
ctctgggcgggcaggtcagcctc

SEQ ID NO: 9185487 - DNA, 23 bp, Homo sapiens
ctctgggcgggcaggtcagcctc

SEQ ID NO: 9185488 - DNA, 22 bp, Homo sapiens
ctctgggcggcccaggccaacc

SEQ ID NO: 9185489 - DNA, 22 bp, Homo sapiens
ctctgggcggcccaggccaacc

SEQ ID NO: 9185490 - DNA, 22 bp, Homo sapiens
ctctgggcccacttaaatctgg

SEQ ID NO: 9185491 - DNA, 21 bp, Homo sapiens
ctctgggccattttcttccac

SEQ ID NO: 9185492 - DNA, 22 bp, Homo sapiens
ctctgggccatgctactgctct

SEQ ID NO: 9185493 - DNA, 22 bp, Homo sapiens
ttttagttgtactgtcaacagt

SEQ ID NO: 9185494 - DNA, 22 bp, Homo sapiens
ctctgggctgaatggctgaacc

SEQ ID NO: 9185495 - DNA, 22 bp, Homo sapiens
ctctgggctgaatggctgaacc

SEQ ID NO: 9185496 - DNA, 22 bp, Homo sapiens
ctctgggctccttcagcccttt

SEQ ID NO: 9185497 - DNA, 22 bp, Homo sapiens
tttgtctttcccctcctcattg

SEQ ID NO: 9185498 - DNA, 22 bp, Homo sapiens
tttgtctttcccctcctcattg

SEQ ID NO: 9185499 - DNA, 22 bp, Homo sapiens
tttgtctttcccctcctcattg

SEQ ID NO: 9185500 - DNA, 22 bp, Homo sapiens
tttgtcttgtgtccttaggacc

SEQ ID NO: 9185501 - DNA, 22 bp, Homo sapiens
ctctcctctgaagtggtgaccc

SEQ ID NO: 9185502 - DNA, 22 bp, Homo sapiens
ctctcctcccatgtaggagatg

SEQ ID NO: 9185503 - DNA, 22 bp, Homo sapiens
ctctcctctgaagtggtgaccc

SEQ ID NO: 9185504 - DNA, 22 bp, Homo sapiens
ctctcctcccatgtaggagatg

SEQ ID NO: 9185505 - DNA, 23 bp, Homo sapiens
ctctcctgaaggacaagctgccg

SEQ ID NO: 9185506 - DNA, 22 bp, Homo sapiens
tttgtacatcctaattctgagt

SEQ ID NO: 9185507 - DNA, 22 bp, Homo sapiens
tttgtacatcctaattctgagt

SEQ ID NO: 9185508 - DNA, 22 bp, Homo sapiens
tttgtcttggccaaggttctga

SEQ ID NO: 9185509 - DNA, 22 bp, Homo sapiens
tttgtcttgaggctggggaagt

SEQ ID NO: 9185510 - DNA, 22 bp, Homo sapiens
ctctggctggctgggcctcagt

SEQ ID NO: 9185511 - DNA, 22 bp, Homo sapiens
ctctggctggctgggcctcagt

SEQ ID NO: 9185512 - DNA, 22 bp, Homo sapiens
ctctggctgtcccgatgagcag

SEQ ID NO: 9185513 - DNA, 22 bp, Homo sapiens
ctctggctgtcccgatgagcag

SEQ ID NO: 9185514 - DNA, 22 bp, Homo sapiens
ctctggctggcattgctggact

SEQ ID NO: 9185515 - DNA, 19 bp, Homo sapiens
ctctggcttccaaagcatc

SEQ ID NO: 9185516 - DNA, 22 bp, Homo sapiens
ctctggcttagtatgctccaaa

SEQ ID NO: 9185517 - DNA, 19 bp, Homo sapiens
ctctggctcctgggctgcc

SEQ ID NO: 9185518 - DNA, 22 bp, Homo sapiens
ctctggctgcctctcaggcctg

SEQ ID NO: 9185519 - DNA, 22 bp, Homo sapiens
ctctggctgcggggcgcgtgga

SEQ ID NO: 9185520 - DNA, 22 bp, Homo sapiens
tttttaagctcctttgatgtca

SEQ ID NO: 9185521 - DNA, 22 bp, Homo sapiens
tttttaagagattctccagtct

SEQ ID NO: 9185522 - DNA, 22 bp, Homo sapiens
ttttgttttcttagaaacctgg

SEQ ID NO: 9185523 - DNA, 22 bp, Homo sapiens
ttttgttttcttagaaacctgg

SEQ ID NO: 9185524 - DNA, 22 bp, Homo sapiens
ctctttttcagccttaccaaag

SEQ ID NO: 9185525 - DNA, 19 bp, Homo sapiens
ctgaaaaacattctcagga

SEQ ID NO: 9185526 - DNA, 17 bp, Homo sapiens
ctcttttgtcttcttcc

SEQ ID NO: 9185527 - DNA, 20 bp, Homo sapiens
ctcttttgactctttgcaag

SEQ ID NO: 9185528 - DNA, 20 bp, Homo sapiens
ctcttttcactctcagtggt

SEQ ID NO: 9185529 - DNA, 22 bp, Homo sapiens
ctcttttcaaacctgtttatgg

SEQ ID NO: 9185530 - DNA, 22 bp, Homo sapiens
ctctttgtatttctttgggcca

SEQ ID NO: 9185531 - DNA, 22 bp, Homo sapiens
ctctttggttaatcacacagat

SEQ ID NO: 9185532 - DNA, 21 bp, Homo sapiens
ctctttgtggcaatgtatttt

SEQ ID NO: 9185533 - DNA, 22 bp, Homo sapiens
ctctggttcagggctccctggc

SEQ ID NO: 9185534 - DNA, 22 bp, Homo sapiens
ctctggtcaagcaaagaggttt

SEQ ID NO: 9185535 - DNA, 21 bp, Homo sapiens
ctctggtcctgtctggcaggc

SEQ ID NO: 9185536 - DNA, 22 bp, Homo sapiens
ctctggtcatttggaagagcat

SEQ ID NO: 9185537 - DNA, 23 bp, Homo sapiens
ttttattgatatgtagctgttgt

SEQ ID NO: 9185538 - DNA, 23 bp, Homo sapiens
ttttattgatatgtagctgttgt

SEQ ID NO: 9185539 - DNA, 23 bp, Homo sapiens
ttttattgatatgtagctgttgt

SEQ ID NO: 9185540 - DNA, 21 bp, Homo sapiens
ttttattgatgaatggccact

SEQ ID NO: 9185541 - DNA, 22 bp, Homo sapiens
ctctgggttcactgaggctctg

SEQ ID NO: 9185542 - DNA, 17 bp, Homo sapiens
ctgaagataatggcaac

SEQ ID NO: 9185543 - DNA, 17 bp, Homo sapiens
ctgaagagtcctggcta

SEQ ID NO: 9185544 - DNA, 20 bp, Homo sapiens
ctgaagagtggcctgatctg

SEQ ID NO: 9185545 - DNA, 22 bp, Homo sapiens
ctgactgtaattctgttcttaa

SEQ ID NO: 9185546 - DNA, 22 bp, Homo sapiens
ctgaagatgatgatactaagga

SEQ ID NO: 9185547 - DNA, 22 bp, Homo sapiens
ctgaagatagtgtctgatcatg

SEQ ID NO: 9185548 - DNA, 22 bp, Homo sapiens
ctgaagatgaggctgctggggg

SEQ ID NO: 9185549 - DNA, 22 bp, Homo sapiens
ctgaagaggacgcagcagcaag

SEQ ID NO: 9185550 - DNA, 22 bp, Homo sapiens
ctgaagaggactgggttggagg

SEQ ID NO: 9185551 - DNA, 22 bp, Homo sapiens
ctgaagaggttgttgaggaata

SEQ ID NO: 9185552 - DNA, 22 bp, Homo sapiens
ctgaagaggctccgcccacaag

SEQ ID NO: 9185553 - DNA, 22 bp, Homo sapiens
ctgaagaggagaccgcgcccac

SEQ ID NO: 9185554 - DNA, 22 bp, Homo sapiens
ctgaagaggacgcagcagcaag

SEQ ID NO: 9185555 - DNA, 22 bp, Homo sapiens
ctgaagagctctcctgtcccct

SEQ ID NO: 9185556 - DNA, 23 bp, Homo sapiens
ctgaagagccaacaaaaagcttg

SEQ ID NO: 9185557 - DNA, 22 bp, Homo sapiens
ctgaagagcactgtggccagtt

SEQ ID NO: 9185558 - DNA, 20 bp, Homo sapiens
ctgagaactatgactgtctt

SEQ ID NO: 9185559 - DNA, 22 bp, Homo sapiens
ctgagaaagtttatgtttattt

SEQ ID NO: 9185560 - DNA, 22 bp, Homo sapiens
ctgagaaatacccaagtctggt

SEQ ID NO: 9185561 - DNA, 22 bp, Homo sapiens
ctgagaaattctttctttcact

SEQ ID NO: 9185562 - DNA, 22 bp, Homo sapiens
ctgagaaatacccaagtctggt

SEQ ID NO: 9185563 - DNA, 22 bp, Homo sapiens
ctgaagagactggagggggcat

SEQ ID NO: 9185564 - DNA, 20 bp, Homo sapiens
ctgaagagactggaggggca

SEQ ID NO: 9185565 - DNA, 22 bp, Homo sapiens
ctgaagagatgtcaatattggc

SEQ ID NO: 9185566 - DNA, 22 bp, Homo sapiens
ctgaagagcaaaccaactggac

SEQ ID NO: 9185567 - DNA, 20 bp, Homo sapiens
ctgaagagactggaggggca

SEQ ID NO: 9185568 - DNA, 22 bp, Homo sapiens
ctgaagagaaatgtacacatgg

SEQ ID NO: 9185569 - DNA, 22 bp, Homo sapiens
ctgaagagaaagggagctcttc

SEQ ID NO: 9185570 - DNA, 22 bp, Homo sapiens
ctgaacttattgagtgcttgct

SEQ ID NO: 9185571 - DNA, 22 bp, Homo sapiens
ctgaaaggagagctgcaaggat

SEQ ID NO: 9185572 - DNA, 22 bp, Homo sapiens
tttttaatgcagtctgagacat

SEQ ID NO: 9185573 - DNA, 22 bp, Homo sapiens
ctgaacatcatagagtgtactt

SEQ ID NO: 9185574 - DNA, 22 bp, Homo sapiens
ctgcagacctctgaggtccatg

SEQ ID NO: 9185575 - DNA, 22 bp, Homo sapiens
ctgcagacctctgaggtccatg

SEQ ID NO: 9185576 - DNA, 22 bp, Homo sapiens
ctgcaaaagtaattgcaggttt

SEQ ID NO: 9185577 - DNA, 22 bp, Homo sapiens
ctgcacttgacatgctctcaga

SEQ ID NO: 9185578 - DNA, 22 bp, Homo sapiens
ctgcagagcatgaggaggtctg

SEQ ID NO: 9185579 - DNA, 22 bp, Homo sapiens
ctgcagagcatgaggaggtctg

SEQ ID NO: 9185580 - DNA, 22 bp, Homo sapiens
ctgcagagcataaatctgaata

SEQ ID NO: 9185581 - DNA, 22 bp, Homo sapiens
ctgattgctaacctgttagaat

SEQ ID NO: 9185582 - DNA, 22 bp, Homo sapiens
ctgattccagagtctgtgttct

SEQ ID NO: 9185583 - DNA, 22 bp, Homo sapiens
ctgatgcaggtggtttaaaaac

SEQ ID NO: 9185584 - DNA, 22 bp, Homo sapiens
ctgatgcatggttacatataca

SEQ ID NO: 9185585 - DNA, 22 bp, Homo sapiens
ctgatgcttgcaacaaagaacc

SEQ ID NO: 9185586 - DNA, 22 bp, Homo sapiens
ctgaggcactgtcagctgaggc

SEQ ID NO: 9185587 - DNA, 22 bp, Homo sapiens
ctgaggcactgtcagctgaggc

SEQ ID NO: 9185588 - DNA, 19 bp, Homo sapiens
ctgaggcaagtggtggtca

SEQ ID NO: 9185589 - DNA, 22 bp, Homo sapiens
ctgaggagtgggtgggcagtga

SEQ ID NO: 9185590 - DNA, 22 bp, Homo sapiens
ctgaggagtgggtgggcagtga

SEQ ID NO: 9185591 - DNA, 22 bp, Homo sapiens
ctgaggagtgggtgggcagtga

SEQ ID NO: 9185592 - DNA, 22 bp, Homo sapiens
ctgaggagtgggtgggcagtga

SEQ ID NO: 9185593 - DNA, 22 bp, Homo sapiens
ctgaggagtgggtgggcagtga

SEQ ID NO: 9185594 - DNA, 22 bp, Homo sapiens
ctgaggaggggcctgagtgaga

SEQ ID NO: 9185595 - DNA, 22 bp, Homo sapiens
ctgaggaggggcctgagtgaga

SEQ ID NO: 9185596 - DNA, 22 bp, Homo sapiens
ctgaggagggaagtccccaaag

SEQ ID NO: 9185597 - DNA, 22 bp, Homo sapiens
ctgaggagtcagttccactcag

SEQ ID NO: 9185598 - DNA, 22 bp, Homo sapiens
ctgaggagtcagttccactcag

SEQ ID NO: 9185599 - DNA, 22 bp, Homo sapiens
ctgaggagtcagcttactcact

SEQ ID NO: 9185600 - DNA, 22 bp, Homo sapiens
ctgaggagtcagcttactcact

SEQ ID NO: 9185601 - DNA, 22 bp, Homo sapiens
ctgaggaggggcctgagtgaga

SEQ ID NO: 9185602 - DNA, 22 bp, Homo sapiens
ctgaggagtttgggttgttcaa

SEQ ID NO: 9185603 - DNA, 22 bp, Homo sapiens
ctgaggagtttgggttgttcaa

SEQ ID NO: 9185604 - DNA, 22 bp, Homo sapiens
ctgaggagtttcttatatgtgt

SEQ ID NO: 9185605 - DNA, 22 bp, Homo sapiens
ctgaggagtttcttatatgtgt

SEQ ID NO: 9185606 - DNA, 22 bp, Homo sapiens
ctgaggagtttcttatatgtgt

SEQ ID NO: 9185607 - DNA, 22 bp, Homo sapiens
ctgaggagttggtgaataagcc

SEQ ID NO: 9185608 - DNA, 22 bp, Homo sapiens
ctgaggagttggtgaataagcc

SEQ ID NO: 9185609 - DNA, 22 bp, Homo sapiens
ctgagagaatcatgctgcaggt

SEQ ID NO: 9185610 - DNA, 22 bp, Homo sapiens
ctgagagaatcatgctgcaggt

SEQ ID NO: 9185611 - DNA, 22 bp, Homo sapiens
ctgaggagaaagatggtccaag

SEQ ID NO: 9185612 - DNA, 22 bp, Homo sapiens
ctgaggagaaagatggtccaag

SEQ ID NO: 9185613 - DNA, 22 bp, Homo sapiens
ctgaggaccccacaggaggccc

SEQ ID NO: 9185614 - DNA, 22 bp, Homo sapiens
ctgagagatcaagccacaggat

SEQ ID NO: 9185615 - DNA, 22 bp, Homo sapiens
ctgaggagaaatgggatggttc

SEQ ID NO: 9185616 - DNA, 22 bp, Homo sapiens
ctgaggagaaagatggtccaag

SEQ ID NO: 9185617 - DNA, 22 bp, Homo sapiens
ctgaggagaaatgggatggttc

SEQ ID NO: 9185618 - DNA, 22 bp, Homo sapiens
ctgaggagggaagtccccaaag

SEQ ID NO: 9185619 - DNA, 22 bp, Homo sapiens
ctgaggaggggcctgagtgaga

SEQ ID NO: 9185620 - DNA, 22 bp, Homo sapiens
ctgaggaggggcctgagtgaga

SEQ ID NO: 9185621 - DNA, 22 bp, Homo sapiens
ctgaggaggctaatttgaggat

SEQ ID NO: 9185622 - DNA, 22 bp, Homo sapiens
ctgaggaggctaatttgaggat

SEQ ID NO: 9185623 - DNA, 22 bp, Homo sapiens
ctgagagaaacatgactcagga

SEQ ID NO: 9185624 - DNA, 22 bp, Homo sapiens
ctgagagaatcatgctgcaggt

SEQ ID NO: 9185625 - DNA, 22 bp, Homo sapiens
ctgagacccagacacctgagga

SEQ ID NO: 9185626 - DNA, 22 bp, Homo sapiens
ctgagactttcatgtgctttta

SEQ ID NO: 9185627 - DNA, 22 bp, Homo sapiens
ctgagaattactctgatgagta

SEQ ID NO: 9185628 - DNA, 22 bp, Homo sapiens
ctgccgttgtgaagctcttaga

SEQ ID NO: 9185629 - DNA, 20 bp, Homo sapiens
ctgccgaccacagccatgga

SEQ ID NO: 9185630 - DNA, 22 bp, Homo sapiens
ctgccatctgagggtccagcct

SEQ ID NO: 9185631 - DNA, 22 bp, Homo sapiens
ctgccatcgggggccccactgc

SEQ ID NO: 9185632 - DNA, 22 bp, Homo sapiens
ctgccatctgagccaaaagtgc

SEQ ID NO: 9185633 - DNA, 22 bp, Homo sapiens
ctgccagtctatgctgctcggc

SEQ ID NO: 9185634 - DNA, 22 bp, Homo sapiens
ctgccaggtgcctttgtgcagt

SEQ ID NO: 9185635 - DNA, 22 bp, Homo sapiens
ctgccaggttggcgctcgctct

SEQ ID NO: 9185636 - DNA, 22 bp, Homo sapiens
ctgccaggttggcgctcgctct

SEQ ID NO: 9185637 - DNA, 22 bp, Homo sapiens
ctgccaggtgcctttgtgcagt

SEQ ID NO: 9185638 - DNA, 22 bp, Homo sapiens
ctgccaggtaaactgcaggaat

SEQ ID NO: 9185639 - DNA, 22 bp, Homo sapiens
ctgccaggtgagctccaggcct

SEQ ID NO: 9185640 - DNA, 22 bp, Homo sapiens
ctgccaggtaaactgcaggaat

SEQ ID NO: 9185641 - DNA, 22 bp, Homo sapiens
ctgcctcagccttctgggtgac

SEQ ID NO: 9185642 - DNA, 22 bp, Homo sapiens
ctgcctcagcgttgtggcccta

SEQ ID NO: 9185643 - DNA, 22 bp, Homo sapiens
ctgcctcagccttctgggtgac

SEQ ID NO: 9185644 - DNA, 22 bp, Homo sapiens
ctgcctcagcgttgtggcccta

SEQ ID NO: 9185645 - DNA, 22 bp, Homo sapiens
ctgcctcagcgttgtggcccta

SEQ ID NO: 9185646 - DNA, 22 bp, Homo sapiens
ctgcctcagccttctgggtgac

SEQ ID NO: 9185647 - DNA, 22 bp, Homo sapiens
ctgcctcacattggctgtgtga

SEQ ID NO: 9185648 - DNA, 22 bp, Homo sapiens
ctgcctcatgctgcctgcagcc

SEQ ID NO: 9185649 - DNA, 22 bp, Homo sapiens
ctgcctcatgctgcctgcagcc

SEQ ID NO: 9185650 - DNA, 22 bp, Homo sapiens
ctgcctcctgccgtgcagcttc

SEQ ID NO: 9185651 - DNA, 22 bp, Homo sapiens
ctgcctcctcacgtccacagtg

SEQ ID NO: 9185652 - DNA, 22 bp, Homo sapiens
ctgcctcctcacgtccacagtg

SEQ ID NO: 9185653 - DNA, 22 bp, Homo sapiens
ctgccagctggagaccaaggaa

SEQ ID NO: 9185654 - DNA, 22 bp, Homo sapiens
ctgccagctctctggaggctct

SEQ ID NO: 9185655 - DNA, 22 bp, Homo sapiens
ctgccaggcctccgctgtcccc

SEQ ID NO: 9185656 - DNA, 22 bp, Homo sapiens
ctgccaggactgacgtcttcag

SEQ ID NO: 9185657 - DNA, 22 bp, Homo sapiens
ctgccaggcctccgctgtcccc

SEQ ID NO: 9185658 - DNA, 22 bp, Homo sapiens
ctgccaggcctccgctgtcccc

SEQ ID NO: 9185659 - DNA, 22 bp, Homo sapiens
ctgccaggcctggggtgctgtc

SEQ ID NO: 9185660 - DNA, 22 bp, Homo sapiens
ctgcagccacgagtcacagccc

SEQ ID NO: 9185661 - DNA, 22 bp, Homo sapiens
ctgccagctctctggaggctct

SEQ ID NO: 9185662 - DNA, 22 bp, Homo sapiens
ctgccagggccctactcagttt

SEQ ID NO: 9185663 - DNA, 22 bp, Homo sapiens
ctgccagggccctactcagttt

SEQ ID NO: 9185664 - DNA, 22 bp, Homo sapiens
ctgccagggccctactcagttt

SEQ ID NO: 9185665 - DNA, 22 bp, Homo sapiens
ctgccagggcatcctgtggtgg

SEQ ID NO: 9185666 - DNA, 22 bp, Homo sapiens
ctgccaggggcctcacaggcca

SEQ ID NO: 9185667 - DNA, 22 bp, Homo sapiens
ctgccaggggcctcacaggcca

SEQ ID NO: 9185668 - DNA, 22 bp, Homo sapiens
ctgccagggaggctgggaagtt

SEQ ID NO: 9185669 - DNA, 22 bp, Homo sapiens
ctgccaggcgatggattggctg

SEQ ID NO: 9185670 - DNA, 22 bp, Homo sapiens
ctgccaggcgatggattggctg

SEQ ID NO: 9185671 - DNA, 22 bp, Homo sapiens
ctgcagcagggcttgcccacct

SEQ ID NO: 9185672 - DNA, 22 bp, Homo sapiens
ctgcagcagtactcagcagcca

SEQ ID NO: 9185673 - DNA, 22 bp, Homo sapiens
ctgcagcagtactcagcagcca

SEQ ID NO: 9185674 - DNA, 22 bp, Homo sapiens
ctgcagcagcctccagccttgg

SEQ ID NO: 9185675 - DNA, 21 bp, Homo sapiens
ctgcagcaaaactttgctcct

SEQ ID NO: 9185676 - DNA, 22 bp, Homo sapiens
ctgcagcaagagaagtgctgac

SEQ ID NO: 9185677 - DNA, 22 bp, Homo sapiens
ctgcagagtggagcctcggctg

SEQ ID NO: 9185678 - DNA, 22 bp, Homo sapiens
ctgcagagtggagcctcggctg

SEQ ID NO: 9185679 - DNA, 22 bp, Homo sapiens
ctgcagagtatagcgagttggg

SEQ ID NO: 9185680 - DNA, 22 bp, Homo sapiens
ctgcagagtggagcctcggctg

SEQ ID NO: 9185681 - DNA, 22 bp, Homo sapiens
ctgcagagtatagcgagttggg

SEQ ID NO: 9185682 - DNA, 22 bp, Homo sapiens
ctgcagagtatagcgagttggg

SEQ ID NO: 9185683 - DNA, 22 bp, Homo sapiens
ctgcagaggtcttgctgatggt

SEQ ID NO: 9185684 - DNA, 22 bp, Homo sapiens
ctgcagaggtcttgctgatggt

SEQ ID NO: 9185685 - DNA, 22 bp, Homo sapiens
ctgcagagctttctgaatgaag

SEQ ID NO: 9185686 - DNA, 22 bp, Homo sapiens
ctgcagagctttctgaatgaag

SEQ ID NO: 9185687 - DNA, 22 bp, Homo sapiens
ctgcagagcttgtctggatgtg

SEQ ID NO: 9185688 - DNA, 22 bp, Homo sapiens
ctgcagagcttgtctggatgtg

SEQ ID NO: 9185689 - DNA, 22 bp, Homo sapiens
ctgcagagcttgtctggatgtg

SEQ ID NO: 9185690 - DNA, 22 bp, Homo sapiens
ctgcagagcttgtctggatgtg

SEQ ID NO: 9185691 - DNA, 22 bp, Homo sapiens
ctgcagagctaggctgagtgaa

SEQ ID NO: 9185692 - DNA, 22 bp, Homo sapiens
ctgcagagctaggctgagtgaa

SEQ ID NO: 9185693 - DNA, 22 bp, Homo sapiens
ctgcagagctaggctgagtgaa

SEQ ID NO: 9185694 - DNA, 22 bp, Homo sapiens
ctgcagaggggttgaagggtcc

SEQ ID NO: 9185695 - DNA, 22 bp, Homo sapiens
ctgcagagggtttgagcatcct

SEQ ID NO: 9185696 - DNA, 22 bp, Homo sapiens
ctgcagagggtttgagcatcct

SEQ ID NO: 9185697 - DNA, 22 bp, Homo sapiens
ctgcagaggcctcgcctcctct

SEQ ID NO: 9185698 - DNA, 22 bp, Homo sapiens
ctgcagaggcctcgcctcctct

SEQ ID NO: 9185699 - DNA, 22 bp, Homo sapiens
ctgcagaggggttgaagggtcc

SEQ ID NO: 9185700 - DNA, 22 bp, Homo sapiens
ctgcagaggggttgaagggtcc

SEQ ID NO: 9185701 - DNA, 22 bp, Homo sapiens
ctggatggaaggaggatagtat

SEQ ID NO: 9185702 - DNA, 22 bp, Homo sapiens
ctggatggtcccatgagcagct

SEQ ID NO: 9185703 - DNA, 22 bp, Homo sapiens
ctggatggtcccatgagcagct

SEQ ID NO: 9185704 - DNA, 22 bp, Homo sapiens
ctggatgtaaagggtgaagaaa

SEQ ID NO: 9185705 - DNA, 22 bp, Homo sapiens
ctggatgtaaagggtgaagaaa

SEQ ID NO: 9185706 - DNA, 22 bp, Homo sapiens
ctggatgataacagcaatattt

SEQ ID NO: 9185707 - DNA, 22 bp, Homo sapiens
ctggatgctgagaggtaccaag

SEQ ID NO: 9185708 - DNA, 22 bp, Homo sapiens
ctggatgctgagaggtaccaag

SEQ ID NO: 9185709 - DNA, 22 bp, Homo sapiens
ctggatcttcagagatcaccag

SEQ ID NO: 9185710 - DNA, 22 bp, Homo sapiens
ctggatcttgctgcattgagaa

SEQ ID NO: 9185711 - DNA, 22 bp, Homo sapiens
ctggatcttcagagatcaccag

SEQ ID NO: 9185712 - DNA, 21 bp, Homo sapiens
ctggatctgtcatcgagtttt

SEQ ID NO: 9185713 - DNA, 22 bp, Homo sapiens
ctggatctgtcccctttttgtt

SEQ ID NO: 9185714 - DNA, 22 bp, Homo sapiens
ctggatctgtttgtgcttgtgg

SEQ ID NO: 9185715 - DNA, 22 bp, Homo sapiens
ctggatctgtcttttggatccc

SEQ ID NO: 9185716 - DNA, 22 bp, Homo sapiens
ctggatctaaaggtggatgtag

SEQ ID NO: 9185717 - DNA, 22 bp, Homo sapiens
ctggatctgaacatcggtatca

SEQ ID NO: 9185718 - DNA, 22 bp, Homo sapiens
ctggcaagaaatatatatctta

SEQ ID NO: 9185719 - DNA, 22 bp, Homo sapiens
ctggcaagaaatatatatctta

SEQ ID NO: 9185720 - DNA, 22 bp, Homo sapiens
ctggattttgatgagcagtttt

SEQ ID NO: 9185721 - DNA, 22 bp, Homo sapiens
ctggattttatcattgtagttt

SEQ ID NO: 9185722 - DNA, 22 bp, Homo sapiens
ctggattttagaaggcttccta

SEQ ID NO: 9185723 - DNA, 22 bp, Homo sapiens
ctggattttaaattttctctgt

SEQ ID NO: 9185724 - DNA, 22 bp, Homo sapiens
ctggattttaaattttctctgt

SEQ ID NO: 9185725 - DNA, 23 bp, Homo sapiens
ctggatttggaagcttaaataac

SEQ ID NO: 9185726 - DNA, 22 bp, Homo sapiens
ctggatttgcctatggtgcttt

SEQ ID NO: 9185727 - DNA, 22 bp, Homo sapiens
ctggatttaggactagtccaag

SEQ ID NO: 9185728 - DNA, 22 bp, Homo sapiens
ctggatttaattaactgttgct

SEQ ID NO: 9185729 - DNA, 22 bp, Homo sapiens
ctggatttactgagttttatca

SEQ ID NO: 9185730 - DNA, 22 bp, Homo sapiens
ctggattctggattcttctcat

SEQ ID NO: 9185731 - DNA, 22 bp, Homo sapiens
ctggattcatgccaggccaccc

SEQ ID NO: 9185732 - DNA, 22 bp, Homo sapiens
ctggattctcatcagagccaga

SEQ ID NO: 9185733 - DNA, 22 bp, Homo sapiens
ctggattaagtaaaatagagga

SEQ ID NO: 9185734 - DNA, 18 bp, Homo sapiens
ctggattaagacagtgct

SEQ ID NO: 9185735 - DNA, 22 bp, Homo sapiens
ctggatgtttatgaaggaccca

SEQ ID NO: 9185736 - DNA, 22 bp, Homo sapiens
ctggatgttttgctaaggactc

SEQ ID NO: 9185737 - DNA, 22 bp, Homo sapiens
ctggatgtccttcccctgaagc

SEQ ID NO: 9185738 - DNA, 22 bp, Homo sapiens
ctggatgtcttggggactcctg

SEQ ID NO: 9185739 - DNA, 22 bp, Homo sapiens
ctggatgtccttcccctgaagc

SEQ ID NO: 9185740 - DNA, 22 bp, Homo sapiens
ctggatgtaacgaaggtttcac

SEQ ID NO: 9185741 - DNA, 22 bp, Homo sapiens
ctggatgtccaggtagaagttt

SEQ ID NO: 9185742 - DNA, 22 bp, Homo sapiens
ctggatgttttgctaaggactc

SEQ ID NO: 9185743 - DNA, 22 bp, Homo sapiens
ctggatgtttatgaaggaccca

SEQ ID NO: 9185744 - DNA, 22 bp, Homo sapiens
ctggatgttcttctgcaattat

SEQ ID NO: 9185745 - DNA, 22 bp, Homo sapiens
ctggatgtcttggggactcctg

SEQ ID NO: 9185746 - DNA, 22 bp, Homo sapiens
ctggatgtggtaatgactttga

SEQ ID NO: 9185747 - DNA, 22 bp, Homo sapiens
ctggcagcaggtcacacgcaga

SEQ ID NO: 9185748 - DNA, 22 bp, Homo sapiens
ctggcagattggggtcagcagt

SEQ ID NO: 9185749 - DNA, 22 bp, Homo sapiens
ctggcacatcactcctagttta

SEQ ID NO: 9185750 - DNA, 22 bp, Homo sapiens
ctggcacctccagctcatggcc

SEQ ID NO: 9185751 - DNA, 22 bp, Homo sapiens
ctggccaagcactggggtcaaa

SEQ ID NO: 9185752 - DNA, 22 bp, Homo sapiens
ctggcatttttggaaagaagaa

SEQ ID NO: 9185753 - DNA, 22 bp, Homo sapiens
ctggccacaactagcccaggac

SEQ ID NO: 9185754 - DNA, 22 bp, Homo sapiens
ctggccacatgtgtgctgagca

SEQ ID NO: 9185755 - DNA, 22 bp, Homo sapiens
ctggccacatgtgtgctgagca

SEQ ID NO: 9185756 - DNA, 19 bp, Homo sapiens
ctggccacacctgctggtt

SEQ ID NO: 9185757 - DNA, 19 bp, Homo sapiens
ctggccacacctgctggtt

SEQ ID NO: 9185758 - DNA, 22 bp, Homo sapiens
ctggccacaactagcccaggac

SEQ ID NO: 9185759 - DNA, 19 bp, Homo sapiens
ctggccacacctgctggtt

SEQ ID NO: 9185760 - DNA, 23 bp, Homo sapiens
ctggccaccatctttctggcttc

SEQ ID NO: 9185761 - DNA, 23 bp, Homo sapiens
ctggccaccatctttctggcttc

SEQ ID NO: 9185762 - DNA, 22 bp, Homo sapiens
ctggccaccaagagcttgctca

SEQ ID NO: 9185763 - DNA, 22 bp, Homo sapiens
ctggccaccaagagcttgctca

SEQ ID NO: 9185764 - DNA, 22 bp, Homo sapiens
ctggccacccatgcctccctga

SEQ ID NO: 9185765 - DNA, 22 bp, Homo sapiens
ctggccaggcggcccctgcatg

SEQ ID NO: 9185766 - DNA, 22 bp, Homo sapiens
ctggcagtggggcctcagtgtt

SEQ ID NO: 9185767 - DNA, 22 bp, Homo sapiens
ctggcagtgtccagctcgtgat

SEQ ID NO: 9185768 - DNA, 22 bp, Homo sapiens
ctggcatgaaatggcatctcat

SEQ ID NO: 9185769 - DNA, 22 bp, Homo sapiens
ctggcagtttgccaggagctcg

SEQ ID NO: 9185770 - DNA, 22 bp, Homo sapiens
ctggcagtctgcctcttcactg

SEQ ID NO: 9185771 - DNA, 22 bp, Homo sapiens
ctggcagtgacattgcaggtgc

SEQ ID NO: 9185772 - DNA, 22 bp, Homo sapiens
ctggcagcattaacagagagca

SEQ ID NO: 9185773 - DNA, 22 bp, Homo sapiens
ctggcagcattaacagagagca

SEQ ID NO: 9185774 - DNA, 22 bp, Homo sapiens
ctggcagcattaacagagagca

SEQ ID NO: 9185775 - DNA, 22 bp, Homo sapiens
ctggcagggctctttgggtgct

SEQ ID NO: 9185776 - DNA, 22 bp, Homo sapiens
ctggcaggtatctaaagttgtc

SEQ ID NO: 9185777 - DNA, 22 bp, Homo sapiens
ctggcccagagagcagagctta

SEQ ID NO: 9185778 - DNA, 22 bp, Homo sapiens
ctggcccagagagcagagctta

SEQ ID NO: 9185779 - DNA, 22 bp, Homo sapiens
ctggcccagagctctggccttt

SEQ ID NO: 9185780 - DNA, 22 bp, Homo sapiens
ctggcccagagctctggccttt

SEQ ID NO: 9185781 - DNA, 22 bp, Homo sapiens
ctggcctggagcctctgggtgg

SEQ ID NO: 9185782 - DNA, 22 bp, Homo sapiens
ctggcctgctgggtgaggtcct

SEQ ID NO: 9185783 - DNA, 22 bp, Homo sapiens
ctggcctgatctcatgctgtcc

SEQ ID NO: 9185784 - DNA, 22 bp, Homo sapiens
ctggcctgcagatcccagggtc

SEQ ID NO: 9185785 - DNA, 22 bp, Homo sapiens
ctggcctgaggccgccttcaga

SEQ ID NO: 9185786 - DNA, 22 bp, Homo sapiens
ctggcctgaggccgccttcaga

SEQ ID NO: 9185787 - DNA, 22 bp, Homo sapiens
ctggcctgaggccgccttcaga

SEQ ID NO: 9185788 - DNA, 22 bp, Homo sapiens
ctggcctgaggccgccttcaga

SEQ ID NO: 9185789 - DNA, 22 bp, Homo sapiens
ctggcctgagcacagcggctgc

SEQ ID NO: 9185790 - DNA, 22 bp, Homo sapiens
ctggcctgagaatgctaccctt

SEQ ID NO: 9185791 - DNA, 22 bp, Homo sapiens
ctggcctgagaatgctaccctt

SEQ ID NO: 9185792 - DNA, 22 bp, Homo sapiens
ctggcctctgtgttcaccatag

SEQ ID NO: 9185793 - DNA, 22 bp, Homo sapiens
ctggctctctgatttcacattc

SEQ ID NO: 9185794 - DNA, 22 bp, Homo sapiens
ctggctctgaccgcgctggcct

SEQ ID NO: 9185795 - DNA, 22 bp, Homo sapiens
ctggctctattccctaaggatg

SEQ ID NO: 9185796 - DNA, 22 bp, Homo sapiens
ctggctctcaggctggtcccca

SEQ ID NO: 9185797 - DNA, 22 bp, Homo sapiens
ctggctcctctacacacccaaa

SEQ ID NO: 9185798 - DNA, 22 bp, Homo sapiens
ctggctcctctacacacccaaa

SEQ ID NO: 9185799 - DNA, 22 bp, Homo sapiens
ctggctcctccaaggcctggag

SEQ ID NO: 9185800 - DNA, 22 bp, Homo sapiens
ctggctcctctacacacccaaa

SEQ ID NO: 9185801 - DNA, 22 bp, Homo sapiens
ctggctcctgaggcttggcccc

SEQ ID NO: 9185802 - DNA, 22 bp, Homo sapiens
ctggctcctgaggcttggcccc

SEQ ID NO: 9185803 - DNA, 22 bp, Homo sapiens
ctggctcctgtttaaccagctg

SEQ ID NO: 9185804 - DNA, 22 bp, Homo sapiens
ctggctcctgtttaaccagctg

SEQ ID NO: 9185805 - DNA, 22 bp, Homo sapiens
ctggctctaagtgtcagctccc

SEQ ID NO: 9185806 - DNA, 22 bp, Homo sapiens
ctggctctaagtgtcagctccc

SEQ ID NO: 9185807 - DNA, 22 bp, Homo sapiens
ctggctctatctccaaggctgg

SEQ ID NO: 9185808 - DNA, 22 bp, Homo sapiens
ctggctcgcattatattttggg

SEQ ID NO: 9185809 - DNA, 22 bp, Homo sapiens
ctggctctgggctaagctccca

SEQ ID NO: 9185810 - DNA, 22 bp, Homo sapiens
ctggctctgagcccacctccag

SEQ ID NO: 9185811 - DNA, 22 bp, Homo sapiens
ctggctctgagcccacctccag

SEQ ID NO: 9185812 - DNA, 22 bp, Homo sapiens
ctggctctgtcaccctttctcc

SEQ ID NO: 9185813 - DNA, 23 bp, Homo sapiens
ctggctctgtaggtggcatcctt

SEQ ID NO: 9185814 - DNA, 23 bp, Homo sapiens
ctggctctgtaggtggcatcctt

SEQ ID NO: 9185815 - DNA, 22 bp, Homo sapiens
ctggctctgtgggacctggcct

SEQ ID NO: 9185816 - DNA, 22 bp, Homo sapiens
ctggctctgtcaccctttctcc

SEQ ID NO: 9185817 - DNA, 22 bp, Homo sapiens
ctggctctgtggcttccttcat

SEQ ID NO: 9185818 - DNA, 22 bp, Homo sapiens
ctggctccaccccaggaggatg

SEQ ID NO: 9185819 - DNA, 22 bp, Homo sapiens
ctggctccaccccaggaggatg

SEQ ID NO: 9185820 - DNA, 22 bp, Homo sapiens
ctggcctggggggacacatccc

SEQ ID NO: 9185821 - DNA, 22 bp, Homo sapiens
ctggcctggggcctcagctgct

SEQ ID NO: 9185822 - DNA, 22 bp, Homo sapiens
ctggcctggggcctcagctgct

SEQ ID NO: 9185823 - DNA, 22 bp, Homo sapiens
ctggcctggcaggggacctcta

SEQ ID NO: 9185824 - DNA, 22 bp, Homo sapiens
ctggcctggcaggggacctcta

SEQ ID NO: 9185825 - DNA, 22 bp, Homo sapiens
ctggcctggcaggggacctcta

SEQ ID NO: 9185826 - DNA, 22 bp, Homo sapiens
ctggcctggcgcagtggctcac

SEQ ID NO: 9185827 - DNA, 22 bp, Homo sapiens
ctggcctgggagctgctagcgt

SEQ ID NO: 9185828 - DNA, 22 bp, Homo sapiens
ctggctccctggacatggggcc

SEQ ID NO: 9185829 - DNA, 22 bp, Homo sapiens
ctggctccctggacatggggcc

SEQ ID NO: 9185830 - DNA, 22 bp, Homo sapiens
ctggctcctcagtattccactt

SEQ ID NO: 9185831 - DNA, 23 bp, Homo sapiens
ctggctccgaagactccaggatc

SEQ ID NO: 9185832 - DNA, 23 bp, Homo sapiens
ctggctccgaagactccaggatc

SEQ ID NO: 9185833 - DNA, 22 bp, Homo sapiens
ctggctcctcaggactgcggga

SEQ ID NO: 9185834 - DNA, 22 bp, Homo sapiens
ctggctccaggtcatgcactca

SEQ ID NO: 9185835 - DNA, 22 bp, Homo sapiens
ctggctccaggtcatgcactca

SEQ ID NO: 9185836 - DNA, 22 bp, Homo sapiens
ctggctccctcgctgaggtgct

SEQ ID NO: 9185837 - DNA, 22 bp, Homo sapiens
ctggctccctctccctgagtca

SEQ ID NO: 9185838 - DNA, 22 bp, Homo sapiens
ctggctccactccctgcctgac

SEQ ID NO: 9185839 - DNA, 22 bp, Homo sapiens
ctggctccactccctgcctgac

SEQ ID NO: 9185840 - DNA, 22 bp, Homo sapiens
ctggaattgatagaagggagct

SEQ ID NO: 9185841 - DNA, 22 bp, Homo sapiens
ctggaattatgaccaaaggtcc

SEQ ID NO: 9185842 - DNA, 22 bp, Homo sapiens
ctggacaaaggactcacaggat

SEQ ID NO: 9185843 - DNA, 22 bp, Homo sapiens
ctggaaggttctttgtgtgcct

SEQ ID NO: 9185844 - DNA, 22 bp, Homo sapiens
ctggaagtataggggagatgat

SEQ ID NO: 9185845 - DNA, 23 bp, Homo sapiens
ctggaagtgcttttatagctttg

SEQ ID NO: 9185846 - DNA, 22 bp, Homo sapiens
ctggacaggctggggactgcaa

SEQ ID NO: 9185847 - DNA, 22 bp, Homo sapiens
ctggacagaaagggctgctgtg

SEQ ID NO: 9185848 - DNA, 22 bp, Homo sapiens
ctggacagaaaccagtcctggg

SEQ ID NO: 9185849 - DNA, 22 bp, Homo sapiens
ctgctttggctcagtgacatca

SEQ ID NO: 9185850 - DNA, 22 bp, Homo sapiens
ctgctttggacaactattcttg

SEQ ID NO: 9185851 - DNA, 18 bp, Homo sapiens
ctgctttgccttcattcc

SEQ ID NO: 9185852 - DNA, 22 bp, Homo sapiens
ctgctttggacaactattcttg

SEQ ID NO: 9185853 - DNA, 22 bp, Homo sapiens
ctgctttgcatagctgccagag

SEQ ID NO: 9185854 - DNA, 22 bp, Homo sapiens
ctgctttgcatagctgccagag

SEQ ID NO: 9185855 - DNA, 22 bp, Homo sapiens
ctgctttgtggaatcacactgg

SEQ ID NO: 9185856 - DNA, 22 bp, Homo sapiens
ctgctttgtaaaatagacataa

SEQ ID NO: 9185857 - DNA, 22 bp, Homo sapiens
ctgctttgggcagctttgtggc

SEQ ID NO: 9185858 - DNA, 22 bp, Homo sapiens
ctgctttgaaaataaacttgtc

SEQ ID NO: 9185859 - DNA, 22 bp, Homo sapiens
ctgctttgaaaataaacttgtc

SEQ ID NO: 9185860 - DNA, 22 bp, Homo sapiens
ctgctttgattagaagagtaca

SEQ ID NO: 9185861 - DNA, 22 bp, Homo sapiens
ctgctttgactgttaagaacca

SEQ ID NO: 9185862 - DNA, 22 bp, Homo sapiens
ctggaaaatgaagaagcagagg

SEQ ID NO: 9185863 - DNA, 22 bp, Homo sapiens
ctgcttttgagcccagtgctca

SEQ ID NO: 9185864 - DNA, 22 bp, Homo sapiens
ctgctttgtggaatcacactgg

SEQ ID NO: 9185865 - DNA, 22 bp, Homo sapiens
ctgctttttgtaggtcccagag

SEQ ID NO: 9185866 - DNA, 22 bp, Homo sapiens
ctggaaagatttacacggggaa

SEQ ID NO: 9185867 - DNA, 22 bp, Homo sapiens
ctggaaagagatggcagggttt

SEQ ID NO: 9185868 - DNA, 22 bp, Homo sapiens
ctgctttaggtggaatgttcta

SEQ ID NO: 9185869 - DNA, 22 bp, Homo sapiens
ctgctttagctagtgctcttag

SEQ ID NO: 9185870 - DNA, 22 bp, Homo sapiens
ctgctttagctagtgctcttag

SEQ ID NO: 9185871 - DNA, 23 bp, Homo sapiens
ctgctttcccactccatgctctt

SEQ ID NO: 9185872 - DNA, 22 bp, Homo sapiens
ctgcttctaagaacctgcagct

SEQ ID NO: 9185873 - DNA, 22 bp, Homo sapiens
ctgctttactcatagggtttca

SEQ ID NO: 9185874 - DNA, 22 bp, Homo sapiens
ctgcttctaagaacctgcagct

SEQ ID NO: 9185875 - DNA, 22 bp, Homo sapiens
ctgcttctaagaacctgcagct

SEQ ID NO: 9185876 - DNA, 22 bp, Homo sapiens
ctgcctggctaaactcaagtcg

SEQ ID NO: 9185877 - DNA, 22 bp, Homo sapiens
ctgcctggcccagggatgggcc

SEQ ID NO: 9185878 - DNA, 22 bp, Homo sapiens
ctgcctggccacaacccagggt

SEQ ID NO: 9185879 - DNA, 22 bp, Homo sapiens
ctgcctggcccagggatgggcc

SEQ ID NO: 9185880 - DNA, 22 bp, Homo sapiens
ctgcctgggccatgcccagtcc

SEQ ID NO: 9185881 - DNA, 23 bp, Homo sapiens
ctgcttccttgcttcattgctgg

SEQ ID NO: 9185882 - DNA, 19 bp, Homo sapiens
ctgcttccttccctcactg

SEQ ID NO: 9185883 - DNA, 22 bp, Homo sapiens
ctgcctggagcattctgaaggt

SEQ ID NO: 9185884 - DNA, 17 bp, Homo sapiens
ctgcctggagtcccatc

SEQ ID NO: 9185885 - DNA, 22 bp, Homo sapiens
ctgcctggatgaatggcgcctt

SEQ ID NO: 9185886 - DNA, 22 bp, Homo sapiens
ctgcctggcatggagaagagaa

SEQ ID NO: 9185887 - DNA, 22 bp, Homo sapiens
ctgcctggcatggagaagagaa

SEQ ID NO: 9185888 - DNA, 22 bp, Homo sapiens
ctgcctggccacaacccagggt

SEQ ID NO: 9185889 - DNA, 22 bp, Homo sapiens
ctgcctggaatgccagcttctc

SEQ ID NO: 9185890 - DNA, 22 bp, Homo sapiens
ctgcctggaatgccagcttctc

SEQ ID NO: 9185891 - DNA, 22 bp, Homo sapiens
ctgcctggaatgccagcttctc

SEQ ID NO: 9185892 - DNA, 22 bp, Homo sapiens
ctgcctggagcattctgaaggt

SEQ ID NO: 9185893 - DNA, 22 bp, Homo sapiens
ctgcctggaccggcagccctcc

SEQ ID NO: 9185894 - DNA, 22 bp, Homo sapiens
ctgcctggaccggcagccctcc

SEQ ID NO: 9185895 - DNA, 22 bp, Homo sapiens
ctggagctctccagagccccgt

SEQ ID NO: 9185896 - DNA, 22 bp, Homo sapiens
ctggagctctgtgtgttcctga

SEQ ID NO: 9185897 - DNA, 22 bp, Homo sapiens
ctggagctctgtgtgttcctga

SEQ ID NO: 9185898 - DNA, 22 bp, Homo sapiens
ctggagctctgtgtgttcctga

SEQ ID NO: 9185899 - DNA, 22 bp, Homo sapiens
ctggaggaataatggcatcttg

SEQ ID NO: 9185900 - DNA, 22 bp, Homo sapiens
ctggagctcttctgagtgtgct

SEQ ID NO: 9185901 - DNA, 22 bp, Homo sapiens
ctggaggaataatctcctaccc

SEQ ID NO: 9185902 - DNA, 22 bp, Homo sapiens
ctggaggacagaggccatgtct

SEQ ID NO: 9185903 - DNA, 22 bp, Homo sapiens
ctggaggaatcacagaaggctt

SEQ ID NO: 9185904 - DNA, 19 bp, Homo sapiens
ctggacctggaggcccgga

SEQ ID NO: 9185905 - DNA, 22 bp, Homo sapiens
ctggaccctgtttccctaggtc

SEQ ID NO: 9185906 - DNA, 22 bp, Homo sapiens
ctggaccctgtttccctaggtc

SEQ ID NO: 9185907 - DNA, 22 bp, Homo sapiens
ctggaccagaaaggacatggct

SEQ ID NO: 9185908 - DNA, 22 bp, Homo sapiens
ctggacagtgggcagaggagac

SEQ ID NO: 9185909 - DNA, 22 bp, Homo sapiens
ctggacttaggcaggcaccccg

SEQ ID NO: 9185910 - DNA, 20 bp, Homo sapiens
ctggacttgctgctcacctg

SEQ ID NO: 9185911 - DNA, 22 bp, Homo sapiens
ctggacttctcttcaaagacag

SEQ ID NO: 9185912 - DNA, 22 bp, Homo sapiens
ctggacttacttgctgaggact

SEQ ID NO: 9185913 - DNA, 21 bp, Homo sapiens
ctggactgaggagacagtcgc

SEQ ID NO: 9185914 - DNA, 22 bp, Homo sapiens
ctggacttggggaggctagatt

SEQ ID NO: 9185915 - DNA, 22 bp, Homo sapiens
ctggacttggagtcagaaaact

SEQ ID NO: 9185916 - DNA, 22 bp, Homo sapiens
ctggactcatccatagaggtga

SEQ ID NO: 9185917 - DNA, 21 bp, Homo sapiens
ctggaggcaggtggtgccagg

SEQ ID NO: 9185918 - DNA, 22 bp, Homo sapiens
ctggaggcagttgccccagtca

SEQ ID NO: 9185919 - DNA, 21 bp, Homo sapiens
ctggaggcaggtggtgccagg

SEQ ID NO: 9185920 - DNA, 21 bp, Homo sapiens
ctggaggcaggtggtgccagg

SEQ ID NO: 9185921 - DNA, 22 bp, Homo sapiens
ctggaggcacccttagagaggc

SEQ ID NO: 9185922 - DNA, 22 bp, Homo sapiens
ctggagggacaaggtatgcatt

SEQ ID NO: 9185923 - DNA, 22 bp, Homo sapiens
ctggaggacccctgcctggaag

SEQ ID NO: 9185924 - DNA, 22 bp, Homo sapiens
ctggaggagagtctgaatgaca

SEQ ID NO: 9185925 - DNA, 22 bp, Homo sapiens
ctggaggagagtctgaatgaca

SEQ ID NO: 9185926 - DNA, 22 bp, Homo sapiens
ctggaggagaacttgaggaagg

SEQ ID NO: 9185927 - DNA, 22 bp, Homo sapiens
ctggaggagaacttgaggaagg

SEQ ID NO: 9185928 - DNA, 22 bp, Homo sapiens
ctggaggcaaagcagaggcatg

SEQ ID NO: 9185929 - DNA, 22 bp, Homo sapiens
ctggagtcctgcatttgctctt

SEQ ID NO: 9185930 - DNA, 21 bp, Homo sapiens
ctggagtcattttctgagtag

SEQ ID NO: 9185931 - DNA, 17 bp, Homo sapiens
ctggagtctaacccctt

SEQ ID NO: 9185932 - DNA, 22 bp, Homo sapiens
ctggagtcggcgccccaacaga

SEQ ID NO: 9185933 - DNA, 20 bp, Homo sapiens
ctggagtctaggagtactgg

SEQ ID NO: 9185934 - DNA, 22 bp, Homo sapiens
ctggagtcagcaaggacgaggc

SEQ ID NO: 9185935 - DNA, 21 bp, Homo sapiens
ctggagtcattttctgagtag

SEQ ID NO: 9185936 - DNA, 18 bp, Homo sapiens
ctggagtcacagtgggga

SEQ ID NO: 9185937 - DNA, 22 bp, Homo sapiens
ctggagtacaggaatcttccca

SEQ ID NO: 9185938 - DNA, 22 bp, Homo sapiens
ctggagtcacacacaccaaggt

SEQ ID NO: 9185939 - DNA, 22 bp, Homo sapiens
ctggagtcactcatgtagctgc

SEQ ID NO: 9185940 - DNA, 18 bp, Homo sapiens
ctggagtcacagtgggga

SEQ ID NO: 9185941 - DNA, 22 bp, Homo sapiens
ctggagtcactcatgtagctgc

SEQ ID NO: 9185942 - DNA, 22 bp, Homo sapiens
ctggaggtgcctagatgagctc

SEQ ID NO: 9185943 - DNA, 22 bp, Homo sapiens
ctggaggtgcttcgctggccac

SEQ ID NO: 9185944 - DNA, 22 bp, Homo sapiens
ctggaggtgcttcgctggccac

SEQ ID NO: 9185945 - DNA, 22 bp, Homo sapiens
ctggaggtctacagtggtagct

SEQ ID NO: 9185946 - DNA, 22 bp, Homo sapiens
ctggaggtctacagtggtagct

SEQ ID NO: 9185947 - DNA, 22 bp, Homo sapiens
ctggaggtgcctagatgagctc

SEQ ID NO: 9185948 - DNA, 22 bp, Homo sapiens
ctggaggtgcctagatgagctc

SEQ ID NO: 9185949 - DNA, 22 bp, Homo sapiens
ctggaggtgggggcaagagtgt

SEQ ID NO: 9185950 - DNA, 22 bp, Homo sapiens
ctggaggttgggtccaggccag

SEQ ID NO: 9185951 - DNA, 22 bp, Homo sapiens
ctggaggtgggggcaagagtgt

SEQ ID NO: 9185952 - DNA, 22 bp, Homo sapiens
ctggaggttgggtccaggccag

SEQ ID NO: 9185953 - DNA, 22 bp, Homo sapiens
ctggagtagccggacgggtctg

SEQ ID NO: 9185954 - DNA, 22 bp, Homo sapiens
ctggaggtttattattttagat

SEQ ID NO: 9185955 - DNA, 22 bp, Homo sapiens
ctggagtggccggtgctgtggc

SEQ ID NO: 9185956 - DNA, 22 bp, Homo sapiens
ctggagtgtaaagagcatagaa

SEQ ID NO: 9185957 - DNA, 22 bp, Homo sapiens
ctggagtctccccaggagcgtg

SEQ ID NO: 9185958 - DNA, 20 bp, Homo sapiens
ctggagtctaggagtactgg

SEQ ID NO: 9185959 - DNA, 22 bp, Homo sapiens
ctggagtctccccaggagcgtg

SEQ ID NO: 9185960 - DNA, 22 bp, Homo sapiens
ctggagtctcttctgtagctac

SEQ ID NO: 9185961 - DNA, 20 bp, Homo sapiens
ctggagtgtagcagtggctg

SEQ ID NO: 9185962 - DNA, 20 bp, Homo sapiens
ctggagtgtagcagtggctg

SEQ ID NO: 9185963 - DNA, 20 bp, Homo sapiens
ctggagtgtagcagtggctg

SEQ ID NO: 9185964 - DNA, 20 bp, Homo sapiens
ctggagtgtagcagtggctg

SEQ ID NO: 9185965 - DNA, 22 bp, Homo sapiens
ctggagtgtaaagagcatagaa

SEQ ID NO: 9185966 - DNA, 22 bp, Homo sapiens
ctggagtgtaaagagcatagaa

SEQ ID NO: 9185967 - DNA, 22 bp, Homo sapiens
ctggagttcgactgagttgaat

SEQ ID NO: 9185968 - DNA, 22 bp, Homo sapiens
ctggagttcgactgagttgaat

SEQ ID NO: 9185969 - DNA, 22 bp, Homo sapiens
ctggagtgttatggtcaagtca

SEQ ID NO: 9185970 - DNA, 22 bp, Homo sapiens
ctggagtttgcggggacagaga

SEQ ID NO: 9185971 - DNA, 22 bp, Homo sapiens
ctggaggtcacccttagaacat

SEQ ID NO: 9185972 - DNA, 22 bp, Homo sapiens
ctggaggtcaagtccccccttg

SEQ ID NO: 9185973 - DNA, 19 bp, Homo sapiens
ctggaggtagagggttagt

SEQ ID NO: 9185974 - DNA, 19 bp, Homo sapiens
ctggaggtagagggttagt

SEQ ID NO: 9185975 - DNA, 22 bp, Homo sapiens
ctggaggtagatggtggtaatg

SEQ ID NO: 9185976 - DNA, 22 bp, Homo sapiens
ctggaggtcacccttagaacat

SEQ ID NO: 9185977 - DNA, 22 bp, Homo sapiens
ctggaggtcatgtaatatggaa

SEQ ID NO: 9185978 - DNA, 22 bp, Homo sapiens
ctggaggtaagaggccctgggc

SEQ ID NO: 9185979 - DNA, 22 bp, Homo sapiens
ctggaggtaatgttatttttgt

SEQ ID NO: 9185980 - DNA, 22 bp, Homo sapiens
ctggaggtaagaggccctgggc

SEQ ID NO: 9185981 - DNA, 22 bp, Homo sapiens
ctggagggtggagagaagtctc

SEQ ID NO: 9185982 - DNA, 22 bp, Homo sapiens
ctggagggggaaatgttcattg

SEQ ID NO: 9185983 - DNA, 22 bp, Homo sapiens
ctggagggtgagcctcatctct

SEQ ID NO: 9185984 - DNA, 22 bp, Homo sapiens
ctggaggggccatccacagtct

SEQ ID NO: 9185985 - DNA, 22 bp, Homo sapiens
ctggagggcttctgcaggttac

SEQ ID NO: 9185986 - DNA, 22 bp, Homo sapiens
ctggaggggctggcatggtagc

SEQ ID NO: 9185987 - DNA, 22 bp, Homo sapiens
ctggaggggctggcatggtagc

SEQ ID NO: 9185988 - DNA, 22 bp, Homo sapiens
ctggagggcttctgcaggttac

SEQ ID NO: 9185989 - DNA, 22 bp, Homo sapiens
ctggagggctggactaaggaaa

SEQ ID NO: 9185990 - DNA, 22 bp, Homo sapiens
ctggagggagattcaaaggagg

SEQ ID NO: 9185991 - DNA, 22 bp, Homo sapiens
ctggagggactttctcacggat

SEQ ID NO: 9185992 - DNA, 22 bp, Homo sapiens
ttcagaaaaaacttcaataagt

SEQ ID NO: 9185993 - DNA, 22 bp, Homo sapiens
ttcagaaacagagtgagtgagt

SEQ ID NO: 9185994 - DNA, 22 bp, Homo sapiens
ttcagaaacccattgggtctct

SEQ ID NO: 9185995 - DNA, 22 bp, Homo sapiens
ttcagaaaaaacttcaataagt

SEQ ID NO: 9185996 - DNA, 22 bp, Homo sapiens
ttcagaaaaaacttcaataagt

SEQ ID NO: 9185997 - DNA, 22 bp, Homo sapiens
ttcactgtttcatcctacttct

SEQ ID NO: 9185998 - DNA, 22 bp, Homo sapiens
cggctgagacggccatagacac

SEQ ID NO: 9185999 - DNA, 22 bp, Homo sapiens
cggctgagacggccatagacac

SEQ ID NO: 9186000 - DNA, 22 bp, Homo sapiens
cggctgagcagtgctgatggaa

SEQ ID NO: 9186001 - DNA, 22 bp, Homo sapiens
cggctgaggatctccaggcctg

SEQ ID NO: 9186002 - DNA, 23 bp, Homo sapiens
cggctgctcggccgagtcctcgg

SEQ ID NO: 9186003 - DNA, 22 bp, Homo sapiens
cggctgaggatctccaggcctg

SEQ ID NO: 9186004 - DNA, 22 bp, Homo sapiens
cggctggggctgtccccatgac

SEQ ID NO: 9186005 - DNA, 22 bp, Homo sapiens
cggctggggctgtccccatgac

SEQ ID NO: 9186006 - DNA, 22 bp, Homo sapiens
cggctgctgcctgagtcgctgt

SEQ ID NO: 9186007 - DNA, 22 bp, Homo sapiens
ttcattcctgagcccatattta

SEQ ID NO: 9186008 - DNA, 22 bp, Homo sapiens
ttcattccttccctaagcaact

SEQ ID NO: 9186009 - DNA, 22 bp, Homo sapiens
ttcattccttctgtaccttgcc

SEQ ID NO: 9186010 - DNA, 23 bp, Homo sapiens
ttcatgagttggacaagactggg

SEQ ID NO: 9186011 - DNA, 22 bp, Homo sapiens
ttcattcccaagagtaaacata

SEQ ID NO: 9186012 - DNA, 22 bp, Homo sapiens
ttcagaaaggtaaatggatttc

SEQ ID NO: 9186013 - DNA, 22 bp, Homo sapiens
ttccaaaatgccttgatatgat

SEQ ID NO: 9186014 - DNA, 22 bp, Homo sapiens
ttccaaacctcaaataattaat

SEQ ID NO: 9186015 - DNA, 19 bp, Homo sapiens
ttcattctcttattgttgt

SEQ ID NO: 9186016 - DNA, 22 bp, Homo sapiens
cggcatccccacttcctcctgc

SEQ ID NO: 9186017 - DNA, 22 bp, Homo sapiens
cggacaggctcctggagctcct

SEQ ID NO: 9186018 - DNA, 22 bp, Homo sapiens
cgctgtgtttacatcattgctg

SEQ ID NO: 9186019 - DNA, 22 bp, Homo sapiens
cgcttaattttctatagaaaag

SEQ ID NO: 9186020 - DNA, 22 bp, Homo sapiens
cgctgtgtgcagactgaaaatg

SEQ ID NO: 9186021 - DNA, 22 bp, Homo sapiens
cgctttaacgtgagaagaaggg

SEQ ID NO: 9186022 - DNA, 22 bp, Homo sapiens
cgctgggcaggtccacttgtta

SEQ ID NO: 9186023 - DNA, 22 bp, Homo sapiens
cgctgggggaacttcagccaat

SEQ ID NO: 9186024 - DNA, 22 bp, Homo sapiens
cgctgggggaacagcgagggtg

SEQ ID NO: 9186025 - DNA, 22 bp, Homo sapiens
cgctggggctttttgcttgaga

SEQ ID NO: 9186026 - DNA, 22 bp, Homo sapiens
cgctgggggaacagcgagggtg

SEQ ID NO: 9186027 - DNA, 22 bp, Homo sapiens
cgctgggggaacagcgagggtg

SEQ ID NO: 9186028 - DNA, 22 bp, Homo sapiens
ttcacataaatagatcacatca

SEQ ID NO: 9186029 - DNA, 22 bp, Homo sapiens
ttcacagtttgctgggacagga

SEQ ID NO: 9186030 - DNA, 22 bp, Homo sapiens
ttcacagtttaatggcaaggat

SEQ ID NO: 9186031 - DNA, 22 bp, Homo sapiens
ttcacatataatgtctttaaaa

SEQ ID NO: 9186032 - DNA, 22 bp, Homo sapiens
ttcacagtgtgatctatgggca

SEQ ID NO: 9186033 - DNA, 22 bp, Homo sapiens
cctgggtggctgcctgcctttc

SEQ ID NO: 9186034 - DNA, 21 bp, Homo sapiens
cctgggtgggacccctcttcc

SEQ ID NO: 9186035 - DNA, 22 bp, Homo sapiens
ctaagtcatggaaagtgtgtgt

SEQ ID NO: 9186036 - DNA, 22 bp, Homo sapiens
ctaaggcaccgaggcaggagcg

SEQ ID NO: 9186037 - DNA, 20 bp, Homo sapiens
ctaatattctactctaagga

SEQ ID NO: 9186038 - DNA, 22 bp, Homo sapiens
ctacaaaagtaattgtggtttt

SEQ ID NO: 9186039 - DNA, 22 bp, Homo sapiens
ttccttcctggggatttatcat

SEQ ID NO: 9186040 - DNA, 22 bp, Homo sapiens
ttccttccgggcaccaggcact

SEQ ID NO: 9186041 - DNA, 22 bp, Homo sapiens
ttccttccacttcaggattttg

SEQ ID NO: 9186042 - DNA, 22 bp, Homo sapiens
ttccttcccctagctgagaaac

SEQ ID NO: 9186043 - DNA, 22 bp, Homo sapiens
ctacaaaagtaattgtggtttt

SEQ ID NO: 9186044 - DNA, 22 bp, Homo sapiens
ctacaaaagtaattgtggtttt

SEQ ID NO: 9186045 - DNA, 22 bp, Homo sapiens
ctacaaagctcttctacaggca

SEQ ID NO: 9186046 - DNA, 22 bp, Homo sapiens
ctacaaagaatttctctagctc

SEQ ID NO: 9186047 - DNA, 22 bp, Homo sapiens
ctacaaatataaaacacagata

SEQ ID NO: 9186048 - DNA, 21 bp, Homo sapiens
ttcctggggaaggagctgcct

SEQ ID NO: 9186049 - DNA, 22 bp, Homo sapiens
ctacaaatccacaaggcacttt

SEQ ID NO: 9186050 - DNA, 22 bp, Homo sapiens
ctacaaatatgttaaggtgttt

SEQ ID NO: 9186051 - DNA, 22 bp, Homo sapiens
ttccttccacttcaggattttg

SEQ ID NO: 9186052 - DNA, 22 bp, Homo sapiens
ttccttcagttcagggaaccct

SEQ ID NO: 9186053 - DNA, 22 bp, Homo sapiens
ttccatttggagctcgcagcct

SEQ ID NO: 9186054 - DNA, 22 bp, Homo sapiens
ttccatttggcacttcactgag

SEQ ID NO: 9186055 - DNA, 22 bp, Homo sapiens
ttccatttggcacttcactgag

SEQ ID NO: 9186056 - DNA, 22 bp, Homo sapiens
ttccatttattcttgtccagat

SEQ ID NO: 9186057 - DNA, 22 bp, Homo sapiens
ttccaggcaaaggaagcagctt

SEQ ID NO: 9186058 - DNA, 22 bp, Homo sapiens
ttccaggcaaaggaagcagctt

SEQ ID NO: 9186059 - DNA, 22 bp, Homo sapiens
ttccaggcaaaggaagcagctt

SEQ ID NO: 9186060 - DNA, 22 bp, Homo sapiens
ttccaggatgggctgtcctact

SEQ ID NO: 9186061 - DNA, 22 bp, Homo sapiens
ttccatttttctaactctcaga

SEQ ID NO: 9186062 - DNA, 22 bp, Homo sapiens
ttccaaagctgctttatttagt

SEQ ID NO: 9186063 - DNA, 22 bp, Homo sapiens
ttccaaagaagttcacatttac

SEQ ID NO: 9186064 - DNA, 22 bp, Homo sapiens
ttccaaagaagttcacatttac

SEQ ID NO: 9186065 - DNA, 22 bp, Homo sapiens
ttccaaactcatagtatggtgt

SEQ ID NO: 9186066 - DNA, 22 bp, Homo sapiens
ttccaaactgccaattcagaag

SEQ ID NO: 9186067 - DNA, 22 bp, Homo sapiens
ttccggaaggttctctagaatt

SEQ ID NO: 9186068 - DNA, 22 bp, Homo sapiens
ctaagaaaatagaagcatgcta

SEQ ID NO: 9186069 - DNA, 22 bp, Homo sapiens
ttccctttgttaaattggaaga

SEQ ID NO: 9186070 - DNA, 22 bp, Homo sapiens
ttccctttcttaaagagttagg

SEQ ID NO: 9186071 - DNA, 22 bp, Homo sapiens
ttcccttttttctagtaggtag

SEQ ID NO: 9186072 - DNA, 22 bp, Homo sapiens
ttcccttgaccccagaccctgg

SEQ ID NO: 9186073 - DNA, 22 bp, Homo sapiens
ttcccacagagattacattgaa

SEQ ID NO: 9186074 - DNA, 22 bp, Homo sapiens
ttcccacattctttacattcat

SEQ ID NO: 9186075 - DNA, 22 bp, Homo sapiens
ttcccacagtgttgaatcctct

SEQ ID NO: 9186076 - DNA, 22 bp, Homo sapiens
ttcccttaaattatggcatcta

SEQ ID NO: 9186077 - DNA, 22 bp, Homo sapiens
ttcccttcaaggtggcctaaag

SEQ ID NO: 9186078 - DNA, 22 bp, Homo sapiens
ttcccttaaattatggcatcta

SEQ ID NO: 9186079 - DNA, 22 bp, Homo sapiens
ttccctggggaaggtgaccttt

SEQ ID NO: 9186080 - DNA, 22 bp, Homo sapiens
ttgataaaatgatgaaatcact

SEQ ID NO: 9186081 - DNA, 22 bp, Homo sapiens
ttgataaaatgatatcttcttt

SEQ ID NO: 9186082 - DNA, 22 bp, Homo sapiens
ttgataaaatgatgaaatcact

SEQ ID NO: 9186083 - DNA, 21 bp, Homo sapiens
ttgaggagtgagagtgggttt

SEQ ID NO: 9186084 - DNA, 22 bp, Homo sapiens
ttgaggagcactagtcaggtat

SEQ ID NO: 9186085 - DNA, 20 bp, Homo sapiens
ttgagcttttagtacagaca

SEQ ID NO: 9186086 - DNA, 23 bp, Homo sapiens
ttgaggacaatttacatggtgtt

SEQ ID NO: 9186087 - DNA, 22 bp, Homo sapiens
ttgaggaggcctttcagggctt

SEQ ID NO: 9186088 - DNA, 22 bp, Homo sapiens
ttgaggaggaaaagggggtacc

SEQ ID NO: 9186089 - DNA, 22 bp, Homo sapiens
ttgaggaggaactgtgaggcaa

SEQ ID NO: 9186090 - DNA, 22 bp, Homo sapiens
ttgaggagtacaaagcatgctt

SEQ ID NO: 9186091 - DNA, 22 bp, Homo sapiens
ttgaggagtcaggggcacggaa

SEQ ID NO: 9186092 - DNA, 22 bp, Homo sapiens
ttgaggaggtagtacagagtat

SEQ ID NO: 9186093 - DNA, 22 bp, Homo sapiens
ttgactgtgaatctaagttact

SEQ ID NO: 9186094 - DNA, 22 bp, Homo sapiens
ttgacttcccagacttgtgttt

SEQ ID NO: 9186095 - DNA, 22 bp, Homo sapiens
ttgacttcagcctgtacttgta

SEQ ID NO: 9186096 - DNA, 22 bp, Homo sapiens
ttgacccgagtccttcttgggg

SEQ ID NO: 9186097 - DNA, 22 bp, Homo sapiens
ctcagcagtaaacgtccggaac

SEQ ID NO: 9186098 - DNA, 22 bp, Homo sapiens
ttgacccagctttccccacaat

SEQ ID NO: 9186099 - DNA, 22 bp, Homo sapiens
ctcagcagtatactctgaagat

SEQ ID NO: 9186100 - DNA, 22 bp, Homo sapiens
ttgacctttgtttttacagagt

SEQ ID NO: 9186101 - DNA, 22 bp, Homo sapiens
ttgactcatacctgcctgaccc

SEQ ID NO: 9186102 - DNA, 19 bp, Homo sapiens
ttgacgttgtggaattaac

SEQ ID NO: 9186103 - DNA, 22 bp, Homo sapiens
ttgactcatacctgcctgaccc

SEQ ID NO: 9186104 - DNA, 22 bp, Homo sapiens
ttgacttttcttggtcacatga

SEQ ID NO: 9186105 - DNA, 22 bp, Homo sapiens
ttgagaaaacacagagtttatt

SEQ ID NO: 9186106 - DNA, 22 bp, Homo sapiens
ttgagctttgaagttcaatatt

SEQ ID NO: 9186107 - DNA, 22 bp, Homo sapiens
ttgagaaacatctaatctttgt

SEQ ID NO: 9186108 - DNA, 22 bp, Homo sapiens
ttcttgtatgtatgcaaaatca

SEQ ID NO: 9186109 - DNA, 22 bp, Homo sapiens
ttcttgttctcctcatttagag

SEQ ID NO: 9186110 - DNA, 22 bp, Homo sapiens
ttcttgttctggttctgttagc

SEQ ID NO: 9186111 - DNA, 22 bp, Homo sapiens
ttcttgttctggttctgttagc

SEQ ID NO: 9186112 - DNA, 22 bp, Homo sapiens
ttcttgttctggttctgttagc

SEQ ID NO: 9186113 - DNA, 22 bp, Homo sapiens
ttcttggcatcatgaaaaatta

SEQ ID NO: 9186114 - DNA, 22 bp, Homo sapiens
ttcttgtactggagatacatga

SEQ ID NO: 9186115 - DNA, 22 bp, Homo sapiens
ttcttgtatataaaaatcattt

SEQ ID NO: 9186116 - DNA, 22 bp, Homo sapiens
ctattttcccatatggttgaca

SEQ ID NO: 9186117 - DNA, 22 bp, Homo sapiens
ctattttcattcttacattgtc

SEQ ID NO: 9186118 - DNA, 22 bp, Homo sapiens
ctattttctgtctctatagagt

SEQ ID NO: 9186119 - DNA, 22 bp, Homo sapiens
ctattttccgcagcaggaagta

SEQ ID NO: 9186120 - DNA, 22 bp, Homo sapiens
ctattttaagaggccattaggt

SEQ ID NO: 9186121 - DNA, 22 bp, Homo sapiens
ctattttaacttgattacctct

SEQ ID NO: 9186122 - DNA, 22 bp, Homo sapiens
ctcagcagcagggaagaggtca

SEQ ID NO: 9186123 - DNA, 22 bp, Homo sapiens
ctcagcagagaccagggaggaa

SEQ ID NO: 9186124 - DNA, 22 bp, Homo sapiens
ctcagcagaggcagtattcagt

SEQ ID NO: 9186125 - DNA, 22 bp, Homo sapiens
ctcagcagcagggaagaggtca

SEQ ID NO: 9186126 - DNA, 22 bp, Homo sapiens
ctcagcagctacaggattcggg

SEQ ID NO: 9186127 - DNA, 22 bp, Homo sapiens
ctcagcagctgctgctggtggg

SEQ ID NO: 9186128 - DNA, 17 bp, Homo sapiens
ctcagcagggctcactt

SEQ ID NO: 9186129 - DNA, 17 bp, Homo sapiens
ctcagcagggctcactt

SEQ ID NO: 9186130 - DNA, 22 bp, Homo sapiens
ctcagcaggcactgtgccttac

SEQ ID NO: 9186131 - DNA, 22 bp, Homo sapiens
ctcagcagtaaacgtccggaac

SEQ ID NO: 9186132 - DNA, 22 bp, Homo sapiens
ctcagcaggtcttgggtagggg

SEQ ID NO: 9186133 - DNA, 23 bp, Homo sapiens
ctcagcaggtcaggccccttcct

SEQ ID NO: 9186134 - DNA, 22 bp, Homo sapiens
ctcagcaggtaccacatgatct

SEQ ID NO: 9186135 - DNA, 22 bp, Homo sapiens
ctcagcaggtaccacatgatct

SEQ ID NO: 9186136 - DNA, 22 bp, Homo sapiens
ctatttttctgtaccctaattt

SEQ ID NO: 9186137 - DNA, 22 bp, Homo sapiens
ctatttctaaacctataagtga

SEQ ID NO: 9186138 - DNA, 22 bp, Homo sapiens
ctatttgaagttgcagagatga

SEQ ID NO: 9186139 - DNA, 22 bp, Homo sapiens
ctatttctgcctaatgacctgt

SEQ ID NO: 9186140 - DNA, 22 bp, Homo sapiens
ctatttgaattatgaagcactg

SEQ ID NO: 9186141 - DNA, 22 bp, Homo sapiens
ctatttgcttgtctagcatcta

SEQ ID NO: 9186142 - DNA, 22 bp, Homo sapiens
ctatttggccatagtgcagtta

SEQ ID NO: 9186143 - DNA, 22 bp, Homo sapiens
ctagggccaaaggctgtgatgc

SEQ ID NO: 9186144 - DNA, 23 bp, Homo sapiens
ctagggcagtatttcacagacac

SEQ ID NO: 9186145 - DNA, 23 bp, Homo sapiens
ctagggcagtatttcacagacac

SEQ ID NO: 9186146 - DNA, 22 bp, Homo sapiens
ctagggcagggagtgtttgcgc

SEQ ID NO: 9186147 - DNA, 22 bp, Homo sapiens
ctagggctccaaagctgagaag

SEQ ID NO: 9186148 - DNA, 22 bp, Homo sapiens
ctattcaattttgctattgtag

SEQ ID NO: 9186149 - DNA, 22 bp, Homo sapiens
ctatttatgtgctattttgtat

SEQ ID NO: 9186150 - DNA, 22 bp, Homo sapiens
ttctgtccactgctggggcctc

SEQ ID NO: 9186151 - DNA, 22 bp, Homo sapiens
ttctgtcatttagcattgtcat

SEQ ID NO: 9186152 - DNA, 21 bp, Homo sapiens
ttcttcctaaatacagatctc

SEQ ID NO: 9186153 - DNA, 22 bp, Homo sapiens
ttcttggatgccctcatgcctt

SEQ ID NO: 9186154 - DNA, 22 bp, Homo sapiens
ttcttggatgccctcatgcctt

SEQ ID NO: 9186155 - DNA, 22 bp, Homo sapiens
ctattttaacttgattacctct

SEQ ID NO: 9186156 - DNA, 22 bp, Homo sapiens
ttctgtatttcaatgtctttat

SEQ ID NO: 9186157 - DNA, 22 bp, Homo sapiens
ttctgtatgtacatatgtgtat

SEQ ID NO: 9186158 - DNA, 22 bp, Homo sapiens
ttctgtatctttcttcaagatt

SEQ ID NO: 9186159 - DNA, 22 bp, Homo sapiens
ttctgtatctctgtgtttcttg

SEQ ID NO: 9186160 - DNA, 22 bp, Homo sapiens
ctagggaaagtggacatggctt

SEQ ID NO: 9186161 - DNA, 22 bp, Homo sapiens
ctaggctgcacctaggatggct

SEQ ID NO: 9186162 - DNA, 22 bp, Homo sapiens
ctaggctggagtgcagtggcac

SEQ ID NO: 9186163 - DNA, 22 bp, Homo sapiens
ctaggctggagtgcagtggcat

SEQ ID NO: 9186164 - DNA, 22 bp, Homo sapiens
ctaggctgttcatgctcagacc

SEQ ID NO: 9186165 - DNA, 22 bp, Homo sapiens
ctaggctgagctgggctgagct

SEQ ID NO: 9186166 - DNA, 22 bp, Homo sapiens
ctaggctgagctgggctgagct

SEQ ID NO: 9186167 - DNA, 22 bp, Homo sapiens
ctaggctcagtctctggtctgt

SEQ ID NO: 9186168 - DNA, 22 bp, Homo sapiens
ctaggctctgccagcactgtcg

SEQ ID NO: 9186169 - DNA, 22 bp, Homo sapiens
ctaggccagttaggaagagaag

SEQ ID NO: 9186170 - DNA, 22 bp, Homo sapiens
ctaggcccatgaggtttgctgg

SEQ ID NO: 9186171 - DNA, 23 bp, Homo sapiens
ctaggcaggattgtaggcgggta

SEQ ID NO: 9186172 - DNA, 22 bp, Homo sapiens
ctaggccacagggcaaaaagga

SEQ ID NO: 9186173 - DNA, 22 bp, Homo sapiens
ctaggccagagagacctcatga

SEQ ID NO: 9186174 - DNA, 22 bp, Homo sapiens
ctaggccacagggcaaaaagga

SEQ ID NO: 9186175 - DNA, 22 bp, Homo sapiens
ttccttctaatattctgcctgt

SEQ ID NO: 9186176 - DNA, 22 bp, Homo sapiens
ttccttctaatattctgcctgt

SEQ ID NO: 9186177 - DNA, 22 bp, Homo sapiens
ttccttctaattttacacctga

SEQ ID NO: 9186178 - DNA, 22 bp, Homo sapiens
ttcctttcccttgcttctgtgc

SEQ ID NO: 9186179 - DNA, 22 bp, Homo sapiens
ttcctttccctcacagcctcgg

SEQ ID NO: 9186180 - DNA, 22 bp, Homo sapiens
ttccttttacaaatagcctcct

SEQ ID NO: 9186181 - DNA, 22 bp, Homo sapiens
ttccttttatttgtccaggctt

SEQ ID NO: 9186182 - DNA, 22 bp, Homo sapiens
ctaggcagactgagctctaggg

SEQ ID NO: 9186183 - DNA, 22 bp, Homo sapiens
ctagccatgggcattaaaggta

SEQ ID NO: 9186184 - DNA, 20 bp, Homo sapiens
ttccttttcgcctctctccc

SEQ ID NO: 9186185 - DNA, 20 bp, Homo sapiens
ttccttttcgcctctctccc

SEQ ID NO: 9186186 - DNA, 22 bp, Homo sapiens
ttccttttcttatgcatcatta

SEQ ID NO: 9186187 - DNA, 22 bp, Homo sapiens
ttccttttcttctaccacatgt

SEQ ID NO: 9186188 - DNA, 22 bp, Homo sapiens
ctcagtttctgaagtggacagg

SEQ ID NO: 9186189 - DNA, 22 bp, Homo sapiens
ctcagtttctgacattaaaatc

SEQ ID NO: 9186190 - DNA, 22 bp, Homo sapiens
ctcagtttcttcatattgtagg

SEQ ID NO: 9186191 - DNA, 22 bp, Homo sapiens
ctcagtttgtgtgatattgtct

SEQ ID NO: 9186192 - DNA, 22 bp, Homo sapiens
ttgctttgccaccagaagtcta

SEQ ID NO: 9186193 - DNA, 22 bp, Homo sapiens
ctcagttttgaaaaggtaagct

SEQ ID NO: 9186194 - DNA, 22 bp, Homo sapiens
ctcagttttcccttgggagcgt

SEQ ID NO: 9186195 - DNA, 22 bp, Homo sapiens
ttgctttgtggtggttcttcca

SEQ ID NO: 9186196 - DNA, 18 bp, Homo sapiens
ttgctttgtaagcttgca

SEQ ID NO: 9186197 - DNA, 22 bp, Homo sapiens
ttgctttgtttaaaagtggtat

SEQ ID NO: 9186198 - DNA, 22 bp, Homo sapiens
ttgctttgttactgcagtttcc

SEQ ID NO: 9186199 - DNA, 22 bp, Homo sapiens
ttgcttttccctgtctctgatt

SEQ ID NO: 9186200 - DNA, 22 bp, Homo sapiens
ttgcttttgtgtgctctctgga

SEQ ID NO: 9186201 - DNA, 22 bp, Homo sapiens
ttgcttttgtgtgctctctgga

SEQ ID NO: 9186202 - DNA, 22 bp, Homo sapiens
ttggatcttatgaaggtggcat

SEQ ID NO: 9186203 - DNA, 20 bp, Homo sapiens
ttggatctaaaatgtgggga

SEQ ID NO: 9186204 - DNA, 22 bp, Homo sapiens
ttggaaaacttacacagagctg

SEQ ID NO: 9186205 - DNA, 22 bp, Homo sapiens
ttggaaaagcgttctctgtagc

SEQ ID NO: 9186206 - DNA, 22 bp, Homo sapiens
ttggaaaagcgttctctgtagc

SEQ ID NO: 9186207 - DNA, 22 bp, Homo sapiens
ttggcatttattctaaggtcaa

SEQ ID NO: 9186208 - DNA, 22 bp, Homo sapiens
ctcatctgataaatcactctta

SEQ ID NO: 9186209 - DNA, 20 bp, Homo sapiens
ctcatctctgagcctcctgg

SEQ ID NO: 9186210 - DNA, 22 bp, Homo sapiens
ttgggcagaggccaggaggatg

SEQ ID NO: 9186211 - DNA, 22 bp, Homo sapiens
ttggccagaggtttctctcatg

SEQ ID NO: 9186212 - DNA, 22 bp, Homo sapiens
ctcagtttttttaagagccatg

SEQ ID NO: 9186213 - DNA, 22 bp, Homo sapiens
ctcataaacattattcattatt

SEQ ID NO: 9186214 - DNA, 22 bp, Homo sapiens
ctcataaagtgagaatatgacc

SEQ ID NO: 9186215 - DNA, 22 bp, Homo sapiens
ctcataaagtgagaatatgacc

SEQ ID NO: 9186216 - DNA, 22 bp, Homo sapiens
ctcatcaccacatataacaaag

SEQ ID NO: 9186217 - DNA, 22 bp, Homo sapiens
ctcatacatatgccattcctgc

SEQ ID NO: 9186218 - DNA, 22 bp, Homo sapiens
ctcatagggtgaggataaaaga

SEQ ID NO: 9186219 - DNA, 22 bp, Homo sapiens
ctcatagttagagacacagaga

SEQ ID NO: 9186220 - DNA, 22 bp, Homo sapiens
ttggccagagaccagagcaggg

SEQ ID NO: 9186221 - DNA, 22 bp, Homo sapiens
ttggccagactgaggtgctggg

SEQ ID NO: 9186222 - DNA, 22 bp, Homo sapiens
ttggccacactcactagagccc

SEQ ID NO: 9186223 - DNA, 22 bp, Homo sapiens
ttggccacactcactagagccc

SEQ ID NO: 9186224 - DNA, 22 bp, Homo sapiens
ttggccacaatccaagccttgg

SEQ ID NO: 9186225 - DNA, 22 bp, Homo sapiens
ttggccacaatccaagccttgg

SEQ ID NO: 9186226 - DNA, 21 bp, Homo sapiens
ttggccacgtctctccttccc

SEQ ID NO: 9186227 - DNA, 22 bp, Homo sapiens
tttaaaaaactagtctgagtct

SEQ ID NO: 9186228 - DNA, 22 bp, Homo sapiens
tttaaaaaactagtctgagtct

SEQ ID NO: 9186229 - DNA, 22 bp, Homo sapiens
tttaaaaaactagtctgagtct

SEQ ID NO: 9186230 - DNA, 22 bp, Homo sapiens
tttaaaaaactagtctgagtct

SEQ ID NO: 9186231 - DNA, 22 bp, Homo sapiens
tttaaaaaactagtctgagtct

SEQ ID NO: 9186232 - DNA, 22 bp, Homo sapiens
ctccagtgccctccttgggggc

SEQ ID NO: 9186233 - DNA, 22 bp, Homo sapiens
ctccagtgcgcaggacagcccc

SEQ ID NO: 9186234 - DNA, 22 bp, Homo sapiens
ttgtttcaggatggtttgttac

SEQ ID NO: 9186235 - DNA, 22 bp, Homo sapiens
ctccagtgcacccagaggattt

SEQ ID NO: 9186236 - DNA, 22 bp, Homo sapiens
ctccagtgagtgagcaggcgac

SEQ ID NO: 9186237 - DNA, 22 bp, Homo sapiens
ctccagtgagtgagcaggcgac

SEQ ID NO: 9186238 - DNA, 22 bp, Homo sapiens
ctccagtgagcgcggggcatgg

SEQ ID NO: 9186239 - DNA, 22 bp, Homo sapiens
ctccagtctagtagagcctgct

SEQ ID NO: 9186240 - DNA, 22 bp, Homo sapiens
ctccagtctagtagagcctgct

SEQ ID NO: 9186241 - DNA, 22 bp, Homo sapiens
ctccaggtgcagaaggactcag

SEQ ID NO: 9186242 - DNA, 22 bp, Homo sapiens
ctccaggtattactgttttccc

SEQ ID NO: 9186243 - DNA, 22 bp, Homo sapiens
ctccaggttttacaaggtctat

SEQ ID NO: 9186244 - DNA, 22 bp, Homo sapiens
ctccagtcatagtctgtcttgt

SEQ ID NO: 9186245 - DNA, 22 bp, Homo sapiens
ttgttacagcacttaacctttt

SEQ ID NO: 9186246 - DNA, 22 bp, Homo sapiens
ttgttacacataataacatttt

SEQ ID NO: 9186247 - DNA, 21 bp, Homo sapiens
ttgttacaatgcaagagtatg

SEQ ID NO: 9186248 - DNA, 21 bp, Homo sapiens
ttgttacaatgcaagagtatg

SEQ ID NO: 9186249 - DNA, 21 bp, Homo sapiens
ttgttacaatgcaagagtatg

SEQ ID NO: 9186250 - DNA, 22 bp, Homo sapiens
ctccagggttccccgatccact

SEQ ID NO: 9186251 - DNA, 22 bp, Homo sapiens
ctccagggttccccgatccact

SEQ ID NO: 9186252 - DNA, 22 bp, Homo sapiens
ttgttacagcagcaatagaaaa

SEQ ID NO: 9186253 - DNA, 18 bp, Homo sapiens
ctccaggtaattctgata

SEQ ID NO: 9186254 - DNA, 22 bp, Homo sapiens
ttgttaagggttatgcagcttt

SEQ ID NO: 9186255 - DNA, 22 bp, Homo sapiens
ttgttaaagatgcagattccat

SEQ ID NO: 9186256 - DNA, 22 bp, Homo sapiens
ttgttaaaatgaggtcattctg

SEQ ID NO: 9186257 - DNA, 22 bp, Homo sapiens
ttgtattttgttatgctactgc

SEQ ID NO: 9186258 - DNA, 22 bp, Homo sapiens
ttgtgtactacagtatgccaca

SEQ ID NO: 9186259 - DNA, 22 bp, Homo sapiens
ttgtattttgttatgctactgc

SEQ ID NO: 9186260 - DNA, 22 bp, Homo sapiens
ttgtattttgttatgctactgc

SEQ ID NO: 9186261 - DNA, 22 bp, Homo sapiens
ttgtgtactgttggttgatatt

SEQ ID NO: 9186262 - DNA, 22 bp, Homo sapiens
ttgggttttgatacatgtctaa

SEQ ID NO: 9186263 - DNA, 22 bp, Homo sapiens
ttggtaaaatcatagtggtaac

SEQ ID NO: 9186264 - DNA, 22 bp, Homo sapiens
ttggtacatgcagatatttagt

SEQ ID NO: 9186265 - DNA, 22 bp, Homo sapiens
ttgggtctacgtagaaagaaca

SEQ ID NO: 9186266 - DNA, 22 bp, Homo sapiens
ttgggtggtggggagagttcag

SEQ ID NO: 9186267 - DNA, 22 bp, Homo sapiens
ttggtataacagatgacttacg

SEQ ID NO: 9186268 - DNA, 22 bp, Homo sapiens
ttggtataacagatgacttacg

SEQ ID NO: 9186269 - DNA, 22 bp, Homo sapiens
ttggtcaagtcttaaagaaaaa

SEQ ID NO: 9186270 - DNA, 22 bp, Homo sapiens
ctccagggagcttggaaagacc

SEQ ID NO: 9186271 - DNA, 22 bp, Homo sapiens
ctccagggagctgtggaggttt

SEQ ID NO: 9186272 - DNA, 22 bp, Homo sapiens
ctccagggagctgcgggagcca

SEQ ID NO: 9186273 - DNA, 22 bp, Homo sapiens
ctccagggagctgcgggagcca

SEQ ID NO: 9186274 - DNA, 22 bp, Homo sapiens
ctccaggcgccgcttttgcagt

SEQ ID NO: 9186275 - DNA, 22 bp, Homo sapiens
ctccagggaggagcacgggttc

SEQ ID NO: 9186276 - DNA, 22 bp, Homo sapiens
ctccagggaggtctgcaggact

SEQ ID NO: 9186277 - DNA, 22 bp, Homo sapiens
ctccagggatgagacagagtag

SEQ ID NO: 9186278 - DNA, 22 bp, Homo sapiens
ctccagggatgagacagagtag

SEQ ID NO: 9186279 - DNA, 22 bp, Homo sapiens
ctccagggaggtctgcaggact

SEQ ID NO: 9186280 - DNA, 22 bp, Homo sapiens
ctccagggcagcatggcagtgg

SEQ ID NO: 9186281 - DNA, 22 bp, Homo sapiens
ctccaggggccagaagcctggc

SEQ ID NO: 9186282 - DNA, 22 bp, Homo sapiens
ctccaggggccagaagcctggc

SEQ ID NO: 9186283 - DNA, 22 bp, Homo sapiens
ctccaggggccagaagcctggc

SEQ ID NO: 9186284 - DNA, 22 bp, Homo sapiens
ttgtatttgattgtcatatcgt

SEQ ID NO: 9186285 - DNA, 22 bp, Homo sapiens
ttgtatttgattgtcatatcgt

SEQ ID NO: 9186286 - DNA, 22 bp, Homo sapiens
ttgtatttgattgtcatatcgt

SEQ ID NO: 9186287 - DNA, 22 bp, Homo sapiens
ttgtatttgattgtcatatcgt

SEQ ID NO: 9186288 - DNA, 22 bp, Homo sapiens
ttgtatttgattgtcatatcgt

SEQ ID NO: 9186289 - DNA, 22 bp, Homo sapiens
ttgtatttgggtagtatagaga

SEQ ID NO: 9186290 - DNA, 22 bp, Homo sapiens
ctccagggggcatccacacagc

SEQ ID NO: 9186291 - DNA, 22 bp, Homo sapiens
ttgtatttctccactttctgtt

SEQ ID NO: 9186292 - DNA, 22 bp, Homo sapiens
ttgtatttgattgtcatatcgt

SEQ ID NO: 9186293 - DNA, 22 bp, Homo sapiens
ttgtatttgattgtcatatcgt

SEQ ID NO: 9186294 - DNA, 22 bp, Homo sapiens
ttgtatttcttccggtctcatt

SEQ ID NO: 9186295 - DNA, 22 bp, Homo sapiens
ttgtatttctccactttctgtt

SEQ ID NO: 9186296 - DNA, 22 bp, Homo sapiens
tttagaatgtgactgtatttga

SEQ ID NO: 9186297 - DNA, 22 bp, Homo sapiens
tttagaatgtgactgtatttga

SEQ ID NO: 9186298 - DNA, 22 bp, Homo sapiens
tttagaatgttagcgttaaagg

SEQ ID NO: 9186299 - DNA, 22 bp, Homo sapiens
ctcctctgtctaccacgagggt

SEQ ID NO: 9186300 - DNA, 22 bp, Homo sapiens
ctcctctgtctggccctgagcc

SEQ ID NO: 9186301 - DNA, 22 bp, Homo sapiens
ctcctcttctgagtaccaggga

SEQ ID NO: 9186302 - DNA, 22 bp, Homo sapiens
ctcctcttggaatgcgtggctc

SEQ ID NO: 9186303 - DNA, 22 bp, Homo sapiens
ctcctctggcttcctggaggca

SEQ ID NO: 9186304 - DNA, 22 bp, Homo sapiens
ctcctctggcttcctggaggca

SEQ ID NO: 9186305 - DNA, 22 bp, Homo sapiens
ctcctctgggtcctggtggcca

SEQ ID NO: 9186306 - DNA, 22 bp, Homo sapiens
ctcctctgggtcctggtggcca

SEQ ID NO: 9186307 - DNA, 22 bp, Homo sapiens
ctcctctgtattgattgggact

SEQ ID NO: 9186308 - DNA, 22 bp, Homo sapiens
ctcctgaattgtccctcacagc

SEQ ID NO: 9186309 - DNA, 22 bp, Homo sapiens
ctcctctttggggatttacaca

SEQ ID NO: 9186310 - DNA, 22 bp, Homo sapiens
ctcctctttagccccagctgga

SEQ ID NO: 9186311 - DNA, 22 bp, Homo sapiens
ctcctctttacccgcatggtct

SEQ ID NO: 9186312 - DNA, 22 bp, Homo sapiens
ctcctgagaggatctctgttgt

SEQ ID NO: 9186313 - DNA, 22 bp, Homo sapiens
ctcctgagaattttcagttgga

SEQ ID NO: 9186314 - DNA, 22 bp, Homo sapiens
ctcctggctatgactacatttc

SEQ ID NO: 9186315 - DNA, 22 bp, Homo sapiens
ctcctggctcgcccccagctga

SEQ ID NO: 9186316 - DNA, 22 bp, Homo sapiens
ctcctggctatgactacatttc

SEQ ID NO: 9186317 - DNA, 22 bp, Homo sapiens
ctcctggccctgagctcccagg

SEQ ID NO: 9186318 - DNA, 22 bp, Homo sapiens
ctcctggctatgactacatttc

SEQ ID NO: 9186319 - DNA, 22 bp, Homo sapiens
ctcctggccctgagctcccagg

SEQ ID NO: 9186320 - DNA, 22 bp, Homo sapiens
tttaaatttagaagaaacactg

SEQ ID NO: 9186321 - DNA, 22 bp, Homo sapiens
tttaacactagtttctttaact

SEQ ID NO: 9186322 - DNA, 22 bp, Homo sapiens
tttaacacctgtagcaggataa

SEQ ID NO: 9186323 - DNA, 22 bp, Homo sapiens
tttaaatttgtgtttagagggt

SEQ ID NO: 9186324 - DNA, 22 bp, Homo sapiens
tttaaatttagaagaaacactg

SEQ ID NO: 9186325 - DNA, 22 bp, Homo sapiens
tttaaaaaactagtctgagtct

SEQ ID NO: 9186326 - DNA, 22 bp, Homo sapiens
tttaaaaaactagtctgagtct

SEQ ID NO: 9186327 - DNA, 22 bp, Homo sapiens
tttaaaaaactagtctgagtct

SEQ ID NO: 9186328 - DNA, 22 bp, Homo sapiens
tttaaaaggcagcttcttttgt

SEQ ID NO: 9186329 - DNA, 22 bp, Homo sapiens
tttaaaaggggtattaagtcca

SEQ ID NO: 9186330 - DNA, 22 bp, Homo sapiens
tttacagttaagaaatgttacc

SEQ ID NO: 9186331 - DNA, 22 bp, Homo sapiens
tttacatgtaatgttatacaaa

SEQ ID NO: 9186332 - DNA, 22 bp, Homo sapiens
tttacatggaatattgtcttgt

SEQ ID NO: 9186333 - DNA, 22 bp, Homo sapiens
tttacatgtaatgttatacaaa

SEQ ID NO: 9186334 - DNA, 17 bp, Homo sapiens
tttagaatacaatgttt

SEQ ID NO: 9186335 - DNA, 17 bp, Homo sapiens
tttagaatacaatgttt

SEQ ID NO: 9186336 - DNA, 22 bp, Homo sapiens
tttacattgcattaggtattat

SEQ ID NO: 9186337 - DNA, 22 bp, Homo sapiens
tttacatttccctctgtcagtt

SEQ ID NO: 9186338 - DNA, 22 bp, Homo sapiens
ctctccagatctgctgagccag

SEQ ID NO: 9186339 - DNA, 22 bp, Homo sapiens
ctctccagagcccttccggccc

SEQ ID NO: 9186340 - DNA, 22 bp, Homo sapiens
ctctccagagcccttccggccc

SEQ ID NO: 9186341 - DNA, 22 bp, Homo sapiens
ctctccagatctgctgagccag

SEQ ID NO: 9186342 - DNA, 22 bp, Homo sapiens
ctctccagcagatgtagtctgt

SEQ ID NO: 9186343 - DNA, 22 bp, Homo sapiens
ctctccagcagatgtagtctgt

SEQ ID NO: 9186344 - DNA, 22 bp, Homo sapiens
ctctccagcagatgtagtctgt

SEQ ID NO: 9186345 - DNA, 22 bp, Homo sapiens
ctctccagatctgctgagccag

SEQ ID NO: 9186346 - DNA, 22 bp, Homo sapiens
ctctccagatctgctgagccag

SEQ ID NO: 9186347 - DNA, 22 bp, Homo sapiens
ctctccagcctttagcccacgc

SEQ ID NO: 9186348 - DNA, 22 bp, Homo sapiens
ctctccagccaggggcttcctg

SEQ ID NO: 9186349 - DNA, 22 bp, Homo sapiens
ctctccagccaggggcttcctg

SEQ ID NO: 9186350 - DNA, 22 bp, Homo sapiens
ctctccagccaggggcttcctg

SEQ ID NO: 9186351 - DNA, 22 bp, Homo sapiens
ctctccagccacagaagctgct

SEQ ID NO: 9186352 - DNA, 22 bp, Homo sapiens
ctctccagccacagaagctgct

SEQ ID NO: 9186353 - DNA, 22 bp, Homo sapiens
ctcctgggctgggaactcagcc

SEQ ID NO: 9186354 - DNA, 18 bp, Homo sapiens
ctcctgggctgcagatgc

SEQ ID NO: 9186355 - DNA, 18 bp, Homo sapiens
ctcctgggctgcagatgc

SEQ ID NO: 9186356 - DNA, 20 bp, Homo sapiens
ctctcacagctccctcagcc

SEQ ID NO: 9186357 - DNA, 22 bp, Homo sapiens
ctctccagaatatgccgccgtg

SEQ ID NO: 9186358 - DNA, 22 bp, Homo sapiens
ctctccagaatatgccgccgtg

SEQ ID NO: 9186359 - DNA, 22 bp, Homo sapiens
ctctccactcagcgtcatgtcc

SEQ ID NO: 9186360 - DNA, 22 bp, Homo sapiens
ctctccagaattattactatta

SEQ ID NO: 9186361 - DNA, 22 bp, Homo sapiens
ctctccagaattattactatta

SEQ ID NO: 9186362 - DNA, 22 bp, Homo sapiens
ctcctgggctcaagtgatcctc

SEQ ID NO: 9186363 - DNA, 21 bp, Homo sapiens
ctcctgggctaagatatagtg

SEQ ID NO: 9186364 - DNA, 22 bp, Homo sapiens
ctcctgggagcagggatggatg

SEQ ID NO: 9186365 - DNA, 22 bp, Homo sapiens
ctcctgggagctgtggcagagc

SEQ ID NO: 9186366 - DNA, 22 bp, Homo sapiens
ctcctgggaggatgcggacccg

SEQ ID NO: 9186367 - DNA, 22 bp, Homo sapiens
ctcctgggaggatgcggacccg

SEQ ID NO: 9186368 - DNA, 22 bp, Homo sapiens
ctcctgggaggatgcggacccg

SEQ ID NO: 9186369 - DNA, 22 bp, Homo sapiens
ctctcccccacagcagccttct

SEQ ID NO: 9186370 - DNA, 22 bp, Homo sapiens
ctctcccccacagcagccttct

SEQ ID NO: 9186371 - DNA, 22 bp, Homo sapiens
ctctccccggtacgagcggccg

SEQ ID NO: 9186372 - DNA, 22 bp, Homo sapiens
ctctccctatgcctcccaggag

SEQ ID NO: 9186373 - DNA, 22 bp, Homo sapiens
ctctccctatgcctcccaggag

SEQ ID NO: 9186374 - DNA, 20 bp, Homo sapiens
ctctcctcacccgtgtcagg

SEQ ID NO: 9186375 - DNA, 22 bp, Homo sapiens
ctctcctccaggaactcacagt

SEQ ID NO: 9186376 - DNA, 22 bp, Homo sapiens
ctctcctcagaacaggccctct

SEQ ID NO: 9186377 - DNA, 22 bp, Homo sapiens
ctctcctccaacagccctgccg

SEQ ID NO: 9186378 - DNA, 22 bp, Homo sapiens
ctctcctccaacagccctgccg

SEQ ID NO: 9186379 - DNA, 22 bp, Homo sapiens
ctctccagttacctaggtctga

SEQ ID NO: 9186380 - DNA, 22 bp, Homo sapiens
ctctccagttacctaggtctga

SEQ ID NO: 9186381 - DNA, 21 bp, Homo sapiens
ctctccagtggttcctgattc

SEQ ID NO: 9186382 - DNA, 21 bp, Homo sapiens
ctctccagtggttcctgattc

SEQ ID NO: 9186383 - DNA, 21 bp, Homo sapiens
ctctccagtggttcctgattc

SEQ ID NO: 9186384 - DNA, 19 bp, Homo sapiens
ctctccagctccagtagct

SEQ ID NO: 9186385 - DNA, 19 bp, Homo sapiens
ctctccagctccagtagct

SEQ ID NO: 9186386 - DNA, 19 bp, Homo sapiens
ctctccagctccagtagct

SEQ ID NO: 9186387 - DNA, 22 bp, Homo sapiens
ctctccagcctttagcccacgc

SEQ ID NO: 9186388 - DNA, 19 bp, Homo sapiens
ctctccagctccagtagct

SEQ ID NO: 9186389 - DNA, 19 bp, Homo sapiens
ctctccagctccagtagct

SEQ ID NO: 9186390 - DNA, 22 bp, Homo sapiens
ctctccaggactttggcccaat

SEQ ID NO: 9186391 - DNA, 22 bp, Homo sapiens
ctctccaggactttggcccaat

SEQ ID NO: 9186392 - DNA, 22 bp, Homo sapiens
ctctccaggagagcactttgag

SEQ ID NO: 9186393 - DNA, 22 bp, Homo sapiens
ctctccaggagagcactttgag

SEQ ID NO: 9186394 - DNA, 22 bp, Homo sapiens
taaagtgaaggtcataatgatt

SEQ ID NO: 9186395 - DNA, 22 bp, Homo sapiens
taaatagaatctaaactgctca

SEQ ID NO: 9186396 - DNA, 22 bp, Homo sapiens
taaatagaatctaaactgctca

SEQ ID NO: 9186397 - DNA, 18 bp, Homo sapiens
taaatatatttccccctt

SEQ ID NO: 9186398 - DNA, 18 bp, Homo sapiens
taaatatatttccccctt

SEQ ID NO: 9186399 - DNA, 22 bp, Homo sapiens
taaatagggaatagaagaggaa

SEQ ID NO: 9186400 - DNA, 22 bp, Homo sapiens
taaatagagaatcagcttggag

SEQ ID NO: 9186401 - DNA, 22 bp, Homo sapiens
taaatatgcatgtatccttatc

SEQ ID NO: 9186402 - DNA, 22 bp, Homo sapiens
taaatatgcatgtatccttatc

SEQ ID NO: 9186403 - DNA, 22 bp, Homo sapiens
taaatatgcatgtatccttatc

SEQ ID NO: 9186404 - DNA, 22 bp, Homo sapiens
taaatatcacctggaattgtta

SEQ ID NO: 9186405 - DNA, 22 bp, Homo sapiens
taaatagagaatcagcttggag

SEQ ID NO: 9186406 - DNA, 22 bp, Homo sapiens
taaatgctttctatgaaagagg

SEQ ID NO: 9186407 - DNA, 22 bp, Homo sapiens
taaatgctttctatgaaagagg

SEQ ID NO: 9186408 - DNA, 22 bp, Homo sapiens
taaatgcttagattcatagaaa

SEQ ID NO: 9186409 - DNA, 22 bp, Homo sapiens
caggagccgccaggcacgttgg

SEQ ID NO: 9186410 - DNA, 22 bp, Homo sapiens
caggagcctcctgattccaatt

SEQ ID NO: 9186411 - DNA, 22 bp, Homo sapiens
caggagccgccaggcacgttgg

SEQ ID NO: 9186412 - DNA, 22 bp, Homo sapiens
caggagcctcctgattccaatt

SEQ ID NO: 9186413 - DNA, 22 bp, Homo sapiens
caggagccttaggaaatacatc

SEQ ID NO: 9186414 - DNA, 22 bp, Homo sapiens
caggagcctcctgattccaatt

SEQ ID NO: 9186415 - DNA, 22 bp, Homo sapiens
caggagccctggtgggtggaca

SEQ ID NO: 9186416 - DNA, 22 bp, Homo sapiens
caggagccgccaggcacgttgg

SEQ ID NO: 9186417 - DNA, 22 bp, Homo sapiens
caggagcccgttgctccggcgg

SEQ ID NO: 9186418 - DNA, 22 bp, Homo sapiens
caggagcccgttgctccggcgg

SEQ ID NO: 9186419 - DNA, 22 bp, Homo sapiens
caggagcccgttgctccggcgg

SEQ ID NO: 9186420 - DNA, 22 bp, Homo sapiens
caggagccctggtgggtggaca

SEQ ID NO: 9186421 - DNA, 22 bp, Homo sapiens
caggagctcaagaccaccctgg

SEQ ID NO: 9186422 - DNA, 22 bp, Homo sapiens
caggagctactcaggttgggtt

SEQ ID NO: 9186423 - DNA, 22 bp, Homo sapiens
caggagccttaggaaatacatc

SEQ ID NO: 9186424 - DNA, 22 bp, Homo sapiens
caggagctcacagtctttgggt

SEQ ID NO: 9186425 - DNA, 22 bp, Homo sapiens
caggagctcaagaccaccctgg

SEQ ID NO: 9186426 - DNA, 22 bp, Homo sapiens
caggagctcacagtctttgggt

SEQ ID NO: 9186427 - DNA, 22 bp, Homo sapiens
caggagctcactgtctaatggg

SEQ ID NO: 9186428 - DNA, 22 bp, Homo sapiens
caggagctcagatgacatctca

SEQ ID NO: 9186429 - DNA, 22 bp, Homo sapiens
taaagcagtgtggttgtgtccc

SEQ ID NO: 9186430 - DNA, 22 bp, Homo sapiens
caggagctcttaaggatgtgat

SEQ ID NO: 9186431 - DNA, 22 bp, Homo sapiens
caggagctctcatcgtcagggc

SEQ ID NO: 9186432 - DNA, 22 bp, Homo sapiens
caggagctcttaaggatgtgat

SEQ ID NO: 9186433 - DNA, 22 bp, Homo sapiens
caggagctggataggaccacaa

SEQ ID NO: 9186434 - DNA, 22 bp, Homo sapiens
caggagctggataggaccacaa

SEQ ID NO: 9186435 - DNA, 22 bp, Homo sapiens
caggagaggctgtacgtttctc

SEQ ID NO: 9186436 - DNA, 22 bp, Homo sapiens
caggagatgacagggaagaacc

SEQ ID NO: 9186437 - DNA, 22 bp, Homo sapiens
caggagatgacagggaagaacc

SEQ ID NO: 9186438 - DNA, 22 bp, Homo sapiens
caggagatgacagggaagaacc

SEQ ID NO: 9186439 - DNA, 22 bp, Homo sapiens
caggagatgacagggaagaacc

SEQ ID NO: 9186440 - DNA, 19 bp, Homo sapiens
caggagagcatgcactttg

SEQ ID NO: 9186441 - DNA, 19 bp, Homo sapiens
caggagagcatgcactttg

SEQ ID NO: 9186442 - DNA, 22 bp, Homo sapiens
caggagaggaggctacttctta

SEQ ID NO: 9186443 - DNA, 22 bp, Homo sapiens
caggagagcccgggtccgggct

SEQ ID NO: 9186444 - DNA, 22 bp, Homo sapiens
caggagagcccgggtccgggct

SEQ ID NO: 9186445 - DNA, 22 bp, Homo sapiens
caggagagatatgagtccccac

SEQ ID NO: 9186446 - DNA, 19 bp, Homo sapiens
caggagagcatgcactttg

SEQ ID NO: 9186447 - DNA, 22 bp, Homo sapiens
caggagactcagcatccaggat

SEQ ID NO: 9186448 - DNA, 22 bp, Homo sapiens
caggagactcagcatccaggat

SEQ ID NO: 9186449 - DNA, 22 bp, Homo sapiens
taacaaagtaccatagattggg

SEQ ID NO: 9186450 - DNA, 22 bp, Homo sapiens
taacaaagtaccatagattggg

SEQ ID NO: 9186451 - DNA, 22 bp, Homo sapiens
taacaaagtaccatagattggg

SEQ ID NO: 9186452 - DNA, 22 bp, Homo sapiens
caggatactacaacaggactgt

SEQ ID NO: 9186453 - DNA, 22 bp, Homo sapiens
taacaaaggttgccaaactaag

SEQ ID NO: 9186454 - DNA, 22 bp, Homo sapiens
caggagtggtgtgagggactcc

SEQ ID NO: 9186455 - DNA, 22 bp, Homo sapiens
caggagtggtgtgagggactcc

SEQ ID NO: 9186456 - DNA, 22 bp, Homo sapiens
caggagtgcaggtggtgaggca

SEQ ID NO: 9186457 - DNA, 22 bp, Homo sapiens
caggaggcatatttaaatccaa

SEQ ID NO: 9186458 - DNA, 22 bp, Homo sapiens
caggaggcatcatggagcggac

SEQ ID NO: 9186459 - DNA, 22 bp, Homo sapiens
caggaggcatcatggagcggac

SEQ ID NO: 9186460 - DNA, 22 bp, Homo sapiens
caggaggccaactgtgggactt

SEQ ID NO: 9186461 - DNA, 22 bp, Homo sapiens
caggaggccaactgtgggactt

SEQ ID NO: 9186462 - DNA, 22 bp, Homo sapiens
caggaggcccacaggcccctgc

SEQ ID NO: 9186463 - DNA, 22 bp, Homo sapiens
caggaggcccacaggcccctgc

SEQ ID NO: 9186464 - DNA, 22 bp, Homo sapiens
caggaggcccggccacagccca

SEQ ID NO: 9186465 - DNA, 22 bp, Homo sapiens
caggaggcccaaagggcgcaga

SEQ ID NO: 9186466 - DNA, 22 bp, Homo sapiens
caggaggcccacaggcccctgc

SEQ ID NO: 9186467 - DNA, 22 bp, Homo sapiens
caggaggcccaaagggcgcaga

SEQ ID NO: 9186468 - DNA, 22 bp, Homo sapiens
caggaggctcctagggctctgt

SEQ ID NO: 9186469 - DNA, 22 bp, Homo sapiens
caggaggcgtcttcagtttgtt

SEQ ID NO: 9186470 - DNA, 22 bp, Homo sapiens
caggaggctcctagggctctgt

SEQ ID NO: 9186471 - DNA, 23 bp, Homo sapiens
caggagggaatgaagttagacaa

SEQ ID NO: 9186472 - DNA, 20 bp, Homo sapiens
caggagggacatttcagcat

SEQ ID NO: 9186473 - DNA, 22 bp, Homo sapiens
caggaggcagtttcagaagtca

SEQ ID NO: 9186474 - DNA, 22 bp, Homo sapiens
caggaggcagtttcagaagtca

SEQ ID NO: 9186475 - DNA, 22 bp, Homo sapiens
caggaggcagcgctctcaggac

SEQ ID NO: 9186476 - DNA, 22 bp, Homo sapiens
caggaggcagcgctctcaggac

SEQ ID NO: 9186477 - DNA, 22 bp, Homo sapiens
caggaggcagcgctctcaggac

SEQ ID NO: 9186478 - DNA, 22 bp, Homo sapiens
caggaggcagaggttgcagcga

SEQ ID NO: 9186479 - DNA, 22 bp, Homo sapiens
caggaggcagaggatgcccagt

SEQ ID NO: 9186480 - DNA, 22 bp, Homo sapiens
caggaggcagaggttgcagtga

SEQ ID NO: 9186481 - DNA, 22 bp, Homo sapiens
caggaggcagcgctctcaggac

SEQ ID NO: 9186482 - DNA, 22 bp, Homo sapiens
caggaggaagaactctgcaaca

SEQ ID NO: 9186483 - DNA, 22 bp, Homo sapiens
caggaggaagaactctgcaaca

SEQ ID NO: 9186484 - DNA, 22 bp, Homo sapiens
caggaggattgcttgaggccag

SEQ ID NO: 9186485 - DNA, 22 bp, Homo sapiens
caggaggcagaggatgcccagt

SEQ ID NO: 9186486 - DNA, 20 bp, Homo sapiens
caggaggcaaggtcaaggtc

SEQ ID NO: 9186487 - DNA, 20 bp, Homo sapiens
caggaggcaaggtcaaggtc

SEQ ID NO: 9186488 - DNA, 20 bp, Homo sapiens
caggaggcaaggtcaaggtc

SEQ ID NO: 9186489 - DNA, 22 bp, Homo sapiens
caggaggaaactggattcactt

SEQ ID NO: 9186490 - DNA, 22 bp, Homo sapiens
caggaggaaatgtgaccctgct

SEQ ID NO: 9186491 - DNA, 22 bp, Homo sapiens
caggaggaacaagaggttctgg

SEQ ID NO: 9186492 - DNA, 22 bp, Homo sapiens
caggagcttctgcccatggcca

SEQ ID NO: 9186493 - DNA, 22 bp, Homo sapiens
caggagcttctgcccatggcca

SEQ ID NO: 9186494 - DNA, 22 bp, Homo sapiens
caggagcttctgcccatggcca

SEQ ID NO: 9186495 - DNA, 21 bp, Homo sapiens
taaatgtgagcagggctgggc

SEQ ID NO: 9186496 - DNA, 22 bp, Homo sapiens
taaatgtctttgtcacgttggg

SEQ ID NO: 9186497 - DNA, 22 bp, Homo sapiens
taaatgtctgttaacatgaatg

SEQ ID NO: 9186498 - DNA, 22 bp, Homo sapiens
caggagctggatctccttgcgg

SEQ ID NO: 9186499 - DNA, 22 bp, Homo sapiens
taaatgtgcacaggttagaagg

SEQ ID NO: 9186500 - DNA, 22 bp, Homo sapiens
caggagctgggtctggaagcag

SEQ ID NO: 9186501 - DNA, 22 bp, Homo sapiens
caggagctgggtctggaagcag

SEQ ID NO: 9186502 - DNA, 22 bp, Homo sapiens
caggagctgggtctggaagcag

SEQ ID NO: 9186503 - DNA, 22 bp, Homo sapiens
taaatgtaaatggcgtcttgcg

SEQ ID NO: 9186504 - DNA, 22 bp, Homo sapiens
taaatgtcaatgtgatttataa

SEQ ID NO: 9186505 - DNA, 22 bp, Homo sapiens
taaatgtataggcactaaacct

SEQ ID NO: 9186506 - DNA, 22 bp, Homo sapiens
taaatgtataggcactaaacct

SEQ ID NO: 9186507 - DNA, 22 bp, Homo sapiens
taaatgtataggcactaaacct

SEQ ID NO: 9186508 - DNA, 22 bp, Homo sapiens
taaaatagcatgtgcagtgaaa

SEQ ID NO: 9186509 - DNA, 22 bp, Homo sapiens
taaaatagcatgtgcagtgaaa

SEQ ID NO: 9186510 - DNA, 22 bp, Homo sapiens
taaaaagttgaaaggacttatc

SEQ ID NO: 9186511 - DNA, 22 bp, Homo sapiens
taaaatcattctggtgtcagta

SEQ ID NO: 9186512 - DNA, 22 bp, Homo sapiens
taaaatgacttcctccaacatc

SEQ ID NO: 9186513 - DNA, 22 bp, Homo sapiens
taaaatgacttcctccaacatc

SEQ ID NO: 9186514 - DNA, 22 bp, Homo sapiens
taaaatcaccaaaagcaggtgg

SEQ ID NO: 9186515 - DNA, 22 bp, Homo sapiens
taaaatcaccaaaagcaggtgg

SEQ ID NO: 9186516 - DNA, 22 bp, Homo sapiens
taaaaagcagctgagattttct

SEQ ID NO: 9186517 - DNA, 22 bp, Homo sapiens
taaaaagcagctgagattttct

SEQ ID NO: 9186518 - DNA, 22 bp, Homo sapiens
taaaaaacattactctgtcctg

SEQ ID NO: 9186519 - DNA, 22 bp, Homo sapiens
taaaaaacattactctgtcctg

SEQ ID NO: 9186520 - DNA, 22 bp, Homo sapiens
taaaaaacattactctgtcctg

SEQ ID NO: 9186521 - DNA, 22 bp, Homo sapiens
taaaaaacattactctgtcctg

SEQ ID NO: 9186522 - DNA, 22 bp, Homo sapiens
gttttctggcagttattcctta

SEQ ID NO: 9186523 - DNA, 22 bp, Homo sapiens
gttttctggcagttattcctta

SEQ ID NO: 9186524 - DNA, 22 bp, Homo sapiens
gttttctctgagatgcctttct

SEQ ID NO: 9186525 - DNA, 19 bp, Homo sapiens
gttttctgatcttgccccc

SEQ ID NO: 9186526 - DNA, 22 bp, Homo sapiens
gttttctgattagcaaatctga

SEQ ID NO: 9186527 - DNA, 22 bp, Homo sapiens
gttttctcatctcctcaatggt

SEQ ID NO: 9186528 - DNA, 22 bp, Homo sapiens
gttttctaccagggaagagagt

SEQ ID NO: 9186529 - DNA, 22 bp, Homo sapiens
caggagacaatggctgtggggc

SEQ ID NO: 9186530 - DNA, 22 bp, Homo sapiens
caggagactatggcccaaggcc

SEQ ID NO: 9186531 - DNA, 22 bp, Homo sapiens
caggagactatggcccaaggcc

SEQ ID NO: 9186532 - DNA, 22 bp, Homo sapiens
caggagacaagttagcagctga

SEQ ID NO: 9186533 - DNA, 22 bp, Homo sapiens
caggagaaggtttggagtgcag

SEQ ID NO: 9186534 - DNA, 22 bp, Homo sapiens
caggagaagtctctagggggtg

SEQ ID NO: 9186535 - DNA, 19 bp, Homo sapiens
caggacagtttgccaagaa

SEQ ID NO: 9186536 - DNA, 19 bp, Homo sapiens
caggacagtttgccaagaa

SEQ ID NO: 9186537 - DNA, 19 bp, Homo sapiens
caggacagtttgccaagaa

SEQ ID NO: 9186538 - DNA, 22 bp, Homo sapiens
caggacagttggcatctgctgc

SEQ ID NO: 9186539 - DNA, 22 bp, Homo sapiens
caggacagtttgctttgccctg

SEQ ID NO: 9186540 - DNA, 23 bp, Homo sapiens
caggacatgggaggaagtatggc

SEQ ID NO: 9186541 - DNA, 22 bp, Homo sapiens
caggaccattgcaactgcccct

SEQ ID NO: 9186542 - DNA, 22 bp, Homo sapiens
caggacccatcagccaggcact

SEQ ID NO: 9186543 - DNA, 22 bp, Homo sapiens
caggacccaacctccctgctct

SEQ ID NO: 9186544 - DNA, 22 bp, Homo sapiens
taaaccttggtagcatcttgct

SEQ ID NO: 9186545 - DNA, 22 bp, Homo sapiens
taaactatctgtgtttgaagtt

SEQ ID NO: 9186546 - DNA, 22 bp, Homo sapiens
taaactatctgtgtttgaagtt

SEQ ID NO: 9186547 - DNA, 22 bp, Homo sapiens
caggacagtgcaggtccatcct

SEQ ID NO: 9186548 - DNA, 22 bp, Homo sapiens
taaactcttctgtagaatcaga

SEQ ID NO: 9186549 - DNA, 22 bp, Homo sapiens
taaactgaagctcaactcaaat

SEQ ID NO: 9186550 - DNA, 22 bp, Homo sapiens
taaacatgttgacatcttacct

SEQ ID NO: 9186551 - DNA, 22 bp, Homo sapiens
taaacatttgttattcttgttt

SEQ ID NO: 9186552 - DNA, 22 bp, Homo sapiens
taaacatttgttattcttgttt

SEQ ID NO: 9186553 - DNA, 22 bp, Homo sapiens
taaaccaggtaaagaagctctc

SEQ ID NO: 9186554 - DNA, 18 bp, Homo sapiens
taaaccagatgacagttg

SEQ ID NO: 9186555 - DNA, 21 bp, Homo sapiens
taaaccaggtaatttccattc

SEQ ID NO: 9186556 - DNA, 19 bp, Homo sapiens
taaaccctggctttttctg

SEQ ID NO: 9186557 - DNA, 18 bp, Homo sapiens
taaacctgagaagcgtgt

SEQ ID NO: 9186558 - DNA, 22 bp, Homo sapiens
taaacctgcaactatagccacc

SEQ ID NO: 9186559 - DNA, 22 bp, Homo sapiens
taaacctgtagttgatgtaatt

SEQ ID NO: 9186560 - DNA, 21 bp, Homo sapiens
taaacctggcgctgttcaaag

SEQ ID NO: 9186561 - DNA, 22 bp, Homo sapiens
caggaatgtttgtgctccttta

SEQ ID NO: 9186562 - DNA, 22 bp, Homo sapiens
caggacactaaaaagccaagct

SEQ ID NO: 9186563 - DNA, 22 bp, Homo sapiens
caggacacagggtgtggctgat

SEQ ID NO: 9186564 - DNA, 22 bp, Homo sapiens
caggacacagaataaggcagtt

SEQ ID NO: 9186565 - DNA, 22 bp, Homo sapiens
caggacaattttgagccacctg

SEQ ID NO: 9186566 - DNA, 22 bp, Homo sapiens
caggaatgatctgctgagtgat

SEQ ID NO: 9186567 - DNA, 22 bp, Homo sapiens
caggaatgagttctggtgctct

SEQ ID NO: 9186568 - DNA, 19 bp, Homo sapiens
caggaatgaggtaatggct

SEQ ID NO: 9186569 - DNA, 22 bp, Homo sapiens
caggaatgactgcagatggggc

SEQ ID NO: 9186570 - DNA, 22 bp, Homo sapiens
caggaatgactgcagatggggc

SEQ ID NO: 9186571 - DNA, 22 bp, Homo sapiens
caggaatgtatgatacagtggt

SEQ ID NO: 9186572 - DNA, 22 bp, Homo sapiens
caggaatgtagcagcgatggaa

SEQ ID NO: 9186573 - DNA, 18 bp, Homo sapiens
caggaatggatgggattt

SEQ ID NO: 9186574 - DNA, 22 bp, Homo sapiens
caggaatgggtgacagtcagct

SEQ ID NO: 9186575 - DNA, 22 bp, Homo sapiens
caggacagctgggccaccacca

SEQ ID NO: 9186576 - DNA, 22 bp, Homo sapiens
caggacagctcaacacctcctc

SEQ ID NO: 9186577 - DNA, 22 bp, Homo sapiens
caggacagctcaacacctcctc

SEQ ID NO: 9186578 - DNA, 22 bp, Homo sapiens
caggacagctcaacacctcctc

SEQ ID NO: 9186579 - DNA, 22 bp, Homo sapiens
caggacaggagtggggtcaaag

SEQ ID NO: 9186580 - DNA, 22 bp, Homo sapiens
caggacagctgggccaccacca

SEQ ID NO: 9186581 - DNA, 22 bp, Homo sapiens
caggacaggagtggggtcaaag

SEQ ID NO: 9186582 - DNA, 22 bp, Homo sapiens
caggacaggtgttctagatcag

SEQ ID NO: 9186583 - DNA, 22 bp, Homo sapiens
caggacaggccctgtggggtct

SEQ ID NO: 9186584 - DNA, 22 bp, Homo sapiens
caggacaggccctgtggggtct

SEQ ID NO: 9186585 - DNA, 22 bp, Homo sapiens
caggacaggtgttctagatcag

SEQ ID NO: 9186586 - DNA, 22 bp, Homo sapiens
caggacagtataggctttagga

SEQ ID NO: 9186587 - DNA, 22 bp, Homo sapiens
caggaatgaaaggtcagggttg

SEQ ID NO: 9186588 - DNA, 22 bp, Homo sapiens
caggaatgactgcagatggggc

SEQ ID NO: 9186589 - DNA, 22 bp, Homo sapiens
caggaatccagagtgagcctcc

SEQ ID NO: 9186590 - DNA, 22 bp, Homo sapiens
caggaagggggatccttggaag

SEQ ID NO: 9186591 - DNA, 22 bp, Homo sapiens
caggaagggggatccttggaag

SEQ ID NO: 9186592 - DNA, 22 bp, Homo sapiens
caggaagtctttgcccaggcca

SEQ ID NO: 9186593 - DNA, 22 bp, Homo sapiens
caggaagtgggtagaaggaata

SEQ ID NO: 9186594 - DNA, 22 bp, Homo sapiens
caggaagtgcctggtgagagga

SEQ ID NO: 9186595 - DNA, 22 bp, Homo sapiens
caggaaggaaagggtgtggaga

SEQ ID NO: 9186596 - DNA, 22 bp, Homo sapiens
caggaaggaaagggtgtggaga

SEQ ID NO: 9186597 - DNA, 22 bp, Homo sapiens
caggaaggaaagggtgtggaga

SEQ ID NO: 9186598 - DNA, 22 bp, Homo sapiens
caggaagggggatccttggaag

SEQ ID NO: 9186599 - DNA, 22 bp, Homo sapiens
caggaagctgtgaaggagacgg

SEQ ID NO: 9186600 - DNA, 22 bp, Homo sapiens
caggaaggaaagggtgtggaga

SEQ ID NO: 9186601 - DNA, 22 bp, Homo sapiens
caggaagctgccggtgagcgag

SEQ ID NO: 9186602 - DNA, 22 bp, Homo sapiens
caggaagctgagctgcactgca

SEQ ID NO: 9186603 - DNA, 22 bp, Homo sapiens
gtttgtaaccagaacagagagt

SEQ ID NO: 9186604 - DNA, 22 bp, Homo sapiens
caggaagccttccttgtctgct

SEQ ID NO: 9186605 - DNA, 22 bp, Homo sapiens
caggaagccttccttgtctgct

SEQ ID NO: 9186606 - DNA, 22 bp, Homo sapiens
gtttggatgtgtagtgagggga

SEQ ID NO: 9186607 - DNA, 22 bp, Homo sapiens
taacatttcggtgacagtggga

SEQ ID NO: 9186608 - DNA, 22 bp, Homo sapiens
taacatttgctgtctcctatgt

SEQ ID NO: 9186609 - DNA, 22 bp, Homo sapiens
taacatttgctgtctcctatgt

SEQ ID NO: 9186610 - DNA, 22 bp, Homo sapiens
taacatttaaatttttcacata

SEQ ID NO: 9186611 - DNA, 22 bp, Homo sapiens
taacatttaaatttttcacata

SEQ ID NO: 9186612 - DNA, 22 bp, Homo sapiens
taacttgaacatggagagtaag

SEQ ID NO: 9186613 - DNA, 22 bp, Homo sapiens
taacttgacctgtataaaacac

SEQ ID NO: 9186614 - DNA, 16 bp, Homo sapiens
taacatttttaaaagg

SEQ ID NO: 9186615 - DNA, 16 bp, Homo sapiens
taacatttttaaaagg

SEQ ID NO: 9186616 - DNA, 16 bp, Homo sapiens
taacatttttaaaagg

SEQ ID NO: 9186617 - DNA, 22 bp, Homo sapiens
taacttgataagtattctctgc

SEQ ID NO: 9186618 - DNA, 22 bp, Homo sapiens
taacttggttggtgggcaggag

SEQ ID NO: 9186619 - DNA, 22 bp, Homo sapiens
taactttaggaataggtaatct

SEQ ID NO: 9186620 - DNA, 22 bp, Homo sapiens
taactttgaagggaattttact

SEQ ID NO: 9186621 - DNA, 22 bp, Homo sapiens
taactttgatcacttgataagg

SEQ ID NO: 9186622 - DNA, 22 bp, Homo sapiens
taactttgataagaatcaggga

SEQ ID NO: 9186623 - DNA, 22 bp, Homo sapiens
caggatgccatgccccaataca

SEQ ID NO: 9186624 - DNA, 21 bp, Homo sapiens
caggatgatgggaaggtggtg

SEQ ID NO: 9186625 - DNA, 22 bp, Homo sapiens
caggatggtctcgatctcctga

SEQ ID NO: 9186626 - DNA, 22 bp, Homo sapiens
caggatctgccaatattcaacc

SEQ ID NO: 9186627 - DNA, 22 bp, Homo sapiens
caggatctgcccaggcctttgg

SEQ ID NO: 9186628 - DNA, 22 bp, Homo sapiens
caggatcttttaatgtctccag

SEQ ID NO: 9186629 - DNA, 22 bp, Homo sapiens
taagaaacatttttatgacagt

SEQ ID NO: 9186630 - DNA, 22 bp, Homo sapiens
taagaaacatttttatgacagt

SEQ ID NO: 9186631 - DNA, 22 bp, Homo sapiens
taacactgtgtctgccatatcc

SEQ ID NO: 9186632 - DNA, 22 bp, Homo sapiens
taacactttggattaaaattct

SEQ ID NO: 9186633 - DNA, 22 bp, Homo sapiens
taacaagatatatgacttggat

SEQ ID NO: 9186634 - DNA, 19 bp, Homo sapiens
taacaaagtctgaagtcag

SEQ ID NO: 9186635 - DNA, 19 bp, Homo sapiens
taacaaagtctgaagtcag

SEQ ID NO: 9186636 - DNA, 22 bp, Homo sapiens
taacagaaaggggacagaaata

SEQ ID NO: 9186637 - DNA, 22 bp, Homo sapiens
taacattcctcaaagttttcag

SEQ ID NO: 9186638 - DNA, 22 bp, Homo sapiens
taacatttaaatttttcacata

SEQ ID NO: 9186639 - DNA, 22 bp, Homo sapiens
taacattatacagagaggacag

SEQ ID NO: 9186640 - DNA, 22 bp, Homo sapiens
taacattaggtagacataagcc

SEQ ID NO: 9186641 - DNA, 22 bp, Homo sapiens
taacagaagttgttcattgtgg

SEQ ID NO: 9186642 - DNA, 22 bp, Homo sapiens
caggcacaggggaatgtctttt

SEQ ID NO: 9186643 - DNA, 22 bp, Homo sapiens
caggcacagctaagactggcca

SEQ ID NO: 9186644 - DNA, 22 bp, Homo sapiens
caggcacaatgagcgccatctt

SEQ ID NO: 9186645 - DNA, 22 bp, Homo sapiens
caggcacaagatcggctagata

SEQ ID NO: 9186646 - DNA, 22 bp, Homo sapiens
caggcacaagaagcaaatgtta

SEQ ID NO: 9186647 - DNA, 22 bp, Homo sapiens
caggcacaagatcggctagata

SEQ ID NO: 9186648 - DNA, 22 bp, Homo sapiens
caggcacagtgttgctgttcaa

SEQ ID NO: 9186649 - DNA, 22 bp, Homo sapiens
caggcacatgggagctcatcat

SEQ ID NO: 9186650 - DNA, 22 bp, Homo sapiens
caggcaagatccagaggctgct

SEQ ID NO: 9186651 - DNA, 22 bp, Homo sapiens
caggatggtgtgagtgtgagga

SEQ ID NO: 9186652 - DNA, 22 bp, Homo sapiens
caggatggtgtgagtgtgagga

SEQ ID NO: 9186653 - DNA, 22 bp, Homo sapiens
caggattataaactgtgcactg

SEQ ID NO: 9186654 - DNA, 22 bp, Homo sapiens
caggatgttgctcccatgtccc

SEQ ID NO: 9186655 - DNA, 22 bp, Homo sapiens
caggatggtggcatgatcagaa

SEQ ID NO: 9186656 - DNA, 22 bp, Homo sapiens
caggatggtggcatgatcagaa

SEQ ID NO: 9186657 - DNA, 22 bp, Homo sapiens
caggcacaaatttctagataag

SEQ ID NO: 9186658 - DNA, 22 bp, Homo sapiens
caggcaaggaggcactgaggga

SEQ ID NO: 9186659 - DNA, 22 bp, Homo sapiens
caggcaaggaggcactgaggga

SEQ ID NO: 9186660 - DNA, 22 bp, Homo sapiens
caggcaagattagagatgagca

SEQ ID NO: 9186661 - DNA, 22 bp, Homo sapiens
caggcactcagtctggatccct

SEQ ID NO: 9186662 - DNA, 19 bp, Homo sapiens
taaggcagcagtgacaggc

SEQ ID NO: 9186663 - DNA, 22 bp, Homo sapiens
taagcaaatagctagatcagag

SEQ ID NO: 9186664 - DNA, 22 bp, Homo sapiens
taagcaaatagctagatcagag

SEQ ID NO: 9186665 - DNA, 22 bp, Homo sapiens
taagcaaataatgcatcaaggg

SEQ ID NO: 9186666 - DNA, 22 bp, Homo sapiens
taaggcacacagttgctgcatg

SEQ ID NO: 9186667 - DNA, 22 bp, Homo sapiens
taaggcaccataatatatttaa

SEQ ID NO: 9186668 - DNA, 22 bp, Homo sapiens
taaggcacccatgttcatacag

SEQ ID NO: 9186669 - DNA, 22 bp, Homo sapiens
taaggcacccttctgagtagag

SEQ ID NO: 9186670 - DNA, 22 bp, Homo sapiens
taaggcacccgtgagctgccag

SEQ ID NO: 9186671 - DNA, 22 bp, Homo sapiens
taaggcacgcataagagggggc

SEQ ID NO: 9186672 - DNA, 22 bp, Homo sapiens
taaggcacctgtccaggctggg

SEQ ID NO: 9186673 - DNA, 22 bp, Homo sapiens
taaggcacgcggtgaatgccaa

SEQ ID NO: 9186674 - DNA, 22 bp, Homo sapiens
taaggcacttcaatgtttagaa

SEQ ID NO: 9186675 - DNA, 22 bp, Homo sapiens
taagatgtacttttgtcctcac

SEQ ID NO: 9186676 - DNA, 22 bp, Homo sapiens
taagatgtacaaccacttctct

SEQ ID NO: 9186677 - DNA, 22 bp, Homo sapiens
taagatgtacaaccacttctct

SEQ ID NO: 9186678 - DNA, 22 bp, Homo sapiens
taagatgtaagatcagagcttg

SEQ ID NO: 9186679 - DNA, 22 bp, Homo sapiens
taagatgtaagatcagagcttg

SEQ ID NO: 9186680 - DNA, 22 bp, Homo sapiens
taagcaaaggattttgatcttt

SEQ ID NO: 9186681 - DNA, 22 bp, Homo sapiens
taagatttttaaaatgtcctca

SEQ ID NO: 9186682 - DNA, 22 bp, Homo sapiens
taagatgtcatccacatagagt

SEQ ID NO: 9186683 - DNA, 22 bp, Homo sapiens
taagatgtcaaagggtcacagt

SEQ ID NO: 9186684 - DNA, 22 bp, Homo sapiens
taagattacagtgagaaataaa

SEQ ID NO: 9186685 - DNA, 22 bp, Homo sapiens
taagatgttttggtttgataag

SEQ ID NO: 9186686 - DNA, 22 bp, Homo sapiens
taagatgtggaatcacagcttc

SEQ ID NO: 9186687 - DNA, 22 bp, Homo sapiens
taagatgtggaatcacagcttc

SEQ ID NO: 9186688 - DNA, 22 bp, Homo sapiens
taagattatacttaaagagaaa

SEQ ID NO: 9186689 - DNA, 22 bp, Homo sapiens
tacaaatgaaccaactttgatg

SEQ ID NO: 9186690 - DNA, 22 bp, Homo sapiens
caggcagggagctggaaaggat

SEQ ID NO: 9186691 - DNA, 22 bp, Homo sapiens
tacaaatgagttgtatgaacca

SEQ ID NO: 9186692 - DNA, 22 bp, Homo sapiens
tacaaatgaccatagccactta

SEQ ID NO: 9186693 - DNA, 22 bp, Homo sapiens
tacaaatgagttgtatgaacca

SEQ ID NO: 9186694 - DNA, 22 bp, Homo sapiens
tacaaattaatgggcatgttta

SEQ ID NO: 9186695 - DNA, 22 bp, Homo sapiens
tacaaatggttgaatggatgaa

SEQ ID NO: 9186696 - DNA, 22 bp, Homo sapiens
tacaaatgtattttattttggt

SEQ ID NO: 9186697 - DNA, 22 bp, Homo sapiens
tacaaatgggttaaaatatagt

SEQ ID NO: 9186698 - DNA, 22 bp, Homo sapiens
tacaaatgggttaaaatatagt

SEQ ID NO: 9186699 - DNA, 22 bp, Homo sapiens
tacaagtcacttcctttctaaa

SEQ ID NO: 9186700 - DNA, 22 bp, Homo sapiens
tacaagtgctagcagatattgt

SEQ ID NO: 9186701 - DNA, 22 bp, Homo sapiens
tacaagtgtaagcttgtgagac

SEQ ID NO: 9186702 - DNA, 22 bp, Homo sapiens
tacaagtgtgcaccaccatgtc

SEQ ID NO: 9186703 - DNA, 22 bp, Homo sapiens
tacagctggactggtagctgtg

SEQ ID NO: 9186704 - DNA, 22 bp, Homo sapiens
tacaggggtaacagtggggaat

SEQ ID NO: 9186705 - DNA, 22 bp, Homo sapiens
tacaggggtaacagtggggaat

SEQ ID NO: 9186706 - DNA, 22 bp, Homo sapiens
tacaggtaaaattatcagaaac

SEQ ID NO: 9186707 - DNA, 22 bp, Homo sapiens
caggccctggcagggctgagtc

SEQ ID NO: 9186708 - DNA, 22 bp, Homo sapiens
caggccctggcagggctgagtc

SEQ ID NO: 9186709 - DNA, 22 bp, Homo sapiens
caggccctggcagggctgagtc

SEQ ID NO: 9186710 - DNA, 22 bp, Homo sapiens
tacaggtggtaaaaatattgtt

SEQ ID NO: 9186711 - DNA, 22 bp, Homo sapiens
tacagtaacatgttgtacaagc

SEQ ID NO: 9186712 - DNA, 22 bp, Homo sapiens
tacagtaaccttatttgtcatt

SEQ ID NO: 9186713 - DNA, 22 bp, Homo sapiens
tacatgtggagataactgaagc

SEQ ID NO: 9186714 - DNA, 22 bp, Homo sapiens
tacatcatgaaagcatacatca

SEQ ID NO: 9186715 - DNA, 22 bp, Homo sapiens
tacatatgaactttataacttg

SEQ ID NO: 9186716 - DNA, 22 bp, Homo sapiens
tacatatgtaaacatgtataaa

SEQ ID NO: 9186717 - DNA, 22 bp, Homo sapiens
tacatatgtaaacatgtataaa

SEQ ID NO: 9186718 - DNA, 22 bp, Homo sapiens
taatttaattccatggattcta

SEQ ID NO: 9186719 - DNA, 22 bp, Homo sapiens
taatttaattccatggattcta

SEQ ID NO: 9186720 - DNA, 22 bp, Homo sapiens
taatttaatccaagtgttacat

SEQ ID NO: 9186721 - DNA, 22 bp, Homo sapiens
taatttaatccaagtgttacat

SEQ ID NO: 9186722 - DNA, 22 bp, Homo sapiens
taatttaatccaagtgttacat

SEQ ID NO: 9186723 - DNA, 22 bp, Homo sapiens
taattgtcatcgtagtaaacat

SEQ ID NO: 9186724 - DNA, 22 bp, Homo sapiens
taattgtcttagtctgtgcagg

SEQ ID NO: 9186725 - DNA, 22 bp, Homo sapiens
taattgtcttaggtgtgatgat

SEQ ID NO: 9186726 - DNA, 22 bp, Homo sapiens
taatttactcagatgttcaatc

SEQ ID NO: 9186727 - DNA, 22 bp, Homo sapiens
taatttacagagatacagtcag

SEQ ID NO: 9186728 - DNA, 22 bp, Homo sapiens
taatttaatttcatgccagcct

SEQ ID NO: 9186729 - DNA, 22 bp, Homo sapiens
taatttaatttcatgccagcct

SEQ ID NO: 9186730 - DNA, 22 bp, Homo sapiens
caggcagagcaactggtccaga

SEQ ID NO: 9186731 - DNA, 22 bp, Homo sapiens
caggcagagcaactggtccaga

SEQ ID NO: 9186732 - DNA, 22 bp, Homo sapiens
taattgcttgtaaagccctgaa

SEQ ID NO: 9186733 - DNA, 22 bp, Homo sapiens
taattgctttatcctgttagaa

SEQ ID NO: 9186734 - DNA, 22 bp, Homo sapiens
taattggatgttctctggaagc

SEQ ID NO: 9186735 - DNA, 22 bp, Homo sapiens
taattgtaaagtagtagtacag

SEQ ID NO: 9186736 - DNA, 22 bp, Homo sapiens
taattgtacgatgttaaatcag

SEQ ID NO: 9186737 - DNA, 22 bp, Homo sapiens
taattgtatggagaaggctgca

SEQ ID NO: 9186738 - DNA, 22 bp, Homo sapiens
taattgtactccctgtgggaaa

SEQ ID NO: 9186739 - DNA, 22 bp, Homo sapiens
caggcagagaactcatccgtga

SEQ ID NO: 9186740 - DNA, 22 bp, Homo sapiens
caggcagactttgagaatgatg

SEQ ID NO: 9186741 - DNA, 17 bp, Homo sapiens
caggcagacatgtaagc

SEQ ID NO: 9186742 - DNA, 22 bp, Homo sapiens
caggcagagacgtcagtgtagg

SEQ ID NO: 9186743 - DNA, 22 bp, Homo sapiens
caggcagagacgtcagtgtagg

SEQ ID NO: 9186744 - DNA, 22 bp, Homo sapiens
caggcagagaggagcatttaat

SEQ ID NO: 9186745 - DNA, 22 bp, Homo sapiens
caggcagaaattttgtttcatt

SEQ ID NO: 9186746 - DNA, 22 bp, Homo sapiens
caggcagaaggaagtaccaggc

SEQ ID NO: 9186747 - DNA, 22 bp, Homo sapiens
caggcagaaggaagtaccaggc

SEQ ID NO: 9186748 - DNA, 22 bp, Homo sapiens
caggcagcatttactctgatga

SEQ ID NO: 9186749 - DNA, 22 bp, Homo sapiens
caggcagcatcagtctgctgta

SEQ ID NO: 9186750 - DNA, 22 bp, Homo sapiens
caggcagcatcagtctgctgta

SEQ ID NO: 9186751 - DNA, 22 bp, Homo sapiens
caggcagcatcagtctgctgta

SEQ ID NO: 9186752 - DNA, 22 bp, Homo sapiens
caggcagcatcagtctgctgta

SEQ ID NO: 9186753 - DNA, 22 bp, Homo sapiens
caggcagcaggagccctgctcg

SEQ ID NO: 9186754 - DNA, 22 bp, Homo sapiens
caggcagcaggagccctgctcg

SEQ ID NO: 9186755 - DNA, 22 bp, Homo sapiens
caggcagcagccactctggtat

SEQ ID NO: 9186756 - DNA, 22 bp, Homo sapiens
caggcagcagccactctggtat

SEQ ID NO: 9186757 - DNA, 22 bp, Homo sapiens
caggcagctctaatggaaagtg

SEQ ID NO: 9186758 - DNA, 22 bp, Homo sapiens
caggcagctctaatggaaagtg

SEQ ID NO: 9186759 - DNA, 22 bp, Homo sapiens
caggcagcctgagggatctggg

SEQ ID NO: 9186760 - DNA, 22 bp, Homo sapiens
caggcagcctgcggtctgcaca

SEQ ID NO: 9186761 - DNA, 22 bp, Homo sapiens
caggcagctctaatggaaagtg

SEQ ID NO: 9186762 - DNA, 22 bp, Homo sapiens
caggcagcctgagggatctggg

SEQ ID NO: 9186763 - DNA, 22 bp, Homo sapiens
caggcagcctgagggatctggg

SEQ ID NO: 9186764 - DNA, 22 bp, Homo sapiens
caggcagctgcgacaagagagc

SEQ ID NO: 9186765 - DNA, 22 bp, Homo sapiens
caggcagctgactgtcagatat

SEQ ID NO: 9186766 - DNA, 22 bp, Homo sapiens
caggcagctgcgacaagagagc

SEQ ID NO: 9186767 - DNA, 22 bp, Homo sapiens
caggcagctgaggactttgcta

SEQ ID NO: 9186768 - DNA, 22 bp, Homo sapiens
caggcaggagaggaggatttct

SEQ ID NO: 9186769 - DNA, 22 bp, Homo sapiens
caggcaggagaggaggatttct

SEQ ID NO: 9186770 - DNA, 22 bp, Homo sapiens
caggcaggagccagggattcca

SEQ ID NO: 9186771 - DNA, 23 bp, Homo sapiens
caggcaggatgaggactacactc

SEQ ID NO: 9186772 - DNA, 22 bp, Homo sapiens
gttggccagcacagcttgcaag

SEQ ID NO: 9186773 - DNA, 22 bp, Homo sapiens
gttggccagcacagcttgcaag

SEQ ID NO: 9186774 - DNA, 22 bp, Homo sapiens
gttggccagagatgctgatata

SEQ ID NO: 9186775 - DNA, 22 bp, Homo sapiens
gttggccagagatgctgatata

SEQ ID NO: 9186776 - DNA, 22 bp, Homo sapiens
gttggcactactccttgcttaa

SEQ ID NO: 9186777 - DNA, 22 bp, Homo sapiens
gttggagtgcagcttgtgcgat

SEQ ID NO: 9186778 - DNA, 22 bp, Homo sapiens
gttggccattaattggaggaca

SEQ ID NO: 9186779 - DNA, 22 bp, Homo sapiens
gttggccatcgctatgacaaga

SEQ ID NO: 9186780 - DNA, 22 bp, Homo sapiens
gttggccatcgctatgacaaga

SEQ ID NO: 9186781 - DNA, 22 bp, Homo sapiens
gttggccaggctggtctcaaac

SEQ ID NO: 9186782 - DNA, 22 bp, Homo sapiens
gttggccaggctggtctcaatc

SEQ ID NO: 9186783 - DNA, 22 bp, Homo sapiens
gttggctatagggagatggggc

SEQ ID NO: 9186784 - DNA, 22 bp, Homo sapiens
gttggccattaattggaggaca

SEQ ID NO: 9186785 - DNA, 22 bp, Homo sapiens
gttggctatgagagctttagtg

SEQ ID NO: 9186786 - DNA, 22 bp, Homo sapiens
gttggctatgagagctttagtg

SEQ ID NO: 9186787 - DNA, 22 bp, Homo sapiens
caggaaagtctgtaaaggaacc

SEQ ID NO: 9186788 - DNA, 22 bp, Homo sapiens
caggaaaggtagtcacaatgta

SEQ ID NO: 9186789 - DNA, 22 bp, Homo sapiens
caggaaagggatgggctgccac

SEQ ID NO: 9186790 - DNA, 22 bp, Homo sapiens
caggaaagggatgggctgccac

SEQ ID NO: 9186791 - DNA, 22 bp, Homo sapiens
caggaaagccgagtgccatagg

SEQ ID NO: 9186792 - DNA, 22 bp, Homo sapiens
caggaaagggatgggctgccac

SEQ ID NO: 9186793 - DNA, 22 bp, Homo sapiens
caggaaatggggtttagttatt

SEQ ID NO: 9186794 - DNA, 22 bp, Homo sapiens
caggaaatttatgttctactta

SEQ ID NO: 9186795 - DNA, 22 bp, Homo sapiens
caggaacaaggcctatgggact

SEQ ID NO: 9186796 - DNA, 22 bp, Homo sapiens
gttcttcagaggtcggaggcta

SEQ ID NO: 9186797 - DNA, 22 bp, Homo sapiens
gttgctgaaagccctgactggc

SEQ ID NO: 9186798 - DNA, 22 bp, Homo sapiens
gttgctgaaagccctgactggc

SEQ ID NO: 9186799 - DNA, 22 bp, Homo sapiens
gttgctgaaggcatgccagaga

SEQ ID NO: 9186800 - DNA, 22 bp, Homo sapiens
gttgctgaaattaatattggag

SEQ ID NO: 9186801 - DNA, 22 bp, Homo sapiens
gttgctgattaacactttgagt

SEQ ID NO: 9186802 - DNA, 22 bp, Homo sapiens
gttgctgatggcaagattccag

SEQ ID NO: 9186803 - DNA, 22 bp, Homo sapiens
gttctgggagatcttgagcttc

SEQ ID NO: 9186804 - DNA, 22 bp, Homo sapiens
gttctgggaaggtggacctgtt

SEQ ID NO: 9186805 - DNA, 22 bp, Homo sapiens
gttctgggaaggtggacctgtt

SEQ ID NO: 9186806 - DNA, 22 bp, Homo sapiens
gttctgggagatcttgagcttc

SEQ ID NO: 9186807 - DNA, 22 bp, Homo sapiens
gttctgggtctggacacacaga

SEQ ID NO: 9186808 - DNA, 22 bp, Homo sapiens
gttctgggtctggacacacaga

SEQ ID NO: 9186809 - DNA, 22 bp, Homo sapiens
gttctgggtagatgtatctttt

SEQ ID NO: 9186810 - DNA, 22 bp, Homo sapiens
gttctgggttcaaaccccggcc

SEQ ID NO: 9186811 - DNA, 22 bp, Homo sapiens
gttctgggtgatgaggttggct

SEQ ID NO: 9186812 - DNA, 22 bp, Homo sapiens
gttctgggttctgggttattgg

SEQ ID NO: 9186813 - DNA, 22 bp, Homo sapiens
gttcttaaagattcatcaagca

SEQ ID NO: 9186814 - DNA, 22 bp, Homo sapiens
gttcccaggccctgggctctcc

SEQ ID NO: 9186815 - DNA, 22 bp, Homo sapiens
gttcccaggccctgggctctcc

SEQ ID NO: 9186816 - DNA, 22 bp, Homo sapiens
gttcacagtgttttctttgcat

SEQ ID NO: 9186817 - DNA, 22 bp, Homo sapiens
gttcacagtctacatagtaaag

SEQ ID NO: 9186818 - DNA, 22 bp, Homo sapiens
gttctgggaaggtggacctgtt

SEQ ID NO: 9186819 - DNA, 22 bp, Homo sapiens
gttctgggaaggtggacctgtt

SEQ ID NO: 9186820 - DNA, 22 bp, Homo sapiens
gttctggagtggtgccaggcct

SEQ ID NO: 9186821 - DNA, 22 bp, Homo sapiens
gttcctgagaaataaagagaga

SEQ ID NO: 9186822 - DNA, 22 bp, Homo sapiens
gttcctgaagggactggtgcag

SEQ ID NO: 9186823 - DNA, 22 bp, Homo sapiens
gttcctaaccagcagagaaaca

SEQ ID NO: 9186824 - DNA, 22 bp, Homo sapiens
gtttacaacatcttgtccttca

SEQ ID NO: 9186825 - DNA, 22 bp, Homo sapiens
gtttacaaatattttaaatggt

SEQ ID NO: 9186826 - DNA, 22 bp, Homo sapiens
gtttacatgcagaaaatcaatg

SEQ ID NO: 9186827 - DNA, 22 bp, Homo sapiens
gtttacatgcagaaaatcaatg

SEQ ID NO: 9186828 - DNA, 22 bp, Homo sapiens
gtttacatgcagaaaatcaatg

SEQ ID NO: 9186829 - DNA, 22 bp, Homo sapiens
gtttacatatgtctgtctgcac

SEQ ID NO: 9186830 - DNA, 22 bp, Homo sapiens
caggaagattgtggaggtggtt

SEQ ID NO: 9186831 - DNA, 22 bp, Homo sapiens
caggaagattgtggaggtggtt

SEQ ID NO: 9186832 - DNA, 22 bp, Homo sapiens
caggaagattgtggaggtggtt

SEQ ID NO: 9186833 - DNA, 22 bp, Homo sapiens
caggaagcaccagcccggcccc

SEQ ID NO: 9186834 - DNA, 22 bp, Homo sapiens
caggaagcaccagcccggcccc

SEQ ID NO: 9186835 - DNA, 22 bp, Homo sapiens
caggaagcacagtgaggagacc

SEQ ID NO: 9186836 - DNA, 22 bp, Homo sapiens
caggaagaggtatcaccgagca

SEQ ID NO: 9186837 - DNA, 22 bp, Homo sapiens
caggaagattagaccaagagct

SEQ ID NO: 9186838 - DNA, 22 bp, Homo sapiens
caggaagattagaccaagagct

SEQ ID NO: 9186839 - DNA, 22 bp, Homo sapiens
caggaagattagaccaagagct

SEQ ID NO: 9186840 - DNA, 22 bp, Homo sapiens
caggaagattagaccaagagct

SEQ ID NO: 9186841 - DNA, 22 bp, Homo sapiens
caggaagagaacatggaggctg

SEQ ID NO: 9186842 - DNA, 19 bp, Homo sapiens
caggaacatggagggaggg

SEQ ID NO: 9186843 - DNA, 22 bp, Homo sapiens
caggaagaggtatcaccgagca

SEQ ID NO: 9186844 - DNA, 22 bp, Homo sapiens
caggaagaggtatcaccgagca

SEQ ID NO: 9186845 - DNA, 22 bp, Homo sapiens
caggaagaggacaggcttcccc

SEQ ID NO: 9186846 - DNA, 22 bp, Homo sapiens
caggaagagaacatggaggctg

SEQ ID NO: 9186847 - DNA, 22 bp, Homo sapiens
caggaacacaagttcagggatg

SEQ ID NO: 9186848 - DNA, 22 bp, Homo sapiens
caggaacacaagttcagggatg

SEQ ID NO: 9186849 - DNA, 22 bp, Homo sapiens
caggaacaggctgatgggcagg

SEQ ID NO: 9186850 - DNA, 22 bp, Homo sapiens
gtttattattcaacttcatgtt

SEQ ID NO: 9186851 - DNA, 22 bp, Homo sapiens
gtttattattcaacttcatgtt

SEQ ID NO: 9186852 - DNA, 22 bp, Homo sapiens
gtttattccagcaatctgctta

SEQ ID NO: 9186853 - DNA, 22 bp, Homo sapiens
gtttattccagcaatctgctta

SEQ ID NO: 9186854 - DNA, 22 bp, Homo sapiens
gtttattattcaacttcatgtt

SEQ ID NO: 9186855 - DNA, 22 bp, Homo sapiens
gtttacatgtttttctcttaca

SEQ ID NO: 9186856 - DNA, 22 bp, Homo sapiens
gtttacatgtactcattatact

SEQ ID NO: 9186857 - DNA, 22 bp, Homo sapiens
gtttacatgtactcattatact

SEQ ID NO: 9186858 - DNA, 22 bp, Homo sapiens
gtttacatgcatgcaagaatga

SEQ ID NO: 9186859 - DNA, 22 bp, Homo sapiens
gtttacatgtaatgtgttattg

SEQ ID NO: 9186860 - DNA, 22 bp, Homo sapiens
gtttattgggtattgtggagcc

SEQ ID NO: 9186861 - DNA, 22 bp, Homo sapiens
gtttattgggtattgtggagcc

SEQ ID NO: 9186862 - DNA, 22 bp, Homo sapiens
gtttattgggtattgtggagcc

SEQ ID NO: 9186863 - DNA, 22 bp, Homo sapiens
gtttcaaaagtcaggctattct

SEQ ID NO: 9186864 - DNA, 22 bp, Homo sapiens
gtttattgataaaagctggaca

SEQ ID NO: 9186865 - DNA, 22 bp, Homo sapiens
gtttattgataaaagctggaca

SEQ ID NO: 9186866 - DNA, 22 bp, Homo sapiens
gtttattgataaaagctggaca

SEQ ID NO: 9186867 - DNA, 22 bp, Homo sapiens
gtttattcttcagcaacatctg

SEQ ID NO: 9186868 - DNA, 22 bp, Homo sapiens
gtttattccagcaatctgctta

SEQ ID NO: 9186869 - DNA, 22 bp, Homo sapiens
gtttattcttcagcaacatctg

SEQ ID NO: 9186870 - DNA, 22 bp, Homo sapiens
gtttattcttcagcaacatctg

SEQ ID NO: 9186871 - DNA, 22 bp, Homo sapiens
gtttcctgatgtgggagatctt

SEQ ID NO: 9186872 - DNA, 18 bp, Homo sapiens
gtttcctgaggtgaaggg

SEQ ID NO: 9186873 - DNA, 22 bp, Homo sapiens
gtttcctgaccctggcccagca

SEQ ID NO: 9186874 - DNA, 22 bp, Homo sapiens
gtttcctgactgtggaattata

SEQ ID NO: 9186875 - DNA, 22 bp, Homo sapiens
gtttcctgcacacgtgttatat

SEQ ID NO: 9186876 - DNA, 22 bp, Homo sapiens
gtttcctgccctgtcttatcca

SEQ ID NO: 9186877 - DNA, 22 bp, Homo sapiens
gtttcctgaagttatttcatcc

SEQ ID NO: 9186878 - DNA, 22 bp, Homo sapiens
gtttcctgaaatagagtactgg

SEQ ID NO: 9186879 - DNA, 19 bp, Homo sapiens
gtttccttgggtgtaggga

SEQ ID NO: 9186880 - DNA, 22 bp, Homo sapiens
gtttgcatttattagtcttctg

SEQ ID NO: 9186881 - DNA, 22 bp, Homo sapiens
gtttgcctgtgatgtacatttc

SEQ ID NO: 9186882 - DNA, 22 bp, Homo sapiens
gtttgccttttagataggaatg

SEQ ID NO: 9186883 - DNA, 22 bp, Homo sapiens
gtttcctgtctgctttactata

SEQ ID NO: 9186884 - DNA, 22 bp, Homo sapiens
gtttcctggaaactgctccact

SEQ ID NO: 9186885 - DNA, 22 bp, Homo sapiens
gtttcctggaaacattaggaga

SEQ ID NO: 9186886 - DNA, 22 bp, Homo sapiens
gtttcctggaggttatttttga

SEQ ID NO: 9186887 - DNA, 22 bp, Homo sapiens
gtttcctgtggccacagaataa

SEQ ID NO: 9186888 - DNA, 22 bp, Homo sapiens
gttcacagcttcttaggtcata

SEQ ID NO: 9186889 - DNA, 22 bp, Homo sapiens
caggaaagagctgccaggcagg

SEQ ID NO: 9186890 - DNA, 22 bp, Homo sapiens
caggaaagagctgccaggcagg

SEQ ID NO: 9186891 - DNA, 22 bp, Homo sapiens
caggaaagagctgccaggcagg

SEQ ID NO: 9186892 - DNA, 22 bp, Homo sapiens
caggaaagagctgccaggcagg

SEQ ID NO: 9186893 - DNA, 22 bp, Homo sapiens
caggaaagaaatgagaacacca

SEQ ID NO: 9186894 - DNA, 22 bp, Homo sapiens
caggaaagaaatgagaacacca

SEQ ID NO: 9186895 - DNA, 21 bp, Homo sapiens
caggaaagaaaacgtacatat

SEQ ID NO: 9186896 - DNA, 22 bp, Homo sapiens
caggaaacattcccataacaca

SEQ ID NO: 9186897 - DNA, 22 bp, Homo sapiens
caggaaaatgtcaatggaaagc

SEQ ID NO: 9186898 - DNA, 22 bp, Homo sapiens
caggaaaatgtcaatggaaagc

SEQ ID NO: 9186899 - DNA, 22 bp, Homo sapiens
caggaaaatgtcaatggaaagc

SEQ ID NO: 9186900 - DNA, 22 bp, Homo sapiens
cagcttgggtcaggtgcctgct

SEQ ID NO: 9186901 - DNA, 22 bp, Homo sapiens
caggaaaatggaatcacctgta

SEQ ID NO: 9186902 - DNA, 22 bp, Homo sapiens
caggaaaatggaatcacctgta

SEQ ID NO: 9186903 - DNA, 22 bp, Homo sapiens
caggaaaatggaatcacctgta

SEQ ID NO: 9186904 - DNA, 22 bp, Homo sapiens
caggaaaatctgcccacacaag

SEQ ID NO: 9186905 - DNA, 22 bp, Homo sapiens
cagcttggattttggcacgtgt

SEQ ID NO: 9186906 - DNA, 22 bp, Homo sapiens
cagcttggcgaatgtaggtatg

SEQ ID NO: 9186907 - DNA, 22 bp, Homo sapiens
cagcttggcttcacattctgta

SEQ ID NO: 9186908 - DNA, 22 bp, Homo sapiens
cagcttgggggcgctggcctca

SEQ ID NO: 9186909 - DNA, 22 bp, Homo sapiens
cagcttgggtcaggtgcctgct

SEQ ID NO: 9186910 - DNA, 22 bp, Homo sapiens
cagcttgggggcgctggcctca

SEQ ID NO: 9186911 - DNA, 22 bp, Homo sapiens
cagcttctgctatcgaacatct

SEQ ID NO: 9186912 - DNA, 20 bp, Homo sapiens
cagcttggatgagaggctga

SEQ ID NO: 9186913 - DNA, 20 bp, Homo sapiens
cagcttggatgagaggctga

SEQ ID NO: 9186914 - DNA, 22 bp, Homo sapiens
cagcttctgagcaagccagggg

SEQ ID NO: 9186915 - DNA, 22 bp, Homo sapiens
cagcttctgagcaagccagggg

SEQ ID NO: 9186916 - DNA, 22 bp, Homo sapiens
cagcttctgagcaagccagggg

SEQ ID NO: 9186917 - DNA, 21 bp, Homo sapiens
cagcttctgaaggtgtaggaa

SEQ ID NO: 9186918 - DNA, 22 bp, Homo sapiens
cagcttctccattcttctggct

SEQ ID NO: 9186919 - DNA, 22 bp, Homo sapiens
cagcttctccattcttctggct

SEQ ID NO: 9186920 - DNA, 22 bp, Homo sapiens
cagcttctccattcttctggct

SEQ ID NO: 9186921 - DNA, 22 bp, Homo sapiens
cagcttctccggcctggtgcgg

SEQ ID NO: 9186922 - DNA, 22 bp, Homo sapiens
cagcttctcgggagcgcatgtg

SEQ ID NO: 9186923 - DNA, 22 bp, Homo sapiens
cagcttctccggcctggtgcgg

SEQ ID NO: 9186924 - DNA, 22 bp, Homo sapiens
cagcttctaccatcaggaaatt

SEQ ID NO: 9186925 - DNA, 22 bp, Homo sapiens
cagcttctagcatcggctttga

SEQ ID NO: 9186926 - DNA, 22 bp, Homo sapiens
cagcttctatttatctttgtgt

SEQ ID NO: 9186927 - DNA, 22 bp, Homo sapiens
cagcttctcagaaagctgaggt

SEQ ID NO: 9186928 - DNA, 22 bp, Homo sapiens
cagcttctcagaaagctgaggt

SEQ ID NO: 9186929 - DNA, 22 bp, Homo sapiens
cagcttctccagatgaccctca

SEQ ID NO: 9186930 - DNA, 22 bp, Homo sapiens
gttattcaatggcttataagga

SEQ ID NO: 9186931 - DNA, 22 bp, Homo sapiens
gttattcaacttgtgtctctta

SEQ ID NO: 9186932 - DNA, 22 bp, Homo sapiens
gttacatttggtgatttggtgc

SEQ ID NO: 9186933 - DNA, 22 bp, Homo sapiens
gttattgacatgtattaagcac

SEQ ID NO: 9186934 - DNA, 22 bp, Homo sapiens
cagcttcagaagaagccgtgag

SEQ ID NO: 9186935 - DNA, 22 bp, Homo sapiens
cagcttcagcgtgacaccagtg

SEQ ID NO: 9186936 - DNA, 22 bp, Homo sapiens
cagcttattcagtaagcacata

SEQ ID NO: 9186937 - DNA, 22 bp, Homo sapiens
cagcttcaactgcacagtcaac

SEQ ID NO: 9186938 - DNA, 22 bp, Homo sapiens
cagcttctaaagtgtgaagcca

SEQ ID NO: 9186939 - DNA, 22 bp, Homo sapiens
cagcttccataagagatggaga

SEQ ID NO: 9186940 - DNA, 22 bp, Homo sapiens
cagcttccacagacttggctcg

SEQ ID NO: 9186941 - DNA, 22 bp, Homo sapiens
cagcttcattgcctgatgtctt

SEQ ID NO: 9186942 - DNA, 22 bp, Homo sapiens
cagctgtggggagcttgggcca

SEQ ID NO: 9186943 - DNA, 22 bp, Homo sapiens
cagctgtgtaaacacatgtgta

SEQ ID NO: 9186944 - DNA, 22 bp, Homo sapiens
cagctgtgtagatgcagggtca

SEQ ID NO: 9186945 - DNA, 22 bp, Homo sapiens
cagctgtgtagatgcagggtca

SEQ ID NO: 9186946 - DNA, 22 bp, Homo sapiens
cagctgtgtagatgcagggtca

SEQ ID NO: 9186947 - DNA, 22 bp, Homo sapiens
cagctgtgtatgagagcatgct

SEQ ID NO: 9186948 - DNA, 22 bp, Homo sapiens
cagctgtggagggaggaaatgc

SEQ ID NO: 9186949 - DNA, 22 bp, Homo sapiens
cagctgtggagggaggaaatgc

SEQ ID NO: 9186950 - DNA, 22 bp, Homo sapiens
cagctgtggctgccactgctcc

SEQ ID NO: 9186951 - DNA, 22 bp, Homo sapiens
cagctgtggctgccactgctcc

SEQ ID NO: 9186952 - DNA, 22 bp, Homo sapiens
cagctgtgggcctgacgtggca

SEQ ID NO: 9186953 - DNA, 22 bp, Homo sapiens
cagctgtgggcctgacgtggca

SEQ ID NO: 9186954 - DNA, 22 bp, Homo sapiens
cagctgtggggagcttgggcca

SEQ ID NO: 9186955 - DNA, 22 bp, Homo sapiens
cagctgtgggcctgacgtggca

SEQ ID NO: 9186956 - DNA, 22 bp, Homo sapiens
cagctgtgatatgcctgcctga

SEQ ID NO: 9186957 - DNA, 22 bp, Homo sapiens
cagctgtgatatgcctgcctga

SEQ ID NO: 9186958 - DNA, 22 bp, Homo sapiens
cagctgtgattcctgctgtcca

SEQ ID NO: 9186959 - DNA, 22 bp, Homo sapiens
cagctgtgagagtgcattgaag

SEQ ID NO: 9186960 - DNA, 22 bp, Homo sapiens
cagctgtgagcagccagttgcc

SEQ ID NO: 9186961 - DNA, 22 bp, Homo sapiens
cagctgtgagcagccagttgcc

SEQ ID NO: 9186962 - DNA, 18 bp, Homo sapiens
cagctgtgccctgtttgg

SEQ ID NO: 9186963 - DNA, 18 bp, Homo sapiens
cagctgtgccctgtttgg

SEQ ID NO: 9186964 - DNA, 22 bp, Homo sapiens
cagctgtgattcctgctgtcca

SEQ ID NO: 9186965 - DNA, 22 bp, Homo sapiens
cagctgtgctagaagccacgaa

SEQ ID NO: 9186966 - DNA, 22 bp, Homo sapiens
cagctgtgctagaagccacgaa

SEQ ID NO: 9186967 - DNA, 22 bp, Homo sapiens
cagctgtgctagaagccacgaa

SEQ ID NO: 9186968 - DNA, 22 bp, Homo sapiens
cagctgtgctgattgctcagta

SEQ ID NO: 9186969 - DNA, 22 bp, Homo sapiens
cagctgtgctgattgctcagta

SEQ ID NO: 9186970 - DNA, 22 bp, Homo sapiens
cagctgtgctgattgctcagta

SEQ ID NO: 9186971 - DNA, 22 bp, Homo sapiens
cagctgtgctgtattaagctct

SEQ ID NO: 9186972 - DNA, 22 bp, Homo sapiens
cagctgtgctgtattaagctct

SEQ ID NO: 9186973 - DNA, 22 bp, Homo sapiens
cagctgtgctgtattaagctct

SEQ ID NO: 9186974 - DNA, 22 bp, Homo sapiens
cagctgtggagatggggtgcat

SEQ ID NO: 9186975 - DNA, 22 bp, Homo sapiens
cagctgtggagatggggtgcat

SEQ ID NO: 9186976 - DNA, 22 bp, Homo sapiens
gttacaaatgccaaagctgaga

SEQ ID NO: 9186977 - DNA, 22 bp, Homo sapiens
gttacaaatgccaaagctgaga

SEQ ID NO: 9186978 - DNA, 22 bp, Homo sapiens
gttaaactgaaaggctcgttca

SEQ ID NO: 9186979 - DNA, 22 bp, Homo sapiens
gttacacagctaagcttctcct

SEQ ID NO: 9186980 - DNA, 22 bp, Homo sapiens
gttacaaatgtaaattctgggg

SEQ ID NO: 9186981 - DNA, 22 bp, Homo sapiens
gttacaaatgtaaattctgggg

SEQ ID NO: 9186982 - DNA, 22 bp, Homo sapiens
gttacaaatgccaaagctgaga

SEQ ID NO: 9186983 - DNA, 22 bp, Homo sapiens
gttacaaatgtaaattctgggg

SEQ ID NO: 9186984 - DNA, 22 bp, Homo sapiens
gtgtgtgccaactttatgtgca

SEQ ID NO: 9186985 - DNA, 22 bp, Homo sapiens
gtgtgtgcaagaggtttattga

SEQ ID NO: 9186986 - DNA, 22 bp, Homo sapiens
gtgtttgttcatcctctcttct

SEQ ID NO: 9186987 - DNA, 22 bp, Homo sapiens
gtgttttaagaaagaagctcag

SEQ ID NO: 9186988 - DNA, 22 bp, Homo sapiens
cagctgcctatgacctagcctc

SEQ ID NO: 9186989 - DNA, 22 bp, Homo sapiens
cagctgcctatgacctagcctc

SEQ ID NO: 9186990 - DNA, 22 bp, Homo sapiens
cagctgcctgcaacacaagctt

SEQ ID NO: 9186991 - DNA, 22 bp, Homo sapiens
cagctgcagtgggggaccacaa

SEQ ID NO: 9186992 - DNA, 22 bp, Homo sapiens
cagctgcagtgggggaccacaa

SEQ ID NO: 9186993 - DNA, 18 bp, Homo sapiens
cagctgcaggctcaggac

SEQ ID NO: 9186994 - DNA, 22 bp, Homo sapiens
cagctgcagtcatcttctagaa

SEQ ID NO: 9186995 - DNA, 22 bp, Homo sapiens
cagctgcagtgggggaccacaa

SEQ ID NO: 9186996 - DNA, 22 bp, Homo sapiens
cagctgcagtgggggaccacaa

SEQ ID NO: 9186997 - DNA, 18 bp, Homo sapiens
cagctgcaggctcaggac

SEQ ID NO: 9186998 - DNA, 18 bp, Homo sapiens
cagctgcaggctcaggac

SEQ ID NO: 9186999 - DNA, 22 bp, Homo sapiens
cagctgcaggctgtgcaggaag

SEQ ID NO: 9187000 - DNA, 22 bp, Homo sapiens
cagctgcaggctgtgcaggaag

SEQ ID NO: 9187001 - DNA, 18 bp, Homo sapiens
cagctgcaggctcaggac

SEQ ID NO: 9187002 - DNA, 22 bp, Homo sapiens
cagctgcaggagctgagcactt

SEQ ID NO: 9187003 - DNA, 22 bp, Homo sapiens
cagctgcaggagaaacagaggc

SEQ ID NO: 9187004 - DNA, 22 bp, Homo sapiens
cagctgcaggagaaacagaggc

SEQ ID NO: 9187005 - DNA, 22 bp, Homo sapiens
cagctgcaggagaaacagaggc

SEQ ID NO: 9187006 - DNA, 22 bp, Homo sapiens
cagctgcaggagctgagcactt

SEQ ID NO: 9187007 - DNA, 22 bp, Homo sapiens
cagctgcaggagctgagcactt

SEQ ID NO: 9187008 - DNA, 22 bp, Homo sapiens
cagctgcaggagctgagcactt

SEQ ID NO: 9187009 - DNA, 22 bp, Homo sapiens
cagctgcagaaagcaagcaggt

SEQ ID NO: 9187010 - DNA, 22 bp, Homo sapiens
cagctgcactgaagcaggtttg

SEQ ID NO: 9187011 - DNA, 19 bp, Homo sapiens
cagctgcaccgtgaccatc

SEQ ID NO: 9187012 - DNA, 22 bp, Homo sapiens
cagctgcagaaagcaagcaggt

SEQ ID NO: 9187013 - DNA, 22 bp, Homo sapiens
cagctgatggttttgctgagac

SEQ ID NO: 9187014 - DNA, 22 bp, Homo sapiens
gtggggctggaagatgggtact

SEQ ID NO: 9187015 - DNA, 19 bp, Homo sapiens
cagctgcaccgtgaccatc

SEQ ID NO: 9187016 - DNA, 19 bp, Homo sapiens
cagctgcaccgtgaccatc

SEQ ID NO: 9187017 - DNA, 22 bp, Homo sapiens
gtggggctgagtggagccagaa

SEQ ID NO: 9187018 - DNA, 22 bp, Homo sapiens
gtggggcatgcacgctgctcct

SEQ ID NO: 9187019 - DNA, 22 bp, Homo sapiens
gtggggcatgcacgctgctcct

SEQ ID NO: 9187020 - DNA, 22 bp, Homo sapiens
gtggggcatgcacgctgctcct

SEQ ID NO: 9187021 - DNA, 22 bp, Homo sapiens
gtggggcatgcacgctgctcct

SEQ ID NO: 9187022 - DNA, 22 bp, Homo sapiens
gtggggctcccatctcctggct

SEQ ID NO: 9187023 - DNA, 22 bp, Homo sapiens
gtggggctaaaaactgtgcagt

SEQ ID NO: 9187024 - DNA, 22 bp, Homo sapiens
gtggggagtgttctgtgattgg

SEQ ID NO: 9187025 - DNA, 22 bp, Homo sapiens
gtggggagtgttctgtgattgg

SEQ ID NO: 9187026 - DNA, 22 bp, Homo sapiens
gtggggcagtggcctgggagca

SEQ ID NO: 9187027 - DNA, 22 bp, Homo sapiens
gtggggcagtggcctgggagca

SEQ ID NO: 9187028 - DNA, 22 bp, Homo sapiens
cagctgcctgtattgtcctcat

SEQ ID NO: 9187029 - DNA, 22 bp, Homo sapiens
cagctgctgttactgcttatta

SEQ ID NO: 9187030 - DNA, 22 bp, Homo sapiens
cagctgctgtaacagaatactt

SEQ ID NO: 9187031 - DNA, 22 bp, Homo sapiens
cagctgcttctcctccagagct

SEQ ID NO: 9187032 - DNA, 22 bp, Homo sapiens
cagctgcttctcctccagagct

SEQ ID NO: 9187033 - DNA, 22 bp, Homo sapiens
cagctggccaatcagggcgccc

SEQ ID NO: 9187034 - DNA, 22 bp, Homo sapiens
gtgggtggatcatgaggtcagg

SEQ ID NO: 9187035 - DNA, 22 bp, Homo sapiens
gtgtatgttctacttaatatta

SEQ ID NO: 9187036 - DNA, 22 bp, Homo sapiens
gtgtattagtgagaaggaagat

SEQ ID NO: 9187037 - DNA, 22 bp, Homo sapiens
gtgtctggaacgggtggtactc

SEQ ID NO: 9187038 - DNA, 22 bp, Homo sapiens
gtgtcttaattcttgttgttca

SEQ ID NO: 9187039 - DNA, 22 bp, Homo sapiens
gtgtgagaagggaatgtaaagc

SEQ ID NO: 9187040 - DNA, 22 bp, Homo sapiens
gtgtgagagaagctgccatgga

SEQ ID NO: 9187041 - DNA, 20 bp, Homo sapiens
gtgtgaagccctcaggagga

SEQ ID NO: 9187042 - DNA, 22 bp, Homo sapiens
gtgtgagcaggtttgacctaag

SEQ ID NO: 9187043 - DNA, 22 bp, Homo sapiens
gtgtgagcatcaaagcctgtca

SEQ ID NO: 9187044 - DNA, 22 bp, Homo sapiens
gtgtgagagactgaagaaagcc

SEQ ID NO: 9187045 - DNA, 22 bp, Homo sapiens
gtgtgagagcaaaactgcagga

SEQ ID NO: 9187046 - DNA, 17 bp, Homo sapiens
gtgtctttgctgttgtg

SEQ ID NO: 9187047 - DNA, 22 bp, Homo sapiens
gtgtcttttctgtctagcacaa

SEQ ID NO: 9187048 - DNA, 18 bp, Homo sapiens
gtgtcttattacagtggg

SEQ ID NO: 9187049 - DNA, 22 bp, Homo sapiens
gtgtctttattcctctatgttt

SEQ ID NO: 9187050 - DNA, 18 bp, Homo sapiens
gtgtcttattacagtggg

SEQ ID NO: 9187051 - DNA, 22 bp, Homo sapiens
gtgtcttagtcatttcaggctg

SEQ ID NO: 9187052 - DNA, 22 bp, Homo sapiens
gtgtgaaagtaattgcggtttt

SEQ ID NO: 9187053 - DNA, 22 bp, Homo sapiens
gtgtcttttgaggctgaccagt

SEQ ID NO: 9187054 - DNA, 22 bp, Homo sapiens
gtgtgaaaatgtgcacaatatg

SEQ ID NO: 9187055 - DNA, 22 bp, Homo sapiens
gtgtacagtgatttgagttcac

SEQ ID NO: 9187056 - DNA, 22 bp, Homo sapiens
gtgggtggatggctcacctcca

SEQ ID NO: 9187057 - DNA, 22 bp, Homo sapiens
gtgggtggggagctctctggag

SEQ ID NO: 9187058 - DNA, 22 bp, Homo sapiens
gtgggtgtcagtatctttaacg

SEQ ID NO: 9187059 - DNA, 22 bp, Homo sapiens
gtgggtgtgataagaccaaggg

SEQ ID NO: 9187060 - DNA, 22 bp, Homo sapiens
gtgtataataatgtgagctaaa

SEQ ID NO: 9187061 - DNA, 22 bp, Homo sapiens
gtgtataatgctgtttgtacat

SEQ ID NO: 9187062 - DNA, 22 bp, Homo sapiens
gtgtacatagaattgtgctttg

SEQ ID NO: 9187063 - DNA, 22 bp, Homo sapiens
gtgtataacccaaatatgctgc

SEQ ID NO: 9187064 - DNA, 22 bp, Homo sapiens
gtgtagtataaggttaaaacct

SEQ ID NO: 9187065 - DNA, 22 bp, Homo sapiens
gtgtagcagaaagaaaattaga

SEQ ID NO: 9187066 - DNA, 21 bp, Homo sapiens
gtgtggatatgtgacaggtgg

SEQ ID NO: 9187067 - DNA, 22 bp, Homo sapiens
gtgtggccctgcgtcctgagtc

SEQ ID NO: 9187068 - DNA, 23 bp, Homo sapiens
gtgtggccccagggcctcctcgc

SEQ ID NO: 9187069 - DNA, 22 bp, Homo sapiens
gtgtggccctgcgtcctgagtc

SEQ ID NO: 9187070 - DNA, 20 bp, Homo sapiens
gtgtggccaggagctgcgct

SEQ ID NO: 9187071 - DNA, 22 bp, Homo sapiens
gtgtggccaattatgggcattc

SEQ ID NO: 9187072 - DNA, 22 bp, Homo sapiens
cagctggctggtcagtgcacaa

SEQ ID NO: 9187073 - DNA, 22 bp, Homo sapiens
gtgtggccgtgtatccatggct

SEQ ID NO: 9187074 - DNA, 22 bp, Homo sapiens
gtgtggccgtgtatccatggct

SEQ ID NO: 9187075 - DNA, 22 bp, Homo sapiens
gtgtgcgctggtgcttggtcaa

SEQ ID NO: 9187076 - DNA, 22 bp, Homo sapiens
gtgtgcgccgacacagccaggt

SEQ ID NO: 9187077 - DNA, 22 bp, Homo sapiens
cagctgggcctcctgagccctg

SEQ ID NO: 9187078 - DNA, 22 bp, Homo sapiens
cagctgggctaagagtagaggc

SEQ ID NO: 9187079 - DNA, 22 bp, Homo sapiens
cagctggggcagccacgtgcgg

SEQ ID NO: 9187080 - DNA, 22 bp, Homo sapiens
cagctggggagagacatggcag

SEQ ID NO: 9187081 - DNA, 22 bp, Homo sapiens
cagctggggcagccacgtgcgg

SEQ ID NO: 9187082 - DNA, 17 bp, Homo sapiens
cagctgtgagagcctta

SEQ ID NO: 9187083 - DNA, 17 bp, Homo sapiens
cagctgtgagagcctta

SEQ ID NO: 9187084 - DNA, 17 bp, Homo sapiens
cagctgtgagagcctta

SEQ ID NO: 9187085 - DNA, 22 bp, Homo sapiens
cagctgtgagagtgcattgaag

SEQ ID NO: 9187086 - DNA, 22 bp, Homo sapiens
cagctgtgaattgtcttatcta

SEQ ID NO: 9187087 - DNA, 22 bp, Homo sapiens
cagctgtgaattgtcttatcta

SEQ ID NO: 9187088 - DNA, 17 bp, Homo sapiens
cagctgtgagagcctta

SEQ ID NO: 9187089 - DNA, 22 bp, Homo sapiens
cagctgtgacagccagttgatg

SEQ ID NO: 9187090 - DNA, 22 bp, Homo sapiens
cagctgtgacagccagttgatg

SEQ ID NO: 9187091 - DNA, 22 bp, Homo sapiens
cagctgtgacagccagttgatg

SEQ ID NO: 9187092 - DNA, 22 bp, Homo sapiens
cagctgggtgatcttgggcagg

SEQ ID NO: 9187093 - DNA, 22 bp, Homo sapiens
cagctgtctggggagtgctcgc

SEQ ID NO: 9187094 - DNA, 22 bp, Homo sapiens
cagctgtctgctgaaggaagct

SEQ ID NO: 9187095 - DNA, 22 bp, Homo sapiens
cagctctgttgccaaagtgggc

SEQ ID NO: 9187096 - DNA, 22 bp, Homo sapiens
cagctctgttgccctggaaacg

SEQ ID NO: 9187097 - DNA, 22 bp, Homo sapiens
cagctctgttcatagatggtgc

SEQ ID NO: 9187098 - DNA, 22 bp, Homo sapiens
cagctctgttcatagatggtgc

SEQ ID NO: 9187099 - DNA, 22 bp, Homo sapiens
cagctctgttcaaactatccag

SEQ ID NO: 9187100 - DNA, 22 bp, Homo sapiens
cagctctgttcaaactatccag

SEQ ID NO: 9187101 - DNA, 22 bp, Homo sapiens
cagctgaaagaaggaagtgtca

SEQ ID NO: 9187102 - DNA, 22 bp, Homo sapiens
cagctgaacatgtagagcatct

SEQ ID NO: 9187103 - DNA, 22 bp, Homo sapiens
cagctgaagaaagagtggttag

SEQ ID NO: 9187104 - DNA, 22 bp, Homo sapiens
cagctgaggtcaaagaagcagg

SEQ ID NO: 9187105 - DNA, 22 bp, Homo sapiens
cagctgaggaatactagatgta

SEQ ID NO: 9187106 - DNA, 22 bp, Homo sapiens
cagctgaggaatactagatgta

SEQ ID NO: 9187107 - DNA, 22 bp, Homo sapiens
cagctgagcatcactagtctgg

SEQ ID NO: 9187108 - DNA, 23 bp, Homo sapiens
cagctgaagcagcctgggctgga

SEQ ID NO: 9187109 - DNA, 22 bp, Homo sapiens
cagctgaagagaggtgctgagt

SEQ ID NO: 9187110 - DNA, 22 bp, Homo sapiens
cagctgagcatcactagtctgg

SEQ ID NO: 9187111 - DNA, 22 bp, Homo sapiens
cagctgagcatcactagtctgg

SEQ ID NO: 9187112 - DNA, 22 bp, Homo sapiens
cagctgagtttccaagtctgcc

SEQ ID NO: 9187113 - DNA, 22 bp, Homo sapiens
cagctgagtttccaagtctgcc

SEQ ID NO: 9187114 - DNA, 22 bp, Homo sapiens
cagctgagttactctgaggtct

SEQ ID NO: 9187115 - DNA, 22 bp, Homo sapiens
cagctgagtttccaagtctgcc

SEQ ID NO: 9187116 - DNA, 22 bp, Homo sapiens
cagctgagttactctgaggtct

SEQ ID NO: 9187117 - DNA, 22 bp, Homo sapiens
cagctgagtctgaggttctttg

SEQ ID NO: 9187118 - DNA, 22 bp, Homo sapiens
cagctgagtgttggcatgttca

SEQ ID NO: 9187119 - DNA, 22 bp, Homo sapiens
cagctgagtggaccctagaggc

SEQ ID NO: 9187120 - DNA, 22 bp, Homo sapiens
gtgggcaggccccaaagcaggg

SEQ ID NO: 9187121 - DNA, 22 bp, Homo sapiens
gtgggcaggagtgagcaacagg

SEQ ID NO: 9187122 - DNA, 22 bp, Homo sapiens
gtgggcaggccctaggcgattt

SEQ ID NO: 9187123 - DNA, 22 bp, Homo sapiens
gtgggacagcggggtgggacag

SEQ ID NO: 9187124 - DNA, 22 bp, Homo sapiens
gtgggacaggtcaaatcttaaa

SEQ ID NO: 9187125 - DNA, 22 bp, Homo sapiens
gtgggacagctttccgttgagg

SEQ ID NO: 9187126 - DNA, 22 bp, Homo sapiens
gtgggacagctggagggtccct

SEQ ID NO: 9187127 - DNA, 22 bp, Homo sapiens
gtgggacagtcagaagtgagca

SEQ ID NO: 9187128 - DNA, 22 bp, Homo sapiens
gtgggcagtgcctgacggatga

SEQ ID NO: 9187129 - DNA, 22 bp, Homo sapiens
gtgggcagtggtttgcgcggtc

SEQ ID NO: 9187130 - DNA, 22 bp, Homo sapiens
gtgggcagtggggtcttctgcc

SEQ ID NO: 9187131 - DNA, 22 bp, Homo sapiens
gtggggagggagatgctgaagt

SEQ ID NO: 9187132 - DNA, 22 bp, Homo sapiens
gtggggagggagatgctgaagt

SEQ ID NO: 9187133 - DNA, 22 bp, Homo sapiens
gtgggaagaacttcaagtggct

SEQ ID NO: 9187134 - DNA, 22 bp, Homo sapiens
gtgggaagaacttcaagtggct

SEQ ID NO: 9187135 - DNA, 22 bp, Homo sapiens
gtgggaagagccaattggggta

SEQ ID NO: 9187136 - DNA, 22 bp, Homo sapiens
gtgggaagtctctcggaggaag

SEQ ID NO: 9187137 - DNA, 22 bp, Homo sapiens
gtgggaagtctctcggaggaag

SEQ ID NO: 9187138 - DNA, 22 bp, Homo sapiens
gtgggacacatagaaaaataag

SEQ ID NO: 9187139 - DNA, 22 bp, Homo sapiens
gtgggacaaggatgaagatatt

SEQ ID NO: 9187140 - DNA, 19 bp, Homo sapiens
gtgggacagacattacata

SEQ ID NO: 9187141 - DNA, 19 bp, Homo sapiens
gtgggacagacattacata

SEQ ID NO: 9187142 - DNA, 22 bp, Homo sapiens
gtggcttgaccatccctgctac

SEQ ID NO: 9187143 - DNA, 22 bp, Homo sapiens
gtggcttcttcttgggagctgc

SEQ ID NO: 9187144 - DNA, 22 bp, Homo sapiens
gtggcttcttctgccagaagga

SEQ ID NO: 9187145 - DNA, 22 bp, Homo sapiens
gtggcttcttcttgggagctgc

SEQ ID NO: 9187146 - DNA, 22 bp, Homo sapiens
gtggcttctggctgggcctcag

SEQ ID NO: 9187147 - DNA, 22 bp, Homo sapiens
gtggcttctggctgggcctcag

SEQ ID NO: 9187148 - DNA, 22 bp, Homo sapiens
gtggcttggaccagtcacagtg

SEQ ID NO: 9187149 - DNA, 22 bp, Homo sapiens
gtggcgcagagggtggcagaga

SEQ ID NO: 9187150 - DNA, 22 bp, Homo sapiens
gtggcggactcgacctggcctg

SEQ ID NO: 9187151 - DNA, 22 bp, Homo sapiens
gtggcttctgcggtgtgcgcag

SEQ ID NO: 9187152 - DNA, 22 bp, Homo sapiens
gtggcttctgcggtgtgcgcag

SEQ ID NO: 9187153 - DNA, 22 bp, Homo sapiens
gtggcttctgcggtgtgcgcag

SEQ ID NO: 9187154 - DNA, 22 bp, Homo sapiens
gtggcttctgcggtgtgcgcag

SEQ ID NO: 9187155 - DNA, 22 bp, Homo sapiens
cagctctgctgggaggatgcag

SEQ ID NO: 9187156 - DNA, 22 bp, Homo sapiens
cagctctgctggtggtgccagg

SEQ ID NO: 9187157 - DNA, 22 bp, Homo sapiens
cagctctgctggtggtgccagg

SEQ ID NO: 9187158 - DNA, 22 bp, Homo sapiens
cagctctgcttccttgtacagg

SEQ ID NO: 9187159 - DNA, 22 bp, Homo sapiens
cagctctggcagagcccaaccc

SEQ ID NO: 9187160 - DNA, 22 bp, Homo sapiens
cagctctggcgtcagggagcga

SEQ ID NO: 9187161 - DNA, 22 bp, Homo sapiens
cagctctggccagatctatcct

SEQ ID NO: 9187162 - DNA, 22 bp, Homo sapiens
cagctctgtgggagcgtatgtg

SEQ ID NO: 9187163 - DNA, 22 bp, Homo sapiens
cagctctgtgtattttccccac

SEQ ID NO: 9187164 - DNA, 22 bp, Homo sapiens
cagctctgtgcaggcctgggga

SEQ ID NO: 9187165 - DNA, 22 bp, Homo sapiens
cagctctgtctgtagaaacttc

SEQ ID NO: 9187166 - DNA, 22 bp, Homo sapiens
cagctctgggagtcccacccct

SEQ ID NO: 9187167 - DNA, 22 bp, Homo sapiens
cagctctggctattgaggacca

SEQ ID NO: 9187168 - DNA, 22 bp, Homo sapiens
gtggccaggccgactgccaggc

SEQ ID NO: 9187169 - DNA, 22 bp, Homo sapiens
gtggcaggttccgtagacagca

SEQ ID NO: 9187170 - DNA, 22 bp, Homo sapiens
gtggccatctttggccctgact

SEQ ID NO: 9187171 - DNA, 22 bp, Homo sapiens
gtggccatgttgctttcctttg

SEQ ID NO: 9187172 - DNA, 22 bp, Homo sapiens
gtggccatgtgcttgcagggta

SEQ ID NO: 9187173 - DNA, 22 bp, Homo sapiens
gtggccatataattttcttgaa

SEQ ID NO: 9187174 - DNA, 22 bp, Homo sapiens
gtggccatacatgtccatatta

SEQ ID NO: 9187175 - DNA, 22 bp, Homo sapiens
gtggccagtggtgggcgccctg

SEQ ID NO: 9187176 - DNA, 22 bp, Homo sapiens
gtggccagtgggaatgggctca

SEQ ID NO: 9187177 - DNA, 22 bp, Homo sapiens
gtggccagtcccgatgcttgtt

SEQ ID NO: 9187178 - DNA, 22 bp, Homo sapiens
gtggagccaggggctgtaggta

SEQ ID NO: 9187179 - DNA, 22 bp, Homo sapiens
cagcccaggactgcaggtgttt

SEQ ID NO: 9187180 - DNA, 22 bp, Homo sapiens
cagcccaggactgcaggtgttt

SEQ ID NO: 9187181 - DNA, 22 bp, Homo sapiens
cagcccaggccgacagttcctc

SEQ ID NO: 9187182 - DNA, 22 bp, Homo sapiens
cagcccagccttgtctctttat

SEQ ID NO: 9187183 - DNA, 22 bp, Homo sapiens
cagcccagccgagggcctggct

SEQ ID NO: 9187184 - DNA, 21 bp, Homo sapiens
cagcccagcccattgacagtg

SEQ ID NO: 9187185 - DNA, 22 bp, Homo sapiens
cagcccagcgcaaacaactggc

SEQ ID NO: 9187186 - DNA, 22 bp, Homo sapiens
cagcccagctctgactaaccct

SEQ ID NO: 9187187 - DNA, 22 bp, Homo sapiens
cagcccagctctgactaaccct

SEQ ID NO: 9187188 - DNA, 22 bp, Homo sapiens
cagcccagctgggatcacactc

SEQ ID NO: 9187189 - DNA, 21 bp, Homo sapiens
cagcccagcttcttccccagt

SEQ ID NO: 9187190 - DNA, 22 bp, Homo sapiens
gtggcaggtcccattggagcag

SEQ ID NO: 9187191 - DNA, 22 bp, Homo sapiens
gtggcagggtgctcatcatgca

SEQ ID NO: 9187192 - DNA, 22 bp, Homo sapiens
gtggcagggtgctcatcatgca

SEQ ID NO: 9187193 - DNA, 22 bp, Homo sapiens
gtggcaggttataagcatctca

SEQ ID NO: 9187194 - DNA, 22 bp, Homo sapiens
gtggcaggtggagcctcctgca

SEQ ID NO: 9187195 - DNA, 22 bp, Homo sapiens
gtggcaggtggagcctcctgca

SEQ ID NO: 9187196 - DNA, 22 bp, Homo sapiens
catttagagaagattacaagga

SEQ ID NO: 9187197 - DNA, 22 bp, Homo sapiens
catttagaaactgtttttaaca

SEQ ID NO: 9187198 - DNA, 19 bp, Homo sapiens
catttagaagtacatatta

SEQ ID NO: 9187199 - DNA, 19 bp, Homo sapiens
catttagaagtacatatta

SEQ ID NO: 9187200 - DNA, 22 bp, Homo sapiens
catttagaagtcttagaactat

SEQ ID NO: 9187201 - DNA, 22 bp, Homo sapiens
catttagagagtaaaaattagc

SEQ ID NO: 9187202 - DNA, 22 bp, Homo sapiens
catttatataaaatgtccagaa

SEQ ID NO: 9187203 - DNA, 22 bp, Homo sapiens
catttagttttgcagtagcagg

SEQ ID NO: 9187204 - DNA, 22 bp, Homo sapiens
catttagttttgcagtagcagg

SEQ ID NO: 9187205 - DNA, 22 bp, Homo sapiens
catttacacttctaaccacaag

SEQ ID NO: 9187206 - DNA, 17 bp, Homo sapiens
tccaggcagcaactgag

SEQ ID NO: 9187207 - DNA, 17 bp, Homo sapiens
tccaggcagcaactgag

SEQ ID NO: 9187208 - DNA, 22 bp, Homo sapiens
catttacttaaatctttacaag

SEQ ID NO: 9187209 - DNA, 22 bp, Homo sapiens
catttagaaaatgataaccctt

SEQ ID NO: 9187210 - DNA, 22 bp, Homo sapiens
tccaggcactatatatactttt

SEQ ID NO: 9187211 - DNA, 20 bp, Homo sapiens
tccaggcagacagctatggg

SEQ ID NO: 9187212 - DNA, 22 bp, Homo sapiens
catttctcactccagcaacttt

SEQ ID NO: 9187213 - DNA, 22 bp, Homo sapiens
tcccagggtcagtggtgaggcc

SEQ ID NO: 9187214 - DNA, 21 bp, Homo sapiens
catttctattgatgagaaaag

SEQ ID NO: 9187215 - DNA, 22 bp, Homo sapiens
tcccagggggatgaacactgcc

SEQ ID NO: 9187216 - DNA, 22 bp, Homo sapiens
tcccagggtatcctgtagtaaa

SEQ ID NO: 9187217 - DNA, 22 bp, Homo sapiens
tcccagggtcagtggtgaggcc

SEQ ID NO: 9187218 - DNA, 22 bp, Homo sapiens
tcccagggctctagagtgctgg

SEQ ID NO: 9187219 - DNA, 22 bp, Homo sapiens
tcccagggcttttctcatgctt

SEQ ID NO: 9187220 - DNA, 22 bp, Homo sapiens
tcccagggggatgaacactgcc

SEQ ID NO: 9187221 - DNA, 22 bp, Homo sapiens
tcccagggcttttctcatgctt

SEQ ID NO: 9187222 - DNA, 22 bp, Homo sapiens
tcccagggcttttctcatgctt

SEQ ID NO: 9187223 - DNA, 21 bp, Homo sapiens
tcccagggccaggtgccatca

SEQ ID NO: 9187224 - DNA, 21 bp, Homo sapiens
tcccagggccaggtgccatca

SEQ ID NO: 9187225 - DNA, 22 bp, Homo sapiens
tcccagggccgcaaacgagttt

SEQ ID NO: 9187226 - DNA, 22 bp, Homo sapiens
tcccagggcactcaccctccct

SEQ ID NO: 9187227 - DNA, 22 bp, Homo sapiens
tcccagggcactcaccctccct

SEQ ID NO: 9187228 - DNA, 22 bp, Homo sapiens
tcccagggcagctgtccagaag

SEQ ID NO: 9187229 - DNA, 22 bp, Homo sapiens
tcccagggcagctgtccagaag

SEQ ID NO: 9187230 - DNA, 22 bp, Homo sapiens
catttatataaaatgtccagaa

SEQ ID NO: 9187231 - DNA, 22 bp, Homo sapiens
catttatataaaatgtccagaa

SEQ ID NO: 9187232 - DNA, 22 bp, Homo sapiens
catttatataaaatgtccagaa

SEQ ID NO: 9187233 - DNA, 22 bp, Homo sapiens
catttattagttagttcgatgt

SEQ ID NO: 9187234 - DNA, 22 bp, Homo sapiens
ccaaaagcagctgtctgtgaat

SEQ ID NO: 9187235 - DNA, 22 bp, Homo sapiens
ccaaagtaaggcaattcctaaa

SEQ ID NO: 9187236 - DNA, 22 bp, Homo sapiens
ccaaagtattaaatcttagcaa

SEQ ID NO: 9187237 - DNA, 22 bp, Homo sapiens
tccctgctcagctcacctggca

SEQ ID NO: 9187238 - DNA, 22 bp, Homo sapiens
tccctgctgagagtgctctccc

SEQ ID NO: 9187239 - DNA, 22 bp, Homo sapiens
tccctgctgagagtgctctccc

SEQ ID NO: 9187240 - DNA, 22 bp, Homo sapiens
tccctgctcagctcacctggca

SEQ ID NO: 9187241 - DNA, 22 bp, Homo sapiens
tccctgcttggaatgaccctta

SEQ ID NO: 9187242 - DNA, 21 bp, Homo sapiens
tccctgctttctggcccagtc

SEQ ID NO: 9187243 - DNA, 21 bp, Homo sapiens
tccctgctttctggcccagtc

SEQ ID NO: 9187244 - DNA, 22 bp, Homo sapiens
tccctgcttgctctcagccctt

SEQ ID NO: 9187245 - DNA, 22 bp, Homo sapiens
tccctgctgcactcacacctac

SEQ ID NO: 9187246 - DNA, 22 bp, Homo sapiens
catttctcactccagcaacttt

SEQ ID NO: 9187247 - DNA, 22 bp, Homo sapiens
catttgaagacttagaagagga

SEQ ID NO: 9187248 - DNA, 22 bp, Homo sapiens
catttgacttgctttcccagct

SEQ ID NO: 9187249 - DNA, 22 bp, Homo sapiens
catttgacagtgagtcacagca

SEQ ID NO: 9187250 - DNA, 22 bp, Homo sapiens
catttgcaaaccaacaagatga

SEQ ID NO: 9187251 - DNA, 22 bp, Homo sapiens
catttgctagcaggccttttat

SEQ ID NO: 9187252 - DNA, 22 bp, Homo sapiens
catttgctctggttccttctgg

SEQ ID NO: 9187253 - DNA, 22 bp, Homo sapiens
catttgctctgtgtcagtggca

SEQ ID NO: 9187254 - DNA, 22 bp, Homo sapiens
catttgctggagatggaccaca

SEQ ID NO: 9187255 - DNA, 22 bp, Homo sapiens
catttgctggggtcttgggagt

SEQ ID NO: 9187256 - DNA, 22 bp, Homo sapiens
catttgctgaggccttcagagg

SEQ ID NO: 9187257 - DNA, 22 bp, Homo sapiens
catttgctgaggccttcagagg

SEQ ID NO: 9187258 - DNA, 22 bp, Homo sapiens
catttgctcttcatccccaact

SEQ ID NO: 9187259 - DNA, 22 bp, Homo sapiens
catttgcttcctgggtcttgaa

SEQ ID NO: 9187260 - DNA, 22 bp, Homo sapiens
catttgctgtattttcagattc

SEQ ID NO: 9187261 - DNA, 22 bp, Homo sapiens
catttgcttgcctcccccaggt

SEQ ID NO: 9187262 - DNA, 22 bp, Homo sapiens
catttgctgtaatgacaataag

SEQ ID NO: 9187263 - DNA, 22 bp, Homo sapiens
catttgctgtaatgacaataag

SEQ ID NO: 9187264 - DNA, 22 bp, Homo sapiens
catttgctgtattttcagattc

SEQ ID NO: 9187265 - DNA, 17 bp, Homo sapiens
catttgctggttggctc

SEQ ID NO: 9187266 - DNA, 20 bp, Homo sapiens
tccctgccttttactgctgg

SEQ ID NO: 9187267 - DNA, 22 bp, Homo sapiens
tcctgccagcccacagactcat

SEQ ID NO: 9187268 - DNA, 22 bp, Homo sapiens
tcctgccagcccacagactcat

SEQ ID NO: 9187269 - DNA, 22 bp, Homo sapiens
tcctgcccacagctgctggaca

SEQ ID NO: 9187270 - DNA, 22 bp, Homo sapiens
tcctgcccacagctgctggaca

SEQ ID NO: 9187271 - DNA, 22 bp, Homo sapiens
tcctgcccacagctgctggaca

SEQ ID NO: 9187272 - DNA, 22 bp, Homo sapiens
tcctgccatcccacccggctca

SEQ ID NO: 9187273 - DNA, 22 bp, Homo sapiens
tcctgccaggagtgctggccct

SEQ ID NO: 9187274 - DNA, 20 bp, Homo sapiens
tcctgcagttcctaggaggg

SEQ ID NO: 9187275 - DNA, 17 bp, Homo sapiens
tcctgccacctgtcagg

SEQ ID NO: 9187276 - DNA, 17 bp, Homo sapiens
tcctgccacctgtcagg

SEQ ID NO: 9187277 - DNA, 22 bp, Homo sapiens
tcctgccacctgcacagctccc

SEQ ID NO: 9187278 - DNA, 22 bp, Homo sapiens
tcctgccacctgcacagctccc

SEQ ID NO: 9187279 - DNA, 22 bp, Homo sapiens
tcctgccaaagcatgtactggg

SEQ ID NO: 9187280 - DNA, 22 bp, Homo sapiens
tcctgccacctgcacagctccc

SEQ ID NO: 9187281 - DNA, 20 bp, Homo sapiens
ccacagaggacagggctgtg

SEQ ID NO: 9187282 - DNA, 20 bp, Homo sapiens
ccacagaggacagggctgtg

SEQ ID NO: 9187283 - DNA, 22 bp, Homo sapiens
ccacagaggacaactgcctggc

SEQ ID NO: 9187284 - DNA, 22 bp, Homo sapiens
ccacagagtccgcatttgaggc

SEQ ID NO: 9187285 - DNA, 20 bp, Homo sapiens
ccacagaggacagggctgtg

SEQ ID NO: 9187286 - DNA, 23 bp, Homo sapiens
ccacagagctgccaattcctgtg

SEQ ID NO: 9187287 - DNA, 22 bp, Homo sapiens
ccacagcatgcaggcctgacac

SEQ ID NO: 9187288 - DNA, 17 bp, Homo sapiens
ccacagcctggcacttg

SEQ ID NO: 9187289 - DNA, 22 bp, Homo sapiens
ccacagctagggcaatctgatt

SEQ ID NO: 9187290 - DNA, 22 bp, Homo sapiens
ccacagctcctcagcctctttc

SEQ ID NO: 9187291 - DNA, 23 bp, Homo sapiens
ccacagctatagggtagtgcagt

SEQ ID NO: 9187292 - DNA, 22 bp, Homo sapiens
ccacagctgaaagcagaggctc

SEQ ID NO: 9187293 - DNA, 22 bp, Homo sapiens
ccacagctctagctccctccca

SEQ ID NO: 9187294 - DNA, 22 bp, Homo sapiens
ccacagagtcttccttctcttc

SEQ ID NO: 9187295 - DNA, 22 bp, Homo sapiens
ccacagcaggactggagccgcc

SEQ ID NO: 9187296 - DNA, 18 bp, Homo sapiens
ccacagcagagttcttac

SEQ ID NO: 9187297 - DNA, 18 bp, Homo sapiens
ccacagcagagttcttac

SEQ ID NO: 9187298 - DNA, 22 bp, Homo sapiens
ccacagcacctgcagccagttg

SEQ ID NO: 9187299 - DNA, 22 bp, Homo sapiens
ccacagcacctgcagccagttg

SEQ ID NO: 9187300 - DNA, 22 bp, Homo sapiens
tcctccccaaagcccagcctgg

SEQ ID NO: 9187301 - DNA, 22 bp, Homo sapiens
tcctccccaaagcccagcctgg

SEQ ID NO: 9187302 - DNA, 22 bp, Homo sapiens
tcctcccacataggacaatggg

SEQ ID NO: 9187303 - DNA, 22 bp, Homo sapiens
tcctcccacataggacaatggg

SEQ ID NO: 9187304 - DNA, 22 bp, Homo sapiens
tcctccccaaagcccagcctgg

SEQ ID NO: 9187305 - DNA, 22 bp, Homo sapiens
ccaaagtgtgggagaagaggta

SEQ ID NO: 9187306 - DNA, 22 bp, Homo sapiens
ccacaaggcctgtggggctgct

SEQ ID NO: 9187307 - DNA, 22 bp, Homo sapiens
ccacacagataagtgttttcta

SEQ ID NO: 9187308 - DNA, 22 bp, Homo sapiens
tcctgcagtgtgtctcctgcac

SEQ ID NO: 9187309 - DNA, 22 bp, Homo sapiens
tcctgcagtgtgtctcctgcac

SEQ ID NO: 9187310 - DNA, 22 bp, Homo sapiens
tcctgcagtgtgtctcctgcac

SEQ ID NO: 9187311 - DNA, 22 bp, Homo sapiens
tcctgcagttacatcccagcca

SEQ ID NO: 9187312 - DNA, 22 bp, Homo sapiens
tcctgcagttacatcccagcca

SEQ ID NO: 9187313 - DNA, 22 bp, Homo sapiens
tcctgcagttacatcccagcca

SEQ ID NO: 9187314 - DNA, 22 bp, Homo sapiens
ccacacagggggatgagttatt

SEQ ID NO: 9187315 - DNA, 22 bp, Homo sapiens
tcctgcagtgtgtctcctgcac

SEQ ID NO: 9187316 - DNA, 22 bp, Homo sapiens
ccaattcacttccaaccccttc

SEQ ID NO: 9187317 - DNA, 22 bp, Homo sapiens
ccaagggcatcttgcatgctgg

SEQ ID NO: 9187318 - DNA, 22 bp, Homo sapiens
ccacaagatgcaaactctaaca

SEQ ID NO: 9187319 - DNA, 21 bp, Homo sapiens
ccagaagctgcttgcaggcta

SEQ ID NO: 9187320 - DNA, 22 bp, Homo sapiens
ccagaagcagagcctgaggcag

SEQ ID NO: 9187321 - DNA, 23 bp, Homo sapiens
ccagaaggagccacactccttgc

SEQ ID NO: 9187322 - DNA, 22 bp, Homo sapiens
ccagaagcttctacacaggaga

SEQ ID NO: 9187323 - DNA, 22 bp, Homo sapiens
ccagaagcaaaacagacagttt

SEQ ID NO: 9187324 - DNA, 22 bp, Homo sapiens
ccagaagcaaaacagacagttt

SEQ ID NO: 9187325 - DNA, 22 bp, Homo sapiens
ccagaagaggacacagtgtgga

SEQ ID NO: 9187326 - DNA, 22 bp, Homo sapiens
ccagaagagatcacagttcttg

SEQ ID NO: 9187327 - DNA, 22 bp, Homo sapiens
ccagaatctcaatacctttcaa

SEQ ID NO: 9187328 - DNA, 19 bp, Homo sapiens
ccagaagggcagctatgga

SEQ ID NO: 9187329 - DNA, 20 bp, Homo sapiens
ccagaaggtttgccactttc

SEQ ID NO: 9187330 - DNA, 20 bp, Homo sapiens
ccagaaggtttgccactttc

SEQ ID NO: 9187331 - DNA, 22 bp, Homo sapiens
ccagaaaaggagctgcaggatg

SEQ ID NO: 9187332 - DNA, 22 bp, Homo sapiens
ccactgccgtgggccttgggga

SEQ ID NO: 9187333 - DNA, 22 bp, Homo sapiens
ccactgcctctccagggccatc

SEQ ID NO: 9187334 - DNA, 22 bp, Homo sapiens
ccactgccctgcaaaagctgga

SEQ ID NO: 9187335 - DNA, 22 bp, Homo sapiens
ccactgcctctccagggccatc

SEQ ID NO: 9187336 - DNA, 22 bp, Homo sapiens
ccactgcctatttgcagggccc

SEQ ID NO: 9187337 - DNA, 22 bp, Homo sapiens
ccactgcctatttgcagggccc

SEQ ID NO: 9187338 - DNA, 22 bp, Homo sapiens
ccactgccgtgggccttgggga

SEQ ID NO: 9187339 - DNA, 22 bp, Homo sapiens
ccactgccgatgttccatcttg

SEQ ID NO: 9187340 - DNA, 22 bp, Homo sapiens
ccactgccctgcaaaagctgga

SEQ ID NO: 9187341 - DNA, 22 bp, Homo sapiens
ccactgccccctgaagaccagg

SEQ ID NO: 9187342 - DNA, 22 bp, Homo sapiens
ccactgcccaccccgacgtcta

SEQ ID NO: 9187343 - DNA, 22 bp, Homo sapiens
ccactgccccctgaagaccagg

SEQ ID NO: 9187344 - DNA, 22 bp, Homo sapiens
ccactgccatgggctaggcatg

SEQ ID NO: 9187345 - DNA, 22 bp, Homo sapiens
ccactgcccaccccgacgtcta

SEQ ID NO: 9187346 - DNA, 22 bp, Homo sapiens
ccactgccagctttgtcctccc

SEQ ID NO: 9187347 - DNA, 22 bp, Homo sapiens
ccactgccagctttgtcctccc

SEQ ID NO: 9187348 - DNA, 22 bp, Homo sapiens
ccactgccagccgcccggaggc

SEQ ID NO: 9187349 - DNA, 22 bp, Homo sapiens
ccactgccagccgcccggaggc

SEQ ID NO: 9187350 - DNA, 22 bp, Homo sapiens
ccactgagtgagcagagcaggg

SEQ ID NO: 9187351 - DNA, 22 bp, Homo sapiens
ccactgagtacccgatggctgc

SEQ ID NO: 9187352 - DNA, 22 bp, Homo sapiens
ccactgagtgagcagagcaggg

SEQ ID NO: 9187353 - DNA, 22 bp, Homo sapiens
ccactgaggcctgggcccaggg

SEQ ID NO: 9187354 - DNA, 22 bp, Homo sapiens
ccactgaggcctgggcccaggg

SEQ ID NO: 9187355 - DNA, 22 bp, Homo sapiens
ccactgaggaacatgggctcca

SEQ ID NO: 9187356 - DNA, 21 bp, Homo sapiens
ccactgagcattgttatgaag

SEQ ID NO: 9187357 - DNA, 22 bp, Homo sapiens
ccactgaggaacatgggctcca

SEQ ID NO: 9187358 - DNA, 22 bp, Homo sapiens
ccactgaggaggtgaggacaga

SEQ ID NO: 9187359 - DNA, 22 bp, Homo sapiens
ccacaggtacggattgaggacc

SEQ ID NO: 9187360 - DNA, 16 bp, Homo sapiens
ccacaggtgtcctgca

SEQ ID NO: 9187361 - DNA, 22 bp, Homo sapiens
ccacagtacaggaaatcttgtt

SEQ ID NO: 9187362 - DNA, 22 bp, Homo sapiens
ccacagggtgtcatcagcttga

SEQ ID NO: 9187363 - DNA, 22 bp, Homo sapiens
ccacagggtcagccactctgca

SEQ ID NO: 9187364 - DNA, 19 bp, Homo sapiens
tcctggtgaccctgaaatt

SEQ ID NO: 9187365 - DNA, 22 bp, Homo sapiens
ccacagctagggcaatctgatt

SEQ ID NO: 9187366 - DNA, 22 bp, Homo sapiens
tcctggggagggttctggctcc

SEQ ID NO: 9187367 - DNA, 22 bp, Homo sapiens
tcctggggagggttctggctcc

SEQ ID NO: 9187368 - DNA, 22 bp, Homo sapiens
tcctggggagggttctggctcc

SEQ ID NO: 9187369 - DNA, 22 bp, Homo sapiens
tcctggtcagtgccaaactggt

SEQ ID NO: 9187370 - DNA, 23 bp, Homo sapiens
tcctggtgacatgcctgagcatc

SEQ ID NO: 9187371 - DNA, 20 bp, Homo sapiens
ccactccgcccccagagggc

SEQ ID NO: 9187372 - DNA, 22 bp, Homo sapiens
ccactctgctgtgctccatgat

SEQ ID NO: 9187373 - DNA, 22 bp, Homo sapiens
ccactctgattttggctccact

SEQ ID NO: 9187374 - DNA, 22 bp, Homo sapiens
ccactctgattttggctccact

SEQ ID NO: 9187375 - DNA, 22 bp, Homo sapiens
ccactctgattttggctccact

SEQ ID NO: 9187376 - DNA, 17 bp, Homo sapiens
ccactgactctgacttc

SEQ ID NO: 9187377 - DNA, 22 bp, Homo sapiens
ccactgactccaggagctgagg

SEQ ID NO: 9187378 - DNA, 22 bp, Homo sapiens
ccactgaaggtcaacatagagc

SEQ ID NO: 9187379 - DNA, 22 bp, Homo sapiens
ccactgacacagacaaggcctg

SEQ ID NO: 9187380 - DNA, 22 bp, Homo sapiens
ccactcttgaatcaagagctca

SEQ ID NO: 9187381 - DNA, 22 bp, Homo sapiens
ccactgaaaaatttgagatgga

SEQ ID NO: 9187382 - DNA, 22 bp, Homo sapiens
ccactgaaggtcaacatagagc

SEQ ID NO: 9187383 - DNA, 23 bp, Homo sapiens
ccactgaagaatccagggagttt

SEQ ID NO: 9187384 - DNA, 23 bp, Homo sapiens
ccactgaagaatccagggagttt

SEQ ID NO: 9187385 - DNA, 22 bp, Homo sapiens
ccacagtgacacgggctggccc

SEQ ID NO: 9187386 - DNA, 22 bp, Homo sapiens
ccacagtgacacgggctggccc

SEQ ID NO: 9187387 - DNA, 22 bp, Homo sapiens
ccacagtgacacgggctggccc

SEQ ID NO: 9187388 - DNA, 22 bp, Homo sapiens
ccacagtagaattcatctccct

SEQ ID NO: 9187389 - DNA, 22 bp, Homo sapiens
ccacagtagaattcatctccct

SEQ ID NO: 9187390 - DNA, 22 bp, Homo sapiens
ccacagtagcatccaaacagta

SEQ ID NO: 9187391 - DNA, 22 bp, Homo sapiens
ccacagtaggaacaagttgtcg

SEQ ID NO: 9187392 - DNA, 20 bp, Homo sapiens
ccagagctgatggctgcccg

SEQ ID NO: 9187393 - DNA, 22 bp, Homo sapiens
ccagagctgatgggcccagggt

SEQ ID NO: 9187394 - DNA, 22 bp, Homo sapiens
ccagagcctgctgagccccatt

SEQ ID NO: 9187395 - DNA, 22 bp, Homo sapiens
ccagagcctgctgagccccatt

SEQ ID NO: 9187396 - DNA, 22 bp, Homo sapiens
ccagacaggaacacacatctcc

SEQ ID NO: 9187397 - DNA, 20 bp, Homo sapiens
ccagacagcacctgcctggt

SEQ ID NO: 9187398 - DNA, 22 bp, Homo sapiens
ccagacagcagttaaaggacat

SEQ ID NO: 9187399 - DNA, 22 bp, Homo sapiens
ccagaatgttctagagccaccc

SEQ ID NO: 9187400 - DNA, 22 bp, Homo sapiens
ccagaatgttctagagccaccc

SEQ ID NO: 9187401 - DNA, 20 bp, Homo sapiens
ccagacagcacctgcctggt

SEQ ID NO: 9187402 - DNA, 18 bp, Homo sapiens
ccagagctggctcctcgc

SEQ ID NO: 9187403 - DNA, 22 bp, Homo sapiens
ccagagctgcatccagcaggtt

SEQ ID NO: 9187404 - DNA, 22 bp, Homo sapiens
ccagagctgcatccagcaggtt

SEQ ID NO: 9187405 - DNA, 22 bp, Homo sapiens
ccagagctgcatccagcaggtt

SEQ ID NO: 9187406 - DNA, 22 bp, Homo sapiens
ccagagctgattcctgggactt

SEQ ID NO: 9187407 - DNA, 22 bp, Homo sapiens
ccagagctgattcctgggactt

SEQ ID NO: 9187408 - DNA, 22 bp, Homo sapiens
ccagagcttcggggcggctgta

SEQ ID NO: 9187409 - DNA, 22 bp, Homo sapiens
ccagagcttcggggcggctgta

SEQ ID NO: 9187410 - DNA, 22 bp, Homo sapiens
ccagagcttgacgtgcaacgga

SEQ ID NO: 9187411 - DNA, 18 bp, Homo sapiens
ccagagctggctcctcgc

SEQ ID NO: 9187412 - DNA, 18 bp, Homo sapiens
ccagagctggctcctcgc

SEQ ID NO: 9187413 - DNA, 22 bp, Homo sapiens
ccagagcttcggggcggctgta

SEQ ID NO: 9187414 - DNA, 21 bp, Homo sapiens
tctccagtatccttctctgag

SEQ ID NO: 9187415 - DNA, 22 bp, Homo sapiens
ccagaggaaaaatatctcccta

SEQ ID NO: 9187416 - DNA, 22 bp, Homo sapiens
tctccagtatctttccaatgaa

SEQ ID NO: 9187417 - DNA, 22 bp, Homo sapiens
tctccagtcccttctctgttag

SEQ ID NO: 9187418 - DNA, 22 bp, Homo sapiens
tctctaaatgattgtgtactcc

SEQ ID NO: 9187419 - DNA, 22 bp, Homo sapiens
tctctaaatctggttcacttgc

SEQ ID NO: 9187420 - DNA, 22 bp, Homo sapiens
tctctaaatacagatgtcatgg

SEQ ID NO: 9187421 - DNA, 22 bp, Homo sapiens
tctcctgggaggacaaggaagg

SEQ ID NO: 9187422 - DNA, 22 bp, Homo sapiens
tctcccacagccgtgcttcaag

SEQ ID NO: 9187423 - DNA, 22 bp, Homo sapiens
tctctaggcagtgtcagaatca

SEQ ID NO: 9187424 - DNA, 22 bp, Homo sapiens
tctctagggcgggttgaaatga

SEQ ID NO: 9187425 - DNA, 22 bp, Homo sapiens
tctctagggtttagcacagata

SEQ ID NO: 9187426 - DNA, 19 bp, Homo sapiens
ccagaggactgttaatgaa

SEQ ID NO: 9187427 - DNA, 22 bp, Homo sapiens
tctctaggtgcagtcactgctc

SEQ ID NO: 9187428 - DNA, 22 bp, Homo sapiens
tctctaggtgcagtcactgctc

SEQ ID NO: 9187429 - DNA, 22 bp, Homo sapiens
tctctacacaggattcacatga

SEQ ID NO: 9187430 - DNA, 22 bp, Homo sapiens
ccagaggacttgggggctgaat

SEQ ID NO: 9187431 - DNA, 22 bp, Homo sapiens
ccagaggacttgggggctgaat

SEQ ID NO: 9187432 - DNA, 22 bp, Homo sapiens
ccagaggacttgggggctgaat

SEQ ID NO: 9187433 - DNA, 22 bp, Homo sapiens
ccagaggagcaggctggctcca

SEQ ID NO: 9187434 - DNA, 22 bp, Homo sapiens
ccagaggagatgcctcctctgt

SEQ ID NO: 9187435 - DNA, 22 bp, Homo sapiens
ccagaggagatgcctcctctgt

SEQ ID NO: 9187436 - DNA, 22 bp, Homo sapiens
ccagaggagggctctgatgagg

SEQ ID NO: 9187437 - DNA, 22 bp, Homo sapiens
ccagaggagggctctgatgagg

SEQ ID NO: 9187438 - DNA, 22 bp, Homo sapiens
ccagaggagttgaggctttggg

SEQ ID NO: 9187439 - DNA, 22 bp, Homo sapiens
ccagatggaaatgatgttctca

SEQ ID NO: 9187440 - DNA, 22 bp, Homo sapiens
ccagatggaaatgatgttctca

SEQ ID NO: 9187441 - DNA, 18 bp, Homo sapiens
ccagatggccagtctgct

SEQ ID NO: 9187442 - DNA, 22 bp, Homo sapiens
ccagatgggccaggggtttgtt

SEQ ID NO: 9187443 - DNA, 22 bp, Homo sapiens
ccagatgggctttagcaaatga

SEQ ID NO: 9187444 - DNA, 22 bp, Homo sapiens
ccagatgggctttagcaaatga

SEQ ID NO: 9187445 - DNA, 18 bp, Homo sapiens
ccagatggccagtctgct

SEQ ID NO: 9187446 - DNA, 18 bp, Homo sapiens
ccagatggccagtctgct

SEQ ID NO: 9187447 - DNA, 22 bp, Homo sapiens
ccagatgggaagaagcatgact

SEQ ID NO: 9187448 - DNA, 22 bp, Homo sapiens
ccagatggtatagtagggagag

SEQ ID NO: 9187449 - DNA, 22 bp, Homo sapiens
ccagatgggttacttcaagcaa

SEQ ID NO: 9187450 - DNA, 20 bp, Homo sapiens
ccagatggtccctgtgaaaa

SEQ ID NO: 9187451 - DNA, 22 bp, Homo sapiens
ccagatggtccagagtctagcc

SEQ ID NO: 9187452 - DNA, 20 bp, Homo sapiens
ccagatggtccctgtgaaaa

SEQ ID NO: 9187453 - DNA, 19 bp, Homo sapiens
tctctctgtacattagata

SEQ ID NO: 9187454 - DNA, 19 bp, Homo sapiens
tctctctgtacattagata

SEQ ID NO: 9187455 - DNA, 20 bp, Homo sapiens
tctctctggttggaggagct

SEQ ID NO: 9187456 - DNA, 22 bp, Homo sapiens
ccagatggtgcctgtcagaagg

SEQ ID NO: 9187457 - DNA, 22 bp, Homo sapiens
ccagatggtttgcatgggaggg

SEQ ID NO: 9187458 - DNA, 22 bp, Homo sapiens
ccagatctaagtccaaagtact

SEQ ID NO: 9187459 - DNA, 22 bp, Homo sapiens
ccagatcactcaaccagagctc

SEQ ID NO: 9187460 - DNA, 19 bp, Homo sapiens
ccagagttggcagagcagg

SEQ ID NO: 9187461 - DNA, 22 bp, Homo sapiens
ccagataaggctttttaaaagc

SEQ ID NO: 9187462 - DNA, 22 bp, Homo sapiens
ccagatagcaggtcagaagtgc

SEQ ID NO: 9187463 - DNA, 22 bp, Homo sapiens
ccagccagtcccgcatgaccgc

SEQ ID NO: 9187464 - DNA, 22 bp, Homo sapiens
ccagccagtcccgcatgaccgc

SEQ ID NO: 9187465 - DNA, 22 bp, Homo sapiens
tctgaaatctgtaagcactagc

SEQ ID NO: 9187466 - DNA, 22 bp, Homo sapiens
tctgaaatctgtaagcactagc

SEQ ID NO: 9187467 - DNA, 22 bp, Homo sapiens
tctgaaatctgtaagcactagc

SEQ ID NO: 9187468 - DNA, 22 bp, Homo sapiens
tctgaaatcctttatcttggct

SEQ ID NO: 9187469 - DNA, 22 bp, Homo sapiens
tctgaaatctaatgctctgtgg

SEQ ID NO: 9187470 - DNA, 22 bp, Homo sapiens
tctcttggtgatagtctttctt

SEQ ID NO: 9187471 - DNA, 22 bp, Homo sapiens
tctgaaataggaaagcaaatgg

SEQ ID NO: 9187472 - DNA, 22 bp, Homo sapiens
tctgaaataggaaagcaaatgg

SEQ ID NO: 9187473 - DNA, 22 bp, Homo sapiens
tctcttgtggttttgtagttga

SEQ ID NO: 9187474 - DNA, 22 bp, Homo sapiens
tctgaaataggaaagcaaatgg

SEQ ID NO: 9187475 - DNA, 22 bp, Homo sapiens
tctgaaatatattttgagtgtt

SEQ ID NO: 9187476 - DNA, 22 bp, Homo sapiens
tctgaaataggcttcttttggt

SEQ ID NO: 9187477 - DNA, 22 bp, Homo sapiens
tctgaaataggagccatgtaga

SEQ ID NO: 9187478 - DNA, 22 bp, Homo sapiens
tctgaaataggagccatgtaga

SEQ ID NO: 9187479 - DNA, 22 bp, Homo sapiens
tctgaaataggagccatgtaga

SEQ ID NO: 9187480 - DNA, 22 bp, Homo sapiens
tctgaaatattggtaatacttt

SEQ ID NO: 9187481 - DNA, 22 bp, Homo sapiens
tctgaaatattggtaatacttt

SEQ ID NO: 9187482 - DNA, 22 bp, Homo sapiens
tctgaaatatattttgagtgtt

SEQ ID NO: 9187483 - DNA, 22 bp, Homo sapiens
tctgaaatattggtaatacttt

SEQ ID NO: 9187484 - DNA, 22 bp, Homo sapiens
tctcttgggaggaaagagagaa

SEQ ID NO: 9187485 - DNA, 22 bp, Homo sapiens
tctcttggagagtccatcatca

SEQ ID NO: 9187486 - DNA, 22 bp, Homo sapiens
tctcttgatgttcccagacagc

SEQ ID NO: 9187487 - DNA, 22 bp, Homo sapiens
tctcttgatatattacatagag

SEQ ID NO: 9187488 - DNA, 22 bp, Homo sapiens
tctcttgactgctaaaattaga

SEQ ID NO: 9187489 - DNA, 22 bp, Homo sapiens
tctcttgagctcagttctgatg

SEQ ID NO: 9187490 - DNA, 22 bp, Homo sapiens
tctcttgaagattgaagacaaa

SEQ ID NO: 9187491 - DNA, 19 bp, Homo sapiens
tctcttgaataggtcaaac

SEQ ID NO: 9187492 - DNA, 22 bp, Homo sapiens
tctcttaagttaagtgtaattc

SEQ ID NO: 9187493 - DNA, 22 bp, Homo sapiens
tctcttaactggttcagcaatt

SEQ ID NO: 9187494 - DNA, 22 bp, Homo sapiens
tctctctgtgacagctttgctg

SEQ ID NO: 9187495 - DNA, 16 bp, Homo sapiens
tctctctgtatttgct

SEQ ID NO: 9187496 - DNA, 19 bp, Homo sapiens
tctctctgtacattagata

SEQ ID NO: 9187497 - DNA, 22 bp, Homo sapiens
tctctcttcaacccttaactag

SEQ ID NO: 9187498 - DNA, 22 bp, Homo sapiens
tctctcttgaagtattagctag

SEQ ID NO: 9187499 - DNA, 22 bp, Homo sapiens
tctctcttcatgcttttagaat

SEQ ID NO: 9187500 - DNA, 22 bp, Homo sapiens
tctctcttctttgttaagaatg

SEQ ID NO: 9187501 - DNA, 22 bp, Homo sapiens
ccagcccctatcctcgctccac

SEQ ID NO: 9187502 - DNA, 22 bp, Homo sapiens
ccagccccgggaacctggccgt

SEQ ID NO: 9187503 - DNA, 22 bp, Homo sapiens
ccagcccatgcccttatagcat

SEQ ID NO: 9187504 - DNA, 22 bp, Homo sapiens
ccagcccatgcccttatagcat

SEQ ID NO: 9187505 - DNA, 19 bp, Homo sapiens
ccagcccatagtccatcac

SEQ ID NO: 9187506 - DNA, 19 bp, Homo sapiens
ccagcccatagtccatcac

SEQ ID NO: 9187507 - DNA, 22 bp, Homo sapiens
ccagcccaaacaagccgccttc

SEQ ID NO: 9187508 - DNA, 22 bp, Homo sapiens
ccagcccaaacaagccgccttc

SEQ ID NO: 9187509 - DNA, 22 bp, Homo sapiens
ccagcccaaagtcaccccggga

SEQ ID NO: 9187510 - DNA, 22 bp, Homo sapiens
ccagcccaaacaagccgccttc

SEQ ID NO: 9187511 - DNA, 22 bp, Homo sapiens
ccagccatgggccacctagctg

SEQ ID NO: 9187512 - DNA, 22 bp, Homo sapiens
ccagccatgggccacctagctg

SEQ ID NO: 9187513 - DNA, 21 bp, Homo sapiens
ccagcccagcctccttctctt

SEQ ID NO: 9187514 - DNA, 19 bp, Homo sapiens
ccagcccacagtgactttc

SEQ ID NO: 9187515 - DNA, 19 bp, Homo sapiens
ccagcccacagtgactttc

SEQ ID NO: 9187516 - DNA, 19 bp, Homo sapiens
ccagcccacagtgactttc

SEQ ID NO: 9187517 - DNA, 21 bp, Homo sapiens
ccagcccagctgtgtcccagc

SEQ ID NO: 9187518 - DNA, 21 bp, Homo sapiens
ccagcccagctgtgtcccagc

SEQ ID NO: 9187519 - DNA, 21 bp, Homo sapiens
ccagcccagctgtgtcccagc

SEQ ID NO: 9187520 - DNA, 22 bp, Homo sapiens
ccagccctacagtatcacctgt

SEQ ID NO: 9187521 - DNA, 22 bp, Homo sapiens
tctgaggacagtgctgtgcctg

SEQ ID NO: 9187522 - DNA, 22 bp, Homo sapiens
tctgaggaccatcggggagctg

SEQ ID NO: 9187523 - DNA, 23 bp, Homo sapiens
tctgaggatgaaggatagcaagt

SEQ ID NO: 9187524 - DNA, 22 bp, Homo sapiens
tctgaggatctgaagggaacag

SEQ ID NO: 9187525 - DNA, 22 bp, Homo sapiens
tctgaggatagaggcaatagga

SEQ ID NO: 9187526 - DNA, 22 bp, Homo sapiens
tctgaggactattgcaatactt

SEQ ID NO: 9187527 - DNA, 22 bp, Homo sapiens
tctgaggcccagttcaactctt

SEQ ID NO: 9187528 - DNA, 22 bp, Homo sapiens
tctgaggcccctgggcaggatg

SEQ ID NO: 9187529 - DNA, 22 bp, Homo sapiens
tctgaggcccctgggcaggatg

SEQ ID NO: 9187530 - DNA, 22 bp, Homo sapiens
ccagctagtaagcacctgcatc

SEQ ID NO: 9187531 - DNA, 22 bp, Homo sapiens
ccagctagtaagcacctgcatc

SEQ ID NO: 9187532 - DNA, 22 bp, Homo sapiens
ccagctaggcttgcactcttgt

SEQ ID NO: 9187533 - DNA, 22 bp, Homo sapiens
ccagctccagcatagccaccat

SEQ ID NO: 9187534 - DNA, 22 bp, Homo sapiens
ccagctccaagtttgggcatca

SEQ ID NO: 9187535 - DNA, 22 bp, Homo sapiens
ccagctccaagtttgggcatca

SEQ ID NO: 9187536 - DNA, 22 bp, Homo sapiens
ccagctccactgtcagatgaga

SEQ ID NO: 9187537 - DNA, 22 bp, Homo sapiens
ccagccttcacctgctctggtc

SEQ ID NO: 9187538 - DNA, 22 bp, Homo sapiens
ccagccttactgcccttcagtg

SEQ ID NO: 9187539 - DNA, 22 bp, Homo sapiens
ccagccttccagccaatggctg

SEQ ID NO: 9187540 - DNA, 19 bp, Homo sapiens
ccagcctttccagtgattg

SEQ ID NO: 9187541 - DNA, 22 bp, Homo sapiens
ccagccttgggggatccaggac

SEQ ID NO: 9187542 - DNA, 22 bp, Homo sapiens
ccagccttctgagctgcctgga

SEQ ID NO: 9187543 - DNA, 22 bp, Homo sapiens
ccagccttgactgccccagcac

SEQ ID NO: 9187544 - DNA, 22 bp, Homo sapiens
ccagccttgcaccgagccagcc

SEQ ID NO: 9187545 - DNA, 22 bp, Homo sapiens
ccagcctggagggcagtggtgg

SEQ ID NO: 9187546 - DNA, 22 bp, Homo sapiens
tctgataggcagaaggcataag

SEQ ID NO: 9187547 - DNA, 22 bp, Homo sapiens
tctgataatggacttctcatct

SEQ ID NO: 9187548 - DNA, 22 bp, Homo sapiens
tctgataagtggtgtatactgt

SEQ ID NO: 9187549 - DNA, 20 bp, Homo sapiens
tctgataactggttgtgatt

SEQ ID NO: 9187550 - DNA, 22 bp, Homo sapiens
tctgataagacagctgatttga

SEQ ID NO: 9187551 - DNA, 20 bp, Homo sapiens
tctgataaaaactactccat

SEQ ID NO: 9187552 - DNA, 22 bp, Homo sapiens
tctgataaatgccatctttttg

SEQ ID NO: 9187553 - DNA, 22 bp, Homo sapiens
tctgagtgtgactggttaatga

SEQ ID NO: 9187554 - DNA, 22 bp, Homo sapiens
tctgagtgtcttaataggctct

SEQ ID NO: 9187555 - DNA, 22 bp, Homo sapiens
tctgagtgggaactctcatgac

SEQ ID NO: 9187556 - DNA, 23 bp, Homo sapiens
tctgagtgattagcctctggggt

SEQ ID NO: 9187557 - DNA, 22 bp, Homo sapiens
tctgagtgcactaggaggggca

SEQ ID NO: 9187558 - DNA, 22 bp, Homo sapiens
tctgagtggactgtcctgcagg

SEQ ID NO: 9187559 - DNA, 22 bp, Homo sapiens
tctgagtgatgttgagtcagaa

SEQ ID NO: 9187560 - DNA, 22 bp, Homo sapiens
tctgagtgatcagatgcattgc

SEQ ID NO: 9187561 - DNA, 22 bp, Homo sapiens
tctgagtgacgtcctgacagga

SEQ ID NO: 9187562 - DNA, 22 bp, Homo sapiens
tctgagtgagggtgtgagatat

SEQ ID NO: 9187563 - DNA, 22 bp, Homo sapiens
tctgagtgagcacatggttaga

SEQ ID NO: 9187564 - DNA, 22 bp, Homo sapiens
tctgagtgagtgtaggcctgac

SEQ ID NO: 9187565 - DNA, 19 bp, Homo sapiens
tctgagtgagggttatcct

SEQ ID NO: 9187566 - DNA, 23 bp, Homo sapiens
ccagctccgtgagcctcgggctc

SEQ ID NO: 9187567 - DNA, 22 bp, Homo sapiens
ccagctccaggactgggagctg

SEQ ID NO: 9187568 - DNA, 23 bp, Homo sapiens
ccagctccgtgagcctcgggctc

SEQ ID NO: 9187569 - DNA, 21 bp, Homo sapiens
ccagctccaggaccttggatc

SEQ ID NO: 9187570 - DNA, 21 bp, Homo sapiens
ccagctccaggaccttggatc

SEQ ID NO: 9187571 - DNA, 22 bp, Homo sapiens
ccagctcctcttgtctctagca

SEQ ID NO: 9187572 - DNA, 22 bp, Homo sapiens
ccagctcctgagcatggtttcc

SEQ ID NO: 9187573 - DNA, 22 bp, Homo sapiens
ccagctcctgagcatggtttcc

SEQ ID NO: 9187574 - DNA, 22 bp, Homo sapiens
ccagctcctcttcccagtgtca

SEQ ID NO: 9187575 - DNA, 22 bp, Homo sapiens
ccagctcctgggtcttagtcag

SEQ ID NO: 9187576 - DNA, 22 bp, Homo sapiens
ccagctcctgggtcttagtcag

SEQ ID NO: 9187577 - DNA, 22 bp, Homo sapiens
ccagctccttctgtctgtggag

SEQ ID NO: 9187578 - DNA, 22 bp, Homo sapiens
ccagctccttctgtctgtggag

SEQ ID NO: 9187579 - DNA, 22 bp, Homo sapiens
ccagctctaaacggctctgtgg

SEQ ID NO: 9187580 - DNA, 22 bp, Homo sapiens
ccagctctcaaggctccctggg

SEQ ID NO: 9187581 - DNA, 22 bp, Homo sapiens
ccagctctcaaggctccctggg

SEQ ID NO: 9187582 - DNA, 22 bp, Homo sapiens
ccagctctaaacggctctgtgg

SEQ ID NO: 9187583 - DNA, 22 bp, Homo sapiens
tctgccaccttcatcctccact

SEQ ID NO: 9187584 - DNA, 22 bp, Homo sapiens
ccagctctcagcgggagactca

SEQ ID NO: 9187585 - DNA, 22 bp, Homo sapiens
tctgccagaagttctgagagta

SEQ ID NO: 9187586 - DNA, 22 bp, Homo sapiens
tctgccagaagttctgagagta

SEQ ID NO: 9187587 - DNA, 22 bp, Homo sapiens
tctgccagaagttctgagagta

SEQ ID NO: 9187588 - DNA, 22 bp, Homo sapiens
tctgccagaagttctgagagta

SEQ ID NO: 9187589 - DNA, 22 bp, Homo sapiens
tctgccagctctgtgggtctcg

SEQ ID NO: 9187590 - DNA, 22 bp, Homo sapiens
tctgccagcaccatgatccttc

SEQ ID NO: 9187591 - DNA, 22 bp, Homo sapiens
tctgccagccctgtgagtcttg

SEQ ID NO: 9187592 - DNA, 22 bp, Homo sapiens
tctgccagacctgactcagtag

SEQ ID NO: 9187593 - DNA, 22 bp, Homo sapiens
tctgccactgtgatgcatgata

SEQ ID NO: 9187594 - DNA, 22 bp, Homo sapiens
tctgccacttacctccatgtac

SEQ ID NO: 9187595 - DNA, 22 bp, Homo sapiens
tctgccactgtggccatgggag

SEQ ID NO: 9187596 - DNA, 20 bp, Homo sapiens
tctgccactttttctgtcac

SEQ ID NO: 9187597 - DNA, 22 bp, Homo sapiens
tctgccagaagccagggtctgg

SEQ ID NO: 9187598 - DNA, 22 bp, Homo sapiens
tctgccagaagccagggtctgg

SEQ ID NO: 9187599 - DNA, 22 bp, Homo sapiens
tctgccaggcattgtgctgctc

SEQ ID NO: 9187600 - DNA, 22 bp, Homo sapiens
tctgccaggcattgtgctgctc

SEQ ID NO: 9187601 - DNA, 22 bp, Homo sapiens
tctgccagcttctggtggttgc

SEQ ID NO: 9187602 - DNA, 21 bp, Homo sapiens
tctgccagctgaagaggtgga

SEQ ID NO: 9187603 - DNA, 22 bp, Homo sapiens
tctgcctcgctaacagcagcca

SEQ ID NO: 9187604 - DNA, 22 bp, Homo sapiens
tctgcctcctgcttgtcccgac

SEQ ID NO: 9187605 - DNA, 22 bp, Homo sapiens
tctgcctcgctaacagcagcca

SEQ ID NO: 9187606 - DNA, 19 bp, Homo sapiens
tctgcctctggtcaggctc

SEQ ID NO: 9187607 - DNA, 22 bp, Homo sapiens
ccaggaggcagaagttgcagtg

SEQ ID NO: 9187608 - DNA, 22 bp, Homo sapiens
ccaggaggcaatatcaagtcca

SEQ ID NO: 9187609 - DNA, 22 bp, Homo sapiens
ccaggaggcagaagttgcagtg

SEQ ID NO: 9187610 - DNA, 22 bp, Homo sapiens
ccaggaggcaatatcaagtcca

SEQ ID NO: 9187611 - DNA, 22 bp, Homo sapiens
ccaggaggatggttgttaggtg

SEQ ID NO: 9187612 - DNA, 22 bp, Homo sapiens
ccaggaggatgattttaagagg

SEQ ID NO: 9187613 - DNA, 22 bp, Homo sapiens
ccaggaagctctgctccacggg

SEQ ID NO: 9187614 - DNA, 22 bp, Homo sapiens
ccaggaaggaagcaggggtttc

SEQ ID NO: 9187615 - DNA, 22 bp, Homo sapiens
ccaggaagcggtgagggctgcc

SEQ ID NO: 9187616 - DNA, 22 bp, Homo sapiens
ccaggaagcggtgagggctgcc

SEQ ID NO: 9187617 - DNA, 22 bp, Homo sapiens
ccaggaagcggtgagggctgcc

SEQ ID NO: 9187618 - DNA, 22 bp, Homo sapiens
ccaggaagcggtgagggctgcc

SEQ ID NO: 9187619 - DNA, 22 bp, Homo sapiens
ccaggaagatttattttggctt

SEQ ID NO: 9187620 - DNA, 23 bp, Homo sapiens
ccaggaagaggccatccacagtc

SEQ ID NO: 9187621 - DNA, 23 bp, Homo sapiens
ccaggaagaggccatccacagtc

SEQ ID NO: 9187622 - DNA, 23 bp, Homo sapiens
ccaggaagaggccatccacagtc

SEQ ID NO: 9187623 - DNA, 22 bp, Homo sapiens
ccaggaagcctgtgtctctgga

SEQ ID NO: 9187624 - DNA, 22 bp, Homo sapiens
ccaggaagcctgtgtctctgga

SEQ ID NO: 9187625 - DNA, 22 bp, Homo sapiens
ccaggaagcctcagatgctgag

SEQ ID NO: 9187626 - DNA, 22 bp, Homo sapiens
ccaggaagcataatgtagtggg

SEQ ID NO: 9187627 - DNA, 22 bp, Homo sapiens
ccaggaagacacatgctcatcc

SEQ ID NO: 9187628 - DNA, 22 bp, Homo sapiens
ccaggaactcagctctgcactt

SEQ ID NO: 9187629 - DNA, 22 bp, Homo sapiens
ccaggaaccgatgatcagaggg

SEQ ID NO: 9187630 - DNA, 22 bp, Homo sapiens
ccaggaaacctgcgccatccag

SEQ ID NO: 9187631 - DNA, 23 bp, Homo sapiens
ccaggaaagatccaggaagaggc

SEQ ID NO: 9187632 - DNA, 22 bp, Homo sapiens
ccaggaaaaagagaaacatggt

SEQ ID NO: 9187633 - DNA, 22 bp, Homo sapiens
ccaggaggcggaaggtacagtg

SEQ ID NO: 9187634 - DNA, 22 bp, Homo sapiens
ccaggaggcggaaggtacagtg

SEQ ID NO: 9187635 - DNA, 22 bp, Homo sapiens
ccaggaggcagaggttacagtg

SEQ ID NO: 9187636 - DNA, 22 bp, Homo sapiens
ccaggaggcagaggttgtagtg

SEQ ID NO: 9187637 - DNA, 22 bp, Homo sapiens
ccaggaggcagaggttacagtg

SEQ ID NO: 9187638 - DNA, 22 bp, Homo sapiens
ccaggaggcggaggttgcagcg

SEQ ID NO: 9187639 - DNA, 22 bp, Homo sapiens
ccaggaggcggaaggtacagtg

SEQ ID NO: 9187640 - DNA, 22 bp, Homo sapiens
tctgtcaccgagggcatccaaa

SEQ ID NO: 9187641 - DNA, 22 bp, Homo sapiens
tctgtcacccctgtttctggct

SEQ ID NO: 9187642 - DNA, 22 bp, Homo sapiens
tctgtcactccctgatgatgaa

SEQ ID NO: 9187643 - DNA, 22 bp, Homo sapiens
tctgtcactctagagatggcag

SEQ ID NO: 9187644 - DNA, 23 bp, Homo sapiens
tctgtcacctatggctgctcttc

SEQ ID NO: 9187645 - DNA, 23 bp, Homo sapiens
tctgtcactttctgctgtggagt

SEQ ID NO: 9187646 - DNA, 22 bp, Homo sapiens
tctgtcataaacacacacaagc

SEQ ID NO: 9187647 - DNA, 22 bp, Homo sapiens
tctgtcaggagattggcagctg

SEQ ID NO: 9187648 - DNA, 22 bp, Homo sapiens
tctgtcagcccctcagctgtca

SEQ ID NO: 9187649 - DNA, 22 bp, Homo sapiens
tctgtcacttattaagatggat

SEQ ID NO: 9187650 - DNA, 22 bp, Homo sapiens
tctgtggcaaacacagtgacca

SEQ ID NO: 9187651 - DNA, 23 bp, Homo sapiens
tctgtcttgtttaggccactgtt

SEQ ID NO: 9187652 - DNA, 18 bp, Homo sapiens
tctgtggcagcagtgcac

SEQ ID NO: 9187653 - DNA, 22 bp, Homo sapiens
tctgtggcacgattgcactgca

SEQ ID NO: 9187654 - DNA, 17 bp, Homo sapiens
tctgtcttgactgtcac

SEQ ID NO: 9187655 - DNA, 17 bp, Homo sapiens
tctgtcttgactgtcac

SEQ ID NO: 9187656 - DNA, 17 bp, Homo sapiens
tctgtcttgactgtcac

SEQ ID NO: 9187657 - DNA, 17 bp, Homo sapiens
tctgtcttgactgtcac

SEQ ID NO: 9187658 - DNA, 23 bp, Homo sapiens
tctgtcttgtttaggccactgtt

SEQ ID NO: 9187659 - DNA, 22 bp, Homo sapiens
tctgtcttggccagccatctgg

SEQ ID NO: 9187660 - DNA, 21 bp, Homo sapiens
tctgtcttcctcagcctaagg

SEQ ID NO: 9187661 - DNA, 21 bp, Homo sapiens
tctgtcttcctcagcctaagg

SEQ ID NO: 9187662 - DNA, 22 bp, Homo sapiens
tctgtcttctgtagctaataat

SEQ ID NO: 9187663 - DNA, 22 bp, Homo sapiens
tctgtcttcttcattgcctata

SEQ ID NO: 9187664 - DNA, 22 bp, Homo sapiens
tctgtcttcatcagcatgtgat

SEQ ID NO: 9187665 - DNA, 22 bp, Homo sapiens
tctgtcttagccatctcaggct

SEQ ID NO: 9187666 - DNA, 22 bp, Homo sapiens
tctgtcttagcatctttgctca

SEQ ID NO: 9187667 - DNA, 22 bp, Homo sapiens
tctgtcttagcatctttgctca

SEQ ID NO: 9187668 - DNA, 17 bp, Homo sapiens
tctgtctgtggtccact

SEQ ID NO: 9187669 - DNA, 22 bp, Homo sapiens
tctgtctggtccaggaagatgt

SEQ ID NO: 9187670 - DNA, 22 bp, Homo sapiens
tctgtctggtccaggaagatgt

SEQ ID NO: 9187671 - DNA, 22 bp, Homo sapiens
tctggctcataggaaggccatt

SEQ ID NO: 9187672 - DNA, 22 bp, Homo sapiens
tctggctgttaggcctgacctt

SEQ ID NO: 9187673 - DNA, 22 bp, Homo sapiens
tctggctgttttagatgagctc

SEQ ID NO: 9187674 - DNA, 22 bp, Homo sapiens
tctggctgttttagatgagctc

SEQ ID NO: 9187675 - DNA, 22 bp, Homo sapiens
tctggcttcaactttactgaaa

SEQ ID NO: 9187676 - DNA, 22 bp, Homo sapiens
tctggcttcaagtcccagctct

SEQ ID NO: 9187677 - DNA, 22 bp, Homo sapiens
tctggcttcagtagggttcact

SEQ ID NO: 9187678 - DNA, 22 bp, Homo sapiens
tctggcttcacactgaagtttg

SEQ ID NO: 9187679 - DNA, 22 bp, Homo sapiens
tctggcttcacactgaagtttg

SEQ ID NO: 9187680 - DNA, 23 bp, Homo sapiens
tctggcttccagtgggttcaacc

SEQ ID NO: 9187681 - DNA, 22 bp, Homo sapiens
tctggcttccctacttactatg

SEQ ID NO: 9187682 - DNA, 22 bp, Homo sapiens
tctggcttcccactctgccggg

SEQ ID NO: 9187683 - DNA, 22 bp, Homo sapiens
tctggcttccctctgttctggg

SEQ ID NO: 9187684 - DNA, 22 bp, Homo sapiens
tctggcttctatgaatgtcctt

SEQ ID NO: 9187685 - DNA, 22 bp, Homo sapiens
tctggcttcgcagctcccagcc

SEQ ID NO: 9187686 - DNA, 22 bp, Homo sapiens
tctggcttctcctagagcaatg

SEQ ID NO: 9187687 - DNA, 22 bp, Homo sapiens
tctggagcttgaagctttggtt

SEQ ID NO: 9187688 - DNA, 22 bp, Homo sapiens
tctggagcttgtttcagatggt

SEQ ID NO: 9187689 - DNA, 22 bp, Homo sapiens
tctggaggcaggctgccaggat

SEQ ID NO: 9187690 - DNA, 22 bp, Homo sapiens
tctggaggcaactaacctagtt

SEQ ID NO: 9187691 - DNA, 22 bp, Homo sapiens
tctggctcatacaagcctgcaa

SEQ ID NO: 9187692 - DNA, 22 bp, Homo sapiens
tctggaggcaggctgccaggat

SEQ ID NO: 9187693 - DNA, 22 bp, Homo sapiens
tctggagctggagggcaaggca

SEQ ID NO: 9187694 - DNA, 21 bp, Homo sapiens
tctggagctgcaggctgggca

SEQ ID NO: 9187695 - DNA, 22 bp, Homo sapiens
tctggagctgggggcttagtat

SEQ ID NO: 9187696 - DNA, 22 bp, Homo sapiens
tctggcttgtgtccttccttgc

SEQ ID NO: 9187697 - DNA, 22 bp, Homo sapiens
tctggctttattccttcactga

SEQ ID NO: 9187698 - DNA, 22 bp, Homo sapiens
tctggctttattttcatcatct

SEQ ID NO: 9187699 - DNA, 22 bp, Homo sapiens
ccagctgtcactcagaaaggcc

SEQ ID NO: 9187700 - DNA, 22 bp, Homo sapiens
ccagctgtcactcagaaaggcc

SEQ ID NO: 9187701 - DNA, 22 bp, Homo sapiens
ccagctgtcagtgtgaaaataa

SEQ ID NO: 9187702 - DNA, 22 bp, Homo sapiens
ccagctgtctggttccagagcc

SEQ ID NO: 9187703 - DNA, 22 bp, Homo sapiens
tctggcttggcgctgccctctg

SEQ ID NO: 9187704 - DNA, 22 bp, Homo sapiens
tctggcttggacacaatcttcc

SEQ ID NO: 9187705 - DNA, 22 bp, Homo sapiens
tctggcttggctggcatctctg

SEQ ID NO: 9187706 - DNA, 22 bp, Homo sapiens
tctggcttgtctcagggtctga

SEQ ID NO: 9187707 - DNA, 22 bp, Homo sapiens
tctggcttgggtaggtagttca

SEQ ID NO: 9187708 - DNA, 22 bp, Homo sapiens
tctggcttggctggcatctctg

SEQ ID NO: 9187709 - DNA, 22 bp, Homo sapiens
tctggcttgctggcttggtccc

SEQ ID NO: 9187710 - DNA, 22 bp, Homo sapiens
tctggcttgagcttcgaccagt

SEQ ID NO: 9187711 - DNA, 22 bp, Homo sapiens
tctggcttgagaggtaattatt

SEQ ID NO: 9187712 - DNA, 22 bp, Homo sapiens
tctggcttctgcaggattacta

SEQ ID NO: 9187713 - DNA, 22 bp, Homo sapiens
tctggcttgaacaattaggtaa

SEQ ID NO: 9187714 - DNA, 22 bp, Homo sapiens
tctggcttctcctagagcaatg

SEQ ID NO: 9187715 - DNA, 21 bp, Homo sapiens
ccagctgtctgtccttaggca

SEQ ID NO: 9187716 - DNA, 22 bp, Homo sapiens
ccagctgtctggttccagagcc

SEQ ID NO: 9187717 - DNA, 22 bp, Homo sapiens
ccagctgtgccggggacctggg

SEQ ID NO: 9187718 - DNA, 18 bp, Homo sapiens
ccagctgtgcagcatctg

SEQ ID NO: 9187719 - DNA, 23 bp, Homo sapiens
ccagctgtgcctggcccaggagc

SEQ ID NO: 9187720 - DNA, 23 bp, Homo sapiens
ccagctgtgcctggcccaggagc

SEQ ID NO: 9187721 - DNA, 22 bp, Homo sapiens
ccagctgtgcctaggagcaggg

SEQ ID NO: 9187722 - DNA, 22 bp, Homo sapiens
ccagctgttggagtttcactgc

SEQ ID NO: 9187723 - DNA, 22 bp, Homo sapiens
ccagctggttaaaatagagaaa

SEQ ID NO: 9187724 - DNA, 22 bp, Homo sapiens
tctggagccttggatgggaaag

SEQ ID NO: 9187725 - DNA, 19 bp, Homo sapiens
tctggagctgatgcaggtg

SEQ ID NO: 9187726 - DNA, 22 bp, Homo sapiens
ccagctggtgacatccccaacc

SEQ ID NO: 9187727 - DNA, 22 bp, Homo sapiens
ccagctggtgggtctttctctg

SEQ ID NO: 9187728 - DNA, 22 bp, Homo sapiens
ccagctggtgttccttaggacc

SEQ ID NO: 9187729 - DNA, 22 bp, Homo sapiens
ccagctggtgggtctttctctg

SEQ ID NO: 9187730 - DNA, 22 bp, Homo sapiens
ccagctggtctgtgctcatgtt

SEQ ID NO: 9187731 - DNA, 22 bp, Homo sapiens
ccagctggtctgtgctcatgtt

SEQ ID NO: 9187732 - DNA, 22 bp, Homo sapiens
ccagctggggaagtggggcata

SEQ ID NO: 9187733 - DNA, 22 bp, Homo sapiens
ccagctgggtccctgctggggc

SEQ ID NO: 9187734 - DNA, 22 bp, Homo sapiens
ccagctggtaagtgatggagcc

SEQ ID NO: 9187735 - DNA, 22 bp, Homo sapiens
ccagctggtaagtgatggagcc

SEQ ID NO: 9187736 - DNA, 22 bp, Homo sapiens
tctgctaaatagatttggcaat

SEQ ID NO: 9187737 - DNA, 22 bp, Homo sapiens
tctgctaacaatattgcagact

SEQ ID NO: 9187738 - DNA, 22 bp, Homo sapiens
tctgctaacaatattgcagact

SEQ ID NO: 9187739 - DNA, 22 bp, Homo sapiens
tctgctaaggcatttgcttgga

SEQ ID NO: 9187740 - DNA, 22 bp, Homo sapiens
tctgctaatgtggttatttcta

SEQ ID NO: 9187741 - DNA, 19 bp, Homo sapiens
tctgcctctggtcaggctc

SEQ ID NO: 9187742 - DNA, 22 bp, Homo sapiens
tctgcctctttcaggcctggca

SEQ ID NO: 9187743 - DNA, 22 bp, Homo sapiens
tctgccttgccgaattccaggc

SEQ ID NO: 9187744 - DNA, 22 bp, Homo sapiens
tctgccttttcactgccactaa

SEQ ID NO: 9187745 - DNA, 22 bp, Homo sapiens
tctgcgccctgtcgcctgctcc

SEQ ID NO: 9187746 - DNA, 22 bp, Homo sapiens
tataagaaacaaggcaaatttt

SEQ ID NO: 9187747 - DNA, 17 bp, Homo sapiens
tacatgtgtatctgatt

SEQ ID NO: 9187748 - DNA, 22 bp, Homo sapiens
tacatgtggtagggagggcagt

SEQ ID NO: 9187749 - DNA, 22 bp, Homo sapiens
tagttttagtcccattttacag

SEQ ID NO: 9187750 - DNA, 22 bp, Homo sapiens
tataagcatgcttcatatggat

SEQ ID NO: 9187751 - DNA, 20 bp, Homo sapiens
tataagcagctccaggcaga

SEQ ID NO: 9187752 - DNA, 22 bp, Homo sapiens
tataatatgaggcaggagtgat

SEQ ID NO: 9187753 - DNA, 22 bp, Homo sapiens
tataatatgaggcaggagtgat

SEQ ID NO: 9187754 - DNA, 22 bp, Homo sapiens
tataatccattcattgatttct

SEQ ID NO: 9187755 - DNA, 22 bp, Homo sapiens
tataatctggttttattaagag

SEQ ID NO: 9187756 - DNA, 22 bp, Homo sapiens
tataatctggttttattaagag

SEQ ID NO: 9187757 - DNA, 22 bp, Homo sapiens
tataatcctgcttcacattgaa

SEQ ID NO: 9187758 - DNA, 22 bp, Homo sapiens
tataatattccttgttgtaggt

SEQ ID NO: 9187759 - DNA, 22 bp, Homo sapiens
tataatattccttgttgtaggt

SEQ ID NO: 9187760 - DNA, 22 bp, Homo sapiens
caggggcctggctgtctaggaa

SEQ ID NO: 9187761 - DNA, 22 bp, Homo sapiens
caggggcctggctgtctaggaa

SEQ ID NO: 9187762 - DNA, 22 bp, Homo sapiens
cagggtcttataaggccaattt

SEQ ID NO: 9187763 - DNA, 22 bp, Homo sapiens
caggggcagtctgtgtgcgtgg

SEQ ID NO: 9187764 - DNA, 22 bp, Homo sapiens
caggggcaagaatgctgtcagc

SEQ ID NO: 9187765 - DNA, 22 bp, Homo sapiens
caggggcaggtgtgagatcatc

SEQ ID NO: 9187766 - DNA, 22 bp, Homo sapiens
caggggcaggtgtgagatcatc

SEQ ID NO: 9187767 - DNA, 22 bp, Homo sapiens
caggggccggctgtccgtgccc

SEQ ID NO: 9187768 - DNA, 22 bp, Homo sapiens
caggggccaggctgtctgctgt

SEQ ID NO: 9187769 - DNA, 22 bp, Homo sapiens
caggggccaggctgtctgctgt

SEQ ID NO: 9187770 - DNA, 22 bp, Homo sapiens
tatacagatggaaagatacaca

SEQ ID NO: 9187771 - DNA, 22 bp, Homo sapiens
cagggtggcacatcacagcatt

SEQ ID NO: 9187772 - DNA, 22 bp, Homo sapiens
cagggtggaagctgtagagtgg

SEQ ID NO: 9187773 - DNA, 22 bp, Homo sapiens
cagggtggaatggaatgctggc

SEQ ID NO: 9187774 - DNA, 22 bp, Homo sapiens
tatacagctatggcaagacaaa

SEQ ID NO: 9187775 - DNA, 22 bp, Homo sapiens
tatacagtcttttgctatattc

SEQ ID NO: 9187776 - DNA, 22 bp, Homo sapiens
tatacagtcttttgctatattc

SEQ ID NO: 9187777 - DNA, 22 bp, Homo sapiens
caggtccagaaaccaaaggatt

SEQ ID NO: 9187778 - DNA, 17 bp, Homo sapiens
caggtctgaggccaggc

SEQ ID NO: 9187779 - DNA, 22 bp, Homo sapiens
caggtctgaagagtcacatgcc

SEQ ID NO: 9187780 - DNA, 22 bp, Homo sapiens
caggtctgaagagtcacatgcc

SEQ ID NO: 9187781 - DNA, 22 bp, Homo sapiens
caggtctggcatcagctgtgtg

SEQ ID NO: 9187782 - DNA, 22 bp, Homo sapiens
caggtctggcatcagctgtgtg

SEQ ID NO: 9187783 - DNA, 22 bp, Homo sapiens
caggtctgggttgatggcctgg

SEQ ID NO: 9187784 - DNA, 22 bp, Homo sapiens
caggtctgcaggctggagtcca

SEQ ID NO: 9187785 - DNA, 22 bp, Homo sapiens
caggtctgcagacagggccatg

SEQ ID NO: 9187786 - DNA, 22 bp, Homo sapiens
caggtctgagtcacatgttcat

SEQ ID NO: 9187787 - DNA, 22 bp, Homo sapiens
tattgctggtgctgttctgaat

SEQ ID NO: 9187788 - DNA, 22 bp, Homo sapiens
tattgcttataatttgttgcaa

SEQ ID NO: 9187789 - DNA, 22 bp, Homo sapiens
tattgcttattcttgagagtca

SEQ ID NO: 9187790 - DNA, 22 bp, Homo sapiens
tattgcttcataattgttgcca

SEQ ID NO: 9187791 - DNA, 22 bp, Homo sapiens
tattgctttctcagacgtttag

SEQ ID NO: 9187792 - DNA, 22 bp, Homo sapiens
tattgctgaaatgctgagttca

SEQ ID NO: 9187793 - DNA, 22 bp, Homo sapiens
tattgcatttcccacgttcact

SEQ ID NO: 9187794 - DNA, 22 bp, Homo sapiens
tattgctgactgtcttctgagt

SEQ ID NO: 9187795 - DNA, 22 bp, Homo sapiens
tattgctgacttgttcagtgtt

SEQ ID NO: 9187796 - DNA, 22 bp, Homo sapiens
tattgctgacttgttcagtgtt

SEQ ID NO: 9187797 - DNA, 22 bp, Homo sapiens
tattgctgccaggaccctatcc

SEQ ID NO: 9187798 - DNA, 22 bp, Homo sapiens
tattgctgaggattgaggcttg

SEQ ID NO: 9187799 - DNA, 22 bp, Homo sapiens
tattgctgctattgtcagttca

SEQ ID NO: 9187800 - DNA, 22 bp, Homo sapiens
tattgctggaaaatggtgtgat

SEQ ID NO: 9187801 - DNA, 22 bp, Homo sapiens
tatgtttttcagacgtcctaca

SEQ ID NO: 9187802 - DNA, 22 bp, Homo sapiens
tatgtttttaagagaatgcatt

SEQ ID NO: 9187803 - DNA, 22 bp, Homo sapiens
tatgtttttcaagtgcacacta

SEQ ID NO: 9187804 - DNA, 22 bp, Homo sapiens
tattaaagagagaatcatcatc

SEQ ID NO: 9187805 - DNA, 22 bp, Homo sapiens
tattaaagggaagttatgcatg

SEQ ID NO: 9187806 - DNA, 18 bp, Homo sapiens
tattcctgagtcatccct

SEQ ID NO: 9187807 - DNA, 23 bp, Homo sapiens
tattcctggtaagcctgtcactg

SEQ ID NO: 9187808 - DNA, 22 bp, Homo sapiens
tattaaatatatctgttagttg

SEQ ID NO: 9187809 - DNA, 22 bp, Homo sapiens
tatgtttgttatcacaactagg

SEQ ID NO: 9187810 - DNA, 22 bp, Homo sapiens
tatgtgtcaaaccattcatctg

SEQ ID NO: 9187811 - DNA, 22 bp, Homo sapiens
tatgtgtactcgttaaatattt

SEQ ID NO: 9187812 - DNA, 22 bp, Homo sapiens
tatgtgtagtgtgatcccaatg

SEQ ID NO: 9187813 - DNA, 22 bp, Homo sapiens
tatgtgctatcaaatgctcatt

SEQ ID NO: 9187814 - DNA, 22 bp, Homo sapiens
tatgtgctttgcactgtgctat

SEQ ID NO: 9187815 - DNA, 22 bp, Homo sapiens
tatctcccaactagactctgca

SEQ ID NO: 9187816 - DNA, 22 bp, Homo sapiens
tatctccatctggagagcaaaa

SEQ ID NO: 9187817 - DNA, 17 bp, Homo sapiens
tatctcatacaattata

SEQ ID NO: 9187818 - DNA, 22 bp, Homo sapiens
tatctcttgcatgctttttaga

SEQ ID NO: 9187819 - DNA, 22 bp, Homo sapiens
tatctctttattgacaataaaa

SEQ ID NO: 9187820 - DNA, 22 bp, Homo sapiens
tatctctttcattttagagtca

SEQ ID NO: 9187821 - DNA, 22 bp, Homo sapiens
tatggataggtttcaagaatgc

SEQ ID NO: 9187822 - DNA, 22 bp, Homo sapiens
tatggcagttacccttgatgat

SEQ ID NO: 9187823 - DNA, 22 bp, Homo sapiens
tatggcaatatgtatcaagatc

SEQ ID NO: 9187824 - DNA, 21 bp, Homo sapiens
caggtctggtgaacactctca

SEQ ID NO: 9187825 - DNA, 22 bp, Homo sapiens
caggtctgggttgatggcctgg

SEQ ID NO: 9187826 - DNA, 22 bp, Homo sapiens
caggtctggtgagagaacagtt

SEQ ID NO: 9187827 - DNA, 22 bp, Homo sapiens
tatggcttaggagagtttaact

SEQ ID NO: 9187828 - DNA, 22 bp, Homo sapiens
tatggcttccaggctggccagg

SEQ ID NO: 9187829 - DNA, 22 bp, Homo sapiens
tatggctgtggtgatctcattt

SEQ ID NO: 9187830 - DNA, 22 bp, Homo sapiens
tatggccaatcgggtggacgcc

SEQ ID NO: 9187831 - DNA, 22 bp, Homo sapiens
tatggccacaatggggagaaac

SEQ ID NO: 9187832 - DNA, 22 bp, Homo sapiens
tatggccacagcttgtttgcaa

SEQ ID NO: 9187833 - DNA, 22 bp, Homo sapiens
caggtctgtttccatcagtgct

SEQ ID NO: 9187834 - DNA, 22 bp, Homo sapiens
caggtctgtgtgccatttccaa

SEQ ID NO: 9187835 - DNA, 22 bp, Homo sapiens
caggtctgtttccatcagtgct

SEQ ID NO: 9187836 - DNA, 22 bp, Homo sapiens
caggtctgtgtgccatttccaa

SEQ ID NO: 9187837 - DNA, 18 bp, Homo sapiens
caggtctgtctgcctccc

SEQ ID NO: 9187838 - DNA, 18 bp, Homo sapiens
caggtctgtctgcctccc

SEQ ID NO: 9187839 - DNA, 20 bp, Homo sapiens
caggtcttcatgtggctgtc

SEQ ID NO: 9187840 - DNA, 22 bp, Homo sapiens
caggtctttgttgcagcatgga

SEQ ID NO: 9187841 - DNA, 22 bp, Homo sapiens
caggtcttttctactggtggag

SEQ ID NO: 9187842 - DNA, 22 bp, Homo sapiens
tatgtacatgttaaagggcaaa

SEQ ID NO: 9187843 - DNA, 21 bp, Homo sapiens
tcagaacaattccatgcctcc

SEQ ID NO: 9187844 - DNA, 22 bp, Homo sapiens
tcagaaatttaggctggacttg

SEQ ID NO: 9187845 - DNA, 22 bp, Homo sapiens
tcagaaattttctcagtagttc

SEQ ID NO: 9187846 - DNA, 20 bp, Homo sapiens
tcagaaggctccagagcaga

SEQ ID NO: 9187847 - DNA, 19 bp, Homo sapiens
tcagaaggcaggagaggcc

SEQ ID NO: 9187848 - DNA, 22 bp, Homo sapiens
tcagaaggaagttagagtatgg

SEQ ID NO: 9187849 - DNA, 22 bp, Homo sapiens
tcagaaggatgtgcaggtggca

SEQ ID NO: 9187850 - DNA, 22 bp, Homo sapiens
tcagaagctgggtctcagaagc

SEQ ID NO: 9187851 - DNA, 22 bp, Homo sapiens
tcagaaataatgaatgatgggg

SEQ ID NO: 9187852 - DNA, 22 bp, Homo sapiens
tcagaaatacaaaacacttact

SEQ ID NO: 9187853 - DNA, 22 bp, Homo sapiens
tcagaaataatgaatgatgggg

SEQ ID NO: 9187854 - DNA, 22 bp, Homo sapiens
tcagaaatagctctaagctcct

SEQ ID NO: 9187855 - DNA, 22 bp, Homo sapiens
tcagaaatagctctaagctcct

SEQ ID NO: 9187856 - DNA, 22 bp, Homo sapiens
tcagaaatactatcagcttttg

SEQ ID NO: 9187857 - DNA, 22 bp, Homo sapiens
tcagaaatagtctttaaaatga

SEQ ID NO: 9187858 - DNA, 22 bp, Homo sapiens
tcagaaatagtctttaaaatga

SEQ ID NO: 9187859 - DNA, 22 bp, Homo sapiens
tcagaaatcttgtcaaggcatc

SEQ ID NO: 9187860 - DNA, 22 bp, Homo sapiens
tcagaaatgtaagctgatgact

SEQ ID NO: 9187861 - DNA, 22 bp, Homo sapiens
tcagaaatgtaagctgatgact

SEQ ID NO: 9187862 - DNA, 22 bp, Homo sapiens
tcagaaatgatcgttattcatt

SEQ ID NO: 9187863 - DNA, 22 bp, Homo sapiens
tcagaaatgatcgttattcatt

SEQ ID NO: 9187864 - DNA, 22 bp, Homo sapiens
tcacttcccagacggggtggca

SEQ ID NO: 9187865 - DNA, 22 bp, Homo sapiens
tcagaaaggttgagtcatgtgc

SEQ ID NO: 9187866 - DNA, 22 bp, Homo sapiens
tcacttccctcttcagctccca

SEQ ID NO: 9187867 - DNA, 22 bp, Homo sapiens
tcactcaggttcatgtctttgt

SEQ ID NO: 9187868 - DNA, 22 bp, Homo sapiens
tcactatctcagtaaagcactc

SEQ ID NO: 9187869 - DNA, 22 bp, Homo sapiens
tcactatgcccagaatacagtt

SEQ ID NO: 9187870 - DNA, 22 bp, Homo sapiens
tcactataatatgtcaaaatac

SEQ ID NO: 9187871 - DNA, 22 bp, Homo sapiens
cagtgcagaggccagggaggat

SEQ ID NO: 9187872 - DNA, 19 bp, Homo sapiens
cagtgcccgacgcaggtct

SEQ ID NO: 9187873 - DNA, 22 bp, Homo sapiens
cagtgctgacagggaggaacct

SEQ ID NO: 9187874 - DNA, 22 bp, Homo sapiens
cagtgctgccaaagggaccttg

SEQ ID NO: 9187875 - DNA, 22 bp, Homo sapiens
cagtgctgccaaagggaccttg

SEQ ID NO: 9187876 - DNA, 22 bp, Homo sapiens
cagtgctgcatctccatgccag

SEQ ID NO: 9187877 - DNA, 22 bp, Homo sapiens
cagtgctgggcagaggagagcg

SEQ ID NO: 9187878 - DNA, 22 bp, Homo sapiens
cagtgctgggcagaggagagcg

SEQ ID NO: 9187879 - DNA, 22 bp, Homo sapiens
cagtgctggctgttaggacagt

SEQ ID NO: 9187880 - DNA, 22 bp, Homo sapiens
cagtgctgggcagaggagagcg

SEQ ID NO: 9187881 - DNA, 22 bp, Homo sapiens
cagtgctgggcagaggagagcg

SEQ ID NO: 9187882 - DNA, 22 bp, Homo sapiens
cagtgctgggcagaggagagcg

SEQ ID NO: 9187883 - DNA, 21 bp, Homo sapiens
cagtgctgcctaatagggagt

SEQ ID NO: 9187884 - DNA, 22 bp, Homo sapiens
cagtgctgctctctgtaagaga

SEQ ID NO: 9187885 - DNA, 22 bp, Homo sapiens
cagtgctggagatgggtggaac

SEQ ID NO: 9187886 - DNA, 22 bp, Homo sapiens
cagtgctggaggctggagggaa

SEQ ID NO: 9187887 - DNA, 22 bp, Homo sapiens
cagtgctggaggctggagggaa

SEQ ID NO: 9187888 - DNA, 22 bp, Homo sapiens
cagtgctggaggctggagggaa

SEQ ID NO: 9187889 - DNA, 22 bp, Homo sapiens
tcaccagggctccagccagcct

SEQ ID NO: 9187890 - DNA, 22 bp, Homo sapiens
tcaccagggagcttgtcctctg

SEQ ID NO: 9187891 - DNA, 22 bp, Homo sapiens
tcaccataggaacacagtcaga

SEQ ID NO: 9187892 - DNA, 22 bp, Homo sapiens
tcaccatacataaattacattg

SEQ ID NO: 9187893 - DNA, 22 bp, Homo sapiens
tcacattgattacattccatgt

SEQ ID NO: 9187894 - DNA, 22 bp, Homo sapiens
tcacattctttatttgccatcc

SEQ ID NO: 9187895 - DNA, 22 bp, Homo sapiens
cagtgctgttgtaagctcattg

SEQ ID NO: 9187896 - DNA, 22 bp, Homo sapiens
tcaccaggctggaatgcagtgg

SEQ ID NO: 9187897 - DNA, 22 bp, Homo sapiens
tcaccaggctcctgttaagatg

SEQ ID NO: 9187898 - DNA, 22 bp, Homo sapiens
tcaccaggctggagtgcagtgg

SEQ ID NO: 9187899 - DNA, 19 bp, Homo sapiens
cagtgctgttcattcagtg

SEQ ID NO: 9187900 - DNA, 22 bp, Homo sapiens
cagtgctgtgtttgctgcctgg

SEQ ID NO: 9187901 - DNA, 19 bp, Homo sapiens
cagtgctgttcattcagtg

SEQ ID NO: 9187902 - DNA, 22 bp, Homo sapiens
cagtgctgttgggcccagagag

SEQ ID NO: 9187903 - DNA, 23 bp, Homo sapiens
cagtgctggttctgcctgtgggg

SEQ ID NO: 9187904 - DNA, 23 bp, Homo sapiens
cagtgctggttctgcctgtgggg

SEQ ID NO: 9187905 - DNA, 22 bp, Homo sapiens
cagtgctggtgtaggctgacca

SEQ ID NO: 9187906 - DNA, 22 bp, Homo sapiens
cagtgctgtgctggaagctgtt

SEQ ID NO: 9187907 - DNA, 22 bp, Homo sapiens
cagtgctgtgctggaagctgtt

SEQ ID NO: 9187908 - DNA, 22 bp, Homo sapiens
tatttagaacagacaatagaaa

SEQ ID NO: 9187909 - DNA, 21 bp, Homo sapiens
tatttagttttacaaatgtgg

SEQ ID NO: 9187910 - DNA, 22 bp, Homo sapiens
tatttagtgatagaagcaagga

SEQ ID NO: 9187911 - DNA, 22 bp, Homo sapiens
tatttagaggagaaaagtggct

SEQ ID NO: 9187912 - DNA, 22 bp, Homo sapiens
tatttagatgcatttggattgc

SEQ ID NO: 9187913 - DNA, 20 bp, Homo sapiens
tatttacaacttagagcctc

SEQ ID NO: 9187914 - DNA, 22 bp, Homo sapiens
cagtcctggggaccaggctgag

SEQ ID NO: 9187915 - DNA, 22 bp, Homo sapiens
cagtcctggggaccaggctgag

SEQ ID NO: 9187916 - DNA, 22 bp, Homo sapiens
cagtcctggggaccaggctgag

SEQ ID NO: 9187917 - DNA, 22 bp, Homo sapiens
cagtcctgggcacagccctggg

SEQ ID NO: 9187918 - DNA, 18 bp, Homo sapiens
cagtcctgtttctacagg

SEQ ID NO: 9187919 - DNA, 22 bp, Homo sapiens
cagtcctgtctttatgacttca

SEQ ID NO: 9187920 - DNA, 22 bp, Homo sapiens
cagtcctgtgtcccttggtggg

SEQ ID NO: 9187921 - DNA, 22 bp, Homo sapiens
cagtcctgtgttaaacaagagc

SEQ ID NO: 9187922 - DNA, 22 bp, Homo sapiens
cagtccttggcaagttctcagt

SEQ ID NO: 9187923 - DNA, 22 bp, Homo sapiens
cagtccttgctctgggatgatg

SEQ ID NO: 9187924 - DNA, 22 bp, Homo sapiens
cagtccttgatccaatagtggg

SEQ ID NO: 9187925 - DNA, 22 bp, Homo sapiens
cagtccttgctcaaagtctaca

SEQ ID NO: 9187926 - DNA, 22 bp, Homo sapiens
cagtgaggtggatggatggcct

SEQ ID NO: 9187927 - DNA, 22 bp, Homo sapiens
cagtgagtccaagatggctgaa

SEQ ID NO: 9187928 - DNA, 22 bp, Homo sapiens
cagtgatatttatcctactcac

SEQ ID NO: 9187929 - DNA, 22 bp, Homo sapiens
cagtgaggtggagtagttccca

SEQ ID NO: 9187930 - DNA, 22 bp, Homo sapiens
cagtctcagaggtgggagtggg

SEQ ID NO: 9187931 - DNA, 20 bp, Homo sapiens
cagtgaggaggtgctggggg

SEQ ID NO: 9187932 - DNA, 22 bp, Homo sapiens
cagtctccgccagctcctcaca

SEQ ID NO: 9187933 - DNA, 22 bp, Homo sapiens
cagtctcctgggggctgttgtt

SEQ ID NO: 9187934 - DNA, 18 bp, Homo sapiens
cagtctaattcccttccc

SEQ ID NO: 9187935 - DNA, 18 bp, Homo sapiens
cagtctagtgagaaatgt

SEQ ID NO: 9187936 - DNA, 22 bp, Homo sapiens
cagtctagatgctagaaaatat

SEQ ID NO: 9187937 - DNA, 22 bp, Homo sapiens
cagtgattcacgcccttgggcc

SEQ ID NO: 9187938 - DNA, 22 bp, Homo sapiens
cagtgcaattagaacttattta

SEQ ID NO: 9187939 - DNA, 22 bp, Homo sapiens
cagtgcagacgtggagggggca

SEQ ID NO: 9187940 - DNA, 22 bp, Homo sapiens
cagtgcagaacacatggaaaat

SEQ ID NO: 9187941 - DNA, 22 bp, Homo sapiens
catatattctggttttcactgg

SEQ ID NO: 9187942 - DNA, 22 bp, Homo sapiens
catatatgtagatgtatgtgaa

SEQ ID NO: 9187943 - DNA, 22 bp, Homo sapiens
catatacttttctatagctttc

SEQ ID NO: 9187944 - DNA, 20 bp, Homo sapiens
catatatacctagaagtgga

SEQ ID NO: 9187945 - DNA, 20 bp, Homo sapiens
catatatacctagaagtgga

SEQ ID NO: 9187946 - DNA, 22 bp, Homo sapiens
catatcttctgacatgatcagg

SEQ ID NO: 9187947 - DNA, 22 bp, Homo sapiens
catatgaaatatgagttgaaca

SEQ ID NO: 9187948 - DNA, 15 bp, Homo sapiens
catatcactgggaat

SEQ ID NO: 9187949 - DNA, 22 bp, Homo sapiens
catatcataggtcttggataat

SEQ ID NO: 9187950 - DNA, 22 bp, Homo sapiens
catatcataggtcttggataat

SEQ ID NO: 9187951 - DNA, 22 bp, Homo sapiens
catatcatttgcttataaatct

SEQ ID NO: 9187952 - DNA, 22 bp, Homo sapiens
catatcatggcactgagggaat

SEQ ID NO: 9187953 - DNA, 22 bp, Homo sapiens
catatcttatggttttctaagt

SEQ ID NO: 9187954 - DNA, 22 bp, Homo sapiens
catagacaaagatcagaagagt

SEQ ID NO: 9187955 - DNA, 22 bp, Homo sapiens
tcaggaagttgaggcgtagaga

SEQ ID NO: 9187956 - DNA, 22 bp, Homo sapiens
catatacacttccacctctgtg

SEQ ID NO: 9187957 - DNA, 22 bp, Homo sapiens
catataattacctaccagctgg

SEQ ID NO: 9187958 - DNA, 22 bp, Homo sapiens
catataatgtttgaagatgtgg

SEQ ID NO: 9187959 - DNA, 22 bp, Homo sapiens
catataaatacaacatgtgtta

SEQ ID NO: 9187960 - DNA, 22 bp, Homo sapiens
tcaggaagtgcctaggctggcc

SEQ ID NO: 9187961 - DNA, 22 bp, Homo sapiens
tcaggaagtgcctaggctggcc

SEQ ID NO: 9187962 - DNA, 22 bp, Homo sapiens
tcaggaagtgcctaggctggcc

SEQ ID NO: 9187963 - DNA, 22 bp, Homo sapiens
tcaggaagtctcaattagctac

SEQ ID NO: 9187964 - DNA, 22 bp, Homo sapiens
tcaggaagtgcctaggctggcc

SEQ ID NO: 9187965 - DNA, 22 bp, Homo sapiens
tcaggaagtggtaaaggatgtt

SEQ ID NO: 9187966 - DNA, 22 bp, Homo sapiens
tcaggaagtggtaaaggatgtt

SEQ ID NO: 9187967 - DNA, 22 bp, Homo sapiens
tcaggaagtgctgaggctgctt

SEQ ID NO: 9187968 - DNA, 22 bp, Homo sapiens
tcaggaagtgctgaggctgctt

SEQ ID NO: 9187969 - DNA, 22 bp, Homo sapiens
catcacatcagtgtgaacagtt

SEQ ID NO: 9187970 - DNA, 22 bp, Homo sapiens
catcacagggggctagaagtct

SEQ ID NO: 9187971 - DNA, 22 bp, Homo sapiens
catcacaggtcctgatgacatt

SEQ ID NO: 9187972 - DNA, 22 bp, Homo sapiens
catcacagtttgtcagaaatca

SEQ ID NO: 9187973 - DNA, 22 bp, Homo sapiens
catccagggcagccatggcctg

SEQ ID NO: 9187974 - DNA, 22 bp, Homo sapiens
catccactagaatgacagagtt

SEQ ID NO: 9187975 - DNA, 22 bp, Homo sapiens
catccactagaatgacagagtt

SEQ ID NO: 9187976 - DNA, 22 bp, Homo sapiens
tcagggattgcaaaattcatcc

SEQ ID NO: 9187977 - DNA, 22 bp, Homo sapiens
tcagggattgcaaaattcatcc

SEQ ID NO: 9187978 - DNA, 22 bp, Homo sapiens
tcagggcatggctgcacttggc

SEQ ID NO: 9187979 - DNA, 19 bp, Homo sapiens
tcagggccatgagcgccac

SEQ ID NO: 9187980 - DNA, 22 bp, Homo sapiens
tcagggcccagagctcaggcaa

SEQ ID NO: 9187981 - DNA, 22 bp, Homo sapiens
tcagggccatcttttgcctcaa

SEQ ID NO: 9187982 - DNA, 22 bp, Homo sapiens
tcagggccatcttttgcctcaa

SEQ ID NO: 9187983 - DNA, 22 bp, Homo sapiens
tcagggccctcacttgcatagg

SEQ ID NO: 9187984 - DNA, 22 bp, Homo sapiens
catcacagaaataaacatacct

SEQ ID NO: 9187985 - DNA, 22 bp, Homo sapiens
tcagccccacggggtcagccaa

SEQ ID NO: 9187986 - DNA, 22 bp, Homo sapiens
tcagccctacattaggtaagcc

SEQ ID NO: 9187987 - DNA, 22 bp, Homo sapiens
tcagccctagaaagtctaagca

SEQ ID NO: 9187988 - DNA, 22 bp, Homo sapiens
tcagcccatcactcacgtatta

SEQ ID NO: 9187989 - DNA, 19 bp, Homo sapiens
tcagcccatcagactcaca

SEQ ID NO: 9187990 - DNA, 22 bp, Homo sapiens
tcagcccaggtcacgtaatcaa

SEQ ID NO: 9187991 - DNA, 22 bp, Homo sapiens
tcagcccagttaagaacctgtt

SEQ ID NO: 9187992 - DNA, 21 bp, Homo sapiens
tcagcccaggtgtctttgccc

SEQ ID NO: 9187993 - DNA, 22 bp, Homo sapiens
tcagcccagttttatcatctgt

SEQ ID NO: 9187994 - DNA, 22 bp, Homo sapiens
tcagcccagttttatcatctgt

SEQ ID NO: 9187995 - DNA, 22 bp, Homo sapiens
tcagccctggcactgtctccca

SEQ ID NO: 9187996 - DNA, 22 bp, Homo sapiens
tcagccctagaaagtctaagca

SEQ ID NO: 9187997 - DNA, 22 bp, Homo sapiens
tcagccctgaggacagaggcag

SEQ ID NO: 9187998 - DNA, 22 bp, Homo sapiens
tcagccctgaggacagaggcag

SEQ ID NO: 9187999 - DNA, 22 bp, Homo sapiens
tcagccctgggcttcctcatgg

SEQ ID NO: 9188000 - DNA, 22 bp, Homo sapiens
catactgtcagagcctgaaggg

SEQ ID NO: 9188001 - DNA, 22 bp, Homo sapiens
catactgtcagagcctgaaggg

SEQ ID NO: 9188002 - DNA, 22 bp, Homo sapiens
catactgtgaagcttactattt

SEQ ID NO: 9188003 - DNA, 22 bp, Homo sapiens
catactgtaagtgcaaaagtgt

SEQ ID NO: 9188004 - DNA, 22 bp, Homo sapiens
catagaaaagagtaggtaatgt

SEQ ID NO: 9188005 - DNA, 22 bp, Homo sapiens
tcaggaagtataatcagattca

SEQ ID NO: 9188006 - DNA, 22 bp, Homo sapiens
catagaaaagagtaggtaatgt

SEQ ID NO: 9188007 - DNA, 22 bp, Homo sapiens
tcagctgcagtttcacaagcac

SEQ ID NO: 9188008 - DNA, 22 bp, Homo sapiens
tcagctgcataacaaagtatga

SEQ ID NO: 9188009 - DNA, 22 bp, Homo sapiens
catacattacctaacttaatgc

SEQ ID NO: 9188010 - DNA, 22 bp, Homo sapiens
cataatttttttaagtcagaac

SEQ ID NO: 9188011 - DNA, 22 bp, Homo sapiens
catacatttatacacatctatg

SEQ ID NO: 9188012 - DNA, 22 bp, Homo sapiens
cagtttggtcatttgtcttgta

SEQ ID NO: 9188013 - DNA, 22 bp, Homo sapiens
cagtttggcagcaacatggcga

SEQ ID NO: 9188014 - DNA, 17 bp, Homo sapiens
cagtttggtggatataa

SEQ ID NO: 9188015 - DNA, 22 bp, Homo sapiens
cagtttgcataacaagagattc

SEQ ID NO: 9188016 - DNA, 22 bp, Homo sapiens
cagtttgcataacaagagattc

SEQ ID NO: 9188017 - DNA, 22 bp, Homo sapiens
cagtttctttccattgttacct

SEQ ID NO: 9188018 - DNA, 22 bp, Homo sapiens
cagtttcttctattttgaacta

SEQ ID NO: 9188019 - DNA, 17 bp, Homo sapiens
cagtttcttccccctct

SEQ ID NO: 9188020 - DNA, 22 bp, Homo sapiens
cagtttcttggatgccaatttc

SEQ ID NO: 9188021 - DNA, 20 bp, Homo sapiens
tcagcccagggtgagcatct

SEQ ID NO: 9188022 - DNA, 20 bp, Homo sapiens
tcagcccagggtgagcatct

SEQ ID NO: 9188023 - DNA, 22 bp, Homo sapiens
tcagcccaggaggttgagacta

SEQ ID NO: 9188024 - DNA, 22 bp, Homo sapiens
tcagcccagggacagaggcccc

SEQ ID NO: 9188025 - DNA, 19 bp, Homo sapiens
tcagcccaggctgggaagc

SEQ ID NO: 9188026 - DNA, 22 bp, Homo sapiens
tcagcccaggaatgagccttct

SEQ ID NO: 9188027 - DNA, 22 bp, Homo sapiens
cagtttcttcatctgcagaatc

SEQ ID NO: 9188028 - DNA, 22 bp, Homo sapiens
cagtttcttcatcagttaagca

SEQ ID NO: 9188029 - DNA, 22 bp, Homo sapiens
cagtttcttctattttgaacta

SEQ ID NO: 9188030 - DNA, 22 bp, Homo sapiens
cagtttcttcctcccccagaga

SEQ ID NO: 9188031 - DNA, 17 bp, Homo sapiens
cagtttcttccccctct

SEQ ID NO: 9188032 - DNA, 22 bp, Homo sapiens
cagtttcttcatctgcagaatc

SEQ ID NO: 9188033 - DNA, 22 bp, Homo sapiens
cagtttcttcaattcagacact

SEQ ID NO: 9188034 - DNA, 22 bp, Homo sapiens
cagtttcttagtgacacaaatc

SEQ ID NO: 9188035 - DNA, 22 bp, Homo sapiens
cagtttcttagtgacacaaatc

SEQ ID NO: 9188036 - DNA, 22 bp, Homo sapiens
cagtttcttagtgacacaaatc

SEQ ID NO: 9188037 - DNA, 22 bp, Homo sapiens
cagtttcttatcttcaaaattg

SEQ ID NO: 9188038 - DNA, 22 bp, Homo sapiens
cagtttctgttttaaatagcag

SEQ ID NO: 9188039 - DNA, 22 bp, Homo sapiens
cagtttctgttttaaatagcag

SEQ ID NO: 9188040 - DNA, 22 bp, Homo sapiens
cagtttctgttttaaatagcag

SEQ ID NO: 9188041 - DNA, 22 bp, Homo sapiens
cagtttcttaagactgagatct

SEQ ID NO: 9188042 - DNA, 22 bp, Homo sapiens
cagtttcttaagactgagatct

SEQ ID NO: 9188043 - DNA, 22 bp, Homo sapiens
cagtttcttaagactgagatct

SEQ ID NO: 9188044 - DNA, 22 bp, Homo sapiens
cagtttatatgagggtatcaag

SEQ ID NO: 9188045 - DNA, 22 bp, Homo sapiens
cagtttatatgagggtatcaag

SEQ ID NO: 9188046 - DNA, 22 bp, Homo sapiens
cagtttatatgtcagagctgta

SEQ ID NO: 9188047 - DNA, 22 bp, Homo sapiens
cagtttatatgtcagagctgta

SEQ ID NO: 9188048 - DNA, 22 bp, Homo sapiens
cagtttctctcatacatatttg

SEQ ID NO: 9188049 - DNA, 22 bp, Homo sapiens
cagtttctctcatacatatttg

SEQ ID NO: 9188050 - DNA, 22 bp, Homo sapiens
cagtttctgaggttccaggttt

SEQ ID NO: 9188051 - DNA, 22 bp, Homo sapiens
cagtttctgagccctgtcattt

SEQ ID NO: 9188052 - DNA, 22 bp, Homo sapiens
cagtttctgagccctgtcattt

SEQ ID NO: 9188053 - DNA, 22 bp, Homo sapiens
cagtttctgagccctgtcattt

SEQ ID NO: 9188054 - DNA, 22 bp, Homo sapiens
cagtttctgtggtctcttttca

SEQ ID NO: 9188055 - DNA, 22 bp, Homo sapiens
cagtttctgtctgttcttatcc

SEQ ID NO: 9188056 - DNA, 22 bp, Homo sapiens
cagtttctgggcgttcacaggt

SEQ ID NO: 9188057 - DNA, 15 bp, Homo sapiens
cagtttctgcttgaa

SEQ ID NO: 9188058 - DNA, 22 bp, Homo sapiens
cagtttctgggaggaaaggaag

SEQ ID NO: 9188059 - DNA, 22 bp, Homo sapiens
cagtttctgggaggaaaggaag

SEQ ID NO: 9188060 - DNA, 15 bp, Homo sapiens
cagtttctgatcatc

SEQ ID NO: 9188061 - DNA, 22 bp, Homo sapiens
cagtttctgaggttccaggttt

SEQ ID NO: 9188062 - DNA, 22 bp, Homo sapiens
cagtttctgccaggatgtgtta

SEQ ID NO: 9188063 - DNA, 22 bp, Homo sapiens
cagtttctgccaggatgtgtta

SEQ ID NO: 9188064 - DNA, 22 bp, Homo sapiens
tcagaaggtacagaagggaggt

SEQ ID NO: 9188065 - DNA, 22 bp, Homo sapiens
cagtttatatataagcacattg

SEQ ID NO: 9188066 - DNA, 22 bp, Homo sapiens
catgatctggtcctactgtggg

SEQ ID NO: 9188067 - DNA, 22 bp, Homo sapiens
catgataggtatttaattaaat

SEQ ID NO: 9188068 - DNA, 22 bp, Homo sapiens
catgataattgttaacaaagta

SEQ ID NO: 9188069 - DNA, 22 bp, Homo sapiens
catgagtgtcatctcagcagct

SEQ ID NO: 9188070 - DNA, 22 bp, Homo sapiens
catgagtgggcgccaggaagag

SEQ ID NO: 9188071 - DNA, 22 bp, Homo sapiens
tcagtttcacagtctgtgcaga

SEQ ID NO: 9188072 - DNA, 22 bp, Homo sapiens
tcagtttaagatgactaacaat

SEQ ID NO: 9188073 - DNA, 22 bp, Homo sapiens
tcagtttagagttatttaatct

SEQ ID NO: 9188074 - DNA, 22 bp, Homo sapiens
tcagtttagagttatttaatct

SEQ ID NO: 9188075 - DNA, 22 bp, Homo sapiens
tcagtttacctcaccttaccta

SEQ ID NO: 9188076 - DNA, 22 bp, Homo sapiens
tcagtttaatacccagatgcct

SEQ ID NO: 9188077 - DNA, 22 bp, Homo sapiens
tcagtttagatgcatttgtcgt

SEQ ID NO: 9188078 - DNA, 22 bp, Homo sapiens
tcagtttataaattgtatttag

SEQ ID NO: 9188079 - DNA, 22 bp, Homo sapiens
tcagtttataaattgtatttag

SEQ ID NO: 9188080 - DNA, 22 bp, Homo sapiens
tcagtttatttcttgttccaca

SEQ ID NO: 9188081 - DNA, 22 bp, Homo sapiens
tcagtttatagatattgctgat

SEQ ID NO: 9188082 - DNA, 22 bp, Homo sapiens
tcagtttatagatattgctgat

SEQ ID NO: 9188083 - DNA, 22 bp, Homo sapiens
tcagtttatggtctagttcatg

SEQ ID NO: 9188084 - DNA, 17 bp, Homo sapiens
tcatttgttgtgactag

SEQ ID NO: 9188085 - DNA, 22 bp, Homo sapiens
tcatttgttgaactttagtgcg

SEQ ID NO: 9188086 - DNA, 18 bp, Homo sapiens
tcatgtctcacaggtgat

SEQ ID NO: 9188087 - DNA, 22 bp, Homo sapiens
tcatgtcagtttcttctataaa

SEQ ID NO: 9188088 - DNA, 18 bp, Homo sapiens
tcatgtcactgtgctccc

SEQ ID NO: 9188089 - DNA, 18 bp, Homo sapiens
tcatgtcactgtgctccc

SEQ ID NO: 9188090 - DNA, 22 bp, Homo sapiens
tcatgtctctatgtgcctatta

SEQ ID NO: 9188091 - DNA, 22 bp, Homo sapiens
tcatgtacatgtaagtcagaaa

SEQ ID NO: 9188092 - DNA, 22 bp, Homo sapiens
tcatggtatatttcactcttta

SEQ ID NO: 9188093 - DNA, 22 bp, Homo sapiens
tcatggggctcttcaagtggag

SEQ ID NO: 9188094 - DNA, 22 bp, Homo sapiens
tcatggggtgacagaagggagg

SEQ ID NO: 9188095 - DNA, 22 bp, Homo sapiens
tcatggggtagaagcatgttta

SEQ ID NO: 9188096 - DNA, 22 bp, Homo sapiens
catctttaaaggggagacaccc

SEQ ID NO: 9188097 - DNA, 22 bp, Homo sapiens
catctttaacaatttacaatgt

SEQ ID NO: 9188098 - DNA, 22 bp, Homo sapiens
tcaggtggtcctaagtgccatc

SEQ ID NO: 9188099 - DNA, 22 bp, Homo sapiens
catccccaattagcgcccagct

SEQ ID NO: 9188100 - DNA, 22 bp, Homo sapiens
catccccaattagcgcccagct

SEQ ID NO: 9188101 - DNA, 22 bp, Homo sapiens
catccctgattcctagtacagt

SEQ ID NO: 9188102 - DNA, 22 bp, Homo sapiens
catccattaactcatttgtttc

SEQ ID NO: 9188103 - DNA, 22 bp, Homo sapiens
catccctgctggtggaaggggt

SEQ ID NO: 9188104 - DNA, 22 bp, Homo sapiens
catccctgctggtggaaggggt

SEQ ID NO: 9188105 - DNA, 22 bp, Homo sapiens
tcagttgcatgggaagttcaga

SEQ ID NO: 9188106 - DNA, 22 bp, Homo sapiens
tcagttctttatttcacagtga

SEQ ID NO: 9188107 - DNA, 22 bp, Homo sapiens
tcagttcttagtaatgcagtct

SEQ ID NO: 9188108 - DNA, 22 bp, Homo sapiens
tcagttctggctgctgctgtca

SEQ ID NO: 9188109 - DNA, 22 bp, Homo sapiens
tcagttcttattttcatgaata

SEQ ID NO: 9188110 - DNA, 22 bp, Homo sapiens
tcagttgttggaagtagatgta

SEQ ID NO: 9188111 - DNA, 20 bp, Homo sapiens
tcagtttaaatcctggcttt

SEQ ID NO: 9188112 - DNA, 20 bp, Homo sapiens
tcagtttaaatcctggcttt

SEQ ID NO: 9188113 - DNA, 22 bp, Homo sapiens
tcagttgctgtgtaatgttttc

SEQ ID NO: 9188114 - DNA, 22 bp, Homo sapiens
tcagttctaagtgctttacatg

SEQ ID NO: 9188115 - DNA, 21 bp, Homo sapiens
tcagttctctgcctgtgcttg

SEQ ID NO: 9188116 - DNA, 22 bp, Homo sapiens
tcagttctgaagttctgcctcc

SEQ ID NO: 9188117 - DNA, 22 bp, Homo sapiens
tcagttctaagtgctttacatg

SEQ ID NO: 9188118 - DNA, 19 bp, Homo sapiens
tcagttctgctcgctgtgc

SEQ ID NO: 9188119 - DNA, 19 bp, Homo sapiens
tcagttctgctcgctgtgc

SEQ ID NO: 9188120 - DNA, 22 bp, Homo sapiens
catctttgcaccctcaaaacct

SEQ ID NO: 9188121 - DNA, 22 bp, Homo sapiens
catctttcagtttataagtctg

SEQ ID NO: 9188122 - DNA, 22 bp, Homo sapiens
catctttatttatatagacagg

SEQ ID NO: 9188123 - DNA, 22 bp, Homo sapiens
catctttagggaccattattct

SEQ ID NO: 9188124 - DNA, 22 bp, Homo sapiens
tcattttcacacataaatagca

SEQ ID NO: 9188125 - DNA, 22 bp, Homo sapiens
tcattttgcagagctgaggaac

SEQ ID NO: 9188126 - DNA, 16 bp, Homo sapiens
tcattttgagtgacag

SEQ ID NO: 9188127 - DNA, 22 bp, Homo sapiens
tcattttcacacataaatagca

SEQ ID NO: 9188128 - DNA, 22 bp, Homo sapiens
tcattttcacacataaatagca

SEQ ID NO: 9188129 - DNA, 22 bp, Homo sapiens
tcattttcaagtttgaacagga

SEQ ID NO: 9188130 - DNA, 18 bp, Homo sapiens
tcatttgttttgcatgaa

SEQ ID NO: 9188131 - DNA, 22 bp, Homo sapiens
tcattttgcctgccatttgagt

SEQ ID NO: 9188132 - DNA, 22 bp, Homo sapiens
tcattttgcctgccatttgagt

SEQ ID NO: 9188133 - DNA, 22 bp, Homo sapiens
tcattttgcctgccatttgagt

SEQ ID NO: 9188134 - DNA, 22 bp, Homo sapiens
tcattttggccatgatacagac

SEQ ID NO: 9188135 - DNA, 22 bp, Homo sapiens
tcattttggggtttgtcatctt

SEQ ID NO: 9188136 - DNA, 18 bp, Homo sapiens
tcattttgtctgcctttg

SEQ ID NO: 9188137 - DNA, 22 bp, Homo sapiens
tcattttgtgccttatgaccgc

SEQ ID NO: 9188138 - DNA, 22 bp, Homo sapiens
catgattttgtcttgtgttaat

SEQ ID NO: 9188139 - DNA, 22 bp, Homo sapiens
catgcaaatgtgctaatctgaa

SEQ ID NO: 9188140 - DNA, 22 bp, Homo sapiens
catggctggtgcacctctggga

SEQ ID NO: 9188141 - DNA, 22 bp, Homo sapiens
catggcttgtcttgtcttctga

SEQ ID NO: 9188142 - DNA, 22 bp, Homo sapiens
catggctgaggcagaggactga

SEQ ID NO: 9188143 - DNA, 22 bp, Homo sapiens
catggctgcgagaagagtgggt

SEQ ID NO: 9188144 - DNA, 23 bp, Homo sapiens
catggctgatttcaagctaccac

SEQ ID NO: 9188145 - DNA, 22 bp, Homo sapiens
catgcacaacatactcaagagg

SEQ ID NO: 9188146 - DNA, 22 bp, Homo sapiens
catgcaaaggtcaagatcagga

SEQ ID NO: 9188147 - DNA, 18 bp, Homo sapiens
tccagcccacattttctg

SEQ ID NO: 9188148 - DNA, 20 bp, Homo sapiens
tccagcccagcagcctgaca

SEQ ID NO: 9188149 - DNA, 20 bp, Homo sapiens
tccagcccagcagcctgaca

SEQ ID NO: 9188150 - DNA, 22 bp, Homo sapiens
catgtcttaggaaagcagagga

SEQ ID NO: 9188151 - DNA, 22 bp, Homo sapiens
catgtctgggtatatgcatatg

SEQ ID NO: 9188152 - DNA, 23 bp, Homo sapiens
catgtctgctttcatgctacaac

SEQ ID NO: 9188153 - DNA, 23 bp, Homo sapiens
catgtctgctttcatgctacaac

SEQ ID NO: 9188154 - DNA, 18 bp, Homo sapiens
catgtctgcgccacaagg

SEQ ID NO: 9188155 - DNA, 22 bp, Homo sapiens
catgtctgccaatttggaagga

SEQ ID NO: 9188156 - DNA, 22 bp, Homo sapiens
catgtacatgcctactatcaat

SEQ ID NO: 9188157 - DNA, 22 bp, Homo sapiens
catgtctgagtagagtgtgatt

SEQ ID NO: 9188158 - DNA, 22 bp, Homo sapiens
tccagcccacacctgaagctgg

SEQ ID NO: 9188159 - DNA, 22 bp, Homo sapiens
tccagcccacacctgaagctgg

SEQ ID NO: 9188160 - DNA, 22 bp, Homo sapiens
tccagccatgcatgacaatcac

SEQ ID NO: 9188161 - DNA, 22 bp, Homo sapiens
tccagccattcattatgacacc

SEQ ID NO: 9188162 - DNA, 22 bp, Homo sapiens
tccagccatgcatgacaatcac

SEQ ID NO: 9188163 - DNA, 21 bp, Homo sapiens
tccagccagtaaatgctcagc

SEQ ID NO: 9188164 - DNA, 22 bp, Homo sapiens
tccagccatatcttgtagccct

SEQ ID NO: 9188165 - DNA, 22 bp, Homo sapiens
catggctttttagcatattcaa

SEQ ID NO: 9188166 - DNA, 21 bp, Homo sapiens
tccagccagtaaatgctcagc

SEQ ID NO: 9188167 - DNA, 22 bp, Homo sapiens
catgtctttgttatgctcacca

SEQ ID NO: 9188168 - DNA, 22 bp, Homo sapiens
catgtctttctcatcacatcta

SEQ ID NO: 9188169 - DNA, 22 bp, Homo sapiens
catgtcttgccctgattagtag

SEQ ID NO: 9188170 - DNA, 22 bp, Homo sapiens
catgtcttccttgcacacacac

SEQ ID NO: 9188171 - DNA, 22 bp, Homo sapiens
catgtctttcaaaccacacagt

SEQ ID NO: 9188172 - DNA, 22 bp, Homo sapiens
catgtcttggcttaggcacaga

SEQ ID NO: 9188173 - DNA, 22 bp, Homo sapiens
catgtcttaattggagcccaga

SEQ ID NO: 9188174 - DNA, 22 bp, Homo sapiens
catgtcttatatcctgtcttca

SEQ ID NO: 9188175 - DNA, 22 bp, Homo sapiens
catgtcttatgcggaactttca

SEQ ID NO: 9188176 - DNA, 22 bp, Homo sapiens
catgtcttatttatgcttctta

SEQ ID NO: 9188177 - DNA, 21 bp, Homo sapiens
catgtcttccacactgtagta

SEQ ID NO: 9188178 - DNA, 22 bp, Homo sapiens
catgtgcatccttaatctccct

SEQ ID NO: 9188179 - DNA, 22 bp, Homo sapiens
catgtgcatccttaatctccct

SEQ ID NO: 9188180 - DNA, 22 bp, Homo sapiens
catgtgcagggccaggcattgc

SEQ ID NO: 9188181 - DNA, 19 bp, Homo sapiens
catgtgcacatgtgaatgc

SEQ ID NO: 9188182 - DNA, 23 bp, Homo sapiens
catgtgcaggaactgtgcttttg

SEQ ID NO: 9188183 - DNA, 22 bp, Homo sapiens
catgtgagaaacagtgatgtcg

SEQ ID NO: 9188184 - DNA, 19 bp, Homo sapiens
catgtgcacatgtgaatgc

SEQ ID NO: 9188185 - DNA, 19 bp, Homo sapiens
catgtgcacatgtgaatgc

SEQ ID NO: 9188186 - DNA, 22 bp, Homo sapiens
catgtgcagactctgacaggct

SEQ ID NO: 9188187 - DNA, 22 bp, Homo sapiens
tccaggcaaagtgctgggctgc

SEQ ID NO: 9188188 - DNA, 22 bp, Homo sapiens
tccaggcaaagtgctgggctgc

SEQ ID NO: 9188189 - DNA, 22 bp, Homo sapiens
tccaggcaaagtgctgggctgc

SEQ ID NO: 9188190 - DNA, 22 bp, Homo sapiens
tccaggcaaagggactagcagg

SEQ ID NO: 9188191 - DNA, 22 bp, Homo sapiens
tccaggcaagggaggagcatgg

SEQ ID NO: 9188192 - DNA, 22 bp, Homo sapiens
tccaggcaagggaggagcatgg

SEQ ID NO: 9188193 - DNA, 22 bp, Homo sapiens
tccaggcacagagttggtcagt

SEQ ID NO: 9188194 - DNA, 22 bp, Homo sapiens
tccaggcaaagtgctgggctgc

SEQ ID NO: 9188195 - DNA, 22 bp, Homo sapiens
tccaggcaaaaaccaactacag

SEQ ID NO: 9188196 - DNA, 22 bp, Homo sapiens
tccaggcaaaaaccaactacag

SEQ ID NO: 9188197 - DNA, 22 bp, Homo sapiens
tccaggcaaagggactagcagg

SEQ ID NO: 9188198 - DNA, 22 bp, Homo sapiens
tctgacaataactgagtttaac

SEQ ID NO: 9188199 - DNA, 22 bp, Homo sapiens
tctgacaagtcaagtcttgact

SEQ ID NO: 9188200 - DNA, 22 bp, Homo sapiens
tctgacaatgaacaatctatag

SEQ ID NO: 9188201 - DNA, 21 bp, Homo sapiens
tctgacaatctcatttcaaac

SEQ ID NO: 9188202 - DNA, 21 bp, Homo sapiens
tctgacaatctcatttcaaac

SEQ ID NO: 9188203 - DNA, 22 bp, Homo sapiens
tctgacaattagcctagtcctg

SEQ ID NO: 9188204 - DNA, 22 bp, Homo sapiens
tctgacattagattaattggaa

SEQ ID NO: 9188205 - DNA, 22 bp, Homo sapiens
tctgacattagattaattggaa

SEQ ID NO: 9188206 - DNA, 21 bp, Homo sapiens
tctgacttgatctattctccc

SEQ ID NO: 9188207 - DNA, 22 bp, Homo sapiens
tctgacccagatggcaccgtgg

SEQ ID NO: 9188208 - DNA, 22 bp, Homo sapiens
tctgacattttgagaatgacat

SEQ ID NO: 9188209 - DNA, 22 bp, Homo sapiens
tctgacattttgagaatgacat

SEQ ID NO: 9188210 - DNA, 22 bp, Homo sapiens
tctgacattttgagaatgacat

SEQ ID NO: 9188211 - DNA, 22 bp, Homo sapiens
tctgagaactccgggttagatc

SEQ ID NO: 9188212 - DNA, 22 bp, Homo sapiens
tctgagaacatgctttgatcat

SEQ ID NO: 9188213 - DNA, 20 bp, Homo sapiens
tctgagaagcaaacaatgtt

SEQ ID NO: 9188214 - DNA, 22 bp, Homo sapiens
tctgagaatgagtgttttctta

SEQ ID NO: 9188215 - DNA, 22 bp, Homo sapiens
tctgagaaggtgcatcagctgc

SEQ ID NO: 9188216 - DNA, 22 bp, Homo sapiens
tctgagaagcgggagcctgtga

SEQ ID NO: 9188217 - DNA, 22 bp, Homo sapiens
tctgagaagcgtgtctctgttt

SEQ ID NO: 9188218 - DNA, 22 bp, Homo sapiens
tctgagcccagtgagtctcgca

SEQ ID NO: 9188219 - DNA, 22 bp, Homo sapiens
tctgagccagggtctcctccct

SEQ ID NO: 9188220 - DNA, 22 bp, Homo sapiens
tctgagccaatttctgtgtcca

SEQ ID NO: 9188221 - DNA, 22 bp, Homo sapiens
tctgagccaatttctgtgtcca

SEQ ID NO: 9188222 - DNA, 22 bp, Homo sapiens
tctgagccacagatgtcctgtt

SEQ ID NO: 9188223 - DNA, 22 bp, Homo sapiens
tctgagcattttaggtggtatc

SEQ ID NO: 9188224 - DNA, 22 bp, Homo sapiens
tctgagagagggtcagatgcta

SEQ ID NO: 9188225 - DNA, 23 bp, Homo sapiens
tctgagagaacaatgcctcctat

SEQ ID NO: 9188226 - DNA, 22 bp, Homo sapiens
tctgagctatccagatagtatt

SEQ ID NO: 9188227 - DNA, 22 bp, Homo sapiens
tctgagctatgtaagacttgga

SEQ ID NO: 9188228 - DNA, 22 bp, Homo sapiens
tctgagctacgatgcctgtcac

SEQ ID NO: 9188229 - DNA, 22 bp, Homo sapiens
tctgagctgcagagtggggtgg

SEQ ID NO: 9188230 - DNA, 22 bp, Homo sapiens
tctgagctgcagagtggggtgg

SEQ ID NO: 9188231 - DNA, 19 bp, Homo sapiens
tctgagctgatatgacatt

SEQ ID NO: 9188232 - DNA, 22 bp, Homo sapiens
tctgagcttctgcatttccaac

SEQ ID NO: 9188233 - DNA, 22 bp, Homo sapiens
tctgagcttctgcatttccaac

SEQ ID NO: 9188234 - DNA, 22 bp, Homo sapiens
tctgagctgtggccattcttcc

SEQ ID NO: 9188235 - DNA, 22 bp, Homo sapiens
tctgagctgggcacagaaggcg

SEQ ID NO: 9188236 - DNA, 22 bp, Homo sapiens
tctgagctgtaagtagacaagg

SEQ ID NO: 9188237 - DNA, 22 bp, Homo sapiens
tctgagctggagcccatcacct

SEQ ID NO: 9188238 - DNA, 18 bp, Homo sapiens
tctgaggtggacgaggag

SEQ ID NO: 9188239 - DNA, 22 bp, Homo sapiens
tctgaggtggacgatggagcct

SEQ ID NO: 9188240 - DNA, 17 bp, Homo sapiens
tctgatgactagaggaa

SEQ ID NO: 9188241 - DNA, 22 bp, Homo sapiens
tctgatttatatatgcagatac

SEQ ID NO: 9188242 - DNA, 22 bp, Homo sapiens
tctgatttgtagctacatgtct

SEQ ID NO: 9188243 - DNA, 22 bp, Homo sapiens
tctgcaaacccccatctatcat

SEQ ID NO: 9188244 - DNA, 22 bp, Homo sapiens
tctgcaaacttaagttgaaata

SEQ ID NO: 9188245 - DNA, 22 bp, Homo sapiens
tctgcaaactggctcttactgc

SEQ ID NO: 9188246 - DNA, 22 bp, Homo sapiens
tctgcaaacccccatctatcat

SEQ ID NO: 9188247 - DNA, 20 bp, Homo sapiens
tctgcaaacaagttttagac

SEQ ID NO: 9188248 - DNA, 22 bp, Homo sapiens
tctgcaaatattagcttagaca

SEQ ID NO: 9188249 - DNA, 22 bp, Homo sapiens
tctgcaacagtgccctgtaaat

SEQ ID NO: 9188250 - DNA, 23 bp, Homo sapiens
tctgcaagataatgaagatgata

SEQ ID NO: 9188251 - DNA, 22 bp, Homo sapiens
tctgcaagatggtcttagaggt

SEQ ID NO: 9188252 - DNA, 22 bp, Homo sapiens
tctgatgtctgaaatgctcttg

SEQ ID NO: 9188253 - DNA, 22 bp, Homo sapiens
tctgattccagagcattgctca

SEQ ID NO: 9188254 - DNA, 22 bp, Homo sapiens
tctgagggttcttggtagttgg

SEQ ID NO: 9188255 - DNA, 22 bp, Homo sapiens
tctgagggttgtagagagggac

SEQ ID NO: 9188256 - DNA, 22 bp, Homo sapiens
tctgagggttggctggctgtag

SEQ ID NO: 9188257 - DNA, 23 bp, Homo sapiens
tctgagggagtgggcagtggcac

SEQ ID NO: 9188258 - DNA, 18 bp, Homo sapiens
tctgagggtgcgggagct

SEQ ID NO: 9188259 - DNA, 22 bp, Homo sapiens
tctgagggtgaggcccagaatc

SEQ ID NO: 9188260 - DNA, 18 bp, Homo sapiens
tctgagggtgcgggagct

SEQ ID NO: 9188261 - DNA, 22 bp, Homo sapiens
tctgaggctatgttcaggctaa

SEQ ID NO: 9188262 - DNA, 22 bp, Homo sapiens
tctgaggctgcatctatgtgac

SEQ ID NO: 9188263 - DNA, 22 bp, Homo sapiens
tctgaggccctaccctgagcct

SEQ ID NO: 9188264 - DNA, 22 bp, Homo sapiens
tctgaggaatcttgacacattt

SEQ ID NO: 9188265 - DNA, 22 bp, Homo sapiens
tctgaggaactggcaaagatgg

SEQ ID NO: 9188266 - DNA, 22 bp, Homo sapiens
tctgagctttagctgggatttt

SEQ ID NO: 9188267 - DNA, 22 bp, Homo sapiens
tctgagcttctgcctgctgcaa

SEQ ID NO: 9188268 - DNA, 22 bp, Homo sapiens
tctgagctttagctgggatttt

SEQ ID NO: 9188269 - DNA, 22 bp, Homo sapiens
tctgaggaactggcaaagatgg

SEQ ID NO: 9188270 - DNA, 22 bp, Homo sapiens
tctgaggaaagagagtgggatg

SEQ ID NO: 9188271 - DNA, 22 bp, Homo sapiens
tctgaggaaaagaggaggtagc

SEQ ID NO: 9188272 - DNA, 22 bp, Homo sapiens
tctgaggccttgggacagaagt

SEQ ID NO: 9188273 - DNA, 22 bp, Homo sapiens
tctgaggctaagagacagaggc

SEQ ID NO: 9188274 - DNA, 22 bp, Homo sapiens
tctgaggccctgcaggcagtgt

SEQ ID NO: 9188275 - DNA, 22 bp, Homo sapiens
tctgaggcctgaagcagcagag

SEQ ID NO: 9188276 - DNA, 22 bp, Homo sapiens
tctgaggcctgaagcagcagag

SEQ ID NO: 9188277 - DNA, 22 bp, Homo sapiens
tctgcaagtagatgacagtgag

SEQ ID NO: 9188278 - DNA, 22 bp, Homo sapiens
tctgcacacttttattgacctc

SEQ ID NO: 9188279 - DNA, 22 bp, Homo sapiens
tctgcacatcccccaaagtatt

SEQ ID NO: 9188280 - DNA, 22 bp, Homo sapiens
tctgcagcacttaatgtttcgt

SEQ ID NO: 9188281 - DNA, 22 bp, Homo sapiens
tctgcagatttatcagcagctg

SEQ ID NO: 9188282 - DNA, 22 bp, Homo sapiens
tctgcagaagaattaaggacag

SEQ ID NO: 9188283 - DNA, 22 bp, Homo sapiens
tctgcagaactttatgagcaaa

SEQ ID NO: 9188284 - DNA, 22 bp, Homo sapiens
tctgcagaaactgtgactatgt

SEQ ID NO: 9188285 - DNA, 22 bp, Homo sapiens
tctgcagcttgcacaggcaggc

SEQ ID NO: 9188286 - DNA, 22 bp, Homo sapiens
tctgcaggaaaaaagtgcctgg

SEQ ID NO: 9188287 - DNA, 22 bp, Homo sapiens
tctgcaggaaaaaagtgcctgg

SEQ ID NO: 9188288 - DNA, 22 bp, Homo sapiens
tctgcagcttcttgccagagag

SEQ ID NO: 9188289 - DNA, 18 bp, Homo sapiens
tctgcaggacctcagggc

SEQ ID NO: 9188290 - DNA, 18 bp, Homo sapiens
tctgcaggacctcagggc

SEQ ID NO: 9188291 - DNA, 22 bp, Homo sapiens
tctgcaggaaaaaagtgcctgg

SEQ ID NO: 9188292 - DNA, 22 bp, Homo sapiens
tctgcaggaagctggcggctga

SEQ ID NO: 9188293 - DNA, 22 bp, Homo sapiens
tctgcaggactgaggcctgttt

SEQ ID NO: 9188294 - DNA, 18 bp, Homo sapiens
tctgcaggacctcagggc

SEQ ID NO: 9188295 - DNA, 22 bp, Homo sapiens
tctgcaggactgaggcctgttt

SEQ ID NO: 9188296 - DNA, 22 bp, Homo sapiens
tctgcaggagagtgccctagag

SEQ ID NO: 9188297 - DNA, 22 bp, Homo sapiens
tctgcaggatcagagccagagg

SEQ ID NO: 9188298 - DNA, 22 bp, Homo sapiens
tctgcaggatcagagccagagg

SEQ ID NO: 9188299 - DNA, 22 bp, Homo sapiens
tctgcaggaggctggctgcagg

SEQ ID NO: 9188300 - DNA, 22 bp, Homo sapiens
tctgcaggagcagggcgtggag

SEQ ID NO: 9188301 - DNA, 22 bp, Homo sapiens
tctgcaggatgcaaagtgtaca

SEQ ID NO: 9188302 - DNA, 22 bp, Homo sapiens
tctgcaggatcagagccagagg

SEQ ID NO: 9188303 - DNA, 22 bp, Homo sapiens
tctgcaggatggatgctcagaa

SEQ ID NO: 9188304 - DNA, 22 bp, Homo sapiens
tctgcaggatggatgctcagaa

SEQ ID NO: 9188305 - DNA, 22 bp, Homo sapiens
tctgcaggcctcgacaaggcca

SEQ ID NO: 9188306 - DNA, 22 bp, Homo sapiens
tctgcaggcttggagtggcagc

SEQ ID NO: 9188307 - DNA, 22 bp, Homo sapiens
tctgcaggcttggagtggcagc

SEQ ID NO: 9188308 - DNA, 22 bp, Homo sapiens
tctgcaggcttggagtggcagc

SEQ ID NO: 9188309 - DNA, 22 bp, Homo sapiens
tctgcaggctgtacaggaagca

SEQ ID NO: 9188310 - DNA, 22 bp, Homo sapiens
tctgcaggcttataggatgggt

SEQ ID NO: 9188311 - DNA, 22 bp, Homo sapiens
tctgcaggctctagatgaggtt

SEQ ID NO: 9188312 - DNA, 22 bp, Homo sapiens
tctgcaggctctagatgaggtt

SEQ ID NO: 9188313 - DNA, 22 bp, Homo sapiens
tctgcaggctctagatgaggtt

SEQ ID NO: 9188314 - DNA, 22 bp, Homo sapiens
tctgcaggctgtacaggaagca

SEQ ID NO: 9188315 - DNA, 22 bp, Homo sapiens
tctgcaggtagagctcaggaat

SEQ ID NO: 9188316 - DNA, 22 bp, Homo sapiens
tctgcagggtcccagcctcagc

SEQ ID NO: 9188317 - DNA, 22 bp, Homo sapiens
tctgcaggtaagcgttcttgga

SEQ ID NO: 9188318 - DNA, 22 bp, Homo sapiens
tctgcagggatgtgaggggtga

SEQ ID NO: 9188319 - DNA, 22 bp, Homo sapiens
tctgcagggatgtgaggggtga

SEQ ID NO: 9188320 - DNA, 17 bp, Homo sapiens
tctgcagggggccgtgt

SEQ ID NO: 9188321 - DNA, 22 bp, Homo sapiens
tctgcatattgttaatggaatg

SEQ ID NO: 9188322 - DNA, 22 bp, Homo sapiens
tctgcaggtgttggaagggtca

SEQ ID NO: 9188323 - DNA, 22 bp, Homo sapiens
tctgcaggtcacgctccagcct

SEQ ID NO: 9188324 - DNA, 22 bp, Homo sapiens
tctgcaggtagagctcaggaat

SEQ ID NO: 9188325 - DNA, 22 bp, Homo sapiens
tctgcaggtcacgctccagcct

SEQ ID NO: 9188326 - DNA, 22 bp, Homo sapiens
tctgcaggtgggcccctagaat

SEQ ID NO: 9188327 - DNA, 22 bp, Homo sapiens
tctgcatcatttttcagagccg

SEQ ID NO: 9188328 - DNA, 23 bp, Homo sapiens
tctgccagtgtgtgccaggagcc

SEQ ID NO: 9188329 - DNA, 23 bp, Homo sapiens
tctgccagtgtgtgccaggagcc

SEQ ID NO: 9188330 - DNA, 22 bp, Homo sapiens
tctgccatcaagatgctctggc

SEQ ID NO: 9188331 - DNA, 23 bp, Homo sapiens
tctgccagttccttgatcatgga

SEQ ID NO: 9188332 - DNA, 22 bp, Homo sapiens
tctgccagtttatagacaagcc

SEQ ID NO: 9188333 - DNA, 18 bp, Homo sapiens
tctgccatgtgaggacac

SEQ ID NO: 9188334 - DNA, 21 bp, Homo sapiens
tctgcccacactggccactgc

SEQ ID NO: 9188335 - DNA, 22 bp, Homo sapiens
tctgcccaaggctgtcactaga

SEQ ID NO: 9188336 - DNA, 21 bp, Homo sapiens
tctgcccacactggccactgc

SEQ ID NO: 9188337 - DNA, 19 bp, Homo sapiens
tctgcccacaagaaaggga

SEQ ID NO: 9188338 - DNA, 22 bp, Homo sapiens
tctgccaggtggggagaggcca

SEQ ID NO: 9188339 - DNA, 22 bp, Homo sapiens
tctgccaggtggggagaggcca

SEQ ID NO: 9188340 - DNA, 21 bp, Homo sapiens
tctgccaggttagattgacta

SEQ ID NO: 9188341 - DNA, 21 bp, Homo sapiens
tctgccaggttagattgacta

SEQ ID NO: 9188342 - DNA, 22 bp, Homo sapiens
tctgccagtggtttggccctga

SEQ ID NO: 9188343 - DNA, 22 bp, Homo sapiens
tctgccagtggtttggccctga

SEQ ID NO: 9188344 - DNA, 22 bp, Homo sapiens
tctgccagtggtttggccctga

SEQ ID NO: 9188345 - DNA, 22 bp, Homo sapiens
tctgccagtgccagagtacata

SEQ ID NO: 9188346 - DNA, 22 bp, Homo sapiens
tctgccagtgccagagtacata

SEQ ID NO: 9188347 - DNA, 22 bp, Homo sapiens
tctgccagtgagcggggaatta

SEQ ID NO: 9188348 - DNA, 22 bp, Homo sapiens
tctgccagtattcacggcccgt

SEQ ID NO: 9188349 - DNA, 22 bp, Homo sapiens
tctgccagtgagcggggaatta

SEQ ID NO: 9188350 - DNA, 22 bp, Homo sapiens
tctgccaggcttggtgctagat

SEQ ID NO: 9188351 - DNA, 22 bp, Homo sapiens
tctgccaggcttggtgctagat

SEQ ID NO: 9188352 - DNA, 22 bp, Homo sapiens
tctgccaggcctgcttccgggg

SEQ ID NO: 9188353 - DNA, 22 bp, Homo sapiens
tctgccaggggcacttgcggct

SEQ ID NO: 9188354 - DNA, 16 bp, Homo sapiens
tctgccagggacaggc

SEQ ID NO: 9188355 - DNA, 22 bp, Homo sapiens
tctgccaggggcacttgcggct

SEQ ID NO: 9188356 - DNA, 22 bp, Homo sapiens
tctgccacactggttcagtgga

SEQ ID NO: 9188357 - DNA, 22 bp, Homo sapiens
tctgccaggccacacagggcac

SEQ ID NO: 9188358 - DNA, 22 bp, Homo sapiens
tctgcccaggacacctgccact

SEQ ID NO: 9188359 - DNA, 18 bp, Homo sapiens
tctgcccaggacttggac

SEQ ID NO: 9188360 - DNA, 19 bp, Homo sapiens
tctgcccagttgtctgccc

SEQ ID NO: 9188361 - DNA, 20 bp, Homo sapiens
tctgcccaccccggctccca

SEQ ID NO: 9188362 - DNA, 22 bp, Homo sapiens
tctgcccacagtccaatagttg

SEQ ID NO: 9188363 - DNA, 21 bp, Homo sapiens
tctgcccacactggccactgc

SEQ ID NO: 9188364 - DNA, 19 bp, Homo sapiens
tctgcccagttgtctgccc

SEQ ID NO: 9188365 - DNA, 22 bp, Homo sapiens
tctgcccagtttgtgctcaggt

SEQ ID NO: 9188366 - DNA, 22 bp, Homo sapiens
tctgcccctgctgggcacagag

SEQ ID NO: 9188367 - DNA, 22 bp, Homo sapiens
tctgcccctgctgggcacagag

SEQ ID NO: 9188368 - DNA, 18 bp, Homo sapiens
tctgccccagccgcactg

SEQ ID NO: 9188369 - DNA, 22 bp, Homo sapiens
tctgccctaattcagtgcttag

SEQ ID NO: 9188370 - DNA, 21 bp, Homo sapiens
tctgccctccaggagctcata

SEQ ID NO: 9188371 - DNA, 22 bp, Homo sapiens
tctgcctgagggagctgaggaa

SEQ ID NO: 9188372 - DNA, 22 bp, Homo sapiens
tctgcctgccagtctggtcctc

SEQ ID NO: 9188373 - DNA, 22 bp, Homo sapiens
tctgcctgccgagaacacctac

SEQ ID NO: 9188374 - DNA, 22 bp, Homo sapiens
tctgcctgcagtgtggcagggc

SEQ ID NO: 9188375 - DNA, 22 bp, Homo sapiens
tctgcctgccagtctggtcctc

SEQ ID NO: 9188376 - DNA, 18 bp, Homo sapiens
tctgccctgccattcact

SEQ ID NO: 9188377 - DNA, 18 bp, Homo sapiens
tctgccctgccattcact

SEQ ID NO: 9188378 - DNA, 22 bp, Homo sapiens
tctgccctgcagggagcagtaa

SEQ ID NO: 9188379 - DNA, 22 bp, Homo sapiens
tctgcctgagcagagggaggcc

SEQ ID NO: 9188380 - DNA, 22 bp, Homo sapiens
tctgcctggctcatggcagtga

SEQ ID NO: 9188381 - DNA, 22 bp, Homo sapiens
tctgcctgtaatatttggagaa

SEQ ID NO: 9188382 - DNA, 22 bp, Homo sapiens
tctgcctggattttggaaagct

SEQ ID NO: 9188383 - DNA, 22 bp, Homo sapiens
tctgcctggatgatggcagggc

SEQ ID NO: 9188384 - DNA, 22 bp, Homo sapiens
tctgcctgctaactcctgcacc

SEQ ID NO: 9188385 - DNA, 19 bp, Homo sapiens
tctgcctgcttgtaggggc

SEQ ID NO: 9188386 - DNA, 22 bp, Homo sapiens
tctgctcagtgcttatctctaa

SEQ ID NO: 9188387 - DNA, 22 bp, Homo sapiens
tctgctcataccccatggtttc

SEQ ID NO: 9188388 - DNA, 20 bp, Homo sapiens
tctgctcagccctcagtggc

SEQ ID NO: 9188389 - DNA, 22 bp, Homo sapiens
tctgccttgatggcattgagaa

SEQ ID NO: 9188390 - DNA, 22 bp, Homo sapiens
tctgcctgtggtggaggaagtt

SEQ ID NO: 9188391 - DNA, 22 bp, Homo sapiens
tctggagaatctgtcagtgtgg

SEQ ID NO: 9188392 - DNA, 22 bp, Homo sapiens
tctggagaagcccagggagctg

SEQ ID NO: 9188393 - DNA, 22 bp, Homo sapiens
tctggagaagcccagggagctg

SEQ ID NO: 9188394 - DNA, 22 bp, Homo sapiens
tctggagaacttgcaagaggat

SEQ ID NO: 9188395 - DNA, 22 bp, Homo sapiens
tctggagaacttgcaagaggat

SEQ ID NO: 9188396 - DNA, 22 bp, Homo sapiens
tctggagaagcagtgagagtca

SEQ ID NO: 9188397 - DNA, 22 bp, Homo sapiens
tctggagaagcagtgagagtca

SEQ ID NO: 9188398 - DNA, 22 bp, Homo sapiens
tctggagaagaaacttgctctg

SEQ ID NO: 9188399 - DNA, 22 bp, Homo sapiens
tctggagaaagttgagtttgtg

SEQ ID NO: 9188400 - DNA, 22 bp, Homo sapiens
tctggagaaagttgagtttgtg

SEQ ID NO: 9188401 - DNA, 22 bp, Homo sapiens
tctggagagatcttccacaaca

SEQ ID NO: 9188402 - DNA, 22 bp, Homo sapiens
tctggagaggaggatgtggaca

SEQ ID NO: 9188403 - DNA, 22 bp, Homo sapiens
tctggagagcagatgcctctgg

SEQ ID NO: 9188404 - DNA, 22 bp, Homo sapiens
tctggagaggggcctagaattt

SEQ ID NO: 9188405 - DNA, 22 bp, Homo sapiens
tctggagaggggcctagaattt

SEQ ID NO: 9188406 - DNA, 22 bp, Homo sapiens
tctggagaggaggatgtggaca

SEQ ID NO: 9188407 - DNA, 22 bp, Homo sapiens
tctggagaggaggatgtggaca

SEQ ID NO: 9188408 - DNA, 22 bp, Homo sapiens
tctggagagtcacagtgccaga

SEQ ID NO: 9188409 - DNA, 22 bp, Homo sapiens
tctggagagtcctgctcacgtc

SEQ ID NO: 9188410 - DNA, 22 bp, Homo sapiens
tctggagataagacagacagat

SEQ ID NO: 9188411 - DNA, 22 bp, Homo sapiens
tctggagataagcagcaatgaa

SEQ ID NO: 9188412 - DNA, 22 bp, Homo sapiens
tctggagagtcctgctcacgtc

SEQ ID NO: 9188413 - DNA, 22 bp, Homo sapiens
tctggagagtcacagtgccaga

SEQ ID NO: 9188414 - DNA, 21 bp, Homo sapiens
tctggaccaccttgtaaagct

SEQ ID NO: 9188415 - DNA, 22 bp, Homo sapiens
tctggaccctgggctgtgattt

SEQ ID NO: 9188416 - DNA, 22 bp, Homo sapiens
tctggacgtgttggtgaggacc

SEQ ID NO: 9188417 - DNA, 22 bp, Homo sapiens
tctggaagttagaggaggaaag

SEQ ID NO: 9188418 - DNA, 22 bp, Homo sapiens
tctggaaggaagagctgagtcc

SEQ ID NO: 9188419 - DNA, 22 bp, Homo sapiens
tctggaagctggagtccaggaa

SEQ ID NO: 9188420 - DNA, 22 bp, Homo sapiens
tctggaagaacggggcatgctg

SEQ ID NO: 9188421 - DNA, 22 bp, Homo sapiens
tctgctgttcattcttttagct

SEQ ID NO: 9188422 - DNA, 22 bp, Homo sapiens
tctgctgttcattcttttagct

SEQ ID NO: 9188423 - DNA, 22 bp, Homo sapiens
tctgctgtgttgaatgattggt

SEQ ID NO: 9188424 - DNA, 22 bp, Homo sapiens
tctgctgtgatttgctacctgt

SEQ ID NO: 9188425 - DNA, 22 bp, Homo sapiens
tctgctgtgggtctatatttta

SEQ ID NO: 9188426 - DNA, 22 bp, Homo sapiens
tctgctgtgggtctatatttta

SEQ ID NO: 9188427 - DNA, 22 bp, Homo sapiens
tctgctgtgggcagagacccct

SEQ ID NO: 9188428 - DNA, 22 bp, Homo sapiens
tctgctgtattaggttgaactg

SEQ ID NO: 9188429 - DNA, 22 bp, Homo sapiens
tctgctgtattaggttgaactg

SEQ ID NO: 9188430 - DNA, 22 bp, Homo sapiens
tctgctgtcactcatttgcttc

SEQ ID NO: 9188431 - DNA, 22 bp, Homo sapiens
tctgctgtcctttatatagatt

SEQ ID NO: 9188432 - DNA, 22 bp, Homo sapiens
tctgctgctgagcacactccta

SEQ ID NO: 9188433 - DNA, 22 bp, Homo sapiens
tctgctggccttagcaggtcta

SEQ ID NO: 9188434 - DNA, 20 bp, Homo sapiens
tctgctggccaaaacttcac

SEQ ID NO: 9188435 - DNA, 22 bp, Homo sapiens
tctgctgtaaccttcagaggta

SEQ ID NO: 9188436 - DNA, 22 bp, Homo sapiens
tctgctgtaaagaatttctgcc

SEQ ID NO: 9188437 - DNA, 22 bp, Homo sapiens
tctgctgatgtgtggtgcttca

SEQ ID NO: 9188438 - DNA, 22 bp, Homo sapiens
tctgctgaggtggttttagaga

SEQ ID NO: 9188439 - DNA, 22 bp, Homo sapiens
tctgctgacctttctctgacac

SEQ ID NO: 9188440 - DNA, 22 bp, Homo sapiens
tctgctgaatcagatagctaag

SEQ ID NO: 9188441 - DNA, 22 bp, Homo sapiens
tctgctgaatcagatagctaag

SEQ ID NO: 9188442 - DNA, 22 bp, Homo sapiens
tctgctgctgaccaacactgtg

SEQ ID NO: 9188443 - DNA, 22 bp, Homo sapiens
tctgctgcctgcagggcagaga

SEQ ID NO: 9188444 - DNA, 22 bp, Homo sapiens
tctgctgcctcggtgtgggtac

SEQ ID NO: 9188445 - DNA, 22 bp, Homo sapiens
tctgctgccaccttgtggtgag

SEQ ID NO: 9188446 - DNA, 22 bp, Homo sapiens
tctgctgccatgcagagcagta

SEQ ID NO: 9188447 - DNA, 22 bp, Homo sapiens
tctgctgcagagctgcgggtgc

SEQ ID NO: 9188448 - DNA, 17 bp, Homo sapiens
tctgctctgccaatcca

SEQ ID NO: 9188449 - DNA, 22 bp, Homo sapiens
tctgctctccatacttccgcac

SEQ ID NO: 9188450 - DNA, 22 bp, Homo sapiens
tctgctctccatacttccgcac

SEQ ID NO: 9188451 - DNA, 18 bp, Homo sapiens
tctggagggaagctttga

SEQ ID NO: 9188452 - DNA, 22 bp, Homo sapiens
tctggagggcccacatccacaa

SEQ ID NO: 9188453 - DNA, 23 bp, Homo sapiens
tctggaggggacactgcagatgc

SEQ ID NO: 9188454 - DNA, 22 bp, Homo sapiens
tctggaggggtttagagggaca

SEQ ID NO: 9188455 - DNA, 22 bp, Homo sapiens
tctggaggggtttagagggaca

SEQ ID NO: 9188456 - DNA, 21 bp, Homo sapiens
tctggagccctaagctgagaa

SEQ ID NO: 9188457 - DNA, 21 bp, Homo sapiens
tctggagccctaagctgagaa

SEQ ID NO: 9188458 - DNA, 22 bp, Homo sapiens
tctggagcaacagagcaggaca

SEQ ID NO: 9188459 - DNA, 22 bp, Homo sapiens
tctggagcaacagagcaggaca

SEQ ID NO: 9188460 - DNA, 22 bp, Homo sapiens
tctggagataagcagcaatgaa

SEQ ID NO: 9188461 - DNA, 22 bp, Homo sapiens
tctggagataagcagcaatgaa

SEQ ID NO: 9188462 - DNA, 22 bp, Homo sapiens
tctggagtaactctgtttctgg

SEQ ID NO: 9188463 - DNA, 22 bp, Homo sapiens
tctggagtaattacagtgactg

SEQ ID NO: 9188464 - DNA, 20 bp, Homo sapiens
tctggagtagagcacaggca

SEQ ID NO: 9188465 - DNA, 21 bp, Homo sapiens
tctggagtcatctttaccata

SEQ ID NO: 9188466 - DNA, 22 bp, Homo sapiens
tctggagtatgtgtgaacggtg

SEQ ID NO: 9188467 - DNA, 22 bp, Homo sapiens
tctggagtagggtctgggaatt

SEQ ID NO: 9188468 - DNA, 22 bp, Homo sapiens
tctggagtaggacctgaaaata

SEQ ID NO: 9188469 - DNA, 22 bp, Homo sapiens
tctggagtatgtccctggtgaa

SEQ ID NO: 9188470 - DNA, 22 bp, Homo sapiens
tctggagtctaaagaaccaaaa

SEQ ID NO: 9188471 - DNA, 22 bp, Homo sapiens
tctggagtctgagatctgagga

SEQ ID NO: 9188472 - DNA, 22 bp, Homo sapiens
tctggagtcctggaatcagcta

SEQ ID NO: 9188473 - DNA, 22 bp, Homo sapiens
tctggagtccagatccatttgg

SEQ ID NO: 9188474 - DNA, 22 bp, Homo sapiens
tctggagtggacccagagcact

SEQ ID NO: 9188475 - DNA, 22 bp, Homo sapiens
tctggagtgaatgaagtagtgt

SEQ ID NO: 9188476 - DNA, 22 bp, Homo sapiens
tctggagtgccctgctctgccc

SEQ ID NO: 9188477 - DNA, 22 bp, Homo sapiens
tctggagtctggtggttatggt

SEQ ID NO: 9188478 - DNA, 22 bp, Homo sapiens
tctggatctccctcatcctggg

SEQ ID NO: 9188479 - DNA, 22 bp, Homo sapiens
tctggatgaaagggctatatat

SEQ ID NO: 9188480 - DNA, 22 bp, Homo sapiens
tctggatgaagacccagaggct

SEQ ID NO: 9188481 - DNA, 22 bp, Homo sapiens
tctggatgacagaatggtcata

SEQ ID NO: 9188482 - DNA, 22 bp, Homo sapiens
tctggatgctctgagcccaagg

SEQ ID NO: 9188483 - DNA, 22 bp, Homo sapiens
tctggatgggatgaggcaacaa

SEQ ID NO: 9188484 - DNA, 22 bp, Homo sapiens
tctggatgacagaatggtcata

SEQ ID NO: 9188485 - DNA, 22 bp, Homo sapiens
tctggatgagattaatggtgtg

SEQ ID NO: 9188486 - DNA, 22 bp, Homo sapiens
tctggatgatatgtgaacttga

SEQ ID NO: 9188487 - DNA, 22 bp, Homo sapiens
tctggatttgtggaaaatctgc

SEQ ID NO: 9188488 - DNA, 22 bp, Homo sapiens
tctggattttggatatcaggct

SEQ ID NO: 9188489 - DNA, 22 bp, Homo sapiens
tctggattttcttcgtaaggat

SEQ ID NO: 9188490 - DNA, 22 bp, Homo sapiens
tctggatttgtcatctttaggg

SEQ ID NO: 9188491 - DNA, 22 bp, Homo sapiens
tctggatttcagttctaaatct

SEQ ID NO: 9188492 - DNA, 22 bp, Homo sapiens
tctggatttgagctcagttgta

SEQ ID NO: 9188493 - DNA, 22 bp, Homo sapiens
tctggatttctgcctctacctc

SEQ ID NO: 9188494 - DNA, 22 bp, Homo sapiens
tctggattgaggtgcaggcatt

SEQ ID NO: 9188495 - DNA, 22 bp, Homo sapiens
tctggattcttttggtagttct

SEQ ID NO: 9188496 - DNA, 22 bp, Homo sapiens
tctggattctgaggtgggtgca

SEQ ID NO: 9188497 - DNA, 22 bp, Homo sapiens
tctggattctgtactgtaaagt

SEQ ID NO: 9188498 - DNA, 22 bp, Homo sapiens
tctggattgtggctattgttct

SEQ ID NO: 9188499 - DNA, 22 bp, Homo sapiens
tctggattgcacttgtgggcca

SEQ ID NO: 9188500 - DNA, 22 bp, Homo sapiens
tctggatttcaaggatggattg

SEQ ID NO: 9188501 - DNA, 22 bp, Homo sapiens
tctggatttaaatctcaatgct

SEQ ID NO: 9188502 - DNA, 22 bp, Homo sapiens
tctggattgttacacagagggc

SEQ ID NO: 9188503 - DNA, 22 bp, Homo sapiens
tctggatgttgcggagtacaga

SEQ ID NO: 9188504 - DNA, 22 bp, Homo sapiens
tctggattaactgctgtttatt

SEQ ID NO: 9188505 - DNA, 22 bp, Homo sapiens
tctggattaacctgatgtagga

SEQ ID NO: 9188506 - DNA, 22 bp, Homo sapiens
tctggattagatgctttcaaga

SEQ ID NO: 9188507 - DNA, 22 bp, Homo sapiens
tctggattcaagtccctgtttt

SEQ ID NO: 9188508 - DNA, 22 bp, Homo sapiens
tctggattcacctttagtacct

SEQ ID NO: 9188509 - DNA, 22 bp, Homo sapiens
tctggattctaaggtgtttact

SEQ ID NO: 9188510 - DNA, 17 bp, Homo sapiens
tctggatgtcatggaag

SEQ ID NO: 9188511 - DNA, 22 bp, Homo sapiens
tctggagtttgagcacttcaat

SEQ ID NO: 9188512 - DNA, 22 bp, Homo sapiens
tctggagttgtgcagtggacct

SEQ ID NO: 9188513 - DNA, 22 bp, Homo sapiens
tctggagtttgaggacaagctt

SEQ ID NO: 9188514 - DNA, 22 bp, Homo sapiens
tctggagttttttctgtctgtg

SEQ ID NO: 9188515 - DNA, 22 bp, Homo sapiens
tctggagttcctgcaggctgtg

SEQ ID NO: 9188516 - DNA, 22 bp, Homo sapiens
tctggagttgagagtgtgcgag

SEQ ID NO: 9188517 - DNA, 22 bp, Homo sapiens
tctggagttgaagttcttcccc

SEQ ID NO: 9188518 - DNA, 22 bp, Homo sapiens
tctggagttgcatgttttggct

SEQ ID NO: 9188519 - DNA, 22 bp, Homo sapiens
tctggagtggcagtcatctgaa

SEQ ID NO: 9188520 - DNA, 22 bp, Homo sapiens
tctggagtgggactttgcatct

SEQ ID NO: 9188521 - DNA, 22 bp, Homo sapiens
tctggagtgtccagttctactc

SEQ ID NO: 9188522 - DNA, 22 bp, Homo sapiens
tctggagtggagctgatcattt

SEQ ID NO: 9188523 - DNA, 22 bp, Homo sapiens
tctggagtggaggtgccttggg

SEQ ID NO: 9188524 - DNA, 22 bp, Homo sapiens
tctggagtgtgtgtattcagct

SEQ ID NO: 9188525 - DNA, 22 bp, Homo sapiens
tctggagtgtttctaattactg

SEQ ID NO: 9188526 - DNA, 22 bp, Homo sapiens
tctggagttcctgcaggctgtg

SEQ ID NO: 9188527 - DNA, 22 bp, Homo sapiens
tctggagttagttataatggtt

SEQ ID NO: 9188528 - DNA, 22 bp, Homo sapiens
tctggagttactgctggctttg

SEQ ID NO: 9188529 - DNA, 22 bp, Homo sapiens
tctggccacccgaggcccctgc

SEQ ID NO: 9188530 - DNA, 22 bp, Homo sapiens
tctggcccagcccctgaggtca

SEQ ID NO: 9188531 - DNA, 22 bp, Homo sapiens
tctggcccagcccctgaggtca

SEQ ID NO: 9188532 - DNA, 22 bp, Homo sapiens
tctggcccagcccctgatccca

SEQ ID NO: 9188533 - DNA, 22 bp, Homo sapiens
tctggcagtggatgagggcagc

SEQ ID NO: 9188534 - DNA, 22 bp, Homo sapiens
tctggcatcactcgcaagagca

SEQ ID NO: 9188535 - DNA, 22 bp, Homo sapiens
tctggcaggtcaatcattcttt

SEQ ID NO: 9188536 - DNA, 22 bp, Homo sapiens
tctggcagtgaagtcatgaggt

SEQ ID NO: 9188537 - DNA, 20 bp, Homo sapiens
tctggcaggtgaacgagctg

SEQ ID NO: 9188538 - DNA, 22 bp, Homo sapiens
tctggcaccactgagtctgcag

SEQ ID NO: 9188539 - DNA, 22 bp, Homo sapiens
tctggcacatagcagggtctct

SEQ ID NO: 9188540 - DNA, 22 bp, Homo sapiens
tctggcaaaggcaaccacagtt

SEQ ID NO: 9188541 - DNA, 22 bp, Homo sapiens
tctggcaaaggcaaccacagtt

SEQ ID NO: 9188542 - DNA, 22 bp, Homo sapiens
tctggcaccactgagtctgcag

SEQ ID NO: 9188543 - DNA, 22 bp, Homo sapiens
tctggcagagtcagtgcacaca

SEQ ID NO: 9188544 - DNA, 23 bp, Homo sapiens
tctggctgctcctttcaatgctc

SEQ ID NO: 9188545 - DNA, 22 bp, Homo sapiens
tctggctgctgcgtgagtgctt

SEQ ID NO: 9188546 - DNA, 22 bp, Homo sapiens
tctggctggctcggccgggagt

SEQ ID NO: 9188547 - DNA, 22 bp, Homo sapiens
tctggctggcagtgatggtgtg

SEQ ID NO: 9188548 - DNA, 22 bp, Homo sapiens
tctggctggcagtgatggtgtg

SEQ ID NO: 9188549 - DNA, 22 bp, Homo sapiens
tctggctggcagtgatggtgtg

SEQ ID NO: 9188550 - DNA, 22 bp, Homo sapiens
tctggctgattccctgggactg

SEQ ID NO: 9188551 - DNA, 22 bp, Homo sapiens
tctggctgattccctgggactg

SEQ ID NO: 9188552 - DNA, 22 bp, Homo sapiens
tctggctgccaccatcctcccc

SEQ ID NO: 9188553 - DNA, 22 bp, Homo sapiens
tctggctgtcattggaggcccc

SEQ ID NO: 9188554 - DNA, 22 bp, Homo sapiens
tctggctgtgtaaggtagcacc

SEQ ID NO: 9188555 - DNA, 22 bp, Homo sapiens
tctggctttcctggagcaagaa

SEQ ID NO: 9188556 - DNA, 22 bp, Homo sapiens
tctggctttcatttgtttaaag

SEQ ID NO: 9188557 - DNA, 22 bp, Homo sapiens
tctggctttctcagcatggcat

SEQ ID NO: 9188558 - DNA, 22 bp, Homo sapiens
tctggctttcctggagcaagaa

SEQ ID NO: 9188559 - DNA, 22 bp, Homo sapiens
tctggctttctcagcatggcat

SEQ ID NO: 9188560 - DNA, 22 bp, Homo sapiens
tctggctttctgactctacaac

SEQ ID NO: 9188561 - DNA, 21 bp, Homo sapiens
tctggctttcattccccttct

SEQ ID NO: 9188562 - DNA, 23 bp, Homo sapiens
tctggctttcacgggtattctta

SEQ ID NO: 9188563 - DNA, 22 bp, Homo sapiens
tctgggaaccaaagggtgctta

SEQ ID NO: 9188564 - DNA, 22 bp, Homo sapiens
tctgggaaccaaagggtgctta

SEQ ID NO: 9188565 - DNA, 22 bp, Homo sapiens
tctgggaacattttgagggcaa

SEQ ID NO: 9188566 - DNA, 22 bp, Homo sapiens
tctgggaagctgcgtgcctgtt

SEQ ID NO: 9188567 - DNA, 22 bp, Homo sapiens
tctgggaagatgtttcaaaggt

SEQ ID NO: 9188568 - DNA, 22 bp, Homo sapiens
tctgggaagatgtttcaaaggt

SEQ ID NO: 9188569 - DNA, 22 bp, Homo sapiens
tctgggaagcctgtatgcagaa

SEQ ID NO: 9188570 - DNA, 19 bp, Homo sapiens
tctgggaagccgggctcca

SEQ ID NO: 9188571 - DNA, 21 bp, Homo sapiens
tctgggaaattgggaaagaag

SEQ ID NO: 9188572 - DNA, 22 bp, Homo sapiens
tctgggaacagcttagctccag

SEQ ID NO: 9188573 - DNA, 22 bp, Homo sapiens
tctgggaacagcctggctgtgt

SEQ ID NO: 9188574 - DNA, 22 bp, Homo sapiens
tctgggaacagcctggctgtgt

SEQ ID NO: 9188575 - DNA, 22 bp, Homo sapiens
tctgggaaagtaaatgtaaagg

SEQ ID NO: 9188576 - DNA, 22 bp, Homo sapiens
tctgggaaacactgcatcccca

SEQ ID NO: 9188577 - DNA, 22 bp, Homo sapiens
tctggcttttctcttggatggt

SEQ ID NO: 9188578 - DNA, 22 bp, Homo sapiens
tctggcttttattcagttggca

SEQ ID NO: 9188579 - DNA, 18 bp, Homo sapiens
tctggctttgttccttgt

SEQ ID NO: 9188580 - DNA, 22 bp, Homo sapiens
tctggcttttatgggatgagag

SEQ ID NO: 9188581 - DNA, 23 bp, Homo sapiens
tctggctttgctggaagttttga

SEQ ID NO: 9188582 - DNA, 23 bp, Homo sapiens
tctggctttgctggaagttttga

SEQ ID NO: 9188583 - DNA, 22 bp, Homo sapiens
tctggctttctgactctacaac

SEQ ID NO: 9188584 - DNA, 23 bp, Homo sapiens
tctggctttgctggaagttttga

SEQ ID NO: 9188585 - DNA, 22 bp, Homo sapiens
tctggctttggatttgaagggt

SEQ ID NO: 9188586 - DNA, 22 bp, Homo sapiens
tctggctctataactcctagct

SEQ ID NO: 9188587 - DNA, 22 bp, Homo sapiens
tctggctctaactaggcatcag

SEQ ID NO: 9188588 - DNA, 22 bp, Homo sapiens
tctggctctaactaggcatcag

SEQ ID NO: 9188589 - DNA, 23 bp, Homo sapiens
tctggctctatgtgacagctctc

SEQ ID NO: 9188590 - DNA, 22 bp, Homo sapiens
tctggctctccagtgctcttag

SEQ ID NO: 9188591 - DNA, 22 bp, Homo sapiens
tctggctctcatactcgccagt

SEQ ID NO: 9188592 - DNA, 22 bp, Homo sapiens
tctggctcggatttgtctagca

SEQ ID NO: 9188593 - DNA, 22 bp, Homo sapiens
tctggctcctggctccactgcc

SEQ ID NO: 9188594 - DNA, 22 bp, Homo sapiens
tctggctcggatttgtctagca

SEQ ID NO: 9188595 - DNA, 22 bp, Homo sapiens
tctggctcctggctccactgcc

SEQ ID NO: 9188596 - DNA, 22 bp, Homo sapiens
tctggctcctgagtccatgctc

SEQ ID NO: 9188597 - DNA, 19 bp, Homo sapiens
tctggctcctgccaggctg

SEQ ID NO: 9188598 - DNA, 22 bp, Homo sapiens
tctggctctggagtccacctgc

SEQ ID NO: 9188599 - DNA, 22 bp, Homo sapiens
tctggctctgacactactgtta

SEQ ID NO: 9188600 - DNA, 22 bp, Homo sapiens
tctggctctgaattcacttctg

SEQ ID NO: 9188601 - DNA, 22 bp, Homo sapiens
tctggctgaaaggggctgtgcc

SEQ ID NO: 9188602 - DNA, 22 bp, Homo sapiens
tctggctgaaaggggctgtgcc

SEQ ID NO: 9188603 - DNA, 22 bp, Homo sapiens
tctggctctttgggtgattgta

SEQ ID NO: 9188604 - DNA, 20 bp, Homo sapiens
tctggctctttgctcctccc

SEQ ID NO: 9188605 - DNA, 23 bp, Homo sapiens
tctggctccatccttggggatcc

SEQ ID NO: 9188606 - DNA, 23 bp, Homo sapiens
tctggctccatccttggggatcc

SEQ ID NO: 9188607 - DNA, 22 bp, Homo sapiens
tctggctcccagcctgctctca

SEQ ID NO: 9188608 - DNA, 19 bp, Homo sapiens
tctggctccgcctcttagt

SEQ ID NO: 9188609 - DNA, 22 bp, Homo sapiens
tctggctccgtgtccgctccca

SEQ ID NO: 9188610 - DNA, 22 bp, Homo sapiens
tctggctccactctgtgcatgc

SEQ ID NO: 9188611 - DNA, 22 bp, Homo sapiens
tctggctccactttcttcattt

SEQ ID NO: 9188612 - DNA, 22 bp, Homo sapiens
tctggctccactctgtgcatgc

SEQ ID NO: 9188613 - DNA, 22 bp, Homo sapiens
tctggctccacacctcactgca

SEQ ID NO: 9188614 - DNA, 22 bp, Homo sapiens
tctggccccggtcttcacagct

SEQ ID NO: 9188615 - DNA, 22 bp, Homo sapiens
tctggccccggtcttcacagct

SEQ ID NO: 9188616 - DNA, 22 bp, Homo sapiens
tctggccccgcatgcactttat

SEQ ID NO: 9188617 - DNA, 22 bp, Homo sapiens
tctggccccgcatgcactttat

SEQ ID NO: 9188618 - DNA, 22 bp, Homo sapiens
tctggccctatggcatgtacct

SEQ ID NO: 9188619 - DNA, 21 bp, Homo sapiens
tctggccctaggttgggcctc

SEQ ID NO: 9188620 - DNA, 22 bp, Homo sapiens
tctggcccctggtctctggtgt

SEQ ID NO: 9188621 - DNA, 22 bp, Homo sapiens
tctggcccctggtctctggtgt

SEQ ID NO: 9188622 - DNA, 22 bp, Homo sapiens
tctgggattttatagacatgct

SEQ ID NO: 9188623 - DNA, 22 bp, Homo sapiens
tctgggcactgctgagcctgta

SEQ ID NO: 9188624 - DNA, 22 bp, Homo sapiens
tctgggcagccatgtgcctggc

SEQ ID NO: 9188625 - DNA, 22 bp, Homo sapiens
tctgggcagcagcagctagtag

SEQ ID NO: 9188626 - DNA, 22 bp, Homo sapiens
tctgggcagcctcaggccaggg

SEQ ID NO: 9188627 - DNA, 19 bp, Homo sapiens
tctgggcagggccagcacc

SEQ ID NO: 9188628 - DNA, 21 bp, Homo sapiens
tctgggcccatgctgcctcac

SEQ ID NO: 9188629 - DNA, 22 bp, Homo sapiens
tctgggctcttagtgtaccctc

SEQ ID NO: 9188630 - DNA, 23 bp, Homo sapiens
tctgggctgagctcgagtgtaga

SEQ ID NO: 9188631 - DNA, 23 bp, Homo sapiens
tctgggctgagacttggaaggtc

SEQ ID NO: 9188632 - DNA, 22 bp, Homo sapiens
tctgggctgaaatgaaggcctt

SEQ ID NO: 9188633 - DNA, 22 bp, Homo sapiens
tctgggctgaaatgaaggcctt

SEQ ID NO: 9188634 - DNA, 22 bp, Homo sapiens
tctgggctgctatgaggcagag

SEQ ID NO: 9188635 - DNA, 22 bp, Homo sapiens
tctgggctgctgtgcagtgacc

SEQ ID NO: 9188636 - DNA, 21 bp, Homo sapiens
tctgggctgctgctgcccatc

SEQ ID NO: 9188637 - DNA, 22 bp, Homo sapiens
tctgggagggagcctcagaatc

SEQ ID NO: 9188638 - DNA, 22 bp, Homo sapiens
tctgggaggggctgccattgct

SEQ ID NO: 9188639 - DNA, 22 bp, Homo sapiens
tctgggagagtcacaggcattg

SEQ ID NO: 9188640 - DNA, 22 bp, Homo sapiens
tctgggagggagcctcagaatc

SEQ ID NO: 9188641 - DNA, 22 bp, Homo sapiens
tctgggaggtaaccatgctgat

SEQ ID NO: 9188642 - DNA, 22 bp, Homo sapiens
tctgggaggtaaccatgctgat

SEQ ID NO: 9188643 - DNA, 22 bp, Homo sapiens
tctgggaggtaaccatgctgat

SEQ ID NO: 9188644 - DNA, 22 bp, Homo sapiens
tctgggaggtaaccatgctgat

SEQ ID NO: 9188645 - DNA, 22 bp, Homo sapiens
tctgggaggtaaccatgctgat

SEQ ID NO: 9188646 - DNA, 22 bp, Homo sapiens
tctgggaggtcacattggtctt

SEQ ID NO: 9188647 - DNA, 22 bp, Homo sapiens
tctgggagttagaatacatggg

SEQ ID NO: 9188648 - DNA, 22 bp, Homo sapiens
tctgggagttagaatacatggg

SEQ ID NO: 9188649 - DNA, 22 bp, Homo sapiens
tctgggagtgtgtctggccatc

SEQ ID NO: 9188650 - DNA, 22 bp, Homo sapiens
tctgggagttagaatacatggg

SEQ ID NO: 9188651 - DNA, 22 bp, Homo sapiens
tctgggagtgtgtctggccatc

SEQ ID NO: 9188652 - DNA, 22 bp, Homo sapiens
tctgggaggtgttttgagaact

SEQ ID NO: 9188653 - DNA, 22 bp, Homo sapiens
tctgggaggtgttttgagaact

SEQ ID NO: 9188654 - DNA, 22 bp, Homo sapiens
tctgggaggtggcagggtgcat

SEQ ID NO: 9188655 - DNA, 22 bp, Homo sapiens
tctgggagtaaggcctaggcat

SEQ ID NO: 9188656 - DNA, 22 bp, Homo sapiens
tctgggagtaaggcctaggcat

SEQ ID NO: 9188657 - DNA, 22 bp, Homo sapiens
tctgggagtaaggcctaggcat

SEQ ID NO: 9188658 - DNA, 22 bp, Homo sapiens
tctgggaagtgagatgctgtgt

SEQ ID NO: 9188659 - DNA, 22 bp, Homo sapiens
tctgggaagtcctctgtcatgc

SEQ ID NO: 9188660 - DNA, 22 bp, Homo sapiens
tctgggaagttggcagccagct

SEQ ID NO: 9188661 - DNA, 22 bp, Homo sapiens
tctgggaagtgagatgctgtgt

SEQ ID NO: 9188662 - DNA, 23 bp, Homo sapiens
tctgggaattggctgtccacagg

SEQ ID NO: 9188663 - DNA, 21 bp, Homo sapiens
tctgggacagggcctgaggag

SEQ ID NO: 9188664 - DNA, 22 bp, Homo sapiens
tctgggaatttattggcacttt

SEQ ID NO: 9188665 - DNA, 22 bp, Homo sapiens
tctgggaatgaggcttgggcaa

SEQ ID NO: 9188666 - DNA, 22 bp, Homo sapiens
tctgggaatgaataagacctgt

SEQ ID NO: 9188667 - DNA, 22 bp, Homo sapiens
tctgggaatgaggcttgggcaa

SEQ ID NO: 9188668 - DNA, 22 bp, Homo sapiens
tctgggagaagctgatgtgaag

SEQ ID NO: 9188669 - DNA, 22 bp, Homo sapiens
tctgggagaagctgatgtgaag

SEQ ID NO: 9188670 - DNA, 22 bp, Homo sapiens
tctgggacattctctccatagt

SEQ ID NO: 9188671 - DNA, 22 bp, Homo sapiens
tctgggagagcacgtggctgac

SEQ ID NO: 9188672 - DNA, 22 bp, Homo sapiens
tctgggagacgtgtgttgtcag

SEQ ID NO: 9188673 - DNA, 22 bp, Homo sapiens
tctgggagagggaaagaagact

SEQ ID NO: 9188674 - DNA, 22 bp, Homo sapiens
tctgggagagctgctgtcagag

SEQ ID NO: 9188675 - DNA, 22 bp, Homo sapiens
tctgggagagcacgtggctgac

SEQ ID NO: 9188676 - DNA, 22 bp, Homo sapiens
tctgggagagcacgtggctgac

SEQ ID NO: 9188677 - DNA, 22 bp, Homo sapiens
tctgggagagctgctgtcagag

SEQ ID NO: 9188678 - DNA, 22 bp, Homo sapiens
tctgggagagcacgtggctgac

SEQ ID NO: 9188679 - DNA, 22 bp, Homo sapiens
tctgtcctctccctgaccacaa

SEQ ID NO: 9188680 - DNA, 22 bp, Homo sapiens
tctgtcctgtttcctcctgaca

SEQ ID NO: 9188681 - DNA, 22 bp, Homo sapiens
tctgtcctgtttcctcctgaca

SEQ ID NO: 9188682 - DNA, 20 bp, Homo sapiens
tctgtcctttctgctaaggc

SEQ ID NO: 9188683 - DNA, 22 bp, Homo sapiens
tctgtctcaagttcttgcactc

SEQ ID NO: 9188684 - DNA, 22 bp, Homo sapiens
tctgtctcaagttcttgcactc

SEQ ID NO: 9188685 - DNA, 20 bp, Homo sapiens
tctgtctctgagctagactt

SEQ ID NO: 9188686 - DNA, 22 bp, Homo sapiens
tctgtctgactaccatgaggca

SEQ ID NO: 9188687 - DNA, 22 bp, Homo sapiens
tctgtctgactaccatgaggca

SEQ ID NO: 9188688 - DNA, 22 bp, Homo sapiens
tctgtctctttgttctgtgagt

SEQ ID NO: 9188689 - DNA, 21 bp, Homo sapiens
tctgtctctccactgccctgc

SEQ ID NO: 9188690 - DNA, 22 bp, Homo sapiens
tctgtctcctgccagtgcctct

SEQ ID NO: 9188691 - DNA, 21 bp, Homo sapiens
tctgtctctccactgccctgc

SEQ ID NO: 9188692 - DNA, 22 bp, Homo sapiens
tctgtctcctctgaggtgccag

SEQ ID NO: 9188693 - DNA, 22 bp, Homo sapiens
tctgtcctccggagctcccagt

SEQ ID NO: 9188694 - DNA, 22 bp, Homo sapiens
tctgtccattcagccatccatc

SEQ ID NO: 9188695 - DNA, 22 bp, Homo sapiens
tctgtcattgcaataaaatttc

SEQ ID NO: 9188696 - DNA, 22 bp, Homo sapiens
tctgtcatttcattcatatgaa

SEQ ID NO: 9188697 - DNA, 22 bp, Homo sapiens
tctgtcattgcaataaaatttc

SEQ ID NO: 9188698 - DNA, 22 bp, Homo sapiens
tctgtcatgtttccattacatg

SEQ ID NO: 9188699 - DNA, 22 bp, Homo sapiens
tctgtacatttgtgttgtgaat

SEQ ID NO: 9188700 - DNA, 22 bp, Homo sapiens
tctgtacttcctttaaacttta

SEQ ID NO: 9188701 - DNA, 22 bp, Homo sapiens
tctgtattgagaaagccggaca

SEQ ID NO: 9188702 - DNA, 22 bp, Homo sapiens
tctgtataaggacaaacattta

SEQ ID NO: 9188703 - DNA, 22 bp, Homo sapiens
tctgtattgattctgttaggca

SEQ ID NO: 9188704 - DNA, 22 bp, Homo sapiens
tctgtcaaatgggcataaggat

SEQ ID NO: 9188705 - DNA, 22 bp, Homo sapiens
tctgtcaaggcaactgcatttt

SEQ ID NO: 9188706 - DNA, 22 bp, Homo sapiens
tctgtcaattattcacataggc

SEQ ID NO: 9188707 - DNA, 21 bp, Homo sapiens
tctgtacatcattgagtcccc

SEQ ID NO: 9188708 - DNA, 22 bp, Homo sapiens
tctgtacagtaccagatagtaa

SEQ ID NO: 9188709 - DNA, 20 bp, Homo sapiens
tctgtaaagactccagaagc

SEQ ID NO: 9188710 - DNA, 22 bp, Homo sapiens
tctgtaaagatgtttatacctt

SEQ ID NO: 9188711 - DNA, 22 bp, Homo sapiens
tctgtaaatcctgctcagcaac

SEQ ID NO: 9188712 - DNA, 22 bp, Homo sapiens
tctgtaatcaagatatttgaga

SEQ ID NO: 9188713 - DNA, 22 bp, Homo sapiens
tctgtaatcaagatatttgaga

SEQ ID NO: 9188714 - DNA, 20 bp, Homo sapiens
tctgtaattatgccatcact

SEQ ID NO: 9188715 - DNA, 18 bp, Homo sapiens
tctgtaatttttccttga

SEQ ID NO: 9188716 - DNA, 22 bp, Homo sapiens
tctggggcagttactggggcct

SEQ ID NO: 9188717 - DNA, 22 bp, Homo sapiens
tctgggcttttccatgcctgtg

SEQ ID NO: 9188718 - DNA, 20 bp, Homo sapiens
tctggggatgaggtctagga

SEQ ID NO: 9188719 - DNA, 22 bp, Homo sapiens
tctgggggaggaggcatggccc

SEQ ID NO: 9188720 - DNA, 22 bp, Homo sapiens
tctgggggaggaggcatggccc

SEQ ID NO: 9188721 - DNA, 21 bp, Homo sapiens
tctgggctttcttataaggca

SEQ ID NO: 9188722 - DNA, 21 bp, Homo sapiens
tctgggctttcttataaggca

SEQ ID NO: 9188723 - DNA, 22 bp, Homo sapiens
tctgggctttgtaatgggaggt

SEQ ID NO: 9188724 - DNA, 22 bp, Homo sapiens
tctgggctttagtttgttatct

SEQ ID NO: 9188725 - DNA, 22 bp, Homo sapiens
tctgggctttacactgtgctta

SEQ ID NO: 9188726 - DNA, 22 bp, Homo sapiens
tctgggcttggttagggctgtt

SEQ ID NO: 9188727 - DNA, 22 bp, Homo sapiens
tctgggctttaagaactctgtt

SEQ ID NO: 9188728 - DNA, 22 bp, Homo sapiens
tctgggcttgggtagaaatcac

SEQ ID NO: 9188729 - DNA, 22 bp, Homo sapiens
tctgggcttggattggctctgc

SEQ ID NO: 9188730 - DNA, 22 bp, Homo sapiens
tctgggcttggattggctctgc

SEQ ID NO: 9188731 - DNA, 22 bp, Homo sapiens
tctgggcttggattggctctgc

SEQ ID NO: 9188732 - DNA, 22 bp, Homo sapiens
tctgggctgggcttaggaaccc

SEQ ID NO: 9188733 - DNA, 22 bp, Homo sapiens
tctgggctgggagcgtgtggac

SEQ ID NO: 9188734 - DNA, 23 bp, Homo sapiens
tctgggctgcttaaggatcaagg

SEQ ID NO: 9188735 - DNA, 22 bp, Homo sapiens
tctgggctgcttcagccttcgc

SEQ ID NO: 9188736 - DNA, 22 bp, Homo sapiens
tctgggctggctttatgctgac

SEQ ID NO: 9188737 - DNA, 22 bp, Homo sapiens
tctgggctgcttcagccttcgc

SEQ ID NO: 9188738 - DNA, 22 bp, Homo sapiens
tctgggctggtgctcatgaatt

SEQ ID NO: 9188739 - DNA, 22 bp, Homo sapiens
tctgggctggtgctcatgaatt

SEQ ID NO: 9188740 - DNA, 22 bp, Homo sapiens
tctgggctggttgtgcttgctt

SEQ ID NO: 9188741 - DNA, 15 bp, Homo sapiens
tctgggctgtgagca

SEQ ID NO: 9188742 - DNA, 22 bp, Homo sapiens
tctgggctgtctacaggttggc

SEQ ID NO: 9188743 - DNA, 18 bp, Homo sapiens
tctgggcttcccgaggct

SEQ ID NO: 9188744 - DNA, 20 bp, Homo sapiens
tctgggcttcccccagctcc

SEQ ID NO: 9188745 - DNA, 22 bp, Homo sapiens
tctgggcttgcctggttgtgca

SEQ ID NO: 9188746 - DNA, 22 bp, Homo sapiens
tctgggcttggattggctctgc

SEQ ID NO: 9188747 - DNA, 22 bp, Homo sapiens
tctgggctgtggttccactccg

SEQ ID NO: 9188748 - DNA, 22 bp, Homo sapiens
tctgggctgtgccaaagctctt

SEQ ID NO: 9188749 - DNA, 22 bp, Homo sapiens
tctgggctgtgggaattcaaca

SEQ ID NO: 9188750 - DNA, 17 bp, Homo sapiens
tctgggcttcagtggtc

SEQ ID NO: 9188751 - DNA, 22 bp, Homo sapiens
tctgggctgtgggaattcaaca

SEQ ID NO: 9188752 - DNA, 22 bp, Homo sapiens
tctgggtcggaagccccaggga

SEQ ID NO: 9188753 - DNA, 22 bp, Homo sapiens
tctgggtctatcccatgccttt

SEQ ID NO: 9188754 - DNA, 22 bp, Homo sapiens
tctgggtccgggactgtggatg

SEQ ID NO: 9188755 - DNA, 22 bp, Homo sapiens
tctgggtctatgatctcacttc

SEQ ID NO: 9188756 - DNA, 22 bp, Homo sapiens
tctgggtctttacccatggaat

SEQ ID NO: 9188757 - DNA, 22 bp, Homo sapiens
tctgggtctggctgctggtgca

SEQ ID NO: 9188758 - DNA, 22 bp, Homo sapiens
tctgggtctcagagtgaccatg

SEQ ID NO: 9188759 - DNA, 22 bp, Homo sapiens
tctgggtcatgactcagcgtga

SEQ ID NO: 9188760 - DNA, 22 bp, Homo sapiens
tctgggtccccgaggaaggaga

SEQ ID NO: 9188761 - DNA, 22 bp, Homo sapiens
tctgggtcactgtgggagggca

SEQ ID NO: 9188762 - DNA, 22 bp, Homo sapiens
tctgggtatgacctatttttcc

SEQ ID NO: 9188763 - DNA, 22 bp, Homo sapiens
tctggggttgagtctgggtcag

SEQ ID NO: 9188764 - DNA, 22 bp, Homo sapiens
tctggggttgagtctgggtcag

SEQ ID NO: 9188765 - DNA, 22 bp, Homo sapiens
tctggggttaagcccaggaatg

SEQ ID NO: 9188766 - DNA, 22 bp, Homo sapiens
tctggggtttgtggttcttctg

SEQ ID NO: 9188767 - DNA, 22 bp, Homo sapiens
tctggggttggtgcttacacca

SEQ ID NO: 9188768 - DNA, 22 bp, Homo sapiens
tctggggttttcacgctgtctc

SEQ ID NO: 9188769 - DNA, 22 bp, Homo sapiens
tctggggttttcacgctgtctc

SEQ ID NO: 9188770 - DNA, 22 bp, Homo sapiens
tctggggttttcacgctgtctc

SEQ ID NO: 9188771 - DNA, 18 bp, Homo sapiens
tctggggtgtgctgtgta

SEQ ID NO: 9188772 - DNA, 22 bp, Homo sapiens
tctggggtgtgacctgagcatg

SEQ ID NO: 9188773 - DNA, 19 bp, Homo sapiens
tctggggtgtggcctggca

SEQ ID NO: 9188774 - DNA, 19 bp, Homo sapiens
tctggggtgtggcctggca

SEQ ID NO: 9188775 - DNA, 22 bp, Homo sapiens
tctggggtgtgacctgagcatg

SEQ ID NO: 9188776 - DNA, 22 bp, Homo sapiens
tctggggtgtgacctgagcatg

SEQ ID NO: 9188777 - DNA, 22 bp, Homo sapiens
tctggggtggagccctggagtc

SEQ ID NO: 9188778 - DNA, 22 bp, Homo sapiens
tctggggtgcagcctggacata

SEQ ID NO: 9188779 - DNA, 22 bp, Homo sapiens
tctggggtggagccctggagtc

SEQ ID NO: 9188780 - DNA, 22 bp, Homo sapiens
tctggggtggagccctggagtc

SEQ ID NO: 9188781 - DNA, 22 bp, Homo sapiens
tctggggtgcagcctggacata

SEQ ID NO: 9188782 - DNA, 20 bp, Homo sapiens
tctggggtgaagcccaggaa

SEQ ID NO: 9188783 - DNA, 20 bp, Homo sapiens
tctggggtgaagcccaggaa

SEQ ID NO: 9188784 - DNA, 22 bp, Homo sapiens
tctggggtgaggcctggttatc

SEQ ID NO: 9188785 - DNA, 22 bp, Homo sapiens
tctggggtgcagcctaggcatc

SEQ ID NO: 9188786 - DNA, 22 bp, Homo sapiens
tctggggtgcagcctaggcatc

SEQ ID NO: 9188787 - DNA, 22 bp, Homo sapiens
tctggggtgcagcctaggcatc

SEQ ID NO: 9188788 - DNA, 22 bp, Homo sapiens
tctggggtgcagcctggacata

SEQ ID NO: 9188789 - DNA, 22 bp, Homo sapiens
tctggggtcacctggggtgctt

SEQ ID NO: 9188790 - DNA, 22 bp, Homo sapiens
tctgggtgggcccgagaaatct

SEQ ID NO: 9188791 - DNA, 22 bp, Homo sapiens
tctgggtggcttcagaggccac

SEQ ID NO: 9188792 - DNA, 22 bp, Homo sapiens
tctgggtggtgtcttccaagac

SEQ ID NO: 9188793 - DNA, 21 bp, Homo sapiens
tctgggtgtaaatcttatttg

SEQ ID NO: 9188794 - DNA, 22 bp, Homo sapiens
tctgggtggctgccaatctgcc

SEQ ID NO: 9188795 - DNA, 22 bp, Homo sapiens
tctgggtggcagtgatggcgtg

SEQ ID NO: 9188796 - DNA, 21 bp, Homo sapiens
tctgggtgctagtgtttgctt

SEQ ID NO: 9188797 - DNA, 22 bp, Homo sapiens
tctgggtgccctttgctctgtt

SEQ ID NO: 9188798 - DNA, 22 bp, Homo sapiens
tctgggtgccactgtctgtaca

SEQ ID NO: 9188799 - DNA, 22 bp, Homo sapiens
tctgggtgctacaaacagtatt

SEQ ID NO: 9188800 - DNA, 22 bp, Homo sapiens
tctgggtctttacccatggaat

SEQ ID NO: 9188801 - DNA, 22 bp, Homo sapiens
tctgggtgaccctgggcaaggc

SEQ ID NO: 9188802 - DNA, 22 bp, Homo sapiens
tctgggtgagctgcctcgggtc

SEQ ID NO: 9188803 - DNA, 22 bp, Homo sapiens
tctgggtgatgaaatgcactgt

SEQ ID NO: 9188804 - DNA, 22 bp, Homo sapiens
tctgtaaaattagtataattgt

SEQ ID NO: 9188805 - DNA, 22 bp, Homo sapiens
tctgtaaacaccatgttagagt

SEQ ID NO: 9188806 - DNA, 22 bp, Homo sapiens
tctgtaaaacttctttgtaaat

SEQ ID NO: 9188807 - DNA, 22 bp, Homo sapiens
tctgtaaaacttctttgtaaat

SEQ ID NO: 9188808 - DNA, 22 bp, Homo sapiens
tctgggtgtagggcctggcaac

SEQ ID NO: 9188809 - DNA, 22 bp, Homo sapiens
tctgggtgtagggcctggcaac

SEQ ID NO: 9188810 - DNA, 22 bp, Homo sapiens
tctgggtgtcactcctgcctgc

SEQ ID NO: 9188811 - DNA, 22 bp, Homo sapiens
tctgggtgtggtatcttagcca

SEQ ID NO: 9188812 - DNA, 22 bp, Homo sapiens
tctgggttattatgatggctac

SEQ ID NO: 9188813 - DNA, 22 bp, Homo sapiens
tctgtttcttggctagcctctt

SEQ ID NO: 9188814 - DNA, 22 bp, Homo sapiens
tctgttttagataagaaaggct

SEQ ID NO: 9188815 - DNA, 22 bp, Homo sapiens
tctgttttctctgtattttgac

SEQ ID NO: 9188816 - DNA, 22 bp, Homo sapiens
tctgttttgcataatgttcttt

SEQ ID NO: 9188817 - DNA, 22 bp, Homo sapiens
tctgtttcctcttgtgtaaagt

SEQ ID NO: 9188818 - DNA, 22 bp, Homo sapiens
tctgtttcaagtagggcttata

SEQ ID NO: 9188819 - DNA, 22 bp, Homo sapiens
tctgtttattcaatttctatat

SEQ ID NO: 9188820 - DNA, 22 bp, Homo sapiens
tctgtttatgcatatttaaaac

SEQ ID NO: 9188821 - DNA, 17 bp, Homo sapiens
tctgtttctcctttctt

SEQ ID NO: 9188822 - DNA, 22 bp, Homo sapiens
tctgttttggtcacctttatat

SEQ ID NO: 9188823 - DNA, 22 bp, Homo sapiens
tctgtttttgaggctatcttct

SEQ ID NO: 9188824 - DNA, 22 bp, Homo sapiens
tctgttttgtgtctctctggtg

SEQ ID NO: 9188825 - DNA, 22 bp, Homo sapiens
tctgttttgtaccagatacagc

SEQ ID NO: 9188826 - DNA, 22 bp, Homo sapiens
tcttaaaagtatgccaattgga

SEQ ID NO: 9188827 - DNA, 22 bp, Homo sapiens
tcttaaaggcacatagtgtcta

SEQ ID NO: 9188828 - DNA, 22 bp, Homo sapiens
tcttatatgcacatacattggg

SEQ ID NO: 9188829 - DNA, 22 bp, Homo sapiens
tcttatatgcacatacattggg

SEQ ID NO: 9188830 - DNA, 22 bp, Homo sapiens
tcttataagcaaactgctgaga

SEQ ID NO: 9188831 - DNA, 22 bp, Homo sapiens
tcttataatctctattttaatg

SEQ ID NO: 9188832 - DNA, 22 bp, Homo sapiens
tcttataatctctattttaatg

SEQ ID NO: 9188833 - DNA, 22 bp, Homo sapiens
tcttagtcacagaggtgagaaa

SEQ ID NO: 9188834 - DNA, 22 bp, Homo sapiens
tcttagttagctcccttcttct

SEQ ID NO: 9188835 - DNA, 22 bp, Homo sapiens
tcttaagaaagtgacaaatagg

SEQ ID NO: 9188836 - DNA, 22 bp, Homo sapiens
tcttaagccactgagaaaataa

SEQ ID NO: 9188837 - DNA, 22 bp, Homo sapiens
tcttaagtgcccagaaaccaaa

SEQ ID NO: 9188838 - DNA, 22 bp, Homo sapiens
tcttaaatgactgataagagga

SEQ ID NO: 9188839 - DNA, 22 bp, Homo sapiens
tctgttattctgctcagtatag

SEQ ID NO: 9188840 - DNA, 22 bp, Homo sapiens
tctgttcttggtgcagctggga

SEQ ID NO: 9188841 - DNA, 22 bp, Homo sapiens
tctgttgcaatgtgcatggtga

SEQ ID NO: 9188842 - DNA, 22 bp, Homo sapiens
tctgttgcaatgtgcatggtga

SEQ ID NO: 9188843 - DNA, 22 bp, Homo sapiens
tctgttgcaatgtgcatggtga

SEQ ID NO: 9188844 - DNA, 22 bp, Homo sapiens
tctgtttaatgggaatgatact

SEQ ID NO: 9188845 - DNA, 22 bp, Homo sapiens
tctgttggagcctaggatgaca

SEQ ID NO: 9188846 - DNA, 22 bp, Homo sapiens
tctgttggcttgagatttaatt

SEQ ID NO: 9188847 - DNA, 22 bp, Homo sapiens
tctgtttaggcaaaatagctac

SEQ ID NO: 9188848 - DNA, 22 bp, Homo sapiens
tctgtttagatgctttatctgt

SEQ ID NO: 9188849 - DNA, 22 bp, Homo sapiens
tctgtttagactcagttgaaac

SEQ ID NO: 9188850 - DNA, 22 bp, Homo sapiens
tctgtttatgcatatttaaaac

SEQ ID NO: 9188851 - DNA, 22 bp, Homo sapiens
tctgtttatgtgtctaaataaa

SEQ ID NO: 9188852 - DNA, 22 bp, Homo sapiens
tctgtttatatttcaaaccttc

SEQ ID NO: 9188853 - DNA, 22 bp, Homo sapiens
tctgtttatatgtttttcagac

SEQ ID NO: 9188854 - DNA, 22 bp, Homo sapiens
tctgtgtgccctaaagcctgct

SEQ ID NO: 9188855 - DNA, 22 bp, Homo sapiens
tctgtgtgccctaaagcctgct

SEQ ID NO: 9188856 - DNA, 22 bp, Homo sapiens
tctgtgtctgttacttcactgc

SEQ ID NO: 9188857 - DNA, 22 bp, Homo sapiens
tctgtgtgaccataagccagct

SEQ ID NO: 9188858 - DNA, 22 bp, Homo sapiens
tctgtgtgaccataagccagct

SEQ ID NO: 9188859 - DNA, 20 bp, Homo sapiens
tctgtgtttcagctgcttga

SEQ ID NO: 9188860 - DNA, 20 bp, Homo sapiens
tctgtgtttcagctgcttga

SEQ ID NO: 9188861 - DNA, 22 bp, Homo sapiens
tctgtgttgagaaggatcatga

SEQ ID NO: 9188862 - DNA, 22 bp, Homo sapiens
tctgtgtgttgtcaggaggatt

SEQ ID NO: 9188863 - DNA, 22 bp, Homo sapiens
tctgttatatagataatgtgtg

SEQ ID NO: 9188864 - DNA, 22 bp, Homo sapiens
tctgttatatgttttttctaaa

SEQ ID NO: 9188865 - DNA, 22 bp, Homo sapiens
tctgtgcagaactcacagaagg

SEQ ID NO: 9188866 - DNA, 22 bp, Homo sapiens
tctgtgcagatgtagaccagtt

SEQ ID NO: 9188867 - DNA, 22 bp, Homo sapiens
tctgtgcagtcagggctcagtc

SEQ ID NO: 9188868 - DNA, 22 bp, Homo sapiens
tctgtgcatttcaggacctgaa

SEQ ID NO: 9188869 - DNA, 22 bp, Homo sapiens
tctgtgcatccttaacgcctgc

SEQ ID NO: 9188870 - DNA, 23 bp, Homo sapiens
tctgtgccagtttccatgtctgt

SEQ ID NO: 9188871 - DNA, 23 bp, Homo sapiens
tctgtgccagtttccatgtctgt

SEQ ID NO: 9188872 - DNA, 22 bp, Homo sapiens
tctgtgcctttaagaagctcat

SEQ ID NO: 9188873 - DNA, 22 bp, Homo sapiens
tctgtgaaaggaaagaactgac

SEQ ID NO: 9188874 - DNA, 22 bp, Homo sapiens
tctgtgaacatcacattgacag

SEQ ID NO: 9188875 - DNA, 22 bp, Homo sapiens
tctgtgacttgcgggaggagaa

SEQ ID NO: 9188876 - DNA, 22 bp, Homo sapiens
tctgtgagaaccagtgccaggg

SEQ ID NO: 9188877 - DNA, 22 bp, Homo sapiens
tctgtgacattgaacatctaca

SEQ ID NO: 9188878 - DNA, 22 bp, Homo sapiens
tctgtgcaagaccaactttcaa

SEQ ID NO: 9188879 - DNA, 22 bp, Homo sapiens
tctgtctgcacctaagcacagt

SEQ ID NO: 9188880 - DNA, 22 bp, Homo sapiens
tctgtctgccccagcaagtcac

SEQ ID NO: 9188881 - DNA, 22 bp, Homo sapiens
tctgtctgccttgtgagggcac

SEQ ID NO: 9188882 - DNA, 22 bp, Homo sapiens
tctgtctttgagatctcagcct

SEQ ID NO: 9188883 - DNA, 22 bp, Homo sapiens
tctgtctttgagatctcagcct

SEQ ID NO: 9188884 - DNA, 22 bp, Homo sapiens
tctgtctttgagatctcagcct

SEQ ID NO: 9188885 - DNA, 22 bp, Homo sapiens
tctgtctttgagatctcagcct

SEQ ID NO: 9188886 - DNA, 22 bp, Homo sapiens
tctgtctttgagatctcagcct

SEQ ID NO: 9188887 - DNA, 22 bp, Homo sapiens
tctgtctttgtcaggaccagag

SEQ ID NO: 9188888 - DNA, 22 bp, Homo sapiens
tctgtctttagaggcctgtgct

SEQ ID NO: 9188889 - DNA, 22 bp, Homo sapiens
tctgtctttagaggcctgtgct

SEQ ID NO: 9188890 - DNA, 19 bp, Homo sapiens
tctgtggctgtggggagga

SEQ ID NO: 9188891 - DNA, 23 bp, Homo sapiens
tctgtggctccttcaggctgctg

SEQ ID NO: 9188892 - DNA, 23 bp, Homo sapiens
tctgtggctccttcaggctgctg

SEQ ID NO: 9188893 - DNA, 23 bp, Homo sapiens
tctgtggctccttcaggctgctg

SEQ ID NO: 9188894 - DNA, 19 bp, Homo sapiens
tctgtggagctcagagtag

SEQ ID NO: 9188895 - DNA, 18 bp, Homo sapiens
tctgtggagagggcagtt

SEQ ID NO: 9188896 - DNA, 22 bp, Homo sapiens
tctgtggactcaagggatcaca

SEQ ID NO: 9188897 - DNA, 22 bp, Homo sapiens
tctgtgctgtctcagagaaagc

SEQ ID NO: 9188898 - DNA, 22 bp, Homo sapiens
tctgtgctcatgcatgtgaatt

SEQ ID NO: 9188899 - DNA, 22 bp, Homo sapiens
tctgtgctagcacgcagcaagg

SEQ ID NO: 9188900 - DNA, 22 bp, Homo sapiens
tctgtgctagaggagttggcca

SEQ ID NO: 9188901 - DNA, 23 bp, Homo sapiens
tctgtgctacaaatcgcgtctgt

SEQ ID NO: 9188902 - DNA, 22 bp, Homo sapiens
tctgtgctggactgatttcata

SEQ ID NO: 9188903 - DNA, 22 bp, Homo sapiens
tctgtgctgcaggagtctgcat

SEQ ID NO: 9188904 - DNA, 22 bp, Homo sapiens
tctgtggcttgggcctgcctgt

SEQ ID NO: 9188905 - DNA, 22 bp, Homo sapiens
tctgtggcttgggcctgcctgt

SEQ ID NO: 9188906 - DNA, 22 bp, Homo sapiens
tctgtggcttcctatttcttgg

SEQ ID NO: 9188907 - DNA, 22 bp, Homo sapiens
tctgtggctttcgtgtaagatg

SEQ ID NO: 9188908 - DNA, 22 bp, Homo sapiens
tctgtgggtgcctccagcagtg

SEQ ID NO: 9188909 - DNA, 22 bp, Homo sapiens
tctgtgggtgcctccagcagtg

SEQ ID NO: 9188910 - DNA, 22 bp, Homo sapiens
tctgtgggttttgcagagttgc

SEQ ID NO: 9188911 - DNA, 22 bp, Homo sapiens
tctgtgtctggttgggccagta

SEQ ID NO: 9188912 - DNA, 22 bp, Homo sapiens
tctgtgtctgggcctccgcctg

SEQ ID NO: 9188913 - DNA, 22 bp, Homo sapiens
tctgtgtctgcagaagttcagc

SEQ ID NO: 9188914 - DNA, 22 bp, Homo sapiens
tctgtgtctgcagaagttcagc

SEQ ID NO: 9188915 - DNA, 22 bp, Homo sapiens
tctgtgtctggttgggccagta

SEQ ID NO: 9188916 - DNA, 23 bp, Homo sapiens
tctgtgtctccacccaaatctca

SEQ ID NO: 9188917 - DNA, 22 bp, Homo sapiens
tctgtgtcgttctgtgctctgg

SEQ ID NO: 9188918 - DNA, 22 bp, Homo sapiens
tctgtgtctcaatcccatgctg

SEQ ID NO: 9188919 - DNA, 22 bp, Homo sapiens
tctgtgtcctgctagctgtctt

SEQ ID NO: 9188920 - DNA, 23 bp, Homo sapiens
tctgtgtcctcctggaccacaga

SEQ ID NO: 9188921 - DNA, 22 bp, Homo sapiens
tctgtgtcccttctaatttcag

SEQ ID NO: 9188922 - DNA, 22 bp, Homo sapiens
tctgtgtcagaagatatcatgg

SEQ ID NO: 9188923 - DNA, 22 bp, Homo sapiens
tctgtgtcactgaggcctgtgt

SEQ ID NO: 9188924 - DNA, 22 bp, Homo sapiens
tctgtgtcagcagcactcagcc

SEQ ID NO: 9188925 - DNA, 22 bp, Homo sapiens
tcttcatactcatcacataggt

SEQ ID NO: 9188926 - DNA, 22 bp, Homo sapiens
tcttcatctcagattaacagga

SEQ ID NO: 9188927 - DNA, 22 bp, Homo sapiens
tcttcatgttgcttattctggg

SEQ ID NO: 9188928 - DNA, 22 bp, Homo sapiens
tcttcatgcacctcacagctag

SEQ ID NO: 9188929 - DNA, 22 bp, Homo sapiens
tcttcagtgcatgttacctata

SEQ ID NO: 9188930 - DNA, 22 bp, Homo sapiens
tcttcagtgcatgttacctata

SEQ ID NO: 9188931 - DNA, 22 bp, Homo sapiens
tcttcagtgcacctgatgtctt

SEQ ID NO: 9188932 - DNA, 22 bp, Homo sapiens
tcttcagtgcatgccctcaggc

SEQ ID NO: 9188933 - DNA, 22 bp, Homo sapiens
tcttcaggaagggaaatcatcc

SEQ ID NO: 9188934 - DNA, 21 bp, Homo sapiens
tcttcagtacacttgcacgcc

SEQ ID NO: 9188935 - DNA, 21 bp, Homo sapiens
tcttcagcagtggtgaggtgg

SEQ ID NO: 9188936 - DNA, 22 bp, Homo sapiens
tcttccagccaatagcgtcctt

SEQ ID NO: 9188937 - DNA, 22 bp, Homo sapiens
tcttccagcccttctaatggta

SEQ ID NO: 9188938 - DNA, 22 bp, Homo sapiens
tcttccagccaatagcgtcctt

SEQ ID NO: 9188939 - DNA, 19 bp, Homo sapiens
tcttccagcatctgggggc

SEQ ID NO: 9188940 - DNA, 22 bp, Homo sapiens
tcttccagatgcagatgcttct

SEQ ID NO: 9188941 - DNA, 22 bp, Homo sapiens
tcttccagaatctcagagggct

SEQ ID NO: 9188942 - DNA, 22 bp, Homo sapiens
tcttccagaatgcattctcttt

SEQ ID NO: 9188943 - DNA, 18 bp, Homo sapiens
tcttccaacactgacacc

SEQ ID NO: 9188944 - DNA, 22 bp, Homo sapiens
tcttccaaggtgcagatcttct

SEQ ID NO: 9188945 - DNA, 22 bp, Homo sapiens
tcttcattctcgcctttgtcgt

SEQ ID NO: 9188946 - DNA, 22 bp, Homo sapiens
tcttcattccgtagatatttat

SEQ ID NO: 9188947 - DNA, 22 bp, Homo sapiens
tcttcattccgtagatatttat

SEQ ID NO: 9188948 - DNA, 22 bp, Homo sapiens
tcttcacagatgcatatacttc

SEQ ID NO: 9188949 - DNA, 22 bp, Homo sapiens
tcttcacagatgcatatacttc

SEQ ID NO: 9188950 - DNA, 20 bp, Homo sapiens
tcttcagatgcttttggagt

SEQ ID NO: 9188951 - DNA, 22 bp, Homo sapiens
tcttcagattgcactgagcaag

SEQ ID NO: 9188952 - DNA, 22 bp, Homo sapiens
tcttcaaatacagtcatattga

SEQ ID NO: 9188953 - DNA, 22 bp, Homo sapiens
tcttcaaatacagtcatattga

SEQ ID NO: 9188954 - DNA, 22 bp, Homo sapiens
tcttcaaatgagtgtggattat

SEQ ID NO: 9188955 - DNA, 22 bp, Homo sapiens
tcttcaaatgctagtaatatca

SEQ ID NO: 9188956 - DNA, 22 bp, Homo sapiens
tcttcaaatgctagtaatatca

SEQ ID NO: 9188957 - DNA, 22 bp, Homo sapiens
tcttcaatatgtgtttaatatt

SEQ ID NO: 9188958 - DNA, 22 bp, Homo sapiens
tcttcaatttagaatggattta

SEQ ID NO: 9188959 - DNA, 22 bp, Homo sapiens
tcttcaatttagaatggattta

SEQ ID NO: 9188960 - DNA, 22 bp, Homo sapiens
tcttattgtctagattgagatg

SEQ ID NO: 9188961 - DNA, 22 bp, Homo sapiens
tcttatgtttctagaaaataag

SEQ ID NO: 9188962 - DNA, 22 bp, Homo sapiens
tcttatgtcaagaatgaatatt

SEQ ID NO: 9188963 - DNA, 22 bp, Homo sapiens
tcttattttttaatgacagaga

SEQ ID NO: 9188964 - DNA, 22 bp, Homo sapiens
tcttatttgcaactggctcaga

SEQ ID NO: 9188965 - DNA, 22 bp, Homo sapiens
tcttattgtttaaaagtacaca

SEQ ID NO: 9188966 - DNA, 22 bp, Homo sapiens
tcttattgtttaaaagtacaca

SEQ ID NO: 9188967 - DNA, 22 bp, Homo sapiens
tcttcaaactgaaaatttagaa

SEQ ID NO: 9188968 - DNA, 22 bp, Homo sapiens
tcttcaaactgaaaatttagaa

SEQ ID NO: 9188969 - DNA, 22 bp, Homo sapiens
tcttcaaactgaaaatttagaa

SEQ ID NO: 9188970 - DNA, 22 bp, Homo sapiens
tcttcaaatacagtcatattga

SEQ ID NO: 9188971 - DNA, 22 bp, Homo sapiens
tcttcaaagaattttagtaatt

SEQ ID NO: 9188972 - DNA, 22 bp, Homo sapiens
tcttcaaagaattttagtaatt

SEQ ID NO: 9188973 - DNA, 22 bp, Homo sapiens
tcttcaaaaatacaggttttca

SEQ ID NO: 9188974 - DNA, 22 bp, Homo sapiens
tcttcaaaccctggttttgtga

SEQ ID NO: 9188975 - DNA, 22 bp, Homo sapiens
tcttcaaaaaatatccatcagt

SEQ ID NO: 9188976 - DNA, 22 bp, Homo sapiens
tcttgaaacatatgagtaagtg

SEQ ID NO: 9188977 - DNA, 22 bp, Homo sapiens
tcttgaaagcatgagatggaca

SEQ ID NO: 9188978 - DNA, 22 bp, Homo sapiens
tcttgaaaattgaggttgaagg

SEQ ID NO: 9188979 - DNA, 22 bp, Homo sapiens
tcttctttttgtcccacagaat

SEQ ID NO: 9188980 - DNA, 22 bp, Homo sapiens
tcttctttttgtcccacagaat

SEQ ID NO: 9188981 - DNA, 22 bp, Homo sapiens
tcttctttgaatcatagtgacc

SEQ ID NO: 9188982 - DNA, 22 bp, Homo sapiens
tcttctttggatgaaagaatat

SEQ ID NO: 9188983 - DNA, 22 bp, Homo sapiens
tcttcttttatttcaagggtgt

SEQ ID NO: 9188984 - DNA, 22 bp, Homo sapiens
tcttcttttatttcaagggtgt

SEQ ID NO: 9188985 - DNA, 22 bp, Homo sapiens
tcttctttggatgaaagaatat

SEQ ID NO: 9188986 - DNA, 22 bp, Homo sapiens
tcttctttttgtcccacagaat

SEQ ID NO: 9188987 - DNA, 22 bp, Homo sapiens
tcttctgttaccacagcgatga

SEQ ID NO: 9188988 - DNA, 22 bp, Homo sapiens
tcttcttcctccacagggccca

SEQ ID NO: 9188989 - DNA, 22 bp, Homo sapiens
tcttctttatgtcatatgccag

SEQ ID NO: 9188990 - DNA, 22 bp, Homo sapiens
tcttcttcccatccctcaaatg

SEQ ID NO: 9188991 - DNA, 22 bp, Homo sapiens
tcttctcccatcggccgcaggg

SEQ ID NO: 9188992 - DNA, 22 bp, Homo sapiens
tcttctccagtgcttctgcaca

SEQ ID NO: 9188993 - DNA, 22 bp, Homo sapiens
tcttctccagtgcttctgcaca

SEQ ID NO: 9188994 - DNA, 22 bp, Homo sapiens
tcttctggatgagagcggaggc

SEQ ID NO: 9188995 - DNA, 22 bp, Homo sapiens
tcttctggatgagagcggaggc

SEQ ID NO: 9188996 - DNA, 22 bp, Homo sapiens
tcttctcctttgccatgtgttt

SEQ ID NO: 9188997 - DNA, 22 bp, Homo sapiens
tcttctctacaccagcagcccc

SEQ ID NO: 9188998 - DNA, 22 bp, Homo sapiens
tcttctctacaccagcagcccc

SEQ ID NO: 9188999 - DNA, 22 bp, Homo sapiens
tcttccttaaatgtttggtaga

SEQ ID NO: 9189000 - DNA, 22 bp, Homo sapiens
tcttcctggtttctgggccatc

SEQ ID NO: 9189001 - DNA, 22 bp, Homo sapiens
tcttcctggtttctgggccatc

SEQ ID NO: 9189002 - DNA, 22 bp, Homo sapiens
tcttccttcgcccttgctgttt

SEQ ID NO: 9189003 - DNA, 22 bp, Homo sapiens
tcttccttcgcccttgctgttt

SEQ ID NO: 9189004 - DNA, 22 bp, Homo sapiens
tcttccttcgcccttgctgttt

SEQ ID NO: 9189005 - DNA, 22 bp, Homo sapiens
tcttccttctttgatgacaagg

SEQ ID NO: 9189006 - DNA, 22 bp, Homo sapiens
tcttccttctttgatgacaagg

SEQ ID NO: 9189007 - DNA, 22 bp, Homo sapiens
tcttcctgctttggtgaggctt

SEQ ID NO: 9189008 - DNA, 21 bp, Homo sapiens
tcttcctgctccacactcccc

SEQ ID NO: 9189009 - DNA, 22 bp, Homo sapiens
tcttcctgctttggtgaggctt

SEQ ID NO: 9189010 - DNA, 22 bp, Homo sapiens
tcttctagtaggccaagaagct

SEQ ID NO: 9189011 - DNA, 22 bp, Homo sapiens
tcttccttttgtaccttctgaa

SEQ ID NO: 9189012 - DNA, 16 bp, Homo sapiens
tcttccttttgatttt

SEQ ID NO: 9189013 - DNA, 16 bp, Homo sapiens
tcttccttttgatttt

SEQ ID NO: 9189014 - DNA, 22 bp, Homo sapiens
tcttccttgtaagggctttaga

SEQ ID NO: 9189015 - DNA, 22 bp, Homo sapiens
tcttccttgctccttgtcactt

SEQ ID NO: 9189016 - DNA, 22 bp, Homo sapiens
tcttcctttcattcatgtgtta

SEQ ID NO: 9189017 - DNA, 22 bp, Homo sapiens
tcttccttgccttgcttcatca

SEQ ID NO: 9189018 - DNA, 22 bp, Homo sapiens
tcttccttgctccttgtcactt

SEQ ID NO: 9189019 - DNA, 23 bp, Homo sapiens
tcttcctgaactatcaggcacat

SEQ ID NO: 9189020 - DNA, 23 bp, Homo sapiens
tcttcctgaactatcaggcacat

SEQ ID NO: 9189021 - DNA, 21 bp, Homo sapiens
tcttcctgacatatgcaaggc

SEQ ID NO: 9189022 - DNA, 22 bp, Homo sapiens
tcttcctctagatctgaggccc

SEQ ID NO: 9189023 - DNA, 22 bp, Homo sapiens
tcttcctcttctgctgagaagt

SEQ ID NO: 9189024 - DNA, 18 bp, Homo sapiens
tcttccagcttctggagg

SEQ ID NO: 9189025 - DNA, 22 bp, Homo sapiens
tcttccagctgtaggacctagg

SEQ ID NO: 9189026 - DNA, 20 bp, Homo sapiens
tcttccagcttctggtagaa

SEQ ID NO: 9189027 - DNA, 22 bp, Homo sapiens
tcttccaggacctggggctcca

SEQ ID NO: 9189028 - DNA, 22 bp, Homo sapiens
tcttccaggagggcatttcttt

SEQ ID NO: 9189029 - DNA, 22 bp, Homo sapiens
tcttccagcttctggtggctgc

SEQ ID NO: 9189030 - DNA, 22 bp, Homo sapiens
tcttcctccctacagagctcag

SEQ ID NO: 9189031 - DNA, 22 bp, Homo sapiens
tcttccagggagcctcaaacct

SEQ ID NO: 9189032 - DNA, 20 bp, Homo sapiens
tcttccaggtacagtctgca

SEQ ID NO: 9189033 - DNA, 21 bp, Homo sapiens
tcttcctccacagcgtgccac

SEQ ID NO: 9189034 - DNA, 22 bp, Homo sapiens
tcttccaggccctgccacagct

SEQ ID NO: 9189035 - DNA, 22 bp, Homo sapiens
tcttccaggagggtgggcaaac

SEQ ID NO: 9189036 - DNA, 22 bp, Homo sapiens
tctttccctgtgttagcctgta

SEQ ID NO: 9189037 - DNA, 22 bp, Homo sapiens
tctttccctgtgttagcctgta

SEQ ID NO: 9189038 - DNA, 17 bp, Homo sapiens
tctttcctgccatgctc

SEQ ID NO: 9189039 - DNA, 22 bp, Homo sapiens
tctttcctctgagctcctgtag

SEQ ID NO: 9189040 - DNA, 22 bp, Homo sapiens
tctttcggccatagcgatgatt

SEQ ID NO: 9189041 - DNA, 22 bp, Homo sapiens
tctttccttagaataattcttt

SEQ ID NO: 9189042 - DNA, 22 bp, Homo sapiens
tctttccttagaataattcttt

SEQ ID NO: 9189043 - DNA, 22 bp, Homo sapiens
tctttcctgtaactgctgttca

SEQ ID NO: 9189044 - DNA, 22 bp, Homo sapiens
tctttctgatgggaagggtcaa

SEQ ID NO: 9189045 - DNA, 22 bp, Homo sapiens
tctttctgaatatttgacctca

SEQ ID NO: 9189046 - DNA, 21 bp, Homo sapiens
tctttctgaaatctcagtctg

SEQ ID NO: 9189047 - DNA, 22 bp, Homo sapiens
tctttcttaaataggtggattg

SEQ ID NO: 9189048 - DNA, 22 bp, Homo sapiens
tctttcttaaataggtggattg

SEQ ID NO: 9189049 - DNA, 22 bp, Homo sapiens
tctttgaacttggctgatctct

SEQ ID NO: 9189050 - DNA, 22 bp, Homo sapiens
tctttgaactctgtgtattaac

SEQ ID NO: 9189051 - DNA, 22 bp, Homo sapiens
tctttgaaagctgttctagagt

SEQ ID NO: 9189052 - DNA, 22 bp, Homo sapiens
tctttgaagttgaagtagttgg

SEQ ID NO: 9189053 - DNA, 22 bp, Homo sapiens
tctttgaagttcccctggaaga

SEQ ID NO: 9189054 - DNA, 22 bp, Homo sapiens
tctttgaagtatcttaaatggt

SEQ ID NO: 9189055 - DNA, 22 bp, Homo sapiens
tctttgaagtatcttaaatggt

SEQ ID NO: 9189056 - DNA, 22 bp, Homo sapiens
tctttgaattcaaactgttcaa

SEQ ID NO: 9189057 - DNA, 22 bp, Homo sapiens
tctttgaattcaaactgttcaa

SEQ ID NO: 9189058 - DNA, 22 bp, Homo sapiens
tctttgaatcctttacatctga

SEQ ID NO: 9189059 - DNA, 22 bp, Homo sapiens
tctttgatacagatgtaagctg

SEQ ID NO: 9189060 - DNA, 22 bp, Homo sapiens
tctttgaatttctgactgtctt

SEQ ID NO: 9189061 - DNA, 22 bp, Homo sapiens
tctttgatgcttctgaaggtgt

SEQ ID NO: 9189062 - DNA, 22 bp, Homo sapiens
tctttgatgtggttaattatga

SEQ ID NO: 9189063 - DNA, 22 bp, Homo sapiens
tctttccagaggaatttttaga

SEQ ID NO: 9189064 - DNA, 22 bp, Homo sapiens
tctttccagaggaatttttaga

SEQ ID NO: 9189065 - DNA, 22 bp, Homo sapiens
tctttccagaggaatttttaga

SEQ ID NO: 9189066 - DNA, 22 bp, Homo sapiens
tctttcccagtagctctcccag

SEQ ID NO: 9189067 - DNA, 22 bp, Homo sapiens
tctttcccgccagagcatgagt

SEQ ID NO: 9189068 - DNA, 22 bp, Homo sapiens
tctttccacagcatgtccatgc

SEQ ID NO: 9189069 - DNA, 22 bp, Homo sapiens
tctttccacattctctgtttag

SEQ ID NO: 9189070 - DNA, 22 bp, Homo sapiens
tctttccagaggaatttttaga

SEQ ID NO: 9189071 - DNA, 22 bp, Homo sapiens
tctttccacattctctgtttag

SEQ ID NO: 9189072 - DNA, 22 bp, Homo sapiens
tctttccaaggactctgtagca

SEQ ID NO: 9189073 - DNA, 22 bp, Homo sapiens
tctttccaagtaatacttccca

SEQ ID NO: 9189074 - DNA, 22 bp, Homo sapiens
tctttcaatgagcattctttcc

SEQ ID NO: 9189075 - DNA, 22 bp, Homo sapiens
tctttattgctactggtttgtc

SEQ ID NO: 9189076 - DNA, 22 bp, Homo sapiens
tctttattgctactggtttgtc

SEQ ID NO: 9189077 - DNA, 22 bp, Homo sapiens
tctttattgctactggtttgtc

SEQ ID NO: 9189078 - DNA, 22 bp, Homo sapiens
tctttattgctactggtttgtc

SEQ ID NO: 9189079 - DNA, 22 bp, Homo sapiens
tctttcagctcttcaggaccca

SEQ ID NO: 9189080 - DNA, 19 bp, Homo sapiens
tctttcatttctagctctg

SEQ ID NO: 9189081 - DNA, 19 bp, Homo sapiens
tctttagccagagctctgg

SEQ ID NO: 9189082 - DNA, 19 bp, Homo sapiens
tctttagccagagctctgg

SEQ ID NO: 9189083 - DNA, 22 bp, Homo sapiens
tctttagtgctgcttttggatt

SEQ ID NO: 9189084 - DNA, 22 bp, Homo sapiens
tctttagtaatgtagcagttta

SEQ ID NO: 9189085 - DNA, 19 bp, Homo sapiens
tctttagtcacatttttat

SEQ ID NO: 9189086 - DNA, 22 bp, Homo sapiens
tctttagtattgagttatggta

SEQ ID NO: 9189087 - DNA, 19 bp, Homo sapiens
tctttagtcacatttttat

SEQ ID NO: 9189088 - DNA, 22 bp, Homo sapiens
tctttagttttctaggttctat

SEQ ID NO: 9189089 - DNA, 22 bp, Homo sapiens
tctttatcaagtctgttctttg

SEQ ID NO: 9189090 - DNA, 22 bp, Homo sapiens
tctttatgagaaaaagattgta

SEQ ID NO: 9189091 - DNA, 23 bp, Homo sapiens
tctttacatactgatgagttctc

SEQ ID NO: 9189092 - DNA, 22 bp, Homo sapiens
tctttacacaagacaagaataa

SEQ ID NO: 9189093 - DNA, 22 bp, Homo sapiens
tctttagaaacttttcttcatg

SEQ ID NO: 9189094 - DNA, 22 bp, Homo sapiens
tctttagacatccagtttctct

SEQ ID NO: 9189095 - DNA, 22 bp, Homo sapiens
tctttacaatctaagcatagtt

SEQ ID NO: 9189096 - DNA, 22 bp, Homo sapiens
tctttacaagtcacattttctg

SEQ ID NO: 9189097 - DNA, 22 bp, Homo sapiens
tctttaatcataaccaagatgg

SEQ ID NO: 9189098 - DNA, 21 bp, Homo sapiens
tcttggggaggagggctgcac

SEQ ID NO: 9189099 - DNA, 22 bp, Homo sapiens
tctttaatgtactttctttcac

SEQ ID NO: 9189100 - DNA, 21 bp, Homo sapiens
tcttggggaggagggctgcac

SEQ ID NO: 9189101 - DNA, 22 bp, Homo sapiens
tcttgggatcacctcctggctt

SEQ ID NO: 9189102 - DNA, 22 bp, Homo sapiens
tcttgggcaatttctctagagg

SEQ ID NO: 9189103 - DNA, 22 bp, Homo sapiens
tcttgggagtcccaggacatag

SEQ ID NO: 9189104 - DNA, 22 bp, Homo sapiens
tcttggctttctcctagggatg

SEQ ID NO: 9189105 - DNA, 22 bp, Homo sapiens
tcttggctcccttgtaggccct

SEQ ID NO: 9189106 - DNA, 22 bp, Homo sapiens
tcttggctgcagagccggcaag

SEQ ID NO: 9189107 - DNA, 20 bp, Homo sapiens
tcttggctgtgtgaggacac

SEQ ID NO: 9189108 - DNA, 22 bp, Homo sapiens
tcttggagatgaccaggcatgc

SEQ ID NO: 9189109 - DNA, 22 bp, Homo sapiens
tcttggagtattgggcctcagg

SEQ ID NO: 9189110 - DNA, 22 bp, Homo sapiens
tcttggccaggtgtggtgcctc

SEQ ID NO: 9189111 - DNA, 22 bp, Homo sapiens
tcttggctacttaggaggattc

SEQ ID NO: 9189112 - DNA, 22 bp, Homo sapiens
tcttggattttaatggatcaaa

SEQ ID NO: 9189113 - DNA, 18 bp, Homo sapiens
tcttggcagcatctggca

SEQ ID NO: 9189114 - DNA, 22 bp, Homo sapiens
tcttgagtctaatctgaacttt

SEQ ID NO: 9189115 - DNA, 22 bp, Homo sapiens
tcttgattaataccttagccct

SEQ ID NO: 9189116 - DNA, 22 bp, Homo sapiens
tcttgattacttattttgtgcc

SEQ ID NO: 9189117 - DNA, 22 bp, Homo sapiens
tcttgattgttttctgacctta

SEQ ID NO: 9189118 - DNA, 22 bp, Homo sapiens
tcttgattacttattttgtgcc

SEQ ID NO: 9189119 - DNA, 22 bp, Homo sapiens
tcttgctgtgccccagcagggc

SEQ ID NO: 9189120 - DNA, 19 bp, Homo sapiens
tcttgcttcttcatccctc

SEQ ID NO: 9189121 - DNA, 22 bp, Homo sapiens
tcttgctaggagctatggaaga

SEQ ID NO: 9189122 - DNA, 22 bp, Homo sapiens
tcttgctagaatcatttggaga

SEQ ID NO: 9189123 - DNA, 22 bp, Homo sapiens
tcttgctccacatgctgagatg

SEQ ID NO: 9189124 - DNA, 22 bp, Homo sapiens
tcttgctgagactggcaagttt

SEQ ID NO: 9189125 - DNA, 22 bp, Homo sapiens
tcttgattggttgtatagctac

SEQ ID NO: 9189126 - DNA, 22 bp, Homo sapiens
tcttgctgtgccccagcagggc

SEQ ID NO: 9189127 - DNA, 22 bp, Homo sapiens
tcttgacattgttgttagcagg

SEQ ID NO: 9189128 - DNA, 22 bp, Homo sapiens
tcttgaataagtttcatgagct

SEQ ID NO: 9189129 - DNA, 22 bp, Homo sapiens
tcttgaaaggagattggaggca

SEQ ID NO: 9189130 - DNA, 22 bp, Homo sapiens
tcttgaagaaagtcaagttatt

SEQ ID NO: 9189131 - DNA, 22 bp, Homo sapiens
tcgcccaggctggaagtgcagt

SEQ ID NO: 9189132 - DNA, 22 bp, Homo sapiens
tcgcccaggctggaagtgcagt

SEQ ID NO: 9189133 - DNA, 22 bp, Homo sapiens
tcgcccaggctggaagtgcagt

SEQ ID NO: 9189134 - DNA, 22 bp, Homo sapiens
tcgcccaggctggaagtgcagt

SEQ ID NO: 9189135 - DNA, 22 bp, Homo sapiens
tcgcaccattgcactccagcca

SEQ ID NO: 9189136 - DNA, 22 bp, Homo sapiens
tcgccagggatgctgtaaggaa

SEQ ID NO: 9189137 - DNA, 21 bp, Homo sapiens
tcgtgcagcagctgaggcttg

SEQ ID NO: 9189138 - DNA, 22 bp, Homo sapiens
tcgtgctggatatagggctcta

SEQ ID NO: 9189139 - DNA, 21 bp, Homo sapiens
tcgtgcagcagctgaggcttg

SEQ ID NO: 9189140 - DNA, 22 bp, Homo sapiens
tcgtgctggatatagggctcta

SEQ ID NO: 9189141 - DNA, 22 bp, Homo sapiens
tcgtggagaggccatgtggagg

SEQ ID NO: 9189142 - DNA, 22 bp, Homo sapiens
tcgtggaggcaccgtgagcttt

SEQ ID NO: 9189143 - DNA, 22 bp, Homo sapiens
tctaaaaaagtctgttcacttg

SEQ ID NO: 9189144 - DNA, 22 bp, Homo sapiens
tctaaaaaagtctgttcacttg

SEQ ID NO: 9189145 - DNA, 23 bp, Homo sapiens
tctaaaattcatcatttacgttc

SEQ ID NO: 9189146 - DNA, 23 bp, Homo sapiens
tctaaaattcatcatttacgttc

SEQ ID NO: 9189147 - DNA, 22 bp, Homo sapiens
tctaaacattatgatagtagag

SEQ ID NO: 9189148 - DNA, 22 bp, Homo sapiens
tctaaacattatgatagtagag

SEQ ID NO: 9189149 - DNA, 22 bp, Homo sapiens
tctaaacacgtctctttgaata

SEQ ID NO: 9189150 - DNA, 22 bp, Homo sapiens
tctaaagagagtgggtacatgt

SEQ ID NO: 9189151 - DNA, 20 bp, Homo sapiens
tctaaagtacagtttgtgtg

SEQ ID NO: 9189152 - DNA, 20 bp, Homo sapiens
tctaaagtacagtttgtgtg

SEQ ID NO: 9189153 - DNA, 22 bp, Homo sapiens
tctaaagatttggattcatttg

SEQ ID NO: 9189154 - DNA, 22 bp, Homo sapiens
tccttgggaaacatcatgtaat

SEQ ID NO: 9189155 - DNA, 22 bp, Homo sapiens
tccttgggaaatcactagcact

SEQ ID NO: 9189156 - DNA, 22 bp, Homo sapiens
tccttgggaaacatcatgtaat

SEQ ID NO: 9189157 - DNA, 22 bp, Homo sapiens
tccttggctttctggagcttct

SEQ ID NO: 9189158 - DNA, 22 bp, Homo sapiens
tcctttccctttccatcctggc

SEQ ID NO: 9189159 - DNA, 22 bp, Homo sapiens
tcctttctccagctggcattgt

SEQ ID NO: 9189160 - DNA, 22 bp, Homo sapiens
tcctttccctttccatcctggc

SEQ ID NO: 9189161 - DNA, 22 bp, Homo sapiens
tcctttctatcttgggtatcta

SEQ ID NO: 9189162 - DNA, 18 bp, Homo sapiens
tcctttctccctcatctt

SEQ ID NO: 9189163 - DNA, 22 bp, Homo sapiens
tcctttctcccaggttagttgt

SEQ ID NO: 9189164 - DNA, 22 bp, Homo sapiens
tcctttcttcttctgcccatgg

SEQ ID NO: 9189165 - DNA, 22 bp, Homo sapiens
tcctttcttcttctgcccatgg

SEQ ID NO: 9189166 - DNA, 22 bp, Homo sapiens
tcctttcttttctatgggccca

SEQ ID NO: 9189167 - DNA, 22 bp, Homo sapiens
tcctttctgtgctgtcaggtcc

SEQ ID NO: 9189168 - DNA, 22 bp, Homo sapiens
tcctttctgtctttactctgga

SEQ ID NO: 9189169 - DNA, 18 bp, Homo sapiens
tcctttctccctcatctt

SEQ ID NO: 9189170 - DNA, 22 bp, Homo sapiens
tcctttctgggcctcagtgact

SEQ ID NO: 9189171 - DNA, 22 bp, Homo sapiens
tcctttgcttctgtcattctcc

SEQ ID NO: 9189172 - DNA, 22 bp, Homo sapiens
tcctttgacttcttgcagtcca

SEQ ID NO: 9189173 - DNA, 22 bp, Homo sapiens
tcctttgataaccaattttaag

SEQ ID NO: 9189174 - DNA, 22 bp, Homo sapiens
tcctttgttgagataaattggg

SEQ ID NO: 9189175 - DNA, 22 bp, Homo sapiens
tcctttgttaaggaggtttgtt

SEQ ID NO: 9189176 - DNA, 23 bp, Homo sapiens
tcctttgtctttgcatagatggt

SEQ ID NO: 9189177 - DNA, 23 bp, Homo sapiens
tcctttgtctttgcatagatggt

SEQ ID NO: 9189178 - DNA, 23 bp, Homo sapiens
tcctttgtctttgcatagatggt

SEQ ID NO: 9189179 - DNA, 22 bp, Homo sapiens
tcctttgttaaggaggtttgtt

SEQ ID NO: 9189180 - DNA, 22 bp, Homo sapiens
tcctttgtggaaatacttgtgg

SEQ ID NO: 9189181 - DNA, 22 bp, Homo sapiens
tcgatttgtttgggggagaagt

SEQ ID NO: 9189182 - DNA, 18 bp, Homo sapiens
tccttttctcccacccac

SEQ ID NO: 9189183 - DNA, 22 bp, Homo sapiens
tcgaactcatagtcgtagctgt

SEQ ID NO: 9189184 - DNA, 22 bp, Homo sapiens
tccttaggcaatttgggagagt

SEQ ID NO: 9189185 - DNA, 22 bp, Homo sapiens
tccttcaagtgcagtacctgag

SEQ ID NO: 9189186 - DNA, 22 bp, Homo sapiens
tccttagcacccaccaaggact

SEQ ID NO: 9189187 - DNA, 22 bp, Homo sapiens
tccttagagatactgtcttgaa

SEQ ID NO: 9189188 - DNA, 22 bp, Homo sapiens
tccttagacctggcaaatgggg

SEQ ID NO: 9189189 - DNA, 22 bp, Homo sapiens
tccttagagacaagaccagttt

SEQ ID NO: 9189190 - DNA, 22 bp, Homo sapiens
tccttaaatgtgatctagattt

SEQ ID NO: 9189191 - DNA, 22 bp, Homo sapiens
tccttaaatatttactgttaac

SEQ ID NO: 9189192 - DNA, 22 bp, Homo sapiens
tccttaaatgaactctgcatga

SEQ ID NO: 9189193 - DNA, 22 bp, Homo sapiens
tccttaaatccttcagagatta

SEQ ID NO: 9189194 - DNA, 22 bp, Homo sapiens
tccttcagaacctgtgatggaa

SEQ ID NO: 9189195 - DNA, 22 bp, Homo sapiens
tccttcaatcacccagtgggga

SEQ ID NO: 9189196 - DNA, 23 bp, Homo sapiens
tccttcaagttaggaagtgaaca

SEQ ID NO: 9189197 - DNA, 22 bp, Homo sapiens
tccttcagattcctgcttctgg

SEQ ID NO: 9189198 - DNA, 22 bp, Homo sapiens
tccttggcaagacacagcacag

SEQ ID NO: 9189199 - DNA, 22 bp, Homo sapiens
tccttggcagcagggagcatga

SEQ ID NO: 9189200 - DNA, 22 bp, Homo sapiens
tccttggcacactcggatctga

SEQ ID NO: 9189201 - DNA, 21 bp, Homo sapiens
tccttgctattttcctcagct

SEQ ID NO: 9189202 - DNA, 21 bp, Homo sapiens
tccttgctattttcctcagct

SEQ ID NO: 9189203 - DNA, 18 bp, Homo sapiens
tccttgaggtatctctat

SEQ ID NO: 9189204 - DNA, 22 bp, Homo sapiens
tccttgcaaatagctttctgag

SEQ ID NO: 9189205 - DNA, 22 bp, Homo sapiens
tccttgcagacatctctcttca

SEQ ID NO: 9189206 - DNA, 22 bp, Homo sapiens
tccttgcagcaggtgatattaa

SEQ ID NO: 9189207 - DNA, 22 bp, Homo sapiens
tccttgccctaaatgtctgtgt

SEQ ID NO: 9189208 - DNA, 22 bp, Homo sapiens
tccttgcagggtttgataaaga

SEQ ID NO: 9189209 - DNA, 22 bp, Homo sapiens
tccttcttcatgaagatatatg

SEQ ID NO: 9189210 - DNA, 22 bp, Homo sapiens
tccttctttcacctcatagtca

SEQ ID NO: 9189211 - DNA, 22 bp, Homo sapiens
tccttcttccctggtttgcatc

SEQ ID NO: 9189212 - DNA, 22 bp, Homo sapiens
tccttctttcacctcatagtca

SEQ ID NO: 9189213 - DNA, 22 bp, Homo sapiens
tccttgaaaggggctgcagggc

SEQ ID NO: 9189214 - DNA, 22 bp, Homo sapiens
tccttgagagccactgtcttgg

SEQ ID NO: 9189215 - DNA, 22 bp, Homo sapiens
tccttgaatggacattacactg

SEQ ID NO: 9189216 - DNA, 19 bp, Homo sapiens
tccttctccggccaccccg

SEQ ID NO: 9189217 - DNA, 22 bp, Homo sapiens
tccttcagggggccgcctgcac

SEQ ID NO: 9189218 - DNA, 22 bp, Homo sapiens
tccttcagggttgaggccgact

SEQ ID NO: 9189219 - DNA, 23 bp, Homo sapiens
tccttcctttgagaggctccatc

SEQ ID NO: 9189220 - DNA, 22 bp, Homo sapiens
tccttcctggggtctctgctgc

SEQ ID NO: 9189221 - DNA, 22 bp, Homo sapiens
tccttccttcctgaaattttag

SEQ ID NO: 9189222 - DNA, 19 bp, Homo sapiens
tctagcaacccactgcatg

SEQ ID NO: 9189223 - DNA, 22 bp, Homo sapiens
tctagcaggtggcggccagcga

SEQ ID NO: 9189224 - DNA, 22 bp, Homo sapiens
tctagcatctaattatggaatc

SEQ ID NO: 9189225 - DNA, 23 bp, Homo sapiens
tctagcctgtcatcagcctctcc

SEQ ID NO: 9189226 - DNA, 22 bp, Homo sapiens
tctagcagagggaagaggcttt

SEQ ID NO: 9189227 - DNA, 22 bp, Homo sapiens
tctagcagggaaagcagagaat

SEQ ID NO: 9189228 - DNA, 22 bp, Homo sapiens
tctagcagagggaagaggcttt

SEQ ID NO: 9189229 - DNA, 22 bp, Homo sapiens
tctaggagctgagagtgtgtac

SEQ ID NO: 9189230 - DNA, 22 bp, Homo sapiens
tctagctgacaacccacagcct

SEQ ID NO: 9189231 - DNA, 22 bp, Homo sapiens
tctagctgagggtaggagacct

SEQ ID NO: 9189232 - DNA, 22 bp, Homo sapiens
tctacccagagctatgacctga

SEQ ID NO: 9189233 - DNA, 23 bp, Homo sapiens
tctaccagctagtctccccagca

SEQ ID NO: 9189234 - DNA, 22 bp, Homo sapiens
tctaccagggtcacagaggccc

SEQ ID NO: 9189235 - DNA, 22 bp, Homo sapiens
tctaccatgtgctgtgcattgg

SEQ ID NO: 9189236 - DNA, 17 bp, Homo sapiens
tctactcctgaaggaag

SEQ ID NO: 9189237 - DNA, 22 bp, Homo sapiens
tctaccctgcggtcttggggca

SEQ ID NO: 9189238 - DNA, 22 bp, Homo sapiens
tctactatgtttcttaaataga

SEQ ID NO: 9189239 - DNA, 22 bp, Homo sapiens
tctagaaacaggtttctagaaa

SEQ ID NO: 9189240 - DNA, 22 bp, Homo sapiens
tctagaaaaccaatattacatg

SEQ ID NO: 9189241 - DNA, 23 bp, Homo sapiens
tctagaaaatgaaagaatgcagt

SEQ ID NO: 9189242 - DNA, 22 bp, Homo sapiens
tctactttcactcatacttatt

SEQ ID NO: 9189243 - DNA, 22 bp, Homo sapiens
tctactttataagtatataagt

SEQ ID NO: 9189244 - DNA, 22 bp, Homo sapiens
tctactttataagtatataagt

SEQ ID NO: 9189245 - DNA, 22 bp, Homo sapiens
tctagaaaaacaaagtatctga

SEQ ID NO: 9189246 - DNA, 22 bp, Homo sapiens
tctagaaaaaaactgctgtgga

SEQ ID NO: 9189247 - DNA, 22 bp, Homo sapiens
tctacagacagagcaggtggga

SEQ ID NO: 9189248 - DNA, 22 bp, Homo sapiens
tctacactccagagtctcatca

SEQ ID NO: 9189249 - DNA, 22 bp, Homo sapiens
tctacaagtcaagtctatcaag

SEQ ID NO: 9189250 - DNA, 22 bp, Homo sapiens
tctacaaataaattactatgta

SEQ ID NO: 9189251 - DNA, 19 bp, Homo sapiens
tctacaaagtggcatcagg

SEQ ID NO: 9189252 - DNA, 22 bp, Homo sapiens
tctacatgcagcgaggggactt

SEQ ID NO: 9189253 - DNA, 22 bp, Homo sapiens
tctaattgcaattctcagagat

SEQ ID NO: 9189254 - DNA, 22 bp, Homo sapiens
tctaattgaatctaagcatgtt

SEQ ID NO: 9189255 - DNA, 20 bp, Homo sapiens
tctaattaaaattgtctagt

SEQ ID NO: 9189256 - DNA, 22 bp, Homo sapiens
tctacaaagaagaattaatgtc

SEQ ID NO: 9189257 - DNA, 22 bp, Homo sapiens
tctaaattcagtttattttgat

SEQ ID NO: 9189258 - DNA, 22 bp, Homo sapiens
tctaaatgtcagtacagaatga

SEQ ID NO: 9189259 - DNA, 22 bp, Homo sapiens
tctaaatgtatcacatctggat

SEQ ID NO: 9189260 - DNA, 22 bp, Homo sapiens
tctaaatgtggtagtcataaga

SEQ ID NO: 9189261 - DNA, 22 bp, Homo sapiens
tctaaatggaaagaaaatacct

SEQ ID NO: 9189262 - DNA, 22 bp, Homo sapiens
tctaaatggaaagaaaatacct

SEQ ID NO: 9189263 - DNA, 22 bp, Homo sapiens
tctaacattgaatggctgatta

SEQ ID NO: 9189264 - DNA, 22 bp, Homo sapiens
tctcaaggaaaagtgatggcat

SEQ ID NO: 9189265 - DNA, 22 bp, Homo sapiens
tctcaaggtaaaatttgtcaca

SEQ ID NO: 9189266 - DNA, 21 bp, Homo sapiens
tctcacaatatgatgccagat

SEQ ID NO: 9189267 - DNA, 19 bp, Homo sapiens
tctcaattctccccactgc

SEQ ID NO: 9189268 - DNA, 19 bp, Homo sapiens
tctcaattctccccactgc

SEQ ID NO: 9189269 - DNA, 22 bp, Homo sapiens
tctcacagggctaggccctgcc

SEQ ID NO: 9189270 - DNA, 18 bp, Homo sapiens
tctcaaaaataatggctt

SEQ ID NO: 9189271 - DNA, 22 bp, Homo sapiens
tctcaaactacactgtaaattg

SEQ ID NO: 9189272 - DNA, 22 bp, Homo sapiens
tctatttttatagttgaagtgc

SEQ ID NO: 9189273 - DNA, 22 bp, Homo sapiens
tctatttttatagttgaagtgc

SEQ ID NO: 9189274 - DNA, 22 bp, Homo sapiens
tctattttgtttccagctctac

SEQ ID NO: 9189275 - DNA, 22 bp, Homo sapiens
tctattttgtttccagctctac

SEQ ID NO: 9189276 - DNA, 22 bp, Homo sapiens
tctattgtgctaccagaattac

SEQ ID NO: 9189277 - DNA, 22 bp, Homo sapiens
tctattgtaggcatgtagcttg

SEQ ID NO: 9189278 - DNA, 22 bp, Homo sapiens
tctatttaccaaatgtagttcc

SEQ ID NO: 9189279 - DNA, 22 bp, Homo sapiens
tctattctgataaatgcatgga

SEQ ID NO: 9189280 - DNA, 22 bp, Homo sapiens
tctatttgctggttgcttctgt

SEQ ID NO: 9189281 - DNA, 22 bp, Homo sapiens
tctattttatactcaaatcttc

SEQ ID NO: 9189282 - DNA, 22 bp, Homo sapiens
tctagggtgtataaggaagcct

SEQ ID NO: 9189283 - DNA, 22 bp, Homo sapiens
tctagggtggagctgggaatcc

SEQ ID NO: 9189284 - DNA, 22 bp, Homo sapiens
tctagggtggagctgggaatcc

SEQ ID NO: 9189285 - DNA, 22 bp, Homo sapiens
tctagggtgtataaggaagcct

SEQ ID NO: 9189286 - DNA, 22 bp, Homo sapiens
tctagggtgtgcggcagggcta

SEQ ID NO: 9189287 - DNA, 20 bp, Homo sapiens
tctaggctagattttgtcat

SEQ ID NO: 9189288 - DNA, 22 bp, Homo sapiens
tctaggcccaggcctgcggctg

SEQ ID NO: 9189289 - DNA, 22 bp, Homo sapiens
tctagggtccacagggtcagcc

SEQ ID NO: 9189290 - DNA, 22 bp, Homo sapiens
tctataaaactcaagagcaatt

SEQ ID NO: 9189291 - DNA, 22 bp, Homo sapiens
tctataaaactcaagagcaatt

SEQ ID NO: 9189292 - DNA, 22 bp, Homo sapiens
tctataaagggccagatagtag

SEQ ID NO: 9189293 - DNA, 22 bp, Homo sapiens
tctagttctagatccctgagga

SEQ ID NO: 9189294 - DNA, 22 bp, Homo sapiens
tctagtgttttggaacatggaa

SEQ ID NO: 9189295 - DNA, 22 bp, Homo sapiens
tctagttttggtatgagatgca

SEQ ID NO: 9189296 - DNA, 22 bp, Homo sapiens
tctatgtatatctttccattca

SEQ ID NO: 9189297 - DNA, 22 bp, Homo sapiens
tctatgtcaaccttgcagtgca

SEQ ID NO: 9189298 - DNA, 22 bp, Homo sapiens
tctatgtgccctttgtgtgatg

SEQ ID NO: 9189299 - DNA, 22 bp, Homo sapiens
tctattatggtacttatcatga

SEQ ID NO: 9189300 - DNA, 22 bp, Homo sapiens
tctattactcttttaaggaaaa

SEQ ID NO: 9189301 - DNA, 22 bp, Homo sapiens
tctataaagggccagatagtag

SEQ ID NO: 9189302 - DNA, 22 bp, Homo sapiens
tctatattccagatacagatta

SEQ ID NO: 9189303 - DNA, 22 bp, Homo sapiens
tctatcattcgcactcctactt

SEQ ID NO: 9189304 - DNA, 22 bp, Homo sapiens
tctatattttgaaaggtattta

SEQ ID NO: 9189305 - DNA, 22 bp, Homo sapiens
taagaatagtccctagatgtgt

SEQ ID NO: 9189306 - DNA, 22 bp, Homo sapiens
taagaatagtccctagatgtgt

SEQ ID NO: 9189307 - DNA, 22 bp, Homo sapiens
taagaatagtccctagatgtgt

SEQ ID NO: 9189308 - DNA, 21 bp, Homo sapiens
taagaacattatcttcttcct

SEQ ID NO: 9189309 - DNA, 21 bp, Homo sapiens
taagaacattatcttcttcct

SEQ ID NO: 9189310 - DNA, 22 bp, Homo sapiens
taagaacattttcggaaagata

SEQ ID NO: 9189311 - DNA, 22 bp, Homo sapiens
taagaacagtgtctgtctcaca

SEQ ID NO: 9189312 - DNA, 22 bp, Homo sapiens
taagaacagtgtttcatctcta

SEQ ID NO: 9189313 - DNA, 23 bp, Homo sapiens
taagaacagacaagcatttacat

SEQ ID NO: 9189314 - DNA, 23 bp, Homo sapiens
taagaacagacaagcatttacat

SEQ ID NO: 9189315 - DNA, 22 bp, Homo sapiens
taagaacagtagaacagtaggt

SEQ ID NO: 9189316 - DNA, 22 bp, Homo sapiens
taagaacagtagaacagtaggt

SEQ ID NO: 9189317 - DNA, 22 bp, Homo sapiens
taagaacagataaagtttcccc

SEQ ID NO: 9189318 - DNA, 22 bp, Homo sapiens
taagaatattgggaatggatgg

SEQ ID NO: 9189319 - DNA, 22 bp, Homo sapiens
taagaattccatcgcagagtat

SEQ ID NO: 9189320 - DNA, 22 bp, Homo sapiens
taagaattatctcatggataat

SEQ ID NO: 9189321 - DNA, 22 bp, Homo sapiens
tcctgctggattgtgtctggtg

SEQ ID NO: 9189322 - DNA, 22 bp, Homo sapiens
tcctgcttccttgtctttagac

SEQ ID NO: 9189323 - DNA, 22 bp, Homo sapiens
tcctgcttcttcgagcttctgg

SEQ ID NO: 9189324 - DNA, 22 bp, Homo sapiens
tcctgctgtttacctacaatgg

SEQ ID NO: 9189325 - DNA, 22 bp, Homo sapiens
tcctgctgttttctggcccaca

SEQ ID NO: 9189326 - DNA, 22 bp, Homo sapiens
tcctgctgttttctggcccaca

SEQ ID NO: 9189327 - DNA, 22 bp, Homo sapiens
tcctgctgtttacctacaatgg

SEQ ID NO: 9189328 - DNA, 22 bp, Homo sapiens
tcctgctgtgcttattatcctg

SEQ ID NO: 9189329 - DNA, 22 bp, Homo sapiens
tcctgctggtgatggttaaggt

SEQ ID NO: 9189330 - DNA, 22 bp, Homo sapiens
tcctgctgtgtctagctggttc

SEQ ID NO: 9189331 - DNA, 22 bp, Homo sapiens
tcctgctgtgtctagctggttc

SEQ ID NO: 9189332 - DNA, 19 bp, Homo sapiens
tcctgctgtgtgaagggga

SEQ ID NO: 9189333 - DNA, 19 bp, Homo sapiens
tcctgctgtgtgaagggga

SEQ ID NO: 9189334 - DNA, 19 bp, Homo sapiens
tcctgctgtgtgaagggga

SEQ ID NO: 9189335 - DNA, 22 bp, Homo sapiens
tcctgctggattgtgtctggtg

SEQ ID NO: 9189336 - DNA, 22 bp, Homo sapiens
tcctgctggattgtgtctggtg

SEQ ID NO: 9189337 - DNA, 22 bp, Homo sapiens
tcctgctggcaaggaagggact

SEQ ID NO: 9189338 - DNA, 22 bp, Homo sapiens
tcctgctggcaaggaagggact

SEQ ID NO: 9189339 - DNA, 22 bp, Homo sapiens
tcctgctggcaaggaagggact

SEQ ID NO: 9189340 - DNA, 22 bp, Homo sapiens
tcctgctgggtctaactctggt

SEQ ID NO: 9189341 - DNA, 21 bp, Homo sapiens
tcctgctgggtcaaccgtttt

SEQ ID NO: 9189342 - DNA, 22 bp, Homo sapiens
tcctgctgggcctgctttagga

SEQ ID NO: 9189343 - DNA, 20 bp, Homo sapiens
tcctggaggcttcatccata

SEQ ID NO: 9189344 - DNA, 22 bp, Homo sapiens
tcctggaggcactcgctggggc

SEQ ID NO: 9189345 - DNA, 22 bp, Homo sapiens
tcctggaggcactcgctggggc

SEQ ID NO: 9189346 - DNA, 22 bp, Homo sapiens
tcctggagggaggcggtgctac

SEQ ID NO: 9189347 - DNA, 22 bp, Homo sapiens
tcctggagggaggcggtgctac

SEQ ID NO: 9189348 - DNA, 20 bp, Homo sapiens
tcctggaggcttcatccata

SEQ ID NO: 9189349 - DNA, 22 bp, Homo sapiens
tcctggaggcactcgctggggc

SEQ ID NO: 9189350 - DNA, 22 bp, Homo sapiens
tcctggaggcaaatgagcacat

SEQ ID NO: 9189351 - DNA, 22 bp, Homo sapiens
tcctggaggcaaatgagcacat

SEQ ID NO: 9189352 - DNA, 22 bp, Homo sapiens
tcctggaggcaaatgaagactc

SEQ ID NO: 9189353 - DNA, 22 bp, Homo sapiens
tcctggaggcaaatgaagactc

SEQ ID NO: 9189354 - DNA, 22 bp, Homo sapiens
tcctggaggcaaatgagcacat

SEQ ID NO: 9189355 - DNA, 22 bp, Homo sapiens
tcctggagccaatgtgctgctg

SEQ ID NO: 9189356 - DNA, 22 bp, Homo sapiens
tcctggagccaatgtgctgctg

SEQ ID NO: 9189357 - DNA, 22 bp, Homo sapiens
tcctggaggagatccaatctga

SEQ ID NO: 9189358 - DNA, 22 bp, Homo sapiens
tcctggagccaatgtgctgctg

SEQ ID NO: 9189359 - DNA, 22 bp, Homo sapiens
tcctggaggagatccaatctga

SEQ ID NO: 9189360 - DNA, 22 bp, Homo sapiens
tcctggagggaggcggtgctac

SEQ ID NO: 9189361 - DNA, 22 bp, Homo sapiens
tcctggagggaggcggtgctac

SEQ ID NO: 9189362 - DNA, 22 bp, Homo sapiens
tcctggagggctcacaggcggc

SEQ ID NO: 9189363 - DNA, 22 bp, Homo sapiens
tcctggagggctcacaggcggc

SEQ ID NO: 9189364 - DNA, 22 bp, Homo sapiens
tcctggagggctcacaggcggc

SEQ ID NO: 9189365 - DNA, 22 bp, Homo sapiens
tcctggaggggacagcatgggc

SEQ ID NO: 9189366 - DNA, 20 bp, Homo sapiens
tcctggagtattccatgctt

SEQ ID NO: 9189367 - DNA, 20 bp, Homo sapiens
tcctggagtattccatgctt

SEQ ID NO: 9189368 - DNA, 20 bp, Homo sapiens
tcctggagtattccatgctt

SEQ ID NO: 9189369 - DNA, 20 bp, Homo sapiens
tcctggagtattccatgctt

SEQ ID NO: 9189370 - DNA, 22 bp, Homo sapiens
tcctggagtaggccttagccat

SEQ ID NO: 9189371 - DNA, 22 bp, Homo sapiens
tcctggagtaggccttagccat

SEQ ID NO: 9189372 - DNA, 22 bp, Homo sapiens
tcctggagtaggccttagccat

SEQ ID NO: 9189373 - DNA, 22 bp, Homo sapiens
tcctggaggggacagcatgggc

SEQ ID NO: 9189374 - DNA, 22 bp, Homo sapiens
tcctggaggggacagcatgggc

SEQ ID NO: 9189375 - DNA, 22 bp, Homo sapiens
tcctggagagaggcctggaaga

SEQ ID NO: 9189376 - DNA, 22 bp, Homo sapiens
tcctggagaatggacaatgcac

SEQ ID NO: 9189377 - DNA, 22 bp, Homo sapiens
tcctggagagaggcctggaaga

SEQ ID NO: 9189378 - DNA, 22 bp, Homo sapiens
tcctggagaatcctgccacctg

SEQ ID NO: 9189379 - DNA, 22 bp, Homo sapiens
tcctggagaagaggggcttgga

SEQ ID NO: 9189380 - DNA, 22 bp, Homo sapiens
tcctggagaatcctgccacctg

SEQ ID NO: 9189381 - DNA, 22 bp, Homo sapiens
tcctggagaatggacaatgcac

SEQ ID NO: 9189382 - DNA, 22 bp, Homo sapiens
tcctggagaatggacaatgcac

SEQ ID NO: 9189383 - DNA, 22 bp, Homo sapiens
tcctggagataattgcagtgaa

SEQ ID NO: 9189384 - DNA, 22 bp, Homo sapiens
tcctggagataattgcagtgaa

SEQ ID NO: 9189385 - DNA, 22 bp, Homo sapiens
tcctggagataattgcagtgaa

SEQ ID NO: 9189386 - DNA, 22 bp, Homo sapiens
tcctggagataattgcagtgaa

SEQ ID NO: 9189387 - DNA, 22 bp, Homo sapiens
tcctggagagtgggcgagcaca

SEQ ID NO: 9189388 - DNA, 22 bp, Homo sapiens
tcctggagagtgggcgagcaca

SEQ ID NO: 9189389 - DNA, 22 bp, Homo sapiens
tcctggagataattgcagtgaa

SEQ ID NO: 9189390 - DNA, 22 bp, Homo sapiens
tcctggagagtgggcgagcaca

SEQ ID NO: 9189391 - DNA, 22 bp, Homo sapiens
tcctggagaaactcagagatct

SEQ ID NO: 9189392 - DNA, 22 bp, Homo sapiens
tcctggagaaactcagagatct

SEQ ID NO: 9189393 - DNA, 22 bp, Homo sapiens
tcctggagaaactcagagatct

SEQ ID NO: 9189394 - DNA, 23 bp, Homo sapiens
tcctggagaaaagaaacatttct

SEQ ID NO: 9189395 - DNA, 23 bp, Homo sapiens
tcctggagaaaagaaacatttct

SEQ ID NO: 9189396 - DNA, 22 bp, Homo sapiens
tcctggagaagaggggcttgga

SEQ ID NO: 9189397 - DNA, 22 bp, Homo sapiens
tcctggagaagaggggcttgga

SEQ ID NO: 9189398 - DNA, 22 bp, Homo sapiens
tcctggagaaactcagagatct

SEQ ID NO: 9189399 - DNA, 22 bp, Homo sapiens
tcctggagaactgattcgcggg

SEQ ID NO: 9189400 - DNA, 22 bp, Homo sapiens
tcctggagaactgattcgcggg

SEQ ID NO: 9189401 - DNA, 22 bp, Homo sapiens
tcctggactggctcagcaccct

SEQ ID NO: 9189402 - DNA, 22 bp, Homo sapiens
tcctggagttgtgcagtgcaca

SEQ ID NO: 9189403 - DNA, 22 bp, Homo sapiens
tcctggagttgtgcagtgcaca

SEQ ID NO: 9189404 - DNA, 22 bp, Homo sapiens
tcctggagttgtctgtactcat

SEQ ID NO: 9189405 - DNA, 22 bp, Homo sapiens
tcctggagttgtctgtactcat

SEQ ID NO: 9189406 - DNA, 22 bp, Homo sapiens
tcctggagtttgtggtgatatg

SEQ ID NO: 9189407 - DNA, 22 bp, Homo sapiens
tcctggagtttgtggtgatatg

SEQ ID NO: 9189408 - DNA, 22 bp, Homo sapiens
tcctggagtttgtaaggtgagc

SEQ ID NO: 9189409 - DNA, 22 bp, Homo sapiens
tcctggagtttgtaaggtgagc

SEQ ID NO: 9189410 - DNA, 22 bp, Homo sapiens
tcctggagttgtgcagtgcaca

SEQ ID NO: 9189411 - DNA, 22 bp, Homo sapiens
tcctggagtttgtaaggtgagc

SEQ ID NO: 9189412 - DNA, 22 bp, Homo sapiens
tcctggagtatttctgtggtgt

SEQ ID NO: 9189413 - DNA, 22 bp, Homo sapiens
tcctggagtatttctgtggtgt

SEQ ID NO: 9189414 - DNA, 22 bp, Homo sapiens
tcctggagtatttctgtggtgt

SEQ ID NO: 9189415 - DNA, 22 bp, Homo sapiens
tcctggagtatttctgtggtgt

SEQ ID NO: 9189416 - DNA, 20 bp, Homo sapiens
tcctggagtctggtttggct

SEQ ID NO: 9189417 - DNA, 22 bp, Homo sapiens
tcctggagtggagtctgttgtt

SEQ ID NO: 9189418 - DNA, 20 bp, Homo sapiens
tcctggagtctggtttggct

SEQ ID NO: 9189419 - DNA, 22 bp, Homo sapiens
tcctggagtgtcttccccaagg

SEQ ID NO: 9189420 - DNA, 22 bp, Homo sapiens
tcctggagtgtcttccccaagg

SEQ ID NO: 9189421 - DNA, 22 bp, Homo sapiens
tcctggagtggagtctgttgtt

SEQ ID NO: 9189422 - DNA, 22 bp, Homo sapiens
tcctggagtggagtctgttgtt

SEQ ID NO: 9189423 - DNA, 22 bp, Homo sapiens
tcctggagttgtctgtactcat

SEQ ID NO: 9189424 - DNA, 22 bp, Homo sapiens
tcctggagttgtctgtactcat

SEQ ID NO: 9189425 - DNA, 22 bp, Homo sapiens
tcctggatcagcgggggcaggc

SEQ ID NO: 9189426 - DNA, 22 bp, Homo sapiens
tcctggagtttgtggtgatatg

SEQ ID NO: 9189427 - DNA, 22 bp, Homo sapiens
tcctggatatttgcttaaggtt

SEQ ID NO: 9189428 - DNA, 22 bp, Homo sapiens
tcctggattaatagggagctgt

SEQ ID NO: 9189429 - DNA, 19 bp, Homo sapiens
tcctggcacagtggaacca

SEQ ID NO: 9189430 - DNA, 22 bp, Homo sapiens
tcctggcaaagatgttggtgtt

SEQ ID NO: 9189431 - DNA, 17 bp, Homo sapiens
tcctggcagtcccctgg

SEQ ID NO: 9189432 - DNA, 22 bp, Homo sapiens
tcctggcacattgcaggggctc

SEQ ID NO: 9189433 - DNA, 22 bp, Homo sapiens
tcctggcatccgtgggtctgtg

SEQ ID NO: 9189434 - DNA, 22 bp, Homo sapiens
tcctggcataatggctttgctc

SEQ ID NO: 9189435 - DNA, 22 bp, Homo sapiens
tcctggccaagttactctctgc

SEQ ID NO: 9189436 - DNA, 21 bp, Homo sapiens
tcctggccagggcactaggca

SEQ ID NO: 9189437 - DNA, 21 bp, Homo sapiens
tcctggccagggcactaggca

SEQ ID NO: 9189438 - DNA, 22 bp, Homo sapiens
tcctggccataggctatttcag

SEQ ID NO: 9189439 - DNA, 22 bp, Homo sapiens
tcctggccagaggacaaagctg

SEQ ID NO: 9189440 - DNA, 22 bp, Homo sapiens
tcctggccacccgacagaagtc

SEQ ID NO: 9189441 - DNA, 22 bp, Homo sapiens
tcctggccacccgacagaagtc

SEQ ID NO: 9189442 - DNA, 22 bp, Homo sapiens
tcctggccaggatgacctaaca

SEQ ID NO: 9189443 - DNA, 22 bp, Homo sapiens
tcctggccagaggacaaagctg

SEQ ID NO: 9189444 - DNA, 18 bp, Homo sapiens
tcctggccacactacctt

SEQ ID NO: 9189445 - DNA, 22 bp, Homo sapiens
tcctggccacacattaatagtg

SEQ ID NO: 9189446 - DNA, 22 bp, Homo sapiens
tcctggccaagttactctctgc

SEQ ID NO: 9189447 - DNA, 22 bp, Homo sapiens
tcctggccacccgacagaagtc

SEQ ID NO: 9189448 - DNA, 20 bp, Homo sapiens
tcctggcctccctggggctc

SEQ ID NO: 9189449 - DNA, 22 bp, Homo sapiens
tcctggcctccgttctctgcat

SEQ ID NO: 9189450 - DNA, 22 bp, Homo sapiens
tcctggctcctgatctgtcact

SEQ ID NO: 9189451 - DNA, 22 bp, Homo sapiens
tcctggctcctggagacctgct

SEQ ID NO: 9189452 - DNA, 22 bp, Homo sapiens
tcctggctcctgatctgtcact

SEQ ID NO: 9189453 - DNA, 17 bp, Homo sapiens
tcctggcctggtgtgtg

SEQ ID NO: 9189454 - DNA, 22 bp, Homo sapiens
tcctggcctcgctgtccacctt

SEQ ID NO: 9189455 - DNA, 22 bp, Homo sapiens
tcctggcctctgagtcaagaac

SEQ ID NO: 9189456 - DNA, 22 bp, Homo sapiens
tcctggctcctggagacctgct

SEQ ID NO: 9189457 - DNA, 22 bp, Homo sapiens
tcctggctctaagtcctgagtg

SEQ ID NO: 9189458 - DNA, 22 bp, Homo sapiens
tcctggctctaagtcctgagtg

SEQ ID NO: 9189459 - DNA, 22 bp, Homo sapiens
tcctggctcggcttggggactt

SEQ ID NO: 9189460 - DNA, 17 bp, Homo sapiens
tcctggctctgccactg

SEQ ID NO: 9189461 - DNA, 22 bp, Homo sapiens
tcctggctctctacaaaccaga

SEQ ID NO: 9189462 - DNA, 23 bp, Homo sapiens
tcctggctctgcacttgctaatg

SEQ ID NO: 9189463 - DNA, 22 bp, Homo sapiens
tcctggctctgctgcctcctag

SEQ ID NO: 9189464 - DNA, 22 bp, Homo sapiens
tcctggcccactatgccagcat

SEQ ID NO: 9189465 - DNA, 22 bp, Homo sapiens
tcctggcccactcctagcttct

SEQ ID NO: 9189466 - DNA, 22 bp, Homo sapiens
tcctggcccactatgccagcat

SEQ ID NO: 9189467 - DNA, 22 bp, Homo sapiens
tcctggcccactatgccagcat

SEQ ID NO: 9189468 - DNA, 22 bp, Homo sapiens
tcctggccctctgcaaacgcca

SEQ ID NO: 9189469 - DNA, 22 bp, Homo sapiens
tcctggccctctgcaaacgcca

SEQ ID NO: 9189470 - DNA, 22 bp, Homo sapiens
tcctggccctctgcaaacgcca

SEQ ID NO: 9189471 - DNA, 22 bp, Homo sapiens
tcctggccctgtggcctgcagt

SEQ ID NO: 9189472 - DNA, 22 bp, Homo sapiens
tcctggcctagagtttgtgttc

SEQ ID NO: 9189473 - DNA, 22 bp, Homo sapiens
tcctggccgctggcccctgaga

SEQ ID NO: 9189474 - DNA, 22 bp, Homo sapiens
tcctggggctgcaaggcctgtc

SEQ ID NO: 9189475 - DNA, 22 bp, Homo sapiens
tcctggggctgcaaggcctgtc

SEQ ID NO: 9189476 - DNA, 20 bp, Homo sapiens
tcctggggtaagccatggtc

SEQ ID NO: 9189477 - DNA, 21 bp, Homo sapiens
tcctggggggtaggtgagttt

SEQ ID NO: 9189478 - DNA, 16 bp, Homo sapiens
tcctggggatactgga

SEQ ID NO: 9189479 - DNA, 22 bp, Homo sapiens
tcctggggccagcactggtgga

SEQ ID NO: 9189480 - DNA, 22 bp, Homo sapiens
tcctggggccagcactggtgga

SEQ ID NO: 9189481 - DNA, 22 bp, Homo sapiens
tcctggggtgtgttttgctgct

SEQ ID NO: 9189482 - DNA, 20 bp, Homo sapiens
tcctggggtaagccatggtc

SEQ ID NO: 9189483 - DNA, 22 bp, Homo sapiens
tcctggggtcctgactgcttcc

SEQ ID NO: 9189484 - DNA, 22 bp, Homo sapiens
tcctggtaggctatgtcatgtc

SEQ ID NO: 9189485 - DNA, 22 bp, Homo sapiens
tcctgtctgtctttggtccctt

SEQ ID NO: 9189486 - DNA, 22 bp, Homo sapiens
tcctgtctgctcacagagctgg

SEQ ID NO: 9189487 - DNA, 22 bp, Homo sapiens
tcctgtggctctgtggaacctt

SEQ ID NO: 9189488 - DNA, 22 bp, Homo sapiens
tcctgtggggaaaagcctatct

SEQ ID NO: 9189489 - DNA, 22 bp, Homo sapiens
tcctgtggcgttatcatgtgat

SEQ ID NO: 9189490 - DNA, 18 bp, Homo sapiens
tcctgtggcccagagttt

SEQ ID NO: 9189491 - DNA, 18 bp, Homo sapiens
tcctgtggcccagagttt

SEQ ID NO: 9189492 - DNA, 22 bp, Homo sapiens
tcctgtggagaggactggaggt

SEQ ID NO: 9189493 - DNA, 22 bp, Homo sapiens
tcctggtggtgccggtgcccgg

SEQ ID NO: 9189494 - DNA, 21 bp, Homo sapiens
tcctgtaagcttgggtggctc

SEQ ID NO: 9189495 - DNA, 21 bp, Homo sapiens
tcctgtaagcttgggtggctc

SEQ ID NO: 9189496 - DNA, 22 bp, Homo sapiens
tcctgtcctctgggtgccccat

SEQ ID NO: 9189497 - DNA, 22 bp, Homo sapiens
tcctgtccacagccctgacctc

SEQ ID NO: 9189498 - DNA, 18 bp, Homo sapiens
tcctgggaacttgctagc

SEQ ID NO: 9189499 - DNA, 22 bp, Homo sapiens
tcctgggaactcggaaagctct

SEQ ID NO: 9189500 - DNA, 22 bp, Homo sapiens
tcctgggaactcggaaagctct

SEQ ID NO: 9189501 - DNA, 18 bp, Homo sapiens
tcctgggaaaggcataca

SEQ ID NO: 9189502 - DNA, 18 bp, Homo sapiens
tcctgggaaaggcataca

SEQ ID NO: 9189503 - DNA, 22 bp, Homo sapiens
tcctggcttgtcacatctacgt

SEQ ID NO: 9189504 - DNA, 21 bp, Homo sapiens
tcctggctttatgctacctct

SEQ ID NO: 9189505 - DNA, 22 bp, Homo sapiens
tcctggcttccactcctctgtt

SEQ ID NO: 9189506 - DNA, 22 bp, Homo sapiens
tcctggcttccactcctctgtt

SEQ ID NO: 9189507 - DNA, 22 bp, Homo sapiens
tcctggcttcctgctcttgtca

SEQ ID NO: 9189508 - DNA, 22 bp, Homo sapiens
tcctggcttcctgctcttgtca

SEQ ID NO: 9189509 - DNA, 22 bp, Homo sapiens
tcctggcttctgtctccttatt

SEQ ID NO: 9189510 - DNA, 22 bp, Homo sapiens
tcctggcttaggtttccagaac

SEQ ID NO: 9189511 - DNA, 22 bp, Homo sapiens
tcctggctgccgtcgtcctgcg

SEQ ID NO: 9189512 - DNA, 22 bp, Homo sapiens
tcctggctgagttcccaagtcg

SEQ ID NO: 9189513 - DNA, 22 bp, Homo sapiens
tcctggctgccgtcgtcctgcg

SEQ ID NO: 9189514 - DNA, 22 bp, Homo sapiens
tcctgggaggcggaggttgcag

SEQ ID NO: 9189515 - DNA, 22 bp, Homo sapiens
tcctgggaggctgtgcctggct

SEQ ID NO: 9189516 - DNA, 22 bp, Homo sapiens
tcctgggaagttgcatcaccgt

SEQ ID NO: 9189517 - DNA, 22 bp, Homo sapiens
tcctgggaccaggcacctactg

SEQ ID NO: 9189518 - DNA, 22 bp, Homo sapiens
tcctgggacaccccaatatgag

SEQ ID NO: 9189519 - DNA, 22 bp, Homo sapiens
tcctgggacaagccgtggaagt

SEQ ID NO: 9189520 - DNA, 22 bp, Homo sapiens
tcctgggaagagacctgagcat

SEQ ID NO: 9189521 - DNA, 22 bp, Homo sapiens
tcctgggatgcataaaatatgt

SEQ ID NO: 9189522 - DNA, 22 bp, Homo sapiens
tcctgggattctgcatttctaa

SEQ ID NO: 9189523 - DNA, 22 bp, Homo sapiens
tcctgggcacaagtgagtctcc

SEQ ID NO: 9189524 - DNA, 21 bp, Homo sapiens
tcctgggagtctgagatcctg

SEQ ID NO: 9189525 - DNA, 22 bp, Homo sapiens
tcctgggagtggccatgtaatg

SEQ ID NO: 9189526 - DNA, 22 bp, Homo sapiens
tcctgggatactaagaaatttt

SEQ ID NO: 9189527 - DNA, 22 bp, Homo sapiens
tcctgggatgaggaaacaagga

SEQ ID NO: 9189528 - DNA, 22 bp, Homo sapiens
tcctgggatgcataaaatatgt

SEQ ID NO: 9189529 - DNA, 22 bp, Homo sapiens
tcctgggctgtgtgccactctg

SEQ ID NO: 9189530 - DNA, 22 bp, Homo sapiens
tcctgggctgtggccccgggca

SEQ ID NO: 9189531 - DNA, 19 bp, Homo sapiens
tcctgggctgggccaggtc

SEQ ID NO: 9189532 - DNA, 19 bp, Homo sapiens
tcctgggctgcgtcttgcc

SEQ ID NO: 9189533 - DNA, 22 bp, Homo sapiens
tcctgggctgcagggaagagca

SEQ ID NO: 9189534 - DNA, 22 bp, Homo sapiens
tcctgggcctgtactccatccg

SEQ ID NO: 9189535 - DNA, 22 bp, Homo sapiens
tcctgggccctccggatcaggt

SEQ ID NO: 9189536 - DNA, 22 bp, Homo sapiens
tcctgggccctccggatcaggt

SEQ ID NO: 9189537 - DNA, 22 bp, Homo sapiens
tctgaaggttacttctgctcag

SEQ ID NO: 9189538 - DNA, 22 bp, Homo sapiens
tctgaagggctgagtggaggag

SEQ ID NO: 9189539 - DNA, 22 bp, Homo sapiens
tctgaaggtgctagagaaagct

SEQ ID NO: 9189540 - DNA, 22 bp, Homo sapiens
tctgaaggtgctagagaaagct

SEQ ID NO: 9189541 - DNA, 22 bp, Homo sapiens
tctgaaggtctgagaaccagga

SEQ ID NO: 9189542 - DNA, 22 bp, Homo sapiens
tctgaagggctgagtggaggag

SEQ ID NO: 9189543 - DNA, 22 bp, Homo sapiens
tctgaagggctgagtggaggag

SEQ ID NO: 9189544 - DNA, 21 bp, Homo sapiens
tctgaaggcttgactggggct

SEQ ID NO: 9189545 - DNA, 22 bp, Homo sapiens
tctgaaggcctggagggtccca

SEQ ID NO: 9189546 - DNA, 22 bp, Homo sapiens
tctgaaggcctggagggtccca

SEQ ID NO: 9189547 - DNA, 22 bp, Homo sapiens
tctgaagaggctcttgataaga

SEQ ID NO: 9189548 - DNA, 19 bp, Homo sapiens
tctgaagaattagagagca

SEQ ID NO: 9189549 - DNA, 22 bp, Homo sapiens
tctgaagatatgagctttatga

SEQ ID NO: 9189550 - DNA, 23 bp, Homo sapiens
tctgaagatgctgtttccagtga

SEQ ID NO: 9189551 - DNA, 22 bp, Homo sapiens
tctgaagattctttccactatt

SEQ ID NO: 9189552 - DNA, 22 bp, Homo sapiens
tctgaagcacagcaggaagggt

SEQ ID NO: 9189553 - DNA, 22 bp, Homo sapiens
tctgaaatgcaaatttgactga

SEQ ID NO: 9189554 - DNA, 22 bp, Homo sapiens
tctgaaatgcaaatttgactga

SEQ ID NO: 9189555 - DNA, 22 bp, Homo sapiens
tctgaaatggggctgaagcact

SEQ ID NO: 9189556 - DNA, 22 bp, Homo sapiens
tctgaaatggcgatggccgttg

SEQ ID NO: 9189557 - DNA, 22 bp, Homo sapiens
tctgaaatgcaggcaatttgct

SEQ ID NO: 9189558 - DNA, 22 bp, Homo sapiens
tctgaaatggcagcgggaatga

SEQ ID NO: 9189559 - DNA, 22 bp, Homo sapiens
tctgaaattttagttatagaaa

SEQ ID NO: 9189560 - DNA, 22 bp, Homo sapiens
tctgaaattccttccagacttt

SEQ ID NO: 9189561 - DNA, 22 bp, Homo sapiens
tctgaaattgttagtaaaaatg

SEQ ID NO: 9189562 - DNA, 22 bp, Homo sapiens
tctgaaatgttctcttgttttg

SEQ ID NO: 9189563 - DNA, 22 bp, Homo sapiens
tctgaaattcacagttgagtca

SEQ ID NO: 9189564 - DNA, 22 bp, Homo sapiens
tctgaaattcacagttgagtca

SEQ ID NO: 9189565 - DNA, 22 bp, Homo sapiens
tctgaaattcacagttgagtca

SEQ ID NO: 9189566 - DNA, 22 bp, Homo sapiens
tctgaaatgttctcttgttttg

SEQ ID NO: 9189567 - DNA, 22 bp, Homo sapiens
tctgaaatggggctgaagcact

SEQ ID NO: 9189568 - DNA, 22 bp, Homo sapiens
tctgaaatggcgatggccgttg

SEQ ID NO: 9189569 - DNA, 22 bp, Homo sapiens
tctgaagaaatacagctggggt

SEQ ID NO: 9189570 - DNA, 20 bp, Homo sapiens
tctgaagaaagacagggact

SEQ ID NO: 9189571 - DNA, 22 bp, Homo sapiens
tctgaacatgatgtcatctgga

SEQ ID NO: 9189572 - DNA, 20 bp, Homo sapiens
tctgaacacaatatatcccc

SEQ ID NO: 9189573 - DNA, 21 bp, Homo sapiens
tctgaacaacatacgaatctt

SEQ ID NO: 9189574 - DNA, 20 bp, Homo sapiens
tctgaacaaaatgtaatgtc

SEQ ID NO: 9189575 - DNA, 22 bp, Homo sapiens
tctgaaattttagttatagaaa

SEQ ID NO: 9189576 - DNA, 22 bp, Homo sapiens
tctgaacatggcttcctcttca

SEQ ID NO: 9189577 - DNA, 22 bp, Homo sapiens
tctgaacagcatggaatcattt

SEQ ID NO: 9189578 - DNA, 18 bp, Homo sapiens
tctgaaagcccttttcca

SEQ ID NO: 9189579 - DNA, 22 bp, Homo sapiens
tctgaaagccctagtttgtaat

SEQ ID NO: 9189580 - DNA, 22 bp, Homo sapiens
tctgaaagaagggcagtctttt

SEQ ID NO: 9189581 - DNA, 22 bp, Homo sapiens
tctgaaagagagtacatacagt

SEQ ID NO: 9189582 - DNA, 22 bp, Homo sapiens
tctgaaagcattacagtttatt

SEQ ID NO: 9189583 - DNA, 22 bp, Homo sapiens
tctgaaagtatctggatctttt

SEQ ID NO: 9189584 - DNA, 22 bp, Homo sapiens
tctgaaagggctaaataatttg

SEQ ID NO: 9189585 - DNA, 22 bp, Homo sapiens
tctgaaagggctaaataatttg

SEQ ID NO: 9189586 - DNA, 22 bp, Homo sapiens
tctgaaataaatgcactgttag

SEQ ID NO: 9189587 - DNA, 22 bp, Homo sapiens
tctgaaataaatgcactgttag

SEQ ID NO: 9189588 - DNA, 22 bp, Homo sapiens
tctgaaataactgatgccagat

SEQ ID NO: 9189589 - DNA, 22 bp, Homo sapiens
tctgaaataactgatgccagat

SEQ ID NO: 9189590 - DNA, 22 bp, Homo sapiens
tctgaaataactgatgccagat

SEQ ID NO: 9189591 - DNA, 22 bp, Homo sapiens
tctgaaatactgcaggttctct

SEQ ID NO: 9189592 - DNA, 22 bp, Homo sapiens
tctgaaataagggagaagggaa

SEQ ID NO: 9189593 - DNA, 22 bp, Homo sapiens
tctgaaataaatgcactgttag

SEQ ID NO: 9189594 - DNA, 22 bp, Homo sapiens
tctgaaatagaagtgtctttct

SEQ ID NO: 9189595 - DNA, 22 bp, Homo sapiens
tctgaaaactccatgagctcgt

SEQ ID NO: 9189596 - DNA, 22 bp, Homo sapiens
tctgaaaatgttgactttgttt

SEQ ID NO: 9189597 - DNA, 22 bp, Homo sapiens
tctgaaagaagggcagtctttt

SEQ ID NO: 9189598 - DNA, 22 bp, Homo sapiens
tctgaaagagagtacatacagt

SEQ ID NO: 9189599 - DNA, 20 bp, Homo sapiens
tctcttttagcttacagctg

SEQ ID NO: 9189600 - DNA, 20 bp, Homo sapiens
tctcttttagcttacagctg

SEQ ID NO: 9189601 - DNA, 20 bp, Homo sapiens
tctcttttagcttacagctg

SEQ ID NO: 9189602 - DNA, 22 bp, Homo sapiens
tctctttgtctgctcttagttg

SEQ ID NO: 9189603 - DNA, 21 bp, Homo sapiens
tctctttgggaacattaatca

SEQ ID NO: 9189604 - DNA, 22 bp, Homo sapiens
tctctttctattgcaccatgct

SEQ ID NO: 9189605 - DNA, 17 bp, Homo sapiens
tctctttccctttctgc

SEQ ID NO: 9189606 - DNA, 23 bp, Homo sapiens
tctctttcaagagcttaatgtgc

SEQ ID NO: 9189607 - DNA, 22 bp, Homo sapiens
tctctttgcctgctgccatcca

SEQ ID NO: 9189608 - DNA, 22 bp, Homo sapiens
tctctttgcctgctgccatcca

SEQ ID NO: 9189609 - DNA, 22 bp, Homo sapiens
tctctttctcaaaatgtaagca

SEQ ID NO: 9189610 - DNA, 21 bp, Homo sapiens
tctctttctggaagcttccct

SEQ ID NO: 9189611 - DNA, 22 bp, Homo sapiens
tctctttaaaaatagtgaaata

SEQ ID NO: 9189612 - DNA, 22 bp, Homo sapiens
tctcttctttggggtgggctca

SEQ ID NO: 9189613 - DNA, 22 bp, Homo sapiens
tctcttcttgtgttttcctgcc

SEQ ID NO: 9189614 - DNA, 22 bp, Homo sapiens
tctctttagtgcttagacgtct

SEQ ID NO: 9189615 - DNA, 22 bp, Homo sapiens
tctctttactttcaccaatttg

SEQ ID NO: 9189616 - DNA, 22 bp, Homo sapiens
tctctttaaagactcagagatt

SEQ ID NO: 9189617 - DNA, 22 bp, Homo sapiens
tctctttaagtataatcttata

SEQ ID NO: 9189618 - DNA, 22 bp, Homo sapiens
tctctgtggcaactacttagct

SEQ ID NO: 9189619 - DNA, 21 bp, Homo sapiens
tctctgtggcctaccctctac

SEQ ID NO: 9189620 - DNA, 22 bp, Homo sapiens
tctctgtggtactgagagtcta

SEQ ID NO: 9189621 - DNA, 22 bp, Homo sapiens
tctctgtgtcttagtgaaggga

SEQ ID NO: 9189622 - DNA, 22 bp, Homo sapiens
tctctgtggtttgagagccggg

SEQ ID NO: 9189623 - DNA, 22 bp, Homo sapiens
tctctgtctcccgtgtgtccgg

SEQ ID NO: 9189624 - DNA, 22 bp, Homo sapiens
tctctgggtttttgtcctgtac

SEQ ID NO: 9189625 - DNA, 22 bp, Homo sapiens
tctctgtgacagctgggtatgt

SEQ ID NO: 9189626 - DNA, 22 bp, Homo sapiens
tctcttaatccggtgctttctg

SEQ ID NO: 9189627 - DNA, 22 bp, Homo sapiens
tctcttaggagaaattcataaa

SEQ ID NO: 9189628 - DNA, 22 bp, Homo sapiens
tctcttcagcccattataaggg

SEQ ID NO: 9189629 - DNA, 22 bp, Homo sapiens
tctcttcagcccattataaggg

SEQ ID NO: 9189630 - DNA, 22 bp, Homo sapiens
tctcttattttgcctttgacaa

SEQ ID NO: 9189631 - DNA, 23 bp, Homo sapiens
tctcttatcacaattcattttgc

SEQ ID NO: 9189632 - DNA, 22 bp, Homo sapiens
tctcttctaacactagaaattc

SEQ ID NO: 9189633 - DNA, 21 bp, Homo sapiens
tctcttcctccgcgccgccgc

SEQ ID NO: 9189634 - DNA, 22 bp, Homo sapiens
tctcttccctttatggtatgtg

SEQ ID NO: 9189635 - DNA, 22 bp, Homo sapiens
tctcttccatgtttcagcccca

SEQ ID NO: 9189636 - DNA, 22 bp, Homo sapiens
tctcttccatgtttcagcccca

SEQ ID NO: 9189637 - DNA, 22 bp, Homo sapiens
tctcttctctagtgagcaactg

SEQ ID NO: 9189638 - DNA, 19 bp, Homo sapiens
tctcttctccctggtttta

SEQ ID NO: 9189639 - DNA, 22 bp, Homo sapiens
tctcttctatttgagactattt

SEQ ID NO: 9189640 - DNA, 22 bp, Homo sapiens
tctcttctatttgagactattt

SEQ ID NO: 9189641 - DNA, 22 bp, Homo sapiens
tctcttctatttgagactattt

SEQ ID NO: 9189642 - DNA, 22 bp, Homo sapiens
tctcttctagcttcttgtggtt

SEQ ID NO: 9189643 - DNA, 22 bp, Homo sapiens
tctcttctaattagggtccatg

SEQ ID NO: 9189644 - DNA, 22 bp, Homo sapiens
tctcttctaattttcccgagta

SEQ ID NO: 9189645 - DNA, 22 bp, Homo sapiens
tctcttctctagtgagcaactg

SEQ ID NO: 9189646 - DNA, 22 bp, Homo sapiens
tctcttctgacctagccttgga

SEQ ID NO: 9189647 - DNA, 20 bp, Homo sapiens
tctcttctggggagataaaa

SEQ ID NO: 9189648 - DNA, 18 bp, Homo sapiens
tctcttcttggcagtcaa

SEQ ID NO: 9189649 - DNA, 20 bp, Homo sapiens
tctcttctggggagataaaa

SEQ ID NO: 9189650 - DNA, 22 bp, Homo sapiens
tctcttcttgattttcactgga

SEQ ID NO: 9189651 - DNA, 22 bp, Homo sapiens
tctcttcttgattttcactgga

SEQ ID NO: 9189652 - DNA, 22 bp, Homo sapiens
tctctgagaagttcctttgtga

SEQ ID NO: 9189653 - DNA, 22 bp, Homo sapiens
tctctgaatgagattactgcct

SEQ ID NO: 9189654 - DNA, 22 bp, Homo sapiens
tctctctggagctggggcatga

SEQ ID NO: 9189655 - DNA, 22 bp, Homo sapiens
tctctctgcgaattaggtttgc

SEQ ID NO: 9189656 - DNA, 22 bp, Homo sapiens
tctctctgccaactcacagcca

SEQ ID NO: 9189657 - DNA, 22 bp, Homo sapiens
tctctctgccaactcacagcca

SEQ ID NO: 9189658 - DNA, 23 bp, Homo sapiens
tctctctggcaaatttcacatat

SEQ ID NO: 9189659 - DNA, 22 bp, Homo sapiens
tctctctggagctggggcatga

SEQ ID NO: 9189660 - DNA, 22 bp, Homo sapiens
tctctgaaagcagctgctcatc

SEQ ID NO: 9189661 - DNA, 22 bp, Homo sapiens
tctctctttttaatcatgtaat

SEQ ID NO: 9189662 - DNA, 22 bp, Homo sapiens
tctctgagggagatggcctgcc

SEQ ID NO: 9189663 - DNA, 22 bp, Homo sapiens
tctctgaggttgtttccagcac

SEQ ID NO: 9189664 - DNA, 22 bp, Homo sapiens
tctctgagttctcctccagccc

SEQ ID NO: 9189665 - DNA, 22 bp, Homo sapiens
tctctgagtatcctgaactgcc

SEQ ID NO: 9189666 - DNA, 22 bp, Homo sapiens
tctctgagtaagtgacagttca

SEQ ID NO: 9189667 - DNA, 20 bp, Homo sapiens
tctctgagcttctcttgggg

SEQ ID NO: 9189668 - DNA, 22 bp, Homo sapiens
tctctgagctcaggagctgcag

SEQ ID NO: 9189669 - DNA, 22 bp, Homo sapiens
tctctgagctgcttcttgcata

SEQ ID NO: 9189670 - DNA, 22 bp, Homo sapiens
tctctgagcatgccatattgct

SEQ ID NO: 9189671 - DNA, 22 bp, Homo sapiens
tctctgagacagtagcctctgc

SEQ ID NO: 9189672 - DNA, 22 bp, Homo sapiens
tctctgagacagtagcctctgc

SEQ ID NO: 9189673 - DNA, 22 bp, Homo sapiens
tctctgagcccagtgtccccct

SEQ ID NO: 9189674 - DNA, 22 bp, Homo sapiens
tctctgagcccaatgtagcaat

SEQ ID NO: 9189675 - DNA, 22 bp, Homo sapiens
tctctgagcgcattcctccggc

SEQ ID NO: 9189676 - DNA, 19 bp, Homo sapiens
tctctcaattgcttcaatt

SEQ ID NO: 9189677 - DNA, 22 bp, Homo sapiens
tctctataggaatacttgaaca

SEQ ID NO: 9189678 - DNA, 22 bp, Homo sapiens
tctctatattatatgtagtttg

SEQ ID NO: 9189679 - DNA, 19 bp, Homo sapiens
tctctatatttgtttctga

SEQ ID NO: 9189680 - DNA, 22 bp, Homo sapiens
tctctatttgcctaggcttgtg

SEQ ID NO: 9189681 - DNA, 22 bp, Homo sapiens
tctctcagaggaagaggcagtg

SEQ ID NO: 9189682 - DNA, 22 bp, Homo sapiens
tctctcagaactgcagctgcag

SEQ ID NO: 9189683 - DNA, 22 bp, Homo sapiens
tctctcaggaggcaggttccta

SEQ ID NO: 9189684 - DNA, 22 bp, Homo sapiens
tctctcagatggggcactagta

SEQ ID NO: 9189685 - DNA, 22 bp, Homo sapiens
tctctcagaggccagggtcctg

SEQ ID NO: 9189686 - DNA, 22 bp, Homo sapiens
tctctcagaggaagaggcagtg

SEQ ID NO: 9189687 - DNA, 22 bp, Homo sapiens
tctctcagaggccagggtcctg

SEQ ID NO: 9189688 - DNA, 22 bp, Homo sapiens
tctctcaggctggagtgcagtg

SEQ ID NO: 9189689 - DNA, 22 bp, Homo sapiens
tctctcaggctggagtgcagtg

SEQ ID NO: 9189690 - DNA, 22 bp, Homo sapiens
tctctcagggggaaggctgaag

SEQ ID NO: 9189691 - DNA, 22 bp, Homo sapiens
tctctcagggggaaggctgaag

SEQ ID NO: 9189692 - DNA, 22 bp, Homo sapiens
tctctcagggggaaggctgaag

SEQ ID NO: 9189693 - DNA, 22 bp, Homo sapiens
tctctctgagttgagcaggagt

SEQ ID NO: 9189694 - DNA, 18 bp, Homo sapiens
tctctctgataacatttt

SEQ ID NO: 9189695 - DNA, 22 bp, Homo sapiens
tctctctgcagcccgggacact

SEQ ID NO: 9189696 - DNA, 22 bp, Homo sapiens
tctctctgagccctgctttttc

SEQ ID NO: 9189697 - DNA, 18 bp, Homo sapiens
tctctctgaagagttccc

SEQ ID NO: 9189698 - DNA, 18 bp, Homo sapiens
tctctctgaagagttccc

SEQ ID NO: 9189699 - DNA, 22 bp, Homo sapiens
tctctctatttatttgtcttgt

SEQ ID NO: 9189700 - DNA, 22 bp, Homo sapiens
tctctctatttatttgtcttgt

SEQ ID NO: 9189701 - DNA, 22 bp, Homo sapiens
tctctctactggggcactagga

SEQ ID NO: 9189702 - DNA, 22 bp, Homo sapiens
tctctcccaaatctgcagatag

SEQ ID NO: 9189703 - DNA, 22 bp, Homo sapiens
tctctcccaaatctgcagatag

SEQ ID NO: 9189704 - DNA, 21 bp, Homo sapiens
tctctcctcaagctcgacccc

SEQ ID NO: 9189705 - DNA, 22 bp, Homo sapiens
tctctcctctagtcagggtggt

SEQ ID NO: 9189706 - DNA, 22 bp, Homo sapiens
tctctggctggcaccccaggga

SEQ ID NO: 9189707 - DNA, 22 bp, Homo sapiens
tctctggctgatattcctctgc

SEQ ID NO: 9189708 - DNA, 22 bp, Homo sapiens
tctctggctcctgccgggtcca

SEQ ID NO: 9189709 - DNA, 22 bp, Homo sapiens
tctctggccgagagtccctggg

SEQ ID NO: 9189710 - DNA, 23 bp, Homo sapiens
tctctggcctttgatcaggttga

SEQ ID NO: 9189711 - DNA, 21 bp, Homo sapiens
tctctggcggtgtttggctcc

SEQ ID NO: 9189712 - DNA, 20 bp, Homo sapiens
tctctggccagaaacaacag

SEQ ID NO: 9189713 - DNA, 19 bp, Homo sapiens
tctctggcagttcagagca

SEQ ID NO: 9189714 - DNA, 19 bp, Homo sapiens
tctctggcatagactcaat

SEQ ID NO: 9189715 - DNA, 19 bp, Homo sapiens
tctctggcagttcagagca

SEQ ID NO: 9189716 - DNA, 19 bp, Homo sapiens
tctctggcagttcagagca

SEQ ID NO: 9189717 - DNA, 22 bp, Homo sapiens
tctctggccccatggctgagct

SEQ ID NO: 9189718 - DNA, 22 bp, Homo sapiens
tctctggccctgttttctatct

SEQ ID NO: 9189719 - DNA, 22 bp, Homo sapiens
tctctggccccatggctgagct

SEQ ID NO: 9189720 - DNA, 22 bp, Homo sapiens
tctctggcagacacctccctga

SEQ ID NO: 9189721 - DNA, 22 bp, Homo sapiens
tctctggcactcccttatggct

SEQ ID NO: 9189722 - DNA, 22 bp, Homo sapiens
tctctggcacataataaggtct

SEQ ID NO: 9189723 - DNA, 20 bp, Homo sapiens
tctctggcaagaagctgcag

SEQ ID NO: 9189724 - DNA, 20 bp, Homo sapiens
tctctggcaagaagctgcag

SEQ ID NO: 9189725 - DNA, 21 bp, Homo sapiens
tctctggagttagcagagaga

SEQ ID NO: 9189726 - DNA, 22 bp, Homo sapiens
tctctggcagcttgtgctgttg

SEQ ID NO: 9189727 - DNA, 22 bp, Homo sapiens
tctctggcagggatatctggct

SEQ ID NO: 9189728 - DNA, 22 bp, Homo sapiens
tctctggcagaggccctatccc

SEQ ID NO: 9189729 - DNA, 22 bp, Homo sapiens
tctctggcagactggctgggct

SEQ ID NO: 9189730 - DNA, 22 bp, Homo sapiens
tctctggaattttgagagtgac

SEQ ID NO: 9189731 - DNA, 22 bp, Homo sapiens
tctctggactcgagcttactca

SEQ ID NO: 9189732 - DNA, 22 bp, Homo sapiens
tctctggacttccacctctatt

SEQ ID NO: 9189733 - DNA, 21 bp, Homo sapiens
tctctggagttagcagagaga

SEQ ID NO: 9189734 - DNA, 22 bp, Homo sapiens
tctctggagggctccaggcggg

SEQ ID NO: 9189735 - DNA, 22 bp, Homo sapiens
tctctggaattggctgaggcaa

SEQ ID NO: 9189736 - DNA, 21 bp, Homo sapiens
tctctggaattagaccatgtt

SEQ ID NO: 9189737 - DNA, 19 bp, Homo sapiens
tctctgcttctcttggcat

SEQ ID NO: 9189738 - DNA, 19 bp, Homo sapiens
tctctgcttctcttggcat

SEQ ID NO: 9189739 - DNA, 22 bp, Homo sapiens
tctctggaagcgcagatctgtt

SEQ ID NO: 9189740 - DNA, 22 bp, Homo sapiens
tctctgctctgtgcctcagttt

SEQ ID NO: 9189741 - DNA, 22 bp, Homo sapiens
tctctggggtagggcccaggac

SEQ ID NO: 9189742 - DNA, 22 bp, Homo sapiens
tctctggggtagggcccaggac

SEQ ID NO: 9189743 - DNA, 22 bp, Homo sapiens
tctctgggtaaagttctctcat

SEQ ID NO: 9189744 - DNA, 22 bp, Homo sapiens
tctctgggtaaagttctctcat

SEQ ID NO: 9189745 - DNA, 22 bp, Homo sapiens
tctctgggtattcactgccttc

SEQ ID NO: 9189746 - DNA, 22 bp, Homo sapiens
tctctgggtatggtaacgttgg

SEQ ID NO: 9189747 - DNA, 22 bp, Homo sapiens
tctctggggatggacctgggag

SEQ ID NO: 9189748 - DNA, 22 bp, Homo sapiens
tctctggggcctttctacatca

SEQ ID NO: 9189749 - DNA, 22 bp, Homo sapiens
tctctggggcctttctacatca

SEQ ID NO: 9189750 - DNA, 22 bp, Homo sapiens
tctctgggggtagaactcaggc

SEQ ID NO: 9189751 - DNA, 22 bp, Homo sapiens
tctctgggggtagaactcaggc

SEQ ID NO: 9189752 - DNA, 22 bp, Homo sapiens
tctctgggggtagaactcaggc

SEQ ID NO: 9189753 - DNA, 23 bp, Homo sapiens
tctctgggtgggctgtgtctata

SEQ ID NO: 9189754 - DNA, 22 bp, Homo sapiens
tctctgggtgatggcagggcac

SEQ ID NO: 9189755 - DNA, 22 bp, Homo sapiens
tctctgggtgatggcagggcac

SEQ ID NO: 9189756 - DNA, 22 bp, Homo sapiens
tctctgggtgatggcagggcac

SEQ ID NO: 9189757 - DNA, 22 bp, Homo sapiens
tctctgggtctcagtttgtaca

SEQ ID NO: 9189758 - DNA, 22 bp, Homo sapiens
tctctgggtcctggcaagctca

SEQ ID NO: 9189759 - DNA, 22 bp, Homo sapiens
tctctgggtcctggcaagctca

SEQ ID NO: 9189760 - DNA, 20 bp, Homo sapiens
tctctgggttctcactcagc

SEQ ID NO: 9189761 - DNA, 20 bp, Homo sapiens
tctctgggttctcactcagc

SEQ ID NO: 9189762 - DNA, 22 bp, Homo sapiens
tctctgggttctcactcagcac

SEQ ID NO: 9189763 - DNA, 22 bp, Homo sapiens
tctctgggttgagaactaggac

SEQ ID NO: 9189764 - DNA, 16 bp, Homo sapiens
tctctgggttgcacag

SEQ ID NO: 9189765 - DNA, 22 bp, Homo sapiens
tctctgggttgagaactaggac

SEQ ID NO: 9189766 - DNA, 22 bp, Homo sapiens
tctctgggttgagaactaggac

SEQ ID NO: 9189767 - DNA, 22 bp, Homo sapiens
tctctgggttctcactcagcac

SEQ ID NO: 9189768 - DNA, 22 bp, Homo sapiens
tctctgggctaaaatcaaggtg

SEQ ID NO: 9189769 - DNA, 22 bp, Homo sapiens
tctctgggctaaaatcaaggtg

SEQ ID NO: 9189770 - DNA, 22 bp, Homo sapiens
tctctgggctaaaatcaaggtg

SEQ ID NO: 9189771 - DNA, 22 bp, Homo sapiens
tctctgggcctccctttccaag

SEQ ID NO: 9189772 - DNA, 22 bp, Homo sapiens
tctctgggcctgttttctcatc

SEQ ID NO: 9189773 - DNA, 22 bp, Homo sapiens
tctctgggcctgttttctcatc

SEQ ID NO: 9189774 - DNA, 22 bp, Homo sapiens
tctctgggcctccctttccaag

SEQ ID NO: 9189775 - DNA, 22 bp, Homo sapiens
tctctggggaaaaggctgatac

SEQ ID NO: 9189776 - DNA, 22 bp, Homo sapiens
tctctgggctcaggagcccggc

SEQ ID NO: 9189777 - DNA, 22 bp, Homo sapiens
tctctgggctcaggagcccggc

SEQ ID NO: 9189778 - DNA, 19 bp, Homo sapiens
tctctggggacactttcac

SEQ ID NO: 9189779 - DNA, 19 bp, Homo sapiens
tctctggggacactttcac

SEQ ID NO: 9189780 - DNA, 22 bp, Homo sapiens
tctctggggatgcttattcttg

SEQ ID NO: 9189781 - DNA, 22 bp, Homo sapiens
tctctggggatgcttattcttg

SEQ ID NO: 9189782 - DNA, 22 bp, Homo sapiens
tctctgggcccagaccttcctt

SEQ ID NO: 9189783 - DNA, 22 bp, Homo sapiens
tctctgggcctcagttttctca

SEQ ID NO: 9189784 - DNA, 21 bp, Homo sapiens
tctctgggccctcctgtgggg

SEQ ID NO: 9189785 - DNA, 21 bp, Homo sapiens
tctctgggccctcctgtgggg

SEQ ID NO: 9189786 - DNA, 22 bp, Homo sapiens
tctctgggatcgttttgggctc

SEQ ID NO: 9189787 - DNA, 22 bp, Homo sapiens
tctctgggatcaggtggcccag

SEQ ID NO: 9189788 - DNA, 22 bp, Homo sapiens
tctctgggatcaggtggcccag

SEQ ID NO: 9189789 - DNA, 19 bp, Homo sapiens
tctctggcttgtctgcctg

SEQ ID NO: 9189790 - DNA, 22 bp, Homo sapiens
tctctggcttaggttgagtgca

SEQ ID NO: 9189791 - DNA, 22 bp, Homo sapiens
tctcatttggctttgttttaaa

SEQ ID NO: 9189792 - DNA, 22 bp, Homo sapiens
tctcattattgtattcttagtt

SEQ ID NO: 9189793 - DNA, 22 bp, Homo sapiens
tctcattcataccctacatgct

SEQ ID NO: 9189794 - DNA, 23 bp, Homo sapiens
tctcatgtctttcctacaagcat

SEQ ID NO: 9189795 - DNA, 22 bp, Homo sapiens
tctcatgtgattcccgtgcatg

SEQ ID NO: 9189796 - DNA, 22 bp, Homo sapiens
tctcatgttgcttaactctatg

SEQ ID NO: 9189797 - DNA, 18 bp, Homo sapiens
tctcattacaatctttgt

SEQ ID NO: 9189798 - DNA, 22 bp, Homo sapiens
tctcatgtttctggtactcctt

SEQ ID NO: 9189799 - DNA, 22 bp, Homo sapiens
tctcattaaaacattttaatta

SEQ ID NO: 9189800 - DNA, 22 bp, Homo sapiens
tctccaaggagctcctgtgccg

SEQ ID NO: 9189801 - DNA, 22 bp, Homo sapiens
tctccaatctgtagctgtttgt

SEQ ID NO: 9189802 - DNA, 22 bp, Homo sapiens
tctccaatctgatgtgactggt

SEQ ID NO: 9189803 - DNA, 22 bp, Homo sapiens
tctccaagaaaagatctcagct

SEQ ID NO: 9189804 - DNA, 22 bp, Homo sapiens
tctccaagaaaagatctcagct

SEQ ID NO: 9189805 - DNA, 22 bp, Homo sapiens
tctccaggactgagctccagcc

SEQ ID NO: 9189806 - DNA, 22 bp, Homo sapiens
tctccaggactgagctccagcc

SEQ ID NO: 9189807 - DNA, 17 bp, Homo sapiens
tctccaggacgagctca

SEQ ID NO: 9189808 - DNA, 17 bp, Homo sapiens
tctccaggacgagctca

SEQ ID NO: 9189809 - DNA, 17 bp, Homo sapiens
tctccaggacgagctca

SEQ ID NO: 9189810 - DNA, 17 bp, Homo sapiens
tctccaggacgagctca

SEQ ID NO: 9189811 - DNA, 22 bp, Homo sapiens
tctccaggaagccctccctgac

SEQ ID NO: 9189812 - DNA, 22 bp, Homo sapiens
tctccaggaagccctccctgac

SEQ ID NO: 9189813 - DNA, 17 bp, Homo sapiens
tctccaggacgagctca

SEQ ID NO: 9189814 - DNA, 22 bp, Homo sapiens
tctccaggaagccctccctgac

SEQ ID NO: 9189815 - DNA, 22 bp, Homo sapiens
tctccaggcactacctgggtaa

SEQ ID NO: 9189816 - DNA, 22 bp, Homo sapiens
tctccaggcacttggctgctac

SEQ ID NO: 9189817 - DNA, 22 bp, Homo sapiens
tctccaggcactacctgggtaa

SEQ ID NO: 9189818 - DNA, 22 bp, Homo sapiens
tctccaggagcaagtcacccag

SEQ ID NO: 9189819 - DNA, 22 bp, Homo sapiens
tctccaggactgagctccagcc

SEQ ID NO: 9189820 - DNA, 22 bp, Homo sapiens
tctccaggagaaatatgaagga

SEQ ID NO: 9189821 - DNA, 22 bp, Homo sapiens
tctccaggagaaatatgaagga

SEQ ID NO: 9189822 - DNA, 19 bp, Homo sapiens
tctccaggcaggtgagcga

SEQ ID NO: 9189823 - DNA, 19 bp, Homo sapiens
tctccaggcaggtgagcga

SEQ ID NO: 9189824 - DNA, 22 bp, Homo sapiens
tctccaggcccactgatttata

SEQ ID NO: 9189825 - DNA, 19 bp, Homo sapiens
tctccaggcaggtgagcga

SEQ ID NO: 9189826 - DNA, 19 bp, Homo sapiens
tctccaggcaggtgagcga

SEQ ID NO: 9189827 - DNA, 19 bp, Homo sapiens
tctccaggcaggtgagcga

SEQ ID NO: 9189828 - DNA, 22 bp, Homo sapiens
tctccaggcacttggctgctac

SEQ ID NO: 9189829 - DNA, 22 bp, Homo sapiens
tctccaggcacttggctgctac

SEQ ID NO: 9189830 - DNA, 22 bp, Homo sapiens
tctccaggcacttggctgctac

SEQ ID NO: 9189831 - DNA, 22 bp, Homo sapiens
tctcatggagtcaggagcagaa

SEQ ID NO: 9189832 - DNA, 22 bp, Homo sapiens
tctcatcacacagccagtatgt

SEQ ID NO: 9189833 - DNA, 22 bp, Homo sapiens
tctcatcacacagccagtatgt

SEQ ID NO: 9189834 - DNA, 22 bp, Homo sapiens
tctcatcagcccaaacatgaca

SEQ ID NO: 9189835 - DNA, 22 bp, Homo sapiens
tctcagtggacgtgtctgtctt

SEQ ID NO: 9189836 - DNA, 22 bp, Homo sapiens
tctcagtgctatccatattcca

SEQ ID NO: 9189837 - DNA, 22 bp, Homo sapiens
tctcagtcccattgaagaggtg

SEQ ID NO: 9189838 - DNA, 22 bp, Homo sapiens
tctcagtatgcttgattggatt

SEQ ID NO: 9189839 - DNA, 22 bp, Homo sapiens
tctcagtgacactcttcataca

SEQ ID NO: 9189840 - DNA, 23 bp, Homo sapiens
tctcagtgaatctcagaattcgc

SEQ ID NO: 9189841 - DNA, 22 bp, Homo sapiens
tctcagtgagcttttctatgtt

SEQ ID NO: 9189842 - DNA, 22 bp, Homo sapiens
tctcagtgatggcccatttgga

SEQ ID NO: 9189843 - DNA, 22 bp, Homo sapiens
tctcagtgcagagaggctatct

SEQ ID NO: 9189844 - DNA, 20 bp, Homo sapiens
tctcagggttcagcaaagta

SEQ ID NO: 9189845 - DNA, 20 bp, Homo sapiens
tctcagggtcttagatggaa

SEQ ID NO: 9189846 - DNA, 22 bp, Homo sapiens
tctcagggtttcctgggggctg

SEQ ID NO: 9189847 - DNA, 22 bp, Homo sapiens
tctcagggtttgtacaagtgta

SEQ ID NO: 9189848 - DNA, 22 bp, Homo sapiens
tctcagctgcctgccctgctcc

SEQ ID NO: 9189849 - DNA, 22 bp, Homo sapiens
tctcagcctcacctctatggag

SEQ ID NO: 9189850 - DNA, 18 bp, Homo sapiens
tctcagcccagctccggc

SEQ ID NO: 9189851 - DNA, 20 bp, Homo sapiens
tctcaggccccctccttgct

SEQ ID NO: 9189852 - DNA, 22 bp, Homo sapiens
tctcaggctcttggaacctgtt

SEQ ID NO: 9189853 - DNA, 22 bp, Homo sapiens
tctcaggctgtgtgtggaggac

SEQ ID NO: 9189854 - DNA, 22 bp, Homo sapiens
tctcaggcttcctggtgctgtg

SEQ ID NO: 9189855 - DNA, 22 bp, Homo sapiens
tctcagggagttgaggctgcct

SEQ ID NO: 9189856 - DNA, 22 bp, Homo sapiens
tctcagagtttagagctgagcc

SEQ ID NO: 9189857 - DNA, 22 bp, Homo sapiens
tctcagagtttgaatctggagt

SEQ ID NO: 9189858 - DNA, 22 bp, Homo sapiens
tctcagagtaattctttaaggt

SEQ ID NO: 9189859 - DNA, 22 bp, Homo sapiens
tctcagagttcctctggagtcc

SEQ ID NO: 9189860 - DNA, 22 bp, Homo sapiens
tctcacagttgtccactgaaaa

SEQ ID NO: 9189861 - DNA, 22 bp, Homo sapiens
tctcacaggtgcacgtggctgt

SEQ ID NO: 9189862 - DNA, 22 bp, Homo sapiens
tctcactaagttatgataatca

SEQ ID NO: 9189863 - DNA, 22 bp, Homo sapiens
tctcaccatcttgaatccctta

SEQ ID NO: 9189864 - DNA, 22 bp, Homo sapiens
tctcaccaaagccttgaccata

SEQ ID NO: 9189865 - DNA, 22 bp, Homo sapiens
tctcacattttaaaaggacata

SEQ ID NO: 9189866 - DNA, 22 bp, Homo sapiens
tctcagaaaaaggagaaactgg

SEQ ID NO: 9189867 - DNA, 22 bp, Homo sapiens
tctcactgggtcacagcagagg

SEQ ID NO: 9189868 - DNA, 22 bp, Homo sapiens
tctcactttccagacttttcaa

SEQ ID NO: 9189869 - DNA, 22 bp, Homo sapiens
tctcactgggtcacagcagagg

SEQ ID NO: 9189870 - DNA, 22 bp, Homo sapiens
tctcactgggtataaatgagta

SEQ ID NO: 9189871 - DNA, 22 bp, Homo sapiens
tctcactgatttgagaccaagg

SEQ ID NO: 9189872 - DNA, 22 bp, Homo sapiens
tctcactcatttcctaggtctt

SEQ ID NO: 9189873 - DNA, 22 bp, Homo sapiens
tctcagagagatgaaacttcca

SEQ ID NO: 9189874 - DNA, 22 bp, Homo sapiens
tctcagagatctttctgcatgt

SEQ ID NO: 9189875 - DNA, 22 bp, Homo sapiens
tctcagagatgtcaagagtcta

SEQ ID NO: 9189876 - DNA, 22 bp, Homo sapiens
tctcagaaatactatgttgtca

SEQ ID NO: 9189877 - DNA, 22 bp, Homo sapiens
tctcagagatttatggaaaact

SEQ ID NO: 9189878 - DNA, 23 bp, Homo sapiens
tctcagaggattcctgggccttg

SEQ ID NO: 9189879 - DNA, 23 bp, Homo sapiens
tctcagaggattcctgggccttg

SEQ ID NO: 9189880 - DNA, 22 bp, Homo sapiens
tctcagagcctaactaacctaa

SEQ ID NO: 9189881 - DNA, 22 bp, Homo sapiens
tctcagagcctaactaacctaa

SEQ ID NO: 9189882 - DNA, 22 bp, Homo sapiens
tctcctcccaggctcttccagg

SEQ ID NO: 9189883 - DNA, 22 bp, Homo sapiens
tctcctccagaggctgtgggga

SEQ ID NO: 9189884 - DNA, 22 bp, Homo sapiens
tctcctccagaggctgtgggga

SEQ ID NO: 9189885 - DNA, 22 bp, Homo sapiens
tctcctcccaggctcttccagg

SEQ ID NO: 9189886 - DNA, 21 bp, Homo sapiens
tctcctcccggggagaggccg

SEQ ID NO: 9189887 - DNA, 22 bp, Homo sapiens
tctcctgacatgtctggaggaa

SEQ ID NO: 9189888 - DNA, 22 bp, Homo sapiens
tctcctgatatctgcagaccta

SEQ ID NO: 9189889 - DNA, 22 bp, Homo sapiens
tctcctgatatctgcagaccta

SEQ ID NO: 9189890 - DNA, 22 bp, Homo sapiens
tctcctgaagtttatgaaaact

SEQ ID NO: 9189891 - DNA, 22 bp, Homo sapiens
tctcctctgcgcggcagtgccc

SEQ ID NO: 9189892 - DNA, 22 bp, Homo sapiens
tctcctctgtgccacagcttgg

SEQ ID NO: 9189893 - DNA, 22 bp, Homo sapiens
tctcctgaagaccatgtgcact

SEQ ID NO: 9189894 - DNA, 22 bp, Homo sapiens
tctcctctgtgccacagcttgg

SEQ ID NO: 9189895 - DNA, 22 bp, Homo sapiens
tctcctctcctttcatgttgtt

SEQ ID NO: 9189896 - DNA, 22 bp, Homo sapiens
tctcctctcttacctggtacaa

SEQ ID NO: 9189897 - DNA, 22 bp, Homo sapiens
tctcctctatttctgtatgtat

SEQ ID NO: 9189898 - DNA, 22 bp, Homo sapiens
tctcctctcctttcatgttgtt

SEQ ID NO: 9189899 - DNA, 22 bp, Homo sapiens
tctcctctactgggtctgcaga

SEQ ID NO: 9189900 - DNA, 22 bp, Homo sapiens
tctcctctatttctgtatgtat

SEQ ID NO: 9189901 - DNA, 22 bp, Homo sapiens
tctcctggagcaggaaggtggg

SEQ ID NO: 9189902 - DNA, 22 bp, Homo sapiens
tctcctggagcaggaaggtggg

SEQ ID NO: 9189903 - DNA, 22 bp, Homo sapiens
tctcctggagcccagatgctgg

SEQ ID NO: 9189904 - DNA, 22 bp, Homo sapiens
tctcctggagcccagatgctgg

SEQ ID NO: 9189905 - DNA, 22 bp, Homo sapiens
tctcctggcatgtgggtcatct

SEQ ID NO: 9189906 - DNA, 22 bp, Homo sapiens
tctcctggatggaccttctctt

SEQ ID NO: 9189907 - DNA, 22 bp, Homo sapiens
tctcctggccctgtcgccatct

SEQ ID NO: 9189908 - DNA, 22 bp, Homo sapiens
tctcctgctcccaactgctgca

SEQ ID NO: 9189909 - DNA, 22 bp, Homo sapiens
tctcctgctcccaactgctgca

SEQ ID NO: 9189910 - DNA, 22 bp, Homo sapiens
tctcctggaagaataccacact

SEQ ID NO: 9189911 - DNA, 22 bp, Homo sapiens
tctcctgatgatggtactggca

SEQ ID NO: 9189912 - DNA, 22 bp, Homo sapiens
tctcctgcagcgagcccgacac

SEQ ID NO: 9189913 - DNA, 22 bp, Homo sapiens
tctcctgatgatggtactggca

SEQ ID NO: 9189914 - DNA, 22 bp, Homo sapiens
tctcctgcagcgagcccgacac

SEQ ID NO: 9189915 - DNA, 22 bp, Homo sapiens
tctcctgcagtcagcagtctca

SEQ ID NO: 9189916 - DNA, 22 bp, Homo sapiens
tctcctgcagtcagcagtctca

SEQ ID NO: 9189917 - DNA, 22 bp, Homo sapiens
tctcctgctcagaacagcctca

SEQ ID NO: 9189918 - DNA, 22 bp, Homo sapiens
tctcctgctcagaacagcctca

SEQ ID NO: 9189919 - DNA, 22 bp, Homo sapiens
tctcctgctcagaacagcctca

SEQ ID NO: 9189920 - DNA, 22 bp, Homo sapiens
tctcctgcagtcagcagtctca

SEQ ID NO: 9189921 - DNA, 22 bp, Homo sapiens
tctcgctctgtcgcccaggctg

SEQ ID NO: 9189922 - DNA, 22 bp, Homo sapiens
tctcgctctgtcgcccaggctg

SEQ ID NO: 9189923 - DNA, 22 bp, Homo sapiens
tctctagtctcctttaacctga

SEQ ID NO: 9189924 - DNA, 22 bp, Homo sapiens
tctcgttagatgtttctgttga

SEQ ID NO: 9189925 - DNA, 22 bp, Homo sapiens
tctcgctctgtcgcccaggctg

SEQ ID NO: 9189926 - DNA, 22 bp, Homo sapiens
tctcgacagcctggcacagtgg

SEQ ID NO: 9189927 - DNA, 22 bp, Homo sapiens
tctcctttctggagcctgctca

SEQ ID NO: 9189928 - DNA, 22 bp, Homo sapiens
tctcctttctggagcctgctca

SEQ ID NO: 9189929 - DNA, 22 bp, Homo sapiens
tctccttgtgctgggtccttcc

SEQ ID NO: 9189930 - DNA, 20 bp, Homo sapiens
tctcctggtctggtccgtgc

SEQ ID NO: 9189931 - DNA, 22 bp, Homo sapiens
tctcctggtcacctcagaagtc

SEQ ID NO: 9189932 - DNA, 20 bp, Homo sapiens
tctcctggtctggtccgtgc

SEQ ID NO: 9189933 - DNA, 23 bp, Homo sapiens
tctcctgtcctaattaccacccc

SEQ ID NO: 9189934 - DNA, 22 bp, Homo sapiens
tctcctgtgcaccctccctgtg

SEQ ID NO: 9189935 - DNA, 22 bp, Homo sapiens
tctcctgggtgctttatcagaa

SEQ ID NO: 9189936 - DNA, 22 bp, Homo sapiens
tctcctggtatgtatgcacctg

SEQ ID NO: 9189937 - DNA, 21 bp, Homo sapiens
tctcctgggtccaacccatgc

SEQ ID NO: 9189938 - DNA, 18 bp, Homo sapiens
tctcctgggtaggggcct

SEQ ID NO: 9189939 - DNA, 22 bp, Homo sapiens
tctcctgggtaaaagggttgat

SEQ ID NO: 9189940 - DNA, 22 bp, Homo sapiens
tctccccagctgagctgccctt

SEQ ID NO: 9189941 - DNA, 22 bp, Homo sapiens
tctcccagtggtgcagaaagca

SEQ ID NO: 9189942 - DNA, 22 bp, Homo sapiens
tctcccctagtgcattaaagtg

SEQ ID NO: 9189943 - DNA, 22 bp, Homo sapiens
tctcccccagtctctacagcag

SEQ ID NO: 9189944 - DNA, 22 bp, Homo sapiens
tctcccctactctaaatctgca

SEQ ID NO: 9189945 - DNA, 22 bp, Homo sapiens
tctcccccagtctctacagcag

SEQ ID NO: 9189946 - DNA, 22 bp, Homo sapiens
tctcccctccctggaccagtgc

SEQ ID NO: 9189947 - DNA, 21 bp, Homo sapiens
tctccccattcttattcccat

SEQ ID NO: 9189948 - DNA, 22 bp, Homo sapiens
tctccccaggggtatgggtatt

SEQ ID NO: 9189949 - DNA, 23 bp, Homo sapiens
tctccctcatgcctaggcctggg

SEQ ID NO: 9189950 - DNA, 22 bp, Homo sapiens
tctcccaggtgggtgcctggag

SEQ ID NO: 9189951 - DNA, 22 bp, Homo sapiens
tctcccaggtgggtgcctggag

SEQ ID NO: 9189952 - DNA, 22 bp, Homo sapiens
tctcccagtggtgcagaaagca

SEQ ID NO: 9189953 - DNA, 22 bp, Homo sapiens
tctcccaggctggagtgcagtg

SEQ ID NO: 9189954 - DNA, 22 bp, Homo sapiens
tctcccaggtcatacacagaga

SEQ ID NO: 9189955 - DNA, 22 bp, Homo sapiens
tctcccaggtcatacacagaga

SEQ ID NO: 9189956 - DNA, 22 bp, Homo sapiens
tctcccaggtcatacacagaga

SEQ ID NO: 9189957 - DNA, 20 bp, Homo sapiens
tctcccaggctcagggaaga

SEQ ID NO: 9189958 - DNA, 20 bp, Homo sapiens
tctcccaggctcagggaaga

SEQ ID NO: 9189959 - DNA, 22 bp, Homo sapiens
tctcccaggctgccctgtggac

SEQ ID NO: 9189960 - DNA, 22 bp, Homo sapiens
tctcccaggctgccctgtggac

SEQ ID NO: 9189961 - DNA, 22 bp, Homo sapiens
tctcccaggctgccctgtggac

SEQ ID NO: 9189962 - DNA, 22 bp, Homo sapiens
tctcccaggctgccctgtggac

SEQ ID NO: 9189963 - DNA, 22 bp, Homo sapiens
tctcccaggcaggagtgcagtg

SEQ ID NO: 9189964 - DNA, 22 bp, Homo sapiens
tctcccagaggatcccagtgga

SEQ ID NO: 9189965 - DNA, 22 bp, Homo sapiens
tctcccagaggatcccagtgga

SEQ ID NO: 9189966 - DNA, 22 bp, Homo sapiens
tctcccagaggatcccagtgga

SEQ ID NO: 9189967 - DNA, 22 bp, Homo sapiens
tctcccagaggatcccagtgga

SEQ ID NO: 9189968 - DNA, 22 bp, Homo sapiens
tctcccactgcaagcccaggct

SEQ ID NO: 9189969 - DNA, 22 bp, Homo sapiens
tctccaggttcagtcgatggaa

SEQ ID NO: 9189970 - DNA, 22 bp, Homo sapiens
tctccaggttcagtcgatggaa

SEQ ID NO: 9189971 - DNA, 22 bp, Homo sapiens
tctccaggtggcttgggcttct

SEQ ID NO: 9189972 - DNA, 22 bp, Homo sapiens
tctccaggtggggtcacctttt

SEQ ID NO: 9189973 - DNA, 22 bp, Homo sapiens
tctccaggtgaaacttgcaggg

SEQ ID NO: 9189974 - DNA, 22 bp, Homo sapiens
tctccaggtgactctgatgtat

SEQ ID NO: 9189975 - DNA, 22 bp, Homo sapiens
tctccaggtgactctgatgtat

SEQ ID NO: 9189976 - DNA, 22 bp, Homo sapiens
tctccaggtgaaacttgcaggg

SEQ ID NO: 9189977 - DNA, 22 bp, Homo sapiens
tctccaggtgaaacttgcaggg

SEQ ID NO: 9189978 - DNA, 22 bp, Homo sapiens
tctccaggtaaatggcatcctg

SEQ ID NO: 9189979 - DNA, 22 bp, Homo sapiens
tctccaggtagatatgtcagga

SEQ ID NO: 9189980 - DNA, 22 bp, Homo sapiens
tctccaggtagatatgtcagga

SEQ ID NO: 9189981 - DNA, 22 bp, Homo sapiens
tctccaggtgagggtggttaga

SEQ ID NO: 9189982 - DNA, 22 bp, Homo sapiens
tctccaggtgactctgatgtat

SEQ ID NO: 9189983 - DNA, 22 bp, Homo sapiens
tctccaggtgagggtggttaga

SEQ ID NO: 9189984 - DNA, 19 bp, Homo sapiens
tctccaggtgccccaaaca

SEQ ID NO: 9189985 - DNA, 19 bp, Homo sapiens
tctccaggtgccccaaaca

SEQ ID NO: 9189986 - DNA, 22 bp, Homo sapiens
tctccaggtgctaagtgtgcct

SEQ ID NO: 9189987 - DNA, 22 bp, Homo sapiens
tctccaggtgctaagtgtgcct

SEQ ID NO: 9189988 - DNA, 22 bp, Homo sapiens
tctccaggtgctaagtgtgcct

SEQ ID NO: 9189989 - DNA, 22 bp, Homo sapiens
tctccaggtgctaagtgtgcct

SEQ ID NO: 9189990 - DNA, 22 bp, Homo sapiens
tctccaggtgctaagtgtgcct

SEQ ID NO: 9189991 - DNA, 22 bp, Homo sapiens
tctccaggtggcttgggcttct

SEQ ID NO: 9189992 - DNA, 22 bp, Homo sapiens
tctccaggtggcttgggcttct

SEQ ID NO: 9189993 - DNA, 22 bp, Homo sapiens
tctccaggcttaatctcagctt

SEQ ID NO: 9189994 - DNA, 22 bp, Homo sapiens
tctccaggcttaatctcagctt

SEQ ID NO: 9189995 - DNA, 22 bp, Homo sapiens
tctccaggcttaatctcagctt

SEQ ID NO: 9189996 - DNA, 22 bp, Homo sapiens
tctccaggcttaatctcagctt

SEQ ID NO: 9189997 - DNA, 23 bp, Homo sapiens
tctccaggccttactccaggcct

SEQ ID NO: 9189998 - DNA, 23 bp, Homo sapiens
tctccaggccttactccaggcct

SEQ ID NO: 9189999 - DNA, 23 bp, Homo sapiens
tctccaggccttactccaggcct

SEQ ID NO: 9190000 - DNA, 23 bp, Homo sapiens
tctccaggccttactccaggcct

SEQ ID NO: 9190001 - DNA, 22 bp, Homo sapiens
tctccaggcctttcccatctta

SEQ ID NO: 9190002 - DNA, 22 bp, Homo sapiens
tctccaggcctttcccatctta

SEQ ID NO: 9190003 - DNA, 22 bp, Homo sapiens
tctccagggactgaggctggag

SEQ ID NO: 9190004 - DNA, 22 bp, Homo sapiens
tctccagggactgaggctggag

SEQ ID NO: 9190005 - DNA, 22 bp, Homo sapiens
tctccagggactgaggctggag

SEQ ID NO: 9190006 - DNA, 22 bp, Homo sapiens
tctccagggactgaggctggag

SEQ ID NO: 9190007 - DNA, 22 bp, Homo sapiens
tctccagggactgaggctggag

SEQ ID NO: 9190008 - DNA, 22 bp, Homo sapiens
tctccagggactgaggctggag

SEQ ID NO: 9190009 - DNA, 22 bp, Homo sapiens
tctccaggctttttgtgaattg

SEQ ID NO: 9190010 - DNA, 22 bp, Homo sapiens
tctccaggctttttgtgaattg

SEQ ID NO: 9190011 - DNA, 22 bp, Homo sapiens
tctccaggctttttgtgaattg

SEQ ID NO: 9190012 - DNA, 22 bp, Homo sapiens
tctccagggacatgtttctgga

SEQ ID NO: 9190013 - DNA, 22 bp, Homo sapiens
tctccagggacatgtttctgga

SEQ ID NO: 9190014 - DNA, 22 bp, Homo sapiens
tctccagggactgaggctggag

SEQ ID NO: 9190015 - DNA, 22 bp, Homo sapiens
tctccagggaggtagcccagtg

SEQ ID NO: 9190016 - DNA, 22 bp, Homo sapiens
tctccagggcagagaatagcaa

SEQ ID NO: 9190017 - DNA, 22 bp, Homo sapiens
tctccagggcagagaatagcaa

SEQ ID NO: 9190018 - DNA, 22 bp, Homo sapiens
tctccagggaggtagcccagtg

SEQ ID NO: 9190019 - DNA, 22 bp, Homo sapiens
tctccagggaggtagcccagtg

SEQ ID NO: 9190020 - DNA, 22 bp, Homo sapiens
tctccagggaggtagcccagtg

SEQ ID NO: 9190021 - DNA, 22 bp, Homo sapiens
tctccagggcccccgagcgttg

SEQ ID NO: 9190022 - DNA, 22 bp, Homo sapiens
tctccaggggcagggtctggag

SEQ ID NO: 9190023 - DNA, 22 bp, Homo sapiens
tctccagggcccccgagcgttg

SEQ ID NO: 9190024 - DNA, 22 bp, Homo sapiens
tctccagggcagagaatagcaa

SEQ ID NO: 9190025 - DNA, 22 bp, Homo sapiens
tctccaggggcagggtctggag

SEQ ID NO: 9190026 - DNA, 22 bp, Homo sapiens
tctccaggggcagggtctggag

SEQ ID NO: 9190027 - DNA, 22 bp, Homo sapiens
tctccaggggctgctgtgccac

SEQ ID NO: 9190028 - DNA, 22 bp, Homo sapiens
tctccaggggctgctgtgccac

SEQ ID NO: 9190029 - DNA, 22 bp, Homo sapiens
tctccaggtaaatggcatcctg

SEQ ID NO: 9190030 - DNA, 22 bp, Homo sapiens
tctccaggtaaatggcatcctg

SEQ ID NO: 9190031 - DNA, 22 bp, Homo sapiens
tctccaggggctgctgtgccac

SEQ ID NO: 9190032 - DNA, 22 bp, Homo sapiens
tctccagggtgagctaggccag

SEQ ID NO: 9190033 - DNA, 22 bp, Homo sapiens
tctccagggtgagctaggccag

SEQ ID NO: 9190034 - DNA, 22 bp, Homo sapiens
tctccagggtgagctaggccag

SEQ ID NO: 9190035 - DNA, 22 bp, Homo sapiens
tgcctcaagccctccactgcac

SEQ ID NO: 9190036 - DNA, 22 bp, Homo sapiens
tgcctcaagccctccactgcac

SEQ ID NO: 9190037 - DNA, 23 bp, Homo sapiens
tgcctattcagcagagtgatagc

SEQ ID NO: 9190038 - DNA, 22 bp, Homo sapiens
tgcctcaagccctccactgcac

SEQ ID NO: 9190039 - DNA, 22 bp, Homo sapiens
tgcctaggctggaatgcagtgg

SEQ ID NO: 9190040 - DNA, 22 bp, Homo sapiens
tgcctaggctggagtgtagtgg

SEQ ID NO: 9190041 - DNA, 22 bp, Homo sapiens
tgccgtggggctgaggctggag

SEQ ID NO: 9190042 - DNA, 22 bp, Homo sapiens
tgccgcaagtactgctgcctgt

SEQ ID NO: 9190043 - DNA, 22 bp, Homo sapiens
tgccctggctcttcttgttcca

SEQ ID NO: 9190044 - DNA, 22 bp, Homo sapiens
tgccctggctggagtgcagtgg

SEQ ID NO: 9190045 - DNA, 22 bp, Homo sapiens
tgccctggcttcagctttggct

SEQ ID NO: 9190046 - DNA, 22 bp, Homo sapiens
tgccctgggaacacagatgcca

SEQ ID NO: 9190047 - DNA, 22 bp, Homo sapiens
tgccctgggaacacagatgcca

SEQ ID NO: 9190048 - DNA, 22 bp, Homo sapiens
tgccctgtcgctcactcccacc

SEQ ID NO: 9190049 - DNA, 22 bp, Homo sapiens
tgccctgggaggctttcctgtt

SEQ ID NO: 9190050 - DNA, 22 bp, Homo sapiens
tgccctgggaggctttcctgtt

SEQ ID NO: 9190051 - DNA, 22 bp, Homo sapiens
tgccctgggaggctttcctgtt

SEQ ID NO: 9190052 - DNA, 22 bp, Homo sapiens
tgccctgggaacacagatgcca

SEQ ID NO: 9190053 - DNA, 22 bp, Homo sapiens
tgccctgggacatgcagcggag

SEQ ID NO: 9190054 - DNA, 22 bp, Homo sapiens
tgccctgtgccagacttcctgg

SEQ ID NO: 9190055 - DNA, 22 bp, Homo sapiens
tgcccttaggaaggctcaccaa

SEQ ID NO: 9190056 - DNA, 22 bp, Homo sapiens
tgccgcaagtactgctgcctgt

SEQ ID NO: 9190057 - DNA, 22 bp, Homo sapiens
tgcccctcttgctggccctgtc

SEQ ID NO: 9190058 - DNA, 22 bp, Homo sapiens
tgcccctgacctcaggcgaagg

SEQ ID NO: 9190059 - DNA, 22 bp, Homo sapiens
tgcccctcttgctggccctgtc

SEQ ID NO: 9190060 - DNA, 22 bp, Homo sapiens
tgcccctcttgctggccctgtc

SEQ ID NO: 9190061 - DNA, 22 bp, Homo sapiens
tgcccctcttgagaagctcagc

SEQ ID NO: 9190062 - DNA, 22 bp, Homo sapiens
tgcccctcttgagaagctcagc

SEQ ID NO: 9190063 - DNA, 22 bp, Homo sapiens
tgccccttcaccttcagtcttg

SEQ ID NO: 9190064 - DNA, 22 bp, Homo sapiens
tgccccttctacccgtctctgt

SEQ ID NO: 9190065 - DNA, 22 bp, Homo sapiens
tgccccttctacccgtctctgt

SEQ ID NO: 9190066 - DNA, 21 bp, Homo sapiens
tgcccctttatgggctcccta

SEQ ID NO: 9190067 - DNA, 22 bp, Homo sapiens
tgcccgctgctgctcagtctgt

SEQ ID NO: 9190068 - DNA, 21 bp, Homo sapiens
tgcccctttatgggctcccta

SEQ ID NO: 9190069 - DNA, 22 bp, Homo sapiens
tgccctgcagaccctgcagtgt

SEQ ID NO: 9190070 - DNA, 22 bp, Homo sapiens
tgccctgcagtgagtgcgtctg

SEQ ID NO: 9190071 - DNA, 22 bp, Homo sapiens
tgccctgcagtgagtgcgtctg

SEQ ID NO: 9190072 - DNA, 22 bp, Homo sapiens
tgcccgttcattcatacttaac

SEQ ID NO: 9190073 - DNA, 22 bp, Homo sapiens
tgcccgctgctgctcagtctgt

SEQ ID NO: 9190074 - DNA, 22 bp, Homo sapiens
tgccctcagaattgctccctgc

SEQ ID NO: 9190075 - DNA, 22 bp, Homo sapiens
tgccctgccaagactcagtggt

SEQ ID NO: 9190076 - DNA, 22 bp, Homo sapiens
tgccctgccaagactcagtggt

SEQ ID NO: 9190077 - DNA, 22 bp, Homo sapiens
tgccctgcggctatctagatga

SEQ ID NO: 9190078 - DNA, 22 bp, Homo sapiens
tgccctgcccttgctatttcta

SEQ ID NO: 9190079 - DNA, 22 bp, Homo sapiens
tgccctggctcttcttgttcca

SEQ ID NO: 9190080 - DNA, 22 bp, Homo sapiens
tgccctggctcttcttgttcca

SEQ ID NO: 9190081 - DNA, 22 bp, Homo sapiens
tgccctggctctccactagttt

SEQ ID NO: 9190082 - DNA, 22 bp, Homo sapiens
tgccctggctcctcccacgctg

SEQ ID NO: 9190083 - DNA, 22 bp, Homo sapiens
tgccctggcgctgtctctatgg

SEQ ID NO: 9190084 - DNA, 22 bp, Homo sapiens
tgccctggatgctgcaggtgtg

SEQ ID NO: 9190085 - DNA, 22 bp, Homo sapiens
tgccctggatgctgcaggtgtg

SEQ ID NO: 9190086 - DNA, 22 bp, Homo sapiens
tgccctggcacacacacagctg

SEQ ID NO: 9190087 - DNA, 22 bp, Homo sapiens
tgccctgctgtggctctgccca

SEQ ID NO: 9190088 - DNA, 22 bp, Homo sapiens
tgccctgcttggtttattttca

SEQ ID NO: 9190089 - DNA, 22 bp, Homo sapiens
tgccctggaaatgagaggtgtg

SEQ ID NO: 9190090 - DNA, 22 bp, Homo sapiens
tgccctggaaccatctacagtc

SEQ ID NO: 9190091 - DNA, 22 bp, Homo sapiens
tgccctggaaccatctacagtc

SEQ ID NO: 9190092 - DNA, 22 bp, Homo sapiens
tgccctggaaccatctacagtc

SEQ ID NO: 9190093 - DNA, 22 bp, Homo sapiens
tgccctggaggggcttacagtc

SEQ ID NO: 9190094 - DNA, 22 bp, Homo sapiens
tgccctggaggggcttacagtc

SEQ ID NO: 9190095 - DNA, 22 bp, Homo sapiens
tgccctggaggggcttacagtc

SEQ ID NO: 9190096 - DNA, 22 bp, Homo sapiens
tgcctgcatcttggaggcccca

SEQ ID NO: 9190097 - DNA, 22 bp, Homo sapiens
tgcctgagtttaaccctcagag

SEQ ID NO: 9190098 - DNA, 22 bp, Homo sapiens
tgcctgccacgcttgctaccac

SEQ ID NO: 9190099 - DNA, 22 bp, Homo sapiens
tgcctgcccacgactacagcag

SEQ ID NO: 9190100 - DNA, 22 bp, Homo sapiens
tgcctgctttctgggctgccat

SEQ ID NO: 9190101 - DNA, 22 bp, Homo sapiens
tgcctgctttctcctcaactca

SEQ ID NO: 9190102 - DNA, 22 bp, Homo sapiens
tgcctgctttctcctcaactca

SEQ ID NO: 9190103 - DNA, 19 bp, Homo sapiens
tgcctggacaaatgtgggg

SEQ ID NO: 9190104 - DNA, 22 bp, Homo sapiens
tgcctggaaggcccatgggaag

SEQ ID NO: 9190105 - DNA, 22 bp, Homo sapiens
tgcctggaccccacctccggaa

SEQ ID NO: 9190106 - DNA, 23 bp, Homo sapiens
tgcctggagaagcatgaaatgta

SEQ ID NO: 9190107 - DNA, 22 bp, Homo sapiens
tgcctgcttgtttacctactcc

SEQ ID NO: 9190108 - DNA, 22 bp, Homo sapiens
tgcctgcttgtgtacctggtga

SEQ ID NO: 9190109 - DNA, 22 bp, Homo sapiens
tgcctgcttgtttacctactcc

SEQ ID NO: 9190110 - DNA, 22 bp, Homo sapiens
tgcctgcttgtgtacctggtga

SEQ ID NO: 9190111 - DNA, 22 bp, Homo sapiens
tgcctgctgctaagctctttgt

SEQ ID NO: 9190112 - DNA, 22 bp, Homo sapiens
tgcctgctgcctttcatcccaa

SEQ ID NO: 9190113 - DNA, 22 bp, Homo sapiens
tgcctgctgccactgctgttac

SEQ ID NO: 9190114 - DNA, 22 bp, Homo sapiens
tgcctgctgattggagttgaat

SEQ ID NO: 9190115 - DNA, 22 bp, Homo sapiens
tgcctgctctttattttatgat

SEQ ID NO: 9190116 - DNA, 22 bp, Homo sapiens
tgcctgctgattggagttgaat

SEQ ID NO: 9190117 - DNA, 20 bp, Homo sapiens
tgcctgcccaggtcctgcac

SEQ ID NO: 9190118 - DNA, 22 bp, Homo sapiens
tgcctggcatctagccctggga

SEQ ID NO: 9190119 - DNA, 22 bp, Homo sapiens
tgcctggcaccccagtctgcac

SEQ ID NO: 9190120 - DNA, 22 bp, Homo sapiens
tgcctggcactcctggagctca

SEQ ID NO: 9190121 - DNA, 22 bp, Homo sapiens
tgcctggcaatgccagaagcca

SEQ ID NO: 9190122 - DNA, 22 bp, Homo sapiens
tgcctggcacagagcaggtggc

SEQ ID NO: 9190123 - DNA, 19 bp, Homo sapiens
tgcctggcaccagctccac

SEQ ID NO: 9190124 - DNA, 22 bp, Homo sapiens
tgcctggatggctctgagcagg

SEQ ID NO: 9190125 - DNA, 22 bp, Homo sapiens
tgcctggatggctctgagcagg

SEQ ID NO: 9190126 - DNA, 22 bp, Homo sapiens
tgcctggatctgaggacccatt

SEQ ID NO: 9190127 - DNA, 22 bp, Homo sapiens
tgcctggagtgtgttcaggatt

SEQ ID NO: 9190128 - DNA, 22 bp, Homo sapiens
tgcctggagtccccaagtccat

SEQ ID NO: 9190129 - DNA, 22 bp, Homo sapiens
tgcctggcaactgtggtgggct

SEQ ID NO: 9190130 - DNA, 22 bp, Homo sapiens
tgcctggatgtgctggcctcac

SEQ ID NO: 9190131 - DNA, 22 bp, Homo sapiens
tgcctggcaagaggggctggct

SEQ ID NO: 9190132 - DNA, 22 bp, Homo sapiens
tgcctctgtgggcagagctgcc

SEQ ID NO: 9190133 - DNA, 22 bp, Homo sapiens
tgcctctgtgggccttcctggc

SEQ ID NO: 9190134 - DNA, 22 bp, Homo sapiens
tgcctctgtgggccttcctggc

SEQ ID NO: 9190135 - DNA, 22 bp, Homo sapiens
tgcctctggcctttggtgccca

SEQ ID NO: 9190136 - DNA, 22 bp, Homo sapiens
tgcctctggcctttggtgccca

SEQ ID NO: 9190137 - DNA, 22 bp, Homo sapiens
tgcctctgctgctgtggcatca

SEQ ID NO: 9190138 - DNA, 22 bp, Homo sapiens
tgcctctggttatctggtacct

SEQ ID NO: 9190139 - DNA, 22 bp, Homo sapiens
tgcctctggttatctggtacct

SEQ ID NO: 9190140 - DNA, 22 bp, Homo sapiens
tgcctctgtggaaatggtggtc

SEQ ID NO: 9190141 - DNA, 22 bp, Homo sapiens
tgcctgagtttaaccctcagag

SEQ ID NO: 9190142 - DNA, 22 bp, Homo sapiens
tgcctgagtgatgtggcagcca

SEQ ID NO: 9190143 - DNA, 22 bp, Homo sapiens
tgcctgagtgatgtggcagcca

SEQ ID NO: 9190144 - DNA, 22 bp, Homo sapiens
tgcctgaaataccatcatgagt

SEQ ID NO: 9190145 - DNA, 22 bp, Homo sapiens
tgcctgaagctgcattcctagt

SEQ ID NO: 9190146 - DNA, 22 bp, Homo sapiens
tgcctgaacatgaatagtttat

SEQ ID NO: 9190147 - DNA, 22 bp, Homo sapiens
tgcctctgtgtgcaggtgagca

SEQ ID NO: 9190148 - DNA, 22 bp, Homo sapiens
tgcctctgtgtgcaggtgagca

SEQ ID NO: 9190149 - DNA, 22 bp, Homo sapiens
tgcctctgttgagccttggctg

SEQ ID NO: 9190150 - DNA, 22 bp, Homo sapiens
tgcctctgctgcatattcacct

SEQ ID NO: 9190151 - DNA, 23 bp, Homo sapiens
tgcctctgcctccctagtctgca

SEQ ID NO: 9190152 - DNA, 22 bp, Homo sapiens
tgcctctgcctccattgttagt

SEQ ID NO: 9190153 - DNA, 22 bp, Homo sapiens
tgcctctctaacccatgcccaa

SEQ ID NO: 9190154 - DNA, 22 bp, Homo sapiens
tgcctctgaggaagattgtgtt

SEQ ID NO: 9190155 - DNA, 22 bp, Homo sapiens
tgcctccttcaggagggcccgg

SEQ ID NO: 9190156 - DNA, 22 bp, Homo sapiens
tgcctcaggcacctggcaggtt

SEQ ID NO: 9190157 - DNA, 19 bp, Homo sapiens
tgcctcagggctttgagga

SEQ ID NO: 9190158 - DNA, 22 bp, Homo sapiens
tgcctccattcctgggtcattg

SEQ ID NO: 9190159 - DNA, 22 bp, Homo sapiens
tgcccagcagggagctacctgg

SEQ ID NO: 9190160 - DNA, 22 bp, Homo sapiens
tgcccagcacccagcatgatgc

SEQ ID NO: 9190161 - DNA, 20 bp, Homo sapiens
tgcccagcaagagtgcagtt

SEQ ID NO: 9190162 - DNA, 20 bp, Homo sapiens
tgcccagcaagagtgcagtt

SEQ ID NO: 9190163 - DNA, 22 bp, Homo sapiens
tgcccacctaacagtgtttgga

SEQ ID NO: 9190164 - DNA, 22 bp, Homo sapiens
tgcccacctttactgtgattta

SEQ ID NO: 9190165 - DNA, 20 bp, Homo sapiens
tgcccagcaagagtgcagtt

SEQ ID NO: 9190166 - DNA, 22 bp, Homo sapiens
tgcccagagcctgagaggatta

SEQ ID NO: 9190167 - DNA, 19 bp, Homo sapiens
tgcccagagtgtatgcgca

SEQ ID NO: 9190168 - DNA, 22 bp, Homo sapiens
tgcccagagcctcttacctcca

SEQ ID NO: 9190169 - DNA, 22 bp, Homo sapiens
tgcccaagtcctccaccgaggt

SEQ ID NO: 9190170 - DNA, 22 bp, Homo sapiens
tgcccaagtgtttggctgagtc

SEQ ID NO: 9190171 - DNA, 22 bp, Homo sapiens
tgcccaagtgtttggctgagtc

SEQ ID NO: 9190172 - DNA, 22 bp, Homo sapiens
tgcccaagatcctacatcctga

SEQ ID NO: 9190173 - DNA, 22 bp, Homo sapiens
tgcccaagattcttacatcatg

SEQ ID NO: 9190174 - DNA, 22 bp, Homo sapiens
tgcccaagcagaggagtgattc

SEQ ID NO: 9190175 - DNA, 22 bp, Homo sapiens
tgcccaagcagaggagtgattc

SEQ ID NO: 9190176 - DNA, 20 bp, Homo sapiens
tgcccacatcactcaggagt

SEQ ID NO: 9190177 - DNA, 22 bp, Homo sapiens
tgccatttagtgcatcattagt

SEQ ID NO: 9190178 - DNA, 22 bp, Homo sapiens
tgccattcatttttaaggaagg

SEQ ID NO: 9190179 - DNA, 19 bp, Homo sapiens
tgccatttgactgaatgta

SEQ ID NO: 9190180 - DNA, 22 bp, Homo sapiens
tgccatttgccccagcactgtc

SEQ ID NO: 9190181 - DNA, 22 bp, Homo sapiens
tgccatttctcacatatgtatg

SEQ ID NO: 9190182 - DNA, 22 bp, Homo sapiens
tgccatttctcaaatatgacta

SEQ ID NO: 9190183 - DNA, 22 bp, Homo sapiens
tgccatttctcaggctatttca

SEQ ID NO: 9190184 - DNA, 22 bp, Homo sapiens
tgccatttgctggttttctgat

SEQ ID NO: 9190185 - DNA, 22 bp, Homo sapiens
tgccatttgtaactatcattct

SEQ ID NO: 9190186 - DNA, 22 bp, Homo sapiens
tgccatttgttactatcaggac

SEQ ID NO: 9190187 - DNA, 23 bp, Homo sapiens
tgccattttccatctcatgcaga

SEQ ID NO: 9190188 - DNA, 22 bp, Homo sapiens
tgccatttctttcaatattctt

SEQ ID NO: 9190189 - DNA, 21 bp, Homo sapiens
tgccattttaaccaagtgtgc

SEQ ID NO: 9190190 - DNA, 22 bp, Homo sapiens
tgccattttgagatgttaatga

SEQ ID NO: 9190191 - DNA, 22 bp, Homo sapiens
tgcccaggattgtgaggtcagg

SEQ ID NO: 9190192 - DNA, 22 bp, Homo sapiens
tgcccaggattgtgaggtcagg

SEQ ID NO: 9190193 - DNA, 19 bp, Homo sapiens
tgcccaggccaggttgggc

SEQ ID NO: 9190194 - DNA, 22 bp, Homo sapiens
tgcccaggattgtgaggtcagg

SEQ ID NO: 9190195 - DNA, 19 bp, Homo sapiens
tgcccaggcctcccaaaag

SEQ ID NO: 9190196 - DNA, 19 bp, Homo sapiens
tgcccaggccaggttgggc

SEQ ID NO: 9190197 - DNA, 22 bp, Homo sapiens
tgcccaggctggagtacagtgg

SEQ ID NO: 9190198 - DNA, 22 bp, Homo sapiens
tgcccaggctggagtacagtgg

SEQ ID NO: 9190199 - DNA, 22 bp, Homo sapiens
tgcccaggctggaatgcagtgg

SEQ ID NO: 9190200 - DNA, 22 bp, Homo sapiens
tgcccaggctcctcgcagcctt

SEQ ID NO: 9190201 - DNA, 22 bp, Homo sapiens
tgcccagggtggagtgcagcgg

SEQ ID NO: 9190202 - DNA, 22 bp, Homo sapiens
tgcccaggctggagtgcagtgg

SEQ ID NO: 9190203 - DNA, 22 bp, Homo sapiens
tgcccaggctggagtgcagtgg

SEQ ID NO: 9190204 - DNA, 22 bp, Homo sapiens
tgcccaggctggagtgcagagg

SEQ ID NO: 9190205 - DNA, 22 bp, Homo sapiens
tgcccaggctggagtgcagagg

SEQ ID NO: 9190206 - DNA, 22 bp, Homo sapiens
tgccccaggtgctgaggttgga

SEQ ID NO: 9190207 - DNA, 22 bp, Homo sapiens
tgcccctcagggaacgggtatc

SEQ ID NO: 9190208 - DNA, 22 bp, Homo sapiens
tgcccctctcctgtgatccaag

SEQ ID NO: 9190209 - DNA, 22 bp, Homo sapiens
tgcccctctcctgtgatccaag

SEQ ID NO: 9190210 - DNA, 22 bp, Homo sapiens
tgcccctcgacgcaatgaaggg

SEQ ID NO: 9190211 - DNA, 22 bp, Homo sapiens
tgcccaggtttgagtgcccaag

SEQ ID NO: 9190212 - DNA, 22 bp, Homo sapiens
tgcccagggtttctaagagcag

SEQ ID NO: 9190213 - DNA, 22 bp, Homo sapiens
tgcccagggtttctaagagcag

SEQ ID NO: 9190214 - DNA, 22 bp, Homo sapiens
tgcccagggtggagtgcagtgg

SEQ ID NO: 9190215 - DNA, 22 bp, Homo sapiens
tgcccagggtggagtgcagtgg

SEQ ID NO: 9190216 - DNA, 22 bp, Homo sapiens
tgcccagggtggagtgcagcgg

SEQ ID NO: 9190217 - DNA, 22 bp, Homo sapiens
tgcccagggtggagtgcagcgg

SEQ ID NO: 9190218 - DNA, 22 bp, Homo sapiens
tgcccagggtggagtgcagcgg

SEQ ID NO: 9190219 - DNA, 22 bp, Homo sapiens
tgcccaggtttgagtgcccaag

SEQ ID NO: 9190220 - DNA, 22 bp, Homo sapiens
tgcccaggtttgagtgcccaag

SEQ ID NO: 9190221 - DNA, 22 bp, Homo sapiens
tgcccaggtttgagtgcccaag

SEQ ID NO: 9190222 - DNA, 21 bp, Homo sapiens
tgcccatgagcagaagtcacc

SEQ ID NO: 9190223 - DNA, 22 bp, Homo sapiens
tgcccatgtttctctgtatccc

SEQ ID NO: 9190224 - DNA, 22 bp, Homo sapiens
tgcccatggaccaagcaagggg

SEQ ID NO: 9190225 - DNA, 22 bp, Homo sapiens
tgccaggctaagtggaggactt

SEQ ID NO: 9190226 - DNA, 22 bp, Homo sapiens
tgccaggccctgtgctggatgc

SEQ ID NO: 9190227 - DNA, 22 bp, Homo sapiens
tgccaggctcagcccctatctt

SEQ ID NO: 9190228 - DNA, 22 bp, Homo sapiens
tgccaggctaagtggaggactt

SEQ ID NO: 9190229 - DNA, 22 bp, Homo sapiens
tgccaggctcaggatgtccctg

SEQ ID NO: 9190230 - DNA, 22 bp, Homo sapiens
tgccaggccctcccacagatta

SEQ ID NO: 9190231 - DNA, 22 bp, Homo sapiens
tgccaggccctgcggggtccca

SEQ ID NO: 9190232 - DNA, 22 bp, Homo sapiens
tgccaggccctgcggggtccca

SEQ ID NO: 9190233 - DNA, 22 bp, Homo sapiens
tgccaggccctgtgctggatgc

SEQ ID NO: 9190234 - DNA, 22 bp, Homo sapiens
tgccaggcccagctccagagct

SEQ ID NO: 9190235 - DNA, 22 bp, Homo sapiens
tgccaggcccagctccagagct

SEQ ID NO: 9190236 - DNA, 22 bp, Homo sapiens
tgccaggccctcccacagatta

SEQ ID NO: 9190237 - DNA, 22 bp, Homo sapiens
tgccaggccctcccacagatta

SEQ ID NO: 9190238 - DNA, 22 bp, Homo sapiens
tgccaggccaatgaaggcaggg

SEQ ID NO: 9190239 - DNA, 22 bp, Homo sapiens
tgccaggcatttgacagacact

SEQ ID NO: 9190240 - DNA, 22 bp, Homo sapiens
tgccaggccaattctatttgac

SEQ ID NO: 9190241 - DNA, 22 bp, Homo sapiens
tgccaggccaatgaaggcaggg

SEQ ID NO: 9190242 - DNA, 22 bp, Homo sapiens
tgccaggccacgtagcttcaag

SEQ ID NO: 9190243 - DNA, 22 bp, Homo sapiens
tgccaggcccagcagggcggcc

SEQ ID NO: 9190244 - DNA, 22 bp, Homo sapiens
tgccaggcccagctccagagct

SEQ ID NO: 9190245 - DNA, 22 bp, Homo sapiens
tgccaggcccagcagggcggcc

SEQ ID NO: 9190246 - DNA, 20 bp, Homo sapiens
tgccaggcacggagtgcatg

SEQ ID NO: 9190247 - DNA, 22 bp, Homo sapiens
tgccaggcacgtgagagtggcc

SEQ ID NO: 9190248 - DNA, 22 bp, Homo sapiens
tgccaggcacgtgagagtggcc

SEQ ID NO: 9190249 - DNA, 22 bp, Homo sapiens
tgccaggcaggaccctagaacc

SEQ ID NO: 9190250 - DNA, 22 bp, Homo sapiens
tgccaggcacgtgagagtggcc

SEQ ID NO: 9190251 - DNA, 22 bp, Homo sapiens
tgccaggcagtgtcagattgag

SEQ ID NO: 9190252 - DNA, 22 bp, Homo sapiens
tgccaggcagtgtcagattgag

SEQ ID NO: 9190253 - DNA, 22 bp, Homo sapiens
tgccaggcagtgtcagattgag

SEQ ID NO: 9190254 - DNA, 22 bp, Homo sapiens
tgccaggcatatggcctctttg

SEQ ID NO: 9190255 - DNA, 22 bp, Homo sapiens
tgccaggcatgtagtagacttg

SEQ ID NO: 9190256 - DNA, 17 bp, Homo sapiens
tgccagcctgtcccagg

SEQ ID NO: 9190257 - DNA, 22 bp, Homo sapiens
tgccagctactctgtaggctga

SEQ ID NO: 9190258 - DNA, 22 bp, Homo sapiens
tgccagctactctgtaggctga

SEQ ID NO: 9190259 - DNA, 22 bp, Homo sapiens
tgccagctactctgtaggctga

SEQ ID NO: 9190260 - DNA, 18 bp, Homo sapiens
tgccagccgactggcctg

SEQ ID NO: 9190261 - DNA, 22 bp, Homo sapiens
tgccagcctcctgatatcatcc

SEQ ID NO: 9190262 - DNA, 22 bp, Homo sapiens
tgccagcctggcctgagtcttt

SEQ ID NO: 9190263 - DNA, 20 bp, Homo sapiens
tgccaggcacggagtgcatg

SEQ ID NO: 9190264 - DNA, 22 bp, Homo sapiens
tgccaggcaactgcccagccat

SEQ ID NO: 9190265 - DNA, 22 bp, Homo sapiens
tgccaggattgttgagatgatt

SEQ ID NO: 9190266 - DNA, 22 bp, Homo sapiens
tgccaggcaactgcccagccat

SEQ ID NO: 9190267 - DNA, 19 bp, Homo sapiens
tgccagctcacaggagctc

SEQ ID NO: 9190268 - DNA, 19 bp, Homo sapiens
tgccagctcacaggagctc

SEQ ID NO: 9190269 - DNA, 22 bp, Homo sapiens
tgccagctcagagttaggactg

SEQ ID NO: 9190270 - DNA, 22 bp, Homo sapiens
tgccagctcccttttctcctcc

SEQ ID NO: 9190271 - DNA, 20 bp, Homo sapiens
tgccagggccagcagaggct

SEQ ID NO: 9190272 - DNA, 22 bp, Homo sapiens
tgccagggccatagggagtcta

SEQ ID NO: 9190273 - DNA, 22 bp, Homo sapiens
tgccagggccatagggagtcta

SEQ ID NO: 9190274 - DNA, 22 bp, Homo sapiens
tgccagggccatagggagtcta

SEQ ID NO: 9190275 - DNA, 22 bp, Homo sapiens
tgccagggctgctactggctga

SEQ ID NO: 9190276 - DNA, 23 bp, Homo sapiens
tgccagggccctgtgtgcaatgc

SEQ ID NO: 9190277 - DNA, 22 bp, Homo sapiens
tgccagggtcagctgcagctct

SEQ ID NO: 9190278 - DNA, 22 bp, Homo sapiens
tgccaggggacctagggatgtc

SEQ ID NO: 9190279 - DNA, 22 bp, Homo sapiens
tgccaggggacctagggatgtc

SEQ ID NO: 9190280 - DNA, 22 bp, Homo sapiens
tgccagggtcctgagggccttg

SEQ ID NO: 9190281 - DNA, 22 bp, Homo sapiens
tgccatccccatgtggtggaga

SEQ ID NO: 9190282 - DNA, 22 bp, Homo sapiens
tgccagggtgtcaggagagcta

SEQ ID NO: 9190283 - DNA, 22 bp, Homo sapiens
tgccagggtgtcaggagagcta

SEQ ID NO: 9190284 - DNA, 22 bp, Homo sapiens
tgccagggtgtcaggagagcta

SEQ ID NO: 9190285 - DNA, 22 bp, Homo sapiens
tgccaggtacacaagtagccag

SEQ ID NO: 9190286 - DNA, 22 bp, Homo sapiens
tgccaggctccggaacgacagt

SEQ ID NO: 9190287 - DNA, 22 bp, Homo sapiens
tgccaggctccggaacgacagt

SEQ ID NO: 9190288 - DNA, 20 bp, Homo sapiens
tgccaggctgcacgcctgcc

SEQ ID NO: 9190289 - DNA, 22 bp, Homo sapiens
tgccaggctgaacagggtctta

SEQ ID NO: 9190290 - DNA, 22 bp, Homo sapiens
tgccaggctgaacagggtctta

SEQ ID NO: 9190291 - DNA, 22 bp, Homo sapiens
tgccaggctgtcctgggcctgg

SEQ ID NO: 9190292 - DNA, 22 bp, Homo sapiens
tgccaggctgtcaattcaccca

SEQ ID NO: 9190293 - DNA, 22 bp, Homo sapiens
tgccaggctgccctccagtctg

SEQ ID NO: 9190294 - DNA, 22 bp, Homo sapiens
tgccaggctgccctccagtctg

SEQ ID NO: 9190295 - DNA, 22 bp, Homo sapiens
tgccaggcttagagcaggggct

SEQ ID NO: 9190296 - DNA, 22 bp, Homo sapiens
tgccaggcttagagcaggggct

SEQ ID NO: 9190297 - DNA, 22 bp, Homo sapiens
tgccaggctttggtcaaaggct

SEQ ID NO: 9190298 - DNA, 22 bp, Homo sapiens
tgccagggaccctgtcggccct

SEQ ID NO: 9190299 - DNA, 22 bp, Homo sapiens
tgccagggaccctgtcggccct

SEQ ID NO: 9190300 - DNA, 22 bp, Homo sapiens
tgccagggagccctgctgacca

SEQ ID NO: 9190301 - DNA, 22 bp, Homo sapiens
tgccagggagccctgctgacca

SEQ ID NO: 9190302 - DNA, 20 bp, Homo sapiens
tgccagggccagcagaggct

SEQ ID NO: 9190303 - DNA, 21 bp, Homo sapiens
tgccagggatttacagagcct

SEQ ID NO: 9190304 - DNA, 22 bp, Homo sapiens
tgcatttcagaagaaaattcgg

SEQ ID NO: 9190305 - DNA, 22 bp, Homo sapiens
tgcatttgagttgggagcaggc

SEQ ID NO: 9190306 - DNA, 22 bp, Homo sapiens
tgcatttgaagtcagacaggct

SEQ ID NO: 9190307 - DNA, 22 bp, Homo sapiens
tgcatttgaagtcagacaggct

SEQ ID NO: 9190308 - DNA, 22 bp, Homo sapiens
tgcatttgagttgggagcaggc

SEQ ID NO: 9190309 - DNA, 22 bp, Homo sapiens
tgcatttgctggggatgtgatt

SEQ ID NO: 9190310 - DNA, 22 bp, Homo sapiens
tgcatttgctggggatgtgatt

SEQ ID NO: 9190311 - DNA, 22 bp, Homo sapiens
tgcatttccagatttctggagt

SEQ ID NO: 9190312 - DNA, 22 bp, Homo sapiens
tgcatttgttaccttattgcag

SEQ ID NO: 9190313 - DNA, 20 bp, Homo sapiens
tgcatttgttatttgtactc

SEQ ID NO: 9190314 - DNA, 22 bp, Homo sapiens
tgcatttgtaacattcaagaat

SEQ ID NO: 9190315 - DNA, 22 bp, Homo sapiens
tgccaaagaagtatcaaagatg

SEQ ID NO: 9190316 - DNA, 23 bp, Homo sapiens
tgccaaagtttacctaacactgg

SEQ ID NO: 9190317 - DNA, 22 bp, Homo sapiens
tgccaaaatggccaaaagctag

SEQ ID NO: 9190318 - DNA, 18 bp, Homo sapiens
tgcatttagtacatctag

SEQ ID NO: 9190319 - DNA, 22 bp, Homo sapiens
tgcatttagttatgagaaaaac

SEQ ID NO: 9190320 - DNA, 22 bp, Homo sapiens
tgcattgagtcatttcagtatg

SEQ ID NO: 9190321 - DNA, 22 bp, Homo sapiens
tgcattgattgacaggaaagta

SEQ ID NO: 9190322 - DNA, 22 bp, Homo sapiens
tgccaccctggcggcagcctgc

SEQ ID NO: 9190323 - DNA, 22 bp, Homo sapiens
tgccaccccggcccagagagca

SEQ ID NO: 9190324 - DNA, 22 bp, Homo sapiens
tgccacctagtggtctttagtc

SEQ ID NO: 9190325 - DNA, 22 bp, Homo sapiens
tgccacctcctctaacaagtgg

SEQ ID NO: 9190326 - DNA, 22 bp, Homo sapiens
tgccagaagtgctttataagtg

SEQ ID NO: 9190327 - DNA, 22 bp, Homo sapiens
tgccagagaagacccagtcact

SEQ ID NO: 9190328 - DNA, 22 bp, Homo sapiens
tgccagaatttgcttccaatgt

SEQ ID NO: 9190329 - DNA, 22 bp, Homo sapiens
tgccaccttgtgcagcaggagg

SEQ ID NO: 9190330 - DNA, 22 bp, Homo sapiens
tgccacagggtcctcaggccag

SEQ ID NO: 9190331 - DNA, 22 bp, Homo sapiens
tgccacaggcaatccctgcacg

SEQ ID NO: 9190332 - DNA, 22 bp, Homo sapiens
tgccacagttgtttgtgctcta

SEQ ID NO: 9190333 - DNA, 22 bp, Homo sapiens
tgccacagggtcctcaggccag

SEQ ID NO: 9190334 - DNA, 22 bp, Homo sapiens
tgccacaggcaatccctgcacg

SEQ ID NO: 9190335 - DNA, 22 bp, Homo sapiens
tgccaagaccacaattgctttt

SEQ ID NO: 9190336 - DNA, 22 bp, Homo sapiens
tgccaagagatgactgaaatgg

SEQ ID NO: 9190337 - DNA, 22 bp, Homo sapiens
tgccacagttgtttgtgctcta

SEQ ID NO: 9190338 - DNA, 22 bp, Homo sapiens
tgccaccatctggctgtgttga

SEQ ID NO: 9190339 - DNA, 22 bp, Homo sapiens
tgccagagatttcacactgcta

SEQ ID NO: 9190340 - DNA, 23 bp, Homo sapiens
tgccagaggcagtcacagtggtg

SEQ ID NO: 9190341 - DNA, 23 bp, Homo sapiens
tgccagaggcagtcacagtggtg

SEQ ID NO: 9190342 - DNA, 22 bp, Homo sapiens
tgccagcaccttcctgctccct

SEQ ID NO: 9190343 - DNA, 22 bp, Homo sapiens
tgccagcaccttcctgctccct

SEQ ID NO: 9190344 - DNA, 22 bp, Homo sapiens
tgccagagagtggctgggtgtc

SEQ ID NO: 9190345 - DNA, 22 bp, Homo sapiens
tgccagagaatcacctctcctt

SEQ ID NO: 9190346 - DNA, 22 bp, Homo sapiens
tgccagagaagacccagtcact

SEQ ID NO: 9190347 - DNA, 22 bp, Homo sapiens
tgccagagcaaaatgcccttaa

SEQ ID NO: 9190348 - DNA, 19 bp, Homo sapiens
tgccagagatactcccaga

SEQ ID NO: 9190349 - DNA, 22 bp, Homo sapiens
tgccagccaggttctgaggcta

SEQ ID NO: 9190350 - DNA, 22 bp, Homo sapiens
tgccagccagggaagctcaccc

SEQ ID NO: 9190351 - DNA, 22 bp, Homo sapiens
tgccagccagggaagctcaccc

SEQ ID NO: 9190352 - DNA, 19 bp, Homo sapiens
tgccagcattaggctgaag

SEQ ID NO: 9190353 - DNA, 19 bp, Homo sapiens
tgccagcattaggctgaag

SEQ ID NO: 9190354 - DNA, 22 bp, Homo sapiens
tgccagcagtagcagtaggcca

SEQ ID NO: 9190355 - DNA, 22 bp, Homo sapiens
tgcatacacacataggtatggg

SEQ ID NO: 9190356 - DNA, 22 bp, Homo sapiens
tgcataactagagtaattacag

SEQ ID NO: 9190357 - DNA, 22 bp, Homo sapiens
tgcatagttctccttcctcctc

SEQ ID NO: 9190358 - DNA, 22 bp, Homo sapiens
tgcatcagagtttgctgctgct

SEQ ID NO: 9190359 - DNA, 22 bp, Homo sapiens
tgcatcagctgtgcttcttgac

SEQ ID NO: 9190360 - DNA, 22 bp, Homo sapiens
tgcatcagtgactgggagataa

SEQ ID NO: 9190361 - DNA, 22 bp, Homo sapiens
tgcatccttaaccagcatcact

SEQ ID NO: 9190362 - DNA, 22 bp, Homo sapiens
tgcatctgattctcaggcagaa

SEQ ID NO: 9190363 - DNA, 19 bp, Homo sapiens
tgcataaattatatacttt

SEQ ID NO: 9190364 - DNA, 19 bp, Homo sapiens
tgcataaattatatacttt

SEQ ID NO: 9190365 - DNA, 22 bp, Homo sapiens
tgcataaagtgccatagtatta

SEQ ID NO: 9190366 - DNA, 21 bp, Homo sapiens
tgcataaagaaatacaaatac

SEQ ID NO: 9190367 - DNA, 22 bp, Homo sapiens
tgcataaaatatgagaaatgta

SEQ ID NO: 9190368 - DNA, 22 bp, Homo sapiens
tgcataaacagatacttcatgt

SEQ ID NO: 9190369 - DNA, 22 bp, Homo sapiens
tgcataaaatatgagaaatgta

SEQ ID NO: 9190370 - DNA, 22 bp, Homo sapiens
tgcagttgaccatgctttatat

SEQ ID NO: 9190371 - DNA, 22 bp, Homo sapiens
tgcagttttggccattgaaggc

SEQ ID NO: 9190372 - DNA, 22 bp, Homo sapiens
tgcagttttggccattgaaggc

SEQ ID NO: 9190373 - DNA, 22 bp, Homo sapiens
tgcataaaaaccacatacaagg

SEQ ID NO: 9190374 - DNA, 22 bp, Homo sapiens
tgcagttttgccaggcaatgga

SEQ ID NO: 9190375 - DNA, 22 bp, Homo sapiens
tgcagttttatcacatatatag

SEQ ID NO: 9190376 - DNA, 22 bp, Homo sapiens
tgcagttttccttcaacattgt

SEQ ID NO: 9190377 - DNA, 17 bp, Homo sapiens
tgcatgtcctttgttcc

SEQ ID NO: 9190378 - DNA, 17 bp, Homo sapiens
tgcatgtcctttgttcc

SEQ ID NO: 9190379 - DNA, 22 bp, Homo sapiens
tgcatgtcaaggcactcaggat

SEQ ID NO: 9190380 - DNA, 22 bp, Homo sapiens
tgcatgtatgtaaatgtgagcg

SEQ ID NO: 9190381 - DNA, 17 bp, Homo sapiens
tgcatgtcctttgttcc

SEQ ID NO: 9190382 - DNA, 23 bp, Homo sapiens
tgcatgtgaattcatacttgttt

SEQ ID NO: 9190383 - DNA, 22 bp, Homo sapiens
tgcatggagtaattgatgcttg

SEQ ID NO: 9190384 - DNA, 22 bp, Homo sapiens
tgcatgtgtgtattcagagact

SEQ ID NO: 9190385 - DNA, 22 bp, Homo sapiens
tgcatgtgtgacaaggacagtt

SEQ ID NO: 9190386 - DNA, 22 bp, Homo sapiens
tgcatgtgtgtgtatttataaa

SEQ ID NO: 9190387 - DNA, 22 bp, Homo sapiens
tgcatgagcgaatgtgtcctgt

SEQ ID NO: 9190388 - DNA, 22 bp, Homo sapiens
tgcatcttcagccctcagccag

SEQ ID NO: 9190389 - DNA, 22 bp, Homo sapiens
tgcatgcttcccttctcccagc

SEQ ID NO: 9190390 - DNA, 22 bp, Homo sapiens
tgcagggaagcaagggtggctc

SEQ ID NO: 9190391 - DNA, 22 bp, Homo sapiens
tgcagggaagcaagggtggctc

SEQ ID NO: 9190392 - DNA, 22 bp, Homo sapiens
tgcagggaagcaagggtggctc

SEQ ID NO: 9190393 - DNA, 22 bp, Homo sapiens
tgcagggaagtcccagctcctg

SEQ ID NO: 9190394 - DNA, 22 bp, Homo sapiens
tgcagggaagtcccagctcctg

SEQ ID NO: 9190395 - DNA, 22 bp, Homo sapiens
tgcagggaagtcccagctcctg

SEQ ID NO: 9190396 - DNA, 22 bp, Homo sapiens
tgcagggaatccagtctagggt

SEQ ID NO: 9190397 - DNA, 22 bp, Homo sapiens
tgcagggaatccagtctagggt

SEQ ID NO: 9190398 - DNA, 22 bp, Homo sapiens
tgcagggaatccagtctagggt

SEQ ID NO: 9190399 - DNA, 22 bp, Homo sapiens
tgcagggaatccagtctagggt

SEQ ID NO: 9190400 - DNA, 22 bp, Homo sapiens
tgcagggatcctagctgaagag

SEQ ID NO: 9190401 - DNA, 22 bp, Homo sapiens
tgcagggaaagtgttggcagca

SEQ ID NO: 9190402 - DNA, 22 bp, Homo sapiens
tgcagggaaagtgttggcagca

SEQ ID NO: 9190403 - DNA, 22 bp, Homo sapiens
tgcagggaaagggcactgggct

SEQ ID NO: 9190404 - DNA, 22 bp, Homo sapiens
tgcagggaaagggcactgggct

SEQ ID NO: 9190405 - DNA, 22 bp, Homo sapiens
tgcagggaaagggcactgggct

SEQ ID NO: 9190406 - DNA, 22 bp, Homo sapiens
tgcagggaacttggacagctag

SEQ ID NO: 9190407 - DNA, 22 bp, Homo sapiens
tgcagggaacttggacagctag

SEQ ID NO: 9190408 - DNA, 22 bp, Homo sapiens
tgcagggaacttggacagctag

SEQ ID NO: 9190409 - DNA, 22 bp, Homo sapiens
tgcagggaaagtgttggcagca

SEQ ID NO: 9190410 - DNA, 22 bp, Homo sapiens
tgcagggaacttggacagctag

SEQ ID NO: 9190411 - DNA, 22 bp, Homo sapiens
tgcagggaaaacccaggatgct

SEQ ID NO: 9190412 - DNA, 22 bp, Homo sapiens
tgcaggctgctggcagtagctt

SEQ ID NO: 9190413 - DNA, 22 bp, Homo sapiens
tgcaggctggggaggcagactt

SEQ ID NO: 9190414 - DNA, 22 bp, Homo sapiens
tgcaggctggggaggcagactt

SEQ ID NO: 9190415 - DNA, 22 bp, Homo sapiens
tgcaggctccatgaggacaggc

SEQ ID NO: 9190416 - DNA, 22 bp, Homo sapiens
tgcaggctgcagtctcaggtgg

SEQ ID NO: 9190417 - DNA, 22 bp, Homo sapiens
tgcagggattgttggcatccat

SEQ ID NO: 9190418 - DNA, 22 bp, Homo sapiens
tgcagggattgttggcatccat

SEQ ID NO: 9190419 - DNA, 22 bp, Homo sapiens
tgcagggattgttggcatccat

SEQ ID NO: 9190420 - DNA, 22 bp, Homo sapiens
tgcagggattatgtaggggttg

SEQ ID NO: 9190421 - DNA, 22 bp, Homo sapiens
tgcagggattatgtaggggttg

SEQ ID NO: 9190422 - DNA, 23 bp, Homo sapiens
tgcagggcaagttagagacccca

SEQ ID NO: 9190423 - DNA, 22 bp, Homo sapiens
tgcagggatgctagaggtaaga

SEQ ID NO: 9190424 - DNA, 22 bp, Homo sapiens
tgcagggatgctagaggtaaga

SEQ ID NO: 9190425 - DNA, 22 bp, Homo sapiens
tgcagggatgctagaggtaaga

SEQ ID NO: 9190426 - DNA, 21 bp, Homo sapiens
tgcagggatctttctgcctga

SEQ ID NO: 9190427 - DNA, 21 bp, Homo sapiens
tgcagggatctttctgcctga

SEQ ID NO: 9190428 - DNA, 21 bp, Homo sapiens
tgcagggatctttctgcctga

SEQ ID NO: 9190429 - DNA, 22 bp, Homo sapiens
tgcagggattagaggccgggga

SEQ ID NO: 9190430 - DNA, 22 bp, Homo sapiens
tgcagggattagaggccgggga

SEQ ID NO: 9190431 - DNA, 22 bp, Homo sapiens
tgcagggattagaggccgggga

SEQ ID NO: 9190432 - DNA, 22 bp, Homo sapiens
tgcagggattatgtaggggttg

SEQ ID NO: 9190433 - DNA, 22 bp, Homo sapiens
tgcagggcagctagggagcttt

SEQ ID NO: 9190434 - DNA, 22 bp, Homo sapiens
tgcagggcagatatgactgtag

SEQ ID NO: 9190435 - DNA, 22 bp, Homo sapiens
tgcagggcacacgcacgggtgt

SEQ ID NO: 9190436 - DNA, 22 bp, Homo sapiens
tgcagggccgctggaggtcatg

SEQ ID NO: 9190437 - DNA, 22 bp, Homo sapiens
tgcagggccgctggaggtcatg

SEQ ID NO: 9190438 - DNA, 22 bp, Homo sapiens
tgcagggctataactccattct

SEQ ID NO: 9190439 - DNA, 22 bp, Homo sapiens
tgcagggccatggtggcggctg

SEQ ID NO: 9190440 - DNA, 22 bp, Homo sapiens
tgcagggccagactgggttgga

SEQ ID NO: 9190441 - DNA, 22 bp, Homo sapiens
tgcagggccagactgggttgga

SEQ ID NO: 9190442 - DNA, 22 bp, Homo sapiens
tgcagggcatagggtccagttt

SEQ ID NO: 9190443 - DNA, 22 bp, Homo sapiens
tgcagggtagacaggtgaggtc

SEQ ID NO: 9190444 - DNA, 22 bp, Homo sapiens
tgcagggtggtttgaagggtct

SEQ ID NO: 9190445 - DNA, 22 bp, Homo sapiens
tgcaggggcttgtctgggcctg

SEQ ID NO: 9190446 - DNA, 22 bp, Homo sapiens
tgcaggggcttgtctgggcctg

SEQ ID NO: 9190447 - DNA, 22 bp, Homo sapiens
tgcaggggcttgtctgggcctg

SEQ ID NO: 9190448 - DNA, 20 bp, Homo sapiens
tgcagggctgcctcccagct

SEQ ID NO: 9190449 - DNA, 20 bp, Homo sapiens
tgcagggctgcctcccagct

SEQ ID NO: 9190450 - DNA, 22 bp, Homo sapiens
tgcagggctcctggctccaatc

SEQ ID NO: 9190451 - DNA, 22 bp, Homo sapiens
tgcagggcttcctcttggagtt

SEQ ID NO: 9190452 - DNA, 19 bp, Homo sapiens
tgcagggctgcgcctgggg

SEQ ID NO: 9190453 - DNA, 22 bp, Homo sapiens
tgcaggtgacaccactcttcct

SEQ ID NO: 9190454 - DNA, 22 bp, Homo sapiens
tgcaggtgagtgcaggggctca

SEQ ID NO: 9190455 - DNA, 22 bp, Homo sapiens
tgcaggtgaaaattatgaggat

SEQ ID NO: 9190456 - DNA, 22 bp, Homo sapiens
tgcagggtgcacagtggggtgc

SEQ ID NO: 9190457 - DNA, 22 bp, Homo sapiens
tgcaggtggatatctcatcaga

SEQ ID NO: 9190458 - DNA, 22 bp, Homo sapiens
tgcaggtgagtgcaggggctca

SEQ ID NO: 9190459 - DNA, 22 bp, Homo sapiens
tgcaggtggattcaatgtggga

SEQ ID NO: 9190460 - DNA, 22 bp, Homo sapiens
tgcaggtggctccagggactgc

SEQ ID NO: 9190461 - DNA, 22 bp, Homo sapiens
tgcaggtggctccagggactgc

SEQ ID NO: 9190462 - DNA, 22 bp, Homo sapiens
tgcaggtggctccagggactgc

SEQ ID NO: 9190463 - DNA, 22 bp, Homo sapiens
tgcaggtgtgggcaggggagca

SEQ ID NO: 9190464 - DNA, 23 bp, Homo sapiens
tgcaggtgtgcagagggctcttg

SEQ ID NO: 9190465 - DNA, 22 bp, Homo sapiens
tgcaggtgtctgggggcaacag

SEQ ID NO: 9190466 - DNA, 22 bp, Homo sapiens
tgcaggtgtggttcctcagcca

SEQ ID NO: 9190467 - DNA, 22 bp, Homo sapiens
tgcaggtgtgtgcaagggaggg

SEQ ID NO: 9190468 - DNA, 20 bp, Homo sapiens
tgcaggtgtgtccaagcact

SEQ ID NO: 9190469 - DNA, 22 bp, Homo sapiens
tgcaggtggtccttcctctgct

SEQ ID NO: 9190470 - DNA, 20 bp, Homo sapiens
tgcaggtgggcccttctggg

SEQ ID NO: 9190471 - DNA, 22 bp, Homo sapiens
tgcaggtggtttggacactgct

SEQ ID NO: 9190472 - DNA, 22 bp, Homo sapiens
tgcaggtgtctccagggcaggt

SEQ ID NO: 9190473 - DNA, 22 bp, Homo sapiens
tgcaggtgtctccagggcaggt

SEQ ID NO: 9190474 - DNA, 22 bp, Homo sapiens
tgcaggtgtctccagggcaggt

SEQ ID NO: 9190475 - DNA, 22 bp, Homo sapiens
tgcagtggttgagagcccagac

SEQ ID NO: 9190476 - DNA, 22 bp, Homo sapiens
tgcagtggttgagagcccagac

SEQ ID NO: 9190477 - DNA, 22 bp, Homo sapiens
tgcagtgtgacctgtagcgagc

SEQ ID NO: 9190478 - DNA, 22 bp, Homo sapiens
tgcagtgggccggaggccaggg

SEQ ID NO: 9190479 - DNA, 22 bp, Homo sapiens
tgcagtggtgtccaggtgtact

SEQ ID NO: 9190480 - DNA, 22 bp, Homo sapiens
tgcagtggtggtaaagatgctc

SEQ ID NO: 9190481 - DNA, 22 bp, Homo sapiens
tgcagtgggccggaggccaggg

SEQ ID NO: 9190482 - DNA, 22 bp, Homo sapiens
tgcagtggtggtaaagatgctc

SEQ ID NO: 9190483 - DNA, 23 bp, Homo sapiens
tgcagtaggatggggctgggcct

SEQ ID NO: 9190484 - DNA, 22 bp, Homo sapiens
tgcagtaggcacgtggctgtga

SEQ ID NO: 9190485 - DNA, 23 bp, Homo sapiens
tgcagtaggatggggctgggcct

SEQ ID NO: 9190486 - DNA, 22 bp, Homo sapiens
tgcagaaagtcacattcccttt

SEQ ID NO: 9190487 - DNA, 22 bp, Homo sapiens
tgcagaacagggccatgtcacc

SEQ ID NO: 9190488 - DNA, 21 bp, Homo sapiens
tgcagaaatggtttttctaag

SEQ ID NO: 9190489 - DNA, 22 bp, Homo sapiens
tgcagaaacaagccatcattca

SEQ ID NO: 9190490 - DNA, 22 bp, Homo sapiens
tgcacgtgggctctctgctctt

SEQ ID NO: 9190491 - DNA, 22 bp, Homo sapiens
tgcacgtgtgagcattcacatg

SEQ ID NO: 9190492 - DNA, 22 bp, Homo sapiens
tgcacgttgaagtcccaggttg

SEQ ID NO: 9190493 - DNA, 22 bp, Homo sapiens
tgcagaaggaggaggaaatcca

SEQ ID NO: 9190494 - DNA, 22 bp, Homo sapiens
tgcagaaggaggaggaaatcca

SEQ ID NO: 9190495 - DNA, 22 bp, Homo sapiens
tgcagaagctgcaggtcagtgg

SEQ ID NO: 9190496 - DNA, 22 bp, Homo sapiens
tgcagaagctgcaggtcagtgg

SEQ ID NO: 9190497 - DNA, 22 bp, Homo sapiens
tgcagaaggcctgacattgcac

SEQ ID NO: 9190498 - DNA, 22 bp, Homo sapiens
tgcagaagtattccaggcccca

SEQ ID NO: 9190499 - DNA, 22 bp, Homo sapiens
tgcagaagtgagtcatgaggaa

SEQ ID NO: 9190500 - DNA, 22 bp, Homo sapiens
tgcagaagcagagagttgccaa

SEQ ID NO: 9190501 - DNA, 22 bp, Homo sapiens
tgcagaagcagagccggtggcc

SEQ ID NO: 9190502 - DNA, 22 bp, Homo sapiens
tgcagaagatggtctgagcacc

SEQ ID NO: 9190503 - DNA, 22 bp, Homo sapiens
tgcagaagaccttccagggctg

SEQ ID NO: 9190504 - DNA, 19 bp, Homo sapiens
tgcagaagacacagtggtg

SEQ ID NO: 9190505 - DNA, 19 bp, Homo sapiens
tgcagaagacacagtggtg

SEQ ID NO: 9190506 - DNA, 19 bp, Homo sapiens
tgcagaagacacagtggtg

SEQ ID NO: 9190507 - DNA, 22 bp, Homo sapiens
tgcagaagacacaaggtaacgt

SEQ ID NO: 9190508 - DNA, 22 bp, Homo sapiens
tgcagaagacacaaggtaacgt

SEQ ID NO: 9190509 - DNA, 22 bp, Homo sapiens
tgcagaagaatgtaggcataag

SEQ ID NO: 9190510 - DNA, 22 bp, Homo sapiens
tgcagaagaatgtaggcataag

SEQ ID NO: 9190511 - DNA, 20 bp, Homo sapiens
tgcagaagaacgttctggtt

SEQ ID NO: 9190512 - DNA, 18 bp, Homo sapiens
tgcaccctaagggcccca

SEQ ID NO: 9190513 - DNA, 22 bp, Homo sapiens
tgcaccagagcagggtgcccaa

SEQ ID NO: 9190514 - DNA, 22 bp, Homo sapiens
tgcacctgagaggtctctgagg

SEQ ID NO: 9190515 - DNA, 22 bp, Homo sapiens
tgcacagtgacccctggtgact

SEQ ID NO: 9190516 - DNA, 22 bp, Homo sapiens
tgcacagtaaacatgactggag

SEQ ID NO: 9190517 - DNA, 22 bp, Homo sapiens
tgcacagtatgtggtcctttgt

SEQ ID NO: 9190518 - DNA, 22 bp, Homo sapiens
tgcacattcacttaggtattgt

SEQ ID NO: 9190519 - DNA, 22 bp, Homo sapiens
tgcacattagtgtttgagatgc

SEQ ID NO: 9190520 - DNA, 22 bp, Homo sapiens
tgcacattagtgtttgagatgc

SEQ ID NO: 9190521 - DNA, 22 bp, Homo sapiens
tgcacatctttcagcatcatac

SEQ ID NO: 9190522 - DNA, 20 bp, Homo sapiens
tgcacagggtgggaagcaac

SEQ ID NO: 9190523 - DNA, 20 bp, Homo sapiens
tgcacagggtgggaagcaac

SEQ ID NO: 9190524 - DNA, 22 bp, Homo sapiens
tgcacaggtgagactcaggaag

SEQ ID NO: 9190525 - DNA, 22 bp, Homo sapiens
tgcacaggtatgcaaagcatgt

SEQ ID NO: 9190526 - DNA, 22 bp, Homo sapiens
tgcacaggtgagactcaggaag

SEQ ID NO: 9190527 - DNA, 21 bp, Homo sapiens
tgcacagggcccaggagagcc

SEQ ID NO: 9190528 - DNA, 22 bp, Homo sapiens
tgcacaggccttgaagggagag

SEQ ID NO: 9190529 - DNA, 22 bp, Homo sapiens
tgcacacatacatgggaagtgc

SEQ ID NO: 9190530 - DNA, 21 bp, Homo sapiens
tgcacagcaaaagttgagtaa

SEQ ID NO: 9190531 - DNA, 22 bp, Homo sapiens
tgcacagcgggtgtctgtcagg

SEQ ID NO: 9190532 - DNA, 22 bp, Homo sapiens
tgcacagcgcttgtcgggtgtg

SEQ ID NO: 9190533 - DNA, 21 bp, Homo sapiens
tgcacagccataccctccttg

SEQ ID NO: 9190534 - DNA, 22 bp, Homo sapiens
tgcacagcaaatattgactacc

SEQ ID NO: 9190535 - DNA, 21 bp, Homo sapiens
tgcacagccataccctccttg

SEQ ID NO: 9190536 - DNA, 20 bp, Homo sapiens
tgcacagctgtgaataggat

SEQ ID NO: 9190537 - DNA, 20 bp, Homo sapiens
tgcacagctgtgaataggat

SEQ ID NO: 9190538 - DNA, 22 bp, Homo sapiens
tgcacagctggctctccttttc

SEQ ID NO: 9190539 - DNA, 22 bp, Homo sapiens
tgcacagctgcctcctctctgc

SEQ ID NO: 9190540 - DNA, 22 bp, Homo sapiens
tgcacagcgggtgtctgtcagg

SEQ ID NO: 9190541 - DNA, 22 bp, Homo sapiens
tgcacagctgcctcctctctgc

SEQ ID NO: 9190542 - DNA, 18 bp, Homo sapiens
tgcacagctgtgggctgg

SEQ ID NO: 9190543 - DNA, 22 bp, Homo sapiens
tgcagcagaatatggctgcagg

SEQ ID NO: 9190544 - DNA, 22 bp, Homo sapiens
tgcagcagaatatggctgcagg

SEQ ID NO: 9190545 - DNA, 21 bp, Homo sapiens
tgcagcagaagtctctgtgtc

SEQ ID NO: 9190546 - DNA, 22 bp, Homo sapiens
tgcagcagaagtgttcttctct

SEQ ID NO: 9190547 - DNA, 20 bp, Homo sapiens
tgcagcagaagcccatgctc

SEQ ID NO: 9190548 - DNA, 20 bp, Homo sapiens
tgcagcagaagcccatgctc

SEQ ID NO: 9190549 - DNA, 22 bp, Homo sapiens
tgcagatgcctgggctgcacca

SEQ ID NO: 9190550 - DNA, 22 bp, Homo sapiens
tgcagatgagagggagttttta

SEQ ID NO: 9190551 - DNA, 22 bp, Homo sapiens
tgcagatgcctgggctgcacca

SEQ ID NO: 9190552 - DNA, 22 bp, Homo sapiens
tgcagatgaatgctgagacact

SEQ ID NO: 9190553 - DNA, 22 bp, Homo sapiens
tgcagagtgaggaagaactgca

SEQ ID NO: 9190554 - DNA, 19 bp, Homo sapiens
tgcagagggtaggaaggcc

SEQ ID NO: 9190555 - DNA, 19 bp, Homo sapiens
tgcagagggtaggaaggcc

SEQ ID NO: 9190556 - DNA, 19 bp, Homo sapiens
tgcagagggtaggaaggcc

SEQ ID NO: 9190557 - DNA, 19 bp, Homo sapiens
tgcagagggtaggaaggcc

SEQ ID NO: 9190558 - DNA, 23 bp, Homo sapiens
tgcagagggactgaagccagctt

SEQ ID NO: 9190559 - DNA, 22 bp, Homo sapiens
tgcagagggaaaaggtgctcct

SEQ ID NO: 9190560 - DNA, 22 bp, Homo sapiens
tgcagagggacagccacagctc

SEQ ID NO: 9190561 - DNA, 22 bp, Homo sapiens
tgcagagggaaaaggtgctcct

SEQ ID NO: 9190562 - DNA, 22 bp, Homo sapiens
tgcagaggaccattgtcctgga

SEQ ID NO: 9190563 - DNA, 22 bp, Homo sapiens
tgcagaggaccattgtcctgga

SEQ ID NO: 9190564 - DNA, 22 bp, Homo sapiens
tgcagagcttcattgcataggc

SEQ ID NO: 9190565 - DNA, 22 bp, Homo sapiens
tgcagagattgaacaagaagga

SEQ ID NO: 9190566 - DNA, 22 bp, Homo sapiens
tgcagagatttggctcttaaag

SEQ ID NO: 9190567 - DNA, 21 bp, Homo sapiens
tgcagagatttttacttgtct

SEQ ID NO: 9190568 - DNA, 22 bp, Homo sapiens
tgcagagatctgggcgtcggct

SEQ ID NO: 9190569 - DNA, 22 bp, Homo sapiens
tgcagagatctgggcgtcggct

SEQ ID NO: 9190570 - DNA, 20 bp, Homo sapiens
tgcagagctgacattacctg

SEQ ID NO: 9190571 - DNA, 22 bp, Homo sapiens
tgcagagatcctggactgagcg

SEQ ID NO: 9190572 - DNA, 21 bp, Homo sapiens
tgcagagatatctgaagcaga

SEQ ID NO: 9190573 - DNA, 22 bp, Homo sapiens
tgcagagaaaactcctgggtac

SEQ ID NO: 9190574 - DNA, 22 bp, Homo sapiens
tgcagagaaaactcctgggtac

SEQ ID NO: 9190575 - DNA, 22 bp, Homo sapiens
tgcagacaagtcgtgggatctt

SEQ ID NO: 9190576 - DNA, 22 bp, Homo sapiens
tgcagacaagccaggctatggc

SEQ ID NO: 9190577 - DNA, 22 bp, Homo sapiens
tgcagacagagaaatgaggccc

SEQ ID NO: 9190578 - DNA, 23 bp, Homo sapiens
tgcagaggcatgatcactgctca

SEQ ID NO: 9190579 - DNA, 21 bp, Homo sapiens
tgcagaggcacaaacaagccc

SEQ ID NO: 9190580 - DNA, 22 bp, Homo sapiens
tgcagaggcatttattgatgta

SEQ ID NO: 9190581 - DNA, 22 bp, Homo sapiens
tgcagaggcccagcggttcttc

SEQ ID NO: 9190582 - DNA, 22 bp, Homo sapiens
tgcagaggcgccgtgggtgggg

SEQ ID NO: 9190583 - DNA, 22 bp, Homo sapiens
tgcagaggctggctcgccgggt

SEQ ID NO: 9190584 - DNA, 21 bp, Homo sapiens
tgcagaggcacaaacaagccc

SEQ ID NO: 9190585 - DNA, 22 bp, Homo sapiens
tgcagaggagtcagcctgggca

SEQ ID NO: 9190586 - DNA, 22 bp, Homo sapiens
tgcagaggagtcagcctgggca

SEQ ID NO: 9190587 - DNA, 22 bp, Homo sapiens
tgcagaggagctggaaggctgg

SEQ ID NO: 9190588 - DNA, 22 bp, Homo sapiens
tgcagaggagctggaaggctgg

SEQ ID NO: 9190589 - DNA, 22 bp, Homo sapiens
tgcagaggagctggaaggctgg

SEQ ID NO: 9190590 - DNA, 22 bp, Homo sapiens
tgcagaggagctggaaggctgg

SEQ ID NO: 9190591 - DNA, 22 bp, Homo sapiens
tgcaggctatcctttgctgcaa

SEQ ID NO: 9190592 - DNA, 22 bp, Homo sapiens
tgcaggcagctgaaaggtgcct

SEQ ID NO: 9190593 - DNA, 22 bp, Homo sapiens
tgcaggcagctgaaaggtgcct

SEQ ID NO: 9190594 - DNA, 22 bp, Homo sapiens
tgcaggcagctgaaaggtgcct

SEQ ID NO: 9190595 - DNA, 22 bp, Homo sapiens
tgcaggcctcacacctggcacc

SEQ ID NO: 9190596 - DNA, 22 bp, Homo sapiens
tgcaggcctcagacttagccat

SEQ ID NO: 9190597 - DNA, 22 bp, Homo sapiens
tgcaggctcacctgccagggcc

SEQ ID NO: 9190598 - DNA, 22 bp, Homo sapiens
tgcaggctcaccctggagctga

SEQ ID NO: 9190599 - DNA, 22 bp, Homo sapiens
tgcaggctcaccctggagctga

SEQ ID NO: 9190600 - DNA, 22 bp, Homo sapiens
tgcaggctccacgttgttgtcc

SEQ ID NO: 9190601 - DNA, 22 bp, Homo sapiens
tgcaggctcatctcaagagtag

SEQ ID NO: 9190602 - DNA, 21 bp, Homo sapiens
tgcaggattccaggtcagtat

SEQ ID NO: 9190603 - DNA, 22 bp, Homo sapiens
tgcaggagttcccctctgcctg

SEQ ID NO: 9190604 - DNA, 22 bp, Homo sapiens
tgcaggagttcccctctgcctg

SEQ ID NO: 9190605 - DNA, 22 bp, Homo sapiens
tgcaggagttaagtgctctcct

SEQ ID NO: 9190606 - DNA, 22 bp, Homo sapiens
tgcaggagttaagtgctctcct

SEQ ID NO: 9190607 - DNA, 22 bp, Homo sapiens
tgcaggcagctaaaccatgtaa

SEQ ID NO: 9190608 - DNA, 22 bp, Homo sapiens
tgcaggcaccattctgcctctc

SEQ ID NO: 9190609 - DNA, 21 bp, Homo sapiens
tgcaggagtctgtgagtcagg

SEQ ID NO: 9190610 - DNA, 21 bp, Homo sapiens
tgcaggagtctgtgagtcagg

SEQ ID NO: 9190611 - DNA, 21 bp, Homo sapiens
tgcaggagtctgtgagtcagg

SEQ ID NO: 9190612 - DNA, 18 bp, Homo sapiens
tgcaggagtgaccccggc

SEQ ID NO: 9190613 - DNA, 18 bp, Homo sapiens
tgcaggagtgaccccggc

SEQ ID NO: 9190614 - DNA, 21 bp, Homo sapiens
tgcaggagtgtaatgtgaccc

SEQ ID NO: 9190615 - DNA, 21 bp, Homo sapiens
tgcaggagtgtaatgtgaccc

SEQ ID NO: 9190616 - DNA, 21 bp, Homo sapiens
tgcaggagtgtaatgtgaccc

SEQ ID NO: 9190617 - DNA, 19 bp, Homo sapiens
tgcaggaggactgagcaga

SEQ ID NO: 9190618 - DNA, 19 bp, Homo sapiens
tgcaggaggactgagcaga

SEQ ID NO: 9190619 - DNA, 22 bp, Homo sapiens
tgcaggaggctttattcaggat

SEQ ID NO: 9190620 - DNA, 22 bp, Homo sapiens
tgcaggaggccccatggaaccg

SEQ ID NO: 9190621 - DNA, 22 bp, Homo sapiens
tgcaggagggagggttacagtt

SEQ ID NO: 9190622 - DNA, 22 bp, Homo sapiens
tgcaggagggagggttacagtt

SEQ ID NO: 9190623 - DNA, 22 bp, Homo sapiens
tgcaggagtccaatcaggagac

SEQ ID NO: 9190624 - DNA, 22 bp, Homo sapiens
tgcaggagtccaatcaggagac

SEQ ID NO: 9190625 - DNA, 21 bp, Homo sapiens
tgcaggagtctgtgagtcagg

SEQ ID NO: 9190626 - DNA, 22 bp, Homo sapiens
tgcaggagctgtgcggtgaggg

SEQ ID NO: 9190627 - DNA, 22 bp, Homo sapiens
tgcaggagctgtgcggtgaggg

SEQ ID NO: 9190628 - DNA, 22 bp, Homo sapiens
tgcaggagcttggctctgtccc

SEQ ID NO: 9190629 - DNA, 19 bp, Homo sapiens
tgcaggaggactgagcaga

SEQ ID NO: 9190630 - DNA, 19 bp, Homo sapiens
tgcaggaggactgagcaga

SEQ ID NO: 9190631 - DNA, 22 bp, Homo sapiens
tgcaggagcttggctctgtccc

SEQ ID NO: 9190632 - DNA, 22 bp, Homo sapiens
tgcaggagcttggctctgtccc

SEQ ID NO: 9190633 - DNA, 22 bp, Homo sapiens
tgcaggagcttggctctgtccc

SEQ ID NO: 9190634 - DNA, 22 bp, Homo sapiens
tgcaggagcccttgggctctgg

SEQ ID NO: 9190635 - DNA, 22 bp, Homo sapiens
tgcaggagccttggacttgaaa

SEQ ID NO: 9190636 - DNA, 22 bp, Homo sapiens
tgcaggagcccttgggctctgg

SEQ ID NO: 9190637 - DNA, 22 bp, Homo sapiens
tgcaggagccttggacttgaaa

SEQ ID NO: 9190638 - DNA, 22 bp, Homo sapiens
tgcaggagctgctgtcctgctc

SEQ ID NO: 9190639 - DNA, 22 bp, Homo sapiens
tgcaggagctgctgtcctgctc

SEQ ID NO: 9190640 - DNA, 22 bp, Homo sapiens
tgcaggagctgctgtcctgctc

SEQ ID NO: 9190641 - DNA, 22 bp, Homo sapiens
tgcagcttatctctttggcagt

SEQ ID NO: 9190642 - DNA, 22 bp, Homo sapiens
tgcaggaaacagaggctcaaat

SEQ ID NO: 9190643 - DNA, 22 bp, Homo sapiens
tgcaggaaaacacctatcaccc

SEQ ID NO: 9190644 - DNA, 22 bp, Homo sapiens
tgcagctgttacggaccctgtc

SEQ ID NO: 9190645 - DNA, 22 bp, Homo sapiens
tgcagctgtgggagaatctctg

SEQ ID NO: 9190646 - DNA, 22 bp, Homo sapiens
tgcagctgtgcctgaaaagtac

SEQ ID NO: 9190647 - DNA, 22 bp, Homo sapiens
tgcagctgtgaaagggaaccaa

SEQ ID NO: 9190648 - DNA, 22 bp, Homo sapiens
tgcagctgtaacagaggcctca

SEQ ID NO: 9190649 - DNA, 22 bp, Homo sapiens
tgcagctgtaacagaggcctca

SEQ ID NO: 9190650 - DNA, 20 bp, Homo sapiens
tgcagctggtttcacaggga

SEQ ID NO: 9190651 - DNA, 20 bp, Homo sapiens
tgcagctggtttcacaggga

SEQ ID NO: 9190652 - DNA, 22 bp, Homo sapiens
tgcaggaaattccagggtggcc

SEQ ID NO: 9190653 - DNA, 21 bp, Homo sapiens
tgcaggaaagtgctgcgaccc

SEQ ID NO: 9190654 - DNA, 21 bp, Homo sapiens
tgcaggaaagtgctgcgaccc

SEQ ID NO: 9190655 - DNA, 22 bp, Homo sapiens
tgcaggaacagaactcactccc

SEQ ID NO: 9190656 - DNA, 22 bp, Homo sapiens
tgcaggaactgggagggatagt

SEQ ID NO: 9190657 - DNA, 22 bp, Homo sapiens
tgcaggaagacttcccaagcca

SEQ ID NO: 9190658 - DNA, 22 bp, Homo sapiens
tgcaggaagcaaccaggtccaa

SEQ ID NO: 9190659 - DNA, 21 bp, Homo sapiens
tgcaggaagtatggtgcctat

SEQ ID NO: 9190660 - DNA, 22 bp, Homo sapiens
tgcaggagagctggtctggccc

SEQ ID NO: 9190661 - DNA, 22 bp, Homo sapiens
tgcaggagagctggtctggccc

SEQ ID NO: 9190662 - DNA, 22 bp, Homo sapiens
tgcaggagagctggtctggccc

SEQ ID NO: 9190663 - DNA, 22 bp, Homo sapiens
tgcaggagagtgagtcagtagg

SEQ ID NO: 9190664 - DNA, 22 bp, Homo sapiens
tgcaggagagtgagtcagtagg

SEQ ID NO: 9190665 - DNA, 22 bp, Homo sapiens
tgcaggagagctggtctggccc

SEQ ID NO: 9190666 - DNA, 22 bp, Homo sapiens
tgcaggagcaccagctcaccct

SEQ ID NO: 9190667 - DNA, 22 bp, Homo sapiens
tgcaggagcaccagctcaccct

SEQ ID NO: 9190668 - DNA, 22 bp, Homo sapiens
tgcaggagcaccagctcaccct

SEQ ID NO: 9190669 - DNA, 22 bp, Homo sapiens
tgcaggagcagagatggctgga

SEQ ID NO: 9190670 - DNA, 22 bp, Homo sapiens
tgcaggagcagagatggctgga

SEQ ID NO: 9190671 - DNA, 22 bp, Homo sapiens
tgcaggagcagagatggctgga

SEQ ID NO: 9190672 - DNA, 22 bp, Homo sapiens
tgcaggagcccaggaatactat

SEQ ID NO: 9190673 - DNA, 22 bp, Homo sapiens
tgcaggagcagagatggctgga

SEQ ID NO: 9190674 - DNA, 22 bp, Homo sapiens
tgcaggagcagagatggctgga

SEQ ID NO: 9190675 - DNA, 22 bp, Homo sapiens
tgcagctgagtcacccagccat

SEQ ID NO: 9190676 - DNA, 22 bp, Homo sapiens
tgcagctgaggccagctatgcc

SEQ ID NO: 9190677 - DNA, 17 bp, Homo sapiens
tgcagctgctcccaggc

SEQ ID NO: 9190678 - DNA, 22 bp, Homo sapiens
tgcagctgctggtggctgaaag

SEQ ID NO: 9190679 - DNA, 22 bp, Homo sapiens
tgcagctgctggcccaggtgct

SEQ ID NO: 9190680 - DNA, 22 bp, Homo sapiens
tgcagctgctggtggctgaaag

SEQ ID NO: 9190681 - DNA, 17 bp, Homo sapiens
tgcagctgctcccaggc

SEQ ID NO: 9190682 - DNA, 22 bp, Homo sapiens
tgcagctgggtctgccctggct

SEQ ID NO: 9190683 - DNA, 22 bp, Homo sapiens
tgcagctgggtctgccctggct

SEQ ID NO: 9190684 - DNA, 22 bp, Homo sapiens
tgcagctggtatcccatggatt

SEQ ID NO: 9190685 - DNA, 22 bp, Homo sapiens
tgcagctggtatcccatggatt

SEQ ID NO: 9190686 - DNA, 22 bp, Homo sapiens
tgcagctcaggattctcagggc

SEQ ID NO: 9190687 - DNA, 22 bp, Homo sapiens
tgcagctcattggtgtcctggt

SEQ ID NO: 9190688 - DNA, 22 bp, Homo sapiens
tgcagctcatattagagagaag

SEQ ID NO: 9190689 - DNA, 22 bp, Homo sapiens
tgcagctctgcatggctggttc

SEQ ID NO: 9190690 - DNA, 22 bp, Homo sapiens
tgcagctcgggcttagggtggg

SEQ ID NO: 9190691 - DNA, 18 bp, Homo sapiens
tgcagcctgtagtcttgt

SEQ ID NO: 9190692 - DNA, 23 bp, Homo sapiens
tgcagctcaaagatgggtaaatg

SEQ ID NO: 9190693 - DNA, 22 bp, Homo sapiens
tgcagctcaagctggtgaggtg

SEQ ID NO: 9190694 - DNA, 22 bp, Homo sapiens
tgcagctgacccactccagtcc

SEQ ID NO: 9190695 - DNA, 22 bp, Homo sapiens
tgcagctgaccagcaagtcctg

SEQ ID NO: 9190696 - DNA, 22 bp, Homo sapiens
tgcagctgaccagcaagtcctg

SEQ ID NO: 9190697 - DNA, 22 bp, Homo sapiens
tgcagctctgaacagtcatgaa

SEQ ID NO: 9190698 - DNA, 22 bp, Homo sapiens
tgcagctctgggcaagtgcctt

SEQ ID NO: 9190699 - DNA, 22 bp, Homo sapiens
tgcagctctgggtgtagaggct

SEQ ID NO: 9190700 - DNA, 22 bp, Homo sapiens
tgcagctgaacctagagtctgt

SEQ ID NO: 9190701 - DNA, 21 bp, Homo sapiens
tgcagctgacaccctttggga

SEQ ID NO: 9190702 - DNA, 21 bp, Homo sapiens
tgcagcctctgcccagcagtg

SEQ ID NO: 9190703 - DNA, 22 bp, Homo sapiens
tgcagccatctttcttggagga

SEQ ID NO: 9190704 - DNA, 22 bp, Homo sapiens
tgcagccatctttcttggagga

SEQ ID NO: 9190705 - DNA, 22 bp, Homo sapiens
tgcagccatcgcagagtctgta

SEQ ID NO: 9190706 - DNA, 22 bp, Homo sapiens
tgcagccatcgcagagtctgta

SEQ ID NO: 9190707 - DNA, 22 bp, Homo sapiens
tgcagccattttctgccaatgc

SEQ ID NO: 9190708 - DNA, 21 bp, Homo sapiens
tgcagccattcagccctatgc

SEQ ID NO: 9190709 - DNA, 21 bp, Homo sapiens
tgcagccattcagccctatgc

SEQ ID NO: 9190710 - DNA, 22 bp, Homo sapiens
tgcagccatttgaaaagcagtt

SEQ ID NO: 9190711 - DNA, 23 bp, Homo sapiens
tgcagcagggtggtctacttctc

SEQ ID NO: 9190712 - DNA, 22 bp, Homo sapiens
tgcagccagcaagtgaatacat

SEQ ID NO: 9190713 - DNA, 22 bp, Homo sapiens
tgcagccagactttgtgcgaaa

SEQ ID NO: 9190714 - DNA, 22 bp, Homo sapiens
tgcagccaggaaatatttgctg

SEQ ID NO: 9190715 - DNA, 19 bp, Homo sapiens
tgcagccacgtgagagact

SEQ ID NO: 9190716 - DNA, 23 bp, Homo sapiens
tgcagccactcaggagctcagtg

SEQ ID NO: 9190717 - DNA, 22 bp, Homo sapiens
tgcagcagcctcatctggtttc

SEQ ID NO: 9190718 - DNA, 22 bp, Homo sapiens
tgcagcagcagggaggaggctc

SEQ ID NO: 9190719 - DNA, 22 bp, Homo sapiens
tgcagcagcagggaggaggctc

SEQ ID NO: 9190720 - DNA, 22 bp, Homo sapiens
tgcagcagccaaggttctgtgc

SEQ ID NO: 9190721 - DNA, 22 bp, Homo sapiens
tgcagcagggcccaggcacaga

SEQ ID NO: 9190722 - DNA, 22 bp, Homo sapiens
tgcagcagggcccaggcacaga

SEQ ID NO: 9190723 - DNA, 22 bp, Homo sapiens
tgcagcagggcccaggcacaga

SEQ ID NO: 9190724 - DNA, 22 bp, Homo sapiens
tgcagcagggacctctatgtga

SEQ ID NO: 9190725 - DNA, 22 bp, Homo sapiens
tgcagcagactgagtatgagaa

SEQ ID NO: 9190726 - DNA, 22 bp, Homo sapiens
tgcagcagacataatgtggatt

SEQ ID NO: 9190727 - DNA, 22 bp, Homo sapiens
tgcagcagacataatgtggatt

SEQ ID NO: 9190728 - DNA, 21 bp, Homo sapiens
tgcagcagagtaagcagggga

SEQ ID NO: 9190729 - DNA, 21 bp, Homo sapiens
tgcagcagagtaagcagggga

SEQ ID NO: 9190730 - DNA, 22 bp, Homo sapiens
tgattgaattcaaatgcaatct

SEQ ID NO: 9190731 - DNA, 22 bp, Homo sapiens
tgattgttttagttccctgatg

SEQ ID NO: 9190732 - DNA, 22 bp, Homo sapiens
tgattgtttcctatgtacacct

SEQ ID NO: 9190733 - DNA, 23 bp, Homo sapiens
tgattgaaagcctgagaaagctg

SEQ ID NO: 9190734 - DNA, 22 bp, Homo sapiens
tgattgaatattcccttgggcc

SEQ ID NO: 9190735 - DNA, 22 bp, Homo sapiens
tgattgaatattcccttgggcc

SEQ ID NO: 9190736 - DNA, 22 bp, Homo sapiens
tgattgaagtgttctgttccag

SEQ ID NO: 9190737 - DNA, 22 bp, Homo sapiens
tgattgaagctagaacaaccat

SEQ ID NO: 9190738 - DNA, 22 bp, Homo sapiens
tgattgaagctagaacaaccat

SEQ ID NO: 9190739 - DNA, 22 bp, Homo sapiens
tgattgaagaggtgaggaagtt

SEQ ID NO: 9190740 - DNA, 22 bp, Homo sapiens
tgattgaagaggtgaggaagtt

SEQ ID NO: 9190741 - DNA, 23 bp, Homo sapiens
tgattgaaatgaggagtatttgt

SEQ ID NO: 9190742 - DNA, 22 bp, Homo sapiens
tgattgaactgagcttcaagat

SEQ ID NO: 9190743 - DNA, 23 bp, Homo sapiens
tgattacaagggccaaagaaagg

SEQ ID NO: 9190744 - DNA, 22 bp, Homo sapiens
tgattaactgtctattaatcat

SEQ ID NO: 9190745 - DNA, 22 bp, Homo sapiens
tgatgctctcctaatatgaaaa

SEQ ID NO: 9190746 - DNA, 23 bp, Homo sapiens
tgatgctcagaatgcaggtatag

SEQ ID NO: 9190747 - DNA, 22 bp, Homo sapiens
tgatgctttaagattaatctgg

SEQ ID NO: 9190748 - DNA, 22 bp, Homo sapiens
tgatgctgtgtacctcatggga

SEQ ID NO: 9190749 - DNA, 22 bp, Homo sapiens
tgatgctgtcaaggaggtgaac

SEQ ID NO: 9190750 - DNA, 22 bp, Homo sapiens
tgatgcacaaagtcagcatcct

SEQ ID NO: 9190751 - DNA, 22 bp, Homo sapiens
tgatgcaatcctttagaagtaa

SEQ ID NO: 9190752 - DNA, 22 bp, Homo sapiens
tgatcttttcaaagacaagctt

SEQ ID NO: 9190753 - DNA, 18 bp, Homo sapiens
tgatctttgagtataatg

SEQ ID NO: 9190754 - DNA, 22 bp, Homo sapiens
tgatgaaatgttgaggcagtga

SEQ ID NO: 9190755 - DNA, 22 bp, Homo sapiens
tgatgaaagttcagtagtgaat

SEQ ID NO: 9190756 - DNA, 23 bp, Homo sapiens
tgatggccgccctttgccctgtc

SEQ ID NO: 9190757 - DNA, 18 bp, Homo sapiens
tgatggaggagggctggt

SEQ ID NO: 9190758 - DNA, 22 bp, Homo sapiens
tgatgggactgccagctgctga

SEQ ID NO: 9190759 - DNA, 23 bp, Homo sapiens
tgatgggaaggaacgactaccac

SEQ ID NO: 9190760 - DNA, 22 bp, Homo sapiens
tgatggaggacccagcgtggga

SEQ ID NO: 9190761 - DNA, 22 bp, Homo sapiens
tgatggagcatgtgtgcttcct

SEQ ID NO: 9190762 - DNA, 22 bp, Homo sapiens
tgataggtcctcgggcactgga

SEQ ID NO: 9190763 - DNA, 17 bp, Homo sapiens
tgatagttcattttaag

SEQ ID NO: 9190764 - DNA, 22 bp, Homo sapiens
tgatagaagcagaagcatacca

SEQ ID NO: 9190765 - DNA, 22 bp, Homo sapiens
tgatactagcagtattttttac

SEQ ID NO: 9190766 - DNA, 22 bp, Homo sapiens
tgatatttaagcaaaaatatgg

SEQ ID NO: 9190767 - DNA, 22 bp, Homo sapiens
tgatatttgctgactgcattgt

SEQ ID NO: 9190768 - DNA, 22 bp, Homo sapiens
tgatatgtttggatttaggttt

SEQ ID NO: 9190769 - DNA, 22 bp, Homo sapiens
tgatatgtgaagctattagttc

SEQ ID NO: 9190770 - DNA, 22 bp, Homo sapiens
tgatatgggaaaagggctcgga

SEQ ID NO: 9190771 - DNA, 20 bp, Homo sapiens
tgatatggtttggctgtgtt

SEQ ID NO: 9190772 - DNA, 22 bp, Homo sapiens
tgatatgtaactactccttata

SEQ ID NO: 9190773 - DNA, 22 bp, Homo sapiens
tgatcaaaacattactccacca

SEQ ID NO: 9190774 - DNA, 22 bp, Homo sapiens
tgatcaaaacattactccacca

SEQ ID NO: 9190775 - DNA, 22 bp, Homo sapiens
tgatcattatcaaactggtcat

SEQ ID NO: 9190776 - DNA, 20 bp, Homo sapiens
tgatcatgtgaaagtcatgt

SEQ ID NO: 9190777 - DNA, 21 bp, Homo sapiens
tgatcatttgtgtaaaggaga

SEQ ID NO: 9190778 - DNA, 22 bp, Homo sapiens
tgatctggtcctactgtgggca

SEQ ID NO: 9190779 - DNA, 22 bp, Homo sapiens
tgatctggaattccctgtggta

SEQ ID NO: 9190780 - DNA, 19 bp, Homo sapiens
tgatctggaaggaaccagg

SEQ ID NO: 9190781 - DNA, 22 bp, Homo sapiens
tgatctcctgaccttgtaatcc

SEQ ID NO: 9190782 - DNA, 22 bp, Homo sapiens
tgagtgaggaagcggtggagga

SEQ ID NO: 9190783 - DNA, 20 bp, Homo sapiens
tgagtgagtttgtggcagga

SEQ ID NO: 9190784 - DNA, 20 bp, Homo sapiens
tgagtgagtttgtggcagga

SEQ ID NO: 9190785 - DNA, 22 bp, Homo sapiens
tgagtgagttttcacggtcagc

SEQ ID NO: 9190786 - DNA, 22 bp, Homo sapiens
tgagtgatctcagatgccgcat

SEQ ID NO: 9190787 - DNA, 22 bp, Homo sapiens
tgagtgatgagcatgattttag

SEQ ID NO: 9190788 - DNA, 22 bp, Homo sapiens
tgagtgattaggtttttccttc

SEQ ID NO: 9190789 - DNA, 22 bp, Homo sapiens
tgagtgggatgagttagaggtg

SEQ ID NO: 9190790 - DNA, 22 bp, Homo sapiens
tgagtggagtagtgaatgcatt

SEQ ID NO: 9190791 - DNA, 19 bp, Homo sapiens
tgagtggagtgcaatgaag

SEQ ID NO: 9190792 - DNA, 20 bp, Homo sapiens
tgagtggccactgggtcgca

SEQ ID NO: 9190793 - DNA, 22 bp, Homo sapiens
tgagtggacacctgcttcttta

SEQ ID NO: 9190794 - DNA, 22 bp, Homo sapiens
tgagtggacacctgcttcttta

SEQ ID NO: 9190795 - DNA, 22 bp, Homo sapiens
tgagtgtgcagggaagtggcgg

SEQ ID NO: 9190796 - DNA, 22 bp, Homo sapiens
tgagtgggttatcaggaaaggt

SEQ ID NO: 9190797 - DNA, 22 bp, Homo sapiens
tgagttcagatcctggctctgc

SEQ ID NO: 9190798 - DNA, 22 bp, Homo sapiens
tgagttcatatagttcaagata

SEQ ID NO: 9190799 - DNA, 22 bp, Homo sapiens
tgagttatctaaaatagtcaaa

SEQ ID NO: 9190800 - DNA, 22 bp, Homo sapiens
tgagttcaaattttggctctgc

SEQ ID NO: 9190801 - DNA, 22 bp, Homo sapiens
tgcacacacggagataggcttt

SEQ ID NO: 9190802 - DNA, 22 bp, Homo sapiens
tgcacacacgcggcacatctgt

SEQ ID NO: 9190803 - DNA, 20 bp, Homo sapiens
tgcacacaccctgtcctcca

SEQ ID NO: 9190804 - DNA, 20 bp, Homo sapiens
tgcacacaccctgtcctcca

SEQ ID NO: 9190805 - DNA, 22 bp, Homo sapiens
tgcacacaccgtgcttcactga

SEQ ID NO: 9190806 - DNA, 22 bp, Homo sapiens
tgcacacacaggagtctcctcc

SEQ ID NO: 9190807 - DNA, 22 bp, Homo sapiens
tgcacacaggtctaggacatgg

SEQ ID NO: 9190808 - DNA, 22 bp, Homo sapiens
tgcacacagtggacaagtcttg

SEQ ID NO: 9190809 - DNA, 22 bp, Homo sapiens
tgcacacagatggtacatgcat

SEQ ID NO: 9190810 - DNA, 22 bp, Homo sapiens
tgcacacagctgggcctggctg

SEQ ID NO: 9190811 - DNA, 19 bp, Homo sapiens
tgcacacagataagtatct

SEQ ID NO: 9190812 - DNA, 22 bp, Homo sapiens
tgcacacactctgcatatactt

SEQ ID NO: 9190813 - DNA, 22 bp, Homo sapiens
tgcacacactcgtgtatatgag

SEQ ID NO: 9190814 - DNA, 22 bp, Homo sapiens
tgcaatttgacgtcagcacagt

SEQ ID NO: 9190815 - DNA, 22 bp, Homo sapiens
tgcaatttgacgtcagcacagt

SEQ ID NO: 9190816 - DNA, 22 bp, Homo sapiens
tgcaatttggcttccattttct

SEQ ID NO: 9190817 - DNA, 21 bp, Homo sapiens
tgcaatttagacttgaacatt

SEQ ID NO: 9190818 - DNA, 21 bp, Homo sapiens
tgcaatttagacttgaacatt

SEQ ID NO: 9190819 - DNA, 22 bp, Homo sapiens
tgcaatttaatgtgtcccaatt

SEQ ID NO: 9190820 - DNA, 22 bp, Homo sapiens
tgcaattagcgtattagtttat

SEQ ID NO: 9190821 - DNA, 22 bp, Homo sapiens
tgcaatttatgtgcaagtggtt

SEQ ID NO: 9190822 - DNA, 21 bp, Homo sapiens
tgcaatttagacttgaacatt

SEQ ID NO: 9190823 - DNA, 22 bp, Homo sapiens
tgcaattttcagaaattccaaa

SEQ ID NO: 9190824 - DNA, 22 bp, Homo sapiens
tgcaatttttccatgacctaga

SEQ ID NO: 9190825 - DNA, 22 bp, Homo sapiens
tgcaatttttccatgacctaga

SEQ ID NO: 9190826 - DNA, 22 bp, Homo sapiens
tgcaatttggggaagaaagaga

SEQ ID NO: 9190827 - DNA, 22 bp, Homo sapiens
tgcaattttaatacattagagg

SEQ ID NO: 9190828 - DNA, 22 bp, Homo sapiens
tgcaattttaatacattagagg

SEQ ID NO: 9190829 - DNA, 22 bp, Homo sapiens
tgcacaaacacagagaatagat

SEQ ID NO: 9190830 - DNA, 22 bp, Homo sapiens
tgcaaatttgacttcacacatc

SEQ ID NO: 9190831 - DNA, 22 bp, Homo sapiens
tgcaagaaatgtgaagctacaa

SEQ ID NO: 9190832 - DNA, 22 bp, Homo sapiens
tgcaacttgtttggagagaaag

SEQ ID NO: 9190833 - DNA, 22 bp, Homo sapiens
tgcaagacgtgaaattgagaca

SEQ ID NO: 9190834 - DNA, 22 bp, Homo sapiens
tgcaagagcagaaagaactgag

SEQ ID NO: 9190835 - DNA, 22 bp, Homo sapiens
tgcaagaggaattctagaagca

SEQ ID NO: 9190836 - DNA, 22 bp, Homo sapiens
tgcaagagcccagggccaggaa

SEQ ID NO: 9190837 - DNA, 22 bp, Homo sapiens
tgcaagagcccagggccaggaa

SEQ ID NO: 9190838 - DNA, 21 bp, Homo sapiens
tgcaatccagcctgggcgaca

SEQ ID NO: 9190839 - DNA, 21 bp, Homo sapiens
tgcaatccagcctgggcgaca

SEQ ID NO: 9190840 - DNA, 22 bp, Homo sapiens
tgcaagggtagaagtgatggca

SEQ ID NO: 9190841 - DNA, 22 bp, Homo sapiens
tgcaagggtagaagtgatggca

SEQ ID NO: 9190842 - DNA, 22 bp, Homo sapiens
tgcaagggcttagggggctgtg

SEQ ID NO: 9190843 - DNA, 22 bp, Homo sapiens
tgcaaggcagcaccagctcttg

SEQ ID NO: 9190844 - DNA, 22 bp, Homo sapiens
tgcaaggcagcaccagctcttg

SEQ ID NO: 9190845 - DNA, 22 bp, Homo sapiens
tgcaaggaagggacagctgaga

SEQ ID NO: 9190846 - DNA, 19 bp, Homo sapiens
tgcaagctttttcttgtta

SEQ ID NO: 9190847 - DNA, 20 bp, Homo sapiens
tgcaaggaagcaggcaagtg

SEQ ID NO: 9190848 - DNA, 23 bp, Homo sapiens
tgcaaagaaatctgggtcattgt

SEQ ID NO: 9190849 - DNA, 23 bp, Homo sapiens
tgcaaagaaatctgggtcattgt

SEQ ID NO: 9190850 - DNA, 22 bp, Homo sapiens
tgcaaacaccacagagacaatt

SEQ ID NO: 9190851 - DNA, 22 bp, Homo sapiens
tgcaaacaccacagagacaatt

SEQ ID NO: 9190852 - DNA, 22 bp, Homo sapiens
tgcaaacaatttcctataaagt

SEQ ID NO: 9190853 - DNA, 17 bp, Homo sapiens
tgcaaacaatcacatat

SEQ ID NO: 9190854 - DNA, 17 bp, Homo sapiens
tgcaaacaatcacatat

SEQ ID NO: 9190855 - DNA, 23 bp, Homo sapiens
tgcaaaatttgcagagttcgatg

SEQ ID NO: 9190856 - DNA, 23 bp, Homo sapiens
tgcaaaatttgcagagttcgatg

SEQ ID NO: 9190857 - DNA, 22 bp, Homo sapiens
tgcaaattcaaacattttcctg

SEQ ID NO: 9190858 - DNA, 19 bp, Homo sapiens
tgcaaattctaaaaactga

SEQ ID NO: 9190859 - DNA, 22 bp, Homo sapiens
tgcaaatttaatgaaactatgt

SEQ ID NO: 9190860 - DNA, 22 bp, Homo sapiens
tgcaaatgtgttttaaaccaaa

SEQ ID NO: 9190861 - DNA, 22 bp, Homo sapiens
tgcaaagatatgagaagctgta

SEQ ID NO: 9190862 - DNA, 22 bp, Homo sapiens
tgcaaagaaggggaggaggatt

SEQ ID NO: 9190863 - DNA, 22 bp, Homo sapiens
tgcaaagaagggctgaggagca

SEQ ID NO: 9190864 - DNA, 22 bp, Homo sapiens
tgatttccccagtcttgctgct

SEQ ID NO: 9190865 - DNA, 22 bp, Homo sapiens
tgatttcatagtatatacatga

SEQ ID NO: 9190866 - DNA, 22 bp, Homo sapiens
tgatttatgcattatactgttg

SEQ ID NO: 9190867 - DNA, 22 bp, Homo sapiens
tgatttatgcattatactgttg

SEQ ID NO: 9190868 - DNA, 20 bp, Homo sapiens
tgattttctgaaacagcaca

SEQ ID NO: 9190869 - DNA, 22 bp, Homo sapiens
tgattttgtcatgtttctgata

SEQ ID NO: 9190870 - DNA, 22 bp, Homo sapiens
tgatttttagctattctgaaga

SEQ ID NO: 9190871 - DNA, 22 bp, Homo sapiens
tgcaaaatgacttctgaaaaga

SEQ ID NO: 9190872 - DNA, 22 bp, Homo sapiens
tgcaaaataatgaacgattttt

SEQ ID NO: 9190873 - DNA, 22 bp, Homo sapiens
tgcaaaaattgctggaatcttt

SEQ ID NO: 9190874 - DNA, 22 bp, Homo sapiens
tgcaaaaactgcaattgctttt

SEQ ID NO: 9190875 - DNA, 22 bp, Homo sapiens
tgcaaaaaggcagactggtgat

SEQ ID NO: 9190876 - DNA, 22 bp, Homo sapiens
tgcaaaaagagcgaggagccct

SEQ ID NO: 9190877 - DNA, 22 bp, Homo sapiens
tgcaaaaactgcaattgctttt

SEQ ID NO: 9190878 - DNA, 19 bp, Homo sapiens
tgagaacttttacttatgc

SEQ ID NO: 9190879 - DNA, 22 bp, Homo sapiens
tgagaactggtttctattcatg

SEQ ID NO: 9190880 - DNA, 22 bp, Homo sapiens
tgagaactgaggatttgaattc

SEQ ID NO: 9190881 - DNA, 22 bp, Homo sapiens
tgagaagcagtttcagtaagaa

SEQ ID NO: 9190882 - DNA, 22 bp, Homo sapiens
tgagaagcagcttacaggtgtc

SEQ ID NO: 9190883 - DNA, 23 bp, Homo sapiens
tgagaagccaggggagcgtgagg

SEQ ID NO: 9190884 - DNA, 23 bp, Homo sapiens
tgagaagccattagagcaggtgg

SEQ ID NO: 9190885 - DNA, 22 bp, Homo sapiens
tgagaagcagcttacaggtgtc

SEQ ID NO: 9190886 - DNA, 22 bp, Homo sapiens
tgagaagcattaggaagaacat

SEQ ID NO: 9190887 - DNA, 23 bp, Homo sapiens
tgagaagccattagagcaggtgg

SEQ ID NO: 9190888 - DNA, 22 bp, Homo sapiens
tgagaagcccaagccgggtggt

SEQ ID NO: 9190889 - DNA, 22 bp, Homo sapiens
tgagaagcccacactctttcct

SEQ ID NO: 9190890 - DNA, 20 bp, Homo sapiens
tgagaaagtagagactcagg

SEQ ID NO: 9190891 - DNA, 22 bp, Homo sapiens
tgagaaaggtatttcatgcact

SEQ ID NO: 9190892 - DNA, 22 bp, Homo sapiens
tgagaaaggtatttcatgcact

SEQ ID NO: 9190893 - DNA, 20 bp, Homo sapiens
tgagaaagtagagactcagg

SEQ ID NO: 9190894 - DNA, 22 bp, Homo sapiens
tgagaaattcgacatatattta

SEQ ID NO: 9190895 - DNA, 22 bp, Homo sapiens
tgagaaacatatgagagatttg

SEQ ID NO: 9190896 - DNA, 18 bp, Homo sapiens
tgagaaactgacacatgg

SEQ ID NO: 9190897 - DNA, 22 bp, Homo sapiens
tgagaaacttgccaagcatctc

SEQ ID NO: 9190898 - DNA, 22 bp, Homo sapiens
tgagaaacatatgagagatttg

SEQ ID NO: 9190899 - DNA, 22 bp, Homo sapiens
tgagaaaattactataattgtc

SEQ ID NO: 9190900 - DNA, 22 bp, Homo sapiens
tgagaaaattactataattgtc

SEQ ID NO: 9190901 - DNA, 18 bp, Homo sapiens
tgagacagctaccacttg

SEQ ID NO: 9190902 - DNA, 22 bp, Homo sapiens
tgagacagggtcttgctctgtt

SEQ ID NO: 9190903 - DNA, 22 bp, Homo sapiens
tgagacagggtcttgctctgtt

SEQ ID NO: 9190904 - DNA, 22 bp, Homo sapiens
tgagacagtatcgccccaaggc

SEQ ID NO: 9190905 - DNA, 22 bp, Homo sapiens
tgagacagtcccatgatctgca

SEQ ID NO: 9190906 - DNA, 22 bp, Homo sapiens
tgagacagtcccatgatctgca

SEQ ID NO: 9190907 - DNA, 22 bp, Homo sapiens
tgagacaggcttccttcttggg

SEQ ID NO: 9190908 - DNA, 19 bp, Homo sapiens
tgagacagggattcaggtg

SEQ ID NO: 9190909 - DNA, 22 bp, Homo sapiens
tgagacagcctctgcactcatg

SEQ ID NO: 9190910 - DNA, 22 bp, Homo sapiens
tgagacaggagaggcccctcct

SEQ ID NO: 9190911 - DNA, 22 bp, Homo sapiens
tgagacagcccttctgcacagg

SEQ ID NO: 9190912 - DNA, 22 bp, Homo sapiens
tgagacagcctctgcactcatg

SEQ ID NO: 9190913 - DNA, 22 bp, Homo sapiens
tgagacagcccttctgcacagg

SEQ ID NO: 9190914 - DNA, 22 bp, Homo sapiens
tgagacaacctaattaaacacc

SEQ ID NO: 9190915 - DNA, 22 bp, Homo sapiens
tgagacagcagattagcaatga

SEQ ID NO: 9190916 - DNA, 22 bp, Homo sapiens
tgagacagcagattagcaatga

SEQ ID NO: 9190917 - DNA, 19 bp, Homo sapiens
tgagacagaagatgagcct

SEQ ID NO: 9190918 - DNA, 22 bp, Homo sapiens
tgagaattacaaatgagtcaca

SEQ ID NO: 9190919 - DNA, 22 bp, Homo sapiens
tgagaagctgcttgtgctgtat

SEQ ID NO: 9190920 - DNA, 22 bp, Homo sapiens
tgagaagctgctgacttagcct

SEQ ID NO: 9190921 - DNA, 22 bp, Homo sapiens
tgagaagctctgaaacagtatc

SEQ ID NO: 9190922 - DNA, 20 bp, Homo sapiens
tgagaagctcctgtctcctc

SEQ ID NO: 9190923 - DNA, 23 bp, Homo sapiens
tgagaagccgccgggcagcctgg

SEQ ID NO: 9190924 - DNA, 22 bp, Homo sapiens
tgagaattttttgtcatgcatt

SEQ ID NO: 9190925 - DNA, 22 bp, Homo sapiens
tgagaatttgcatttctaacaa

SEQ ID NO: 9190926 - DNA, 21 bp, Homo sapiens
tgagagagtagcaggacatat

SEQ ID NO: 9190927 - DNA, 22 bp, Homo sapiens
tgagagagcctgaatctcttac

SEQ ID NO: 9190928 - DNA, 22 bp, Homo sapiens
tgagagagcgcctgggatcatt

SEQ ID NO: 9190929 - DNA, 22 bp, Homo sapiens
tgagacagtcaccaggcaggcc

SEQ ID NO: 9190930 - DNA, 18 bp, Homo sapiens
tgagagaatgttcatgct

SEQ ID NO: 9190931 - DNA, 22 bp, Homo sapiens
tgagagagtaattgagtggtaa

SEQ ID NO: 9190932 - DNA, 22 bp, Homo sapiens
tgagagaggggactgcctgctt

SEQ ID NO: 9190933 - DNA, 22 bp, Homo sapiens
tgagagagtaattgagtggtaa

SEQ ID NO: 9190934 - DNA, 22 bp, Homo sapiens
tgagagagtaattgagtggtaa

SEQ ID NO: 9190935 - DNA, 22 bp, Homo sapiens
tgagagagtaattgagtggtaa

SEQ ID NO: 9190936 - DNA, 22 bp, Homo sapiens
tgagagagggatgcaccctcct

SEQ ID NO: 9190937 - DNA, 22 bp, Homo sapiens
tgagagaggatgccctcatatt

SEQ ID NO: 9190938 - DNA, 22 bp, Homo sapiens
tgagagaggggactgcctgctt

SEQ ID NO: 9190939 - DNA, 22 bp, Homo sapiens
tgagagaggatgccctcatatt

SEQ ID NO: 9190940 - DNA, 22 bp, Homo sapiens
tgagagaggatgccctcatatt

SEQ ID NO: 9190941 - DNA, 22 bp, Homo sapiens
tgagaggagtgattgtaaaatt

SEQ ID NO: 9190942 - DNA, 20 bp, Homo sapiens
tgagagctgggcagggatac

SEQ ID NO: 9190943 - DNA, 22 bp, Homo sapiens
tgagaggaacaggcagtaggtt

SEQ ID NO: 9190944 - DNA, 22 bp, Homo sapiens
tgagagctgccacgtgaccatg

SEQ ID NO: 9190945 - DNA, 22 bp, Homo sapiens
tgagagctgccacgtgaccatg

SEQ ID NO: 9190946 - DNA, 22 bp, Homo sapiens
tgagaggccccagctcttggcc

SEQ ID NO: 9190947 - DNA, 22 bp, Homo sapiens
tgagaggctagatcagctctgt

SEQ ID NO: 9190948 - DNA, 18 bp, Homo sapiens
tgagaggctattttttgc

SEQ ID NO: 9190949 - DNA, 22 bp, Homo sapiens
tgagagggttcccaggggtttc

SEQ ID NO: 9190950 - DNA, 22 bp, Homo sapiens
tgagatggttcacagagaaggc

SEQ ID NO: 9190951 - DNA, 22 bp, Homo sapiens
tgagatgggtggggagctcagg

SEQ ID NO: 9190952 - DNA, 22 bp, Homo sapiens
tgagatggctgggccccaggag

SEQ ID NO: 9190953 - DNA, 22 bp, Homo sapiens
tgagatttcaggccaaggagtg

SEQ ID NO: 9190954 - DNA, 22 bp, Homo sapiens
tgagatttcaggccaaggagtg

SEQ ID NO: 9190955 - DNA, 22 bp, Homo sapiens
tgagatgtaaggtatgcttact

SEQ ID NO: 9190956 - DNA, 22 bp, Homo sapiens
tgagatttcgccgacagtattt

SEQ ID NO: 9190957 - DNA, 22 bp, Homo sapiens
tgagatttgggttgtttaacat

SEQ ID NO: 9190958 - DNA, 20 bp, Homo sapiens
tgagatttgtattataagtc

SEQ ID NO: 9190959 - DNA, 20 bp, Homo sapiens
tgagatttgtattataagtc

SEQ ID NO: 9190960 - DNA, 22 bp, Homo sapiens
tgagatttgggttgtttaacat

SEQ ID NO: 9190961 - DNA, 22 bp, Homo sapiens
tgagatttgttttataaaatag

SEQ ID NO: 9190962 - DNA, 22 bp, Homo sapiens
tgagatttgttttataaaatag

SEQ ID NO: 9190963 - DNA, 22 bp, Homo sapiens
tgagattttaatattgagaaaa

SEQ ID NO: 9190964 - DNA, 22 bp, Homo sapiens
tgagattttaatattgagaaaa

SEQ ID NO: 9190965 - DNA, 22 bp, Homo sapiens
tgagattttcctaaatataatg

SEQ ID NO: 9190966 - DNA, 22 bp, Homo sapiens
tgagatgaataactcctgctaa

SEQ ID NO: 9190967 - DNA, 22 bp, Homo sapiens
tgagatgctgctgtaacaaata

SEQ ID NO: 9190968 - DNA, 22 bp, Homo sapiens
tgagatgctgctgtaacaaata

SEQ ID NO: 9190969 - DNA, 21 bp, Homo sapiens
tgagatgctagaaggcaggga

SEQ ID NO: 9190970 - DNA, 22 bp, Homo sapiens
tgagatgctgggaacaaggaag

SEQ ID NO: 9190971 - DNA, 22 bp, Homo sapiens
tgagatgctgggaacaaggaag

SEQ ID NO: 9190972 - DNA, 22 bp, Homo sapiens
tgagatggaaggtgaggcagta

SEQ ID NO: 9190973 - DNA, 22 bp, Homo sapiens
tgagatcattgacttgttcctg

SEQ ID NO: 9190974 - DNA, 22 bp, Homo sapiens
tgagatgaaagcagaaagactt

SEQ ID NO: 9190975 - DNA, 22 bp, Homo sapiens
tgagatgaaagcagaaagactt

SEQ ID NO: 9190976 - DNA, 22 bp, Homo sapiens
tgagccaggttaagacaggagc

SEQ ID NO: 9190977 - DNA, 22 bp, Homo sapiens
tgagcccagtctgtctgacatg

SEQ ID NO: 9190978 - DNA, 22 bp, Homo sapiens
tgagcccatgctctttctacga

SEQ ID NO: 9190979 - DNA, 22 bp, Homo sapiens
tgagccccggagtttcaggctg

SEQ ID NO: 9190980 - DNA, 22 bp, Homo sapiens
tgagccctaagggtcaagcagg

SEQ ID NO: 9190981 - DNA, 22 bp, Homo sapiens
tgagccctacctgctcatctcc

SEQ ID NO: 9190982 - DNA, 22 bp, Homo sapiens
tgagccgtggtctctgagggtg

SEQ ID NO: 9190983 - DNA, 22 bp, Homo sapiens
tgagcctggagcccagatgttt

SEQ ID NO: 9190984 - DNA, 22 bp, Homo sapiens
tgagcctggagcccagatgttt

SEQ ID NO: 9190985 - DNA, 22 bp, Homo sapiens
tgagcctggagcccagatgttt

SEQ ID NO: 9190986 - DNA, 22 bp, Homo sapiens
tgagcctggagtcgtggagggg

SEQ ID NO: 9190987 - DNA, 22 bp, Homo sapiens
tgagcctggcctgcagagacca

SEQ ID NO: 9190988 - DNA, 22 bp, Homo sapiens
tgagcctggagtcgtggagggg

SEQ ID NO: 9190989 - DNA, 22 bp, Homo sapiens
tgagcctgcctgcaggtgtgct

SEQ ID NO: 9190990 - DNA, 22 bp, Homo sapiens
tgagcctgcctgcaggtgtgct

SEQ ID NO: 9190991 - DNA, 23 bp, Homo sapiens
tgagcctgctgatagacacaatt

SEQ ID NO: 9190992 - DNA, 20 bp, Homo sapiens
tgagcctgctgtaggaggcc

SEQ ID NO: 9190993 - DNA, 20 bp, Homo sapiens
tgagcctgctgtaggaggcc

SEQ ID NO: 9190994 - DNA, 22 bp, Homo sapiens
tgagcctgcaataagcacagcc

SEQ ID NO: 9190995 - DNA, 22 bp, Homo sapiens
tgagcctgcaataagcacagcc

SEQ ID NO: 9190996 - DNA, 22 bp, Homo sapiens
tgagcctgggagatggaggctg

SEQ ID NO: 9190997 - DNA, 22 bp, Homo sapiens
tgagcctggggcctgggcagcg

SEQ ID NO: 9190998 - DNA, 22 bp, Homo sapiens
tgagcctggttgcagtgtctgg

SEQ ID NO: 9190999 - DNA, 22 bp, Homo sapiens
tgagcctggttgcagtgtctgg

SEQ ID NO: 9191000 - DNA, 22 bp, Homo sapiens
tgagcctgtcattattcagaga

SEQ ID NO: 9191001 - DNA, 22 bp, Homo sapiens
tgagcctgtcctgtgcatgtga

SEQ ID NO: 9191002 - DNA, 22 bp, Homo sapiens
tgagctggtcactccttctgaa

SEQ ID NO: 9191003 - DNA, 22 bp, Homo sapiens
tgagctggttcttgaggcatga

SEQ ID NO: 9191004 - DNA, 22 bp, Homo sapiens
tgagctggttcttgaggcatga

SEQ ID NO: 9191005 - DNA, 22 bp, Homo sapiens
tgagctggtcttgagtgtagct

SEQ ID NO: 9191006 - DNA, 22 bp, Homo sapiens
tgagctggatccaactccgttt

SEQ ID NO: 9191007 - DNA, 22 bp, Homo sapiens
tgagctggagtctgtggctcct

SEQ ID NO: 9191008 - DNA, 22 bp, Homo sapiens
tgagctggaatcttcttgactg

SEQ ID NO: 9191009 - DNA, 22 bp, Homo sapiens
tgagctgcagagatctttgata

SEQ ID NO: 9191010 - DNA, 22 bp, Homo sapiens
tgagctgcagtgagctgagatg

SEQ ID NO: 9191011 - DNA, 22 bp, Homo sapiens
tgagctgagtttaaaagctgct

SEQ ID NO: 9191012 - DNA, 22 bp, Homo sapiens
tgagctgagtttaaaagctgct

SEQ ID NO: 9191013 - DNA, 22 bp, Homo sapiens
tgagctgatggcatccctgttt

SEQ ID NO: 9191014 - DNA, 22 bp, Homo sapiens
tgagctctaagatcccctcaag

SEQ ID NO: 9191015 - DNA, 22 bp, Homo sapiens
tgagctctcagggacagactat

SEQ ID NO: 9191016 - DNA, 22 bp, Homo sapiens
tgagctgagtggcaggtctcag

SEQ ID NO: 9191017 - DNA, 23 bp, Homo sapiens
tgagctgagtgagttggcctggg

SEQ ID NO: 9191018 - DNA, 22 bp, Homo sapiens
tgagctgacacccaatcatact

SEQ ID NO: 9191019 - DNA, 22 bp, Homo sapiens
tgagctctgttagggctggaac

SEQ ID NO: 9191020 - DNA, 22 bp, Homo sapiens
tgagctcttgatatccttgttt

SEQ ID NO: 9191021 - DNA, 22 bp, Homo sapiens
tgagctgtaaggctgtcactga

SEQ ID NO: 9191022 - DNA, 22 bp, Homo sapiens
tgagctgtactcctccccaggg

SEQ ID NO: 9191023 - DNA, 22 bp, Homo sapiens
tgagctgtcaaggtacagtgaa

SEQ ID NO: 9191024 - DNA, 22 bp, Homo sapiens
tgagctgtagcagatgctgttg

SEQ ID NO: 9191025 - DNA, 22 bp, Homo sapiens
tgagctgtatattgttttaata

SEQ ID NO: 9191026 - DNA, 22 bp, Homo sapiens
tgagctgtctatggtcctgtct

SEQ ID NO: 9191027 - DNA, 22 bp, Homo sapiens
tgagctgtcaaggtacagtgaa

SEQ ID NO: 9191028 - DNA, 22 bp, Homo sapiens
tgagctgtctgaatggtgagga

SEQ ID NO: 9191029 - DNA, 22 bp, Homo sapiens
tgagctgtgagggtacagatat

SEQ ID NO: 9191030 - DNA, 22 bp, Homo sapiens
tgagctgtgatctatgataaat

SEQ ID NO: 9191031 - DNA, 22 bp, Homo sapiens
tgagctgtgattaactctgaga

SEQ ID NO: 9191032 - DNA, 22 bp, Homo sapiens
tgagctgtgctacgccctggga

SEQ ID NO: 9191033 - DNA, 22 bp, Homo sapiens
tgagctgtggtggggtagagga

SEQ ID NO: 9191034 - DNA, 22 bp, Homo sapiens
tgagcttcaaagttggatctga

SEQ ID NO: 9191035 - DNA, 17 bp, Homo sapiens
tgagcttcaatcaggtg

SEQ ID NO: 9191036 - DNA, 22 bp, Homo sapiens
tgagcttcaaagttggatctga

SEQ ID NO: 9191037 - DNA, 22 bp, Homo sapiens
tgagctgtgtgacattgagcca

SEQ ID NO: 9191038 - DNA, 22 bp, Homo sapiens
tgagctgtgtcttggtgagagt

SEQ ID NO: 9191039 - DNA, 22 bp, Homo sapiens
tgagctgtgtcctgggggcagt

SEQ ID NO: 9191040 - DNA, 22 bp, Homo sapiens
tgagctgtttctctggtggctt

SEQ ID NO: 9191041 - DNA, 22 bp, Homo sapiens
tgagcttacgtgggaacagact

SEQ ID NO: 9191042 - DNA, 22 bp, Homo sapiens
tgagctttgtgggtaaagagag

SEQ ID NO: 9191043 - DNA, 22 bp, Homo sapiens
tgagctttcatgtatgaaaaga

SEQ ID NO: 9191044 - DNA, 22 bp, Homo sapiens
tgagcttccctcctgcactaca

SEQ ID NO: 9191045 - DNA, 22 bp, Homo sapiens
tgagcttctttatttggccaga

SEQ ID NO: 9191046 - DNA, 22 bp, Homo sapiens
tgagcttcctccctgcatccat

SEQ ID NO: 9191047 - DNA, 22 bp, Homo sapiens
tgaggaaacttacaaggcagaa

SEQ ID NO: 9191048 - DNA, 22 bp, Homo sapiens
tgaggaaactgaggcacagatg

SEQ ID NO: 9191049 - DNA, 22 bp, Homo sapiens
tgaggaaactgaggcacagatg

SEQ ID NO: 9191050 - DNA, 22 bp, Homo sapiens
tgaggaaacttacaaggcagaa

SEQ ID NO: 9191051 - DNA, 22 bp, Homo sapiens
tgaggaaacttacaaggcagaa

SEQ ID NO: 9191052 - DNA, 22 bp, Homo sapiens
tgaggaaactgaggcacagatg

SEQ ID NO: 9191053 - DNA, 22 bp, Homo sapiens
tgaggaaactgaggcacagatg

SEQ ID NO: 9191054 - DNA, 22 bp, Homo sapiens
tgaggaaaacgtattgaaagga

SEQ ID NO: 9191055 - DNA, 22 bp, Homo sapiens
tgagcagggactttggagtctg

SEQ ID NO: 9191056 - DNA, 22 bp, Homo sapiens
tgagcagggagctgggctgagc

SEQ ID NO: 9191057 - DNA, 19 bp, Homo sapiens
tgagcatgcgagctgagaa

SEQ ID NO: 9191058 - DNA, 22 bp, Homo sapiens
tgagcatggtgggtgcagagca

SEQ ID NO: 9191059 - DNA, 22 bp, Homo sapiens
tgagcagggagctgggctgagc

SEQ ID NO: 9191060 - DNA, 22 bp, Homo sapiens
tgagccacagtgagagctcctg

SEQ ID NO: 9191061 - DNA, 22 bp, Homo sapiens
tgagccaatgatttgaatagag

SEQ ID NO: 9191062 - DNA, 22 bp, Homo sapiens
tgagccaagttcacaccattgc

SEQ ID NO: 9191063 - DNA, 22 bp, Homo sapiens
tgagccaaggagcaaagcctca

SEQ ID NO: 9191064 - DNA, 22 bp, Homo sapiens
tgagcattggatcaaatgactt

SEQ ID NO: 9191065 - DNA, 20 bp, Homo sapiens
tgagccaaacgatgaagagc

SEQ ID NO: 9191066 - DNA, 20 bp, Homo sapiens
tgagccaaacgatgaagagc

SEQ ID NO: 9191067 - DNA, 22 bp, Homo sapiens
tgagccaggcactgctcctgga

SEQ ID NO: 9191068 - DNA, 20 bp, Homo sapiens
tgagccaggctaggaagggc

SEQ ID NO: 9191069 - DNA, 22 bp, Homo sapiens
tgagccagctccttgcctgtca

SEQ ID NO: 9191070 - DNA, 22 bp, Homo sapiens
tgagccagccttgcagctgtgc

SEQ ID NO: 9191071 - DNA, 22 bp, Homo sapiens
tgagcaggcgcagcaggaggtc

SEQ ID NO: 9191072 - DNA, 22 bp, Homo sapiens
tgagcaggcgcagcaggaggtc

SEQ ID NO: 9191073 - DNA, 22 bp, Homo sapiens
tgagcagggactttgagtgtag

SEQ ID NO: 9191074 - DNA, 22 bp, Homo sapiens
tgagcagggactttgagtgtag

SEQ ID NO: 9191075 - DNA, 22 bp, Homo sapiens
tgagcaggattcgcctcttgca

SEQ ID NO: 9191076 - DNA, 22 bp, Homo sapiens
tgagcaggcgcagcaggaggtc

SEQ ID NO: 9191077 - DNA, 22 bp, Homo sapiens
tgagcagcccttcctccggcca

SEQ ID NO: 9191078 - DNA, 22 bp, Homo sapiens
tgagcagcaggatcttctggta

SEQ ID NO: 9191079 - DNA, 22 bp, Homo sapiens
tgagcagcaactgtccatggca

SEQ ID NO: 9191080 - DNA, 22 bp, Homo sapiens
tgagcaggactcactgcagcct

SEQ ID NO: 9191081 - DNA, 22 bp, Homo sapiens
tgagcaggagataaacaggtag

SEQ ID NO: 9191082 - DNA, 22 bp, Homo sapiens
tgagcaggactcactgcagcct

SEQ ID NO: 9191083 - DNA, 22 bp, Homo sapiens
tgagcaggactgaccggcctta

SEQ ID NO: 9191084 - DNA, 22 bp, Homo sapiens
tgagcaggactgaccggcctta

SEQ ID NO: 9191085 - DNA, 22 bp, Homo sapiens
tgagcagaggccagcacctggg

SEQ ID NO: 9191086 - DNA, 22 bp, Homo sapiens
tgagcagagcagtaacaggagc

SEQ ID NO: 9191087 - DNA, 22 bp, Homo sapiens
tgagcagatggaggcttctgca

SEQ ID NO: 9191088 - DNA, 22 bp, Homo sapiens
tgagcacaagtttgcatgtgtg

SEQ ID NO: 9191089 - DNA, 22 bp, Homo sapiens
tgaggtgaggttgaggaaagaa

SEQ ID NO: 9191090 - DNA, 22 bp, Homo sapiens
tgaggtagaagcctgggttgag

SEQ ID NO: 9191091 - DNA, 22 bp, Homo sapiens
tgagggtggccttgtgtggact

SEQ ID NO: 9191092 - DNA, 22 bp, Homo sapiens
tgagggtgggccctgggcatct

SEQ ID NO: 9191093 - DNA, 22 bp, Homo sapiens
tgagggtctggaatctgggctt

SEQ ID NO: 9191094 - DNA, 22 bp, Homo sapiens
tgagggtctggaatctgggctt

SEQ ID NO: 9191095 - DNA, 22 bp, Homo sapiens
tgagggtcatttggaagtggaa

SEQ ID NO: 9191096 - DNA, 22 bp, Homo sapiens
tgagggtatatattgtgtggag

SEQ ID NO: 9191097 - DNA, 22 bp, Homo sapiens
tgagggtagctggatcacggag

SEQ ID NO: 9191098 - DNA, 22 bp, Homo sapiens
tgagggtagaggcaggagtgca

SEQ ID NO: 9191099 - DNA, 22 bp, Homo sapiens
tgaggggttaccttggagttga

SEQ ID NO: 9191100 - DNA, 22 bp, Homo sapiens
tgaggggttaccttggagttga

SEQ ID NO: 9191101 - DNA, 22 bp, Homo sapiens
tgaggggtctaggctgcgcacc

SEQ ID NO: 9191102 - DNA, 22 bp, Homo sapiens
tgagggggttaattaggagagt

SEQ ID NO: 9191103 - DNA, 22 bp, Homo sapiens
tgagggggttaattaggagagt

SEQ ID NO: 9191104 - DNA, 22 bp, Homo sapiens
tgaggggcgctggcaggttcct

SEQ ID NO: 9191105 - DNA, 22 bp, Homo sapiens
tgaggggcagagaggtgtccag

SEQ ID NO: 9191106 - DNA, 19 bp, Homo sapiens
tgaggggctcacagtctca

SEQ ID NO: 9191107 - DNA, 22 bp, Homo sapiens
tgaggggcgctggcaggttcct

SEQ ID NO: 9191108 - DNA, 17 bp, Homo sapiens
tgagtaaagcacatggt

SEQ ID NO: 9191109 - DNA, 22 bp, Homo sapiens
tgagtaaagggccagatagtaa

SEQ ID NO: 9191110 - DNA, 22 bp, Homo sapiens
tgagtaaagggccagatagtaa

SEQ ID NO: 9191111 - DNA, 22 bp, Homo sapiens
tgagtaaatatcagtattgtgc

SEQ ID NO: 9191112 - DNA, 22 bp, Homo sapiens
tgagtaaatatttatgactaga

SEQ ID NO: 9191113 - DNA, 22 bp, Homo sapiens
tgaggttcagttcttggccaca

SEQ ID NO: 9191114 - DNA, 22 bp, Homo sapiens
tgagtagagaattcagctaagg

SEQ ID NO: 9191115 - DNA, 22 bp, Homo sapiens
tgagtaatctcacatattatgt

SEQ ID NO: 9191116 - DNA, 22 bp, Homo sapiens
tgagtaaatatttatgactaga

SEQ ID NO: 9191117 - DNA, 22 bp, Homo sapiens
tgagtagagaattcagctaagg

SEQ ID NO: 9191118 - DNA, 22 bp, Homo sapiens
tgagtaggatagggtggggctt

SEQ ID NO: 9191119 - DNA, 22 bp, Homo sapiens
tgagtcacacatttcttcatac

SEQ ID NO: 9191120 - DNA, 22 bp, Homo sapiens
tgagtcacagccttgccttggt

SEQ ID NO: 9191121 - DNA, 22 bp, Homo sapiens
tgagtcacacatttcttcatac

SEQ ID NO: 9191122 - DNA, 22 bp, Homo sapiens
tgagtctgtatgtccagattta

SEQ ID NO: 9191123 - DNA, 22 bp, Homo sapiens
tgagtctgtatgtccagattta

SEQ ID NO: 9191124 - DNA, 22 bp, Homo sapiens
tgagtcactgggtaatctggat

SEQ ID NO: 9191125 - DNA, 22 bp, Homo sapiens
tgagtctgggcatgttcacttt

SEQ ID NO: 9191126 - DNA, 22 bp, Homo sapiens
tgagtcacccacattaaaatgt

SEQ ID NO: 9191127 - DNA, 23 bp, Homo sapiens
tgagtcaccacagttacagtcac

SEQ ID NO: 9191128 - DNA, 22 bp, Homo sapiens
tgagtcacatccatttttgtgt

SEQ ID NO: 9191129 - DNA, 22 bp, Homo sapiens
tgagtcaccgacctggctggtt

SEQ ID NO: 9191130 - DNA, 22 bp, Homo sapiens
tgagtcacctctcagaagccac

SEQ ID NO: 9191131 - DNA, 22 bp, Homo sapiens
tgagtcaccttggtattggcag

SEQ ID NO: 9191132 - DNA, 22 bp, Homo sapiens
tgagtcactatcactttctctg

SEQ ID NO: 9191133 - DNA, 22 bp, Homo sapiens
tgagtcactggcaaggctttga

SEQ ID NO: 9191134 - DNA, 22 bp, Homo sapiens
tgagtcactatcactttctctg

SEQ ID NO: 9191135 - DNA, 19 bp, Homo sapiens
tgagtcactcttacagtca

SEQ ID NO: 9191136 - DNA, 22 bp, Homo sapiens
tgaggtggttactgtggtgctc

SEQ ID NO: 9191137 - DNA, 22 bp, Homo sapiens
tgaggtgggtgtcaggtcagag

SEQ ID NO: 9191138 - DNA, 22 bp, Homo sapiens
tgaggtggttactgtggtgctc

SEQ ID NO: 9191139 - DNA, 22 bp, Homo sapiens
tgaggccttttctgtctggcta

SEQ ID NO: 9191140 - DNA, 22 bp, Homo sapiens
tgaggcctgggcacataacctc

SEQ ID NO: 9191141 - DNA, 22 bp, Homo sapiens
tgaggcctgtcattgtcttgtt

SEQ ID NO: 9191142 - DNA, 22 bp, Homo sapiens
tgaggctcaagaatagacagta

SEQ ID NO: 9191143 - DNA, 20 bp, Homo sapiens
tgaggcgacgaagaggcggc

SEQ ID NO: 9191144 - DNA, 22 bp, Homo sapiens
tgaggcctggactctgcatgga

SEQ ID NO: 9191145 - DNA, 22 bp, Homo sapiens
tgaggcctggagggaggagttt

SEQ ID NO: 9191146 - DNA, 22 bp, Homo sapiens
tgaggcctgccctggggaagtt

SEQ ID NO: 9191147 - DNA, 22 bp, Homo sapiens
tgaggcctgcttggaattgaat

SEQ ID NO: 9191148 - DNA, 22 bp, Homo sapiens
tgaggctcagagaagtgctgtt

SEQ ID NO: 9191149 - DNA, 18 bp, Homo sapiens
tgaggctcagctcctggt

SEQ ID NO: 9191150 - DNA, 18 bp, Homo sapiens
tgaggctcagctcctggt

SEQ ID NO: 9191151 - DNA, 21 bp, Homo sapiens
tgaggctcatcttatgtggct

SEQ ID NO: 9191152 - DNA, 17 bp, Homo sapiens
tgaggctcggtgaggag

SEQ ID NO: 9191153 - DNA, 22 bp, Homo sapiens
tgaggcttagagaagatgggat

SEQ ID NO: 9191154 - DNA, 22 bp, Homo sapiens
tgaggcttccaacatgtgagaa

SEQ ID NO: 9191155 - DNA, 22 bp, Homo sapiens
tgaggcttccaacatgtgagaa

SEQ ID NO: 9191156 - DNA, 22 bp, Homo sapiens
tgaggcttagagaagatgggat

SEQ ID NO: 9191157 - DNA, 22 bp, Homo sapiens
tgaggctgttctaccagggcca

SEQ ID NO: 9191158 - DNA, 22 bp, Homo sapiens
tgagggagtcatgattaaggaa

SEQ ID NO: 9191159 - DNA, 22 bp, Homo sapiens
tgagggagtcatgattaaggaa

SEQ ID NO: 9191160 - DNA, 22 bp, Homo sapiens
tgagggagtcatgattaaggaa

SEQ ID NO: 9191161 - DNA, 22 bp, Homo sapiens
tgaggggagacagagtggactc

SEQ ID NO: 9191162 - DNA, 22 bp, Homo sapiens
tgaggggagacagagtggactc

SEQ ID NO: 9191163 - DNA, 22 bp, Homo sapiens
tgaggggaggttggggcacatc

SEQ ID NO: 9191164 - DNA, 22 bp, Homo sapiens
tgaggggaggttggggcacatc

SEQ ID NO: 9191165 - DNA, 22 bp, Homo sapiens
tgaggggatacggtacacattg

SEQ ID NO: 9191166 - DNA, 22 bp, Homo sapiens
tgaggggagcccgccctggacg

SEQ ID NO: 9191167 - DNA, 19 bp, Homo sapiens
tgaggggaggagaggcctg

SEQ ID NO: 9191168 - DNA, 22 bp, Homo sapiens
tgagggagcacacactgaagtg

SEQ ID NO: 9191169 - DNA, 22 bp, Homo sapiens
tgagggactcccggccctgcca

SEQ ID NO: 9191170 - DNA, 23 bp, Homo sapiens
tgagggacatggtggcttctgag

SEQ ID NO: 9191171 - DNA, 22 bp, Homo sapiens
tgaggcttggcaaaagagtggt

SEQ ID NO: 9191172 - DNA, 22 bp, Homo sapiens
tgaggcttggagaggtcaggga

SEQ ID NO: 9191173 - DNA, 22 bp, Homo sapiens
tgaggctttatgtaagggtgca

SEQ ID NO: 9191174 - DNA, 22 bp, Homo sapiens
tgaggcttgtctcagatggggg

SEQ ID NO: 9191175 - DNA, 22 bp, Homo sapiens
tgaggcttgtctcagatggggg

SEQ ID NO: 9191176 - DNA, 22 bp, Homo sapiens
tgaggcagggagtttaattgtc

SEQ ID NO: 9191177 - DNA, 22 bp, Homo sapiens
tgaggcagtgtgagataataaa

SEQ ID NO: 9191178 - DNA, 22 bp, Homo sapiens
tgaggcagttcttacttgtatt

SEQ ID NO: 9191179 - DNA, 22 bp, Homo sapiens
tgaggcagtgtgagataataaa

SEQ ID NO: 9191180 - DNA, 22 bp, Homo sapiens
tgaggcagggagagtggatatg

SEQ ID NO: 9191181 - DNA, 22 bp, Homo sapiens
tgaggcagggagagtggatatg

SEQ ID NO: 9191182 - DNA, 23 bp, Homo sapiens
tgaggcaggcggatcacgaggtc

SEQ ID NO: 9191183 - DNA, 23 bp, Homo sapiens
tgaggcaggcggatcacgaggtc

SEQ ID NO: 9191184 - DNA, 22 bp, Homo sapiens
tgaggccaagaaaagctgggtg

SEQ ID NO: 9191185 - DNA, 22 bp, Homo sapiens
tgaggccaactagggagatgga

SEQ ID NO: 9191186 - DNA, 22 bp, Homo sapiens
tgaggccaagcctcctctgcca

SEQ ID NO: 9191187 - DNA, 22 bp, Homo sapiens
tgaggcaggaggattgcaggat

SEQ ID NO: 9191188 - DNA, 22 bp, Homo sapiens
tgaggcaggagaatggcgggaa

SEQ ID NO: 9191189 - DNA, 20 bp, Homo sapiens
tgaggcaggagaatggcatg

SEQ ID NO: 9191190 - DNA, 20 bp, Homo sapiens
tgaggcaggagaatggcatg

SEQ ID NO: 9191191 - DNA, 22 bp, Homo sapiens
tgaggcaggagttaatgtgctc

SEQ ID NO: 9191192 - DNA, 22 bp, Homo sapiens
tgaggcaggagttaatgtgctc

SEQ ID NO: 9191193 - DNA, 22 bp, Homo sapiens
tgaggcaggagttcaggctgcg

SEQ ID NO: 9191194 - DNA, 22 bp, Homo sapiens
tgaggcaggatgcttgcacagg

SEQ ID NO: 9191195 - DNA, 22 bp, Homo sapiens
tgaggcaggagttcaggctgcg

SEQ ID NO: 9191196 - DNA, 22 bp, Homo sapiens
tgaggccagccacagccaccct

SEQ ID NO: 9191197 - DNA, 22 bp, Homo sapiens
tgaggccagagagtttgcattt

SEQ ID NO: 9191198 - DNA, 22 bp, Homo sapiens
tgaggccagagagtttgcattt

SEQ ID NO: 9191199 - DNA, 22 bp, Homo sapiens
tgaggccagcttcagcagtgga

SEQ ID NO: 9191200 - DNA, 19 bp, Homo sapiens
tgaggccagctggcatttt

SEQ ID NO: 9191201 - DNA, 19 bp, Homo sapiens
tgaggccagctggcatttt

SEQ ID NO: 9191202 - DNA, 19 bp, Homo sapiens
tgaggccaaggtcacagat

SEQ ID NO: 9191203 - DNA, 19 bp, Homo sapiens
tgaggccaaggtcacagat

SEQ ID NO: 9191204 - DNA, 21 bp, Homo sapiens
tgaggccaatagcccctggac

SEQ ID NO: 9191205 - DNA, 22 bp, Homo sapiens
tgaggccacttccccacagccc

SEQ ID NO: 9191206 - DNA, 22 bp, Homo sapiens
tgaggcctcttggtatggtgtg

SEQ ID NO: 9191207 - DNA, 22 bp, Homo sapiens
tgaggcctcttggtatggtgtg

SEQ ID NO: 9191208 - DNA, 22 bp, Homo sapiens
tgaggcctgaagcctgaagtga

SEQ ID NO: 9191209 - DNA, 21 bp, Homo sapiens
tgaggcctctcctgggctggc

SEQ ID NO: 9191210 - DNA, 22 bp, Homo sapiens
tgaggcctctgaggcctaggct

SEQ ID NO: 9191211 - DNA, 18 bp, Homo sapiens
tgaggcctctgctgggcc

SEQ ID NO: 9191212 - DNA, 18 bp, Homo sapiens
tgaggcctctgctgggcc

SEQ ID NO: 9191213 - DNA, 22 bp, Homo sapiens
tgaggcctctgaggcctaggct

SEQ ID NO: 9191214 - DNA, 22 bp, Homo sapiens
tgaggcctgaagcctggagcct

SEQ ID NO: 9191215 - DNA, 22 bp, Homo sapiens
tgaggcctgacagaccaagcct

SEQ ID NO: 9191216 - DNA, 21 bp, Homo sapiens
tgaggcctgccagtctcagaa

SEQ ID NO: 9191217 - DNA, 22 bp, Homo sapiens
tgaggcctgcattgaactagaa

SEQ ID NO: 9191218 - DNA, 17 bp, Homo sapiens
tgaggcctgcatcagtg

SEQ ID NO: 9191219 - DNA, 22 bp, Homo sapiens
tgaggccaggatcccaggctct

SEQ ID NO: 9191220 - DNA, 22 bp, Homo sapiens
tgaggccaggatcccaggctct

SEQ ID NO: 9191221 - DNA, 22 bp, Homo sapiens
tgaggcctcataatgagatttc

SEQ ID NO: 9191222 - DNA, 22 bp, Homo sapiens
tgaggcctcatttagggagagg

SEQ ID NO: 9191223 - DNA, 21 bp, Homo sapiens
tgaggcctctcctgggctggc

SEQ ID NO: 9191224 - DNA, 22 bp, Homo sapiens
tgaggcaggactgagcgggatg

SEQ ID NO: 9191225 - DNA, 22 bp, Homo sapiens
tgaggcaggactgagcgggatg

SEQ ID NO: 9191226 - DNA, 22 bp, Homo sapiens
tgaggcaggacttgcataaagt

SEQ ID NO: 9191227 - DNA, 22 bp, Homo sapiens
tgaggcaggagaatcacatgaa

SEQ ID NO: 9191228 - DNA, 20 bp, Homo sapiens
tgaggcaggagaatggcatg

SEQ ID NO: 9191229 - DNA, 22 bp, Homo sapiens
tgaggcagctttttctgtgtgt

SEQ ID NO: 9191230 - DNA, 22 bp, Homo sapiens
tgaggcagcctgcattaaagag

SEQ ID NO: 9191231 - DNA, 22 bp, Homo sapiens
tgaggcagcctgcattaaagag

SEQ ID NO: 9191232 - DNA, 22 bp, Homo sapiens
tgaggcagcctgcattaaagag

SEQ ID NO: 9191233 - DNA, 22 bp, Homo sapiens
tgaggcaggactgagcgggatg

SEQ ID NO: 9191234 - DNA, 22 bp, Homo sapiens
tgaggcaaaaacactgattagg

SEQ ID NO: 9191235 - DNA, 22 bp, Homo sapiens
tgaggcaagagtttgattagag

SEQ ID NO: 9191236 - DNA, 22 bp, Homo sapiens
tgaggcaaagttcaagctgaaa

SEQ ID NO: 9191237 - DNA, 22 bp, Homo sapiens
tgaggcaacagaaagggccaat

SEQ ID NO: 9191238 - DNA, 17 bp, Homo sapiens
tgaggcaaccatcacta

SEQ ID NO: 9191239 - DNA, 22 bp, Homo sapiens
tgaggcaaagacaaagcagcat

SEQ ID NO: 9191240 - DNA, 22 bp, Homo sapiens
tgaggcaaaagttatgtggtag

SEQ ID NO: 9191241 - DNA, 19 bp, Homo sapiens
tgaggcaagctttttcttg

SEQ ID NO: 9191242 - DNA, 22 bp, Homo sapiens
tgaggcaagggatggccccgtg

SEQ ID NO: 9191243 - DNA, 22 bp, Homo sapiens
tgaggcaaggctgaatgaaggc

SEQ ID NO: 9191244 - DNA, 22 bp, Homo sapiens
tgaggcaagctgggcccatgga

SEQ ID NO: 9191245 - DNA, 19 bp, Homo sapiens
tgaggcaagatggctctgg

SEQ ID NO: 9191246 - DNA, 22 bp, Homo sapiens
tgaggcaagtctcaatctttga

SEQ ID NO: 9191247 - DNA, 22 bp, Homo sapiens
tgaggcaagtactttccctttt

SEQ ID NO: 9191248 - DNA, 21 bp, Homo sapiens
tgaggcaagtccttttatagc

SEQ ID NO: 9191249 - DNA, 22 bp, Homo sapiens
tgaggcaattggaaattttaac

SEQ ID NO: 9191250 - DNA, 22 bp, Homo sapiens
tgaggcaatgtccttcatcctt

SEQ ID NO: 9191251 - DNA, 22 bp, Homo sapiens
tgaggcaatccctagggtaagg

SEQ ID NO: 9191252 - DNA, 22 bp, Homo sapiens
tgaggatggggagatggtgtct

SEQ ID NO: 9191253 - DNA, 22 bp, Homo sapiens
tgaggatggtcccgaggacact

SEQ ID NO: 9191254 - DNA, 22 bp, Homo sapiens
tgaggagtttttctagagctaa

SEQ ID NO: 9191255 - DNA, 22 bp, Homo sapiens
tgaggaggtgggcacacagagt

SEQ ID NO: 9191256 - DNA, 22 bp, Homo sapiens
tgaggaggtgggcacacagagt

SEQ ID NO: 9191257 - DNA, 22 bp, Homo sapiens
tgaggaggcccaggttggggct

SEQ ID NO: 9191258 - DNA, 22 bp, Homo sapiens
tgaggaggcccaggttggggct

SEQ ID NO: 9191259 - DNA, 22 bp, Homo sapiens
tgaggagcagggtggcttactc

SEQ ID NO: 9191260 - DNA, 22 bp, Homo sapiens
tgaggagaaatgctcagagcca

SEQ ID NO: 9191261 - DNA, 23 bp, Homo sapiens
tgaggagcatagctgactgacag

SEQ ID NO: 9191262 - DNA, 22 bp, Homo sapiens
tgaggagcgggcagggatgcag

SEQ ID NO: 9191263 - DNA, 22 bp, Homo sapiens
tgaggagcttctggaaagtgca

SEQ ID NO: 9191264 - DNA, 22 bp, Homo sapiens
tgaggaagggtgtgacggcacc

SEQ ID NO: 9191265 - DNA, 18 bp, Homo sapiens
tgaggaaggggaagtatt

SEQ ID NO: 9191266 - DNA, 22 bp, Homo sapiens
tgaggaagttgatctcatcagt

SEQ ID NO: 9191267 - DNA, 22 bp, Homo sapiens
tgaggaagccaaacagctacac

SEQ ID NO: 9191268 - DNA, 22 bp, Homo sapiens
tgaggaagccaaacagctacac

SEQ ID NO: 9191269 - DNA, 22 bp, Homo sapiens
tgaggaagcaaaggcttgtgtg

SEQ ID NO: 9191270 - DNA, 22 bp, Homo sapiens
tgaggaaagaaaggcatgcatg

SEQ ID NO: 9191271 - DNA, 22 bp, Homo sapiens
tgaggaaagaaaggcatgcatg

SEQ ID NO: 9191272 - DNA, 22 bp, Homo sapiens
tgaggaaacttacaaggcagaa

SEQ ID NO: 9191273 - DNA, 22 bp, Homo sapiens
tgaggaaacttacaaggcagaa

SEQ ID NO: 9191274 - DNA, 22 bp, Homo sapiens
tgaggaaagaaaggcatgcatg

SEQ ID NO: 9191275 - DNA, 22 bp, Homo sapiens
tgaggaagaacaagaatttaga

SEQ ID NO: 9191276 - DNA, 22 bp, Homo sapiens
tgaggaaattgaggctcacaga

SEQ ID NO: 9191277 - DNA, 22 bp, Homo sapiens
tgaggaacaactcctgtgacta

SEQ ID NO: 9191278 - DNA, 22 bp, Homo sapiens
tgaaatagtcaagtatttgaac

SEQ ID NO: 9191279 - DNA, 22 bp, Homo sapiens
tgaaataggaaacagatgtttc

SEQ ID NO: 9191280 - DNA, 20 bp, Homo sapiens
tgaaatagatactcagagat

SEQ ID NO: 9191281 - DNA, 20 bp, Homo sapiens
tgaaatagatactcagagat

SEQ ID NO: 9191282 - DNA, 22 bp, Homo sapiens
tgaaatacacaaatttagtaag

SEQ ID NO: 9191283 - DNA, 22 bp, Homo sapiens
tgaaatacacaaatttagtaag

SEQ ID NO: 9191284 - DNA, 22 bp, Homo sapiens
tgaaatacacaaatttagtaag

SEQ ID NO: 9191285 - DNA, 22 bp, Homo sapiens
tgaaatagaaaaacaggcttct

SEQ ID NO: 9191286 - DNA, 22 bp, Homo sapiens
tgaaatactttttgtacctgtc

SEQ ID NO: 9191287 - DNA, 22 bp, Homo sapiens
tgaaatactgagtgaaagaatt

SEQ ID NO: 9191288 - DNA, 22 bp, Homo sapiens
tgaaataatatctggatcaatc

SEQ ID NO: 9191289 - DNA, 22 bp, Homo sapiens
tgaaataatatctggatcaatc

SEQ ID NO: 9191290 - DNA, 22 bp, Homo sapiens
tgaaataacttttgggtgagtt

SEQ ID NO: 9191291 - DNA, 20 bp, Homo sapiens
tgaaataaggagttgtcctt

SEQ ID NO: 9191292 - DNA, 20 bp, Homo sapiens
tgaaataaggagttgtcctt

SEQ ID NO: 9191293 - DNA, 22 bp, Homo sapiens
tgaaatagtctaaaaaaccaga

SEQ ID NO: 9191294 - DNA, 22 bp, Homo sapiens
tgaaagtgaatgtcactgttga

SEQ ID NO: 9191295 - DNA, 22 bp, Homo sapiens
tgaaagttattactgatgatgt

SEQ ID NO: 9191296 - DNA, 22 bp, Homo sapiens
tgaaagttaggatgtagtaatt

SEQ ID NO: 9191297 - DNA, 22 bp, Homo sapiens
tgaaagagtgcaagtcaaggag

SEQ ID NO: 9191298 - DNA, 22 bp, Homo sapiens
tgaaagagtttgacatgattct

SEQ ID NO: 9191299 - DNA, 22 bp, Homo sapiens
tgaaagagtttgacatgattct

SEQ ID NO: 9191300 - DNA, 22 bp, Homo sapiens
tgaaagatgaaagcaggctggt

SEQ ID NO: 9191301 - DNA, 22 bp, Homo sapiens
tgaaagattgtgattcaatatg

SEQ ID NO: 9191302 - DNA, 22 bp, Homo sapiens
tgaaagcactgattctcaactc

SEQ ID NO: 9191303 - DNA, 22 bp, Homo sapiens
tgaaagcacaagttctaacagg

SEQ ID NO: 9191304 - DNA, 22 bp, Homo sapiens
tgaaagcacaagttctaacagg

SEQ ID NO: 9191305 - DNA, 22 bp, Homo sapiens
tgaaatctcctctttatatatc

SEQ ID NO: 9191306 - DNA, 22 bp, Homo sapiens
tgaaatgtaaataggactagaa

SEQ ID NO: 9191307 - DNA, 22 bp, Homo sapiens
tgaaatgtacaagtgctttttt

SEQ ID NO: 9191308 - DNA, 22 bp, Homo sapiens
tgaaatggaattaatttgtatt

SEQ ID NO: 9191309 - DNA, 22 bp, Homo sapiens
tgaaatgctgtagagactgtat

SEQ ID NO: 9191310 - DNA, 22 bp, Homo sapiens
tgaaatgcctatgaagtcagga

SEQ ID NO: 9191311 - DNA, 22 bp, Homo sapiens
tgaaatgaaacagaacatatca

SEQ ID NO: 9191312 - DNA, 22 bp, Homo sapiens
tgaaatgttctggagtttctgt

SEQ ID NO: 9191313 - DNA, 22 bp, Homo sapiens
tgaaatgttaatcacacaaagg

SEQ ID NO: 9191314 - DNA, 22 bp, Homo sapiens
tgaaatgtgttctagtgttttg

SEQ ID NO: 9191315 - DNA, 22 bp, Homo sapiens
tgaaatgtgttctagtgttttg

SEQ ID NO: 9191316 - DNA, 22 bp, Homo sapiens
tgaaatgtttgggtccagaagt

SEQ ID NO: 9191317 - DNA, 22 bp, Homo sapiens
tgaaatgtttgaagaccactga

SEQ ID NO: 9191318 - DNA, 22 bp, Homo sapiens
tgaaatgttggtaattttatat

SEQ ID NO: 9191319 - DNA, 22 bp, Homo sapiens
tgaaatgtttaggaccactaga

SEQ ID NO: 9191320 - DNA, 22 bp, Homo sapiens
tgaaatgtttaggaccactaga

SEQ ID NO: 9191321 - DNA, 22 bp, Homo sapiens
tgaaatgtctttgcaattgaaa

SEQ ID NO: 9191322 - DNA, 22 bp, Homo sapiens
tgaaatgtctgaaagccaatct

SEQ ID NO: 9191323 - DNA, 22 bp, Homo sapiens
tgaaatgtctttgcaattgaaa

SEQ ID NO: 9191324 - DNA, 22 bp, Homo sapiens
tgaaatgtgatctgagcttggc

SEQ ID NO: 9191325 - DNA, 22 bp, Homo sapiens
tgaaatgtgtccatgttatttc

SEQ ID NO: 9191326 - DNA, 22 bp, Homo sapiens
tgaaatgtgttatctgggcctg

SEQ ID NO: 9191327 - DNA, 22 bp, Homo sapiens
tgaaatgtgtaatgtggatgcc

SEQ ID NO: 9191328 - DNA, 22 bp, Homo sapiens
tgaaatgtcagtgttttataag

SEQ ID NO: 9191329 - DNA, 22 bp, Homo sapiens
tgaaatgtagtgaagcatggaa

SEQ ID NO: 9191330 - DNA, 23 bp, Homo sapiens
tgaaatgtagaggaattccacct

SEQ ID NO: 9191331 - DNA, 22 bp, Homo sapiens
tgaaatgtagattaggcattct

SEQ ID NO: 9191332 - DNA, 22 bp, Homo sapiens
tgaactcatactaaaaaatatt

SEQ ID NO: 9191333 - DNA, 22 bp, Homo sapiens
tgaactatacgataacatgatt

SEQ ID NO: 9191334 - DNA, 22 bp, Homo sapiens
tgaacgcaggtccacatggctc

SEQ ID NO: 9191335 - DNA, 22 bp, Homo sapiens
tgaactcctgacctcatgatcc

SEQ ID NO: 9191336 - DNA, 18 bp, Homo sapiens
tgaactggcatcagaatc

SEQ ID NO: 9191337 - DNA, 22 bp, Homo sapiens
tgaactgcaggaatctcagtgg

SEQ ID NO: 9191338 - DNA, 22 bp, Homo sapiens
tgaacattagttgagtaaagtc

SEQ ID NO: 9191339 - DNA, 22 bp, Homo sapiens
tgaacattggcacaaggcagca

SEQ ID NO: 9191340 - DNA, 19 bp, Homo sapiens
tgaacgatgtctcagggca

SEQ ID NO: 9191341 - DNA, 22 bp, Homo sapiens
tgaaatttaggtgcagataaat

SEQ ID NO: 9191342 - DNA, 22 bp, Homo sapiens
tgaacaaactgcattcttcact

SEQ ID NO: 9191343 - DNA, 22 bp, Homo sapiens
tgaaattcaaaacacatttgtc

SEQ ID NO: 9191344 - DNA, 22 bp, Homo sapiens
tgaaattatgcattgttgtacc

SEQ ID NO: 9191345 - DNA, 22 bp, Homo sapiens
tgaaattagtgaagttacagtt

SEQ ID NO: 9191346 - DNA, 21 bp, Homo sapiens
tgaacaaagttcttatcgtga

SEQ ID NO: 9191347 - DNA, 21 bp, Homo sapiens
tgaacaaagttcttatcgtga

SEQ ID NO: 9191348 - DNA, 22 bp, Homo sapiens
tgaacaaatgaatcagtgtagc

SEQ ID NO: 9191349 - DNA, 22 bp, Homo sapiens
tgaacaaatggaaataaccagt

SEQ ID NO: 9191350 - DNA, 22 bp, Homo sapiens
tgaacaaatgaatcagtgtagc

SEQ ID NO: 9191351 - DNA, 22 bp, Homo sapiens
tgaacagtttcaagaaaacttt

SEQ ID NO: 9191352 - DNA, 22 bp, Homo sapiens
tgaagcaggtgaatggatgtcg

SEQ ID NO: 9191353 - DNA, 22 bp, Homo sapiens
tgaagcagagtgaaggtgaatt

SEQ ID NO: 9191354 - DNA, 22 bp, Homo sapiens
tgaagcagcttctttctgtcaa

SEQ ID NO: 9191355 - DNA, 22 bp, Homo sapiens
tgaagcagaggggtcttgagct

SEQ ID NO: 9191356 - DNA, 22 bp, Homo sapiens
tgaagcagaggggtcttgagct

SEQ ID NO: 9191357 - DNA, 22 bp, Homo sapiens
tgaagcagagaatttgacagtc

SEQ ID NO: 9191358 - DNA, 22 bp, Homo sapiens
tgaagcaatgatagcagaatga

SEQ ID NO: 9191359 - DNA, 22 bp, Homo sapiens
tgaagattttgtagctttcagc

SEQ ID NO: 9191360 - DNA, 22 bp, Homo sapiens
tgaagaataagatagatggagc

SEQ ID NO: 9191361 - DNA, 22 bp, Homo sapiens
tgaagaagccaattggtaggct

SEQ ID NO: 9191362 - DNA, 22 bp, Homo sapiens
tgaagacaagtgtgctggtgtt

SEQ ID NO: 9191363 - DNA, 22 bp, Homo sapiens
tgaagaatgttgcagtgagcat

SEQ ID NO: 9191364 - DNA, 22 bp, Homo sapiens
tgaagacaagaaaacactgggg

SEQ ID NO: 9191365 - DNA, 22 bp, Homo sapiens
tgaagacccctgctagtgtcat

SEQ ID NO: 9191366 - DNA, 22 bp, Homo sapiens
tgaagactcagaagctaagata

SEQ ID NO: 9191367 - DNA, 22 bp, Homo sapiens
tcttttcatcatttaataggta

SEQ ID NO: 9191368 - DNA, 22 bp, Homo sapiens
tcttttgttgatggaattaatg

SEQ ID NO: 9191369 - DNA, 22 bp, Homo sapiens
tcttttgtggatgaagaaatgg

SEQ ID NO: 9191370 - DNA, 21 bp, Homo sapiens
tcttttctcagctttgtggtt

SEQ ID NO: 9191371 - DNA, 22 bp, Homo sapiens
tcttttctccagacctgggatc

SEQ ID NO: 9191372 - DNA, 21 bp, Homo sapiens
tcttttctcagctttgtggtt

SEQ ID NO: 9191373 - DNA, 21 bp, Homo sapiens
tcttttctcagctttgtggtt

SEQ ID NO: 9191374 - DNA, 22 bp, Homo sapiens
tcttttctagcaaatccaggag

SEQ ID NO: 9191375 - DNA, 21 bp, Homo sapiens
tcttttcctttctgtgtgcaa

SEQ ID NO: 9191376 - DNA, 18 bp, Homo sapiens
tcttttccttccacttcc

SEQ ID NO: 9191377 - DNA, 18 bp, Homo sapiens
tcttttccttccacttcc

SEQ ID NO: 9191378 - DNA, 22 bp, Homo sapiens
tctttgtttgtactgttagaat

SEQ ID NO: 9191379 - DNA, 22 bp, Homo sapiens
tctttgtttgtactgttagaat

SEQ ID NO: 9191380 - DNA, 22 bp, Homo sapiens
tctttgtttgcctttatcaaga

SEQ ID NO: 9191381 - DNA, 22 bp, Homo sapiens
tctttgtttgcctttatcaaga

SEQ ID NO: 9191382 - DNA, 22 bp, Homo sapiens
tctttgttattgctttatctat

SEQ ID NO: 9191383 - DNA, 20 bp, Homo sapiens
tctttgttaattttatctcc

SEQ ID NO: 9191384 - DNA, 22 bp, Homo sapiens
tcttttatagtgaattttcttg

SEQ ID NO: 9191385 - DNA, 22 bp, Homo sapiens
tcttttagtaataaatatttgt

SEQ ID NO: 9191386 - DNA, 22 bp, Homo sapiens
tcttttagagcatttctgattc

SEQ ID NO: 9191387 - DNA, 22 bp, Homo sapiens
tctttgcaaaatacaacaatgg

SEQ ID NO: 9191388 - DNA, 22 bp, Homo sapiens
tctttgattttgttactaagac

SEQ ID NO: 9191389 - DNA, 22 bp, Homo sapiens
tctttgcaaactatggagtgtg

SEQ ID NO: 9191390 - DNA, 22 bp, Homo sapiens
tctttgcaaatgttattatctt

SEQ ID NO: 9191391 - DNA, 22 bp, Homo sapiens
tctttgcagccccaggaagtgg

SEQ ID NO: 9191392 - DNA, 22 bp, Homo sapiens
tctttgcaggccaaattgttaa

SEQ ID NO: 9191393 - DNA, 22 bp, Homo sapiens
tctttgcagtggtgaataaaga

SEQ ID NO: 9191394 - DNA, 22 bp, Homo sapiens
tctttgcagccccaggaagtgg

SEQ ID NO: 9191395 - DNA, 22 bp, Homo sapiens
tctttgcagaatttaactttgc

SEQ ID NO: 9191396 - DNA, 22 bp, Homo sapiens
tctttgcactgtgcaagcagaa

SEQ ID NO: 9191397 - DNA, 22 bp, Homo sapiens
tctttgcactgtgcaagcagaa

SEQ ID NO: 9191398 - DNA, 22 bp, Homo sapiens
tctttgcatcccttccatagtt

SEQ ID NO: 9191399 - DNA, 22 bp, Homo sapiens
tctttgctattgtgaatagtgc

SEQ ID NO: 9191400 - DNA, 22 bp, Homo sapiens
tctttggaaggagcagtttttg

SEQ ID NO: 9191401 - DNA, 22 bp, Homo sapiens
tctttgtaactgtctattgaga

SEQ ID NO: 9191402 - DNA, 22 bp, Homo sapiens
tctttgtaaatgcctagcataa

SEQ ID NO: 9191403 - DNA, 22 bp, Homo sapiens
tctttgtaagaaattcttccgt

SEQ ID NO: 9191404 - DNA, 22 bp, Homo sapiens
tctttgtaactgtctattgaga

SEQ ID NO: 9191405 - DNA, 22 bp, Homo sapiens
tctttggcatcagggccagcta

SEQ ID NO: 9191406 - DNA, 22 bp, Homo sapiens
tctttgtactttctggctgtcc

SEQ ID NO: 9191407 - DNA, 22 bp, Homo sapiens
tctttgtaagttatatgtagta

SEQ ID NO: 9191408 - DNA, 22 bp, Homo sapiens
tctttgtaagacatgtaagtcc

SEQ ID NO: 9191409 - DNA, 22 bp, Homo sapiens
tctttgtgccatgcagtgaggc

SEQ ID NO: 9191410 - DNA, 22 bp, Homo sapiens
tctttgtctgaacagggacatt

SEQ ID NO: 9191411 - DNA, 22 bp, Homo sapiens
tctttgtggcgggcttaaatac

SEQ ID NO: 9191412 - DNA, 22 bp, Homo sapiens
tctttgtggcgggcttaaatac

SEQ ID NO: 9191413 - DNA, 22 bp, Homo sapiens
tctttgtatgtatgtttcaaag

SEQ ID NO: 9191414 - DNA, 18 bp, Homo sapiens
tctttggacaactactgg

SEQ ID NO: 9191415 - DNA, 22 bp, Homo sapiens
tctttggaattctctgcagccc

SEQ ID NO: 9191416 - DNA, 22 bp, Homo sapiens
tctttggatcccaactggctgg

SEQ ID NO: 9191417 - DNA, 22 bp, Homo sapiens
tgaaagaagccttcgaggctcg

SEQ ID NO: 9191418 - DNA, 22 bp, Homo sapiens
tgaaagaagccttcgaggctcg

SEQ ID NO: 9191419 - DNA, 22 bp, Homo sapiens
tgaaagaagggtggaaaatgta

SEQ ID NO: 9191420 - DNA, 22 bp, Homo sapiens
tgaaagaactagcatcttcaag

SEQ ID NO: 9191421 - DNA, 22 bp, Homo sapiens
tgaaagaagcctccctttggag

SEQ ID NO: 9191422 - DNA, 22 bp, Homo sapiens
tgaaagaagcctccctttggag

SEQ ID NO: 9191423 - DNA, 22 bp, Homo sapiens
tgaaagaagcctccctttggag

SEQ ID NO: 9191424 - DNA, 17 bp, Homo sapiens
tgaaagaatcagggaga

SEQ ID NO: 9191425 - DNA, 22 bp, Homo sapiens
tgaaagaagtgtcacattgcca

SEQ ID NO: 9191426 - DNA, 22 bp, Homo sapiens
tgaaagaagtgtcacattgcca

SEQ ID NO: 9191427 - DNA, 22 bp, Homo sapiens
tgaaagaagtgtcacattgcca

SEQ ID NO: 9191428 - DNA, 21 bp, Homo sapiens
tgaaagaaggtgcagtctgaa

SEQ ID NO: 9191429 - DNA, 21 bp, Homo sapiens
tgaaagaaggtgcagtctgaa

SEQ ID NO: 9191430 - DNA, 22 bp, Homo sapiens
tgaaacttgctaattgcacgta

SEQ ID NO: 9191431 - DNA, 22 bp, Homo sapiens
tgaaacttgagtatatatggat

SEQ ID NO: 9191432 - DNA, 22 bp, Homo sapiens
tgaaagaaacaggtatattggg

SEQ ID NO: 9191433 - DNA, 22 bp, Homo sapiens
tgaaagaaacaggtatattggg

SEQ ID NO: 9191434 - DNA, 22 bp, Homo sapiens
tgaaagaaacaggtatattggg

SEQ ID NO: 9191435 - DNA, 22 bp, Homo sapiens
tgaaacttatatatcccaggtt

SEQ ID NO: 9191436 - DNA, 22 bp, Homo sapiens
tgaaacttataagaatatgaat

SEQ ID NO: 9191437 - DNA, 19 bp, Homo sapiens
tgaaacaaacttaaaagga

SEQ ID NO: 9191438 - DNA, 22 bp, Homo sapiens
tgaaacaaaccagtaattttgt

SEQ ID NO: 9191439 - DNA, 22 bp, Homo sapiens
tgaaacaaaccagtaattttgt

SEQ ID NO: 9191440 - DNA, 22 bp, Homo sapiens
tgaaacaaaattaagattctcg

SEQ ID NO: 9191441 - DNA, 22 bp, Homo sapiens
tgaaacaaaattaagattctcg

SEQ ID NO: 9191442 - DNA, 22 bp, Homo sapiens
tgaaacagtagtctgtgggttt

SEQ ID NO: 9191443 - DNA, 22 bp, Homo sapiens
tgaaacagtagtctgtgggttt

SEQ ID NO: 9191444 - DNA, 19 bp, Homo sapiens
tgaaacaaacttaaaagga

SEQ ID NO: 9191445 - DNA, 22 bp, Homo sapiens
tgaaacaggatgcagaggagga

SEQ ID NO: 9191446 - DNA, 22 bp, Homo sapiens
tgaaacaggatgcagaggagga

SEQ ID NO: 9191447 - DNA, 22 bp, Homo sapiens
tgaaacattaggaaatcattat

SEQ ID NO: 9191448 - DNA, 22 bp, Homo sapiens
tgaaacattatagaatatttat

SEQ ID NO: 9191449 - DNA, 22 bp, Homo sapiens
tgaaacattaggaaatcattat

SEQ ID NO: 9191450 - DNA, 23 bp, Homo sapiens
tgaaacatttagggtagaatttc

SEQ ID NO: 9191451 - DNA, 22 bp, Homo sapiens
tgaaacattgcactgtatgaat

SEQ ID NO: 9191452 - DNA, 23 bp, Homo sapiens
tgaaacatttagggtagaatttc

SEQ ID NO: 9191453 - DNA, 22 bp, Homo sapiens
tgaaaatttccatcagttatat

SEQ ID NO: 9191454 - DNA, 22 bp, Homo sapiens
tgaaaatatagttttccagact

SEQ ID NO: 9191455 - DNA, 22 bp, Homo sapiens
tgaaaagactgcaagagagcat

SEQ ID NO: 9191456 - DNA, 22 bp, Homo sapiens
tgaaaagtcttatattgtctga

SEQ ID NO: 9191457 - DNA, 20 bp, Homo sapiens
tgaaaaggtcaggagacatg

SEQ ID NO: 9191458 - DNA, 22 bp, Homo sapiens
tcttttgttgcctacttattaa

SEQ ID NO: 9191459 - DNA, 22 bp, Homo sapiens
tcttttgttgcctacttattaa

SEQ ID NO: 9191460 - DNA, 22 bp, Homo sapiens
tcttttgttgcctacttattaa

SEQ ID NO: 9191461 - DNA, 22 bp, Homo sapiens
tcttttgttgcctacttattaa

SEQ ID NO: 9191462 - DNA, 22 bp, Homo sapiens
tctttttatattgacaaaaggt

SEQ ID NO: 9191463 - DNA, 22 bp, Homo sapiens
tctttttttcctgtgcagagct

SEQ ID NO: 9191464 - DNA, 22 bp, Homo sapiens
tctttttatattgacaaaaggt

SEQ ID NO: 9191465 - DNA, 22 bp, Homo sapiens
tgaaaaaacaagttggcccatt

SEQ ID NO: 9191466 - DNA, 22 bp, Homo sapiens
tgaaaaaacaagttggcccatt

SEQ ID NO: 9191467 - DNA, 22 bp, Homo sapiens
tgaaaaaacaagttggcccatt

SEQ ID NO: 9191468 - DNA, 22 bp, Homo sapiens
tgaaaaaacaagttggcccatt

SEQ ID NO: 9191469 - DNA, 22 bp, Homo sapiens
tgaaaaaacaagttggcccatt

SEQ ID NO: 9191470 - DNA, 22 bp, Homo sapiens
tgaaaaaacaagttggcccatt

SEQ ID NO: 9191471 - DNA, 22 bp, Homo sapiens
tgaaaaacactaattggaaagc

SEQ ID NO: 9191472 - DNA, 22 bp, Homo sapiens
tgaaaaacctcagtccgcttta

SEQ ID NO: 9191473 - DNA, 22 bp, Homo sapiens
tgaaaaactgaatagttgagta

SEQ ID NO: 9191474 - DNA, 22 bp, Homo sapiens
tgaaaaactttaatccataaag

SEQ ID NO: 9191475 - DNA, 22 bp, Homo sapiens
tgaaaaactttaatccataaag

SEQ ID NO: 9191476 - DNA, 22 bp, Homo sapiens
tgaaaaactttaatccataaag

SEQ ID NO: 9191477 - DNA, 22 bp, Homo sapiens
tgaaaacagaatccttgttttc

SEQ ID NO: 9191478 - DNA, 22 bp, Homo sapiens
tgaaaacagaatccttgttttc

SEQ ID NO: 9191479 - DNA, 22 bp, Homo sapiens
tgaaaacactttagtttaggtc

SEQ ID NO: 9191480 - DNA, 22 bp, Homo sapiens
tgaaaacactttagtttaggtc

SEQ ID NO: 9191481 - DNA, 22 bp, Homo sapiens
tgacatttgagcatacatgtaa

SEQ ID NO: 9191482 - DNA, 22 bp, Homo sapiens
tgacatttgagagagatataca

SEQ ID NO: 9191483 - DNA, 22 bp, Homo sapiens
tgacatttgagagagatataca

SEQ ID NO: 9191484 - DNA, 22 bp, Homo sapiens
tgacatttcttgttgatataaa

SEQ ID NO: 9191485 - DNA, 21 bp, Homo sapiens
tgacatttggattcatagtaa

SEQ ID NO: 9191486 - DNA, 21 bp, Homo sapiens
tgacatttggattcatagtaa

SEQ ID NO: 9191487 - DNA, 22 bp, Homo sapiens
tgacattttatcaatatcacag

SEQ ID NO: 9191488 - DNA, 22 bp, Homo sapiens
tgacatttttaaaaccactagt

SEQ ID NO: 9191489 - DNA, 21 bp, Homo sapiens
tgacccttgccgagctacatt

SEQ ID NO: 9191490 - DNA, 22 bp, Homo sapiens
tgaccctttcattattctcatt

SEQ ID NO: 9191491 - DNA, 22 bp, Homo sapiens
tgaccgtcttcccactttctgt

SEQ ID NO: 9191492 - DNA, 21 bp, Homo sapiens
tgacatttagtagcattgtca

SEQ ID NO: 9191493 - DNA, 22 bp, Homo sapiens
tgacatttatcttctacaatga

SEQ ID NO: 9191494 - DNA, 22 bp, Homo sapiens
tgacatttatcaaagaaatggt

SEQ ID NO: 9191495 - DNA, 22 bp, Homo sapiens
tgacatgtatgttgttggcatg

SEQ ID NO: 9191496 - DNA, 22 bp, Homo sapiens
tgacatgtcctgagaagatggc

SEQ ID NO: 9191497 - DNA, 22 bp, Homo sapiens
tgacattattatcatgtcacca

SEQ ID NO: 9191498 - DNA, 22 bp, Homo sapiens
tgacattattatcatgtcacca

SEQ ID NO: 9191499 - DNA, 22 bp, Homo sapiens
tgacatttaatccctaaatatt

SEQ ID NO: 9191500 - DNA, 22 bp, Homo sapiens
tgacatttaatccctaaatatt

SEQ ID NO: 9191501 - DNA, 22 bp, Homo sapiens
tgacattgtgtgcatttaaagt

SEQ ID NO: 9191502 - DNA, 23 bp, Homo sapiens
tgacctcatgatccgcccacctc

SEQ ID NO: 9191503 - DNA, 22 bp, Homo sapiens
tgacctccaatacctttcttcc

SEQ ID NO: 9191504 - DNA, 22 bp, Homo sapiens
tgactacaacctccacctcccg

SEQ ID NO: 9191505 - DNA, 22 bp, Homo sapiens
tgactaaaataggacattaact

SEQ ID NO: 9191506 - DNA, 22 bp, Homo sapiens
tgacgtcaactgcaaaggcctt

SEQ ID NO: 9191507 - DNA, 22 bp, Homo sapiens
tgactcttaaatatactgttga

SEQ ID NO: 9191508 - DNA, 21 bp, Homo sapiens
tgactccattctccatctgct

SEQ ID NO: 9191509 - DNA, 22 bp, Homo sapiens
tgactcaagagcctgactcatc

SEQ ID NO: 9191510 - DNA, 22 bp, Homo sapiens
tgactcacagtggagaaagagg

SEQ ID NO: 9191511 - DNA, 22 bp, Homo sapiens
tgactattcacaattacaatag

SEQ ID NO: 9191512 - DNA, 22 bp, Homo sapiens
tgacttgtcaaagaaatgtgtg

SEQ ID NO: 9191513 - DNA, 22 bp, Homo sapiens
tgacttgtctctttgggagaca

SEQ ID NO: 9191514 - DNA, 20 bp, Homo sapiens
tgacttctgggatttgtggt

SEQ ID NO: 9191515 - DNA, 20 bp, Homo sapiens
tgacttcttcatgctgtact

SEQ ID NO: 9191516 - DNA, 22 bp, Homo sapiens
tgacttgaagcaaaatagaatt

SEQ ID NO: 9191517 - DNA, 22 bp, Homo sapiens
tgacttcctgcactcaggtgat

SEQ ID NO: 9191518 - DNA, 22 bp, Homo sapiens
tgactgagggaggaagcaggtg

SEQ ID NO: 9191519 - DNA, 21 bp, Homo sapiens
tgactgaggcttcttcacaca

SEQ ID NO: 9191520 - DNA, 22 bp, Homo sapiens
tgactgaggaagaccaggtagc

SEQ ID NO: 9191521 - DNA, 22 bp, Homo sapiens
tgactgaagaagccacattgga

SEQ ID NO: 9191522 - DNA, 22 bp, Homo sapiens
tgacacctcgatcttggacttc

SEQ ID NO: 9191523 - DNA, 22 bp, Homo sapiens
tgacactatgtgtgcagccaga

SEQ ID NO: 9191524 - DNA, 22 bp, Homo sapiens
tgacaccttcatcttggacttc

SEQ ID NO: 9191525 - DNA, 22 bp, Homo sapiens
tgacaccttgatcttggactta

SEQ ID NO: 9191526 - DNA, 22 bp, Homo sapiens
tgacaccttgatcttggacttc

SEQ ID NO: 9191527 - DNA, 22 bp, Homo sapiens
tgacaccttgatcttggacttt

SEQ ID NO: 9191528 - DNA, 22 bp, Homo sapiens
tgacaccacaactagccattga

SEQ ID NO: 9191529 - DNA, 22 bp, Homo sapiens
tgacacaggcagctcccagcac

SEQ ID NO: 9191530 - DNA, 22 bp, Homo sapiens
tgacacaggcagctcccagcac

SEQ ID NO: 9191531 - DNA, 22 bp, Homo sapiens
tgacacactgccaggcgctcgg

SEQ ID NO: 9191532 - DNA, 22 bp, Homo sapiens
tgacagacacaccttaggaaag

SEQ ID NO: 9191533 - DNA, 22 bp, Homo sapiens
tgacagaaagaatatgtcaatc

SEQ ID NO: 9191534 - DNA, 22 bp, Homo sapiens
tgacagaaatagttcttaattt

SEQ ID NO: 9191535 - DNA, 22 bp, Homo sapiens
tgacaccttgctcttggacttc

SEQ ID NO: 9191536 - DNA, 22 bp, Homo sapiens
tgacactgcaaatataaatatt

SEQ ID NO: 9191537 - DNA, 22 bp, Homo sapiens
tgacagcagccacctctcaccc

SEQ ID NO: 9191538 - DNA, 22 bp, Homo sapiens
tgacaggacagagaaatgacct

SEQ ID NO: 9191539 - DNA, 22 bp, Homo sapiens
tgacaggaaacatgcagtgatt

SEQ ID NO: 9191540 - DNA, 22 bp, Homo sapiens
tgacaggcagtgctgggcatgt

SEQ ID NO: 9191541 - DNA, 22 bp, Homo sapiens
tgacaggcaggacagaggtgtg

SEQ ID NO: 9191542 - DNA, 22 bp, Homo sapiens
tgacaggattggttgcttctga

SEQ ID NO: 9191543 - DNA, 22 bp, Homo sapiens
tgacaggatgatgagcaggggg

SEQ ID NO: 9191544 - DNA, 22 bp, Homo sapiens
tgacaggagtggctagtgggag

SEQ ID NO: 9191545 - DNA, 22 bp, Homo sapiens
tgacaggatagtaggaagatct

SEQ ID NO: 9191546 - DNA, 22 bp, Homo sapiens
tgacaggaggcttgaggccagg

SEQ ID NO: 9191547 - DNA, 22 bp, Homo sapiens
tgacaggagggttgtggcaggg

SEQ ID NO: 9191548 - DNA, 22 bp, Homo sapiens
tgacagggccatgctgcactgc

SEQ ID NO: 9191549 - DNA, 22 bp, Homo sapiens
tgacagggctagaggcaatgca

SEQ ID NO: 9191550 - DNA, 22 bp, Homo sapiens
tgacagggcaggcttactggtt

SEQ ID NO: 9191551 - DNA, 22 bp, Homo sapiens
tgacagggaggtggaataagta

SEQ ID NO: 9191552 - DNA, 22 bp, Homo sapiens
tgacagggacagtggagatgga

SEQ ID NO: 9191553 - DNA, 22 bp, Homo sapiens
tgacagggggcagaggtggctg

SEQ ID NO: 9191554 - DNA, 22 bp, Homo sapiens
tgacagggcttccctttaatca

SEQ ID NO: 9191555 - DNA, 22 bp, Homo sapiens
tgacagggctgttctgttttag

SEQ ID NO: 9191556 - DNA, 22 bp, Homo sapiens
tgacagggcttccctttaatca

SEQ ID NO: 9191557 - DNA, 22 bp, Homo sapiens
tgacagggtgtttgtgagacta

SEQ ID NO: 9191558 - DNA, 22 bp, Homo sapiens
tgacagggtgattatgagagct

SEQ ID NO: 9191559 - DNA, 22 bp, Homo sapiens
tgacagggtgtttgtgagacta

SEQ ID NO: 9191560 - DNA, 22 bp, Homo sapiens
tgacagggtcagagctgagctg

SEQ ID NO: 9191561 - DNA, 22 bp, Homo sapiens
tgacagtgaataagtctcttaa

SEQ ID NO: 9191562 - DNA, 22 bp, Homo sapiens
tgacagtattgatggcaggatt

SEQ ID NO: 9191563 - DNA, 22 bp, Homo sapiens
tgacaggttcgttagtcatgtt

SEQ ID NO: 9191564 - DNA, 22 bp, Homo sapiens
tgacaggtgctgggggcagtgt

SEQ ID NO: 9191565 - DNA, 22 bp, Homo sapiens
tgaattcaagttgttgagccat

SEQ ID NO: 9191566 - DNA, 22 bp, Homo sapiens
tgaattcaggggctattatatt

SEQ ID NO: 9191567 - DNA, 22 bp, Homo sapiens
tgaattcatccatttatgcaag

SEQ ID NO: 9191568 - DNA, 22 bp, Homo sapiens
tgaattcaggttgacgttgcca

SEQ ID NO: 9191569 - DNA, 22 bp, Homo sapiens
tgaattcatacagtggatacca

SEQ ID NO: 9191570 - DNA, 22 bp, Homo sapiens
tgaattccttgcatttttacct

SEQ ID NO: 9191571 - DNA, 22 bp, Homo sapiens
tgaatttggcttgaggcagata

SEQ ID NO: 9191572 - DNA, 23 bp, Homo sapiens
tgaatttggaactcagagaatta

SEQ ID NO: 9191573 - DNA, 21 bp, Homo sapiens
tgaatttccctctatcattct

SEQ ID NO: 9191574 - DNA, 22 bp, Homo sapiens
tgaatttatattgctgagagtt

SEQ ID NO: 9191575 - DNA, 22 bp, Homo sapiens
tgaattgctgccatcatatttc

SEQ ID NO: 9191576 - DNA, 22 bp, Homo sapiens
tgaatttaaaataaatgtagtt

SEQ ID NO: 9191577 - DNA, 22 bp, Homo sapiens
tgaattgcctcttatatgacca

SEQ ID NO: 9191578 - DNA, 22 bp, Homo sapiens
tgacaattgtgggcagtttgtg

SEQ ID NO: 9191579 - DNA, 22 bp, Homo sapiens
tgacaattgtgggcagtttgtg

SEQ ID NO: 9191580 - DNA, 22 bp, Homo sapiens
tgacaattgttgtgaattcttc

SEQ ID NO: 9191581 - DNA, 22 bp, Homo sapiens
tgacacaattgagtggtactat

SEQ ID NO: 9191582 - DNA, 22 bp, Homo sapiens
tgacaaagtggttgtttggttg

SEQ ID NO: 9191583 - DNA, 22 bp, Homo sapiens
tgacaaagtgctagtcggtgaa

SEQ ID NO: 9191584 - DNA, 23 bp, Homo sapiens
tgacaaagtggtcgttcaaggtg

SEQ ID NO: 9191585 - DNA, 22 bp, Homo sapiens
tgacaaaggtgttgccagaggg

SEQ ID NO: 9191586 - DNA, 20 bp, Homo sapiens
tgacaaagtcccttcttttc

SEQ ID NO: 9191587 - DNA, 22 bp, Homo sapiens
tgacaaagtgaggtcttcagta

SEQ ID NO: 9191588 - DNA, 23 bp, Homo sapiens
tgacaaagtcatctctccttctt

SEQ ID NO: 9191589 - DNA, 22 bp, Homo sapiens
tgacaaagtgaggtcttcagta

SEQ ID NO: 9191590 - DNA, 22 bp, Homo sapiens
tgacaaaactgcaattactttt

SEQ ID NO: 9191591 - DNA, 22 bp, Homo sapiens
tgacaaaactgcaattactttt

SEQ ID NO: 9191592 - DNA, 22 bp, Homo sapiens
tgacaaagacaaagatatgtcc

SEQ ID NO: 9191593 - DNA, 22 bp, Homo sapiens
tgacaaagacaaagatatgtcc

SEQ ID NO: 9191594 - DNA, 22 bp, Homo sapiens
tgacaaaccctgcaaatagctc

SEQ ID NO: 9191595 - DNA, 22 bp, Homo sapiens
tgacaaactctttgagaacaag

SEQ ID NO: 9191596 - DNA, 22 bp, Homo sapiens
tgacaaactctttgagaacaag

SEQ ID NO: 9191597 - DNA, 22 bp, Homo sapiens
tgacaaaccagtagcaataaag

SEQ ID NO: 9191598 - DNA, 23 bp, Homo sapiens
tgacaaagcgagactccagctca

SEQ ID NO: 9191599 - DNA, 23 bp, Homo sapiens
tgacaaagcgagactccagctca

SEQ ID NO: 9191600 - DNA, 22 bp, Homo sapiens
tgacaaagcctcatccttcaga

SEQ ID NO: 9191601 - DNA, 22 bp, Homo sapiens
tgacaaaggcaggccagaagag

SEQ ID NO: 9191602 - DNA, 20 bp, Homo sapiens
tgacaaagagtaagaggagg

SEQ ID NO: 9191603 - DNA, 22 bp, Homo sapiens
tgacaaagcatgatggtgacag

SEQ ID NO: 9191604 - DNA, 20 bp, Homo sapiens
tgacaaagagtaagaggagg

SEQ ID NO: 9191605 - DNA, 22 bp, Homo sapiens
tgacaaagcatgatggtgacag

SEQ ID NO: 9191606 - DNA, 22 bp, Homo sapiens
tgacaaagaccttcaacaagat

SEQ ID NO: 9191607 - DNA, 22 bp, Homo sapiens
tgacaaagaggaacagcagggg

SEQ ID NO: 9191608 - DNA, 22 bp, Homo sapiens
tgaatacaggaaaatatactga

SEQ ID NO: 9191609 - DNA, 22 bp, Homo sapiens
tgaatacaggaaaatatactga

SEQ ID NO: 9191610 - DNA, 22 bp, Homo sapiens
tgaatacactaaaaatcacttt

SEQ ID NO: 9191611 - DNA, 22 bp, Homo sapiens
tgaatagtccttggaataactg

SEQ ID NO: 9191612 - DNA, 22 bp, Homo sapiens
tgaatcctaattctatcactta

SEQ ID NO: 9191613 - DNA, 22 bp, Homo sapiens
tgaatcagtataaattctcaaa

SEQ ID NO: 9191614 - DNA, 22 bp, Homo sapiens
tgaatatgtgactttgatttca

SEQ ID NO: 9191615 - DNA, 22 bp, Homo sapiens
tgaatatggcacctctgtgtaa

SEQ ID NO: 9191616 - DNA, 22 bp, Homo sapiens
tgaatatgtatttcttatttac

SEQ ID NO: 9191617 - DNA, 22 bp, Homo sapiens
tgaatagtccttggaataactg

SEQ ID NO: 9191618 - DNA, 20 bp, Homo sapiens
tgaatatgaccttatttgga

SEQ ID NO: 9191619 - DNA, 22 bp, Homo sapiens
tgaatgtgatgctaaacatatg

SEQ ID NO: 9191620 - DNA, 22 bp, Homo sapiens
tgaatgtgggagagctggcaat

SEQ ID NO: 9191621 - DNA, 22 bp, Homo sapiens
tgaattcaaattgtgcctatta

SEQ ID NO: 9191622 - DNA, 22 bp, Homo sapiens
tgaattagcagtagacagactg

SEQ ID NO: 9191623 - DNA, 23 bp, Homo sapiens
tgaatgtttattctcggtgcaga

SEQ ID NO: 9191624 - DNA, 22 bp, Homo sapiens
tgaatgaggatccttgacctta

SEQ ID NO: 9191625 - DNA, 21 bp, Homo sapiens
tgaatgaggaggatggcattt

SEQ ID NO: 9191626 - DNA, 21 bp, Homo sapiens
tgaatgagcatctggactttt

SEQ ID NO: 9191627 - DNA, 22 bp, Homo sapiens
tgaagctgtccttgataggggc

SEQ ID NO: 9191628 - DNA, 22 bp, Homo sapiens
tgaaggagctgatgtaaggggt

SEQ ID NO: 9191629 - DNA, 22 bp, Homo sapiens
tgaaggagctcaatgatgatgc

SEQ ID NO: 9191630 - DNA, 22 bp, Homo sapiens
tgaagcttgtatttaaataagt

SEQ ID NO: 9191631 - DNA, 22 bp, Homo sapiens
tgaaggagggaagaaggctctg

SEQ ID NO: 9191632 - DNA, 22 bp, Homo sapiens
tgaaggcacttgcctaggggca

SEQ ID NO: 9191633 - DNA, 21 bp, Homo sapiens
tgaagccaggatcacgattct

SEQ ID NO: 9191634 - DNA, 22 bp, Homo sapiens
tgaagccagctttggaagacac

SEQ ID NO: 9191635 - DNA, 22 bp, Homo sapiens
tgaagccagctttggaagacac

SEQ ID NO: 9191636 - DNA, 22 bp, Homo sapiens
tgaagccagtcaatgttaagtt

SEQ ID NO: 9191637 - DNA, 22 bp, Homo sapiens
tgaagccataggacagaggata

SEQ ID NO: 9191638 - DNA, 22 bp, Homo sapiens
tgaagccagggactgacacttc

SEQ ID NO: 9191639 - DNA, 22 bp, Homo sapiens
tgaagccactttccagaatcac

SEQ ID NO: 9191640 - DNA, 22 bp, Homo sapiens
tgaagccactttccagaatcac

SEQ ID NO: 9191641 - DNA, 22 bp, Homo sapiens
tgaagccactttccagaatcac

SEQ ID NO: 9191642 - DNA, 22 bp, Homo sapiens
tgaagccaccgaaccagaagag

SEQ ID NO: 9191643 - DNA, 22 bp, Homo sapiens
tgaagccaccgaaccagaagag

SEQ ID NO: 9191644 - DNA, 22 bp, Homo sapiens
tgaagccacagagcatctgcct

SEQ ID NO: 9191645 - DNA, 22 bp, Homo sapiens
tgaagccacagagcatctgcct

SEQ ID NO: 9191646 - DNA, 22 bp, Homo sapiens
tgaagccacagagcatctgcct

SEQ ID NO: 9191647 - DNA, 22 bp, Homo sapiens
tgaagccacactagcttgtcct

SEQ ID NO: 9191648 - DNA, 22 bp, Homo sapiens
tgaagccaaggatgcctttctc

SEQ ID NO: 9191649 - DNA, 22 bp, Homo sapiens
tgaagccaatctgccaggcaga

SEQ ID NO: 9191650 - DNA, 22 bp, Homo sapiens
tgaagccacactagcttgtcct

SEQ ID NO: 9191651 - DNA, 22 bp, Homo sapiens
tgaagccaatctgccaggcaga

SEQ ID NO: 9191652 - DNA, 22 bp, Homo sapiens
tgaagccaatctgccaggcaga

SEQ ID NO: 9191653 - DNA, 22 bp, Homo sapiens
tgaagccaaggatgcctttctc

SEQ ID NO: 9191654 - DNA, 22 bp, Homo sapiens
tgaagcagttctcagaagtggg

SEQ ID NO: 9191655 - DNA, 20 bp, Homo sapiens
tgaagccttgggcattgatg

SEQ ID NO: 9191656 - DNA, 22 bp, Homo sapiens
tgaagctagtcaagcttagata

SEQ ID NO: 9191657 - DNA, 22 bp, Homo sapiens
tgaagccatccctcagatggcc

SEQ ID NO: 9191658 - DNA, 22 bp, Homo sapiens
tgaagccatccctcagatggcc

SEQ ID NO: 9191659 - DNA, 22 bp, Homo sapiens
tgaagccatcaggaagccagca

SEQ ID NO: 9191660 - DNA, 22 bp, Homo sapiens
tgaagccatcaggaagccagca

SEQ ID NO: 9191661 - DNA, 22 bp, Homo sapiens
tgaagccattactgtgttaggg

SEQ ID NO: 9191662 - DNA, 22 bp, Homo sapiens
tgaagcccctaagtcccaggca

SEQ ID NO: 9191663 - DNA, 22 bp, Homo sapiens
tgaaggccacttcctgtgagct

SEQ ID NO: 9191664 - DNA, 22 bp, Homo sapiens
tgaaggcctaacttccagtgct

SEQ ID NO: 9191665 - DNA, 22 bp, Homo sapiens
tgaaggcattgatgaaggaatc

SEQ ID NO: 9191666 - DNA, 22 bp, Homo sapiens
tgaaggggttcagcatgggggt

SEQ ID NO: 9191667 - DNA, 21 bp, Homo sapiens
tgaaggggtggcagtgtgctt

SEQ ID NO: 9191668 - DNA, 22 bp, Homo sapiens
tgaaggggttcagcatgggggt

SEQ ID NO: 9191669 - DNA, 22 bp, Homo sapiens
tgaaggtaaaggaaggaggctt

SEQ ID NO: 9191670 - DNA, 22 bp, Homo sapiens
tgaagggggagatatatgtgtg

SEQ ID NO: 9191671 - DNA, 22 bp, Homo sapiens
tgaagggggagatatatgtgtg

SEQ ID NO: 9191672 - DNA, 22 bp, Homo sapiens
tgaaggctgggctcagccagct

SEQ ID NO: 9191673 - DNA, 22 bp, Homo sapiens
tgaagggcaaccccaggcccag

SEQ ID NO: 9191674 - DNA, 22 bp, Homo sapiens
tgaataaactatgaggaggaat

SEQ ID NO: 9191675 - DNA, 22 bp, Homo sapiens
tgaagtttttccagacaagtcc

SEQ ID NO: 9191676 - DNA, 22 bp, Homo sapiens
tgaagtttttccagacaagtcc

SEQ ID NO: 9191677 - DNA, 22 bp, Homo sapiens
tgaagttttctggttgattaag

SEQ ID NO: 9191678 - DNA, 22 bp, Homo sapiens
tgaagttttctggttgattaag

SEQ ID NO: 9191679 - DNA, 22 bp, Homo sapiens
tgaagttttctggttgattaag

SEQ ID NO: 9191680 - DNA, 22 bp, Homo sapiens
tgaagttttctggttgattaag

SEQ ID NO: 9191681 - DNA, 22 bp, Homo sapiens
tgaagttttactaggtgaattt

SEQ ID NO: 9191682 - DNA, 22 bp, Homo sapiens
tgaagttttactaggtgaattt

SEQ ID NO: 9191683 - DNA, 22 bp, Homo sapiens
tgaagttttactaggtgaattt

SEQ ID NO: 9191684 - DNA, 22 bp, Homo sapiens
tgaagtttggtggaaatttcct

SEQ ID NO: 9191685 - DNA, 22 bp, Homo sapiens
tgaagtttggtggaaatttcct

SEQ ID NO: 9191686 - DNA, 22 bp, Homo sapiens
tgaagtttggtggaaatttcct

SEQ ID NO: 9191687 - DNA, 22 bp, Homo sapiens
tgaagttttacatcctctccaa

SEQ ID NO: 9191688 - DNA, 22 bp, Homo sapiens
tgaagttttacatcctctccaa

SEQ ID NO: 9191689 - DNA, 22 bp, Homo sapiens
tgaataaagtatgtcctgggaa

SEQ ID NO: 9191690 - DNA, 22 bp, Homo sapiens
tgaataaagtatgtcctgggaa

SEQ ID NO: 9191691 - DNA, 21 bp, Homo sapiens
tgaataaagctgctgtcgata

SEQ ID NO: 9191692 - DNA, 21 bp, Homo sapiens
tgaataaagctgctgtcgata

SEQ ID NO: 9191693 - DNA, 22 bp, Homo sapiens
tgaataaattgagagcgaatgt

SEQ ID NO: 9191694 - DNA, 22 bp, Homo sapiens
tgaagtttaaggttagataagt

SEQ ID NO: 9191695 - DNA, 22 bp, Homo sapiens
tgaagtttaaggttagataagt

SEQ ID NO: 9191696 - DNA, 22 bp, Homo sapiens
tgaagtttataacatagcctcc

SEQ ID NO: 9191697 - DNA, 22 bp, Homo sapiens
tgaagtttataacatagcctcc

SEQ ID NO: 9191698 - DNA, 22 bp, Homo sapiens
tgaagtttaaggttagataagt

SEQ ID NO: 9191699 - DNA, 22 bp, Homo sapiens
tgaagtttaattttggacatga

SEQ ID NO: 9191700 - DNA, 22 bp, Homo sapiens
tgaagtttaattttggacatga

SEQ ID NO: 9191701 - DNA, 22 bp, Homo sapiens
tgaagtttcctctgaggccagt

SEQ ID NO: 9191702 - DNA, 22 bp, Homo sapiens
tgaagtttcctctgaggccagt

SEQ ID NO: 9191703 - DNA, 22 bp, Homo sapiens
tgaagtttcacgcgtcattcaa

SEQ ID NO: 9191704 - DNA, 22 bp, Homo sapiens
tgaagtttcacgcgtcattcaa

SEQ ID NO: 9191705 - DNA, 22 bp, Homo sapiens
tgaagtttcttgaatcttggag

SEQ ID NO: 9191706 - DNA, 22 bp, Homo sapiens
tgaagtttcttgaatcttggag

SEQ ID NO: 9191707 - DNA, 22 bp, Homo sapiens
tgaagtttgaactgtgttgctg

SEQ ID NO: 9191708 - DNA, 22 bp, Homo sapiens
tgaagtttgaactgtgttgctg

SEQ ID NO: 9191709 - DNA, 20 bp, Homo sapiens
tgaaggtgactcctttcttg

SEQ ID NO: 9191710 - DNA, 22 bp, Homo sapiens
tgaaggtgaatgtctatgggga

SEQ ID NO: 9191711 - DNA, 22 bp, Homo sapiens
tggccaggtgtgggttctcaga

SEQ ID NO: 9191712 - DNA, 22 bp, Homo sapiens
tggccagtagagctcagatagt

SEQ ID NO: 9191713 - DNA, 22 bp, Homo sapiens
tggccaggttgggctttgcagc

SEQ ID NO: 9191714 - DNA, 19 bp, Homo sapiens
tggccaggtactgtctgct

SEQ ID NO: 9191715 - DNA, 23 bp, Homo sapiens
tggccaggtagaggaggtagtga

SEQ ID NO: 9191716 - DNA, 22 bp, Homo sapiens
tggccaggctggtctggaacgc

SEQ ID NO: 9191717 - DNA, 22 bp, Homo sapiens
tggccaggctggtctggaacgc

SEQ ID NO: 9191718 - DNA, 22 bp, Homo sapiens
tggccaggcctcttggtgccca

SEQ ID NO: 9191719 - DNA, 23 bp, Homo sapiens
tggccagggtactacacccaccc

SEQ ID NO: 9191720 - DNA, 23 bp, Homo sapiens
tggccagggtactacacccaccc

SEQ ID NO: 9191721 - DNA, 23 bp, Homo sapiens
tggccagggtactacacccaccc

SEQ ID NO: 9191722 - DNA, 22 bp, Homo sapiens
tggccaggggagttcccctcca

SEQ ID NO: 9191723 - DNA, 22 bp, Homo sapiens
tggccagcccttcagccatgcc

SEQ ID NO: 9191724 - DNA, 22 bp, Homo sapiens
tggccagccctcttcccacact

SEQ ID NO: 9191725 - DNA, 22 bp, Homo sapiens
tggccagcagagttcactctct

SEQ ID NO: 9191726 - DNA, 23 bp, Homo sapiens
tggccagcagaagcaaggggagc

SEQ ID NO: 9191727 - DNA, 22 bp, Homo sapiens
tggccagattcatgcatgtatc

SEQ ID NO: 9191728 - DNA, 22 bp, Homo sapiens
tggccagagttgagggggtttc

SEQ ID NO: 9191729 - DNA, 22 bp, Homo sapiens
tggccagccttgtcatcgcttt

SEQ ID NO: 9191730 - DNA, 22 bp, Homo sapiens
tggccaggcattcagataagac

SEQ ID NO: 9191731 - DNA, 17 bp, Homo sapiens
tggccaggccccgccag

SEQ ID NO: 9191732 - DNA, 22 bp, Homo sapiens
tggccaggccggggacagaact

SEQ ID NO: 9191733 - DNA, 22 bp, Homo sapiens
tggccaggccggggacagaact

SEQ ID NO: 9191734 - DNA, 22 bp, Homo sapiens
tggcatgtaacatctccagatt

SEQ ID NO: 9191735 - DNA, 22 bp, Homo sapiens
tggcatggtggagtgacgggca

SEQ ID NO: 9191736 - DNA, 22 bp, Homo sapiens
tggcatggtcaaggctatgtta

SEQ ID NO: 9191737 - DNA, 22 bp, Homo sapiens
tggcatgggtggagagagcaca

SEQ ID NO: 9191738 - DNA, 22 bp, Homo sapiens
tggcatttcacctttcatttcc

SEQ ID NO: 9191739 - DNA, 22 bp, Homo sapiens
tggcatttcctcagtgctcaga

SEQ ID NO: 9191740 - DNA, 22 bp, Homo sapiens
tggccacactgcccccactggg

SEQ ID NO: 9191741 - DNA, 22 bp, Homo sapiens
tggccacagcctctgccagttc

SEQ ID NO: 9191742 - DNA, 22 bp, Homo sapiens
tggccacagcctctgccagttc

SEQ ID NO: 9191743 - DNA, 22 bp, Homo sapiens
tggccacacccacctagaggag

SEQ ID NO: 9191744 - DNA, 22 bp, Homo sapiens
tggccacacccacctagaggag

SEQ ID NO: 9191745 - DNA, 22 bp, Homo sapiens
tggcatttctggccatttgtgt

SEQ ID NO: 9191746 - DNA, 22 bp, Homo sapiens
tggccacccctttctctgcact

SEQ ID NO: 9191747 - DNA, 22 bp, Homo sapiens
tggccacccccaatgtcagtag

SEQ ID NO: 9191748 - DNA, 22 bp, Homo sapiens
tggccacatgcgtctgtgaggc

SEQ ID NO: 9191749 - DNA, 22 bp, Homo sapiens
tggccacatgcgtctgtgaggc

SEQ ID NO: 9191750 - DNA, 22 bp, Homo sapiens
tggccaccaccaatacttgcct

SEQ ID NO: 9191751 - DNA, 22 bp, Homo sapiens
tggccacagtgtccagcagcag

SEQ ID NO: 9191752 - DNA, 22 bp, Homo sapiens
tggccacatctgaaatgagtgt

SEQ ID NO: 9191753 - DNA, 22 bp, Homo sapiens
tggccacatatgtgggacagct

SEQ ID NO: 9191754 - DNA, 22 bp, Homo sapiens
tggccacatcctttccttgtca

SEQ ID NO: 9191755 - DNA, 22 bp, Homo sapiens
tggccacatatgtgggacagct

SEQ ID NO: 9191756 - DNA, 19 bp, Homo sapiens
tggccacctctgctgttct

SEQ ID NO: 9191757 - DNA, 22 bp, Homo sapiens
tggccaccttatggctattgga

SEQ ID NO: 9191758 - DNA, 22 bp, Homo sapiens
tggccaccttcccacttctgcc

SEQ ID NO: 9191759 - DNA, 22 bp, Homo sapiens
tggccactcagggatgcaggaa

SEQ ID NO: 9191760 - DNA, 22 bp, Homo sapiens
tggccacttggcatgtgtgcca

SEQ ID NO: 9191761 - DNA, 22 bp, Homo sapiens
tggccactcctccctgcaggct

SEQ ID NO: 9191762 - DNA, 22 bp, Homo sapiens
tggccagaacctgcagtaggcc

SEQ ID NO: 9191763 - DNA, 22 bp, Homo sapiens
tggccagaacctgcagtaggcc

SEQ ID NO: 9191764 - DNA, 22 bp, Homo sapiens
tggccagacagagaggctttgt

SEQ ID NO: 9191765 - DNA, 22 bp, Homo sapiens
tggccagagtccagtgagcctt

SEQ ID NO: 9191766 - DNA, 22 bp, Homo sapiens
tggccagagtccagtgagcctt

SEQ ID NO: 9191767 - DNA, 17 bp, Homo sapiens
tggccagagcaggcccc

SEQ ID NO: 9191768 - DNA, 22 bp, Homo sapiens
tggcagggtcttgctgtgttgc

SEQ ID NO: 9191769 - DNA, 22 bp, Homo sapiens
tggcagggtcttgctgtgttgc

SEQ ID NO: 9191770 - DNA, 22 bp, Homo sapiens
tggcagggtcttgctgtgttgc

SEQ ID NO: 9191771 - DNA, 22 bp, Homo sapiens
tggcagggtgccagttgcgagt

SEQ ID NO: 9191772 - DNA, 22 bp, Homo sapiens
tggcagggtggcaacttttggt

SEQ ID NO: 9191773 - DNA, 19 bp, Homo sapiens
tggcaggtagtgagcagtc

SEQ ID NO: 9191774 - DNA, 22 bp, Homo sapiens
tggcaggtcatgagtggccacc

SEQ ID NO: 9191775 - DNA, 19 bp, Homo sapiens
tggcaggtagtgagcagtc

SEQ ID NO: 9191776 - DNA, 18 bp, Homo sapiens
tggcaggtccagctgtgg

SEQ ID NO: 9191777 - DNA, 22 bp, Homo sapiens
tggcaggtgccatgggctcaga

SEQ ID NO: 9191778 - DNA, 22 bp, Homo sapiens
tggcaggtccactcacagatct

SEQ ID NO: 9191779 - DNA, 22 bp, Homo sapiens
tggcaggtccactcacagatct

SEQ ID NO: 9191780 - DNA, 23 bp, Homo sapiens
tggcaggtggttagatgttttgt

SEQ ID NO: 9191781 - DNA, 22 bp, Homo sapiens
tggcaggtggagacagcagagc

SEQ ID NO: 9191782 - DNA, 22 bp, Homo sapiens
tggcaggtgcctgtaatctcag

SEQ ID NO: 9191783 - DNA, 22 bp, Homo sapiens
tggcaggtggcacagcctggga

SEQ ID NO: 9191784 - DNA, 20 bp, Homo sapiens
tggcaggtggcctcagttcc

SEQ ID NO: 9191785 - DNA, 22 bp, Homo sapiens
tggcagtgatgcttatggtttg

SEQ ID NO: 9191786 - DNA, 18 bp, Homo sapiens
tggcagtgccaccttctc

SEQ ID NO: 9191787 - DNA, 22 bp, Homo sapiens
tggcagtgaaagacaattgggc

SEQ ID NO: 9191788 - DNA, 22 bp, Homo sapiens
tggcagtgaagctgtctttagg

SEQ ID NO: 9191789 - DNA, 22 bp, Homo sapiens
tggcaggttatgcgggccacat

SEQ ID NO: 9191790 - DNA, 22 bp, Homo sapiens
tggcagtcccctgtgcctggaa

SEQ ID NO: 9191791 - DNA, 22 bp, Homo sapiens
tggcagtctgggttggcagtta

SEQ ID NO: 9191792 - DNA, 21 bp, Homo sapiens
tggcatggaggtagcagtgtg

SEQ ID NO: 9191793 - DNA, 22 bp, Homo sapiens
tggcatggactagtgctgaggt

SEQ ID NO: 9191794 - DNA, 22 bp, Homo sapiens
tggcatggcaaccctgcaggga

SEQ ID NO: 9191795 - DNA, 22 bp, Homo sapiens
tggcatggcaaccctgcaggga

SEQ ID NO: 9191796 - DNA, 22 bp, Homo sapiens
tggcatggcaaccctgcaggga

SEQ ID NO: 9191797 - DNA, 22 bp, Homo sapiens
tggcatggcgtggcatcgtgtg

SEQ ID NO: 9191798 - DNA, 22 bp, Homo sapiens
tggcatgggccagggagagctg

SEQ ID NO: 9191799 - DNA, 22 bp, Homo sapiens
tggcatgggcaaaccagggaaa

SEQ ID NO: 9191800 - DNA, 22 bp, Homo sapiens
tggcatggggcagaacattaca

SEQ ID NO: 9191801 - DNA, 22 bp, Homo sapiens
tggcatgagaatactgagggat

SEQ ID NO: 9191802 - DNA, 23 bp, Homo sapiens
tggcatcttggcatcttgctgct

SEQ ID NO: 9191803 - DNA, 22 bp, Homo sapiens
tggcatgaagtcagcagctggg

SEQ ID NO: 9191804 - DNA, 22 bp, Homo sapiens
tggcatcctttgtgtcagttta

SEQ ID NO: 9191805 - DNA, 22 bp, Homo sapiens
tggcatgataggaggtgcagaa

SEQ ID NO: 9191806 - DNA, 19 bp, Homo sapiens
tggcatgatgatggatggg

SEQ ID NO: 9191807 - DNA, 19 bp, Homo sapiens
tggcagtgtggggtatgaa

SEQ ID NO: 9191808 - DNA, 22 bp, Homo sapiens
tggcagtggataggggagcggt

SEQ ID NO: 9191809 - DNA, 22 bp, Homo sapiens
tggcagtggcatcaccccaata

SEQ ID NO: 9191810 - DNA, 22 bp, Homo sapiens
tggcagtggcgggactcagggc

SEQ ID NO: 9191811 - DNA, 23 bp, Homo sapiens
tggcatagtgaggggcacagaga

SEQ ID NO: 9191812 - DNA, 22 bp, Homo sapiens
tggcatcctccctcaagctgaa

SEQ ID NO: 9191813 - DNA, 22 bp, Homo sapiens
tggcatcctctcttctgagtgc

SEQ ID NO: 9191814 - DNA, 19 bp, Homo sapiens
tggcatcccagtaaagctt

SEQ ID NO: 9191815 - DNA, 22 bp, Homo sapiens
tggcagttttcaagagttctgt

SEQ ID NO: 9191816 - DNA, 22 bp, Homo sapiens
tggcagtttacagagttctgaa

SEQ ID NO: 9191817 - DNA, 22 bp, Homo sapiens
tggcagttttgtatttgagcat

SEQ ID NO: 9191818 - DNA, 22 bp, Homo sapiens
tggcagttgagttactgggtga

SEQ ID NO: 9191819 - DNA, 22 bp, Homo sapiens
tggcagttggaaaaacggtttg

SEQ ID NO: 9191820 - DNA, 22 bp, Homo sapiens
tggccagtctgtggaagccagg

SEQ ID NO: 9191821 - DNA, 22 bp, Homo sapiens
tggccagtggggttgagcagga

SEQ ID NO: 9191822 - DNA, 22 bp, Homo sapiens
tggccatgggatagtgcagggg

SEQ ID NO: 9191823 - DNA, 22 bp, Homo sapiens
tggccatgaaggaggcagcaga

SEQ ID NO: 9191824 - DNA, 22 bp, Homo sapiens
tggcccagccctgctctagggc

SEQ ID NO: 9191825 - DNA, 22 bp, Homo sapiens
tggcccagccctgctctagggc

SEQ ID NO: 9191826 - DNA, 22 bp, Homo sapiens
tggcccagctcagggtgggcgg

SEQ ID NO: 9191827 - DNA, 22 bp, Homo sapiens
tggcccagctcagggtgggcgg

SEQ ID NO: 9191828 - DNA, 22 bp, Homo sapiens
tggcccagactctgctcttatc

SEQ ID NO: 9191829 - DNA, 22 bp, Homo sapiens
tggcccagactctgctcttatc

SEQ ID NO: 9191830 - DNA, 22 bp, Homo sapiens
tggcccagactctgctcttatc

SEQ ID NO: 9191831 - DNA, 22 bp, Homo sapiens
tggcccaggtctctctgagccc

SEQ ID NO: 9191832 - DNA, 22 bp, Homo sapiens
tggcccaggtctctctgagccc

SEQ ID NO: 9191833 - DNA, 22 bp, Homo sapiens
tggcccagggtctacagcctca

SEQ ID NO: 9191834 - DNA, 22 bp, Homo sapiens
tggcccagggtctacagcctca

SEQ ID NO: 9191835 - DNA, 22 bp, Homo sapiens
tggcccagggtctacagcctca

SEQ ID NO: 9191836 - DNA, 22 bp, Homo sapiens
tggcccaggaggccagagggca

SEQ ID NO: 9191837 - DNA, 22 bp, Homo sapiens
tggcccaggaggccagagggca

SEQ ID NO: 9191838 - DNA, 22 bp, Homo sapiens
tggcccaggcgaggtgggcaga

SEQ ID NO: 9191839 - DNA, 22 bp, Homo sapiens
tggcccaggccaaagccctgga

SEQ ID NO: 9191840 - DNA, 22 bp, Homo sapiens
tggcccaggccaaagccctgga

SEQ ID NO: 9191841 - DNA, 22 bp, Homo sapiens
tggcccaggcgaggtgggcaga

SEQ ID NO: 9191842 - DNA, 22 bp, Homo sapiens
tggcccagtagaaaagggatcg

SEQ ID NO: 9191843 - DNA, 22 bp, Homo sapiens
tggcccagtatgtataatctta

SEQ ID NO: 9191844 - DNA, 22 bp, Homo sapiens
tggcccagtcagcaggagaggg

SEQ ID NO: 9191845 - DNA, 22 bp, Homo sapiens
tggcccagtcagcaggagaggg

SEQ ID NO: 9191846 - DNA, 22 bp, Homo sapiens
tggcccagtcagcaggagaggg

SEQ ID NO: 9191847 - DNA, 22 bp, Homo sapiens
tggcccaggtgcaagagacaga

SEQ ID NO: 9191848 - DNA, 22 bp, Homo sapiens
tggcccaggtgcaagagacaga

SEQ ID NO: 9191849 - DNA, 22 bp, Homo sapiens
tggcccaggtgcacccagaggc

SEQ ID NO: 9191850 - DNA, 23 bp, Homo sapiens
tggccctgaatctgtcctggagg

SEQ ID NO: 9191851 - DNA, 22 bp, Homo sapiens
tggccctcagtcttgctcctgc

SEQ ID NO: 9191852 - DNA, 22 bp, Homo sapiens
tggccctcgtccgacaggtggg

SEQ ID NO: 9191853 - DNA, 22 bp, Homo sapiens
tggccctgcacccagagcagtt

SEQ ID NO: 9191854 - DNA, 22 bp, Homo sapiens
tggccctgagggctcggagcca

SEQ ID NO: 9191855 - DNA, 22 bp, Homo sapiens
tggccctgaggggctgtgcccc

SEQ ID NO: 9191856 - DNA, 22 bp, Homo sapiens
tggccctgacttggaggcctga

SEQ ID NO: 9191857 - DNA, 22 bp, Homo sapiens
tggccctgacaggtcctgggca

SEQ ID NO: 9191858 - DNA, 22 bp, Homo sapiens
tggccctgactgatgtggaggg

SEQ ID NO: 9191859 - DNA, 22 bp, Homo sapiens
tggccctgtccctggagcctgg

SEQ ID NO: 9191860 - DNA, 22 bp, Homo sapiens
tggccctgtccctggagcctgg

SEQ ID NO: 9191861 - DNA, 22 bp, Homo sapiens
tggcccttgttcaaatatgtca

SEQ ID NO: 9191862 - DNA, 22 bp, Homo sapiens
tggccctttggtttatgactga

SEQ ID NO: 9191863 - DNA, 22 bp, Homo sapiens
tggcccttcaaattccctagtc

SEQ ID NO: 9191864 - DNA, 22 bp, Homo sapiens
tggcctggaaaaatgcagatgg

SEQ ID NO: 9191865 - DNA, 22 bp, Homo sapiens
tggcctggaaaaatgcagatgg

SEQ ID NO: 9191866 - DNA, 22 bp, Homo sapiens
tggcctggaaaaatgcagatgg

SEQ ID NO: 9191867 - DNA, 22 bp, Homo sapiens
tggcctggaaaaatgcagatgg

SEQ ID NO: 9191868 - DNA, 22 bp, Homo sapiens
tggcctggaagagaggtcgagg

SEQ ID NO: 9191869 - DNA, 22 bp, Homo sapiens
tggcctggaacctggcagggac

SEQ ID NO: 9191870 - DNA, 22 bp, Homo sapiens
tggcctgcctgggagcagcagg

SEQ ID NO: 9191871 - DNA, 22 bp, Homo sapiens
tggcctgccttcgctgagctga

SEQ ID NO: 9191872 - DNA, 22 bp, Homo sapiens
tggcctgctcacagtcagatgg

SEQ ID NO: 9191873 - DNA, 22 bp, Homo sapiens
tggcctgctttcttaggtgttc

SEQ ID NO: 9191874 - DNA, 22 bp, Homo sapiens
tggcctgctttcttaggtgttc

SEQ ID NO: 9191875 - DNA, 22 bp, Homo sapiens
tggcctgctctgactttggggg

SEQ ID NO: 9191876 - DNA, 22 bp, Homo sapiens
tggcctgctttcatttgatgct

SEQ ID NO: 9191877 - DNA, 22 bp, Homo sapiens
tggcctggccacatccagcagg

SEQ ID NO: 9191878 - DNA, 22 bp, Homo sapiens
tggcctggccacatccagcagg

SEQ ID NO: 9191879 - DNA, 22 bp, Homo sapiens
tggcctggccacatccagcagg

SEQ ID NO: 9191880 - DNA, 23 bp, Homo sapiens
tggcctggagagaaaagatgagt

SEQ ID NO: 9191881 - DNA, 22 bp, Homo sapiens
tggcctggcagagcaaggcctg

SEQ ID NO: 9191882 - DNA, 22 bp, Homo sapiens
tggcctggaagagaggtcgagg

SEQ ID NO: 9191883 - DNA, 23 bp, Homo sapiens
tggcctggagagaaaagatgagt

SEQ ID NO: 9191884 - DNA, 18 bp, Homo sapiens
tggcctggagacaactct

SEQ ID NO: 9191885 - DNA, 22 bp, Homo sapiens
tggcctgcagaggctgtggggc

SEQ ID NO: 9191886 - DNA, 22 bp, Homo sapiens
tggcctgcaaagtcttcttgct

SEQ ID NO: 9191887 - DNA, 22 bp, Homo sapiens
tggcctgcaagctaaaaatcta

SEQ ID NO: 9191888 - DNA, 22 bp, Homo sapiens
tggcctgagttgtctgcaggcc

SEQ ID NO: 9191889 - DNA, 22 bp, Homo sapiens
tggcctgcccaagtcaatcgga

SEQ ID NO: 9191890 - DNA, 22 bp, Homo sapiens
tggcctgccactgccacgccac

SEQ ID NO: 9191891 - DNA, 22 bp, Homo sapiens
tggcctgcagctctcagggaag

SEQ ID NO: 9191892 - DNA, 23 bp, Homo sapiens
tggcctgcagagtttctgctggg

SEQ ID NO: 9191893 - DNA, 22 bp, Homo sapiens
tggcctgcattggctttggtgt

SEQ ID NO: 9191894 - DNA, 22 bp, Homo sapiens
tggcctgccactgccacgccac

SEQ ID NO: 9191895 - DNA, 22 bp, Homo sapiens
tggcctgccccgagatcctggc

SEQ ID NO: 9191896 - DNA, 22 bp, Homo sapiens
tggcctgcctcacttgcttatt

SEQ ID NO: 9191897 - DNA, 22 bp, Homo sapiens
tggcctgcctcccggcttcttt

SEQ ID NO: 9191898 - DNA, 22 bp, Homo sapiens
tggcctgcccagagcagctctg

SEQ ID NO: 9191899 - DNA, 22 bp, Homo sapiens
tggcctctgggaaagcagattc

SEQ ID NO: 9191900 - DNA, 20 bp, Homo sapiens
tggcctctgtagaggccaag

SEQ ID NO: 9191901 - DNA, 22 bp, Homo sapiens
tggcctctgcactgggctcccc

SEQ ID NO: 9191902 - DNA, 22 bp, Homo sapiens
tggcctctgtgggagctgagca

SEQ ID NO: 9191903 - DNA, 22 bp, Homo sapiens
tggcctctgtgggagctgagca

SEQ ID NO: 9191904 - DNA, 22 bp, Homo sapiens
tggcctgactgtcaggctgtat

SEQ ID NO: 9191905 - DNA, 22 bp, Homo sapiens
tggcctgactgtcaggctgtat

SEQ ID NO: 9191906 - DNA, 22 bp, Homo sapiens
tggcctcttaggacatcctcta

SEQ ID NO: 9191907 - DNA, 22 bp, Homo sapiens
tggattcacaccattctcctgc

SEQ ID NO: 9191908 - DNA, 22 bp, Homo sapiens
tggattctcatgggaccagtag

SEQ ID NO: 9191909 - DNA, 22 bp, Homo sapiens
tggattgaattaacacctccca

SEQ ID NO: 9191910 - DNA, 18 bp, Homo sapiens
tggattgaattgagaggt

SEQ ID NO: 9191911 - DNA, 22 bp, Homo sapiens
tggatttctccagctctccatt

SEQ ID NO: 9191912 - DNA, 22 bp, Homo sapiens
tggatttgagatgtgttcagat

SEQ ID NO: 9191913 - DNA, 22 bp, Homo sapiens
tggatttgctaccttctgatat

SEQ ID NO: 9191914 - DNA, 21 bp, Homo sapiens
tggatttgagcagtgcctcgg

SEQ ID NO: 9191915 - DNA, 22 bp, Homo sapiens
tggatttaccacagggccacag

SEQ ID NO: 9191916 - DNA, 22 bp, Homo sapiens
tggattgtaacatagagtaaat

SEQ ID NO: 9191917 - DNA, 22 bp, Homo sapiens
tggattgattataagagattca

SEQ ID NO: 9191918 - DNA, 22 bp, Homo sapiens
tggatttaaggcagagagggcc

SEQ ID NO: 9191919 - DNA, 22 bp, Homo sapiens
tggatttaatggatgaggggca

SEQ ID NO: 9191920 - DNA, 18 bp, Homo sapiens
tggattagaggagaaggt

SEQ ID NO: 9191921 - DNA, 22 bp, Homo sapiens
tggatgtgagagcatcatgttc

SEQ ID NO: 9191922 - DNA, 22 bp, Homo sapiens
tggatgtgagaaggatcaggct

SEQ ID NO: 9191923 - DNA, 22 bp, Homo sapiens
tggattagtttcaaggcagcaa

SEQ ID NO: 9191924 - DNA, 22 bp, Homo sapiens
tggattattgtaagacaaagta

SEQ ID NO: 9191925 - DNA, 20 bp, Homo sapiens
tggatgtcaaattaggctgg

SEQ ID NO: 9191926 - DNA, 22 bp, Homo sapiens
tggatgtctcagcttgagctgc

SEQ ID NO: 9191927 - DNA, 22 bp, Homo sapiens
tggatgtaggacacatagaatt

SEQ ID NO: 9191928 - DNA, 22 bp, Homo sapiens
tggatgtcatagttggatatac

SEQ ID NO: 9191929 - DNA, 22 bp, Homo sapiens
tggcaacatgtcgaagtgctgt

SEQ ID NO: 9191930 - DNA, 22 bp, Homo sapiens
tggcaataaagaccaacaggtt

SEQ ID NO: 9191931 - DNA, 22 bp, Homo sapiens
tggcaacatggacaggtctgcc

SEQ ID NO: 9191932 - DNA, 22 bp, Homo sapiens
tggcaacaagaaaggcagaggg

SEQ ID NO: 9191933 - DNA, 22 bp, Homo sapiens
tggcaaagtgactccttggggc

SEQ ID NO: 9191934 - DNA, 22 bp, Homo sapiens
tggcaaagtttatcaggaatat

SEQ ID NO: 9191935 - DNA, 22 bp, Homo sapiens
tggcaaattttggcaagctgaa

SEQ ID NO: 9191936 - DNA, 22 bp, Homo sapiens
tggcaaagactgcaaggacttt

SEQ ID NO: 9191937 - DNA, 22 bp, Homo sapiens
tggcaaagacgctagctaagat

SEQ ID NO: 9191938 - DNA, 22 bp, Homo sapiens
tggcaaagatggttctcaccat

SEQ ID NO: 9191939 - DNA, 22 bp, Homo sapiens
tggcaaagatgaagcatttcgt

SEQ ID NO: 9191940 - DNA, 22 bp, Homo sapiens
tggcaaagactgcaaggacttt

SEQ ID NO: 9191941 - DNA, 22 bp, Homo sapiens
tggatttgggagcctttccttc

SEQ ID NO: 9191942 - DNA, 22 bp, Homo sapiens
tggcaaaacccacaattatatc

SEQ ID NO: 9191943 - DNA, 22 bp, Homo sapiens
tggcaaagaccgcaattacttt

SEQ ID NO: 9191944 - DNA, 22 bp, Homo sapiens
tggcaaagattaccacatctac

SEQ ID NO: 9191945 - DNA, 23 bp, Homo sapiens
tggcaaagcattcttataacagt

SEQ ID NO: 9191946 - DNA, 22 bp, Homo sapiens
tggcaaagctagacattccctc

SEQ ID NO: 9191947 - DNA, 22 bp, Homo sapiens
tggcaaagctagacattccctc

SEQ ID NO: 9191948 - DNA, 22 bp, Homo sapiens
tggcaaaggaaatgatttaaga

SEQ ID NO: 9191949 - DNA, 22 bp, Homo sapiens
tggcaaagtatctgtcccagct

SEQ ID NO: 9191950 - DNA, 22 bp, Homo sapiens
tggcaaagtaattgggtttctc

SEQ ID NO: 9191951 - DNA, 22 bp, Homo sapiens
tggcaaaggggaccatgttgaa

SEQ ID NO: 9191952 - DNA, 22 bp, Homo sapiens
tggcaaaggcgctcacatgcct

SEQ ID NO: 9191953 - DNA, 22 bp, Homo sapiens
tggcaaaggaacctattttaaa

SEQ ID NO: 9191954 - DNA, 22 bp, Homo sapiens
tggcaaaggcgctcacatgcct

SEQ ID NO: 9191955 - DNA, 22 bp, Homo sapiens
tggcacaaaagtaattgcagtt

SEQ ID NO: 9191956 - DNA, 22 bp, Homo sapiens
tggcaatttcttatggttcaac

SEQ ID NO: 9191957 - DNA, 22 bp, Homo sapiens
tggcaatttcatgtggttcaac

SEQ ID NO: 9191958 - DNA, 22 bp, Homo sapiens
tggcaatttcatatggttcata

SEQ ID NO: 9191959 - DNA, 22 bp, Homo sapiens
tggcaatttcatatggttcaag

SEQ ID NO: 9191960 - DNA, 22 bp, Homo sapiens
tggcaatgtaggcaagaacatt

SEQ ID NO: 9191961 - DNA, 22 bp, Homo sapiens
tggcacagacagatcaggagtc

SEQ ID NO: 9191962 - DNA, 20 bp, Homo sapiens
tggcacagaacccttgccta

SEQ ID NO: 9191963 - DNA, 22 bp, Homo sapiens
tggcacagaaaaatgctccatt

SEQ ID NO: 9191964 - DNA, 22 bp, Homo sapiens
tggcacagaaaaatgctccatt

SEQ ID NO: 9191965 - DNA, 22 bp, Homo sapiens
tggcacagacagatcaggagtc

SEQ ID NO: 9191966 - DNA, 22 bp, Homo sapiens
tggcacagacagcacagcaatg

SEQ ID NO: 9191967 - DNA, 22 bp, Homo sapiens
tggcacagacagatcaggagtc

SEQ ID NO: 9191968 - DNA, 22 bp, Homo sapiens
tggcacagacagcacagcaatg

SEQ ID NO: 9191969 - DNA, 22 bp, Homo sapiens
tggcacagacagcacagcaatg

SEQ ID NO: 9191970 - DNA, 22 bp, Homo sapiens
tggcacagaccttatcttctct

SEQ ID NO: 9191971 - DNA, 17 bp, Homo sapiens
tggcacagaggtgctat

SEQ ID NO: 9191972 - DNA, 17 bp, Homo sapiens
tggcacagaggtgctat

SEQ ID NO: 9191973 - DNA, 22 bp, Homo sapiens
tggcacagcaagagtttgggaa

SEQ ID NO: 9191974 - DNA, 17 bp, Homo sapiens
tggcacagaggtgctat

SEQ ID NO: 9191975 - DNA, 17 bp, Homo sapiens
tggcacagaggtgctat

SEQ ID NO: 9191976 - DNA, 17 bp, Homo sapiens
tggcacagaggtgctat

SEQ ID NO: 9191977 - DNA, 22 bp, Homo sapiens
tggcacagagggacccagcagc

SEQ ID NO: 9191978 - DNA, 23 bp, Homo sapiens
tggcacagaggaccatgctttgc

SEQ ID NO: 9191979 - DNA, 22 bp, Homo sapiens
tggcacagactgggccaaggaa

SEQ ID NO: 9191980 - DNA, 22 bp, Homo sapiens
tggcacagactgggccaaggaa

SEQ ID NO: 9191981 - DNA, 22 bp, Homo sapiens
tggcacagcccagagctcttga

SEQ ID NO: 9191982 - DNA, 22 bp, Homo sapiens
tggcacagcccattcagagaag

SEQ ID NO: 9191983 - DNA, 22 bp, Homo sapiens
tggcacagtgctggatggtgct

SEQ ID NO: 9191984 - DNA, 22 bp, Homo sapiens
tggcacagttaaagttgtagaa

SEQ ID NO: 9191985 - DNA, 22 bp, Homo sapiens
tggcacagcccggattctatga

SEQ ID NO: 9191986 - DNA, 21 bp, Homo sapiens
tggcacagcaagtgggctcat

SEQ ID NO: 9191987 - DNA, 22 bp, Homo sapiens
tggcacagccactgaatcggga

SEQ ID NO: 9191988 - DNA, 23 bp, Homo sapiens
tggcacagcaggtgtgctttgtt

SEQ ID NO: 9191989 - DNA, 23 bp, Homo sapiens
tggcacagcaggtgtgctttgtt

SEQ ID NO: 9191990 - DNA, 22 bp, Homo sapiens
tggcacagccatcttctcctgc

SEQ ID NO: 9191991 - DNA, 22 bp, Homo sapiens
tggcagaggaaaaagtcactgg

SEQ ID NO: 9191992 - DNA, 22 bp, Homo sapiens
tggcagaggaaaaagtcactgg

SEQ ID NO: 9191993 - DNA, 22 bp, Homo sapiens
tggcagaggtatattgggagga

SEQ ID NO: 9191994 - DNA, 16 bp, Homo sapiens
tggcagaggttcagcc

SEQ ID NO: 9191995 - DNA, 16 bp, Homo sapiens
tggcagaggttcagcc

SEQ ID NO: 9191996 - DNA, 22 bp, Homo sapiens
tggcagagctggctgcggatga

SEQ ID NO: 9191997 - DNA, 22 bp, Homo sapiens
tggcagagctggctgcggatga

SEQ ID NO: 9191998 - DNA, 22 bp, Homo sapiens
tggcagaggaaaaagtcactgg

SEQ ID NO: 9191999 - DNA, 22 bp, Homo sapiens
tggcagagctggctgcggatga

SEQ ID NO: 9192000 - DNA, 22 bp, Homo sapiens
tggcagagcccagactccagtc

SEQ ID NO: 9192001 - DNA, 22 bp, Homo sapiens
tggcagagcccagactccagtc

SEQ ID NO: 9192002 - DNA, 22 bp, Homo sapiens
tggcagagccttgccaaactcc

SEQ ID NO: 9192003 - DNA, 22 bp, Homo sapiens
tggcagagccttgccaaactcc

SEQ ID NO: 9192004 - DNA, 22 bp, Homo sapiens
tggcagagcccagaactgagca

SEQ ID NO: 9192005 - DNA, 22 bp, Homo sapiens
tggcagagcccagaactgagca

SEQ ID NO: 9192006 - DNA, 22 bp, Homo sapiens
tggcagagcccagactccagtc

SEQ ID NO: 9192007 - DNA, 22 bp, Homo sapiens
tggcagagcaaaaagatagaat

SEQ ID NO: 9192008 - DNA, 22 bp, Homo sapiens
tggcagagcaaaaagatagaat

SEQ ID NO: 9192009 - DNA, 22 bp, Homo sapiens
tggcagagagagtgcagtcgac

SEQ ID NO: 9192010 - DNA, 22 bp, Homo sapiens
tggcagagatgaagagttgttt

SEQ ID NO: 9192011 - DNA, 22 bp, Homo sapiens
tggcagagatgaagagttgttt

SEQ ID NO: 9192012 - DNA, 22 bp, Homo sapiens
tggcagagagactctccttgat

SEQ ID NO: 9192013 - DNA, 22 bp, Homo sapiens
tggcagagagactctccttgat

SEQ ID NO: 9192014 - DNA, 22 bp, Homo sapiens
tggcagagagactctccttgat

SEQ ID NO: 9192015 - DNA, 22 bp, Homo sapiens
tggcagagagagtgcagtcgac

SEQ ID NO: 9192016 - DNA, 22 bp, Homo sapiens
tggcagagagagtgcagtcgac

SEQ ID NO: 9192017 - DNA, 22 bp, Homo sapiens
tggcagagactcctcctgggag

SEQ ID NO: 9192018 - DNA, 22 bp, Homo sapiens
tggcagagactcctcctgggag

SEQ ID NO: 9192019 - DNA, 22 bp, Homo sapiens
tggcagagactcctcctgggag

SEQ ID NO: 9192020 - DNA, 23 bp, Homo sapiens
tggcagagacccagaatctacat

SEQ ID NO: 9192021 - DNA, 23 bp, Homo sapiens
tggcagagacccagaatctacat

SEQ ID NO: 9192022 - DNA, 22 bp, Homo sapiens
tggcagagaacacggctgatct

SEQ ID NO: 9192023 - DNA, 22 bp, Homo sapiens
tggcagagaacacggctgatct

SEQ ID NO: 9192024 - DNA, 22 bp, Homo sapiens
tggcagagaacacggctgatct

SEQ ID NO: 9192025 - DNA, 22 bp, Homo sapiens
tggcagagaacctgggctttgt

SEQ ID NO: 9192026 - DNA, 22 bp, Homo sapiens
tggcagagaacctgggctttgt

SEQ ID NO: 9192027 - DNA, 22 bp, Homo sapiens
tggcagagaataaatcttgact

SEQ ID NO: 9192028 - DNA, 22 bp, Homo sapiens
tggcagagaataaatcttgact

SEQ ID NO: 9192029 - DNA, 22 bp, Homo sapiens
tggcagagacaaggccgggcct

SEQ ID NO: 9192030 - DNA, 22 bp, Homo sapiens
tggcagagacaaggccgggcct

SEQ ID NO: 9192031 - DNA, 22 bp, Homo sapiens
tggcagagacaaggccgggcct

SEQ ID NO: 9192032 - DNA, 21 bp, Homo sapiens
tggcactgcttagcaggttcc

SEQ ID NO: 9192033 - DNA, 22 bp, Homo sapiens
tggcactgccaacctgctaggt

SEQ ID NO: 9192034 - DNA, 22 bp, Homo sapiens
tggcactgcctggcagggcccc

SEQ ID NO: 9192035 - DNA, 22 bp, Homo sapiens
tggcactgaccccaggcctgtg

SEQ ID NO: 9192036 - DNA, 22 bp, Homo sapiens
tggcactgccaacctgctaggt

SEQ ID NO: 9192037 - DNA, 22 bp, Homo sapiens
tggcactggcgcaggatggcgg

SEQ ID NO: 9192038 - DNA, 22 bp, Homo sapiens
tggcactggcgcaggatggcgg

SEQ ID NO: 9192039 - DNA, 22 bp, Homo sapiens
tggcactgtggatttcacaagt

SEQ ID NO: 9192040 - DNA, 22 bp, Homo sapiens
tggcactgtcaccaatgctgtc

SEQ ID NO: 9192041 - DNA, 22 bp, Homo sapiens
tggcagagaacacacatgattc

SEQ ID NO: 9192042 - DNA, 22 bp, Homo sapiens
tggcacccagtggagctgtgct

SEQ ID NO: 9192043 - DNA, 22 bp, Homo sapiens
tggcacgacaattggcaccaat

SEQ ID NO: 9192044 - DNA, 22 bp, Homo sapiens
tggcactatggatgagactgat

SEQ ID NO: 9192045 - DNA, 22 bp, Homo sapiens
tggcactgaaaaaggagaggtt

SEQ ID NO: 9192046 - DNA, 22 bp, Homo sapiens
tggcactgaagctggaaagcct

SEQ ID NO: 9192047 - DNA, 22 bp, Homo sapiens
tggcactgaagctggaaagcct

SEQ ID NO: 9192048 - DNA, 22 bp, Homo sapiens
tggcacatgatgttgtggcatc

SEQ ID NO: 9192049 - DNA, 22 bp, Homo sapiens
tggcacatatttttagtgctca

SEQ ID NO: 9192050 - DNA, 22 bp, Homo sapiens
tggcacagttaaagttgtagaa

SEQ ID NO: 9192051 - DNA, 22 bp, Homo sapiens
tggcacagttaaagttgtagaa

SEQ ID NO: 9192052 - DNA, 22 bp, Homo sapiens
tggcacatagcaggtactcagt

SEQ ID NO: 9192053 - DNA, 22 bp, Homo sapiens
tggcacatggttaatcataatt

SEQ ID NO: 9192054 - DNA, 23 bp, Homo sapiens
tggcaccaggcattctaggggta

SEQ ID NO: 9192055 - DNA, 22 bp, Homo sapiens
tggcaccaggcggggtggctgt

SEQ ID NO: 9192056 - DNA, 20 bp, Homo sapiens
tggcaccaggtggtggcccc

SEQ ID NO: 9192057 - DNA, 18 bp, Homo sapiens
tggcagggaggaaatata

SEQ ID NO: 9192058 - DNA, 18 bp, Homo sapiens
tggcagggaggaaatata

SEQ ID NO: 9192059 - DNA, 22 bp, Homo sapiens
tggcaggcattgatgcgagttc

SEQ ID NO: 9192060 - DNA, 22 bp, Homo sapiens
tggcagggagttcgttcacaac

SEQ ID NO: 9192061 - DNA, 19 bp, Homo sapiens
tggcagggagtgatattag

SEQ ID NO: 9192062 - DNA, 19 bp, Homo sapiens
tggcagggagtgatattag

SEQ ID NO: 9192063 - DNA, 22 bp, Homo sapiens
tggcaggcaagttcagctccac

SEQ ID NO: 9192064 - DNA, 22 bp, Homo sapiens
tggcaggcaagttcagctccac

SEQ ID NO: 9192065 - DNA, 22 bp, Homo sapiens
tggcaggcagtgtgggagctgg

SEQ ID NO: 9192066 - DNA, 22 bp, Homo sapiens
tggcaggcagctggcatcctaa

SEQ ID NO: 9192067 - DNA, 21 bp, Homo sapiens
tggcaggggtagtagtacagc

SEQ ID NO: 9192068 - DNA, 22 bp, Homo sapiens
tggcagggtacaccttaacacc

SEQ ID NO: 9192069 - DNA, 21 bp, Homo sapiens
tggcaggggtagtagtacagc

SEQ ID NO: 9192070 - DNA, 18 bp, Homo sapiens
tggcaggggcagtacgcc

SEQ ID NO: 9192071 - DNA, 22 bp, Homo sapiens
tggcagggcctgctcatcatcc

SEQ ID NO: 9192072 - DNA, 22 bp, Homo sapiens
tggcaggggaggtgcttgctta

SEQ ID NO: 9192073 - DNA, 18 bp, Homo sapiens
tggcaggggcagtacgcc

SEQ ID NO: 9192074 - DNA, 22 bp, Homo sapiens
tggcagggcctgaatcttatac

SEQ ID NO: 9192075 - DNA, 22 bp, Homo sapiens
tggcagggcctgctcatcatcc

SEQ ID NO: 9192076 - DNA, 22 bp, Homo sapiens
tggcagggcctaccccaatatc

SEQ ID NO: 9192077 - DNA, 22 bp, Homo sapiens
tggcagggagttgcaggatttc

SEQ ID NO: 9192078 - DNA, 22 bp, Homo sapiens
tggcagggagttcgttcacaac

SEQ ID NO: 9192079 - DNA, 20 bp, Homo sapiens
tggcaggaggcagcagtgga

SEQ ID NO: 9192080 - DNA, 22 bp, Homo sapiens
tggcaggaggttttctccagga

SEQ ID NO: 9192081 - DNA, 22 bp, Homo sapiens
tggcaggaggatgaggcggcta

SEQ ID NO: 9192082 - DNA, 22 bp, Homo sapiens
tggcaggagagcgtcagatcag

SEQ ID NO: 9192083 - DNA, 22 bp, Homo sapiens
tggcaggagacacatggcatag

SEQ ID NO: 9192084 - DNA, 18 bp, Homo sapiens
tggcaggaaatgcacttt

SEQ ID NO: 9192085 - DNA, 22 bp, Homo sapiens
tggcaggaaccaggaggctctc

SEQ ID NO: 9192086 - DNA, 18 bp, Homo sapiens
tggcaggaaatgcacttt

SEQ ID NO: 9192087 - DNA, 22 bp, Homo sapiens
tggcaggaaagtaacagagcac

SEQ ID NO: 9192088 - DNA, 22 bp, Homo sapiens
tggcagctctgttcaacatgag

SEQ ID NO: 9192089 - DNA, 20 bp, Homo sapiens
tggcagagttgtcccaccca

SEQ ID NO: 9192090 - DNA, 22 bp, Homo sapiens
tggcagcacttgaacttgagcc

SEQ ID NO: 9192091 - DNA, 20 bp, Homo sapiens
tggcagagttgtcccaccca

SEQ ID NO: 9192092 - DNA, 22 bp, Homo sapiens
tggcagagttggaggtggaaga

SEQ ID NO: 9192093 - DNA, 21 bp, Homo sapiens
tggcagagttgagtagttatg

SEQ ID NO: 9192094 - DNA, 21 bp, Homo sapiens
tggcagagttgagtagttatg

SEQ ID NO: 9192095 - DNA, 22 bp, Homo sapiens
tggcagagttggaggtggaaga

SEQ ID NO: 9192096 - DNA, 22 bp, Homo sapiens
tggcagagttggaggtggaaga

SEQ ID NO: 9192097 - DNA, 22 bp, Homo sapiens
tggcagagttcgctgtgccttt

SEQ ID NO: 9192098 - DNA, 22 bp, Homo sapiens
tggcagagttcgctgtgccttt

SEQ ID NO: 9192099 - DNA, 22 bp, Homo sapiens
tggcagagttcgctcctattca

SEQ ID NO: 9192100 - DNA, 22 bp, Homo sapiens
tggcagagttcgctcctattca

SEQ ID NO: 9192101 - DNA, 18 bp, Homo sapiens
tggcagagtgtctgttct

SEQ ID NO: 9192102 - DNA, 18 bp, Homo sapiens
tggcagagtgtctgttct

SEQ ID NO: 9192103 - DNA, 22 bp, Homo sapiens
tggcagagtggaccatactcaa

SEQ ID NO: 9192104 - DNA, 22 bp, Homo sapiens
tggcagagtggaccatactcaa

SEQ ID NO: 9192105 - DNA, 22 bp, Homo sapiens
tggcagagttatgggtatttat

SEQ ID NO: 9192106 - DNA, 22 bp, Homo sapiens
tggcagagttatgggtatttat

SEQ ID NO: 9192107 - DNA, 22 bp, Homo sapiens
tggcagagtgcggcatcccctg

SEQ ID NO: 9192108 - DNA, 21 bp, Homo sapiens
tggcagagtgcagtctataca

SEQ ID NO: 9192109 - DNA, 21 bp, Homo sapiens
tggcagagtgcagtctataca

SEQ ID NO: 9192110 - DNA, 22 bp, Homo sapiens
tggcagagtgcggcatcccctg

SEQ ID NO: 9192111 - DNA, 22 bp, Homo sapiens
tggcagagtctgggcttgggca

SEQ ID NO: 9192112 - DNA, 22 bp, Homo sapiens
tggcagagtgcagaagaggcat

SEQ ID NO: 9192113 - DNA, 22 bp, Homo sapiens
tggcagagtgcagaagaggcat

SEQ ID NO: 9192114 - DNA, 22 bp, Homo sapiens
tggcagagtcatcacatctgga

SEQ ID NO: 9192115 - DNA, 22 bp, Homo sapiens
tggcagagtctctcctttccag

SEQ ID NO: 9192116 - DNA, 22 bp, Homo sapiens
tggcagagtctgggcttgggca

SEQ ID NO: 9192117 - DNA, 22 bp, Homo sapiens
tggcagagtctctcctttccag

SEQ ID NO: 9192118 - DNA, 22 bp, Homo sapiens
tggcagagtcatcacatctgga

SEQ ID NO: 9192119 - DNA, 22 bp, Homo sapiens
tggcagagtcatcacatctgga

SEQ ID NO: 9192120 - DNA, 22 bp, Homo sapiens
tggcagagtaggatggccctgt

SEQ ID NO: 9192121 - DNA, 22 bp, Homo sapiens
tggcagagtaggatggccctgt

SEQ ID NO: 9192122 - DNA, 22 bp, Homo sapiens
tggcagcagacaaaaggccatt

SEQ ID NO: 9192123 - DNA, 22 bp, Homo sapiens
tggcagcagcaaatggcatatc

SEQ ID NO: 9192124 - DNA, 22 bp, Homo sapiens
tggcagcagcaaatggcatatc

SEQ ID NO: 9192125 - DNA, 22 bp, Homo sapiens
tggcagcagacatctgaggtct

SEQ ID NO: 9192126 - DNA, 23 bp, Homo sapiens
tggcagcagatcttaaagtgacc

SEQ ID NO: 9192127 - DNA, 22 bp, Homo sapiens
tggcagcagccatggaaggccc

SEQ ID NO: 9192128 - DNA, 22 bp, Homo sapiens
tggcagcagccatggaaggccc

SEQ ID NO: 9192129 - DNA, 18 bp, Homo sapiens
tggcagcaggaagccatt

SEQ ID NO: 9192130 - DNA, 22 bp, Homo sapiens
tggcagcagtagccaccccagc

SEQ ID NO: 9192131 - DNA, 22 bp, Homo sapiens
tggcagcagggaggccagtgtt

SEQ ID NO: 9192132 - DNA, 22 bp, Homo sapiens
tggcagcatgttatgtaaggaa

SEQ ID NO: 9192133 - DNA, 22 bp, Homo sapiens
tggcagcataaagcatttagct

SEQ ID NO: 9192134 - DNA, 22 bp, Homo sapiens
tggcagcataaagcatttagct

SEQ ID NO: 9192135 - DNA, 22 bp, Homo sapiens
tggcagcagtggaggtagaaag

SEQ ID NO: 9192136 - DNA, 22 bp, Homo sapiens
tggcagcattttttccagaaca

SEQ ID NO: 9192137 - DNA, 22 bp, Homo sapiens
tggcagccatcagagcaggggt

SEQ ID NO: 9192138 - DNA, 22 bp, Homo sapiens
tggcagccatcagagcaggggt

SEQ ID NO: 9192139 - DNA, 22 bp, Homo sapiens
tggcagcctgcgtgaaggagct

SEQ ID NO: 9192140 - DNA, 22 bp, Homo sapiens
tggcagcctcccagctgcattc

SEQ ID NO: 9192141 - DNA, 22 bp, Homo sapiens
tggcagcctcccagctgcattc

SEQ ID NO: 9192142 - DNA, 22 bp, Homo sapiens
tggcagctcctggggccagcac

SEQ ID NO: 9192143 - DNA, 22 bp, Homo sapiens
tggcagctacagacagaggtga

SEQ ID NO: 9192144 - DNA, 22 bp, Homo sapiens
tggcagccttctctgagaaggt

SEQ ID NO: 9192145 - DNA, 22 bp, Homo sapiens
tgggagaagcagtgggacagta

SEQ ID NO: 9192146 - DNA, 22 bp, Homo sapiens
tgggagaagcagtgggacagta

SEQ ID NO: 9192147 - DNA, 22 bp, Homo sapiens
tgggagaaagaaccctgagtga

SEQ ID NO: 9192148 - DNA, 22 bp, Homo sapiens
tgggagaagagaaattactgcc

SEQ ID NO: 9192149 - DNA, 22 bp, Homo sapiens
tgggagagcttcatgccttcag

SEQ ID NO: 9192150 - DNA, 19 bp, Homo sapiens
tgggagaggcaacagagta

SEQ ID NO: 9192151 - DNA, 22 bp, Homo sapiens
tgggagagcttcatgccttcag

SEQ ID NO: 9192152 - DNA, 19 bp, Homo sapiens
tgggagaggcaacagagta

SEQ ID NO: 9192153 - DNA, 22 bp, Homo sapiens
tgggagaggctgccatcttgca

SEQ ID NO: 9192154 - DNA, 21 bp, Homo sapiens
tgggagagggctcagctaccc

SEQ ID NO: 9192155 - DNA, 21 bp, Homo sapiens
tgggagagggctcagctaccc

SEQ ID NO: 9192156 - DNA, 22 bp, Homo sapiens
tgggagagtctaaaaccgaggt

SEQ ID NO: 9192157 - DNA, 22 bp, Homo sapiens
tgggagagtgctcaatgtgcaa

SEQ ID NO: 9192158 - DNA, 22 bp, Homo sapiens
tgggagcaaatgactgggagat

SEQ ID NO: 9192159 - DNA, 22 bp, Homo sapiens
tgggagatggttctgagacttt

SEQ ID NO: 9192160 - DNA, 22 bp, Homo sapiens
tgggaggacttgtgggcttcat

SEQ ID NO: 9192161 - DNA, 22 bp, Homo sapiens
tgggaggaatgtcactgagcca

SEQ ID NO: 9192162 - DNA, 22 bp, Homo sapiens
tgggagctggggttggacgtct

SEQ ID NO: 9192163 - DNA, 22 bp, Homo sapiens
tgggagctcctggagggcagga

SEQ ID NO: 9192164 - DNA, 22 bp, Homo sapiens
tgggaggaagtgctaatgggag

SEQ ID NO: 9192165 - DNA, 22 bp, Homo sapiens
tgggaggaagtgctaatgggag

SEQ ID NO: 9192166 - DNA, 22 bp, Homo sapiens
tgggaggatctcttgaggccag

SEQ ID NO: 9192167 - DNA, 22 bp, Homo sapiens
tgggaggcagaagttgactgga

SEQ ID NO: 9192168 - DNA, 22 bp, Homo sapiens
tgggaggatctcttgaggccag

SEQ ID NO: 9192169 - DNA, 22 bp, Homo sapiens
tgggaggcaggtaggtgatgat

SEQ ID NO: 9192170 - DNA, 22 bp, Homo sapiens
tgggaggcagaagttgactgga

SEQ ID NO: 9192171 - DNA, 22 bp, Homo sapiens
tgggaggatcgcttgagcccag

SEQ ID NO: 9192172 - DNA, 22 bp, Homo sapiens
tgggaggagccctctgggaagg

SEQ ID NO: 9192173 - DNA, 22 bp, Homo sapiens
tgggaggatcgcttgagcccag

SEQ ID NO: 9192174 - DNA, 22 bp, Homo sapiens
tgggagcagctttgcgagggag

SEQ ID NO: 9192175 - DNA, 22 bp, Homo sapiens
tgggagcagccaacatggcctt

SEQ ID NO: 9192176 - DNA, 22 bp, Homo sapiens
tgggagcagccaacatggcctt

SEQ ID NO: 9192177 - DNA, 22 bp, Homo sapiens
tgggagcactctttgggaagca

SEQ ID NO: 9192178 - DNA, 22 bp, Homo sapiens
tgggagcaccttgagggcagaa

SEQ ID NO: 9192179 - DNA, 22 bp, Homo sapiens
tgggagcaccctgaggagcttc

SEQ ID NO: 9192180 - DNA, 22 bp, Homo sapiens
tgggagcaccttgagggcagaa

SEQ ID NO: 9192181 - DNA, 22 bp, Homo sapiens
tgggagcactctttgggaagca

SEQ ID NO: 9192182 - DNA, 22 bp, Homo sapiens
tgggagcaagctggtgctggag

SEQ ID NO: 9192183 - DNA, 22 bp, Homo sapiens
tgggagcaagctggtgctggag

SEQ ID NO: 9192184 - DNA, 22 bp, Homo sapiens
tgggagcaagctggtgctggag

SEQ ID NO: 9192185 - DNA, 22 bp, Homo sapiens
tgggagcaccctgaggagcttc

SEQ ID NO: 9192186 - DNA, 22 bp, Homo sapiens
tgggaaggggagctggaaagga

SEQ ID NO: 9192187 - DNA, 22 bp, Homo sapiens
tgggaagggcctgcccttcctc

SEQ ID NO: 9192188 - DNA, 22 bp, Homo sapiens
tgggaagggcctgcccttcctc

SEQ ID NO: 9192189 - DNA, 22 bp, Homo sapiens
tgggaaggggagctggaaagga

SEQ ID NO: 9192190 - DNA, 22 bp, Homo sapiens
tgggaagggtcaacagctggaa

SEQ ID NO: 9192191 - DNA, 22 bp, Homo sapiens
tgggaagggtcaacagctggaa

SEQ ID NO: 9192192 - DNA, 22 bp, Homo sapiens
tgggaaggggagctggaaagga

SEQ ID NO: 9192193 - DNA, 22 bp, Homo sapiens
tgggaaggggagctggaaagga

SEQ ID NO: 9192194 - DNA, 22 bp, Homo sapiens
tgggaaggtacacgggaaagag

SEQ ID NO: 9192195 - DNA, 22 bp, Homo sapiens
tgggaaggtacacgggaaagag

SEQ ID NO: 9192196 - DNA, 22 bp, Homo sapiens
tgggaaggtgtagaaagaacaa

SEQ ID NO: 9192197 - DNA, 22 bp, Homo sapiens
tgggaaggtgtagaaagaacaa

SEQ ID NO: 9192198 - DNA, 22 bp, Homo sapiens
tgggaaggtgattttccaaaag

SEQ ID NO: 9192199 - DNA, 22 bp, Homo sapiens
tgggaagggtcagtttcttcat

SEQ ID NO: 9192200 - DNA, 22 bp, Homo sapiens
tgggaagggtcaacagctggaa

SEQ ID NO: 9192201 - DNA, 22 bp, Homo sapiens
tgggaaggtacacgggaaagag

SEQ ID NO: 9192202 - DNA, 22 bp, Homo sapiens
tgggaagggtctgaatctgaga

SEQ ID NO: 9192203 - DNA, 22 bp, Homo sapiens
tgggaagggtctgaatctgaga

SEQ ID NO: 9192204 - DNA, 22 bp, Homo sapiens
tgggaagggtctgaatctgaga

SEQ ID NO: 9192205 - DNA, 22 bp, Homo sapiens
tgggaaggcgtggaagtagaag

SEQ ID NO: 9192206 - DNA, 22 bp, Homo sapiens
tgggaaggcgtggaagtagaag

SEQ ID NO: 9192207 - DNA, 22 bp, Homo sapiens
tgggaagggccgatggagcctc

SEQ ID NO: 9192208 - DNA, 22 bp, Homo sapiens
tgggaagggccgatggagcctc

SEQ ID NO: 9192209 - DNA, 22 bp, Homo sapiens
tgggaagggccgatggagcctc

SEQ ID NO: 9192210 - DNA, 22 bp, Homo sapiens
tgggaagggagtttcttggagt

SEQ ID NO: 9192211 - DNA, 22 bp, Homo sapiens
tgggaagggagagtgtcctgga

SEQ ID NO: 9192212 - DNA, 22 bp, Homo sapiens
tgggaagggagtttcttggagt

SEQ ID NO: 9192213 - DNA, 22 bp, Homo sapiens
tgggaagaggcgggaggctgtt

SEQ ID NO: 9192214 - DNA, 22 bp, Homo sapiens
tgggaagaggggtataaagaag

SEQ ID NO: 9192215 - DNA, 22 bp, Homo sapiens
tgggaagatatgagtgaccaac

SEQ ID NO: 9192216 - DNA, 22 bp, Homo sapiens
tgggaagatgaggtgccatggg

SEQ ID NO: 9192217 - DNA, 22 bp, Homo sapiens
tgggaagatgataattcacagt

SEQ ID NO: 9192218 - DNA, 22 bp, Homo sapiens
tgggacagggaatctgatcccc

SEQ ID NO: 9192219 - DNA, 22 bp, Homo sapiens
tgggacaggttggagagaagca

SEQ ID NO: 9192220 - DNA, 22 bp, Homo sapiens
tgggacaggttggagagaagca

SEQ ID NO: 9192221 - DNA, 22 bp, Homo sapiens
tgggacagggaatctgatcccc

SEQ ID NO: 9192222 - DNA, 22 bp, Homo sapiens
tgggaatgtggcaaggcataga

SEQ ID NO: 9192223 - DNA, 22 bp, Homo sapiens
tgggacaaggactagctccaat

SEQ ID NO: 9192224 - DNA, 22 bp, Homo sapiens
tgggaatgcaaggaaagctgtt

SEQ ID NO: 9192225 - DNA, 22 bp, Homo sapiens
tgggaaggttagcagtttgtca

SEQ ID NO: 9192226 - DNA, 22 bp, Homo sapiens
tgggaagtatcatttggcctgg

SEQ ID NO: 9192227 - DNA, 22 bp, Homo sapiens
tgggaagttgtaccttctgtta

SEQ ID NO: 9192228 - DNA, 22 bp, Homo sapiens
tgggaataggcttggtaggcac

SEQ ID NO: 9192229 - DNA, 23 bp, Homo sapiens
tgggaatgacatctagagcagag

SEQ ID NO: 9192230 - DNA, 22 bp, Homo sapiens
tgggactcactcttttggccag

SEQ ID NO: 9192231 - DNA, 20 bp, Homo sapiens
tgggactgacccatctgagc

SEQ ID NO: 9192232 - DNA, 22 bp, Homo sapiens
tgggacatgcttggaatctaga

SEQ ID NO: 9192233 - DNA, 22 bp, Homo sapiens
tgggacagttgtcctccactct

SEQ ID NO: 9192234 - DNA, 22 bp, Homo sapiens
tgggacagttgtcctccactct

SEQ ID NO: 9192235 - DNA, 22 bp, Homo sapiens
tgggacagttgtcctccactct

SEQ ID NO: 9192236 - DNA, 22 bp, Homo sapiens
tgggacagtgtgccttgctcct

SEQ ID NO: 9192237 - DNA, 22 bp, Homo sapiens
tgggacagtgtgccttgctcct

SEQ ID NO: 9192238 - DNA, 22 bp, Homo sapiens
tgggacagtgtgccttgctcct

SEQ ID NO: 9192239 - DNA, 22 bp, Homo sapiens
tgggacagtgaccccagaggtc

SEQ ID NO: 9192240 - DNA, 22 bp, Homo sapiens
tgggacagtgaccccagaggtc

SEQ ID NO: 9192241 - DNA, 22 bp, Homo sapiens
tgggacagtgaccccagaggtc

SEQ ID NO: 9192242 - DNA, 21 bp, Homo sapiens
tgggacagtgatggctcctcc

SEQ ID NO: 9192243 - DNA, 21 bp, Homo sapiens
tgggacagtgatggctcctcc

SEQ ID NO: 9192244 - DNA, 22 bp, Homo sapiens
tgggaaaccatgtgtgtcactt

SEQ ID NO: 9192245 - DNA, 22 bp, Homo sapiens
tgggaaaccatgtgtgtcactt

SEQ ID NO: 9192246 - DNA, 22 bp, Homo sapiens
tggcttttgttggtaccacctt

SEQ ID NO: 9192247 - DNA, 22 bp, Homo sapiens
tgggaaacagtgatgccaagaa

SEQ ID NO: 9192248 - DNA, 22 bp, Homo sapiens
tggctttgaaatccagtcatta

SEQ ID NO: 9192249 - DNA, 22 bp, Homo sapiens
tggctttgacttaccagaagtg

SEQ ID NO: 9192250 - DNA, 22 bp, Homo sapiens
tggctttgatggacagaggtca

SEQ ID NO: 9192251 - DNA, 21 bp, Homo sapiens
tggcttttatggagctctggg

SEQ ID NO: 9192252 - DNA, 22 bp, Homo sapiens
tgggaaagtaattgtcatcctt

SEQ ID NO: 9192253 - DNA, 20 bp, Homo sapiens
tgggaaagtctaagtgcctc

SEQ ID NO: 9192254 - DNA, 19 bp, Homo sapiens
tgggaaagtaacatacaaa

SEQ ID NO: 9192255 - DNA, 22 bp, Homo sapiens
tgggaaagccagcagtgtcacc

SEQ ID NO: 9192256 - DNA, 22 bp, Homo sapiens
tggcttcttgtctaatttgtta

SEQ ID NO: 9192257 - DNA, 22 bp, Homo sapiens
tggctttcccccagcccagttg

SEQ ID NO: 9192258 - DNA, 22 bp, Homo sapiens
tggcttcttactagggctcagt

SEQ ID NO: 9192259 - DNA, 22 bp, Homo sapiens
tggcttcttcatatgtgatctt

SEQ ID NO: 9192260 - DNA, 22 bp, Homo sapiens
tggcttcttgacttcttggctg

SEQ ID NO: 9192261 - DNA, 18 bp, Homo sapiens
tggcttcttgagctaaca

SEQ ID NO: 9192262 - DNA, 22 bp, Homo sapiens
tggcttcttgatcttggacttg

SEQ ID NO: 9192263 - DNA, 22 bp, Homo sapiens
tgggaaatgctgcattgggcaa

SEQ ID NO: 9192264 - DNA, 22 bp, Homo sapiens
tgggaaatatggcattgggcct

SEQ ID NO: 9192265 - DNA, 22 bp, Homo sapiens
tgggaaagtgttgaggtgtctt

SEQ ID NO: 9192266 - DNA, 22 bp, Homo sapiens
tgggaaagtgttgaggtgtctt

SEQ ID NO: 9192267 - DNA, 22 bp, Homo sapiens
tgggaaagtgttgaggtgtctt

SEQ ID NO: 9192268 - DNA, 22 bp, Homo sapiens
tgggaagaagcagagaactgga

SEQ ID NO: 9192269 - DNA, 22 bp, Homo sapiens
tgggaagaagcagagaactgga

SEQ ID NO: 9192270 - DNA, 22 bp, Homo sapiens
tgggaagactcctcaggaggcg

SEQ ID NO: 9192271 - DNA, 22 bp, Homo sapiens
tgggaagaggcgggaggctgtt

SEQ ID NO: 9192272 - DNA, 22 bp, Homo sapiens
tgggaagaggatgaggcatatg

SEQ ID NO: 9192273 - DNA, 22 bp, Homo sapiens
tgggaagaggatgaggcatatg

SEQ ID NO: 9192274 - DNA, 22 bp, Homo sapiens
tggcttcctgcacagtgtctgc

SEQ ID NO: 9192275 - DNA, 22 bp, Homo sapiens
tggcttcctccagagcaggagg

SEQ ID NO: 9192276 - DNA, 21 bp, Homo sapiens
tggcttcagccattttctctg

SEQ ID NO: 9192277 - DNA, 22 bp, Homo sapiens
tggcttcactgctcaagtgatt

SEQ ID NO: 9192278 - DNA, 22 bp, Homo sapiens
tggcttcacctcagcatgaagg

SEQ ID NO: 9192279 - DNA, 22 bp, Homo sapiens
tggcttctcagtttcataatga

SEQ ID NO: 9192280 - DNA, 22 bp, Homo sapiens
tggcttctccagaaatcttggt

SEQ ID NO: 9192281 - DNA, 22 bp, Homo sapiens
tggcttctcagaatactctgga

SEQ ID NO: 9192282 - DNA, 22 bp, Homo sapiens
tggcttctcaaaataactggtt

SEQ ID NO: 9192283 - DNA, 18 bp, Homo sapiens
tggcttctcaaagcccag

SEQ ID NO: 9192284 - DNA, 18 bp, Homo sapiens
tggcttctattttactca

SEQ ID NO: 9192285 - DNA, 22 bp, Homo sapiens
tggcttctagcagtgttgattt

SEQ ID NO: 9192286 - DNA, 22 bp, Homo sapiens
tggcttctagtttgaggaaaaa

SEQ ID NO: 9192287 - DNA, 22 bp, Homo sapiens
tggcttctgagcattgaaacgt

SEQ ID NO: 9192288 - DNA, 22 bp, Homo sapiens
tggcttctctgttttagtattt

SEQ ID NO: 9192289 - DNA, 22 bp, Homo sapiens
tggcttctcgcctgtcatcccg

SEQ ID NO: 9192290 - DNA, 22 bp, Homo sapiens
tggcttctctgtgtgagggaga

SEQ ID NO: 9192291 - DNA, 22 bp, Homo sapiens
tggcttctctgtggtggctccc

SEQ ID NO: 9192292 - DNA, 22 bp, Homo sapiens
tggcttctccctccccatctag

SEQ ID NO: 9192293 - DNA, 22 bp, Homo sapiens
tggcttctgggacttgtgagca

SEQ ID NO: 9192294 - DNA, 22 bp, Homo sapiens
tggcttctggtttatccttata

SEQ ID NO: 9192295 - DNA, 22 bp, Homo sapiens
tggcttctgtccctgctacatt

SEQ ID NO: 9192296 - DNA, 18 bp, Homo sapiens
tggcttctgctagctgga

SEQ ID NO: 9192297 - DNA, 23 bp, Homo sapiens
tggcttctgccccattctctcca

SEQ ID NO: 9192298 - DNA, 21 bp, Homo sapiens
tggcttctgccaatgttaaga

SEQ ID NO: 9192299 - DNA, 22 bp, Homo sapiens
tggcttctgcatatttttagag

SEQ ID NO: 9192300 - DNA, 22 bp, Homo sapiens
tggcttctgctcccagaatgat

SEQ ID NO: 9192301 - DNA, 19 bp, Homo sapiens
tggcttctggcaacagatg

SEQ ID NO: 9192302 - DNA, 22 bp, Homo sapiens
tggctgtgcctctttccaggcc

SEQ ID NO: 9192303 - DNA, 22 bp, Homo sapiens
tggctgtggactcagatggctc

SEQ ID NO: 9192304 - DNA, 22 bp, Homo sapiens
tggctgtgggatgagagcctca

SEQ ID NO: 9192305 - DNA, 20 bp, Homo sapiens
tggctgtgggcatctgtttc

SEQ ID NO: 9192306 - DNA, 22 bp, Homo sapiens
tggctgtggtttatcccagttc

SEQ ID NO: 9192307 - DNA, 22 bp, Homo sapiens
tggctgtgtccctgtccagagt

SEQ ID NO: 9192308 - DNA, 22 bp, Homo sapiens
tggctgtgttaccacttcatgt

SEQ ID NO: 9192309 - DNA, 22 bp, Homo sapiens
tggcttaagatttatgctttta

SEQ ID NO: 9192310 - DNA, 23 bp, Homo sapiens
tggcttaacctcttcctatgtct

SEQ ID NO: 9192311 - DNA, 23 bp, Homo sapiens
tggcttcaactctgtcggcagcc

SEQ ID NO: 9192312 - DNA, 22 bp, Homo sapiens
tggcttcaaggtgataatttac

SEQ ID NO: 9192313 - DNA, 22 bp, Homo sapiens
tggcttaatttctctgtgcctc

SEQ ID NO: 9192314 - DNA, 22 bp, Homo sapiens
tggctgggtgctatccagtact

SEQ ID NO: 9192315 - DNA, 19 bp, Homo sapiens
tggctgggtgccaatggcc

SEQ ID NO: 9192316 - DNA, 22 bp, Homo sapiens
tggctgggggtgctatagctgc

SEQ ID NO: 9192317 - DNA, 22 bp, Homo sapiens
tggctgggggtgctatagctgc

SEQ ID NO: 9192318 - DNA, 22 bp, Homo sapiens
tggctgggggtgctatagctgc

SEQ ID NO: 9192319 - DNA, 19 bp, Homo sapiens
tggctgggtgccaatggcc

SEQ ID NO: 9192320 - DNA, 22 bp, Homo sapiens
tggctggggagccccgactccc

SEQ ID NO: 9192321 - DNA, 22 bp, Homo sapiens
tggctggggccacagttttcct

SEQ ID NO: 9192322 - DNA, 22 bp, Homo sapiens
tggctggggagccccgactccc

SEQ ID NO: 9192323 - DNA, 22 bp, Homo sapiens
tggctggggccacagttttcct

SEQ ID NO: 9192324 - DNA, 22 bp, Homo sapiens
tggctggggcctgaatcctgca

SEQ ID NO: 9192325 - DNA, 22 bp, Homo sapiens
tggctggggcctgaatcctgca

SEQ ID NO: 9192326 - DNA, 22 bp, Homo sapiens
tggctgggccgggccttgtgcc

SEQ ID NO: 9192327 - DNA, 19 bp, Homo sapiens
tggctgggcgtgcctccgt

SEQ ID NO: 9192328 - DNA, 22 bp, Homo sapiens
tggctggggagccccgactccc

SEQ ID NO: 9192329 - DNA, 19 bp, Homo sapiens
tggctgggcgtgcctccgt

SEQ ID NO: 9192330 - DNA, 19 bp, Homo sapiens
tggctgggcgtgcctccgt

SEQ ID NO: 9192331 - DNA, 22 bp, Homo sapiens
tggctggagggttagtgagata

SEQ ID NO: 9192332 - DNA, 22 bp, Homo sapiens
tggctggaggaaggaactgagg

SEQ ID NO: 9192333 - DNA, 22 bp, Homo sapiens
tggctggagcgccctcctctgc

SEQ ID NO: 9192334 - DNA, 22 bp, Homo sapiens
tggctggagcattccttgtctt

SEQ ID NO: 9192335 - DNA, 22 bp, Homo sapiens
tggctggaatggagctgagcct

SEQ ID NO: 9192336 - DNA, 22 bp, Homo sapiens
tggctggagagggtcccatgag

SEQ ID NO: 9192337 - DNA, 22 bp, Homo sapiens
tggctggatatcagaggaagtg

SEQ ID NO: 9192338 - DNA, 22 bp, Homo sapiens
tggctggcaaggctggagtcag

SEQ ID NO: 9192339 - DNA, 22 bp, Homo sapiens
tggctggcaaggctggagtcag

SEQ ID NO: 9192340 - DNA, 22 bp, Homo sapiens
tggctggcgccgggctagccac

SEQ ID NO: 9192341 - DNA, 22 bp, Homo sapiens
tggctggcagtaggctagtggc

SEQ ID NO: 9192342 - DNA, 22 bp, Homo sapiens
tggctggcagtaggctagtggc

SEQ ID NO: 9192343 - DNA, 22 bp, Homo sapiens
tggctggcgttggggccagtga

SEQ ID NO: 9192344 - DNA, 22 bp, Homo sapiens
tggctggctagaatggaaatgt

SEQ ID NO: 9192345 - DNA, 22 bp, Homo sapiens
tggctgggagctggaactgggc

SEQ ID NO: 9192346 - DNA, 22 bp, Homo sapiens
tggctgggagctggaactgggc

SEQ ID NO: 9192347 - DNA, 22 bp, Homo sapiens
tggctgggagctggaactgggc

SEQ ID NO: 9192348 - DNA, 22 bp, Homo sapiens
tggctgggcccccacctgcctc

SEQ ID NO: 9192349 - DNA, 22 bp, Homo sapiens
tggctgggcccccacctgcctc

SEQ ID NO: 9192350 - DNA, 22 bp, Homo sapiens
tggctgggccgggccttgtgcc

SEQ ID NO: 9192351 - DNA, 22 bp, Homo sapiens
tggctgggcccccacctgcctc

SEQ ID NO: 9192352 - DNA, 22 bp, Homo sapiens
tggctgggcccccacctgcctc

SEQ ID NO: 9192353 - DNA, 22 bp, Homo sapiens
tggctccacaggccagggtgtg

SEQ ID NO: 9192354 - DNA, 22 bp, Homo sapiens
tggctcagttccatcatctgga

SEQ ID NO: 9192355 - DNA, 22 bp, Homo sapiens
tggctccactctccaggagttt

SEQ ID NO: 9192356 - DNA, 22 bp, Homo sapiens
tggctccagatctgtctcctgt

SEQ ID NO: 9192357 - DNA, 22 bp, Homo sapiens
tggctccagcgtccacgtcctg

SEQ ID NO: 9192358 - DNA, 20 bp, Homo sapiens
tggctccagcctcccctacc

SEQ ID NO: 9192359 - DNA, 22 bp, Homo sapiens
tggctccagccctgagcaagct

SEQ ID NO: 9192360 - DNA, 22 bp, Homo sapiens
tggctcctaatgctgcccagac

SEQ ID NO: 9192361 - DNA, 22 bp, Homo sapiens
tggctcctatcaaggagtgggt

SEQ ID NO: 9192362 - DNA, 22 bp, Homo sapiens
tggctcctaggatggtgcctgg

SEQ ID NO: 9192363 - DNA, 22 bp, Homo sapiens
tggctcctaatcggcttctttc

SEQ ID NO: 9192364 - DNA, 21 bp, Homo sapiens
tggctcccttgaattgtctgt

SEQ ID NO: 9192365 - DNA, 22 bp, Homo sapiens
tggctcccgcttgcacctaaga

SEQ ID NO: 9192366 - DNA, 21 bp, Homo sapiens
tggctcccttgaattgtctgt

SEQ ID NO: 9192367 - DNA, 22 bp, Homo sapiens
tggctcccgcttgcacctaaga

SEQ ID NO: 9192368 - DNA, 22 bp, Homo sapiens
tggctcccacaaactcactact

SEQ ID NO: 9192369 - DNA, 22 bp, Homo sapiens
tggctcccgcagaccctgtgct

SEQ ID NO: 9192370 - DNA, 22 bp, Homo sapiens
tggctcccacaaactcactact

SEQ ID NO: 9192371 - DNA, 22 bp, Homo sapiens
tggctcccaaggagctcctgcc

SEQ ID NO: 9192372 - DNA, 22 bp, Homo sapiens
tggctcccaaggagctcctgcc

SEQ ID NO: 9192373 - DNA, 22 bp, Homo sapiens
tggctcctcttctgggtgtccc

SEQ ID NO: 9192374 - DNA, 22 bp, Homo sapiens
tggctcctccctgtgtgtgcgt

SEQ ID NO: 9192375 - DNA, 20 bp, Homo sapiens
tggctcctcttggctgtggc

SEQ ID NO: 9192376 - DNA, 22 bp, Homo sapiens
tggctcctcttctgggtgtccc

SEQ ID NO: 9192377 - DNA, 22 bp, Homo sapiens
tggctcctcacgtcctcagagc

SEQ ID NO: 9192378 - DNA, 19 bp, Homo sapiens
tggctcctgcctgccttct

SEQ ID NO: 9192379 - DNA, 22 bp, Homo sapiens
tggctcctgcatttgtgctaac

SEQ ID NO: 9192380 - DNA, 22 bp, Homo sapiens
tggctcagataattcaaggggc

SEQ ID NO: 9192381 - DNA, 22 bp, Homo sapiens
tggctcagagccttgagagctg

SEQ ID NO: 9192382 - DNA, 22 bp, Homo sapiens
tggctcagaaggctgccttcac

SEQ ID NO: 9192383 - DNA, 22 bp, Homo sapiens
tggctcacttccgtggagaggt

SEQ ID NO: 9192384 - DNA, 22 bp, Homo sapiens
tggctcaagtaacaaaaatata

SEQ ID NO: 9192385 - DNA, 22 bp, Homo sapiens
tggctagtccgttagaggcgtg

SEQ ID NO: 9192386 - DNA, 22 bp, Homo sapiens
tggcgtctctcataagtatgtg

SEQ ID NO: 9192387 - DNA, 22 bp, Homo sapiens
tggcgtctctcataagtatgtg

SEQ ID NO: 9192388 - DNA, 20 bp, Homo sapiens
tggcggggatgagggagtta

SEQ ID NO: 9192389 - DNA, 22 bp, Homo sapiens
tggcggagttccagctgggatc

SEQ ID NO: 9192390 - DNA, 22 bp, Homo sapiens
tggccttggagaggcacggccc

SEQ ID NO: 9192391 - DNA, 22 bp, Homo sapiens
tggcctgttgctcctaggggtc

SEQ ID NO: 9192392 - DNA, 20 bp, Homo sapiens
tggccttggggagctcacac

SEQ ID NO: 9192393 - DNA, 22 bp, Homo sapiens
tggccttgtgtttaagcaagaa

SEQ ID NO: 9192394 - DNA, 22 bp, Homo sapiens
tggccttggtcctctttgcaat

SEQ ID NO: 9192395 - DNA, 22 bp, Homo sapiens
tggcctttgttgatagctatgc

SEQ ID NO: 9192396 - DNA, 22 bp, Homo sapiens
tggcctggccctgaggccctgt

SEQ ID NO: 9192397 - DNA, 22 bp, Homo sapiens
tggcctggctcacagtgagatt

SEQ ID NO: 9192398 - DNA, 22 bp, Homo sapiens
tggcctgggtcacaccagggtc

SEQ ID NO: 9192399 - DNA, 22 bp, Homo sapiens
tggcctgggtgctgctgacatc

SEQ ID NO: 9192400 - DNA, 22 bp, Homo sapiens
tggcctgggtgctgctgacatc

SEQ ID NO: 9192401 - DNA, 22 bp, Homo sapiens
tggcctggtaccacatagattt

SEQ ID NO: 9192402 - DNA, 22 bp, Homo sapiens
tggcctggtccttgtcaaggca

SEQ ID NO: 9192403 - DNA, 22 bp, Homo sapiens
tggcctggtgctcaggcagtag

SEQ ID NO: 9192404 - DNA, 22 bp, Homo sapiens
tggcctggtccttgtcaaggca

SEQ ID NO: 9192405 - DNA, 22 bp, Homo sapiens
tggcctggtgctcaggcagtag

SEQ ID NO: 9192406 - DNA, 22 bp, Homo sapiens
tggcctggttgttgctgccgtt

SEQ ID NO: 9192407 - DNA, 22 bp, Homo sapiens
tggcctggttatattgctatca

SEQ ID NO: 9192408 - DNA, 22 bp, Homo sapiens
tggcctggtgtctgcgaggcct

SEQ ID NO: 9192409 - DNA, 22 bp, Homo sapiens
tggcctggtgtctgcgaggcct

SEQ ID NO: 9192410 - DNA, 22 bp, Homo sapiens
tggcctggtgtctgcgaggcct

SEQ ID NO: 9192411 - DNA, 21 bp, Homo sapiens
tggctgcaagcagctgcctcc

SEQ ID NO: 9192412 - DNA, 22 bp, Homo sapiens
tggctgcaagggcacggaccct

SEQ ID NO: 9192413 - DNA, 22 bp, Homo sapiens
tggctgagtttcatgcatcatg

SEQ ID NO: 9192414 - DNA, 22 bp, Homo sapiens
tggctgagtttcatgcatcatg

SEQ ID NO: 9192415 - DNA, 22 bp, Homo sapiens
tggctgcacttacctctcctgc

SEQ ID NO: 9192416 - DNA, 22 bp, Homo sapiens
tggctgcagacacctatggcag

SEQ ID NO: 9192417 - DNA, 22 bp, Homo sapiens
tggctgcagaacctcctcagga

SEQ ID NO: 9192418 - DNA, 22 bp, Homo sapiens
tggctgcagatcaagggcaggc

SEQ ID NO: 9192419 - DNA, 22 bp, Homo sapiens
tggctgcagacacctatggcag

SEQ ID NO: 9192420 - DNA, 22 bp, Homo sapiens
tggctgagttacgaacagagca

SEQ ID NO: 9192421 - DNA, 22 bp, Homo sapiens
tggctgagttcctggcacacgg

SEQ ID NO: 9192422 - DNA, 22 bp, Homo sapiens
tggctgagttacgaacagagca

SEQ ID NO: 9192423 - DNA, 22 bp, Homo sapiens
tggctgagttacgaacagagca

SEQ ID NO: 9192424 - DNA, 22 bp, Homo sapiens
tggctgagttcctggcacacgg

SEQ ID NO: 9192425 - DNA, 22 bp, Homo sapiens
tggctgagttcctggcacacgg

SEQ ID NO: 9192426 - DNA, 22 bp, Homo sapiens
tggctgagttctccaggagtag

SEQ ID NO: 9192427 - DNA, 22 bp, Homo sapiens
tggctgagttctccaggagtag

SEQ ID NO: 9192428 - DNA, 22 bp, Homo sapiens
tggctgagtgttccaaggagca

SEQ ID NO: 9192429 - DNA, 21 bp, Homo sapiens
tggctgagtggatgcatgaat

SEQ ID NO: 9192430 - DNA, 21 bp, Homo sapiens
tggctgagtggatgcatgaat

SEQ ID NO: 9192431 - DNA, 22 bp, Homo sapiens
tggctgagtgatatttgcaaag

SEQ ID NO: 9192432 - DNA, 22 bp, Homo sapiens
tggctgagtgaacatgtccatt

SEQ ID NO: 9192433 - DNA, 22 bp, Homo sapiens
tggctgcagttgggccctcaga

SEQ ID NO: 9192434 - DNA, 22 bp, Homo sapiens
tggctgcagtgcttgagatgtc

SEQ ID NO: 9192435 - DNA, 22 bp, Homo sapiens
tggctgcagtgcttgagatgtc

SEQ ID NO: 9192436 - DNA, 22 bp, Homo sapiens
tggctgcagttcacaggagcaa

SEQ ID NO: 9192437 - DNA, 22 bp, Homo sapiens
tggctgccccctcccgtggaca

SEQ ID NO: 9192438 - DNA, 22 bp, Homo sapiens
tggctgccagctcctcgccttg

SEQ ID NO: 9192439 - DNA, 20 bp, Homo sapiens
tggctgcccgaggcacacac

SEQ ID NO: 9192440 - DNA, 22 bp, Homo sapiens
tggctgctgagaaggcagctgt

SEQ ID NO: 9192441 - DNA, 22 bp, Homo sapiens
tggctgctgcagacagacagga

SEQ ID NO: 9192442 - DNA, 21 bp, Homo sapiens
tggctgctggccctctctcca

SEQ ID NO: 9192443 - DNA, 21 bp, Homo sapiens
tggctgctggccctctctcca

SEQ ID NO: 9192444 - DNA, 22 bp, Homo sapiens
tggctgctgctcactcagcctc

SEQ ID NO: 9192445 - DNA, 22 bp, Homo sapiens
tggctgctgcttggtcttcttc

SEQ ID NO: 9192446 - DNA, 18 bp, Homo sapiens
tggctgcttccaggtaca

SEQ ID NO: 9192447 - DNA, 22 bp, Homo sapiens
tggctgagaaaatggttttagg

SEQ ID NO: 9192448 - DNA, 22 bp, Homo sapiens
tggctgagaagttctggtggga

SEQ ID NO: 9192449 - DNA, 22 bp, Homo sapiens
tggctgagaagttctggtggga

SEQ ID NO: 9192450 - DNA, 22 bp, Homo sapiens
tggctgagaaaatggttttagg

SEQ ID NO: 9192451 - DNA, 22 bp, Homo sapiens
tggctgagaaaaaagagctata

SEQ ID NO: 9192452 - DNA, 22 bp, Homo sapiens
tggctgaagtgggcaggaggga

SEQ ID NO: 9192453 - DNA, 22 bp, Homo sapiens
tggctgaataaaatatggtgtt

SEQ ID NO: 9192454 - DNA, 22 bp, Homo sapiens
tggctgaactaatgtgctgttt

SEQ ID NO: 9192455 - DNA, 22 bp, Homo sapiens
tggctgaaggaagattcttcta

SEQ ID NO: 9192456 - DNA, 22 bp, Homo sapiens
tggctgaaagcctggcctgcca

SEQ ID NO: 9192457 - DNA, 22 bp, Homo sapiens
tggctgaataatattctgttgt

SEQ ID NO: 9192458 - DNA, 22 bp, Homo sapiens
tggctgaattcatcaagaaaat

SEQ ID NO: 9192459 - DNA, 23 bp, Homo sapiens
tggctgagcccactatcttggcc

SEQ ID NO: 9192460 - DNA, 22 bp, Homo sapiens
tggctgagcctttggggctttc

SEQ ID NO: 9192461 - DNA, 21 bp, Homo sapiens
tggctgagccaggtgtgtgga

SEQ ID NO: 9192462 - DNA, 22 bp, Homo sapiens
tggctgagagtcatcctgtgtg

SEQ ID NO: 9192463 - DNA, 22 bp, Homo sapiens
tggctgagagcaattgactctg

SEQ ID NO: 9192464 - DNA, 22 bp, Homo sapiens
tggctgagccacttgttcagat

SEQ ID NO: 9192465 - DNA, 23 bp, Homo sapiens
tggctgagatcctactgtttgct

SEQ ID NO: 9192466 - DNA, 22 bp, Homo sapiens
tggctgaggctggagtgcagtg

SEQ ID NO: 9192467 - DNA, 22 bp, Homo sapiens
tggctgaggctggagtgcagtg

SEQ ID NO: 9192468 - DNA, 22 bp, Homo sapiens
tggctgaggctggagtgcagtg

SEQ ID NO: 9192469 - DNA, 22 bp, Homo sapiens
tggctgaggcttttcttaaaga

SEQ ID NO: 9192470 - DNA, 22 bp, Homo sapiens
tggctgagggcactatgaagcc

SEQ ID NO: 9192471 - DNA, 22 bp, Homo sapiens
tggctgaggtctggggcttctg

SEQ ID NO: 9192472 - DNA, 22 bp, Homo sapiens
tggctgaggttatgctggttgt

SEQ ID NO: 9192473 - DNA, 22 bp, Homo sapiens
tggctgagtaagttgtgatatg

SEQ ID NO: 9192474 - DNA, 22 bp, Homo sapiens
tggctgaggttatgctggttgt

SEQ ID NO: 9192475 - DNA, 22 bp, Homo sapiens
tggctgagtgaacatgtccatt

SEQ ID NO: 9192476 - DNA, 22 bp, Homo sapiens
tggctgagtaagttgtgatatg

SEQ ID NO: 9192477 - DNA, 22 bp, Homo sapiens
tggctgagctgcagcgtggctt

SEQ ID NO: 9192478 - DNA, 19 bp, Homo sapiens
tggctgagctggactgagg

SEQ ID NO: 9192479 - DNA, 22 bp, Homo sapiens
tggctgagctgcagcgtggctt

SEQ ID NO: 9192480 - DNA, 22 bp, Homo sapiens
tggctgagcctttggggctttc

SEQ ID NO: 9192481 - DNA, 22 bp, Homo sapiens
tggctgagctccctgtgtgttg

SEQ ID NO: 9192482 - DNA, 22 bp, Homo sapiens
tggctgaggagagggcggaagt

SEQ ID NO: 9192483 - DNA, 22 bp, Homo sapiens
tggctgaggagagggcggaagt

SEQ ID NO: 9192484 - DNA, 22 bp, Homo sapiens
tggctgaggagagggcggaagt

SEQ ID NO: 9192485 - DNA, 22 bp, Homo sapiens
tggctgaggagggtcttctggt

SEQ ID NO: 9192486 - DNA, 22 bp, Homo sapiens
tggctgaggcacagctgccgcc

SEQ ID NO: 9192487 - DNA, 21 bp, Homo sapiens
tggctctgctcagagcagtcc

SEQ ID NO: 9192488 - DNA, 21 bp, Homo sapiens
tggctctgctcagagcagtcc

SEQ ID NO: 9192489 - DNA, 22 bp, Homo sapiens
tggctctgctgaacctagtgca

SEQ ID NO: 9192490 - DNA, 22 bp, Homo sapiens
tggctctgcgtctgttcgtggg

SEQ ID NO: 9192491 - DNA, 21 bp, Homo sapiens
tggctctgctcagagcagtcc

SEQ ID NO: 9192492 - DNA, 22 bp, Homo sapiens
tggctctggagctcctgggccc

SEQ ID NO: 9192493 - DNA, 22 bp, Homo sapiens
tggctctggagctcctgggccc

SEQ ID NO: 9192494 - DNA, 22 bp, Homo sapiens
tggctctgctgaacctagtgca

SEQ ID NO: 9192495 - DNA, 18 bp, Homo sapiens
tggctctggacttgctcc

SEQ ID NO: 9192496 - DNA, 18 bp, Homo sapiens
tggctctgcagccagatg

SEQ ID NO: 9192497 - DNA, 22 bp, Homo sapiens
tggctctgatcagatgtccagt

SEQ ID NO: 9192498 - DNA, 22 bp, Homo sapiens
tggctctgcacctcagtgtacc

SEQ ID NO: 9192499 - DNA, 18 bp, Homo sapiens
tggctctgcagccagatg

SEQ ID NO: 9192500 - DNA, 22 bp, Homo sapiens
tggctctgccacctttccctaa

SEQ ID NO: 9192501 - DNA, 18 bp, Homo sapiens
tggctctgccactcaccg

SEQ ID NO: 9192502 - DNA, 18 bp, Homo sapiens
tggctctgccactcaccg

SEQ ID NO: 9192503 - DNA, 21 bp, Homo sapiens
tggctctgagcctcatggctg

SEQ ID NO: 9192504 - DNA, 22 bp, Homo sapiens
tggctctgagctgcaaagctgc

SEQ ID NO: 9192505 - DNA, 21 bp, Homo sapiens
tggctctgagcctcatggctg

SEQ ID NO: 9192506 - DNA, 23 bp, Homo sapiens
tggctctgagaggttcagatgct

SEQ ID NO: 9192507 - DNA, 17 bp, Homo sapiens
tggctctgaggctgaat

SEQ ID NO: 9192508 - DNA, 20 bp, Homo sapiens
tggctcctgcggtggaacca

SEQ ID NO: 9192509 - DNA, 22 bp, Homo sapiens
tggctcctggcaggtgtttcaa

SEQ ID NO: 9192510 - DNA, 20 bp, Homo sapiens
tggctcctggctcctccctc

SEQ ID NO: 9192511 - DNA, 22 bp, Homo sapiens
tggctcctgtggctatttcagt

SEQ ID NO: 9192512 - DNA, 22 bp, Homo sapiens
tggctccttcattctcctgcca

SEQ ID NO: 9192513 - DNA, 22 bp, Homo sapiens
tggctccttcattctcctgcca

SEQ ID NO: 9192514 - DNA, 22 bp, Homo sapiens
tggctccttccgcagcatgcct

SEQ ID NO: 9192515 - DNA, 22 bp, Homo sapiens
tggctcctttccagcctggttt

SEQ ID NO: 9192516 - DNA, 22 bp, Homo sapiens
tggctcggccacctgccagcca

SEQ ID NO: 9192517 - DNA, 20 bp, Homo sapiens
tggctctcaccctgtgcgat

SEQ ID NO: 9192518 - DNA, 22 bp, Homo sapiens
tggctctgagacacaggctctc

SEQ ID NO: 9192519 - DNA, 22 bp, Homo sapiens
tggctctgttgtgctgagccag

SEQ ID NO: 9192520 - DNA, 19 bp, Homo sapiens
tggctctgtttctctggag

SEQ ID NO: 9192521 - DNA, 19 bp, Homo sapiens
tggctctgtttctctggag

SEQ ID NO: 9192522 - DNA, 23 bp, Homo sapiens
tggctctgtgtcacatacaggat

SEQ ID NO: 9192523 - DNA, 22 bp, Homo sapiens
tggctctgttcgccatcaggag

SEQ ID NO: 9192524 - DNA, 22 bp, Homo sapiens
tggctctgttcgccatcaggag

SEQ ID NO: 9192525 - DNA, 22 bp, Homo sapiens
tggctctgttcgccatcaggag

SEQ ID NO: 9192526 - DNA, 22 bp, Homo sapiens
tggctctgttgtgctgagccag

SEQ ID NO: 9192527 - DNA, 22 bp, Homo sapiens
tggctctgtgcttctagtatct

SEQ ID NO: 9192528 - DNA, 22 bp, Homo sapiens
tggctctgtgcttctagtatct

SEQ ID NO: 9192529 - DNA, 22 bp, Homo sapiens
tggctctggggacagtaagtcc

SEQ ID NO: 9192530 - DNA, 22 bp, Homo sapiens
tggctctgtcgccgtttggaat

SEQ ID NO: 9192531 - DNA, 22 bp, Homo sapiens
tggctctgtggatgttctgacc

SEQ ID NO: 9192532 - DNA, 22 bp, Homo sapiens
tggctctgtggtcttagcatgc

SEQ ID NO: 9192533 - DNA, 23 bp, Homo sapiens
tggctctgtggatccctcaggag

SEQ ID NO: 9192534 - DNA, 23 bp, Homo sapiens
tggctctgtggatccctcaggag

SEQ ID NO: 9192535 - DNA, 22 bp, Homo sapiens
tggctctgggaatgggaagatg

SEQ ID NO: 9192536 - DNA, 22 bp, Homo sapiens
tggctctgggcaccgtgtccac

SEQ ID NO: 9192537 - DNA, 22 bp, Homo sapiens
tggctctggggacagtaagtcc

SEQ ID NO: 9192538 - DNA, 22 bp, Homo sapiens
tggctctgggaatctgttgctt

SEQ ID NO: 9192539 - DNA, 22 bp, Homo sapiens
tggctctgggaatgggaagatg

SEQ ID NO: 9192540 - DNA, 22 bp, Homo sapiens
tggctctggattaatctaggaa

SEQ ID NO: 9192541 - DNA, 22 bp, Homo sapiens
tggctctggccaccgggagggc

SEQ ID NO: 9192542 - DNA, 22 bp, Homo sapiens
tggctctggagctggcggctga

SEQ ID NO: 9192543 - DNA, 22 bp, Homo sapiens
tgctataagagtcacttttcct

SEQ ID NO: 9192544 - DNA, 22 bp, Homo sapiens
tgctataagaattatattactc

SEQ ID NO: 9192545 - DNA, 22 bp, Homo sapiens
tgctatcaccaactctgctaag

SEQ ID NO: 9192546 - DNA, 21 bp, Homo sapiens
tgctatcacactctttctgct

SEQ ID NO: 9192547 - DNA, 22 bp, Homo sapiens
tgctatttaacttttatgtgta

SEQ ID NO: 9192548 - DNA, 22 bp, Homo sapiens
tgctatttctatctcatttaaa

SEQ ID NO: 9192549 - DNA, 22 bp, Homo sapiens
tgctatttggaaaagcatttgg

SEQ ID NO: 9192550 - DNA, 22 bp, Homo sapiens
tgctatttgggggctacatgat

SEQ ID NO: 9192551 - DNA, 22 bp, Homo sapiens
tgctatttgggggctacatgat

SEQ ID NO: 9192552 - DNA, 22 bp, Homo sapiens
tgctatttggcacttttgacct

SEQ ID NO: 9192553 - DNA, 22 bp, Homo sapiens
tgctatttttatcttgatcaaa

SEQ ID NO: 9192554 - DNA, 22 bp, Homo sapiens
tgcgtttagtttcaagacacgt

SEQ ID NO: 9192555 - DNA, 22 bp, Homo sapiens
tgcgttgcgctcctgcagcagg

SEQ ID NO: 9192556 - DNA, 20 bp, Homo sapiens
tgcgtgtgtatttattttct

SEQ ID NO: 9192557 - DNA, 20 bp, Homo sapiens
tgcgtgtgtatttattttct

SEQ ID NO: 9192558 - DNA, 22 bp, Homo sapiens
tgcgtactgtttatacatgtgt

SEQ ID NO: 9192559 - DNA, 22 bp, Homo sapiens
tgcgggggaagctgtgggagaa

SEQ ID NO: 9192560 - DNA, 22 bp, Homo sapiens
tgcgggatgacagtggccaaca

SEQ ID NO: 9192561 - DNA, 22 bp, Homo sapiens
tgcgcatgagtctgtgcataca

SEQ ID NO: 9192562 - DNA, 22 bp, Homo sapiens
tgcgcaggagctctgccaggag

SEQ ID NO: 9192563 - DNA, 22 bp, Homo sapiens
tgcgcaggacacttgcagtgac

SEQ ID NO: 9192564 - DNA, 22 bp, Homo sapiens
tgcgcggctcagtcatctccag

SEQ ID NO: 9192565 - DNA, 19 bp, Homo sapiens
tgctcagctcctgtgagtc

SEQ ID NO: 9192566 - DNA, 19 bp, Homo sapiens
tgctcagctcctgtgagtc

SEQ ID NO: 9192567 - DNA, 22 bp, Homo sapiens
tgctcagcgccaaagctgatgg

SEQ ID NO: 9192568 - DNA, 22 bp, Homo sapiens
tgctcagcgccaaagctgatgg

SEQ ID NO: 9192569 - DNA, 21 bp, Homo sapiens
tgctcagattctccatctgga

SEQ ID NO: 9192570 - DNA, 22 bp, Homo sapiens
tgctcagattacagccccacat

SEQ ID NO: 9192571 - DNA, 22 bp, Homo sapiens
tgctcagacaagctgaacagta

SEQ ID NO: 9192572 - DNA, 18 bp, Homo sapiens
tgctcacactgacctctg

SEQ ID NO: 9192573 - DNA, 22 bp, Homo sapiens
tgctcaatgtcttatgagactg

SEQ ID NO: 9192574 - DNA, 23 bp, Homo sapiens
tgctcaatagaccataatatcca

SEQ ID NO: 9192575 - DNA, 22 bp, Homo sapiens
tgctatttttatcttgatcaaa

SEQ ID NO: 9192576 - DNA, 22 bp, Homo sapiens
tgctcactctattcacagtgcc

SEQ ID NO: 9192577 - DNA, 22 bp, Homo sapiens
tgctcactctattcacagtgcc

SEQ ID NO: 9192578 - DNA, 22 bp, Homo sapiens
tgctcacatatcacctacctaa

SEQ ID NO: 9192579 - DNA, 22 bp, Homo sapiens
tgctcacttatccagttccact

SEQ ID NO: 9192580 - DNA, 22 bp, Homo sapiens
tgctcagaaagccaccagagcg

SEQ ID NO: 9192581 - DNA, 22 bp, Homo sapiens
tgctcagaaagccaccagagcg

SEQ ID NO: 9192582 - DNA, 22 bp, Homo sapiens
tgctcagtcctcctgcagtgcc

SEQ ID NO: 9192583 - DNA, 22 bp, Homo sapiens
tgctcatcaacatgatgatcat

SEQ ID NO: 9192584 - DNA, 21 bp, Homo sapiens
tgctcatgagcccacagctgc

SEQ ID NO: 9192585 - DNA, 19 bp, Homo sapiens
tgctcatggggacttctcc

SEQ ID NO: 9192586 - DNA, 22 bp, Homo sapiens
tgctcagttaagcagaggaaat

SEQ ID NO: 9192587 - DNA, 22 bp, Homo sapiens
tgctcagttcaaggaaggtgga

SEQ ID NO: 9192588 - DNA, 22 bp, Homo sapiens
tgctccagaacctgaccatgct

SEQ ID NO: 9192589 - DNA, 22 bp, Homo sapiens
tgctccagaacctgaccatgct

SEQ ID NO: 9192590 - DNA, 22 bp, Homo sapiens
tgctccacctcccagctaacat

SEQ ID NO: 9192591 - DNA, 22 bp, Homo sapiens
tgctcattggcgatctgaggga

SEQ ID NO: 9192592 - DNA, 22 bp, Homo sapiens
tgcgaccctagccccctcactt

SEQ ID NO: 9192593 - DNA, 22 bp, Homo sapiens
tgccttttgaagcctcacaggt

SEQ ID NO: 9192594 - DNA, 22 bp, Homo sapiens
tgcctttgcaattgaggaggat

SEQ ID NO: 9192595 - DNA, 22 bp, Homo sapiens
tgcctttactataaaggatctg

SEQ ID NO: 9192596 - DNA, 22 bp, Homo sapiens
tgccttggaggaatgatgagag

SEQ ID NO: 9192597 - DNA, 22 bp, Homo sapiens
tgccttggaggaatgatgagag

SEQ ID NO: 9192598 - DNA, 22 bp, Homo sapiens
tgccttgcaggttttaaataca

SEQ ID NO: 9192599 - DNA, 22 bp, Homo sapiens
tgccttcttctccctggctcag

SEQ ID NO: 9192600 - DNA, 22 bp, Homo sapiens
tgccttcttctccctggctcag

SEQ ID NO: 9192601 - DNA, 22 bp, Homo sapiens
tgccttgcgggcgtttctgttg

SEQ ID NO: 9192602 - DNA, 20 bp, Homo sapiens
tgccttgccaagcctcctaa

SEQ ID NO: 9192603 - DNA, 22 bp, Homo sapiens
tgcctgtgtccccttcttggca

SEQ ID NO: 9192604 - DNA, 22 bp, Homo sapiens
tgcctgtgccctttgctgggag

SEQ ID NO: 9192605 - DNA, 22 bp, Homo sapiens
tgcctgtggaaaggctggtgct

SEQ ID NO: 9192606 - DNA, 22 bp, Homo sapiens
tgcctgtggttccagttttttc

SEQ ID NO: 9192607 - DNA, 22 bp, Homo sapiens
tgcctgggtgccctctgctcct

SEQ ID NO: 9192608 - DNA, 22 bp, Homo sapiens
tgcctgtcagggggagtgggaa

SEQ ID NO: 9192609 - DNA, 22 bp, Homo sapiens
tgcctgtcttggagtcctggcc

SEQ ID NO: 9192610 - DNA, 22 bp, Homo sapiens
tgcctgtctcctctgcagggtg

SEQ ID NO: 9192611 - DNA, 22 bp, Homo sapiens
tgcctgtcttaatatctggaaa

SEQ ID NO: 9192612 - DNA, 22 bp, Homo sapiens
tgcctggggattgctctgggcc

SEQ ID NO: 9192613 - DNA, 22 bp, Homo sapiens
tgcctggggattgctctgggcc

SEQ ID NO: 9192614 - DNA, 22 bp, Homo sapiens
tgcctggccctgacagccctgg

SEQ ID NO: 9192615 - DNA, 22 bp, Homo sapiens
tgcctggccctgacagccctgg

SEQ ID NO: 9192616 - DNA, 22 bp, Homo sapiens
tgcctggccctgacagccctgg

SEQ ID NO: 9192617 - DNA, 22 bp, Homo sapiens
tgcctggccagaccctatagag

SEQ ID NO: 9192618 - DNA, 22 bp, Homo sapiens
tgcctggcatgttatagacaca

SEQ ID NO: 9192619 - DNA, 22 bp, Homo sapiens
tgcctggctgaggtgacaggtt

SEQ ID NO: 9192620 - DNA, 22 bp, Homo sapiens
tgcctggctgaggtgacaggtt

SEQ ID NO: 9192621 - DNA, 22 bp, Homo sapiens
tgcctggctctatcagtggtgg

SEQ ID NO: 9192622 - DNA, 22 bp, Homo sapiens
tgctccagcgctgccaccagtt

SEQ ID NO: 9192623 - DNA, 22 bp, Homo sapiens
tgctccagctggagatgggggc

SEQ ID NO: 9192624 - DNA, 20 bp, Homo sapiens
tgctccaggaacactggccg

SEQ ID NO: 9192625 - DNA, 20 bp, Homo sapiens
tgctccaggaacactggccg

SEQ ID NO: 9192626 - DNA, 22 bp, Homo sapiens
tgctccagcccctggtgcacag

SEQ ID NO: 9192627 - DNA, 22 bp, Homo sapiens
tgctccagcccctggtgcacag

SEQ ID NO: 9192628 - DNA, 22 bp, Homo sapiens
tgctccagcgctgccaccagtt

SEQ ID NO: 9192629 - DNA, 22 bp, Homo sapiens
tgctccagcctatgctctccgg

SEQ ID NO: 9192630 - DNA, 22 bp, Homo sapiens
tgctccaggctgctgaagatct

SEQ ID NO: 9192631 - DNA, 22 bp, Homo sapiens
tgctccagggcctccagtgggg

SEQ ID NO: 9192632 - DNA, 22 bp, Homo sapiens
tgctccaggccgcctggggctg

SEQ ID NO: 9192633 - DNA, 22 bp, Homo sapiens
tgctccaggcaagctgagagtt

SEQ ID NO: 9192634 - DNA, 18 bp, Homo sapiens
tgctccaggcccatgggc

SEQ ID NO: 9192635 - DNA, 22 bp, Homo sapiens
tgctccaggcaagctgagagtt

SEQ ID NO: 9192636 - DNA, 18 bp, Homo sapiens
tgctccaggcccatgggc

SEQ ID NO: 9192637 - DNA, 22 bp, Homo sapiens
tgctccctgctcagagaggcca

SEQ ID NO: 9192638 - DNA, 22 bp, Homo sapiens
tgctccctgacccaggtcttct

SEQ ID NO: 9192639 - DNA, 22 bp, Homo sapiens
tgctcccatgtgtgggtacaga

SEQ ID NO: 9192640 - DNA, 23 bp, Homo sapiens
tgctcccaggtgacgctgctgtt

SEQ ID NO: 9192641 - DNA, 22 bp, Homo sapiens
tgctcctaaacctcttggaatg

SEQ ID NO: 9192642 - DNA, 22 bp, Homo sapiens
tgctccgggaaagagcagccgc

SEQ ID NO: 9192643 - DNA, 22 bp, Homo sapiens
tgctcccttgccagaggggaag

SEQ ID NO: 9192644 - DNA, 22 bp, Homo sapiens
tgctcccttgccagaggggaag

SEQ ID NO: 9192645 - DNA, 20 bp, Homo sapiens
tgctcccttgcgagtcgctg

SEQ ID NO: 9192646 - DNA, 22 bp, Homo sapiens
tgctcccaggactcttgagcca

SEQ ID NO: 9192647 - DNA, 22 bp, Homo sapiens
tgctcctgatatctaatgtgta

SEQ ID NO: 9192648 - DNA, 22 bp, Homo sapiens
tgctcctgctgcatgcatctcc

SEQ ID NO: 9192649 - DNA, 22 bp, Homo sapiens
tgctcctgctcctcccggttga

SEQ ID NO: 9192650 - DNA, 22 bp, Homo sapiens
tgctcctgctgcatgcatctcc

SEQ ID NO: 9192651 - DNA, 22 bp, Homo sapiens
tgctcctgctgcatgcatctcc

SEQ ID NO: 9192652 - DNA, 22 bp, Homo sapiens
tgctcctgctgcatgcatctcc

SEQ ID NO: 9192653 - DNA, 22 bp, Homo sapiens
tgctcctgctggccctcgtgcc

SEQ ID NO: 9192654 - DNA, 22 bp, Homo sapiens
tgctcctgctggccctcgtgcc

SEQ ID NO: 9192655 - DNA, 22 bp, Homo sapiens
tgctcctgctggccctcgtgcc

SEQ ID NO: 9192656 - DNA, 22 bp, Homo sapiens
tgctcctgctggccctcgtgcc

SEQ ID NO: 9192657 - DNA, 22 bp, Homo sapiens
tgctcctgaattacactactac

SEQ ID NO: 9192658 - DNA, 22 bp, Homo sapiens
tgctccttcctcatcctgtgca

SEQ ID NO: 9192659 - DNA, 22 bp, Homo sapiens
tgctcctttcatccaattctca

SEQ ID NO: 9192660 - DNA, 22 bp, Homo sapiens
tgctcgctgactcaacaagctt

SEQ ID NO: 9192661 - DNA, 22 bp, Homo sapiens
tgctcgccccacatgccctcat

SEQ ID NO: 9192662 - DNA, 22 bp, Homo sapiens
tgctcgcgctgttccagcagct

SEQ ID NO: 9192663 - DNA, 22 bp, Homo sapiens
tgctctaagaactctaggaatt

SEQ ID NO: 9192664 - DNA, 22 bp, Homo sapiens
tgctctatatgtctgttttgag

SEQ ID NO: 9192665 - DNA, 22 bp, Homo sapiens
tgctctatgggacacttctgct

SEQ ID NO: 9192666 - DNA, 22 bp, Homo sapiens
tgctcctggcttcaggttgggc

SEQ ID NO: 9192667 - DNA, 22 bp, Homo sapiens
tgctcctggcttcaggttgggc

SEQ ID NO: 9192668 - DNA, 22 bp, Homo sapiens
tgctcctggcttcaggttgggc

SEQ ID NO: 9192669 - DNA, 22 bp, Homo sapiens
tgctcctggatgaggtactcca

SEQ ID NO: 9192670 - DNA, 22 bp, Homo sapiens
tgctcctggatgaggtactcca

SEQ ID NO: 9192671 - DNA, 22 bp, Homo sapiens
tgctcctggcatctctgcgtcc

SEQ ID NO: 9192672 - DNA, 22 bp, Homo sapiens
tgctcctggatgaggtactcca

SEQ ID NO: 9192673 - DNA, 22 bp, Homo sapiens
tgctcctggatgaggtactcca

SEQ ID NO: 9192674 - DNA, 17 bp, Homo sapiens
tgctcctgtggcagcct

SEQ ID NO: 9192675 - DNA, 17 bp, Homo sapiens
tgctcctgggacaagga

SEQ ID NO: 9192676 - DNA, 22 bp, Homo sapiens
tgctcctgggctgaagcacact

SEQ ID NO: 9192677 - DNA, 17 bp, Homo sapiens
tgctcctgtggcagcct

SEQ ID NO: 9192678 - DNA, 22 bp, Homo sapiens
tgctctgggattcagcagcctg

SEQ ID NO: 9192679 - DNA, 23 bp, Homo sapiens
tgctctgggaggccctggagagc

SEQ ID NO: 9192680 - DNA, 23 bp, Homo sapiens
tgctctgggaggccctggagagc

SEQ ID NO: 9192681 - DNA, 23 bp, Homo sapiens
tgctctgggaggccctggagagc

SEQ ID NO: 9192682 - DNA, 22 bp, Homo sapiens
tgctctggctgggatgagtgca

SEQ ID NO: 9192683 - DNA, 22 bp, Homo sapiens
tgctctggctggagcaatgact

SEQ ID NO: 9192684 - DNA, 19 bp, Homo sapiens
tgctctctggtgcttcatg

SEQ ID NO: 9192685 - DNA, 22 bp, Homo sapiens
tgctctcctgctcctcagccca

SEQ ID NO: 9192686 - DNA, 22 bp, Homo sapiens
tgctctcctgctcctcagccca

SEQ ID NO: 9192687 - DNA, 22 bp, Homo sapiens
tgctctgggctcaatggcagct

SEQ ID NO: 9192688 - DNA, 22 bp, Homo sapiens
tgctctgggctcaatggcagct

SEQ ID NO: 9192689 - DNA, 22 bp, Homo sapiens
tgctctgggctcaatggcagct

SEQ ID NO: 9192690 - DNA, 22 bp, Homo sapiens
tgctctgggctatctgagaaag

SEQ ID NO: 9192691 - DNA, 22 bp, Homo sapiens
tgctctgggctatctgagaaag

SEQ ID NO: 9192692 - DNA, 22 bp, Homo sapiens
tgctctgggcaacagcctccct

SEQ ID NO: 9192693 - DNA, 22 bp, Homo sapiens
tgctctgggcaacagcctccct

SEQ ID NO: 9192694 - DNA, 22 bp, Homo sapiens
tgctctgggattcagcagcctg

SEQ ID NO: 9192695 - DNA, 22 bp, Homo sapiens
tgctctgggattcagcagcctg

SEQ ID NO: 9192696 - DNA, 22 bp, Homo sapiens
tgctctggggagctcctctgcg

SEQ ID NO: 9192697 - DNA, 22 bp, Homo sapiens
tgctctggggagctcctctgcg

SEQ ID NO: 9192698 - DNA, 22 bp, Homo sapiens
tgctctggggctccccaccaga

SEQ ID NO: 9192699 - DNA, 22 bp, Homo sapiens
tgctctgggggaagccagctgt

SEQ ID NO: 9192700 - DNA, 20 bp, Homo sapiens
tgctgaggttgacatgccca

SEQ ID NO: 9192701 - DNA, 22 bp, Homo sapiens
tgctgagggctgttaaggaagc

SEQ ID NO: 9192702 - DNA, 22 bp, Homo sapiens
tgctgaggctagacctggaagt

SEQ ID NO: 9192703 - DNA, 22 bp, Homo sapiens
tgctgaggcagatgtctgtgac

SEQ ID NO: 9192704 - DNA, 22 bp, Homo sapiens
tgctgaggcagtcctaacagga

SEQ ID NO: 9192705 - DNA, 22 bp, Homo sapiens
tgctgaggcccaggagcacttt

SEQ ID NO: 9192706 - DNA, 22 bp, Homo sapiens
tgctgaggcccaggagcacttt

SEQ ID NO: 9192707 - DNA, 22 bp, Homo sapiens
tgctgaggtttcgtctgcttgc

SEQ ID NO: 9192708 - DNA, 22 bp, Homo sapiens
tgctgaggtttctgactatgga

SEQ ID NO: 9192709 - DNA, 22 bp, Homo sapiens
tgctgaggtttctgactatgga

SEQ ID NO: 9192710 - DNA, 22 bp, Homo sapiens
tgctgaggttgtggagtgcatt

SEQ ID NO: 9192711 - DNA, 21 bp, Homo sapiens
tgctgatgtcagagaagcaag

SEQ ID NO: 9192712 - DNA, 22 bp, Homo sapiens
tgctgattttgcctactgatcc

SEQ ID NO: 9192713 - DNA, 22 bp, Homo sapiens
tgctgcaaagctggccagtagc

SEQ ID NO: 9192714 - DNA, 22 bp, Homo sapiens
tgctgatatattctagttttct

SEQ ID NO: 9192715 - DNA, 22 bp, Homo sapiens
tgctgatgagtccttctatcgc

SEQ ID NO: 9192716 - DNA, 22 bp, Homo sapiens
tgctgatgctgttctgttagga

SEQ ID NO: 9192717 - DNA, 22 bp, Homo sapiens
tgctgcaggtgtgttcagtgag

SEQ ID NO: 9192718 - DNA, 22 bp, Homo sapiens
tgctgcagtatatatttcttgg

SEQ ID NO: 9192719 - DNA, 19 bp, Homo sapiens
tgctgcagtcaggcgaggg

SEQ ID NO: 9192720 - DNA, 22 bp, Homo sapiens
tgctgcagttattgaaactatg

SEQ ID NO: 9192721 - DNA, 22 bp, Homo sapiens
tgctgcagttcaccctgccgtc

SEQ ID NO: 9192722 - DNA, 22 bp, Homo sapiens
tgctgcagtgggattagcctga

SEQ ID NO: 9192723 - DNA, 22 bp, Homo sapiens
tgctgcagtgtttgctgaagtt

SEQ ID NO: 9192724 - DNA, 22 bp, Homo sapiens
tgctgcagggatttcagagaca

SEQ ID NO: 9192725 - DNA, 22 bp, Homo sapiens
tgctgcagggccttccctgcat

SEQ ID NO: 9192726 - DNA, 22 bp, Homo sapiens
tgctgcagggccttccctgcat

SEQ ID NO: 9192727 - DNA, 22 bp, Homo sapiens
tgctgcagggccttccctgcat

SEQ ID NO: 9192728 - DNA, 22 bp, Homo sapiens
tgctgcagggccttccctgcat

SEQ ID NO: 9192729 - DNA, 22 bp, Homo sapiens
tgctgcaggccttggctgggaa

SEQ ID NO: 9192730 - DNA, 20 bp, Homo sapiens
tgctctgggggtggagagac

SEQ ID NO: 9192731 - DNA, 20 bp, Homo sapiens
tgctctgggggtggagagac

SEQ ID NO: 9192732 - DNA, 20 bp, Homo sapiens
tgctctgggggtggagagac

SEQ ID NO: 9192733 - DNA, 22 bp, Homo sapiens
tgctctgggtcctgggcctcct

SEQ ID NO: 9192734 - DNA, 22 bp, Homo sapiens
tgctctggtaactcacttccat

SEQ ID NO: 9192735 - DNA, 22 bp, Homo sapiens
tgctctggtaactcacttccat

SEQ ID NO: 9192736 - DNA, 22 bp, Homo sapiens
tgctctggtcctccctcggcgc

SEQ ID NO: 9192737 - DNA, 18 bp, Homo sapiens
tgctctggtctcacttgg

SEQ ID NO: 9192738 - DNA, 18 bp, Homo sapiens
tgctctggtctcacttgg

SEQ ID NO: 9192739 - DNA, 22 bp, Homo sapiens
tgctcttcaccattacatcatg

SEQ ID NO: 9192740 - DNA, 22 bp, Homo sapiens
tgctcttcacagtttcagcatc

SEQ ID NO: 9192741 - DNA, 18 bp, Homo sapiens
tgctctgtttaatgattt

SEQ ID NO: 9192742 - DNA, 22 bp, Homo sapiens
tgctctgtattctatggcagtt

SEQ ID NO: 9192743 - DNA, 22 bp, Homo sapiens
tgctctgtaggggaaagagagc

SEQ ID NO: 9192744 - DNA, 22 bp, Homo sapiens
tgctctgtcaagaaaagatgcc

SEQ ID NO: 9192745 - DNA, 22 bp, Homo sapiens
tgctgaaacaataacatactgg

SEQ ID NO: 9192746 - DNA, 22 bp, Homo sapiens
tgctgaaaactcaaccattgtg

SEQ ID NO: 9192747 - DNA, 22 bp, Homo sapiens
tgctgaaaagtaaataggccta

SEQ ID NO: 9192748 - DNA, 22 bp, Homo sapiens
tgctgaaggcaggggaggtggc

SEQ ID NO: 9192749 - DNA, 20 bp, Homo sapiens
tgctgaagaatcacagatgg

SEQ ID NO: 9192750 - DNA, 22 bp, Homo sapiens
tgctgaaggcaggggaggtggc

SEQ ID NO: 9192751 - DNA, 22 bp, Homo sapiens
tgctgaaagtcccaaatctcat

SEQ ID NO: 9192752 - DNA, 22 bp, Homo sapiens
tgctgaaatatttatgggtcaa

SEQ ID NO: 9192753 - DNA, 22 bp, Homo sapiens
tgctgagcgcatccggcggccg

SEQ ID NO: 9192754 - DNA, 22 bp, Homo sapiens
tgctgagcgcatccggcggccg

SEQ ID NO: 9192755 - DNA, 22 bp, Homo sapiens
tgctgagcgcatccggcggccg

SEQ ID NO: 9192756 - DNA, 22 bp, Homo sapiens
tgctgaagggaaggtcttgaat

SEQ ID NO: 9192757 - DNA, 22 bp, Homo sapiens
tgctgagatgaatagggctgtc

SEQ ID NO: 9192758 - DNA, 21 bp, Homo sapiens
tgctgagatttgcctgattac

SEQ ID NO: 9192759 - DNA, 22 bp, Homo sapiens
tgctgaggacacctagccttct

SEQ ID NO: 9192760 - DNA, 22 bp, Homo sapiens
tgctgaggactaaaggagatga

SEQ ID NO: 9192761 - DNA, 22 bp, Homo sapiens
tgctgaggaggtggctgtgctt

SEQ ID NO: 9192762 - DNA, 19 bp, Homo sapiens
tgctgaggatgcaagatcc

SEQ ID NO: 9192763 - DNA, 22 bp, Homo sapiens
tgctgaggaggtggctgtgctt

SEQ ID NO: 9192764 - DNA, 22 bp, Homo sapiens
tgcttctcccaaccagggcctg

SEQ ID NO: 9192765 - DNA, 22 bp, Homo sapiens
tgcttctctctaggaagacgct

SEQ ID NO: 9192766 - DNA, 23 bp, Homo sapiens
tgcttctctgcttgacagttctg

SEQ ID NO: 9192767 - DNA, 22 bp, Homo sapiens
tgcttctcagcctgtctggaaa

SEQ ID NO: 9192768 - DNA, 22 bp, Homo sapiens
tgcttctcaaagaagcataatg

SEQ ID NO: 9192769 - DNA, 22 bp, Homo sapiens
tgcttctcaaaaggaggtaggt

SEQ ID NO: 9192770 - DNA, 22 bp, Homo sapiens
tgcttctgctcagcttcctact

SEQ ID NO: 9192771 - DNA, 22 bp, Homo sapiens
tgcttctgcaggagctcctgat

SEQ ID NO: 9192772 - DNA, 22 bp, Homo sapiens
tgcttctgatgtgagcagcccc

SEQ ID NO: 9192773 - DNA, 22 bp, Homo sapiens
tgcttctgaagtggatgggtgc

SEQ ID NO: 9192774 - DNA, 22 bp, Homo sapiens
tgcttcagtgtgtcattattta

SEQ ID NO: 9192775 - DNA, 22 bp, Homo sapiens
tgcttccaggaatccatctggc

SEQ ID NO: 9192776 - DNA, 22 bp, Homo sapiens
tgcttccactaatgagctgtgt

SEQ ID NO: 9192777 - DNA, 22 bp, Homo sapiens
tgcttcaaggccatgtcaagct

SEQ ID NO: 9192778 - DNA, 22 bp, Homo sapiens
tgcttcaaggccatgtcaagct

SEQ ID NO: 9192779 - DNA, 22 bp, Homo sapiens
tgcttcagaggaaaggcaaaag

SEQ ID NO: 9192780 - DNA, 22 bp, Homo sapiens
tgcttcagagacatcctactca

SEQ ID NO: 9192781 - DNA, 22 bp, Homo sapiens
tgcttcagagacatcctactca

SEQ ID NO: 9192782 - DNA, 22 bp, Homo sapiens
tgcttcagagacatcctactca

SEQ ID NO: 9192783 - DNA, 22 bp, Homo sapiens
tgctgtgaggttgagaaggaag

SEQ ID NO: 9192784 - DNA, 22 bp, Homo sapiens
tgctgtgaggttgagaaggaag

SEQ ID NO: 9192785 - DNA, 22 bp, Homo sapiens
tgctgtgagaccatttgttgag

SEQ ID NO: 9192786 - DNA, 22 bp, Homo sapiens
tgcttaaaaagctccatcaata

SEQ ID NO: 9192787 - DNA, 22 bp, Homo sapiens
tgcttaaaaagctccatcaata

SEQ ID NO: 9192788 - DNA, 22 bp, Homo sapiens
tgcttaaaaacagtatggtagt

SEQ ID NO: 9192789 - DNA, 22 bp, Homo sapiens
tgcttaaaatgatgattatttt

SEQ ID NO: 9192790 - DNA, 22 bp, Homo sapiens
tgcttaaaatagttcatttttg

SEQ ID NO: 9192791 - DNA, 20 bp, Homo sapiens
tgctgtcgtgttttctgctt

SEQ ID NO: 9192792 - DNA, 22 bp, Homo sapiens
tgctgtctgattcagggtgatt

SEQ ID NO: 9192793 - DNA, 22 bp, Homo sapiens
tgctgtctttcattgtctgcct

SEQ ID NO: 9192794 - DNA, 22 bp, Homo sapiens
tgctgtcttctctgaggtccct

SEQ ID NO: 9192795 - DNA, 22 bp, Homo sapiens
tgctgtcttccaggatggtgaa

SEQ ID NO: 9192796 - DNA, 22 bp, Homo sapiens
tgctgtctgtttactggctata

SEQ ID NO: 9192797 - DNA, 22 bp, Homo sapiens
tgctgtctttttcccttcctaa

SEQ ID NO: 9192798 - DNA, 22 bp, Homo sapiens
tgctgtcttttcccaatcctgg

SEQ ID NO: 9192799 - DNA, 22 bp, Homo sapiens
tgcttaatcaagaagcctattt

SEQ ID NO: 9192800 - DNA, 22 bp, Homo sapiens
tgcttaggctaacaaaaatagc

SEQ ID NO: 9192801 - DNA, 22 bp, Homo sapiens
tgcttagggctcctccaataga

SEQ ID NO: 9192802 - DNA, 22 bp, Homo sapiens
tgcttaggtgttatgtaatatc

SEQ ID NO: 9192803 - DNA, 17 bp, Homo sapiens
tgcttataaactctgct

SEQ ID NO: 9192804 - DNA, 22 bp, Homo sapiens
tgcttaggttggtctagaccat

SEQ ID NO: 9192805 - DNA, 22 bp, Homo sapiens
tgcttatatttcattggcccaa

SEQ ID NO: 9192806 - DNA, 22 bp, Homo sapiens
tgcttatccaggcaatgcattc

SEQ ID NO: 9192807 - DNA, 22 bp, Homo sapiens
tgcttataaagatattagtttc

SEQ ID NO: 9192808 - DNA, 22 bp, Homo sapiens
tgcttaaacatactatttatat

SEQ ID NO: 9192809 - DNA, 22 bp, Homo sapiens
tgcttaaaccctgatcatgtgt

SEQ ID NO: 9192810 - DNA, 22 bp, Homo sapiens
tgcttaaaccctgatcatgtgt

SEQ ID NO: 9192811 - DNA, 22 bp, Homo sapiens
tgcttaaaccctgatcatgtgt

SEQ ID NO: 9192812 - DNA, 22 bp, Homo sapiens
tgctgggttacctaagcctaaa

SEQ ID NO: 9192813 - DNA, 22 bp, Homo sapiens
tgctgggttacctaagcctaaa

SEQ ID NO: 9192814 - DNA, 22 bp, Homo sapiens
tgctgggtggttgctcctcccg

SEQ ID NO: 9192815 - DNA, 22 bp, Homo sapiens
tgctgggtcccttgagagctca

SEQ ID NO: 9192816 - DNA, 20 bp, Homo sapiens
tgctgggtgggcagctgtaa

SEQ ID NO: 9192817 - DNA, 22 bp, Homo sapiens
tgctggtgaggtccttgctgga

SEQ ID NO: 9192818 - DNA, 22 bp, Homo sapiens
tgctggtgattaaatcctgaag

SEQ ID NO: 9192819 - DNA, 22 bp, Homo sapiens
tgctggtggagaaagtggaggt

SEQ ID NO: 9192820 - DNA, 22 bp, Homo sapiens
tgctggtggagaaagtggaggt

SEQ ID NO: 9192821 - DNA, 22 bp, Homo sapiens
tgctggtgattaaatcctgaag

SEQ ID NO: 9192822 - DNA, 21 bp, Homo sapiens
tgctggtgagctcatgtggct

SEQ ID NO: 9192823 - DNA, 23 bp, Homo sapiens
tgctggtgtttttgggaccaggg

SEQ ID NO: 9192824 - DNA, 23 bp, Homo sapiens
tgctggtgtttttgggaccaggg

SEQ ID NO: 9192825 - DNA, 23 bp, Homo sapiens
tgctggttcaaaaaggaaggagg

SEQ ID NO: 9192826 - DNA, 20 bp, Homo sapiens
tgctggttacaccaccaagg

SEQ ID NO: 9192827 - DNA, 22 bp, Homo sapiens
tgctggttcttaagatgcctcc

SEQ ID NO: 9192828 - DNA, 22 bp, Homo sapiens
tgctgtagggagaaagagttga

SEQ ID NO: 9192829 - DNA, 22 bp, Homo sapiens
tgctgtcagttggcaggatgag

SEQ ID NO: 9192830 - DNA, 22 bp, Homo sapiens
tgctgtcagacagcagtggtaa

SEQ ID NO: 9192831 - DNA, 22 bp, Homo sapiens
tgctgtcaaggttacatgcttt

SEQ ID NO: 9192832 - DNA, 22 bp, Homo sapiens
tgctggggcagaagagccaaga

SEQ ID NO: 9192833 - DNA, 22 bp, Homo sapiens
tgctggggcagaagagccaaga

SEQ ID NO: 9192834 - DNA, 22 bp, Homo sapiens
tgctggggcagaagagccaaga

SEQ ID NO: 9192835 - DNA, 22 bp, Homo sapiens
tgctggggcagaagagccaaga

SEQ ID NO: 9192836 - DNA, 22 bp, Homo sapiens
tgctggggctctgaccactcca

SEQ ID NO: 9192837 - DNA, 16 bp, Homo sapiens
tgctggggcgccgtcc

SEQ ID NO: 9192838 - DNA, 22 bp, Homo sapiens
tgctggggagtgattgaccatc

SEQ ID NO: 9192839 - DNA, 22 bp, Homo sapiens
tgctggggagtgattgaccatc

SEQ ID NO: 9192840 - DNA, 22 bp, Homo sapiens
tgctggggatccgtaccaaccc

SEQ ID NO: 9192841 - DNA, 20 bp, Homo sapiens
tgctggggacatacagggtg

SEQ ID NO: 9192842 - DNA, 20 bp, Homo sapiens
tgctggggacatacagggtg

SEQ ID NO: 9192843 - DNA, 22 bp, Homo sapiens
tgctgggcttgaaagctgctaa

SEQ ID NO: 9192844 - DNA, 20 bp, Homo sapiens
tgctggggacatacagggtg

SEQ ID NO: 9192845 - DNA, 20 bp, Homo sapiens
tgctggggacatacagggtg

SEQ ID NO: 9192846 - DNA, 22 bp, Homo sapiens
tgctggggtcatggggcgcccg

SEQ ID NO: 9192847 - DNA, 23 bp, Homo sapiens
tgctggggtagtttgtggcacag

SEQ ID NO: 9192848 - DNA, 23 bp, Homo sapiens
tgctggggtagtttgtggcacag

SEQ ID NO: 9192849 - DNA, 22 bp, Homo sapiens
tgctggggtcatggggcgcccg

SEQ ID NO: 9192850 - DNA, 22 bp, Homo sapiens
tgctggggtctctccggtgccc

SEQ ID NO: 9192851 - DNA, 22 bp, Homo sapiens
tgctggggtctctccggtgccc

SEQ ID NO: 9192852 - DNA, 22 bp, Homo sapiens
tgctggggtctctccggtgccc

SEQ ID NO: 9192853 - DNA, 23 bp, Homo sapiens
tgctgggtatcagaatcactgag

SEQ ID NO: 9192854 - DNA, 18 bp, Homo sapiens
tgctgggtaactgtatgg

SEQ ID NO: 9192855 - DNA, 22 bp, Homo sapiens
tgctgggtagaagtattagtct

SEQ ID NO: 9192856 - DNA, 22 bp, Homo sapiens
tgctgggcactgtctctgggga

SEQ ID NO: 9192857 - DNA, 22 bp, Homo sapiens
tgctggcttcctgtgcacagca

SEQ ID NO: 9192858 - DNA, 22 bp, Homo sapiens
tgctggcttcctgtgcacagca

SEQ ID NO: 9192859 - DNA, 22 bp, Homo sapiens
tgctggcttcctgtgcacagca

SEQ ID NO: 9192860 - DNA, 22 bp, Homo sapiens
tgctgggcatcgtaggaggtac

SEQ ID NO: 9192861 - DNA, 23 bp, Homo sapiens
tgctgggcagagctggtgctgag

SEQ ID NO: 9192862 - DNA, 22 bp, Homo sapiens
tgctgggcagtgtgccctcgag

SEQ ID NO: 9192863 - DNA, 22 bp, Homo sapiens
tgctgggcagtgtgccctcgag

SEQ ID NO: 9192864 - DNA, 22 bp, Homo sapiens
tgctgggccaaagcagggtttt

SEQ ID NO: 9192865 - DNA, 22 bp, Homo sapiens
tgctgggcatttttatggctcc

SEQ ID NO: 9192866 - DNA, 20 bp, Homo sapiens
tgctgggcatgcagtggaaa

SEQ ID NO: 9192867 - DNA, 18 bp, Homo sapiens
tgctgggcattaggctta

SEQ ID NO: 9192868 - DNA, 20 bp, Homo sapiens
tgctgggccatcttgcatgc

SEQ ID NO: 9192869 - DNA, 22 bp, Homo sapiens
tgctgggcccagggagcctctg

SEQ ID NO: 9192870 - DNA, 22 bp, Homo sapiens
tgctgggctagggtggagctct

SEQ ID NO: 9192871 - DNA, 22 bp, Homo sapiens
tgctgggctagggtggagctct

SEQ ID NO: 9192872 - DNA, 22 bp, Homo sapiens
tgctgggctagggtggagctct

SEQ ID NO: 9192873 - DNA, 22 bp, Homo sapiens
tgctgggctagaagctgaggcc

SEQ ID NO: 9192874 - DNA, 22 bp, Homo sapiens
tgctgggctagaagctgaggcc

SEQ ID NO: 9192875 - DNA, 22 bp, Homo sapiens
tgctgggctgttcctgtccatg

SEQ ID NO: 9192876 - DNA, 22 bp, Homo sapiens
tgctgggcttcaactgcctgag

SEQ ID NO: 9192877 - DNA, 22 bp, Homo sapiens
tgctgggcttcaactgcctgag

SEQ ID NO: 9192878 - DNA, 22 bp, Homo sapiens
tgctgggctggagctgccaggg

SEQ ID NO: 9192879 - DNA, 21 bp, Homo sapiens
tgctgggctgcaggggatgca

SEQ ID NO: 9192880 - DNA, 22 bp, Homo sapiens
tgctgggctggagctgccaggg

SEQ ID NO: 9192881 - DNA, 21 bp, Homo sapiens
tgctgggctgcaggggatgca

SEQ ID NO: 9192882 - DNA, 22 bp, Homo sapiens
tgctgcttgttttgtaaataaa

SEQ ID NO: 9192883 - DNA, 22 bp, Homo sapiens
tgctgctttaaaaagtgctgat

SEQ ID NO: 9192884 - DNA, 22 bp, Homo sapiens
tgctgctttgatgtgtaaatca

SEQ ID NO: 9192885 - DNA, 22 bp, Homo sapiens
tgctgctgtttcctacatctca

SEQ ID NO: 9192886 - DNA, 22 bp, Homo sapiens
tgctgctgtttcctacatctca

SEQ ID NO: 9192887 - DNA, 22 bp, Homo sapiens
tgctgcttcacctgttgtacag

SEQ ID NO: 9192888 - DNA, 22 bp, Homo sapiens
tgctgctgatggcacctaggca

SEQ ID NO: 9192889 - DNA, 19 bp, Homo sapiens
tgctgctgtccttgcaggg

SEQ ID NO: 9192890 - DNA, 22 bp, Homo sapiens
tgctgctgtatccttagtgtca

SEQ ID NO: 9192891 - DNA, 22 bp, Homo sapiens
tgctggacagggcacggcccat

SEQ ID NO: 9192892 - DNA, 22 bp, Homo sapiens
tgctggaaataggcattgtagc

SEQ ID NO: 9192893 - DNA, 21 bp, Homo sapiens
tgctggaggacagggtttcat

SEQ ID NO: 9192894 - DNA, 22 bp, Homo sapiens
tgctggagctccgggctgtagg

SEQ ID NO: 9192895 - DNA, 22 bp, Homo sapiens
tgctggagaagctcctgggact

SEQ ID NO: 9192896 - DNA, 22 bp, Homo sapiens
tgctggagcccaggcggccttt

SEQ ID NO: 9192897 - DNA, 22 bp, Homo sapiens
tgctggagcggaggtgagccag

SEQ ID NO: 9192898 - DNA, 22 bp, Homo sapiens
tgctgccatgcagagcaacaga

SEQ ID NO: 9192899 - DNA, 18 bp, Homo sapiens
tgctgcccaactctcccc

SEQ ID NO: 9192900 - DNA, 23 bp, Homo sapiens
tgctgcccactcttccagccctc

SEQ ID NO: 9192901 - DNA, 23 bp, Homo sapiens
tgctgcccactcttccagccctc

SEQ ID NO: 9192902 - DNA, 23 bp, Homo sapiens
tgctgccctgccttcagctctcc

SEQ ID NO: 9192903 - DNA, 22 bp, Homo sapiens
tgctgctcttcaccatggcctc

SEQ ID NO: 9192904 - DNA, 22 bp, Homo sapiens
tgctgctcgccacggcccaggg

SEQ ID NO: 9192905 - DNA, 22 bp, Homo sapiens
tgctgctccccagcacacagca

SEQ ID NO: 9192906 - DNA, 22 bp, Homo sapiens
tgctgctcctgcctggctccca

SEQ ID NO: 9192907 - DNA, 22 bp, Homo sapiens
tgctgctcctgcctggctccca

SEQ ID NO: 9192908 - DNA, 22 bp, Homo sapiens
tgctgctgaggctaaagtatag

SEQ ID NO: 9192909 - DNA, 22 bp, Homo sapiens
tgctgctgatcatttatagtct

SEQ ID NO: 9192910 - DNA, 22 bp, Homo sapiens
tgctgccactggtagtctcatt

SEQ ID NO: 9192911 - DNA, 22 bp, Homo sapiens
tgctgccacctgtggtagtctg

SEQ ID NO: 9192912 - DNA, 18 bp, Homo sapiens
tgctgccagatctatttc

SEQ ID NO: 9192913 - DNA, 21 bp, Homo sapiens
tgctgccatagacctgaggga

SEQ ID NO: 9192914 - DNA, 22 bp, Homo sapiens
tgctgccaggtcttgctgtcca

SEQ ID NO: 9192915 - DNA, 22 bp, Homo sapiens
tgctgccaatttctggtcttga

SEQ ID NO: 9192916 - DNA, 22 bp, Homo sapiens
tgctgccacaaattcagctgcc

SEQ ID NO: 9192917 - DNA, 20 bp, Homo sapiens
tgctgcagtttcatgggact

SEQ ID NO: 9192918 - DNA, 22 bp, Homo sapiens
tgctgcatttgcagtcctttaa

SEQ ID NO: 9192919 - DNA, 22 bp, Homo sapiens
tgctggagttcgacattgcaaa

SEQ ID NO: 9192920 - DNA, 22 bp, Homo sapiens
tgctggagttcgacattgcaaa

SEQ ID NO: 9192921 - DNA, 22 bp, Homo sapiens
tgctggagtggcactgtgtggc

SEQ ID NO: 9192922 - DNA, 22 bp, Homo sapiens
tgctggagtggcactgtgtggc

SEQ ID NO: 9192923 - DNA, 22 bp, Homo sapiens
tgctggagtgagtggtttctta

SEQ ID NO: 9192924 - DNA, 22 bp, Homo sapiens
tgctggagtgagtggtttctta

SEQ ID NO: 9192925 - DNA, 23 bp, Homo sapiens
tgctggagtttactcaggccagc

SEQ ID NO: 9192926 - DNA, 22 bp, Homo sapiens
tgctggcagtggcagtgatggt

SEQ ID NO: 9192927 - DNA, 22 bp, Homo sapiens
tgctggcatactctctttgttg

SEQ ID NO: 9192928 - DNA, 22 bp, Homo sapiens
tgctggcacatagagactggct

SEQ ID NO: 9192929 - DNA, 22 bp, Homo sapiens
tgctggcacgtgactgggaagt

SEQ ID NO: 9192930 - DNA, 22 bp, Homo sapiens
tgctggcagaaggctcgtggaa

SEQ ID NO: 9192931 - DNA, 22 bp, Homo sapiens
tgctggcacgtggaccaggaga

SEQ ID NO: 9192932 - DNA, 19 bp, Homo sapiens
tgctggagggtagtgagtc

SEQ ID NO: 9192933 - DNA, 22 bp, Homo sapiens
tgctggagggggtaccactcaa

SEQ ID NO: 9192934 - DNA, 22 bp, Homo sapiens
tgctggaggggcctgaccagga

SEQ ID NO: 9192935 - DNA, 22 bp, Homo sapiens
tgctggaggggcctgaccagga

SEQ ID NO: 9192936 - DNA, 17 bp, Homo sapiens
tgctggaggcggggtat

SEQ ID NO: 9192937 - DNA, 17 bp, Homo sapiens
tgctggaggcggggtat

SEQ ID NO: 9192938 - DNA, 22 bp, Homo sapiens
tgctggaggggatgccttcact

SEQ ID NO: 9192939 - DNA, 22 bp, Homo sapiens
tgctggaggggatgccttcact

SEQ ID NO: 9192940 - DNA, 19 bp, Homo sapiens
tgctggaggttgacagggt

SEQ ID NO: 9192941 - DNA, 19 bp, Homo sapiens
tgctggaggttgacagggt

SEQ ID NO: 9192942 - DNA, 22 bp, Homo sapiens
tgctggagtaacaagacactca

SEQ ID NO: 9192943 - DNA, 22 bp, Homo sapiens
tgctggagtaacaagacactca

SEQ ID NO: 9192944 - DNA, 22 bp, Homo sapiens
tgctggagtaacaagacactca

SEQ ID NO: 9192945 - DNA, 22 bp, Homo sapiens
tgctggagtctcttgaccctgg

SEQ ID NO: 9192946 - DNA, 22 bp, Homo sapiens
tgctggaggccgagaagcagca

SEQ ID NO: 9192947 - DNA, 22 bp, Homo sapiens
tgctggaggccgagaagcagca

SEQ ID NO: 9192948 - DNA, 22 bp, Homo sapiens
tgctggaggcctgactgtgttt

SEQ ID NO: 9192949 - DNA, 22 bp, Homo sapiens
tgctggaggcctgactgtgttt

SEQ ID NO: 9192950 - DNA, 20 bp, Homo sapiens
tgctggaggcgccggcgctc

SEQ ID NO: 9192951 - DNA, 22 bp, Homo sapiens
tgctggaggagtttactgtggc

SEQ ID NO: 9192952 - DNA, 22 bp, Homo sapiens
tgctggaggcagtggaggtgcc

SEQ ID NO: 9192953 - DNA, 22 bp, Homo sapiens
tgctggaggcagtggaggtgcc

SEQ ID NO: 9192954 - DNA, 21 bp, Homo sapiens
tgctggctgaaaggcacagag

SEQ ID NO: 9192955 - DNA, 21 bp, Homo sapiens
tgctggctgaaaggcacagag

SEQ ID NO: 9192956 - DNA, 21 bp, Homo sapiens
tgctggctgaaaggcacagag

SEQ ID NO: 9192957 - DNA, 23 bp, Homo sapiens
tgctggctgaaacagccaaagga

SEQ ID NO: 9192958 - DNA, 23 bp, Homo sapiens
tgctggctgaaacagccaaagga

SEQ ID NO: 9192959 - DNA, 22 bp, Homo sapiens
tgctggctctgggccaagcagg

SEQ ID NO: 9192960 - DNA, 22 bp, Homo sapiens
tgctggctctgggccaagcagg

SEQ ID NO: 9192961 - DNA, 22 bp, Homo sapiens
tgctggcatttcaggactcacc

SEQ ID NO: 9192962 - DNA, 22 bp, Homo sapiens
tgctggcattgcataggcagtt

SEQ ID NO: 9192963 - DNA, 22 bp, Homo sapiens
tgctggccaacaaggctccaag

SEQ ID NO: 9192964 - DNA, 22 bp, Homo sapiens
tgctggctccaacctggcatct

SEQ ID NO: 9192965 - DNA, 22 bp, Homo sapiens
tgctggctactgatggcaggcc

SEQ ID NO: 9192966 - DNA, 22 bp, Homo sapiens
tgctggctactgatggcaggcc

SEQ ID NO: 9192967 - DNA, 22 bp, Homo sapiens
tgctggctgtgtaccatctcaa

SEQ ID NO: 9192968 - DNA, 23 bp, Homo sapiens
tgctggctgtgttattgccaaca

SEQ ID NO: 9192969 - DNA, 22 bp, Homo sapiens
tgctggctgtatatgtgagagt

SEQ ID NO: 9192970 - DNA, 22 bp, Homo sapiens
tgctggcttatttagtaaatgt

SEQ ID NO: 9192971 - DNA, 22 bp, Homo sapiens
tgctggcttatttagtaaatgt

SEQ ID NO: 9192972 - DNA, 22 bp, Homo sapiens
tgctggctgttctagggaggcc

SEQ ID NO: 9192973 - DNA, 22 bp, Homo sapiens
tgctggctgttctagggaggcc

SEQ ID NO: 9192974 - DNA, 22 bp, Homo sapiens
tgctggctgcagtgctgtcaaa

SEQ ID NO: 9192975 - DNA, 22 bp, Homo sapiens
tgctggctggcctggcctggac

SEQ ID NO: 9192976 - DNA, 22 bp, Homo sapiens
tgctggctgtatatgtgagagt

SEQ ID NO: 9192977 - DNA, 22 bp, Homo sapiens
tgctggctgggctgctggagac

SEQ ID NO: 9192978 - DNA, 22 bp, Homo sapiens
tggaatgacagagagtctgaat

SEQ ID NO: 9192979 - DNA, 22 bp, Homo sapiens
tggaatgacaagttgttcagag

SEQ ID NO: 9192980 - DNA, 22 bp, Homo sapiens
tggaatgaagacatgttgtttg

SEQ ID NO: 9192981 - DNA, 22 bp, Homo sapiens
tggaatgaaaatggagatcttg

SEQ ID NO: 9192982 - DNA, 23 bp, Homo sapiens
tggaatgagctgggaagctgagc

SEQ ID NO: 9192983 - DNA, 21 bp, Homo sapiens
tggaatgaggctgagcagtgc

SEQ ID NO: 9192984 - DNA, 22 bp, Homo sapiens
tggaatggaaacaaactgagga

SEQ ID NO: 9192985 - DNA, 22 bp, Homo sapiens
tggaattaataggggatataca

SEQ ID NO: 9192986 - DNA, 22 bp, Homo sapiens
tggacaacatagtgagacctca

SEQ ID NO: 9192987 - DNA, 22 bp, Homo sapiens
tggaattttgtattagctttga

SEQ ID NO: 9192988 - DNA, 22 bp, Homo sapiens
tggaatttagttaattccattt

SEQ ID NO: 9192989 - DNA, 22 bp, Homo sapiens
tggacaggatagtgcagtacgc

SEQ ID NO: 9192990 - DNA, 22 bp, Homo sapiens
tggacaggatagtgcagtacgc

SEQ ID NO: 9192991 - DNA, 22 bp, Homo sapiens
tggacaggatagtgcagtacgc

SEQ ID NO: 9192992 - DNA, 22 bp, Homo sapiens
tggacaggatctgagactgaga

SEQ ID NO: 9192993 - DNA, 22 bp, Homo sapiens
tggacaggatctgagactgaga

SEQ ID NO: 9192994 - DNA, 22 bp, Homo sapiens
tggacaggcaagcaagacatac

SEQ ID NO: 9192995 - DNA, 23 bp, Homo sapiens
tggacaggacccccttcggaccc

SEQ ID NO: 9192996 - DNA, 18 bp, Homo sapiens
tggacacatggcctgggt

SEQ ID NO: 9192997 - DNA, 18 bp, Homo sapiens
tggacacatggcctgggt

SEQ ID NO: 9192998 - DNA, 22 bp, Homo sapiens
tggacacagtaggagctgcgca

SEQ ID NO: 9192999 - DNA, 22 bp, Homo sapiens
tggacaatcaatggaggtaagt

SEQ ID NO: 9193000 - DNA, 22 bp, Homo sapiens
tggacaacatagtgagacctca

SEQ ID NO: 9193001 - DNA, 22 bp, Homo sapiens
tggacacaatgttgccttaggg

SEQ ID NO: 9193002 - DNA, 19 bp, Homo sapiens
tggacctgtgcccatggct

SEQ ID NO: 9193003 - DNA, 20 bp, Homo sapiens
tggacctgtctctttaggga

SEQ ID NO: 9193004 - DNA, 21 bp, Homo sapiens
tggactggtgagtttaggctg

SEQ ID NO: 9193005 - DNA, 21 bp, Homo sapiens
tggacttatggagtgtttctt

SEQ ID NO: 9193006 - DNA, 22 bp, Homo sapiens
tggacctgagcctggccctgcc

SEQ ID NO: 9193007 - DNA, 22 bp, Homo sapiens
tggacctgaagaataggaagta

SEQ ID NO: 9193008 - DNA, 22 bp, Homo sapiens
tggacctgctggatgggcaggt

SEQ ID NO: 9193009 - DNA, 22 bp, Homo sapiens
tggacctgctggatgggcaggt

SEQ ID NO: 9193010 - DNA, 22 bp, Homo sapiens
tggacctggggtggcctcctct

SEQ ID NO: 9193011 - DNA, 22 bp, Homo sapiens
tggacctgcgtaggtgctgggc

SEQ ID NO: 9193012 - DNA, 23 bp, Homo sapiens
tggaccctgcacaccagctctac

SEQ ID NO: 9193013 - DNA, 22 bp, Homo sapiens
tggaccctgaagcaacagggag

SEQ ID NO: 9193014 - DNA, 22 bp, Homo sapiens
tggaccctggactgccctggcc

SEQ ID NO: 9193015 - DNA, 17 bp, Homo sapiens
tggacccttgggcctcc

SEQ ID NO: 9193016 - DNA, 22 bp, Homo sapiens
tggaccccagacaagccagggt

SEQ ID NO: 9193017 - DNA, 22 bp, Homo sapiens
tggaccccctcaaggcagagct

SEQ ID NO: 9193018 - DNA, 22 bp, Homo sapiens
tggaccccagacaagccagggt

SEQ ID NO: 9193019 - DNA, 22 bp, Homo sapiens
tggaccctacccggccctcggc

SEQ ID NO: 9193020 - DNA, 22 bp, Homo sapiens
tggaccagcagccccagtgcct

SEQ ID NO: 9193021 - DNA, 22 bp, Homo sapiens
tggaccagggtcccagagtatg

SEQ ID NO: 9193022 - DNA, 21 bp, Homo sapiens
tggaccaggaaggtggtggtg

SEQ ID NO: 9193023 - DNA, 20 bp, Homo sapiens
tggaccaccctcctctttgc

SEQ ID NO: 9193024 - DNA, 22 bp, Homo sapiens
tggaccacatagtgaggccccc

SEQ ID NO: 9193025 - DNA, 22 bp, Homo sapiens
tggacatttggaatactatatt

SEQ ID NO: 9193026 - DNA, 22 bp, Homo sapiens
tggacaggtgagtgactcaggg

SEQ ID NO: 9193027 - DNA, 18 bp, Homo sapiens
tggacagggtggagaaaa

SEQ ID NO: 9193028 - DNA, 20 bp, Homo sapiens
tggacaggggcataggttgc

SEQ ID NO: 9193029 - DNA, 22 bp, Homo sapiens
tggacagggcagagaccgagtc

SEQ ID NO: 9193030 - DNA, 22 bp, Homo sapiens
tggacaggctcctaggggttcc

SEQ ID NO: 9193031 - DNA, 22 bp, Homo sapiens
tggacaggctcctaggggttcc

SEQ ID NO: 9193032 - DNA, 18 bp, Homo sapiens
tggacagggtggagaaaa

SEQ ID NO: 9193033 - DNA, 23 bp, Homo sapiens
tggacagggtaactggtggtttt

SEQ ID NO: 9193034 - DNA, 20 bp, Homo sapiens
tggacaggggcataggttgc

SEQ ID NO: 9193035 - DNA, 22 bp, Homo sapiens
tggacaggggctgctgttgtca

SEQ ID NO: 9193036 - DNA, 22 bp, Homo sapiens
tggaatagaggtgctgatatta

SEQ ID NO: 9193037 - DNA, 22 bp, Homo sapiens
tggaatatactcagaacaggct

SEQ ID NO: 9193038 - DNA, 21 bp, Homo sapiens
tggaatccccaagaaagcagc

SEQ ID NO: 9193039 - DNA, 22 bp, Homo sapiens
tggaagtgccttgctggctgtg

SEQ ID NO: 9193040 - DNA, 22 bp, Homo sapiens
tggaagtgctaaactggagtgt

SEQ ID NO: 9193041 - DNA, 22 bp, Homo sapiens
tggaagtgctaaactggagtgt

SEQ ID NO: 9193042 - DNA, 22 bp, Homo sapiens
tggaagtgctcttctgaccaac

SEQ ID NO: 9193043 - DNA, 22 bp, Homo sapiens
tggaagtggcagaaaatgaaca

SEQ ID NO: 9193044 - DNA, 22 bp, Homo sapiens
tggaagtgccttgctggctgtg

SEQ ID NO: 9193045 - DNA, 22 bp, Homo sapiens
tggaagtgagaagtttcctcag

SEQ ID NO: 9193046 - DNA, 22 bp, Homo sapiens
tggaaggagactgggaagtgtg

SEQ ID NO: 9193047 - DNA, 22 bp, Homo sapiens
tggaaggagctaaggacctggg

SEQ ID NO: 9193048 - DNA, 22 bp, Homo sapiens
tggaaggagactgggaagtgtg

SEQ ID NO: 9193049 - DNA, 22 bp, Homo sapiens
tggaaggaagccaaggaaggtt

SEQ ID NO: 9193050 - DNA, 22 bp, Homo sapiens
tggaaggaagccaaggaaggtt

SEQ ID NO: 9193051 - DNA, 22 bp, Homo sapiens
tggaagggagtgacagtcagag

SEQ ID NO: 9193052 - DNA, 22 bp, Homo sapiens
tggaaggggagctggaaagggg

SEQ ID NO: 9193053 - DNA, 22 bp, Homo sapiens
tggaaggggagctggaaagggg

SEQ ID NO: 9193054 - DNA, 22 bp, Homo sapiens
tggaaggggttacgcagcagga

SEQ ID NO: 9193055 - DNA, 22 bp, Homo sapiens
tggaaggtggatatcctagtca

SEQ ID NO: 9193056 - DNA, 22 bp, Homo sapiens
tggaaggtgtggcaggtctagt

SEQ ID NO: 9193057 - DNA, 22 bp, Homo sapiens
tggaagggggaagacagctctg

SEQ ID NO: 9193058 - DNA, 16 bp, Homo sapiens
tggaaggggtctccgg

SEQ ID NO: 9193059 - DNA, 22 bp, Homo sapiens
tggaaggggccaggcgcggagt

SEQ ID NO: 9193060 - DNA, 22 bp, Homo sapiens
tggaaggggagttgttccacgt

SEQ ID NO: 9193061 - DNA, 22 bp, Homo sapiens
tggaaggggccaggcgcggagt

SEQ ID NO: 9193062 - DNA, 22 bp, Homo sapiens
tggaaggggagctggaaagggg

SEQ ID NO: 9193063 - DNA, 22 bp, Homo sapiens
tggaaggggagctggaaagggg

SEQ ID NO: 9193064 - DNA, 22 bp, Homo sapiens
tggaaggggagctggaaagggg

SEQ ID NO: 9193065 - DNA, 22 bp, Homo sapiens
tggaagccagctgggcacctgc

SEQ ID NO: 9193066 - DNA, 22 bp, Homo sapiens
tggaagcccagaaggaagcaga

SEQ ID NO: 9193067 - DNA, 22 bp, Homo sapiens
tggaaggaaaggtagcagagaa

SEQ ID NO: 9193068 - DNA, 22 bp, Homo sapiens
tggaaggaagccaaggaaggtt

SEQ ID NO: 9193069 - DNA, 22 bp, Homo sapiens
tggaaggaaaggtagcagagaa

SEQ ID NO: 9193070 - DNA, 22 bp, Homo sapiens
tggaaggaaaggtagcagagaa

SEQ ID NO: 9193071 - DNA, 22 bp, Homo sapiens
tggaaggaaaggtagcagagaa

SEQ ID NO: 9193072 - DNA, 22 bp, Homo sapiens
tggaagcttttgagattgttgc

SEQ ID NO: 9193073 - DNA, 18 bp, Homo sapiens
tggaagctggcagatttt

SEQ ID NO: 9193074 - DNA, 22 bp, Homo sapiens
tggaagctcaaggcagggtgag

SEQ ID NO: 9193075 - DNA, 18 bp, Homo sapiens
tggaagctggtgagcaga

SEQ ID NO: 9193076 - DNA, 22 bp, Homo sapiens
tggaagcttcctgttcttgagg

SEQ ID NO: 9193077 - DNA, 22 bp, Homo sapiens
tggaagagaaaggagtggatct

SEQ ID NO: 9193078 - DNA, 22 bp, Homo sapiens
tggaagactatcccgtgatttt

SEQ ID NO: 9193079 - DNA, 22 bp, Homo sapiens
tggaagagacacttacattcag

SEQ ID NO: 9193080 - DNA, 19 bp, Homo sapiens
tggaagaggaagggaaata

SEQ ID NO: 9193081 - DNA, 22 bp, Homo sapiens
tggaagagcaggcagacaatgc

SEQ ID NO: 9193082 - DNA, 22 bp, Homo sapiens
tggaagaggtggaagtggcttc

SEQ ID NO: 9193083 - DNA, 19 bp, Homo sapiens
tggaagaggaagggaaata

SEQ ID NO: 9193084 - DNA, 22 bp, Homo sapiens
tggaaagatgaagatgtttaag

SEQ ID NO: 9193085 - DNA, 22 bp, Homo sapiens
tggaaagaggaagtgcccagca

SEQ ID NO: 9193086 - DNA, 21 bp, Homo sapiens
tggaaacagcgccatctgccg

SEQ ID NO: 9193087 - DNA, 22 bp, Homo sapiens
tggaaacactgcatgttcaccc

SEQ ID NO: 9193088 - DNA, 22 bp, Homo sapiens
tggaaacactgcatgttcaccc

SEQ ID NO: 9193089 - DNA, 22 bp, Homo sapiens
tggaaacactgcatgttcaccc

SEQ ID NO: 9193090 - DNA, 22 bp, Homo sapiens
tggaaaacaaagctctcattat

SEQ ID NO: 9193091 - DNA, 22 bp, Homo sapiens
tggaaaacaatgatttgggcaa

SEQ ID NO: 9193092 - DNA, 22 bp, Homo sapiens
tggaaaacatgcacattggatt

SEQ ID NO: 9193093 - DNA, 22 bp, Homo sapiens
tggaaaacattgagataccaag

SEQ ID NO: 9193094 - DNA, 22 bp, Homo sapiens
tggaaaactttggtggtgaggg

SEQ ID NO: 9193095 - DNA, 21 bp, Homo sapiens
tggaaaacatttaaatagcaa

SEQ ID NO: 9193096 - DNA, 22 bp, Homo sapiens
tggaaaacatgcacattggatt

SEQ ID NO: 9193097 - DNA, 22 bp, Homo sapiens
tggaaaatcaggggacattgat

SEQ ID NO: 9193098 - DNA, 19 bp, Homo sapiens
tggaaaatggattgaatca

SEQ ID NO: 9193099 - DNA, 19 bp, Homo sapiens
tggaaaatggattgaatca

SEQ ID NO: 9193100 - DNA, 22 bp, Homo sapiens
tggaaacaaagtcataagctca

SEQ ID NO: 9193101 - DNA, 22 bp, Homo sapiens
tggaaacaaagctggatgtagt

SEQ ID NO: 9193102 - DNA, 22 bp, Homo sapiens
tggaaaatgtgactattctaaa

SEQ ID NO: 9193103 - DNA, 22 bp, Homo sapiens
tggaaaatgtgactattctaaa

SEQ ID NO: 9193104 - DNA, 22 bp, Homo sapiens
tggaaaatgtgactattctaaa

SEQ ID NO: 9193105 - DNA, 20 bp, Homo sapiens
tgcttttatacctataatga

SEQ ID NO: 9193106 - DNA, 22 bp, Homo sapiens
tggaaaaaaattggctagcttc

SEQ ID NO: 9193107 - DNA, 22 bp, Homo sapiens
tggaaaaaacccagactctaga

SEQ ID NO: 9193108 - DNA, 22 bp, Homo sapiens
tggaaaaaacccagactctaga

SEQ ID NO: 9193109 - DNA, 21 bp, Homo sapiens
tggaaaaatgtggcctagtga

SEQ ID NO: 9193110 - DNA, 22 bp, Homo sapiens
tggaaaaactgagacttagaca

SEQ ID NO: 9193111 - DNA, 22 bp, Homo sapiens
tggaaaaactgagacttagaca

SEQ ID NO: 9193112 - DNA, 22 bp, Homo sapiens
tgctttgctggcactcctggct

SEQ ID NO: 9193113 - DNA, 22 bp, Homo sapiens
tgctttggatctatttgctgag

SEQ ID NO: 9193114 - DNA, 22 bp, Homo sapiens
tgctttggccactagaattcag

SEQ ID NO: 9193115 - DNA, 22 bp, Homo sapiens
tgctttggccactagaattcag

SEQ ID NO: 9193116 - DNA, 22 bp, Homo sapiens
tgctttgggtttgactctcatg

SEQ ID NO: 9193117 - DNA, 22 bp, Homo sapiens
tgctttgggtttgactctcatg

SEQ ID NO: 9193118 - DNA, 22 bp, Homo sapiens
tgctttggctgacacgctcctg

SEQ ID NO: 9193119 - DNA, 22 bp, Homo sapiens
tgctttggctgacacgctcctg

SEQ ID NO: 9193120 - DNA, 22 bp, Homo sapiens
tgctttgggtctctctagtttc

SEQ ID NO: 9193121 - DNA, 22 bp, Homo sapiens
tgctttgtgtacacaagaatca

SEQ ID NO: 9193122 - DNA, 22 bp, Homo sapiens
tgctttgtgtttgaatagataa

SEQ ID NO: 9193123 - DNA, 22 bp, Homo sapiens
tgcttttaggagattaaaatta

SEQ ID NO: 9193124 - DNA, 22 bp, Homo sapiens
tggaaatattgggtaatagttg

SEQ ID NO: 9193125 - DNA, 22 bp, Homo sapiens
tggaaatattgggtaatagttg

SEQ ID NO: 9193126 - DNA, 22 bp, Homo sapiens
tggaaatattgggtaatagttg

SEQ ID NO: 9193127 - DNA, 22 bp, Homo sapiens
tggaaatatttgctcattatct

SEQ ID NO: 9193128 - DNA, 19 bp, Homo sapiens
tggaaatggaagctcagcc

SEQ ID NO: 9193129 - DNA, 22 bp, Homo sapiens
tggaaatagctccagtttcatt

SEQ ID NO: 9193130 - DNA, 22 bp, Homo sapiens
tggaaatagctccagtttcatt

SEQ ID NO: 9193131 - DNA, 22 bp, Homo sapiens
tggaaatagttgtgagtcaggc

SEQ ID NO: 9193132 - DNA, 22 bp, Homo sapiens
tggaaatagttgtgagtcaggc

SEQ ID NO: 9193133 - DNA, 22 bp, Homo sapiens
tggaaatagttgtgagtcaggc

SEQ ID NO: 9193134 - DNA, 22 bp, Homo sapiens
tggaaatagatagtatcattca

SEQ ID NO: 9193135 - DNA, 22 bp, Homo sapiens
tggaaatagctccagttaagca

SEQ ID NO: 9193136 - DNA, 22 bp, Homo sapiens
tggaaatagctccagttaagca

SEQ ID NO: 9193137 - DNA, 22 bp, Homo sapiens
tggaaatacttgccataaaact

SEQ ID NO: 9193138 - DNA, 21 bp, Homo sapiens
tggaaagattcaaagaccagg

SEQ ID NO: 9193139 - DNA, 22 bp, Homo sapiens
tggaaaggacagttgctgatag

SEQ ID NO: 9193140 - DNA, 22 bp, Homo sapiens
tggaaatacaagaagtatgtca

SEQ ID NO: 9193141 - DNA, 22 bp, Homo sapiens
tggaaatggatctgatgagtct

SEQ ID NO: 9193142 - DNA, 22 bp, Homo sapiens
tggaacacaagtcattgagggg

SEQ ID NO: 9193143 - DNA, 23 bp, Homo sapiens
tggaagaaaatggtttggctgtg

SEQ ID NO: 9193144 - DNA, 19 bp, Homo sapiens
tggaacctgtgccagggct

SEQ ID NO: 9193145 - DNA, 20 bp, Homo sapiens
tgctttgatggaaatacagc

SEQ ID NO: 9193146 - DNA, 19 bp, Homo sapiens
tgctttgccttgattagct

SEQ ID NO: 9193147 - DNA, 22 bp, Homo sapiens
tgctttgaaagataatactgtc

SEQ ID NO: 9193148 - DNA, 22 bp, Homo sapiens
tgctttgaaagataatactgtc

SEQ ID NO: 9193149 - DNA, 22 bp, Homo sapiens
tgctttgacagggatgacatga

SEQ ID NO: 9193150 - DNA, 22 bp, Homo sapiens
tgctttctgctcttgtccacac

SEQ ID NO: 9193151 - DNA, 22 bp, Homo sapiens
tgctttctctctaccccacttt

SEQ ID NO: 9193152 - DNA, 22 bp, Homo sapiens
tgctttctttagctcctgagtc

SEQ ID NO: 9193153 - DNA, 22 bp, Homo sapiens
tgctttctttagctcctgagtc

SEQ ID NO: 9193154 - DNA, 22 bp, Homo sapiens
tgctttctttagctcctgagtc

SEQ ID NO: 9193155 - DNA, 17 bp, Homo sapiens
tgctttcttcctgccct

SEQ ID NO: 9193156 - DNA, 19 bp, Homo sapiens
tgctttctaaacacatgca

SEQ ID NO: 9193157 - DNA, 18 bp, Homo sapiens
tgctttctagcttcagat

SEQ ID NO: 9193158 - DNA, 22 bp, Homo sapiens
tgctttctcctgtctgaaagat

SEQ ID NO: 9193159 - DNA, 22 bp, Homo sapiens
tgctttattaagagagaaattt

SEQ ID NO: 9193160 - DNA, 22 bp, Homo sapiens
tgctttattaagagagaaattt

SEQ ID NO: 9193161 - DNA, 22 bp, Homo sapiens
tgctttataacttagtttatgg

SEQ ID NO: 9193162 - DNA, 22 bp, Homo sapiens
tgctttataacttagtttatgg

SEQ ID NO: 9193163 - DNA, 22 bp, Homo sapiens
tgctttataggggattgcaggc

SEQ ID NO: 9193164 - DNA, 22 bp, Homo sapiens
tgctttatatctctcttcttag

SEQ ID NO: 9193165 - DNA, 22 bp, Homo sapiens
tgctttatatctctcttcttag

SEQ ID NO: 9193166 - DNA, 22 bp, Homo sapiens
tgctttatctgtgagaacctga

SEQ ID NO: 9193167 - DNA, 22 bp, Homo sapiens
tgctttatgtggctgatactca

SEQ ID NO: 9193168 - DNA, 22 bp, Homo sapiens
tgctttatgtggctgatactca

SEQ ID NO: 9193169 - DNA, 21 bp, Homo sapiens
tgctttatgggaaaaatgtca

SEQ ID NO: 9193170 - DNA, 21 bp, Homo sapiens
tgctttatgggaaaaatgtca

SEQ ID NO: 9193171 - DNA, 18 bp, Homo sapiens
tgctttatgcttatataa

SEQ ID NO: 9193172 - DNA, 20 bp, Homo sapiens
tgctttatgctatactttgt

SEQ ID NO: 9193173 - DNA, 20 bp, Homo sapiens
tgctttatgctatactttgt

SEQ ID NO: 9193174 - DNA, 22 bp, Homo sapiens
tgcttctgttacataccagaac

SEQ ID NO: 9193175 - DNA, 22 bp, Homo sapiens
tgcttctgttctttcacctacg

SEQ ID NO: 9193176 - DNA, 22 bp, Homo sapiens
tgcttctttactataggcaatt

SEQ ID NO: 9193177 - DNA, 22 bp, Homo sapiens
tgcttcttactcatatgctgat

SEQ ID NO: 9193178 - DNA, 22 bp, Homo sapiens
tgcttcttactcatatgctgat

SEQ ID NO: 9193179 - DNA, 22 bp, Homo sapiens
tgcttctggggacaggctgcct

SEQ ID NO: 9193180 - DNA, 19 bp, Homo sapiens
tgcttctggggcttctcca

SEQ ID NO: 9193181 - DNA, 22 bp, Homo sapiens
tgcttctggggacaggctgcct

SEQ ID NO: 9193182 - DNA, 22 bp, Homo sapiens
tgcttctgctgatattttgtga

SEQ ID NO: 9193183 - DNA, 19 bp, Homo sapiens
tgcttctggaatgcaaggc

SEQ ID NO: 9193184 - DNA, 22 bp, Homo sapiens
tgcttctggcttatctcgtgcc

SEQ ID NO: 9193185 - DNA, 22 bp, Homo sapiens
tgcttctggcacttgagggggt

SEQ ID NO: 9193186 - DNA, 22 bp, Homo sapiens
tgcttctggcacttgagggggt

SEQ ID NO: 9193187 - DNA, 22 bp, Homo sapiens
tgcttgcagatgaaaggaagtc

SEQ ID NO: 9193188 - DNA, 22 bp, Homo sapiens
tgcttgcaaatactctgctgtt

SEQ ID NO: 9193189 - DNA, 22 bp, Homo sapiens
tgcttgcaagagatgcaatgac

SEQ ID NO: 9193190 - DNA, 21 bp, Homo sapiens
tgcttgcagaactttcaggct

SEQ ID NO: 9193191 - DNA, 19 bp, Homo sapiens
tgcttgcacatcaagctac

SEQ ID NO: 9193192 - DNA, 22 bp, Homo sapiens
tgcttgatttggcagtgtattc

SEQ ID NO: 9193193 - DNA, 22 bp, Homo sapiens
tgcttgaggggaataaaaagaa

SEQ ID NO: 9193194 - DNA, 22 bp, Homo sapiens
tgcttgagacacatatgaattt

SEQ ID NO: 9193195 - DNA, 22 bp, Homo sapiens
tgcttgaacaaggataaatttg

SEQ ID NO: 9193196 - DNA, 22 bp, Homo sapiens
tgcttgaaaggggtttcccagt

SEQ ID NO: 9193197 - DNA, 22 bp, Homo sapiens
tgctttaaaatggactgttttg

SEQ ID NO: 9193198 - DNA, 22 bp, Homo sapiens
tgctttaaaatggactgttttg

SEQ ID NO: 9193199 - DNA, 22 bp, Homo sapiens
tgcttgtgagagttttttcaga

SEQ ID NO: 9193200 - DNA, 22 bp, Homo sapiens
tgctttaaatatgaattagcat

SEQ ID NO: 9193201 - DNA, 22 bp, Homo sapiens
tgctttaaccatcttgtttgga

SEQ ID NO: 9193202 - DNA, 22 bp, Homo sapiens
tgctttaagagattgttagtac

SEQ ID NO: 9193203 - DNA, 22 bp, Homo sapiens
tgctttataaccatttctgtgg

SEQ ID NO: 9193204 - DNA, 20 bp, Homo sapiens
tggaggcacctgtggagatc

SEQ ID NO: 9193205 - DNA, 20 bp, Homo sapiens
tggaggcagagccagaggga

SEQ ID NO: 9193206 - DNA, 19 bp, Homo sapiens
tggaggcaagacatggagg

SEQ ID NO: 9193207 - DNA, 22 bp, Homo sapiens
tggaggcaactgaagatgtagt

SEQ ID NO: 9193208 - DNA, 22 bp, Homo sapiens
tggaggcaggtggaggagtgaa

SEQ ID NO: 9193209 - DNA, 22 bp, Homo sapiens
tggaggcaggagacagggcaaa

SEQ ID NO: 9193210 - DNA, 18 bp, Homo sapiens
tggaggcagagttctggc

SEQ ID NO: 9193211 - DNA, 22 bp, Homo sapiens
tggaggcccacactgggtagat

SEQ ID NO: 9193212 - DNA, 22 bp, Homo sapiens
tggaggccatgccagagcccta

SEQ ID NO: 9193213 - DNA, 22 bp, Homo sapiens
tggaggcccaagattctacagc

SEQ ID NO: 9193214 - DNA, 22 bp, Homo sapiens
tggaggccagtgaaagtagatt

SEQ ID NO: 9193215 - DNA, 22 bp, Homo sapiens
tggaggcagtaactgagcaaca

SEQ ID NO: 9193216 - DNA, 22 bp, Homo sapiens
tggaggcaggttagccagacga

SEQ ID NO: 9193217 - DNA, 22 bp, Homo sapiens
tggaggcctaggttgatgtgtg

SEQ ID NO: 9193218 - DNA, 22 bp, Homo sapiens
tggaggcctgggtgtgttgagc

SEQ ID NO: 9193219 - DNA, 22 bp, Homo sapiens
tggaggccgcgtagtctgagca

SEQ ID NO: 9193220 - DNA, 22 bp, Homo sapiens
tggaggccggactgagaggcat

SEQ ID NO: 9193221 - DNA, 22 bp, Homo sapiens
tggaggccgcgtagtctgagca

SEQ ID NO: 9193222 - DNA, 22 bp, Homo sapiens
tggaggcccccaggcaacagca

SEQ ID NO: 9193223 - DNA, 23 bp, Homo sapiens
tggagctgggctcagaccctggg

SEQ ID NO: 9193224 - DNA, 23 bp, Homo sapiens
tggagctgggctcagaccctggg

SEQ ID NO: 9193225 - DNA, 22 bp, Homo sapiens
tggagctgggagtcctgggctg

SEQ ID NO: 9193226 - DNA, 22 bp, Homo sapiens
tggagctgggagtcctgggctg

SEQ ID NO: 9193227 - DNA, 22 bp, Homo sapiens
tggagctggttctggggaagct

SEQ ID NO: 9193228 - DNA, 22 bp, Homo sapiens
tggagctggtaaacagtgacat

SEQ ID NO: 9193229 - DNA, 22 bp, Homo sapiens
tggagctggtaaacagtgacat

SEQ ID NO: 9193230 - DNA, 22 bp, Homo sapiens
tggagctggtaaacagtgacat

SEQ ID NO: 9193231 - DNA, 22 bp, Homo sapiens
tggagctgtagccaccaccctg

SEQ ID NO: 9193232 - DNA, 20 bp, Homo sapiens
tggagctgtaatcttgtctg

SEQ ID NO: 9193233 - DNA, 20 bp, Homo sapiens
tggagctgtaatcttgtctg

SEQ ID NO: 9193234 - DNA, 22 bp, Homo sapiens
tggagctggttctggggaagct

SEQ ID NO: 9193235 - DNA, 22 bp, Homo sapiens
tggaggaaaaaaccaggcagag

SEQ ID NO: 9193236 - DNA, 18 bp, Homo sapiens
tggaggaaaaatctcatg

SEQ ID NO: 9193237 - DNA, 22 bp, Homo sapiens
tggagctgtcactcagaaccaa

SEQ ID NO: 9193238 - DNA, 20 bp, Homo sapiens
tggagctgtggtaaggagca

SEQ ID NO: 9193239 - DNA, 22 bp, Homo sapiens
tggagctgtcactcagaaccaa

SEQ ID NO: 9193240 - DNA, 22 bp, Homo sapiens
tggaggagaatttatggtcgaa

SEQ ID NO: 9193241 - DNA, 22 bp, Homo sapiens
tggaggagaactccctggctac

SEQ ID NO: 9193242 - DNA, 18 bp, Homo sapiens
tggaggaaaaatctcatg

SEQ ID NO: 9193243 - DNA, 22 bp, Homo sapiens
tggaggagaccattccactcag

SEQ ID NO: 9193244 - DNA, 22 bp, Homo sapiens
tggaggagaccattccactcag

SEQ ID NO: 9193245 - DNA, 22 bp, Homo sapiens
tggaggagggctggtgtctgta

SEQ ID NO: 9193246 - DNA, 22 bp, Homo sapiens
tggaggagggctggtgtctgta

SEQ ID NO: 9193247 - DNA, 22 bp, Homo sapiens
tggaggattccacttacatgag

SEQ ID NO: 9193248 - DNA, 22 bp, Homo sapiens
tggaggattaatctggaaagat

SEQ ID NO: 9193249 - DNA, 22 bp, Homo sapiens
tggaggatgccatccaggatac

SEQ ID NO: 9193250 - DNA, 22 bp, Homo sapiens
tggaggagggctggtgtctgta

SEQ ID NO: 9193251 - DNA, 22 bp, Homo sapiens
tggaggagtgtgattgtctgcc

SEQ ID NO: 9193252 - DNA, 22 bp, Homo sapiens
tggataaaatgacattacctga

SEQ ID NO: 9193253 - DNA, 22 bp, Homo sapiens
tggataaactcactgtaagttg

SEQ ID NO: 9193254 - DNA, 23 bp, Homo sapiens
tggataaagctgtgctgcatagg

SEQ ID NO: 9193255 - DNA, 22 bp, Homo sapiens
tggagttgcagctaccagacat

SEQ ID NO: 9193256 - DNA, 22 bp, Homo sapiens
tggagtggacttcatgaggcca

SEQ ID NO: 9193257 - DNA, 22 bp, Homo sapiens
tggagtgggcaatgtaggcaag

SEQ ID NO: 9193258 - DNA, 22 bp, Homo sapiens
tggagtggacttcatgaggcca

SEQ ID NO: 9193259 - DNA, 20 bp, Homo sapiens
tggatgctgcacgtagatgg

SEQ ID NO: 9193260 - DNA, 22 bp, Homo sapiens
tggatgctggatgaacagatgc

SEQ ID NO: 9193261 - DNA, 22 bp, Homo sapiens
tggatgcttaaatcgtttgaat

SEQ ID NO: 9193262 - DNA, 22 bp, Homo sapiens
tggatgggttgaaatgtgagcc

SEQ ID NO: 9193263 - DNA, 22 bp, Homo sapiens
tggatggctgtggtctttgccc

SEQ ID NO: 9193264 - DNA, 22 bp, Homo sapiens
tggataaatagatacacttgca

SEQ ID NO: 9193265 - DNA, 22 bp, Homo sapiens
tggataaatgtgcagatgacat

SEQ ID NO: 9193266 - DNA, 22 bp, Homo sapiens
tggatatccttgttaactttct

SEQ ID NO: 9193267 - DNA, 22 bp, Homo sapiens
tggatatccttgttaactttct

SEQ ID NO: 9193268 - DNA, 22 bp, Homo sapiens
tggatatgcccagggcacccta

SEQ ID NO: 9193269 - DNA, 22 bp, Homo sapiens
tggatgctatggagtatttaga

SEQ ID NO: 9193270 - DNA, 22 bp, Homo sapiens
tggatgctgctgtcagggatgg

SEQ ID NO: 9193271 - DNA, 22 bp, Homo sapiens
tggagtgaagtaaagaggacaa

SEQ ID NO: 9193272 - DNA, 22 bp, Homo sapiens
tggagtgaagggttggcacggt

SEQ ID NO: 9193273 - DNA, 22 bp, Homo sapiens
tggagtgcaatagtaataaggt

SEQ ID NO: 9193274 - DNA, 21 bp, Homo sapiens
tggagtgcactcagagttggt

SEQ ID NO: 9193275 - DNA, 22 bp, Homo sapiens
tggagtggacttcatgaggcca

SEQ ID NO: 9193276 - DNA, 22 bp, Homo sapiens
tggagtggacttcatgaggcca

SEQ ID NO: 9193277 - DNA, 20 bp, Homo sapiens
tggagtgctgtgttgagaag

SEQ ID NO: 9193278 - DNA, 22 bp, Homo sapiens
tggagtccacattcttttacaa

SEQ ID NO: 9193279 - DNA, 22 bp, Homo sapiens
tggagtcccactgggaactggg

SEQ ID NO: 9193280 - DNA, 20 bp, Homo sapiens
tggagtcatgggacactcac

SEQ ID NO: 9193281 - DNA, 20 bp, Homo sapiens
tggagtcatgggacactcac

SEQ ID NO: 9193282 - DNA, 22 bp, Homo sapiens
tggagtcatgatggctgctgat

SEQ ID NO: 9193283 - DNA, 22 bp, Homo sapiens
tggagtctgtgatgctctgggt

SEQ ID NO: 9193284 - DNA, 22 bp, Homo sapiens
tggagtctgtgatgctctgggt

SEQ ID NO: 9193285 - DNA, 20 bp, Homo sapiens
tggagtctgacagatgggta

SEQ ID NO: 9193286 - DNA, 22 bp, Homo sapiens
tggagtcactttctcttccagt

SEQ ID NO: 9193287 - DNA, 22 bp, Homo sapiens
tggagtcacttccatatgggaa

SEQ ID NO: 9193288 - DNA, 23 bp, Homo sapiens
tggagtcaccttagttccaaaag

SEQ ID NO: 9193289 - DNA, 23 bp, Homo sapiens
tggagtcaccttagttccaaaag

SEQ ID NO: 9193290 - DNA, 22 bp, Homo sapiens
tggagtcacagtgacctgagtc

SEQ ID NO: 9193291 - DNA, 22 bp, Homo sapiens
tggagtcaggcaatgcttgctt

SEQ ID NO: 9193292 - DNA, 22 bp, Homo sapiens
tggagtcagtctgggttgcaat

SEQ ID NO: 9193293 - DNA, 18 bp, Homo sapiens
tggagtcagtgacaccag

SEQ ID NO: 9193294 - DNA, 18 bp, Homo sapiens
tggagtcagtgacaccag

SEQ ID NO: 9193295 - DNA, 22 bp, Homo sapiens
tggagtcagtctgggttgcaat

SEQ ID NO: 9193296 - DNA, 22 bp, Homo sapiens
tggagtcagtctgggttgcaat

SEQ ID NO: 9193297 - DNA, 22 bp, Homo sapiens
tggagtcatcttaatctaggca

SEQ ID NO: 9193298 - DNA, 22 bp, Homo sapiens
tggagtcagtggctattgggca

SEQ ID NO: 9193299 - DNA, 22 bp, Homo sapiens
tggagtcagaatgcgacaggcc

SEQ ID NO: 9193300 - DNA, 22 bp, Homo sapiens
tggagtcagaatgcgacaggcc

SEQ ID NO: 9193301 - DNA, 22 bp, Homo sapiens
tggagtcagagggggaagtcac

SEQ ID NO: 9193302 - DNA, 22 bp, Homo sapiens
tggagtcagagggggaagtcac

SEQ ID NO: 9193303 - DNA, 22 bp, Homo sapiens
tggagtcaggatcttataaata

SEQ ID NO: 9193304 - DNA, 22 bp, Homo sapiens
tggagtcaggatcttataaata

SEQ ID NO: 9193305 - DNA, 22 bp, Homo sapiens
tggagtcagctagacctgtgtt

SEQ ID NO: 9193306 - DNA, 22 bp, Homo sapiens
tggaggtgtggagtcaaaggga

SEQ ID NO: 9193307 - DNA, 22 bp, Homo sapiens
tggaggtgtataaggtagcttc

SEQ ID NO: 9193308 - DNA, 22 bp, Homo sapiens
tggaggtggcacaagggaggtc

SEQ ID NO: 9193309 - DNA, 22 bp, Homo sapiens
tggaggtggcacaagggaggtc

SEQ ID NO: 9193310 - DNA, 22 bp, Homo sapiens
tggagggcgcttagatggaggg

SEQ ID NO: 9193311 - DNA, 22 bp, Homo sapiens
tggagggctaagctgagggata

SEQ ID NO: 9193312 - DNA, 18 bp, Homo sapiens
tggagggcttgctgcagc

SEQ ID NO: 9193313 - DNA, 18 bp, Homo sapiens
tggagggcttgctgcagc

SEQ ID NO: 9193314 - DNA, 22 bp, Homo sapiens
tggagggctctttcacctggta

SEQ ID NO: 9193315 - DNA, 22 bp, Homo sapiens
tggaggctgtgtgcatgagacc

SEQ ID NO: 9193316 - DNA, 22 bp, Homo sapiens
tggaggctgtgtgcatgagacc

SEQ ID NO: 9193317 - DNA, 22 bp, Homo sapiens
tggagggatacaaagatgaaaa

SEQ ID NO: 9193318 - DNA, 22 bp, Homo sapiens
tggagggatacaaagatgaaaa

SEQ ID NO: 9193319 - DNA, 22 bp, Homo sapiens
tggagggaacccaggctgctct

SEQ ID NO: 9193320 - DNA, 22 bp, Homo sapiens
tggagggcatctgtggtcaggc

SEQ ID NO: 9193321 - DNA, 22 bp, Homo sapiens
tggagggcatctgtggtcaggc

SEQ ID NO: 9193322 - DNA, 22 bp, Homo sapiens
tggagggcatagctgttctttc

SEQ ID NO: 9193323 - DNA, 22 bp, Homo sapiens
tggagagaagaggcagtgtgct

SEQ ID NO: 9193324 - DNA, 22 bp, Homo sapiens
tggagagaacagtgtctgaaag

SEQ ID NO: 9193325 - DNA, 22 bp, Homo sapiens
tggagagaaagttgaatggagg

SEQ ID NO: 9193326 - DNA, 22 bp, Homo sapiens
tggagaataggggccactggtg

SEQ ID NO: 9193327 - DNA, 22 bp, Homo sapiens
tggagaagtcaaagtgaacagg

SEQ ID NO: 9193328 - DNA, 22 bp, Homo sapiens
tggagagaaagttgaatggagg

SEQ ID NO: 9193329 - DNA, 22 bp, Homo sapiens
tggactttcacatagcaaagga

SEQ ID NO: 9193330 - DNA, 22 bp, Homo sapiens
tggactttctagggtagaggaa

SEQ ID NO: 9193331 - DNA, 22 bp, Homo sapiens
tggactttttaactgataggag

SEQ ID NO: 9193332 - DNA, 22 bp, Homo sapiens
tggagaagattggtcaccattc

SEQ ID NO: 9193333 - DNA, 22 bp, Homo sapiens
tggagaaagctgcatatggaaa

SEQ ID NO: 9193334 - DNA, 22 bp, Homo sapiens
tggagaagattggtcaccattc

SEQ ID NO: 9193335 - DNA, 22 bp, Homo sapiens
tggagaagctgtaggtggactc

SEQ ID NO: 9193336 - DNA, 22 bp, Homo sapiens
tggagaagctgtaggtggactc

SEQ ID NO: 9193337 - DNA, 22 bp, Homo sapiens
tggagaaggacagcctgagaaa

SEQ ID NO: 9193338 - DNA, 22 bp, Homo sapiens
tggagaaggggcagggtctcca

SEQ ID NO: 9193339 - DNA, 22 bp, Homo sapiens
tggagaaggccggccaggagtg

SEQ ID NO: 9193340 - DNA, 19 bp, Homo sapiens
tggagaggaaatgctgctc

SEQ ID NO: 9193341 - DNA, 22 bp, Homo sapiens
tggagaggaaagtgcagttttg

SEQ ID NO: 9193342 - DNA, 22 bp, Homo sapiens
tggagaggaaagtgcagttttg

SEQ ID NO: 9193343 - DNA, 22 bp, Homo sapiens
tggagagctggttcaaagcaga

SEQ ID NO: 9193344 - DNA, 22 bp, Homo sapiens
tggagagcgcgacgggaggaag

SEQ ID NO: 9193345 - DNA, 22 bp, Homo sapiens
tggagagcgcgacgggaggaag

SEQ ID NO: 9193346 - DNA, 22 bp, Homo sapiens
tggagagcgtgcttagcactct

SEQ ID NO: 9193347 - DNA, 22 bp, Homo sapiens
tggagagctatttggacctcca

SEQ ID NO: 9193348 - DNA, 21 bp, Homo sapiens
tggagagcccttgcctgagtc

SEQ ID NO: 9193349 - DNA, 22 bp, Homo sapiens
tggagagcaggggatgcgggcg

SEQ ID NO: 9193350 - DNA, 18 bp, Homo sapiens
tggagagcagcagtgggg

SEQ ID NO: 9193351 - DNA, 22 bp, Homo sapiens
tggagagcaatgaggggcaggc

SEQ ID NO: 9193352 - DNA, 22 bp, Homo sapiens
tggagagatgtctgttcaaggt

SEQ ID NO: 9193353 - DNA, 22 bp, Homo sapiens
tggagagcaagtcgcagacatg

SEQ ID NO: 9193354 - DNA, 22 bp, Homo sapiens
tggagagcaagtcgcagacatg

SEQ ID NO: 9193355 - DNA, 22 bp, Homo sapiens
tggagagatgtctgttcaaggt

SEQ ID NO: 9193356 - DNA, 22 bp, Homo sapiens
tggagagcaagtcgcagacatg

SEQ ID NO: 9193357 - DNA, 22 bp, Homo sapiens
tggagcagccatgatgacagag

SEQ ID NO: 9193358 - DNA, 22 bp, Homo sapiens
tggagcagccttttctaagcaa

SEQ ID NO: 9193359 - DNA, 22 bp, Homo sapiens
tggagcagcatcactttgagct

SEQ ID NO: 9193360 - DNA, 22 bp, Homo sapiens
tggagcagcacaagaaagggga

SEQ ID NO: 9193361 - DNA, 22 bp, Homo sapiens
tggagcagcattcatccagcag

SEQ ID NO: 9193362 - DNA, 22 bp, Homo sapiens
tggagcagcattcatccagcag

SEQ ID NO: 9193363 - DNA, 22 bp, Homo sapiens
tggagcagagatggtggccttc

SEQ ID NO: 9193364 - DNA, 22 bp, Homo sapiens
tggagcagaggaagaaggcttt

SEQ ID NO: 9193365 - DNA, 22 bp, Homo sapiens
tggagcagaggaagaaggcttt

SEQ ID NO: 9193366 - DNA, 22 bp, Homo sapiens
tggagcagagttcagcggggag

SEQ ID NO: 9193367 - DNA, 22 bp, Homo sapiens
tggagcagcacaagaaagggga

SEQ ID NO: 9193368 - DNA, 22 bp, Homo sapiens
tggagcagaggctgaggttggg

SEQ ID NO: 9193369 - DNA, 22 bp, Homo sapiens
tggagaggagcaccatggccat

SEQ ID NO: 9193370 - DNA, 19 bp, Homo sapiens
tggagaggaaatgctgctc

SEQ ID NO: 9193371 - DNA, 22 bp, Homo sapiens
tggagaggagcaccatggccat

SEQ ID NO: 9193372 - DNA, 22 bp, Homo sapiens
tggagaggttgaataacttgtc

SEQ ID NO: 9193373 - DNA, 22 bp, Homo sapiens
tggagaggtttaaacaaaagtt

SEQ ID NO: 9193374 - DNA, 22 bp, Homo sapiens
tggagaggtttaaacaaaagtt

SEQ ID NO: 9193375 - DNA, 22 bp, Homo sapiens
tggagcagagatgggagcccaa

SEQ ID NO: 9193376 - DNA, 22 bp, Homo sapiens
tggagcagaaatggcctcttgt

SEQ ID NO: 9193377 - DNA, 22 bp, Homo sapiens
tggagcagaaatttgaagccat

SEQ ID NO: 9193378 - DNA, 22 bp, Homo sapiens
tggagagtggatatgggagcaa

SEQ ID NO: 9193379 - DNA, 22 bp, Homo sapiens
tggagagtggtttgggggacat

SEQ ID NO: 9193380 - DNA, 22 bp, Homo sapiens
tggagcccagggtgagaaggag

SEQ ID NO: 9193381 - DNA, 22 bp, Homo sapiens
tggagcccagggtgagaaggag

SEQ ID NO: 9193382 - DNA, 22 bp, Homo sapiens
tggagcccaggagaggataaac

SEQ ID NO: 9193383 - DNA, 22 bp, Homo sapiens
tggagcccagacactggcattg

SEQ ID NO: 9193384 - DNA, 22 bp, Homo sapiens
tggagcctccagtctttctaga

SEQ ID NO: 9193385 - DNA, 22 bp, Homo sapiens
tggagcccctcacccacacctg

SEQ ID NO: 9193386 - DNA, 22 bp, Homo sapiens
tggagcccaggtgcaagagagt

SEQ ID NO: 9193387 - DNA, 22 bp, Homo sapiens
tggagcccatgagccataccag

SEQ ID NO: 9193388 - DNA, 22 bp, Homo sapiens
tggagcccacggatgtcgcttt

SEQ ID NO: 9193389 - DNA, 22 bp, Homo sapiens
tggagcccacggatgtcgcttt

SEQ ID NO: 9193390 - DNA, 22 bp, Homo sapiens
tggagcccagacactggcattg

SEQ ID NO: 9193391 - DNA, 22 bp, Homo sapiens
tggagccagtgttgcccaacac

SEQ ID NO: 9193392 - DNA, 22 bp, Homo sapiens
tggagccagggtagaagcagag

SEQ ID NO: 9193393 - DNA, 20 bp, Homo sapiens
tggagccagggacctgttct

SEQ ID NO: 9193394 - DNA, 22 bp, Homo sapiens
tggagctgaactttgaggccag

SEQ ID NO: 9193395 - DNA, 22 bp, Homo sapiens
tggagctgaactttgaggccag

SEQ ID NO: 9193396 - DNA, 21 bp, Homo sapiens
tggagctgaatttttggcatc

SEQ ID NO: 9193397 - DNA, 21 bp, Homo sapiens
tggagctgaatttttggcatc

SEQ ID NO: 9193398 - DNA, 23 bp, Homo sapiens
tggagcctgggatacaatagatg

SEQ ID NO: 9193399 - DNA, 22 bp, Homo sapiens
tggagcctgtgtttctgcccag

SEQ ID NO: 9193400 - DNA, 22 bp, Homo sapiens
tggagcctgttctgagaagccg

SEQ ID NO: 9193401 - DNA, 22 bp, Homo sapiens
tggagcctgttctgagaagccg

SEQ ID NO: 9193402 - DNA, 22 bp, Homo sapiens
tggagctcaaaggcctgtggga

SEQ ID NO: 9193403 - DNA, 23 bp, Homo sapiens
tggagctcctgcccatcctggct

SEQ ID NO: 9193404 - DNA, 22 bp, Homo sapiens
tggagctgcctggcacctacag

SEQ ID NO: 9193405 - DNA, 22 bp, Homo sapiens
tggagctgcctggcacctacag

SEQ ID NO: 9193406 - DNA, 18 bp, Homo sapiens
tggagctgagtgctgtgc

SEQ ID NO: 9193407 - DNA, 18 bp, Homo sapiens
tggagctgagtgctgtgc

SEQ ID NO: 9193408 - DNA, 22 bp, Homo sapiens
tggagctgatacagctggcttt

SEQ ID NO: 9193409 - DNA, 22 bp, Homo sapiens
tggagctggaatttgagctgga

SEQ ID NO: 9193410 - DNA, 22 bp, Homo sapiens
tggagctggaatttgagctgga

SEQ ID NO: 9193411 - DNA, 22 bp, Homo sapiens
tggagctggcttgtggaagttg

SEQ ID NO: 9193412 - DNA, 22 bp, Homo sapiens
tggagctggcttgtggaagttg

SEQ ID NO: 9193413 - DNA, 22 bp, Homo sapiens
tggagctggaagacagtgatat

SEQ ID NO: 9193414 - DNA, 22 bp, Homo sapiens
tggagctggaagacagtgatat

SEQ ID NO: 9193415 - DNA, 22 bp, Homo sapiens
tggagctggaatttctgggcct

SEQ ID NO: 9193416 - DNA, 22 bp, Homo sapiens
tggagccagcaggactcagagg

SEQ ID NO: 9193417 - DNA, 22 bp, Homo sapiens
tggagccagcggcctgctgagg

SEQ ID NO: 9193418 - DNA, 18 bp, Homo sapiens
tggagccagctctaggat

SEQ ID NO: 9193419 - DNA, 18 bp, Homo sapiens
tggagccagctctaggat

SEQ ID NO: 9193420 - DNA, 22 bp, Homo sapiens
tggagcatgagagtctttagct

SEQ ID NO: 9193421 - DNA, 22 bp, Homo sapiens
tggagcagtggtcctggagatg

SEQ ID NO: 9193422 - DNA, 22 bp, Homo sapiens
tggagcatactaacccactctg

SEQ ID NO: 9193423 - DNA, 22 bp, Homo sapiens
tggagccaaggccagttctcag

SEQ ID NO: 9193424 - DNA, 22 bp, Homo sapiens
tggagccaatgaacatttgctg

SEQ ID NO: 9193425 - DNA, 22 bp, Homo sapiens
tggagccaaaaagggaaggaga

SEQ ID NO: 9193426 - DNA, 22 bp, Homo sapiens
tggagcaggtgggatgtcgtga

SEQ ID NO: 9193427 - DNA, 22 bp, Homo sapiens
tggagcaggtgctcagggtaat

SEQ ID NO: 9193428 - DNA, 22 bp, Homo sapiens
tggagcaggaaacatctagagg

SEQ ID NO: 9193429 - DNA, 18 bp, Homo sapiens
tggagcaggaagcctggc

SEQ ID NO: 9193430 - DNA, 22 bp, Homo sapiens
tggagcagctaagcctctgaga

SEQ ID NO: 9193431 - DNA, 22 bp, Homo sapiens
tggagcagctctagcgggcgcc

SEQ ID NO: 9193432 - DNA, 22 bp, Homo sapiens
tggagcagctgaacagagttga

SEQ ID NO: 9193433 - DNA, 22 bp, Homo sapiens
tggagcaggtcggcaccatttg

SEQ ID NO: 9193434 - DNA, 22 bp, Homo sapiens
tggagcaggtgccaggtgtgtg

SEQ ID NO: 9193435 - DNA, 22 bp, Homo sapiens
tggagcaggaagtctatggctg

SEQ ID NO: 9193436 - DNA, 22 bp, Homo sapiens
tggagcaggacggggagtggta

SEQ ID NO: 9193437 - DNA, 23 bp, Homo sapiens
tgtaaaatggggtagtgttacca

SEQ ID NO: 9193438 - DNA, 22 bp, Homo sapiens
tgtaaaataattctccatgttt

SEQ ID NO: 9193439 - DNA, 20 bp, Homo sapiens
tgtaaaacaaggtgaatcct

SEQ ID NO: 9193440 - DNA, 22 bp, Homo sapiens
tgtaaaaccaaatcaatctagt

SEQ ID NO: 9193441 - DNA, 22 bp, Homo sapiens
tgtaaaaagcccagccgctgag

SEQ ID NO: 9193442 - DNA, 22 bp, Homo sapiens
tgtaaaacaaaatttgtggaga

SEQ ID NO: 9193443 - DNA, 22 bp, Homo sapiens
tggttttgctaaaatagaaaga

SEQ ID NO: 9193444 - DNA, 22 bp, Homo sapiens
tggttttagagtatattcaggg

SEQ ID NO: 9193445 - DNA, 18 bp, Homo sapiens
tggtttgtcatgagaatt

SEQ ID NO: 9193446 - DNA, 22 bp, Homo sapiens
tggtttgagagtgtgagctttt

SEQ ID NO: 9193447 - DNA, 22 bp, Homo sapiens
tggtttctttccactctccacc

SEQ ID NO: 9193448 - DNA, 18 bp, Homo sapiens
tgtaaacactttcattct

SEQ ID NO: 9193449 - DNA, 18 bp, Homo sapiens
tgtaaacactttcattct

SEQ ID NO: 9193450 - DNA, 22 bp, Homo sapiens
tgtaaaggtaggtgcaaaatga

SEQ ID NO: 9193451 - DNA, 22 bp, Homo sapiens
tgtaaagcatttcctaaatcca

SEQ ID NO: 9193452 - DNA, 22 bp, Homo sapiens
tgtaaagattagattacatgaa

SEQ ID NO: 9193453 - DNA, 22 bp, Homo sapiens
tgtaaagattagattacatgaa

SEQ ID NO: 9193454 - DNA, 22 bp, Homo sapiens
tgtaaataatgcatgtaaatca

SEQ ID NO: 9193455 - DNA, 22 bp, Homo sapiens
tgtaaataattcctaggctttt

SEQ ID NO: 9193456 - DNA, 22 bp, Homo sapiens
tgtaaagtccaagatcaaagag

SEQ ID NO: 9193457 - DNA, 22 bp, Homo sapiens
tgtaaatagttagcttgcctct

SEQ ID NO: 9193458 - DNA, 22 bp, Homo sapiens
tggtgttacctattgactgagt

SEQ ID NO: 9193459 - DNA, 22 bp, Homo sapiens
tggtgtgtgagtcaagacaagt

SEQ ID NO: 9193460 - DNA, 22 bp, Homo sapiens
tggtgtttaatgggctgtttat

SEQ ID NO: 9193461 - DNA, 22 bp, Homo sapiens
tggtgtttaatgggctgtttat

SEQ ID NO: 9193462 - DNA, 22 bp, Homo sapiens
tggtgttttctttagactttat

SEQ ID NO: 9193463 - DNA, 22 bp, Homo sapiens
tggtgtctggcacacaggaagc

SEQ ID NO: 9193464 - DNA, 22 bp, Homo sapiens
tggtgtctgcactccctggcgt

SEQ ID NO: 9193465 - DNA, 22 bp, Homo sapiens
tggtgtcttggaagtaggtgct

SEQ ID NO: 9193466 - DNA, 23 bp, Homo sapiens
tggtggggtcttggagacagcac

SEQ ID NO: 9193467 - DNA, 23 bp, Homo sapiens
tggtggggtcttggagacagcac

SEQ ID NO: 9193468 - DNA, 23 bp, Homo sapiens
tggtggggtcttggagacagcac

SEQ ID NO: 9193469 - DNA, 22 bp, Homo sapiens
tggtgtctccatcctgccctgc

SEQ ID NO: 9193470 - DNA, 23 bp, Homo sapiens
tggtggttgatctggggcacagc

SEQ ID NO: 9193471 - DNA, 22 bp, Homo sapiens
tggtgggtcggctgggagagct

SEQ ID NO: 9193472 - DNA, 18 bp, Homo sapiens
tggtggtgacagggtcat

SEQ ID NO: 9193473 - DNA, 22 bp, Homo sapiens
tggttaagtccagaaaggaagc

SEQ ID NO: 9193474 - DNA, 22 bp, Homo sapiens
tggttaagtccagaaaggaagc

SEQ ID NO: 9193475 - DNA, 22 bp, Homo sapiens
tggtgttttctaagaaagtgtg

SEQ ID NO: 9193476 - DNA, 22 bp, Homo sapiens
tggttgcctctcagagattccg

SEQ ID NO: 9193477 - DNA, 22 bp, Homo sapiens
tggttctgctcaagccagactg

SEQ ID NO: 9193478 - DNA, 22 bp, Homo sapiens
tggtttctctgaactctacgac

SEQ ID NO: 9193479 - DNA, 22 bp, Homo sapiens
tggtttctgtctgagttcctcc

SEQ ID NO: 9193480 - DNA, 22 bp, Homo sapiens
tggtttcagtgccaatacagta

SEQ ID NO: 9193481 - DNA, 22 bp, Homo sapiens
tggtttatatcttgattctagt

SEQ ID NO: 9193482 - DNA, 22 bp, Homo sapiens
tgtacacaattcttaacataca

SEQ ID NO: 9193483 - DNA, 22 bp, Homo sapiens
tgtacacaattcttaacataca

SEQ ID NO: 9193484 - DNA, 22 bp, Homo sapiens
tgtacaatggctataataccct

SEQ ID NO: 9193485 - DNA, 22 bp, Homo sapiens
tgtacaatgccgagactaactc

SEQ ID NO: 9193486 - DNA, 19 bp, Homo sapiens
tgtacaaggattatgcagg

SEQ ID NO: 9193487 - DNA, 22 bp, Homo sapiens
tgtacaaattcattgaactgta

SEQ ID NO: 9193488 - DNA, 22 bp, Homo sapiens
tgtacaatctgatgatgtatgg

SEQ ID NO: 9193489 - DNA, 22 bp, Homo sapiens
tgtacagattgatcatggagag

SEQ ID NO: 9193490 - DNA, 22 bp, Homo sapiens
tgtacaggagaacaatgagaaa

SEQ ID NO: 9193491 - DNA, 22 bp, Homo sapiens
tgtaccaggtgatggagtcata

SEQ ID NO: 9193492 - DNA, 22 bp, Homo sapiens
tgtaccaggccctgtggacatg

SEQ ID NO: 9193493 - DNA, 23 bp, Homo sapiens
tgtaccaggagtttcagcagact

SEQ ID NO: 9193494 - DNA, 20 bp, Homo sapiens
tgtaccataatgactggctc

SEQ ID NO: 9193495 - DNA, 22 bp, Homo sapiens
tgtaccatatatgttactgact

SEQ ID NO: 9193496 - DNA, 22 bp, Homo sapiens
tgtaccataggtctatcattct

SEQ ID NO: 9193497 - DNA, 22 bp, Homo sapiens
tgtaccataatgtgtattttaa

SEQ ID NO: 9193498 - DNA, 22 bp, Homo sapiens
tgtaccagtgttgagaatgaga

SEQ ID NO: 9193499 - DNA, 22 bp, Homo sapiens
tgtaccatgcgacgcctctcac

SEQ ID NO: 9193500 - DNA, 22 bp, Homo sapiens
tgtaccatgtgactggagtctt

SEQ ID NO: 9193501 - DNA, 22 bp, Homo sapiens
tgtaccatgcgacgcctctcac

SEQ ID NO: 9193502 - DNA, 22 bp, Homo sapiens
tgtacagaaattcctactacat

SEQ ID NO: 9193503 - DNA, 22 bp, Homo sapiens
tgtacacctgtctttacacata

SEQ ID NO: 9193504 - DNA, 22 bp, Homo sapiens
tgtaacaatttcttactattgt

SEQ ID NO: 9193505 - DNA, 23 bp, Homo sapiens
tgtaacaatttcatatacatgca

SEQ ID NO: 9193506 - DNA, 23 bp, Homo sapiens
tgtaacaatttcatatacatgca

SEQ ID NO: 9193507 - DNA, 22 bp, Homo sapiens
tgtaacatggttcttactctca

SEQ ID NO: 9193508 - DNA, 22 bp, Homo sapiens
tgtaacatggttcttactctca

SEQ ID NO: 9193509 - DNA, 22 bp, Homo sapiens
tgtaaattgaaggaaatttgtg

SEQ ID NO: 9193510 - DNA, 22 bp, Homo sapiens
tgtaaattctatacacttaaaa

SEQ ID NO: 9193511 - DNA, 21 bp, Homo sapiens
tgtaacaaaatactgcagatt

SEQ ID NO: 9193512 - DNA, 22 bp, Homo sapiens
tgtaacaatgaatatagtgact

SEQ ID NO: 9193513 - DNA, 22 bp, Homo sapiens
tgtaattttctcaagtttctac

SEQ ID NO: 9193514 - DNA, 22 bp, Homo sapiens
tgtacaaagagtatagctttga

SEQ ID NO: 9193515 - DNA, 22 bp, Homo sapiens
tgtaattttctcaagtttctac

SEQ ID NO: 9193516 - DNA, 22 bp, Homo sapiens
tgtacaaagttaaacctatata

SEQ ID NO: 9193517 - DNA, 22 bp, Homo sapiens
tgtacaaagccagaactcccaa

SEQ ID NO: 9193518 - DNA, 22 bp, Homo sapiens
tgtacaaagagtatagctttga

SEQ ID NO: 9193519 - DNA, 22 bp, Homo sapiens
tgtaactcagaaagtcttcatt

SEQ ID NO: 9193520 - DNA, 22 bp, Homo sapiens
tgtaactgccatgtagcctgtc

SEQ ID NO: 9193521 - DNA, 22 bp, Homo sapiens
tgtaagaaaacctgtacaaaga

SEQ ID NO: 9193522 - DNA, 20 bp, Homo sapiens
tgtaagaagtaggagggtta

SEQ ID NO: 9193523 - DNA, 22 bp, Homo sapiens
tgtaagaatcagtctttaatgt

SEQ ID NO: 9193524 - DNA, 22 bp, Homo sapiens
tgtaagatgctgggatagatga

SEQ ID NO: 9193525 - DNA, 22 bp, Homo sapiens
tgtaagattctaagagttaatg

SEQ ID NO: 9193526 - DNA, 22 bp, Homo sapiens
tgtaagatatgagtacatgtaa

SEQ ID NO: 9193527 - DNA, 22 bp, Homo sapiens
tgtaagatattcagcttattga

SEQ ID NO: 9193528 - DNA, 22 bp, Homo sapiens
tgtaagatatgagtacatgtaa

SEQ ID NO: 9193529 - DNA, 22 bp, Homo sapiens
tggtgcagacaggagccccgct

SEQ ID NO: 9193530 - DNA, 22 bp, Homo sapiens
tggtgcagagagggatctaggg

SEQ ID NO: 9193531 - DNA, 22 bp, Homo sapiens
tggtgaggccaaagccatgaca

SEQ ID NO: 9193532 - DNA, 22 bp, Homo sapiens
tggtctctgtgctcgggcatgg

SEQ ID NO: 9193533 - DNA, 18 bp, Homo sapiens
tggtgaagggtggaggag

SEQ ID NO: 9193534 - DNA, 22 bp, Homo sapiens
tggtgacagcatggaagaagtg

SEQ ID NO: 9193535 - DNA, 22 bp, Homo sapiens
tggtctctacggaggaaagctg

SEQ ID NO: 9193536 - DNA, 22 bp, Homo sapiens
tggtctctgcaggccaggctca

SEQ ID NO: 9193537 - DNA, 22 bp, Homo sapiens
tggtccttcttgaagagtgagt

SEQ ID NO: 9193538 - DNA, 22 bp, Homo sapiens
tggtccttgctatagagtgata

SEQ ID NO: 9193539 - DNA, 21 bp, Homo sapiens
tggtccttctttactgcctcc

SEQ ID NO: 9193540 - DNA, 22 bp, Homo sapiens
tggtcctttaagtctttctctg

SEQ ID NO: 9193541 - DNA, 22 bp, Homo sapiens
tggtcctggtagcggtgtgctt

SEQ ID NO: 9193542 - DNA, 22 bp, Homo sapiens
tggtcctggtcatctgggctgg

SEQ ID NO: 9193543 - DNA, 22 bp, Homo sapiens
tggtcctggtgcaagtgcattt

SEQ ID NO: 9193544 - DNA, 22 bp, Homo sapiens
tggtcctggggatctgcagtga

SEQ ID NO: 9193545 - DNA, 22 bp, Homo sapiens
tggtcctggggatctgcagtga

SEQ ID NO: 9193546 - DNA, 22 bp, Homo sapiens
tggtcctggggtgcaggctgac

SEQ ID NO: 9193547 - DNA, 22 bp, Homo sapiens
tggtcctgtagcacttgattag

SEQ ID NO: 9193548 - DNA, 23 bp, Homo sapiens
tggtcctggttgaggtgggcccc

SEQ ID NO: 9193549 - DNA, 20 bp, Homo sapiens
tggtcctgtcccacccactc

SEQ ID NO: 9193550 - DNA, 20 bp, Homo sapiens
tggtcctgtcccacccactc

SEQ ID NO: 9193551 - DNA, 22 bp, Homo sapiens
tggtcctgtagctctctaagtt

SEQ ID NO: 9193552 - DNA, 22 bp, Homo sapiens
tggtcctgtctcaaggagcctt

SEQ ID NO: 9193553 - DNA, 22 bp, Homo sapiens
tggtcctgtctcaaggagcctt

SEQ ID NO: 9193554 - DNA, 22 bp, Homo sapiens
tggtcctgtgttcttcctgcct

SEQ ID NO: 9193555 - DNA, 22 bp, Homo sapiens
tggtccttctctgcctgcagtg

SEQ ID NO: 9193556 - DNA, 22 bp, Homo sapiens
tggtcctgagcaccagcctgac

SEQ ID NO: 9193557 - DNA, 22 bp, Homo sapiens
tggtcctgagaatcctgtcctc

SEQ ID NO: 9193558 - DNA, 22 bp, Homo sapiens
tggtcctgcagtaatagacatc

SEQ ID NO: 9193559 - DNA, 22 bp, Homo sapiens
tggtcctgatcaccgctgggca

SEQ ID NO: 9193560 - DNA, 22 bp, Homo sapiens
tggtcctgaggcttgtttccac

SEQ ID NO: 9193561 - DNA, 22 bp, Homo sapiens
tggtcctgccccgtgcacagag

SEQ ID NO: 9193562 - DNA, 22 bp, Homo sapiens
tggtcctgcccacgcccatctg

SEQ ID NO: 9193563 - DNA, 23 bp, Homo sapiens
tggtcctgccaacggtgcccctc

SEQ ID NO: 9193564 - DNA, 22 bp, Homo sapiens
tggtcctgcttgctgcttaaga

SEQ ID NO: 9193565 - DNA, 22 bp, Homo sapiens
tggtcctgccccgtgcacagag

SEQ ID NO: 9193566 - DNA, 22 bp, Homo sapiens
tggtcctgctacaggggattag

SEQ ID NO: 9193567 - DNA, 22 bp, Homo sapiens
tggtcctgccccgtgcacagag

SEQ ID NO: 9193568 - DNA, 22 bp, Homo sapiens
tggtcctgccccgtgcacagag

SEQ ID NO: 9193569 - DNA, 22 bp, Homo sapiens
tggtcctggagatcaatatgca

SEQ ID NO: 9193570 - DNA, 22 bp, Homo sapiens
tggtcctggccttgaccccagg

SEQ ID NO: 9193571 - DNA, 22 bp, Homo sapiens
tggtcctggccttgaccccagg

SEQ ID NO: 9193572 - DNA, 22 bp, Homo sapiens
tggtcctgggcacagtatatgc

SEQ ID NO: 9193573 - DNA, 22 bp, Homo sapiens
tggtcctggagagtgttccata

SEQ ID NO: 9193574 - DNA, 22 bp, Homo sapiens
tggtcctggaaggtcctgaggg

SEQ ID NO: 9193575 - DNA, 22 bp, Homo sapiens
tggtcctggaaggtcctgaggg

SEQ ID NO: 9193576 - DNA, 22 bp, Homo sapiens
tggtcagcgtttgtcagagcag

SEQ ID NO: 9193577 - DNA, 22 bp, Homo sapiens
tggtcaggctgctctgcggcgt

SEQ ID NO: 9193578 - DNA, 22 bp, Homo sapiens
tggtcaggggcttctgagctgt

SEQ ID NO: 9193579 - DNA, 22 bp, Homo sapiens
tggtcaggggcttctgagctgt

SEQ ID NO: 9193580 - DNA, 22 bp, Homo sapiens
tggtcaggggcttctgagctgt

SEQ ID NO: 9193581 - DNA, 22 bp, Homo sapiens
tggtcagagcccctttcataga

SEQ ID NO: 9193582 - DNA, 22 bp, Homo sapiens
tggtcagaggaccaaactagtg

SEQ ID NO: 9193583 - DNA, 22 bp, Homo sapiens
tggtcagacaaaggagaatgtt

SEQ ID NO: 9193584 - DNA, 22 bp, Homo sapiens
tggtcaggtacctctggctgtc

SEQ ID NO: 9193585 - DNA, 22 bp, Homo sapiens
tggtcagttgatcaggcagcag

SEQ ID NO: 9193586 - DNA, 22 bp, Homo sapiens
tggtccagactttgacctctca

SEQ ID NO: 9193587 - DNA, 22 bp, Homo sapiens
tggtgggggaggctgtctagca

SEQ ID NO: 9193588 - DNA, 22 bp, Homo sapiens
tggtggggctttccttctgctt

SEQ ID NO: 9193589 - DNA, 22 bp, Homo sapiens
tggtggggattccctccctggc

SEQ ID NO: 9193590 - DNA, 16 bp, Homo sapiens
tggtggggaggacagc

SEQ ID NO: 9193591 - DNA, 16 bp, Homo sapiens
tggtggggaggacagc

SEQ ID NO: 9193592 - DNA, 16 bp, Homo sapiens
tggtggggaggacagc

SEQ ID NO: 9193593 - DNA, 22 bp, Homo sapiens
tggtgggcacagtgcccaggct

SEQ ID NO: 9193594 - DNA, 22 bp, Homo sapiens
tggtgggagtccgctgtgctgc

SEQ ID NO: 9193595 - DNA, 22 bp, Homo sapiens
tggtggcaatgtcctggagaag

SEQ ID NO: 9193596 - DNA, 19 bp, Homo sapiens
tggtggcaatgtcagctaa

SEQ ID NO: 9193597 - DNA, 23 bp, Homo sapiens
tggtggcagaagtagcagatgac

SEQ ID NO: 9193598 - DNA, 23 bp, Homo sapiens
tggtggcagaagtagcagatgac

SEQ ID NO: 9193599 - DNA, 22 bp, Homo sapiens
tggtggcacaagggagagaatc

SEQ ID NO: 9193600 - DNA, 22 bp, Homo sapiens
tggtggcagctgggacagaggt

SEQ ID NO: 9193601 - DNA, 22 bp, Homo sapiens
tggtggcagcaggagggcccct

SEQ ID NO: 9193602 - DNA, 22 bp, Homo sapiens
tggtggcagctgagtgtcaggt

SEQ ID NO: 9193603 - DNA, 22 bp, Homo sapiens
tggtggcatcactcagcctccc

SEQ ID NO: 9193604 - DNA, 22 bp, Homo sapiens
tggtggcatcaattgacttctc

SEQ ID NO: 9193605 - DNA, 22 bp, Homo sapiens
tggtggacgatgcccagctgga

SEQ ID NO: 9193606 - DNA, 22 bp, Homo sapiens
tggtggacaccgcagccatgaa

SEQ ID NO: 9193607 - DNA, 22 bp, Homo sapiens
tggtggagctgtggccacgacc

SEQ ID NO: 9193608 - DNA, 22 bp, Homo sapiens
tggtggcaacattgctggagtg

SEQ ID NO: 9193609 - DNA, 22 bp, Homo sapiens
tggtggcaaatcaggacacttc

SEQ ID NO: 9193610 - DNA, 19 bp, Homo sapiens
tggtggaggtgcacctgac

SEQ ID NO: 9193611 - DNA, 19 bp, Homo sapiens
tggtggaggtgcacctgac

SEQ ID NO: 9193612 - DNA, 21 bp, Homo sapiens
tggtggagtgtgctgagcatg

SEQ ID NO: 9193613 - DNA, 21 bp, Homo sapiens
tggtggagtgtgctgagcatg

SEQ ID NO: 9193614 - DNA, 22 bp, Homo sapiens
tggtgcagtcattggcccaggg

SEQ ID NO: 9193615 - DNA, 22 bp, Homo sapiens
tggtgcagtagagctgtctggg

SEQ ID NO: 9193616 - DNA, 22 bp, Homo sapiens
tggtgcagtagagctgtctggg

SEQ ID NO: 9193617 - DNA, 22 bp, Homo sapiens
tggtgcagtcattggcccaggg

SEQ ID NO: 9193618 - DNA, 22 bp, Homo sapiens
tggtgcagatagtggtgtagta

SEQ ID NO: 9193619 - DNA, 22 bp, Homo sapiens
tggtgcagatgcaggtcactgg

SEQ ID NO: 9193620 - DNA, 22 bp, Homo sapiens
tggtgcaggagttggcagggac

SEQ ID NO: 9193621 - DNA, 22 bp, Homo sapiens
tgtatgaacctttaatatagtg

SEQ ID NO: 9193622 - DNA, 22 bp, Homo sapiens
tgtatcactcagcaaagtgtct

SEQ ID NO: 9193623 - DNA, 22 bp, Homo sapiens
tgtatccatggtggtcaatgac

SEQ ID NO: 9193624 - DNA, 22 bp, Homo sapiens
tgtatcatatggggaagcttca

SEQ ID NO: 9193625 - DNA, 22 bp, Homo sapiens
tgtatatgtcctggcatgtcat

SEQ ID NO: 9193626 - DNA, 22 bp, Homo sapiens
tgtatatgcactttccttatcc

SEQ ID NO: 9193627 - DNA, 22 bp, Homo sapiens
tgtatatgtgtattttatgaca

SEQ ID NO: 9193628 - DNA, 22 bp, Homo sapiens
tgtatatgtttgtatgtacaca

SEQ ID NO: 9193629 - DNA, 22 bp, Homo sapiens
tgtatatgtttgtatgtacaca

SEQ ID NO: 9193630 - DNA, 22 bp, Homo sapiens
tgtatatgtgatgtacatgtac

SEQ ID NO: 9193631 - DNA, 22 bp, Homo sapiens
tgtatatgtgcacatgtgcttc

SEQ ID NO: 9193632 - DNA, 22 bp, Homo sapiens
tgtatcaagatcagcagctgtt

SEQ ID NO: 9193633 - DNA, 22 bp, Homo sapiens
tgtatcaagggtttatgtaagc

SEQ ID NO: 9193634 - DNA, 22 bp, Homo sapiens
tgtatcaaaccaaattaattct

SEQ ID NO: 9193635 - DNA, 22 bp, Homo sapiens
tgtatattgcctgagtctttcc

SEQ ID NO: 9193636 - DNA, 22 bp, Homo sapiens
tgtatattctgcctaaaagctt

SEQ ID NO: 9193637 - DNA, 22 bp, Homo sapiens
tgtataaacttaagcaggaacc

SEQ ID NO: 9193638 - DNA, 22 bp, Homo sapiens
tgtataaacttaagcaggaacc

SEQ ID NO: 9193639 - DNA, 19 bp, Homo sapiens
tgtataagaatgtatctgt

SEQ ID NO: 9193640 - DNA, 22 bp, Homo sapiens
tgtatacaaattggaatcagat

SEQ ID NO: 9193641 - DNA, 22 bp, Homo sapiens
tgtataagtgtgtagagtaaga

SEQ ID NO: 9193642 - DNA, 19 bp, Homo sapiens
tgtataagaatgtatctgt

SEQ ID NO: 9193643 - DNA, 21 bp, Homo sapiens
tgtatacacgtgttgaaaaca

SEQ ID NO: 9193644 - DNA, 21 bp, Homo sapiens
tgtatacacgtgttgaaaaca

SEQ ID NO: 9193645 - DNA, 22 bp, Homo sapiens
tgtatacaattcacacttccca

SEQ ID NO: 9193646 - DNA, 22 bp, Homo sapiens
tgtatacaagtcgtgtaaactt

SEQ ID NO: 9193647 - DNA, 22 bp, Homo sapiens
tgtatacaagtcgtgtaaactt

SEQ ID NO: 9193648 - DNA, 22 bp, Homo sapiens
tgtatacatgtctgtgtgcaca

SEQ ID NO: 9193649 - DNA, 22 bp, Homo sapiens
tgtatacatgtctgtgtgcaca

SEQ ID NO: 9193650 - DNA, 22 bp, Homo sapiens
tgtatagagttggaagatgact

SEQ ID NO: 9193651 - DNA, 22 bp, Homo sapiens
tgtatacatttaactagataga

SEQ ID NO: 9193652 - DNA, 22 bp, Homo sapiens
tgtatagtttcttagttactga

SEQ ID NO: 9193653 - DNA, 22 bp, Homo sapiens
tgtatagtgtggaaagaacagt

SEQ ID NO: 9193654 - DNA, 22 bp, Homo sapiens
tgtatagttgagtcaagtttca

SEQ ID NO: 9193655 - DNA, 18 bp, Homo sapiens
tgtagagccaggtttgcc

SEQ ID NO: 9193656 - DNA, 22 bp, Homo sapiens
tgtagataagtaaaagcccagt

SEQ ID NO: 9193657 - DNA, 22 bp, Homo sapiens
tgtagattttggagtctacaag

SEQ ID NO: 9193658 - DNA, 22 bp, Homo sapiens
tgtagcagtgtctaccacatta

SEQ ID NO: 9193659 - DNA, 22 bp, Homo sapiens
tgtagcagagtatctctgtttt

SEQ ID NO: 9193660 - DNA, 23 bp, Homo sapiens
tgtagctgtctgagcagacactg

SEQ ID NO: 9193661 - DNA, 22 bp, Homo sapiens
tgtagctctccagccagcaagg

SEQ ID NO: 9193662 - DNA, 19 bp, Homo sapiens
tgtagcagtttaaaacaac

SEQ ID NO: 9193663 - DNA, 17 bp, Homo sapiens
tgtagcttctccttctc

SEQ ID NO: 9193664 - DNA, 17 bp, Homo sapiens
tgtagcttctccttctc

SEQ ID NO: 9193665 - DNA, 20 bp, Homo sapiens
tgtactgcttgataaatggt

SEQ ID NO: 9193666 - DNA, 22 bp, Homo sapiens
tgtactattaagaggcctaaat

SEQ ID NO: 9193667 - DNA, 22 bp, Homo sapiens
tgtacttgaacttgactgtaga

SEQ ID NO: 9193668 - DNA, 22 bp, Homo sapiens
tgtacttatgagatcctagtcg

SEQ ID NO: 9193669 - DNA, 22 bp, Homo sapiens
tgtagaaactacacatgcaaca

SEQ ID NO: 9193670 - DNA, 22 bp, Homo sapiens
tgtagaaactacacatgcaaca

SEQ ID NO: 9193671 - DNA, 18 bp, Homo sapiens
tgtagagccaggtttgcc

SEQ ID NO: 9193672 - DNA, 22 bp, Homo sapiens
tgtagaaggctatagactagga

SEQ ID NO: 9193673 - DNA, 22 bp, Homo sapiens
tgtagaagttcttcaggagaat

SEQ ID NO: 9193674 - DNA, 22 bp, Homo sapiens
tgtagaaattagtaagatcaac

SEQ ID NO: 9193675 - DNA, 22 bp, Homo sapiens
tgtatttcctggtttagatcaa

SEQ ID NO: 9193676 - DNA, 22 bp, Homo sapiens
tgtatttctgctttctctagta

SEQ ID NO: 9193677 - DNA, 22 bp, Homo sapiens
tgtatttgaaacagtgcatggg

SEQ ID NO: 9193678 - DNA, 22 bp, Homo sapiens
tgtatttgagttatgaaagaga

SEQ ID NO: 9193679 - DNA, 22 bp, Homo sapiens
tgtatttggtgtatttaatgag

SEQ ID NO: 9193680 - DNA, 22 bp, Homo sapiens
tgtatttggtgtatttaatgag

SEQ ID NO: 9193681 - DNA, 22 bp, Homo sapiens
tgtatttggtgtatttaatgag

SEQ ID NO: 9193682 - DNA, 22 bp, Homo sapiens
tgtatttgggtcacaagatggg

SEQ ID NO: 9193683 - DNA, 17 bp, Homo sapiens
tgtatttgtaccacagc

SEQ ID NO: 9193684 - DNA, 22 bp, Homo sapiens
tgtatttgttgttaaatggaga

SEQ ID NO: 9193685 - DNA, 22 bp, Homo sapiens
tgtatttgtgataacgacctga

SEQ ID NO: 9193686 - DNA, 22 bp, Homo sapiens
tgtatttgggtcacaagatggg

SEQ ID NO: 9193687 - DNA, 22 bp, Homo sapiens
tgtatttgatgagaggagggtc

SEQ ID NO: 9193688 - DNA, 22 bp, Homo sapiens
tgtatttgagttatgaaagaga

SEQ ID NO: 9193689 - DNA, 22 bp, Homo sapiens
tgtatttgatgagaggagggtc

SEQ ID NO: 9193690 - DNA, 22 bp, Homo sapiens
tgtatttcaattttagcaccaa

SEQ ID NO: 9193691 - DNA, 20 bp, Homo sapiens
tgtatttcatgcattcctgg

SEQ ID NO: 9193692 - DNA, 22 bp, Homo sapiens
tgtattttgtgaggatcactct

SEQ ID NO: 9193693 - DNA, 22 bp, Homo sapiens
tgtattttgtgaggatcactct

SEQ ID NO: 9193694 - DNA, 22 bp, Homo sapiens
tgtattttgtgaggatcactct

SEQ ID NO: 9193695 - DNA, 22 bp, Homo sapiens
tgtattttgtgaggatcactct

SEQ ID NO: 9193696 - DNA, 22 bp, Homo sapiens
tgtattttcttctggaagctta

SEQ ID NO: 9193697 - DNA, 22 bp, Homo sapiens
tgtattttgagtccaatctcct

SEQ ID NO: 9193698 - DNA, 22 bp, Homo sapiens
tgtattttgagtccaatctcct

SEQ ID NO: 9193699 - DNA, 22 bp, Homo sapiens
tgtattttctgaagataatcaa

SEQ ID NO: 9193700 - DNA, 22 bp, Homo sapiens
tgtattttctgaggagcattag

SEQ ID NO: 9193701 - DNA, 22 bp, Homo sapiens
tgtattttcagagtggcatttc

SEQ ID NO: 9193702 - DNA, 22 bp, Homo sapiens
tgtattttcagagtggcatttc

SEQ ID NO: 9193703 - DNA, 22 bp, Homo sapiens
tgtattttcagagtggcatttc

SEQ ID NO: 9193704 - DNA, 23 bp, Homo sapiens
tgtattgaaggtgtagtttgtag

SEQ ID NO: 9193705 - DNA, 22 bp, Homo sapiens
tgtattgttataatttgtatgt

SEQ ID NO: 9193706 - DNA, 22 bp, Homo sapiens
tgtatgcatctttgataaatag

SEQ ID NO: 9193707 - DNA, 22 bp, Homo sapiens
tgtatgcacatggataagtatg

SEQ ID NO: 9193708 - DNA, 22 bp, Homo sapiens
tgtatgcacatatataggtaca

SEQ ID NO: 9193709 - DNA, 22 bp, Homo sapiens
tgtcaattatcaaggttcattt

SEQ ID NO: 9193710 - DNA, 22 bp, Homo sapiens
tgtcaattaaagtttgtaggtg

SEQ ID NO: 9193711 - DNA, 22 bp, Homo sapiens
tgtcaatgtgtacaggagctca

SEQ ID NO: 9193712 - DNA, 22 bp, Homo sapiens
tgtcacaaaaatcagtaattgc

SEQ ID NO: 9193713 - DNA, 22 bp, Homo sapiens
tgtcaatgaagatatgaataat

SEQ ID NO: 9193714 - DNA, 22 bp, Homo sapiens
tgtcaatatgtaataactgaat

SEQ ID NO: 9193715 - DNA, 22 bp, Homo sapiens
tgtcaaaaccttggaggcaagg

SEQ ID NO: 9193716 - DNA, 22 bp, Homo sapiens
tgtcaaaaccagcaattttgtt

SEQ ID NO: 9193717 - DNA, 22 bp, Homo sapiens
tgtcaaaaataagagagattgt

SEQ ID NO: 9193718 - DNA, 22 bp, Homo sapiens
tgtatttttaggaatgcgctat

SEQ ID NO: 9193719 - DNA, 22 bp, Homo sapiens
tgtatttttaggaatgcgctat

SEQ ID NO: 9193720 - DNA, 22 bp, Homo sapiens
tgtcaaaaataagagagattgt

SEQ ID NO: 9193721 - DNA, 22 bp, Homo sapiens
tgtatttttagacctttagacc

SEQ ID NO: 9193722 - DNA, 22 bp, Homo sapiens
tgtcacataatttatctgtagg

SEQ ID NO: 9193723 - DNA, 22 bp, Homo sapiens
tgtcacataggcaaaatgtttt

SEQ ID NO: 9193724 - DNA, 22 bp, Homo sapiens
tgtcacatatataatgttcaat

SEQ ID NO: 9193725 - DNA, 22 bp, Homo sapiens
tgtcacatgaagccaacatagc

SEQ ID NO: 9193726 - DNA, 22 bp, Homo sapiens
tgtcacatgacacaaatatcta

SEQ ID NO: 9193727 - DNA, 22 bp, Homo sapiens
tgtcacatgaaacttgctcatc

SEQ ID NO: 9193728 - DNA, 22 bp, Homo sapiens
tgtcacatccattttgcaagta

SEQ ID NO: 9193729 - DNA, 22 bp, Homo sapiens
tgtcacatgaaacttgctcatc

SEQ ID NO: 9193730 - DNA, 22 bp, Homo sapiens
tgtcacatcaggtggtggctgt

SEQ ID NO: 9193731 - DNA, 22 bp, Homo sapiens
tgtcacatcaggggtgttgaca

SEQ ID NO: 9193732 - DNA, 22 bp, Homo sapiens
tgtcacagtttgtactttatag

SEQ ID NO: 9193733 - DNA, 22 bp, Homo sapiens
tgtcacagatcgtttttgagct

SEQ ID NO: 9193734 - DNA, 22 bp, Homo sapiens
tgtcacagagcgtgcaacagaa

SEQ ID NO: 9193735 - DNA, 22 bp, Homo sapiens
tgtcacatgtttaatgtggact

SEQ ID NO: 9193736 - DNA, 22 bp, Homo sapiens
tgtcacattatatgtgaggata

SEQ ID NO: 9193737 - DNA, 21 bp, Homo sapiens
tgtcacatgtggatggtattt

SEQ ID NO: 9193738 - DNA, 22 bp, Homo sapiens
tgtcacatgtgtggcatttttc

SEQ ID NO: 9193739 - DNA, 23 bp, Homo sapiens
tgtcacatttagttggcattgtt

SEQ ID NO: 9193740 - DNA, 21 bp, Homo sapiens
tgtcacattgtccctgctgct

SEQ ID NO: 9193741 - DNA, 22 bp, Homo sapiens
tgtcacattgaatatgatttat

SEQ ID NO: 9193742 - DNA, 22 bp, Homo sapiens
tgtcacattgaatatgatttat

SEQ ID NO: 9193743 - DNA, 22 bp, Homo sapiens
tgtcacattctgatgtgaggtg

SEQ ID NO: 9193744 - DNA, 22 bp, Homo sapiens
tgtcaccacatttgtcaatatc

SEQ ID NO: 9193745 - DNA, 22 bp, Homo sapiens
tgtcaccaccggaagaaactgc

SEQ ID NO: 9193746 - DNA, 22 bp, Homo sapiens
tgtcaccactggctgaaacacc

SEQ ID NO: 9193747 - DNA, 22 bp, Homo sapiens
tgtccccaaggttcagcccaca

SEQ ID NO: 9193748 - DNA, 22 bp, Homo sapiens
tgtcccctttctttccttcgta

SEQ ID NO: 9193749 - DNA, 22 bp, Homo sapiens
tgtcccctttacctccgcagcc

SEQ ID NO: 9193750 - DNA, 20 bp, Homo sapiens
tgtcccctagatcccagctc

SEQ ID NO: 9193751 - DNA, 18 bp, Homo sapiens
tgtccctgcaaataacat

SEQ ID NO: 9193752 - DNA, 22 bp, Homo sapiens
tgtccctgatccactggacccc

SEQ ID NO: 9193753 - DNA, 18 bp, Homo sapiens
tgtccctgcaaataacat

SEQ ID NO: 9193754 - DNA, 22 bp, Homo sapiens
tgtccctggtggaggctggcag

SEQ ID NO: 9193755 - DNA, 22 bp, Homo sapiens
tgtccctgctgtacttagagca

SEQ ID NO: 9193756 - DNA, 22 bp, Homo sapiens
tgtccctggactccaggagcca

SEQ ID NO: 9193757 - DNA, 17 bp, Homo sapiens
tgtcccaggctcaacgc

SEQ ID NO: 9193758 - DNA, 22 bp, Homo sapiens
tgtcccaggctgaagtacagtg

SEQ ID NO: 9193759 - DNA, 22 bp, Homo sapiens
tgtcccaggctgaagtacagtg

SEQ ID NO: 9193760 - DNA, 22 bp, Homo sapiens
tgtcccaggcctcatgttgcca

SEQ ID NO: 9193761 - DNA, 22 bp, Homo sapiens
tgtcccagcactttgggagtct

SEQ ID NO: 9193762 - DNA, 22 bp, Homo sapiens
tgtcccagctgtctctgttttt

SEQ ID NO: 9193763 - DNA, 22 bp, Homo sapiens
tgtcccagtttatctgggactg

SEQ ID NO: 9193764 - DNA, 22 bp, Homo sapiens
tgtcccagttttgcaggttaga

SEQ ID NO: 9193765 - DNA, 22 bp, Homo sapiens
tgtcccagttttgcaggttaga

SEQ ID NO: 9193766 - DNA, 22 bp, Homo sapiens
tgtcccagttgggtattgaatt

SEQ ID NO: 9193767 - DNA, 22 bp, Homo sapiens
tgtcccagttcccagggttgct

SEQ ID NO: 9193768 - DNA, 22 bp, Homo sapiens
tgtcccaggtcctagatgacca

SEQ ID NO: 9193769 - DNA, 22 bp, Homo sapiens
tgtccagggatggggtcaggga

SEQ ID NO: 9193770 - DNA, 22 bp, Homo sapiens
tgtccagggatggggtcaggga

SEQ ID NO: 9193771 - DNA, 22 bp, Homo sapiens
tgtccaggctcccttggtgctg

SEQ ID NO: 9193772 - DNA, 22 bp, Homo sapiens
tgtccaggctggagtgcagtgg

SEQ ID NO: 9193773 - DNA, 22 bp, Homo sapiens
tgtccaggctggagtgcagtgg

SEQ ID NO: 9193774 - DNA, 22 bp, Homo sapiens
tgtccaggagtaaaaagacctg

SEQ ID NO: 9193775 - DNA, 22 bp, Homo sapiens
tgtccaggcactgggactctag

SEQ ID NO: 9193776 - DNA, 22 bp, Homo sapiens
tgtccaggctaaagtgcagtgg

SEQ ID NO: 9193777 - DNA, 22 bp, Homo sapiens
tgtccaggcggccttgcctgtt

SEQ ID NO: 9193778 - DNA, 22 bp, Homo sapiens
tgtccaggctaaagtgcagtgg

SEQ ID NO: 9193779 - DNA, 20 bp, Homo sapiens
tgtccaggggatcgttggcc

SEQ ID NO: 9193780 - DNA, 22 bp, Homo sapiens
tgtccagggggcttacctggag

SEQ ID NO: 9193781 - DNA, 22 bp, Homo sapiens
tgtccaggtcagcagcagggac

SEQ ID NO: 9193782 - DNA, 22 bp, Homo sapiens
tgtccaggtcagcagcagggac

SEQ ID NO: 9193783 - DNA, 22 bp, Homo sapiens
tgtccaggtcagcagcagggac

SEQ ID NO: 9193784 - DNA, 22 bp, Homo sapiens
tgtccaggtggcctctgctgct

SEQ ID NO: 9193785 - DNA, 22 bp, Homo sapiens
tgtccaggtgtgtctaaagaga

SEQ ID NO: 9193786 - DNA, 22 bp, Homo sapiens
tgtcctcagatatgtctactct

SEQ ID NO: 9193787 - DNA, 22 bp, Homo sapiens
tgtcctcagatatgtctactct

SEQ ID NO: 9193788 - DNA, 22 bp, Homo sapiens
tgtcctcacaggaatgaacttt

SEQ ID NO: 9193789 - DNA, 22 bp, Homo sapiens
tgtcctcacaggaatgaacttt

SEQ ID NO: 9193790 - DNA, 19 bp, Homo sapiens
tgtcctcacagagcataac

SEQ ID NO: 9193791 - DNA, 20 bp, Homo sapiens
tgtcctaatagacaagcaga

SEQ ID NO: 9193792 - DNA, 22 bp, Homo sapiens
tgtcctatttctctgtgcatga

SEQ ID NO: 9193793 - DNA, 22 bp, Homo sapiens
tgtcctatttctctgtgcatga

SEQ ID NO: 9193794 - DNA, 22 bp, Homo sapiens
tgtcctgggaggcggggtccag

SEQ ID NO: 9193795 - DNA, 22 bp, Homo sapiens
tgtcctgggaatgggatgcagt

SEQ ID NO: 9193796 - DNA, 22 bp, Homo sapiens
tgtcctgggaactcacagtcca

SEQ ID NO: 9193797 - DNA, 22 bp, Homo sapiens
tgtcctgggtcaaatcctggtc

SEQ ID NO: 9193798 - DNA, 22 bp, Homo sapiens
tgtcctggggacaagaggccct

SEQ ID NO: 9193799 - DNA, 22 bp, Homo sapiens
tgtcctggggcgacttggggcc

SEQ ID NO: 9193800 - DNA, 19 bp, Homo sapiens
tgtcctgtcctgctctgac

SEQ ID NO: 9193801 - DNA, 22 bp, Homo sapiens
tgtcctgtacgaagccggagaa

SEQ ID NO: 9193802 - DNA, 22 bp, Homo sapiens
tgtcctgggtccctgctagaag

SEQ ID NO: 9193803 - DNA, 22 bp, Homo sapiens
tgtcctgggtcaaccaggtcga

SEQ ID NO: 9193804 - DNA, 21 bp, Homo sapiens
tgtcctggtcactgctctccc

SEQ ID NO: 9193805 - DNA, 22 bp, Homo sapiens
tgtcctgggtggatgcttcatt

SEQ ID NO: 9193806 - DNA, 21 bp, Homo sapiens
tgtcctggtcactgctctccc

SEQ ID NO: 9193807 - DNA, 22 bp, Homo sapiens
tgtcctgttcttgctgtgtcct

SEQ ID NO: 9193808 - DNA, 22 bp, Homo sapiens
tgtccttagggatataaaatat

SEQ ID NO: 9193809 - DNA, 22 bp, Homo sapiens
tgtccttcttgtcttgcccaaa

SEQ ID NO: 9193810 - DNA, 22 bp, Homo sapiens
tgtcctttatgaaatggtgttt

SEQ ID NO: 9193811 - DNA, 22 bp, Homo sapiens
tgtcctttactgattgcttctg

SEQ ID NO: 9193812 - DNA, 22 bp, Homo sapiens
tgtcctttatgaaatggtgttt

SEQ ID NO: 9193813 - DNA, 22 bp, Homo sapiens
tgtcctttgtgtatctatagta

SEQ ID NO: 9193814 - DNA, 22 bp, Homo sapiens
tgtcctttgttccctgtctctg

SEQ ID NO: 9193815 - DNA, 22 bp, Homo sapiens
tgtcctttgggagggcacagct

SEQ ID NO: 9193816 - DNA, 22 bp, Homo sapiens
tgtcctttgggagggcacagct

SEQ ID NO: 9193817 - DNA, 22 bp, Homo sapiens
tgtccttttccccaaattcact

SEQ ID NO: 9193818 - DNA, 22 bp, Homo sapiens
tgtccttttctttagtgcagct

SEQ ID NO: 9193819 - DNA, 22 bp, Homo sapiens
tgtccttttctttagtgcagct

SEQ ID NO: 9193820 - DNA, 22 bp, Homo sapiens
tgtccttttggctgtctatggt

SEQ ID NO: 9193821 - DNA, 22 bp, Homo sapiens
tgtcctttttcttaggaaatat

SEQ ID NO: 9193822 - DNA, 22 bp, Homo sapiens
tgtcatttcacaatatcactca

SEQ ID NO: 9193823 - DNA, 20 bp, Homo sapiens
tgtcatttatttatcaaatg

SEQ ID NO: 9193824 - DNA, 22 bp, Homo sapiens
tgtcatttcctgaatgctgagt

SEQ ID NO: 9193825 - DNA, 22 bp, Homo sapiens
tgtcatttggactttggtatta

SEQ ID NO: 9193826 - DNA, 22 bp, Homo sapiens
tgtcatttggactttggtatta

SEQ ID NO: 9193827 - DNA, 22 bp, Homo sapiens
tgtcatttgtttaggcaataat

SEQ ID NO: 9193828 - DNA, 22 bp, Homo sapiens
tgtcattttaatcacctttcca

SEQ ID NO: 9193829 - DNA, 22 bp, Homo sapiens
tgtcattttatgtatgtggtct

SEQ ID NO: 9193830 - DNA, 22 bp, Homo sapiens
tgtcattttaatcacctttcca

SEQ ID NO: 9193831 - DNA, 22 bp, Homo sapiens
tgtcattttcagcttatgcttc

SEQ ID NO: 9193832 - DNA, 22 bp, Homo sapiens
tgtccactttgtcagtgtcata

SEQ ID NO: 9193833 - DNA, 22 bp, Homo sapiens
tgtcattttctggttagttaat

SEQ ID NO: 9193834 - DNA, 22 bp, Homo sapiens
tgtcattttctggttagttaat

SEQ ID NO: 9193835 - DNA, 22 bp, Homo sapiens
tgtccagctgacattcccttcc

SEQ ID NO: 9193836 - DNA, 22 bp, Homo sapiens
tgtccagctgaaggcagcctca

SEQ ID NO: 9193837 - DNA, 22 bp, Homo sapiens
tgtccaggaattgaccctgcaa

SEQ ID NO: 9193838 - DNA, 22 bp, Homo sapiens
tgtccaggaccctattctcact

SEQ ID NO: 9193839 - DNA, 22 bp, Homo sapiens
tgtccagagtcacagagctcaa

SEQ ID NO: 9193840 - DNA, 22 bp, Homo sapiens
tgtccagatcaatgcccacatg

SEQ ID NO: 9193841 - DNA, 22 bp, Homo sapiens
tgtccagcggcctggctgctga

SEQ ID NO: 9193842 - DNA, 20 bp, Homo sapiens
tgtcatttatttatcaaatg

SEQ ID NO: 9193843 - DNA, 22 bp, Homo sapiens
tgtcatttatgcttcttcagtg

SEQ ID NO: 9193844 - DNA, 22 bp, Homo sapiens
tgtcatttatcttatagtaatc

SEQ ID NO: 9193845 - DNA, 22 bp, Homo sapiens
tgtcatttaatagatatgatgg

SEQ ID NO: 9193846 - DNA, 22 bp, Homo sapiens
tgtcatttagtcctctgtgtgt

SEQ ID NO: 9193847 - DNA, 23 bp, Homo sapiens
tgtcatctccagactcccagtgc

SEQ ID NO: 9193848 - DNA, 22 bp, Homo sapiens
tgtcatatgtaatatgttcatt

SEQ ID NO: 9193849 - DNA, 22 bp, Homo sapiens
tgtcatatgttgatgaaagaga

SEQ ID NO: 9193850 - DNA, 22 bp, Homo sapiens
tgtcatatctattaaatgtcta

SEQ ID NO: 9193851 - DNA, 21 bp, Homo sapiens
tgtcatatttcaatacagttt

SEQ ID NO: 9193852 - DNA, 22 bp, Homo sapiens
tgtcagtgtaactcttatagca

SEQ ID NO: 9193853 - DNA, 22 bp, Homo sapiens
tgtcagtgtaactcttatagca

SEQ ID NO: 9193854 - DNA, 22 bp, Homo sapiens
tgtcagtgtctgaggttttata

SEQ ID NO: 9193855 - DNA, 22 bp, Homo sapiens
tgtcagtgtatacatacagtat

SEQ ID NO: 9193856 - DNA, 22 bp, Homo sapiens
tgtcagtggacctggagaggcc

SEQ ID NO: 9193857 - DNA, 22 bp, Homo sapiens
tgtcagtggtaaggttgggagt

SEQ ID NO: 9193858 - DNA, 22 bp, Homo sapiens
tgtcagtgctatagtgggaata

SEQ ID NO: 9193859 - DNA, 22 bp, Homo sapiens
tgtcagtgatttgtagggaatt

SEQ ID NO: 9193860 - DNA, 22 bp, Homo sapiens
tgtcagtgcacagatggttgat

SEQ ID NO: 9193861 - DNA, 22 bp, Homo sapiens
tgtcagtgccaactttgctggt

SEQ ID NO: 9193862 - DNA, 22 bp, Homo sapiens
tgtcagtgccaactttgctggt

SEQ ID NO: 9193863 - DNA, 22 bp, Homo sapiens
tgtcagtgcacagatggttgat

SEQ ID NO: 9193864 - DNA, 22 bp, Homo sapiens
tgtcagtgacagatttatgatc

SEQ ID NO: 9193865 - DNA, 22 bp, Homo sapiens
tgtcagtgagttgggtcctgag

SEQ ID NO: 9193866 - DNA, 22 bp, Homo sapiens
tgtcagtgaaaaattgtgatag

SEQ ID NO: 9193867 - DNA, 22 bp, Homo sapiens
tgtcataacttagtgacaaatc

SEQ ID NO: 9193868 - DNA, 18 bp, Homo sapiens
tgtcataatatatcacct

SEQ ID NO: 9193869 - DNA, 22 bp, Homo sapiens
tgtcatagtgtggtagcagtgg

SEQ ID NO: 9193870 - DNA, 22 bp, Homo sapiens
tgtcatagtgtggtagcagtgg

SEQ ID NO: 9193871 - DNA, 22 bp, Homo sapiens
tgtcagttctggttggctccca

SEQ ID NO: 9193872 - DNA, 22 bp, Homo sapiens
tgtcagttgctattccaggcct

SEQ ID NO: 9193873 - DNA, 22 bp, Homo sapiens
tgtcagttctcacttacataaa

SEQ ID NO: 9193874 - DNA, 22 bp, Homo sapiens
tgtcagttcatcagttggctaa

SEQ ID NO: 9193875 - DNA, 22 bp, Homo sapiens
tgtcagttcatcagttggctaa

SEQ ID NO: 9193876 - DNA, 22 bp, Homo sapiens
tgtcagtgtctgaggttttata

SEQ ID NO: 9193877 - DNA, 22 bp, Homo sapiens
tgtcagttacctagcacaagaa

SEQ ID NO: 9193878 - DNA, 22 bp, Homo sapiens
tgtcagttaaatgaggtacaag

SEQ ID NO: 9193879 - DNA, 22 bp, Homo sapiens
tgtcaggttggttttcagagaa

SEQ ID NO: 9193880 - DNA, 22 bp, Homo sapiens
tgtcaggtctaaaatgggtctc

SEQ ID NO: 9193881 - DNA, 22 bp, Homo sapiens
tgtcactttttataggtgttga

SEQ ID NO: 9193882 - DNA, 22 bp, Homo sapiens
tgtcactttggggagagttttg

SEQ ID NO: 9193883 - DNA, 22 bp, Homo sapiens
tgtcactttggggagagttttg

SEQ ID NO: 9193884 - DNA, 22 bp, Homo sapiens
tgtcactgtcaatgtcaactac

SEQ ID NO: 9193885 - DNA, 22 bp, Homo sapiens
tgtcaccttgcagggctggggc

SEQ ID NO: 9193886 - DNA, 22 bp, Homo sapiens
tggtaacacaggcattaaagtt

SEQ ID NO: 9193887 - DNA, 22 bp, Homo sapiens
tggtaactggattctgtctcac

SEQ ID NO: 9193888 - DNA, 22 bp, Homo sapiens
tggtaactttcagcatggtgac

SEQ ID NO: 9193889 - DNA, 22 bp, Homo sapiens
tggtaaagaaggctagatctga

SEQ ID NO: 9193890 - DNA, 22 bp, Homo sapiens
tggtaaatgctccaagcagtac

SEQ ID NO: 9193891 - DNA, 22 bp, Homo sapiens
tgggttttccatctatttactc

SEQ ID NO: 9193892 - DNA, 22 bp, Homo sapiens
tgggttttctgccgattgttcc

SEQ ID NO: 9193893 - DNA, 22 bp, Homo sapiens
tgggttttcagcatgagtttat

SEQ ID NO: 9193894 - DNA, 22 bp, Homo sapiens
tgggttgtcctctttctgttaa

SEQ ID NO: 9193895 - DNA, 22 bp, Homo sapiens
tgggttggaagcaggaggcacc

SEQ ID NO: 9193896 - DNA, 22 bp, Homo sapiens
tgggttctagagggaccagaac

SEQ ID NO: 9193897 - DNA, 22 bp, Homo sapiens
tgggttctagagggaccagaac

SEQ ID NO: 9193898 - DNA, 22 bp, Homo sapiens
tgggttccctgacagcgatgct

SEQ ID NO: 9193899 - DNA, 22 bp, Homo sapiens
tggtatcaaacaattaattaga

SEQ ID NO: 9193900 - DNA, 21 bp, Homo sapiens
tggtatcaaactatacaatat

SEQ ID NO: 9193901 - DNA, 20 bp, Homo sapiens
tggtatcaattactagattg

SEQ ID NO: 9193902 - DNA, 22 bp, Homo sapiens
tggtatgaccgtggtgcaagca

SEQ ID NO: 9193903 - DNA, 22 bp, Homo sapiens
tggtatgtaaattgtaactcaa

SEQ ID NO: 9193904 - DNA, 22 bp, Homo sapiens
tggtatgtaaattgtaactcaa

SEQ ID NO: 9193905 - DNA, 22 bp, Homo sapiens
tggtagtcggcctcggtggctc

SEQ ID NO: 9193906 - DNA, 22 bp, Homo sapiens
tggtagggacactatgcagaaa

SEQ ID NO: 9193907 - DNA, 22 bp, Homo sapiens
tggtataaaagagtaaactatg

SEQ ID NO: 9193908 - DNA, 22 bp, Homo sapiens
tggtataaaagagtaaactatg

SEQ ID NO: 9193909 - DNA, 23 bp, Homo sapiens
tggtataaaaacagtacctacct

SEQ ID NO: 9193910 - DNA, 22 bp, Homo sapiens
tggtataatacagtaagtgttg

SEQ ID NO: 9193911 - DNA, 22 bp, Homo sapiens
tggtatttaagacttcactcct

SEQ ID NO: 9193912 - DNA, 22 bp, Homo sapiens
tggtatttaatatatgagagtt

SEQ ID NO: 9193913 - DNA, 22 bp, Homo sapiens
tggtatttcagcttttgtatct

SEQ ID NO: 9193914 - DNA, 22 bp, Homo sapiens
tggtcaagggacagagctgaac

SEQ ID NO: 9193915 - DNA, 22 bp, Homo sapiens
tggtcaacaggcagggatgaaa

SEQ ID NO: 9193916 - DNA, 22 bp, Homo sapiens
tggtcaaaccagttatctgtaa

SEQ ID NO: 9193917 - DNA, 22 bp, Homo sapiens
tgggtggtttatgagtgggttt

SEQ ID NO: 9193918 - DNA, 19 bp, Homo sapiens
tgggtgtgaccatctctgc

SEQ ID NO: 9193919 - DNA, 22 bp, Homo sapiens
tgggtggttgctgaggctcctt

SEQ ID NO: 9193920 - DNA, 21 bp, Homo sapiens
tgggtgggcagagtctcttca

SEQ ID NO: 9193921 - DNA, 21 bp, Homo sapiens
tgggtgggcagagtctcttca

SEQ ID NO: 9193922 - DNA, 22 bp, Homo sapiens
tgggtgggagcgccctgtctgg

SEQ ID NO: 9193923 - DNA, 22 bp, Homo sapiens
tgggtgggagcgccctgtctgg

SEQ ID NO: 9193924 - DNA, 16 bp, Homo sapiens
tgggtgggaggagcgg

SEQ ID NO: 9193925 - DNA, 16 bp, Homo sapiens
tgggtgggaggagcgg

SEQ ID NO: 9193926 - DNA, 22 bp, Homo sapiens
tgggtgcatgtgagcacgtgca

SEQ ID NO: 9193927 - DNA, 22 bp, Homo sapiens
tgggtgcaggtcttgtgccagg

SEQ ID NO: 9193928 - DNA, 22 bp, Homo sapiens
tgggtgcaggatgagtgctggc

SEQ ID NO: 9193929 - DNA, 21 bp, Homo sapiens
tgggtgcaagctgcggatgct

SEQ ID NO: 9193930 - DNA, 22 bp, Homo sapiens
tgggtgcatgtgagcacgtgca

SEQ ID NO: 9193931 - DNA, 22 bp, Homo sapiens
tgggtgggagcgccctgtctgg

SEQ ID NO: 9193932 - DNA, 21 bp, Homo sapiens
tgggtggaagcgggaggccgc

SEQ ID NO: 9193933 - DNA, 22 bp, Homo sapiens
tgggtgcttcgtcagctctgag

SEQ ID NO: 9193934 - DNA, 22 bp, Homo sapiens
tgggtgcttcgtcagctctgag

SEQ ID NO: 9193935 - DNA, 22 bp, Homo sapiens
tgggtgctctgcgaccgtaggg

SEQ ID NO: 9193936 - DNA, 22 bp, Homo sapiens
tgggtgctctgcgaccgtaggg

SEQ ID NO: 9193937 - DNA, 22 bp, Homo sapiens
tgggtgagggacaaaagtttct

SEQ ID NO: 9193938 - DNA, 22 bp, Homo sapiens
tgggtgagtggagggcattcta

SEQ ID NO: 9193939 - DNA, 22 bp, Homo sapiens
tgggtgagtggagggcattcta

SEQ ID NO: 9193940 - DNA, 22 bp, Homo sapiens
tgggtgagtggagggcattcta

SEQ ID NO: 9193941 - DNA, 22 bp, Homo sapiens
tgggtgagtgggaaaagcccag

SEQ ID NO: 9193942 - DNA, 22 bp, Homo sapiens
tgggtgaggatgatgaggcagc

SEQ ID NO: 9193943 - DNA, 22 bp, Homo sapiens
tgggtgaggatgatgaggcagc

SEQ ID NO: 9193944 - DNA, 22 bp, Homo sapiens
tgggtgaggatgatgaggcagc

SEQ ID NO: 9193945 - DNA, 22 bp, Homo sapiens
tgggtgaggatgatgaggcagc

SEQ ID NO: 9193946 - DNA, 22 bp, Homo sapiens
tgggtgagccacaggagttgtc

SEQ ID NO: 9193947 - DNA, 22 bp, Homo sapiens
tgggtgagccacaggagttgtc

SEQ ID NO: 9193948 - DNA, 22 bp, Homo sapiens
tgggtgagccacaggagttgtc

SEQ ID NO: 9193949 - DNA, 22 bp, Homo sapiens
tgggtgagccacaggagttgtc

SEQ ID NO: 9193950 - DNA, 22 bp, Homo sapiens
tgggtgaggagaggctgtctaa

SEQ ID NO: 9193951 - DNA, 22 bp, Homo sapiens
tgggtgaggagaggctgtctaa

SEQ ID NO: 9193952 - DNA, 22 bp, Homo sapiens
tgggtcccaggaaggaccagca

SEQ ID NO: 9193953 - DNA, 22 bp, Homo sapiens
tgggtcccaatctgaaatgtca

SEQ ID NO: 9193954 - DNA, 22 bp, Homo sapiens
tgggtccctcatgagaggcatt

SEQ ID NO: 9193955 - DNA, 22 bp, Homo sapiens
tgggtccctctggagtagtaca

SEQ ID NO: 9193956 - DNA, 22 bp, Homo sapiens
tgggtccctcatgagaggcatt

SEQ ID NO: 9193957 - DNA, 22 bp, Homo sapiens
tgggtccctcatgagaggcatt

SEQ ID NO: 9193958 - DNA, 22 bp, Homo sapiens
tgggtcctaaatgcagtcacat

SEQ ID NO: 9193959 - DNA, 20 bp, Homo sapiens
tgggtccctgcagtttgaag

SEQ ID NO: 9193960 - DNA, 22 bp, Homo sapiens
tgggtcctcgtcttccaaggca

SEQ ID NO: 9193961 - DNA, 22 bp, Homo sapiens
tgggtcctctggagcagcagca

SEQ ID NO: 9193962 - DNA, 22 bp, Homo sapiens
tgggtcctctgagagggcagcg

SEQ ID NO: 9193963 - DNA, 22 bp, Homo sapiens
tgggtcctctggagcagcagca

SEQ ID NO: 9193964 - DNA, 22 bp, Homo sapiens
tgggtcctctgagagggcagcg

SEQ ID NO: 9193965 - DNA, 22 bp, Homo sapiens
tgggtcctcgtcttccaaggca

SEQ ID NO: 9193966 - DNA, 20 bp, Homo sapiens
tgggtcctgcacattctcca

SEQ ID NO: 9193967 - DNA, 22 bp, Homo sapiens
tgggtcctctggagcagcagca

SEQ ID NO: 9193968 - DNA, 20 bp, Homo sapiens
tgggtcctgcacattctcca

SEQ ID NO: 9193969 - DNA, 20 bp, Homo sapiens
tgggtcctgcttcttcctga

SEQ ID NO: 9193970 - DNA, 22 bp, Homo sapiens
tgggtcctggaaggcgacaggt

SEQ ID NO: 9193971 - DNA, 22 bp, Homo sapiens
tgggtcctgcactgcaagcacc

SEQ ID NO: 9193972 - DNA, 22 bp, Homo sapiens
tgggtcctgcactgcaagcacc

SEQ ID NO: 9193973 - DNA, 22 bp, Homo sapiens
tgggtcctggaaggcgacaggt

SEQ ID NO: 9193974 - DNA, 22 bp, Homo sapiens
tgggtcctggctttgtcagggt

SEQ ID NO: 9193975 - DNA, 22 bp, Homo sapiens
tgggtcctggctttgtcagggt

SEQ ID NO: 9193976 - DNA, 22 bp, Homo sapiens
tgggtcctggaaggcgacaggt

SEQ ID NO: 9193977 - DNA, 22 bp, Homo sapiens
tgggtctgtagggctgtccaat

SEQ ID NO: 9193978 - DNA, 22 bp, Homo sapiens
tgggtctgtagggctgtccaat

SEQ ID NO: 9193979 - DNA, 20 bp, Homo sapiens
tgggtgagagtgtttgctct

SEQ ID NO: 9193980 - DNA, 20 bp, Homo sapiens
tgggtctgcttggcttcagt

SEQ ID NO: 9193981 - DNA, 23 bp, Homo sapiens
tgggtctctagtacaggcaggca

SEQ ID NO: 9193982 - DNA, 23 bp, Homo sapiens
tgggtctctagtacaggcaggca

SEQ ID NO: 9193983 - DNA, 22 bp, Homo sapiens
tgggtctcctgtgcctgggagg

SEQ ID NO: 9193984 - DNA, 22 bp, Homo sapiens
tgggtctcctgtgcctgggagg

SEQ ID NO: 9193985 - DNA, 22 bp, Homo sapiens
tgggtctccagttcagggcagg

SEQ ID NO: 9193986 - DNA, 20 bp, Homo sapiens
tgggtcctgtgggagaagaa

SEQ ID NO: 9193987 - DNA, 22 bp, Homo sapiens
tgggtcctgtctccttgttctg

SEQ ID NO: 9193988 - DNA, 22 bp, Homo sapiens
tgggtccttcaaagctgggtct

SEQ ID NO: 9193989 - DNA, 22 bp, Homo sapiens
tgggtccttgctaacttctatg

SEQ ID NO: 9193990 - DNA, 22 bp, Homo sapiens
tgggtccttgccatcttggagt

SEQ ID NO: 9193991 - DNA, 22 bp, Homo sapiens
tgggtccttcaaagctgggtct

SEQ ID NO: 9193992 - DNA, 22 bp, Homo sapiens
tgggtcctttttggacttcttc

SEQ ID NO: 9193993 - DNA, 22 bp, Homo sapiens
tgggtctccagttcagggcagg

SEQ ID NO: 9193994 - DNA, 22 bp, Homo sapiens
tgggtctccagttcagggcagg

SEQ ID NO: 9193995 - DNA, 22 bp, Homo sapiens
tgggtccttgctggcttcaaag

SEQ ID NO: 9193996 - DNA, 22 bp, Homo sapiens
tgggtccttgctggcttcaaag

SEQ ID NO: 9193997 - DNA, 22 bp, Homo sapiens
tgggtccttgctgattgctgag

SEQ ID NO: 9193998 - DNA, 22 bp, Homo sapiens
tgggtccttgctaacttctatg

SEQ ID NO: 9193999 - DNA, 22 bp, Homo sapiens
tgggtccttgctgattgctgag

SEQ ID NO: 9194000 - DNA, 22 bp, Homo sapiens
tgggtagagtggagggataaga

SEQ ID NO: 9194001 - DNA, 22 bp, Homo sapiens
tgggtactcctattagttcagt

SEQ ID NO: 9194002 - DNA, 23 bp, Homo sapiens
tggggttgaattgtagctgtgcc

SEQ ID NO: 9194003 - DNA, 23 bp, Homo sapiens
tggggttgaattgtagctgtgcc

SEQ ID NO: 9194004 - DNA, 22 bp, Homo sapiens
tggggttgaagaaaggatctag

SEQ ID NO: 9194005 - DNA, 22 bp, Homo sapiens
tgggtaggccaggaagcagtgt

SEQ ID NO: 9194006 - DNA, 22 bp, Homo sapiens
tgggtaggccaggaagcagtgt

SEQ ID NO: 9194007 - DNA, 22 bp, Homo sapiens
tgggtagggcctgcgcctgtgc

SEQ ID NO: 9194008 - DNA, 22 bp, Homo sapiens
tgggtaggggacgtggaagaaa

SEQ ID NO: 9194009 - DNA, 22 bp, Homo sapiens
tggggtgctttcttgcctgtac

SEQ ID NO: 9194010 - DNA, 22 bp, Homo sapiens
tggggtggaacccttctgctgg

SEQ ID NO: 9194011 - DNA, 22 bp, Homo sapiens
tggggtgctttcttgcctgtac

SEQ ID NO: 9194012 - DNA, 22 bp, Homo sapiens
tggggtgccgacagggagggca

SEQ ID NO: 9194013 - DNA, 22 bp, Homo sapiens
tggggtgacagtgcagtggtca

SEQ ID NO: 9194014 - DNA, 22 bp, Homo sapiens
tggggtggatagaaagtgatgt

SEQ ID NO: 9194015 - DNA, 22 bp, Homo sapiens
tggggtggatagaaagtgatgt

SEQ ID NO: 9194016 - DNA, 22 bp, Homo sapiens
tggggtgggcatgcgctgtcct

SEQ ID NO: 9194017 - DNA, 22 bp, Homo sapiens
tggggtggaacccttctgctgg

SEQ ID NO: 9194018 - DNA, 17 bp, Homo sapiens
tggggtgttgaagggtt

SEQ ID NO: 9194019 - DNA, 22 bp, Homo sapiens
tggggtgtgagaagtagaggga

SEQ ID NO: 9194020 - DNA, 22 bp, Homo sapiens
tggggtgggcatgcgctgtcct

SEQ ID NO: 9194021 - DNA, 22 bp, Homo sapiens
tggggtggggttactcattctg

SEQ ID NO: 9194022 - DNA, 22 bp, Homo sapiens
tggggtggggttactcattctg

SEQ ID NO: 9194023 - DNA, 22 bp, Homo sapiens
tgggggtgactatctcgggaat

SEQ ID NO: 9194024 - DNA, 22 bp, Homo sapiens
tggggggatacttgctactggc

SEQ ID NO: 9194025 - DNA, 22 bp, Homo sapiens
tggggggatacttgctactggc

SEQ ID NO: 9194026 - DNA, 22 bp, Homo sapiens
tggggggatacttgctactggc

SEQ ID NO: 9194027 - DNA, 22 bp, Homo sapiens
tgggggtgccctatgaggaagc

SEQ ID NO: 9194028 - DNA, 22 bp, Homo sapiens
tgggggtgccctatgaggaagc

SEQ ID NO: 9194029 - DNA, 23 bp, Homo sapiens
tgggggtgcacgggccacatctt

SEQ ID NO: 9194030 - DNA, 22 bp, Homo sapiens
tggggtcgagggttctctggca

SEQ ID NO: 9194031 - DNA, 20 bp, Homo sapiens
tggggtctagttggcctggg

SEQ ID NO: 9194032 - DNA, 22 bp, Homo sapiens
tgggggtggttcttgcctccag

SEQ ID NO: 9194033 - DNA, 22 bp, Homo sapiens
tggggtctggagttgcccatga

SEQ ID NO: 9194034 - DNA, 22 bp, Homo sapiens
tggggaagggcaccctggagac

SEQ ID NO: 9194035 - DNA, 22 bp, Homo sapiens
tggggaagggcaccctggagac

SEQ ID NO: 9194036 - DNA, 22 bp, Homo sapiens
tggggaagacagcagacactgt

SEQ ID NO: 9194037 - DNA, 22 bp, Homo sapiens
tggggaagacagcagacactgt

SEQ ID NO: 9194038 - DNA, 22 bp, Homo sapiens
tgggctggctgaacttcaacct

SEQ ID NO: 9194039 - DNA, 22 bp, Homo sapiens
tgggctggcgtggagagtttag

SEQ ID NO: 9194040 - DNA, 22 bp, Homo sapiens
tgggctggcgtggagagtttag

SEQ ID NO: 9194041 - DNA, 22 bp, Homo sapiens
tgggctggcccaccacacctcg

SEQ ID NO: 9194042 - DNA, 22 bp, Homo sapiens
tgggctggctgaggcattcact

SEQ ID NO: 9194043 - DNA, 22 bp, Homo sapiens
tgggctggctgaggcattcact

SEQ ID NO: 9194044 - DNA, 22 bp, Homo sapiens
tgggctggctgaacttcaacct

SEQ ID NO: 9194045 - DNA, 22 bp, Homo sapiens
tgggctggtgagggatcattta

SEQ ID NO: 9194046 - DNA, 22 bp, Homo sapiens
tgggctggtgagggatcattta

SEQ ID NO: 9194047 - DNA, 22 bp, Homo sapiens
tgggctggctgaggcattcact

SEQ ID NO: 9194048 - DNA, 22 bp, Homo sapiens
tgggcttcctggagcctgtgct

SEQ ID NO: 9194049 - DNA, 19 bp, Homo sapiens
tgggcttccccagggcaga

SEQ ID NO: 9194050 - DNA, 23 bp, Homo sapiens
tgggcttctgagaaagcacctaa

SEQ ID NO: 9194051 - DNA, 22 bp, Homo sapiens
tgggcttcataattggtcctag

SEQ ID NO: 9194052 - DNA, 22 bp, Homo sapiens
tgggcttggaaagctgctgtgc

SEQ ID NO: 9194053 - DNA, 22 bp, Homo sapiens
tgggcttctggagtggggcaga

SEQ ID NO: 9194054 - DNA, 18 bp, Homo sapiens
tgggcttgaaagcaaggt

SEQ ID NO: 9194055 - DNA, 22 bp, Homo sapiens
tggggacagggctcagcaattt

SEQ ID NO: 9194056 - DNA, 22 bp, Homo sapiens
tggggaggaagtcagatttcag

SEQ ID NO: 9194057 - DNA, 22 bp, Homo sapiens
tggggaggaagtcagatttcag

SEQ ID NO: 9194058 - DNA, 22 bp, Homo sapiens
tggggaggaagtcagatttcag

SEQ ID NO: 9194059 - DNA, 22 bp, Homo sapiens
tggggaggatatgtgagttatt

SEQ ID NO: 9194060 - DNA, 22 bp, Homo sapiens
tggggaggatatgtgagttatt

SEQ ID NO: 9194061 - DNA, 22 bp, Homo sapiens
tggggaggacgggcgccttcct

SEQ ID NO: 9194062 - DNA, 22 bp, Homo sapiens
tggggaggacgggcgccttcct

SEQ ID NO: 9194063 - DNA, 23 bp, Homo sapiens
tggggagggaagtcatttctgta

SEQ ID NO: 9194064 - DNA, 23 bp, Homo sapiens
tggggagggaagtcatttctgta

SEQ ID NO: 9194065 - DNA, 22 bp, Homo sapiens
tggggaggatatgtgagttatt

SEQ ID NO: 9194066 - DNA, 22 bp, Homo sapiens
tggggaggatatgtgagttatt

SEQ ID NO: 9194067 - DNA, 21 bp, Homo sapiens
tggggaggggacctgattatg

SEQ ID NO: 9194068 - DNA, 21 bp, Homo sapiens
tggggaggggacctgattatg

SEQ ID NO: 9194069 - DNA, 21 bp, Homo sapiens
tggggaggggacctgattatg

SEQ ID NO: 9194070 - DNA, 21 bp, Homo sapiens
tggggaggggacctgattatg

SEQ ID NO: 9194071 - DNA, 22 bp, Homo sapiens
tggggaggtaacaatttcaggc

SEQ ID NO: 9194072 - DNA, 22 bp, Homo sapiens
tggggaggtaacaatttcaggc

SEQ ID NO: 9194073 - DNA, 22 bp, Homo sapiens
tggggaggttcgggaatcttgt

SEQ ID NO: 9194074 - DNA, 22 bp, Homo sapiens
tggggaggttcgggaatcttgt

SEQ ID NO: 9194075 - DNA, 22 bp, Homo sapiens
tggggaggttcgggaatcttgt

SEQ ID NO: 9194076 - DNA, 17 bp, Homo sapiens
tggggatggttcatgag

SEQ ID NO: 9194077 - DNA, 17 bp, Homo sapiens
tggggatggttcatgag

SEQ ID NO: 9194078 - DNA, 22 bp, Homo sapiens
tggggatgtagaaatgaacaac

SEQ ID NO: 9194079 - DNA, 19 bp, Homo sapiens
tggggatgctgatgaccaa

SEQ ID NO: 9194080 - DNA, 19 bp, Homo sapiens
tggggatgctgatgaccaa

SEQ ID NO: 9194081 - DNA, 22 bp, Homo sapiens
tggggatgaaacccaggcatct

SEQ ID NO: 9194082 - DNA, 22 bp, Homo sapiens
tggggagtgatgcctcggataa

SEQ ID NO: 9194083 - DNA, 22 bp, Homo sapiens
tggggagtgatgcctcggataa

SEQ ID NO: 9194084 - DNA, 22 bp, Homo sapiens
tgggggagccttcacagtagct

SEQ ID NO: 9194085 - DNA, 22 bp, Homo sapiens
tgggggagccttcacagtagct

SEQ ID NO: 9194086 - DNA, 22 bp, Homo sapiens
tgggggagccttcacagtagct

SEQ ID NO: 9194087 - DNA, 22 bp, Homo sapiens
tgggggagcgacagacataatt

SEQ ID NO: 9194088 - DNA, 22 bp, Homo sapiens
tgggggcacttcgaggtcgcct

SEQ ID NO: 9194089 - DNA, 22 bp, Homo sapiens
tgggggagctcagtccagccca

SEQ ID NO: 9194090 - DNA, 22 bp, Homo sapiens
tgggggagtatagtctggcctc

SEQ ID NO: 9194091 - DNA, 22 bp, Homo sapiens
tgggggagtatagtctggcctc

SEQ ID NO: 9194092 - DNA, 22 bp, Homo sapiens
tgggggcagccaggctgtcaag

SEQ ID NO: 9194093 - DNA, 22 bp, Homo sapiens
tgggggcagccaggctgtcaag

SEQ ID NO: 9194094 - DNA, 22 bp, Homo sapiens
tgggggctccaggctccaggga

SEQ ID NO: 9194095 - DNA, 22 bp, Homo sapiens
tggggctggcacagtctctatt

SEQ ID NO: 9194096 - DNA, 22 bp, Homo sapiens
tggggctggctattgtctccct

SEQ ID NO: 9194097 - DNA, 22 bp, Homo sapiens
tggggctggggatcttgagcct

SEQ ID NO: 9194098 - DNA, 22 bp, Homo sapiens
tggggctgtcccggtttggcga

SEQ ID NO: 9194099 - DNA, 22 bp, Homo sapiens
tgggggagatagagtctgatgg

SEQ ID NO: 9194100 - DNA, 22 bp, Homo sapiens
tgggggagatagagtctgatgg

SEQ ID NO: 9194101 - DNA, 22 bp, Homo sapiens
tgggggagattgtgcatctcta

SEQ ID NO: 9194102 - DNA, 22 bp, Homo sapiens
tgggggagagtgcaagcatgaa

SEQ ID NO: 9194103 - DNA, 22 bp, Homo sapiens
tgggggagagtgcaagcatgaa

SEQ ID NO: 9194104 - DNA, 22 bp, Homo sapiens
tgggggagagtgcaagcatgaa

SEQ ID NO: 9194105 - DNA, 23 bp, Homo sapiens
tggggctctggcaggcctgaggt

SEQ ID NO: 9194106 - DNA, 22 bp, Homo sapiens
tggggctgaggagcctcactct

SEQ ID NO: 9194107 - DNA, 22 bp, Homo sapiens
tggggctgaggagcctcactct

SEQ ID NO: 9194108 - DNA, 23 bp, Homo sapiens
tggggctgatggagacggaccag

SEQ ID NO: 9194109 - DNA, 23 bp, Homo sapiens
tggggctgatggagacggaccag

SEQ ID NO: 9194110 - DNA, 23 bp, Homo sapiens
tggggctgatggagacggaccag

SEQ ID NO: 9194111 - DNA, 22 bp, Homo sapiens
tggggctcctcctggcaggagg

SEQ ID NO: 9194112 - DNA, 22 bp, Homo sapiens
tggggctcatgcctgctggaac

SEQ ID NO: 9194113 - DNA, 22 bp, Homo sapiens
tggggctcatgcctgctggaac

SEQ ID NO: 9194114 - DNA, 22 bp, Homo sapiens
tggggctcctcctggcaggagg

SEQ ID NO: 9194115 - DNA, 22 bp, Homo sapiens
tggggctctccacagtgtctca

SEQ ID NO: 9194116 - DNA, 22 bp, Homo sapiens
tggggcctgtgacgggtccaga

SEQ ID NO: 9194117 - DNA, 22 bp, Homo sapiens
tggggcctggtcagagctgcac

SEQ ID NO: 9194118 - DNA, 22 bp, Homo sapiens
tggggcctggtcagagctgcac

SEQ ID NO: 9194119 - DNA, 22 bp, Homo sapiens
tggggcctgaggtggagctgca

SEQ ID NO: 9194120 - DNA, 22 bp, Homo sapiens
tggggcctgcacaggctgaatg

SEQ ID NO: 9194121 - DNA, 20 bp, Homo sapiens
tggggcctgtttctgtggtt

SEQ ID NO: 9194122 - DNA, 22 bp, Homo sapiens
tggggcgcgaggtcctggctcc

SEQ ID NO: 9194123 - DNA, 22 bp, Homo sapiens
tggggctaaacacgcctggcct

SEQ ID NO: 9194124 - DNA, 22 bp, Homo sapiens
tggggctagaatcctgcaggaa

SEQ ID NO: 9194125 - DNA, 22 bp, Homo sapiens
tggggcagcagacctttcttgg

SEQ ID NO: 9194126 - DNA, 22 bp, Homo sapiens
tggggcagcagacctttcttgg

SEQ ID NO: 9194127 - DNA, 22 bp, Homo sapiens
tggggcacttatgatgtgccac

SEQ ID NO: 9194128 - DNA, 22 bp, Homo sapiens
tggggcacttatgatgtgccac

SEQ ID NO: 9194129 - DNA, 22 bp, Homo sapiens
tggggcagagtaggattttggc

SEQ ID NO: 9194130 - DNA, 22 bp, Homo sapiens
tggggcaccttgtatctctaag

SEQ ID NO: 9194131 - DNA, 22 bp, Homo sapiens
tggggccaggtggctgcaggtc

SEQ ID NO: 9194132 - DNA, 22 bp, Homo sapiens
tggggcctgaaaggttctcgcc

SEQ ID NO: 9194133 - DNA, 22 bp, Homo sapiens
tggggcctgaaaggttctcgcc

SEQ ID NO: 9194134 - DNA, 22 bp, Homo sapiens
tggggcctgaggtggagctgca

SEQ ID NO: 9194135 - DNA, 22 bp, Homo sapiens
tggggcctgaaaggttctcgcc

SEQ ID NO: 9194136 - DNA, 19 bp, Homo sapiens
tggggcctcctgtccctgg

SEQ ID NO: 9194137 - DNA, 22 bp, Homo sapiens
tgggccagcaattgctgctcag

SEQ ID NO: 9194138 - DNA, 22 bp, Homo sapiens
tgggccacgtcatctcccacaa

SEQ ID NO: 9194139 - DNA, 22 bp, Homo sapiens
tgggccacgggggtggagagct

SEQ ID NO: 9194140 - DNA, 22 bp, Homo sapiens
tgggccacacacagaagaatca

SEQ ID NO: 9194141 - DNA, 22 bp, Homo sapiens
tgggccacacacagaagaatca

SEQ ID NO: 9194142 - DNA, 22 bp, Homo sapiens
tgggccacaagccatgggacca

SEQ ID NO: 9194143 - DNA, 22 bp, Homo sapiens
tgggccacaagccatgggacca

SEQ ID NO: 9194144 - DNA, 22 bp, Homo sapiens
tgggccacagctcacacatcca

SEQ ID NO: 9194145 - DNA, 22 bp, Homo sapiens
tgggccacctgcttttttgcat

SEQ ID NO: 9194146 - DNA, 22 bp, Homo sapiens
tgggccacctgctctgtttcta

SEQ ID NO: 9194147 - DNA, 22 bp, Homo sapiens
tgggccacgggggtggagagct

SEQ ID NO: 9194148 - DNA, 22 bp, Homo sapiens
tgggccagcactgggtgctcat

SEQ ID NO: 9194149 - DNA, 22 bp, Homo sapiens
tgggccaggatttcaagaccct

SEQ ID NO: 9194150 - DNA, 22 bp, Homo sapiens
tgggccagctgaagtgccgccc

SEQ ID NO: 9194151 - DNA, 22 bp, Homo sapiens
tgggccagctccctgcccctgg

SEQ ID NO: 9194152 - DNA, 19 bp, Homo sapiens
tgggcagtgccagggctta

SEQ ID NO: 9194153 - DNA, 22 bp, Homo sapiens
tgggcagtgagaaaggtcaggt

SEQ ID NO: 9194154 - DNA, 22 bp, Homo sapiens
tgggcagtccagctggaaacgg

SEQ ID NO: 9194155 - DNA, 22 bp, Homo sapiens
tgggcatgagtggacagagaag

SEQ ID NO: 9194156 - DNA, 22 bp, Homo sapiens
tgggcatcatggacagcagagg

SEQ ID NO: 9194157 - DNA, 22 bp, Homo sapiens
tgggcagtgggcctaggtgtga

SEQ ID NO: 9194158 - DNA, 19 bp, Homo sapiens
tgggcaggttcagtaatgg

SEQ ID NO: 9194159 - DNA, 22 bp, Homo sapiens
tgggcaggggccctgcttccgt

SEQ ID NO: 9194160 - DNA, 22 bp, Homo sapiens
tgggcaggggccctgcttccgt

SEQ ID NO: 9194161 - DNA, 22 bp, Homo sapiens
tgggcaggagagaagctaaaga

SEQ ID NO: 9194162 - DNA, 19 bp, Homo sapiens
tgggcagctccctctgtcc

SEQ ID NO: 9194163 - DNA, 23 bp, Homo sapiens
tgggcagcttctgcatgcccacc

SEQ ID NO: 9194164 - DNA, 19 bp, Homo sapiens
tgggcagctccctctgtcc

SEQ ID NO: 9194165 - DNA, 22 bp, Homo sapiens
tgggcagccatcccagcctctc

SEQ ID NO: 9194166 - DNA, 19 bp, Homo sapiens
tgggcagctccctctgtcc

SEQ ID NO: 9194167 - DNA, 22 bp, Homo sapiens
tgggcagcatcctccacagtca

SEQ ID NO: 9194168 - DNA, 22 bp, Homo sapiens
tgggcagccatcccagcctctc

SEQ ID NO: 9194169 - DNA, 22 bp, Homo sapiens
tgggcagggagctggaaccaca

SEQ ID NO: 9194170 - DNA, 22 bp, Homo sapiens
tgggcagggagctggaaccaca

SEQ ID NO: 9194171 - DNA, 22 bp, Homo sapiens
tgggcaggggccctgcttccgt

SEQ ID NO: 9194172 - DNA, 22 bp, Homo sapiens
tgggcaggggccctgcttccgt

SEQ ID NO: 9194173 - DNA, 22 bp, Homo sapiens
tgggcagcagcaaagccagact

SEQ ID NO: 9194174 - DNA, 22 bp, Homo sapiens
tgggcagcatcctccacagtca

SEQ ID NO: 9194175 - DNA, 22 bp, Homo sapiens
tgggcagcagcaaagccagact

SEQ ID NO: 9194176 - DNA, 22 bp, Homo sapiens
tgggcagcagaaccaggccgac

SEQ ID NO: 9194177 - DNA, 20 bp, Homo sapiens
tgggcagcactgctggctgg

SEQ ID NO: 9194178 - DNA, 20 bp, Homo sapiens
tgggcagcactgctggctgg

SEQ ID NO: 9194179 - DNA, 22 bp, Homo sapiens
tgggcaagggacaggcctggct

SEQ ID NO: 9194180 - DNA, 22 bp, Homo sapiens
tgggcacaaacatctgcctgtt

SEQ ID NO: 9194181 - DNA, 22 bp, Homo sapiens
tgggcaagtcacttctgtcttt

SEQ ID NO: 9194182 - DNA, 22 bp, Homo sapiens
tgggcacactgaatctgctatt

SEQ ID NO: 9194183 - DNA, 22 bp, Homo sapiens
tgggcacagaatagatggccca

SEQ ID NO: 9194184 - DNA, 22 bp, Homo sapiens
tgggcacagaatagatggccca

SEQ ID NO: 9194185 - DNA, 20 bp, Homo sapiens
tgggattgttttttagcttc

SEQ ID NO: 9194186 - DNA, 22 bp, Homo sapiens
tgggatttttaaatgtattaag

SEQ ID NO: 9194187 - DNA, 22 bp, Homo sapiens
tgggatgggatctcgctgtgtc

SEQ ID NO: 9194188 - DNA, 22 bp, Homo sapiens
tgggatggcatcctgggccttg

SEQ ID NO: 9194189 - DNA, 22 bp, Homo sapiens
tgggcacaggggaatggatgaa

SEQ ID NO: 9194190 - DNA, 22 bp, Homo sapiens
tgggcacaggggtaggaatgag

SEQ ID NO: 9194191 - DNA, 22 bp, Homo sapiens
tgggcacatagttttatggtca

SEQ ID NO: 9194192 - DNA, 21 bp, Homo sapiens
tgggcaccaaaacctaggagt

SEQ ID NO: 9194193 - DNA, 22 bp, Homo sapiens
tgggcacatagttttatggtca

SEQ ID NO: 9194194 - DNA, 22 bp, Homo sapiens
tgggcacagagtcccatctgcc

SEQ ID NO: 9194195 - DNA, 22 bp, Homo sapiens
tgggcacctagcaacccttctc

SEQ ID NO: 9194196 - DNA, 22 bp, Homo sapiens
tgggcactcaggctgaggccgt

SEQ ID NO: 9194197 - DNA, 22 bp, Homo sapiens
tgggcacctgaggcctggcagg

SEQ ID NO: 9194198 - DNA, 22 bp, Homo sapiens
tgggatgaggcctctgttgtga

SEQ ID NO: 9194199 - DNA, 23 bp, Homo sapiens
tgggatggattcaccagtgtgct

SEQ ID NO: 9194200 - DNA, 22 bp, Homo sapiens
tgggatgagggtgagccacatg

SEQ ID NO: 9194201 - DNA, 22 bp, Homo sapiens
tgggatgaggcctctgttgtga

SEQ ID NO: 9194202 - DNA, 22 bp, Homo sapiens
tgggatagtggccaggaccccc

SEQ ID NO: 9194203 - DNA, 22 bp, Homo sapiens
tgggatagtagctgagagacaa

SEQ ID NO: 9194204 - DNA, 22 bp, Homo sapiens
tgggagtgaggcagagtctatc

SEQ ID NO: 9194205 - DNA, 18 bp, Homo sapiens
tgggagtgggagtggata

SEQ ID NO: 9194206 - DNA, 22 bp, Homo sapiens
tgggaggccgaggcaggtggat

SEQ ID NO: 9194207 - DNA, 22 bp, Homo sapiens
tgggaggcccaggcctggcagg

SEQ ID NO: 9194208 - DNA, 22 bp, Homo sapiens
tgggaggccgaggcaggtggat

SEQ ID NO: 9194209 - DNA, 22 bp, Homo sapiens
tgggaggccgaggcaggtggat

SEQ ID NO: 9194210 - DNA, 22 bp, Homo sapiens
tgggaggccaaggcaggcggat

SEQ ID NO: 9194211 - DNA, 22 bp, Homo sapiens
tgggaggccaaggcaggcggat

SEQ ID NO: 9194212 - DNA, 22 bp, Homo sapiens
tgggaggccaaggcaggcggat

SEQ ID NO: 9194213 - DNA, 22 bp, Homo sapiens
tgggaggtctcttgcggcctag

SEQ ID NO: 9194214 - DNA, 22 bp, Homo sapiens
tgggaggccgaggcaggtggat

SEQ ID NO: 9194215 - DNA, 22 bp, Homo sapiens
tgggaggcttccagaccttgct

SEQ ID NO: 9194216 - DNA, 22 bp, Homo sapiens
tgggagtccaaggcaggcggat

SEQ ID NO: 9194217 - DNA, 22 bp, Homo sapiens
tgggagtcagacagcctgagat

SEQ ID NO: 9194218 - DNA, 22 bp, Homo sapiens
tgggagtcagacagcctgagat

SEQ ID NO: 9194219 - DNA, 22 bp, Homo sapiens
tgggagtagatgaggagtgggc

SEQ ID NO: 9194220 - DNA, 21 bp, Homo sapiens
tgggcctcaggcagctgtgac

SEQ ID NO: 9194221 - DNA, 22 bp, Homo sapiens
tgggcctcagtttccttaggat

SEQ ID NO: 9194222 - DNA, 22 bp, Homo sapiens
tgggcctcctccgacagccggg

SEQ ID NO: 9194223 - DNA, 22 bp, Homo sapiens
tgggcctcctggaagaatgtgg

SEQ ID NO: 9194224 - DNA, 23 bp, Homo sapiens
tgggccagttctgttgaaagcca

SEQ ID NO: 9194225 - DNA, 23 bp, Homo sapiens
tgggccagttctgttgaaagcca

SEQ ID NO: 9194226 - DNA, 22 bp, Homo sapiens
tgggccagttatttcacctctg

SEQ ID NO: 9194227 - DNA, 22 bp, Homo sapiens
tgggccagtcctgcctaaggtg

SEQ ID NO: 9194228 - DNA, 22 bp, Homo sapiens
tgggccagtcctgcctaaggtg

SEQ ID NO: 9194229 - DNA, 22 bp, Homo sapiens
tgggccagtccagccccaggga

SEQ ID NO: 9194230 - DNA, 22 bp, Homo sapiens
tgggcctcaccttcttggcagc

SEQ ID NO: 9194231 - DNA, 22 bp, Homo sapiens
tgggccaggcatgtgatcagca

SEQ ID NO: 9194232 - DNA, 22 bp, Homo sapiens
tgggccaggcatgtgatcagca

SEQ ID NO: 9194233 - DNA, 22 bp, Homo sapiens
tgggccagggcacccagtccag

SEQ ID NO: 9194234 - DNA, 22 bp, Homo sapiens
tgggccaggggcctcttctgat

SEQ ID NO: 9194235 - DNA, 22 bp, Homo sapiens
tgggccaggtctgcggtcattt

SEQ ID NO: 9194236 - DNA, 17 bp, Homo sapiens
tgggccagtagaaggga

SEQ ID NO: 9194237 - DNA, 21 bp, Homo sapiens
tgggccagtagaaaggaaggc

SEQ ID NO: 9194238 - DNA, 22 bp, Homo sapiens
tgggccaggtgcagtgctttag

SEQ ID NO: 9194239 - DNA, 22 bp, Homo sapiens
tgggccaggtctgtgtcagctg

SEQ ID NO: 9194240 - DNA, 22 bp, Homo sapiens
tgggccagtagctactcgcaag

SEQ ID NO: 9194241 - DNA, 17 bp, Homo sapiens
tgggccagtagaaggga

SEQ ID NO: 9194242 - DNA, 22 bp, Homo sapiens
tgggccagtccagccccaggga

SEQ ID NO: 9194243 - DNA, 22 bp, Homo sapiens
tgggcctgggctggacagcctg

SEQ ID NO: 9194244 - DNA, 22 bp, Homo sapiens
tgggcctgggctggacagcctg

SEQ ID NO: 9194245 - DNA, 22 bp, Homo sapiens
tgggcctgggctggacagcctg

SEQ ID NO: 9194246 - DNA, 22 bp, Homo sapiens
tgggcctgggctcctgtcctct

SEQ ID NO: 9194247 - DNA, 22 bp, Homo sapiens
tgggcctgggctcctgtcctct

SEQ ID NO: 9194248 - DNA, 23 bp, Homo sapiens
tgggcctggaaagccttagagag

SEQ ID NO: 9194249 - DNA, 22 bp, Homo sapiens
tgggcctgccccaggcttcagc

SEQ ID NO: 9194250 - DNA, 23 bp, Homo sapiens
tgggcctggaaagccttagagag

SEQ ID NO: 9194251 - DNA, 23 bp, Homo sapiens
tgggcctggaaagccttagagag

SEQ ID NO: 9194252 - DNA, 22 bp, Homo sapiens
tgggcctgccccaggcttcagc

SEQ ID NO: 9194253 - DNA, 21 bp, Homo sapiens
tgggcctgattcccagggtca

SEQ ID NO: 9194254 - DNA, 21 bp, Homo sapiens
tgggcctgattcccagggtca

SEQ ID NO: 9194255 - DNA, 18 bp, Homo sapiens
tgggcctgcatcctagtc

SEQ ID NO: 9194256 - DNA, 22 bp, Homo sapiens
tgggcctgactcacctgcctcc

SEQ ID NO: 9194257 - DNA, 22 bp, Homo sapiens
tgggcctgactcacctgcctcc

SEQ ID NO: 9194258 - DNA, 22 bp, Homo sapiens
tgggcctgactcacctgcctcc

SEQ ID NO: 9194259 - DNA, 22 bp, Homo sapiens
tgggcctgacacttactaggga

SEQ ID NO: 9194260 - DNA, 21 bp, Homo sapiens
tgggcctgattcccagggtca

SEQ ID NO: 9194261 - DNA, 22 bp, Homo sapiens
tgggcctgagtttgggaactgg

SEQ ID NO: 9194262 - DNA, 20 bp, Homo sapiens
tgggcctgagcctgtgggct

SEQ ID NO: 9194263 - DNA, 22 bp, Homo sapiens
tgggcctgagctcaccaggggc

SEQ ID NO: 9194264 - DNA, 22 bp, Homo sapiens
tgggcctgaaattcccatttta

SEQ ID NO: 9194265 - DNA, 22 bp, Homo sapiens
tgggcctgaaggagctgcgccc

SEQ ID NO: 9194266 - DNA, 22 bp, Homo sapiens
tgggcctgaaggagctgcgccc

SEQ ID NO: 9194267 - DNA, 22 bp, Homo sapiens
tgggcctgaaggagctgcgccc

SEQ ID NO: 9194268 - DNA, 22 bp, Homo sapiens
tgggcctcggggaagcccgtgt

SEQ ID NO: 9194269 - DNA, 22 bp, Homo sapiens
tgggctcaagtgatgctcctgt

SEQ ID NO: 9194270 - DNA, 22 bp, Homo sapiens
tgggcgctgtgctcctctttgt

SEQ ID NO: 9194271 - DNA, 22 bp, Homo sapiens
tgggcgaggcccagggctgcgt

SEQ ID NO: 9194272 - DNA, 23 bp, Homo sapiens
tgggcgaggcaggagtggagcac

SEQ ID NO: 9194273 - DNA, 21 bp, Homo sapiens
tgggcctgtccctcttggagg

SEQ ID NO: 9194274 - DNA, 22 bp, Homo sapiens
tgggcctgggttcctcctgggc

SEQ ID NO: 9194275 - DNA, 21 bp, Homo sapiens
tgggcctgtccctcttggagg

SEQ ID NO: 9194276 - DNA, 22 bp, Homo sapiens
tgggcctgggttcctcctgggc

SEQ ID NO: 9194277 - DNA, 22 bp, Homo sapiens
tgggcctgtgatgctgggctat

SEQ ID NO: 9194278 - DNA, 22 bp, Homo sapiens
tgggcctgtggcttggctctag

SEQ ID NO: 9194279 - DNA, 22 bp, Homo sapiens
tgggcctgtggcttggctctag

SEQ ID NO: 9194280 - DNA, 20 bp, Homo sapiens
tgggcctgtggcagaagtct

SEQ ID NO: 9194281 - DNA, 22 bp, Homo sapiens
tgggcctgtggcttggctctag

SEQ ID NO: 9194282 - DNA, 22 bp, Homo sapiens
tgggcctgttgcctgagtccat

SEQ ID NO: 9194283 - DNA, 22 bp, Homo sapiens
tgggcctgtggcttggctctag

SEQ ID NO: 9194284 - DNA, 22 bp, Homo sapiens
tgggcctgtttcccttcagggc

SEQ ID NO: 9194285 - DNA, 22 bp, Homo sapiens
tgggcctgttggggttgagtta

SEQ ID NO: 9194286 - DNA, 22 bp, Homo sapiens
tgggcgaggagaatgctgtgaa

SEQ ID NO: 9194287 - DNA, 22 bp, Homo sapiens
tgggcctgtttcccttcagggc

SEQ ID NO: 9194288 - DNA, 22 bp, Homo sapiens
tgggctctgaagtcagtctgct

SEQ ID NO: 9194289 - DNA, 22 bp, Homo sapiens
tgggctctggagggcctaggat

SEQ ID NO: 9194290 - DNA, 22 bp, Homo sapiens
tgggctctcacacatgttctga

SEQ ID NO: 9194291 - DNA, 20 bp, Homo sapiens
tgggctgaggatcaggtgcc

SEQ ID NO: 9194292 - DNA, 22 bp, Homo sapiens
tgggctgagcactgaggaagga

SEQ ID NO: 9194293 - DNA, 22 bp, Homo sapiens
tgggctgagagtaccttataaa

SEQ ID NO: 9194294 - DNA, 22 bp, Homo sapiens
tgggctgagtggcagccagagt

SEQ ID NO: 9194295 - DNA, 22 bp, Homo sapiens
tgggctgaggggccttgatgac

SEQ ID NO: 9194296 - DNA, 22 bp, Homo sapiens
tgggctgagtgtggaactagtt

SEQ ID NO: 9194297 - DNA, 22 bp, Homo sapiens
tgggctgaaatgctgtggacta

SEQ ID NO: 9194298 - DNA, 22 bp, Homo sapiens
tgggctgccggcaggctctgcc

SEQ ID NO: 9194299 - DNA, 22 bp, Homo sapiens
tgggctgccggcaggctctgcc

SEQ ID NO: 9194300 - DNA, 22 bp, Homo sapiens
tgggctgccctgatggtcctca

SEQ ID NO: 9194301 - DNA, 22 bp, Homo sapiens
tgggctgccagctctccagatg

SEQ ID NO: 9194302 - DNA, 22 bp, Homo sapiens
tgggctgcaccctcagcctctg

SEQ ID NO: 9194303 - DNA, 22 bp, Homo sapiens
ttagcattctctgtgtgcataa

SEQ ID NO: 9194304 - DNA, 22 bp, Homo sapiens
ttagcaggaagagttggctgga

SEQ ID NO: 9194305 - DNA, 22 bp, Homo sapiens
ttagcagctaaactgacagacc

SEQ ID NO: 9194306 - DNA, 22 bp, Homo sapiens
ttagcactgtctggttatcttg

SEQ ID NO: 9194307 - DNA, 22 bp, Homo sapiens
ttagcactttgattcatgcaga

SEQ ID NO: 9194308 - DNA, 22 bp, Homo sapiens
ttagcagcaatggcatcaacta

SEQ ID NO: 9194309 - DNA, 22 bp, Homo sapiens
ttagcaaacatcttcgtgtgag

SEQ ID NO: 9194310 - DNA, 22 bp, Homo sapiens
ttagcaaacaaatgaaatggtt

SEQ ID NO: 9194311 - DNA, 22 bp, Homo sapiens
ttagcaaacaaatgaaatggtt

SEQ ID NO: 9194312 - DNA, 17 bp, Homo sapiens
ttagcaaaatagcactt

SEQ ID NO: 9194313 - DNA, 22 bp, Homo sapiens
ttagcaaaaatatctcatatta

SEQ ID NO: 9194314 - DNA, 22 bp, Homo sapiens
ttagatgtggacttatgttatt

SEQ ID NO: 9194315 - DNA, 22 bp, Homo sapiens
ttaggtaagtaggatcaaaaaa

SEQ ID NO: 9194316 - DNA, 22 bp, Homo sapiens
ttaggtctgtttataaaacagt

SEQ ID NO: 9194317 - DNA, 22 bp, Homo sapiens
ttagtaaataaagtctactttc

SEQ ID NO: 9194318 - DNA, 22 bp, Homo sapiens
ttagtaaataaagtctactttc

SEQ ID NO: 9194319 - DNA, 19 bp, Homo sapiens
ttaggtattattgctttcc

SEQ ID NO: 9194320 - DNA, 22 bp, Homo sapiens
ttagtacagaatcaaaagcaat

SEQ ID NO: 9194321 - DNA, 22 bp, Homo sapiens
ttagtaattagaaagtaattct

SEQ ID NO: 9194322 - DNA, 22 bp, Homo sapiens
ttaggaaattccacctgtattc

SEQ ID NO: 9194323 - DNA, 22 bp, Homo sapiens
ttaggaaattccacctgtattc

SEQ ID NO: 9194324 - DNA, 22 bp, Homo sapiens
ttagaacatagcaacagaatta

SEQ ID NO: 9194325 - DNA, 22 bp, Homo sapiens
ttagaactgaagaagattaagg

SEQ ID NO: 9194326 - DNA, 22 bp, Homo sapiens
ttagaacttaaacttcagaaag

SEQ ID NO: 9194327 - DNA, 22 bp, Homo sapiens
ttagataaattgcaacttgatt

SEQ ID NO: 9194328 - DNA, 22 bp, Homo sapiens
ttagaacttttcaactccattc

SEQ ID NO: 9194329 - DNA, 22 bp, Homo sapiens
ttagataacagtagaatatcaa

SEQ ID NO: 9194330 - DNA, 22 bp, Homo sapiens
ttagataatgtagagatatgag

SEQ ID NO: 9194331 - DNA, 22 bp, Homo sapiens
ttagaacaccattctatattac

SEQ ID NO: 9194332 - DNA, 22 bp, Homo sapiens
ttagaaaggggtgaatcaatgg

SEQ ID NO: 9194333 - DNA, 22 bp, Homo sapiens
ttagaaagggtgtctgaatctg

SEQ ID NO: 9194334 - DNA, 22 bp, Homo sapiens
ttagaaaggttttgctctgaaa

SEQ ID NO: 9194335 - DNA, 22 bp, Homo sapiens
ttacattttgcacagatgtccc

SEQ ID NO: 9194336 - DNA, 22 bp, Homo sapiens
ttacattttgcacagatgtccc

SEQ ID NO: 9194337 - DNA, 22 bp, Homo sapiens
ttagaaaggagcttatttcttt

SEQ ID NO: 9194338 - DNA, 22 bp, Homo sapiens
ttatgaagttcctgttacagtg

SEQ ID NO: 9194339 - DNA, 22 bp, Homo sapiens
ttatgacaggaaaatcacagaa

SEQ ID NO: 9194340 - DNA, 22 bp, Homo sapiens
ttatgatttgccacagattggt

SEQ ID NO: 9194341 - DNA, 18 bp, Homo sapiens
ttatgcaaaactgttttc

SEQ ID NO: 9194342 - DNA, 22 bp, Homo sapiens
ttatgacatatgagtacaagta

SEQ ID NO: 9194343 - DNA, 22 bp, Homo sapiens
ttatgatttgccacagattggt

SEQ ID NO: 9194344 - DNA, 22 bp, Homo sapiens
ttatgatttgccacagattggt

SEQ ID NO: 9194345 - DNA, 22 bp, Homo sapiens
ttatatgtttctgtttggaggc

SEQ ID NO: 9194346 - DNA, 22 bp, Homo sapiens
ttatatgtttctgtttggaggc

SEQ ID NO: 9194347 - DNA, 22 bp, Homo sapiens
ttatatgtatgcttataaacca

SEQ ID NO: 9194348 - DNA, 22 bp, Homo sapiens
ttatctgtgatcctaaatgtct

SEQ ID NO: 9194349 - DNA, 18 bp, Homo sapiens
ttagtataactgcctgtg

SEQ ID NO: 9194350 - DNA, 22 bp, Homo sapiens
ttagtcaatagtgaatatagag

SEQ ID NO: 9194351 - DNA, 22 bp, Homo sapiens
ttagtgcaaacctcagagacac

SEQ ID NO: 9194352 - DNA, 22 bp, Homo sapiens
ttagtgcaattcagagaacaat

SEQ ID NO: 9194353 - DNA, 22 bp, Homo sapiens
ttattcagggataacatccagg

SEQ ID NO: 9194354 - DNA, 22 bp, Homo sapiens
ttattccacagctcagaatttt

SEQ ID NO: 9194355 - DNA, 22 bp, Homo sapiens
ttattccagtaatctctgtaat

SEQ ID NO: 9194356 - DNA, 22 bp, Homo sapiens
ttattccaggcacagaaggagg

SEQ ID NO: 9194357 - DNA, 22 bp, Homo sapiens
ttattctgccaggagcgtcagt

SEQ ID NO: 9194358 - DNA, 21 bp, Homo sapiens
ttattctgagatgagattctt

SEQ ID NO: 9194359 - DNA, 22 bp, Homo sapiens
ttattctgcacttttaaaatat

SEQ ID NO: 9194360 - DNA, 22 bp, Homo sapiens
ttattctgagagttgaagtaat

SEQ ID NO: 9194361 - DNA, 22 bp, Homo sapiens
ttattctgactaatgtataact

SEQ ID NO: 9194362 - DNA, 22 bp, Homo sapiens
ttattctgaactagactctcat

SEQ ID NO: 9194363 - DNA, 22 bp, Homo sapiens
ttattctcatctccctacttag

SEQ ID NO: 9194364 - DNA, 22 bp, Homo sapiens
ttatttatggccctcacctgat

SEQ ID NO: 9194365 - DNA, 22 bp, Homo sapiens
ttatttatgttaacagtcgaga

SEQ ID NO: 9194366 - DNA, 22 bp, Homo sapiens
ttatttatgttaacagtcgaga

SEQ ID NO: 9194367 - DNA, 22 bp, Homo sapiens
ttattcttggatctgagtctct

SEQ ID NO: 9194368 - DNA, 22 bp, Homo sapiens
ttatttatggcactgttggtgg

SEQ ID NO: 9194369 - DNA, 22 bp, Homo sapiens
ttattcttcttctcttgccagg

SEQ ID NO: 9194370 - DNA, 22 bp, Homo sapiens
ttattctgttgttcagggttgg

SEQ ID NO: 9194371 - DNA, 22 bp, Homo sapiens
ttattctgtttgccgaccagta

SEQ ID NO: 9194372 - DNA, 22 bp, Homo sapiens
ttattctgttgcttttacagta

SEQ ID NO: 9194373 - DNA, 22 bp, Homo sapiens
ttattctgttggccctctcatc

SEQ ID NO: 9194374 - DNA, 17 bp, Homo sapiens
ttattctggcatatgtg

SEQ ID NO: 9194375 - DNA, 22 bp, Homo sapiens
ttattctggaggaagcaaatgg

SEQ ID NO: 9194376 - DNA, 22 bp, Homo sapiens
ttattctgtcaaacttatacat

SEQ ID NO: 9194377 - DNA, 22 bp, Homo sapiens
ttattctgtagaacctagtaca

SEQ ID NO: 9194378 - DNA, 22 bp, Homo sapiens
ttattctgtatttcaggtatgt

SEQ ID NO: 9194379 - DNA, 22 bp, Homo sapiens
ttattctgtgaacatggttaat

SEQ ID NO: 9194380 - DNA, 22 bp, Homo sapiens
ttattctgtctttggtctcaat

SEQ ID NO: 9194381 - DNA, 19 bp, Homo sapiens
ttattctgtcagagcacac

SEQ ID NO: 9194382 - DNA, 22 bp, Homo sapiens
ttacaagacacagtgctgaagg

SEQ ID NO: 9194383 - DNA, 22 bp, Homo sapiens
ttacaacatatttagcttgatt

SEQ ID NO: 9194384 - DNA, 21 bp, Homo sapiens
ttacaacatttgtgttctatg

SEQ ID NO: 9194385 - DNA, 21 bp, Homo sapiens
ttacaacatttgtgttctatg

SEQ ID NO: 9194386 - DNA, 22 bp, Homo sapiens
ttacaacaaaggcacgtgcatg

SEQ ID NO: 9194387 - DNA, 22 bp, Homo sapiens
ttacaacaaaggcacgtgcatg

SEQ ID NO: 9194388 - DNA, 22 bp, Homo sapiens
ttacaacaaaggcacgtgcatg

SEQ ID NO: 9194389 - DNA, 22 bp, Homo sapiens
ttaattaaattcatgagcattg

SEQ ID NO: 9194390 - DNA, 22 bp, Homo sapiens
ttaattaaattcatgagcattg

SEQ ID NO: 9194391 - DNA, 22 bp, Homo sapiens
ttacaaagagaagttgtagaat

SEQ ID NO: 9194392 - DNA, 22 bp, Homo sapiens
ttacaaagagaagttgtagaat

SEQ ID NO: 9194393 - DNA, 22 bp, Homo sapiens
ttaattaagagatactgcagta

SEQ ID NO: 9194394 - DNA, 22 bp, Homo sapiens
ttaattaattagttaagcatgt

SEQ ID NO: 9194395 - DNA, 22 bp, Homo sapiens
ttacaaagtgttatgataaaca

SEQ ID NO: 9194396 - DNA, 22 bp, Homo sapiens
ttacaaagtgttatgataaaca

SEQ ID NO: 9194397 - DNA, 22 bp, Homo sapiens
ttacaaagtgctgcaccatttt

SEQ ID NO: 9194398 - DNA, 22 bp, Homo sapiens
ttaaagcaggcatcattcctca

SEQ ID NO: 9194399 - DNA, 22 bp, Homo sapiens
ttaaagcaggcatcattcctca

SEQ ID NO: 9194400 - DNA, 22 bp, Homo sapiens
ttaaagcagtttgtatacatgg

SEQ ID NO: 9194401 - DNA, 22 bp, Homo sapiens
ttaaagcaaccatcaatttgga

SEQ ID NO: 9194402 - DNA, 22 bp, Homo sapiens
ttaaagcaacctcagccctctt

SEQ ID NO: 9194403 - DNA, 22 bp, Homo sapiens
ttaaagagtctactgcacatcc

SEQ ID NO: 9194404 - DNA, 22 bp, Homo sapiens
ttaaagaggtagttaggtttaa

SEQ ID NO: 9194405 - DNA, 22 bp, Homo sapiens
ttaaagaggcaggttaaataat

SEQ ID NO: 9194406 - DNA, 22 bp, Homo sapiens
ttaaagaggcaggttaaataat

SEQ ID NO: 9194407 - DNA, 22 bp, Homo sapiens
ttaaagagaactcaatgaatga

SEQ ID NO: 9194408 - DNA, 22 bp, Homo sapiens
ttaaactgggttagactgaatt

SEQ ID NO: 9194409 - DNA, 23 bp, Homo sapiens
ttaaacttcagtgcagaacactc

SEQ ID NO: 9194410 - DNA, 22 bp, Homo sapiens
ttaaactgggtccctgctggca

SEQ ID NO: 9194411 - DNA, 22 bp, Homo sapiens
ttaaactgcagactcagtgttc

SEQ ID NO: 9194412 - DNA, 22 bp, Homo sapiens
ttaaactgcagactcagtgttc

SEQ ID NO: 9194413 - DNA, 22 bp, Homo sapiens
ttaatacagaagcaagacactg

SEQ ID NO: 9194414 - DNA, 22 bp, Homo sapiens
ttaatacagaagcaagacactg

SEQ ID NO: 9194415 - DNA, 22 bp, Homo sapiens
ttaatacagaagcaagacactg

SEQ ID NO: 9194416 - DNA, 22 bp, Homo sapiens
ttaatgcttacagtgtcctgcg

SEQ ID NO: 9194417 - DNA, 21 bp, Homo sapiens
ttaatgctatgcagaaaatct

SEQ ID NO: 9194418 - DNA, 22 bp, Homo sapiens
ttaatgtggaaagctcttgagt

SEQ ID NO: 9194419 - DNA, 22 bp, Homo sapiens
ttaatgtgtgtacaggattttg

SEQ ID NO: 9194420 - DNA, 22 bp, Homo sapiens
ttaatggatgcggctgcgtgac

SEQ ID NO: 9194421 - DNA, 22 bp, Homo sapiens
ttaatacaagcatatgcacaca

SEQ ID NO: 9194422 - DNA, 22 bp, Homo sapiens
ttaatacaagcatatgcacaca

SEQ ID NO: 9194423 - DNA, 22 bp, Homo sapiens
ttaatacaactgttgtcactgg

SEQ ID NO: 9194424 - DNA, 22 bp, Homo sapiens
ttaataataatgagcccatttt

SEQ ID NO: 9194425 - DNA, 22 bp, Homo sapiens
ttaataaagtatgaattggaaa

SEQ ID NO: 9194426 - DNA, 22 bp, Homo sapiens
ttaataaagtatgaattggaaa

SEQ ID NO: 9194427 - DNA, 22 bp, Homo sapiens
ttaataaagtatgaattggaaa

SEQ ID NO: 9194428 - DNA, 22 bp, Homo sapiens
ttacaagatctttgaaggcaag

SEQ ID NO: 9194429 - DNA, 22 bp, Homo sapiens
ttacaagatctttgaaggcaag

SEQ ID NO: 9194430 - DNA, 22 bp, Homo sapiens
ttacaagcagctacatatcaca

SEQ ID NO: 9194431 - DNA, 22 bp, Homo sapiens
ttacaagatgggaaagggaagt

SEQ ID NO: 9194432 - DNA, 22 bp, Homo sapiens
ttacaagataacggagaaagca

SEQ ID NO: 9194433 - DNA, 22 bp, Homo sapiens
ttacaagatatgtgagaactag

SEQ ID NO: 9194434 - DNA, 22 bp, Homo sapiens
ttacaagataacggagaaagca

SEQ ID NO: 9194435 - DNA, 22 bp, Homo sapiens
ttacaattgagtctattgtatg

SEQ ID NO: 9194436 - DNA, 22 bp, Homo sapiens
ttacaattgagtctattgtatg

SEQ ID NO: 9194437 - DNA, 22 bp, Homo sapiens
ttacacaaaaataagatatggc

SEQ ID NO: 9194438 - DNA, 22 bp, Homo sapiens
ttacacttttgacaaacctgag

SEQ ID NO: 9194439 - DNA, 22 bp, Homo sapiens
ttacagatcatcaaggtataat

SEQ ID NO: 9194440 - DNA, 22 bp, Homo sapiens
ttacagatggatctagcaaaat

SEQ ID NO: 9194441 - DNA, 22 bp, Homo sapiens
ttacagatggggttgcaataaa

SEQ ID NO: 9194442 - DNA, 22 bp, Homo sapiens
ttacagatgtaggaactgaagt

SEQ ID NO: 9194443 - DNA, 22 bp, Homo sapiens
ttacagatgtttcaggaatact

SEQ ID NO: 9194444 - DNA, 22 bp, Homo sapiens
ttacagatgtaggaactgaagt

SEQ ID NO: 9194445 - DNA, 22 bp, Homo sapiens
ttacatgactgcccttgtcagg

SEQ ID NO: 9194446 - DNA, 22 bp, Homo sapiens
ttacagcagtgggaaggagtca

SEQ ID NO: 9194447 - DNA, 22 bp, Homo sapiens
ttacagcagtgggaaggagtca

SEQ ID NO: 9194448 - DNA, 22 bp, Homo sapiens
ttacatgctctgtgtgtctccg

SEQ ID NO: 9194449 - DNA, 22 bp, Homo sapiens
ttacatgcatatatgtgtgtgt

SEQ ID NO: 9194450 - DNA, 22 bp, Homo sapiens
ttacatgatgatttcataaaca

SEQ ID NO: 9194451 - DNA, 22 bp, Homo sapiens
ttacattaggtcaagctgccaa

SEQ ID NO: 9194452 - DNA, 22 bp, Homo sapiens
ttacattaggtcaagctgccaa

SEQ ID NO: 9194453 - DNA, 22 bp, Homo sapiens
ttacattcaatttctagaggta

SEQ ID NO: 9194454 - DNA, 22 bp, Homo sapiens
ttacattgtccagaaattattg

SEQ ID NO: 9194455 - DNA, 22 bp, Homo sapiens
ttacatgtggagtctgattgca

SEQ ID NO: 9194456 - DNA, 22 bp, Homo sapiens
ttacatgtactggtttgactta

SEQ ID NO: 9194457 - DNA, 22 bp, Homo sapiens
ttacatgtactggtttgactta

SEQ ID NO: 9194458 - DNA, 22 bp, Homo sapiens
ttacatgtaatctaaaataatt

SEQ ID NO: 9194459 - DNA, 22 bp, Homo sapiens
ttacatgtacaaacaattctta

SEQ ID NO: 9194460 - DNA, 22 bp, Homo sapiens
ttacatgtaatctaaaataatt

SEQ ID NO: 9194461 - DNA, 22 bp, Homo sapiens
ttacatgttagaaaaggctgtt

SEQ ID NO: 9194462 - DNA, 22 bp, Homo sapiens
ttacatgttctcatacacagag

SEQ ID NO: 9194463 - DNA, 22 bp, Homo sapiens
ttacatgtttacggatacactt

SEQ ID NO: 9194464 - DNA, 22 bp, Homo sapiens
ttacatgtttacggatacactt

SEQ ID NO: 9194465 - DNA, 23 bp, Homo sapiens
ttacatgtgtgcacacattctgg

SEQ ID NO: 9194466 - DNA, 22 bp, Homo sapiens
ttacatgtttatgtggtacatg

SEQ ID NO: 9194467 - DNA, 22 bp, Homo sapiens
ttcagcttgctgactgcggcag

SEQ ID NO: 9194468 - DNA, 22 bp, Homo sapiens
ttcagcttgaatctggctttga

SEQ ID NO: 9194469 - DNA, 22 bp, Homo sapiens
ttcagcttggagagaattttta

SEQ ID NO: 9194470 - DNA, 22 bp, Homo sapiens
ttcaggaagtgctgcctggtgt

SEQ ID NO: 9194471 - DNA, 22 bp, Homo sapiens
ttcaggaaattggagtccttct

SEQ ID NO: 9194472 - DNA, 22 bp, Homo sapiens
ttcaggaaatgtctgcctacca

SEQ ID NO: 9194473 - DNA, 22 bp, Homo sapiens
ttcagcccaggcatagggcaaa

SEQ ID NO: 9194474 - DNA, 22 bp, Homo sapiens
ttcagcccaggagttggaggct

SEQ ID NO: 9194475 - DNA, 21 bp, Homo sapiens
ttcagccctgtttgaggctac

SEQ ID NO: 9194476 - DNA, 22 bp, Homo sapiens
ttcagcctgtctgcagacccct

SEQ ID NO: 9194477 - DNA, 22 bp, Homo sapiens
ttcagcattggtatgaaaaccc

SEQ ID NO: 9194478 - DNA, 22 bp, Homo sapiens
ttcagccaattagaagccccac

SEQ ID NO: 9194479 - DNA, 21 bp, Homo sapiens
ttcagcttatgtgtcacttgc

SEQ ID NO: 9194480 - DNA, 22 bp, Homo sapiens
ttcagcttcatttgtctttatg

SEQ ID NO: 9194481 - DNA, 22 bp, Homo sapiens
ttcagcagtttctgagaagcaa

SEQ ID NO: 9194482 - DNA, 17 bp, Homo sapiens
ttcagcagtgtttctcc

SEQ ID NO: 9194483 - DNA, 21 bp, Homo sapiens
ttcagcagtcctctagagata

SEQ ID NO: 9194484 - DNA, 22 bp, Homo sapiens
ttcagcagtcgtccaggaaaag

SEQ ID NO: 9194485 - DNA, 22 bp, Homo sapiens
ttcagcagtgcagacacccagt

SEQ ID NO: 9194486 - DNA, 22 bp, Homo sapiens
ttcagcaggtggtgagttctgc

SEQ ID NO: 9194487 - DNA, 22 bp, Homo sapiens
ttcagcaggtggtgagttctgc

SEQ ID NO: 9194488 - DNA, 19 bp, Homo sapiens
ttcagcaggctgaagcttc

SEQ ID NO: 9194489 - DNA, 19 bp, Homo sapiens
ttcagcaggctgaagcttc

SEQ ID NO: 9194490 - DNA, 22 bp, Homo sapiens
ttcagcaggcggtagctgccac

SEQ ID NO: 9194491 - DNA, 22 bp, Homo sapiens
ttcagcagcttttagtacattg

SEQ ID NO: 9194492 - DNA, 22 bp, Homo sapiens
ttcactgccaactaacatggaa

SEQ ID NO: 9194493 - DNA, 22 bp, Homo sapiens
ttcaccctggaccagaaattgg

SEQ ID NO: 9194494 - DNA, 22 bp, Homo sapiens
ttcaccctggaccagaaattgg

SEQ ID NO: 9194495 - DNA, 22 bp, Homo sapiens
ttcacctgtcactgcacaactg

SEQ ID NO: 9194496 - DNA, 22 bp, Homo sapiens
ttcaccattacatacaaagatg

SEQ ID NO: 9194497 - DNA, 22 bp, Homo sapiens
ttcaccatttcccactaaacca

SEQ ID NO: 9194498 - DNA, 19 bp, Homo sapiens
ttcactaattgtaagattt

SEQ ID NO: 9194499 - DNA, 18 bp, Homo sapiens
ttcacctgtcctggcagg

SEQ ID NO: 9194500 - DNA, 22 bp, Homo sapiens
ttcactataaagtttcaacttt

SEQ ID NO: 9194501 - DNA, 22 bp, Homo sapiens
ttcactatgcttggaaacttct

SEQ ID NO: 9194502 - DNA, 22 bp, Homo sapiens
ttcactgcagcccatgaaggga

SEQ ID NO: 9194503 - DNA, 20 bp, Homo sapiens
ttatttgctctttatctgca

SEQ ID NO: 9194504 - DNA, 22 bp, Homo sapiens
ttatttgcccatgtttagcaga

SEQ ID NO: 9194505 - DNA, 22 bp, Homo sapiens
ttatttgattagtaaacctgta

SEQ ID NO: 9194506 - DNA, 22 bp, Homo sapiens
ttatttgccagaatttctcttg

SEQ ID NO: 9194507 - DNA, 22 bp, Homo sapiens
ttatttgccagaatttctcttg

SEQ ID NO: 9194508 - DNA, 22 bp, Homo sapiens
ttatttgctgatttcagtttca

SEQ ID NO: 9194509 - DNA, 22 bp, Homo sapiens
ttatttgtaaaggtccatagta

SEQ ID NO: 9194510 - DNA, 22 bp, Homo sapiens
ttatttgtgaatcatttatcta

SEQ ID NO: 9194511 - DNA, 22 bp, Homo sapiens
ttatttgtgaatcatttatcta

SEQ ID NO: 9194512 - DNA, 22 bp, Homo sapiens
ttatttgtgaatcatttatcta

SEQ ID NO: 9194513 - DNA, 22 bp, Homo sapiens
ttatttcattgatttctaagac

SEQ ID NO: 9194514 - DNA, 22 bp, Homo sapiens
ttatttcctgacacagctgatt

SEQ ID NO: 9194515 - DNA, 22 bp, Homo sapiens
ttatttcctagggaatttgcct

SEQ ID NO: 9194516 - DNA, 22 bp, Homo sapiens
ttatttcctaaatctctttgtt

SEQ ID NO: 9194517 - DNA, 22 bp, Homo sapiens
ttatttcttgtctatgtagcca

SEQ ID NO: 9194518 - DNA, 22 bp, Homo sapiens
ttatttgacttcttgctatgct

SEQ ID NO: 9194519 - DNA, 22 bp, Homo sapiens
ttatttgacttcttgctatgct

SEQ ID NO: 9194520 - DNA, 22 bp, Homo sapiens
ttatttgaatctggctagagaa

SEQ ID NO: 9194521 - DNA, 22 bp, Homo sapiens
ttcacattgtgcagattatggt

SEQ ID NO: 9194522 - DNA, 22 bp, Homo sapiens
ttcacattgttttaatgtgaat

SEQ ID NO: 9194523 - DNA, 22 bp, Homo sapiens
ttcacatttactggtttgtccg

SEQ ID NO: 9194524 - DNA, 22 bp, Homo sapiens
ttcacattgttttaatgtgaat

SEQ ID NO: 9194525 - DNA, 22 bp, Homo sapiens
ttcacatttcataccacagctt

SEQ ID NO: 9194526 - DNA, 22 bp, Homo sapiens
ttcaccatgggatgacaacagt

SEQ ID NO: 9194527 - DNA, 22 bp, Homo sapiens
ttcaccatgtaaaccatgtggc

SEQ ID NO: 9194528 - DNA, 19 bp, Homo sapiens
ttcaccatctcaccaaacc

SEQ ID NO: 9194529 - DNA, 18 bp, Homo sapiens
ttcaccagtgtgatgggt

SEQ ID NO: 9194530 - DNA, 19 bp, Homo sapiens
ttcacatttttgtggcact

SEQ ID NO: 9194531 - DNA, 22 bp, Homo sapiens
ttccagagctttgcgcttggaa

SEQ ID NO: 9194532 - DNA, 23 bp, Homo sapiens
ttccagaggaagaagtcatgact

SEQ ID NO: 9194533 - DNA, 22 bp, Homo sapiens
ttcattgagtataggggtatac

SEQ ID NO: 9194534 - DNA, 23 bp, Homo sapiens
ttcattgagctgttcttgaggat

SEQ ID NO: 9194535 - DNA, 23 bp, Homo sapiens
ttcattgattgcaaggagattgg

SEQ ID NO: 9194536 - DNA, 22 bp, Homo sapiens
ttcattgagttactgcctgggc

SEQ ID NO: 9194537 - DNA, 22 bp, Homo sapiens
ttcattcattcatgaatgttaa

SEQ ID NO: 9194538 - DNA, 22 bp, Homo sapiens
ttcattcatgtattgtctatgg

SEQ ID NO: 9194539 - DNA, 22 bp, Homo sapiens
ttcattcatggtcttctgagat

SEQ ID NO: 9194540 - DNA, 19 bp, Homo sapiens
ttcattctttctacttacc

SEQ ID NO: 9194541 - DNA, 21 bp, Homo sapiens
ttcattcatggcataatatag

SEQ ID NO: 9194542 - DNA, 22 bp, Homo sapiens
ttcattcatcacatgcagctgg

SEQ ID NO: 9194543 - DNA, 22 bp, Homo sapiens
ttcattcagcacatatttattg

SEQ ID NO: 9194544 - DNA, 22 bp, Homo sapiens
ttcattcacccaggaaacatct

SEQ ID NO: 9194545 - DNA, 22 bp, Homo sapiens
ttcattaagtataaaatgtggt

SEQ ID NO: 9194546 - DNA, 22 bp, Homo sapiens
ttcattacattcaaaaggcatt

SEQ ID NO: 9194547 - DNA, 22 bp, Homo sapiens
ttcattagaaaagtaaaaatgc

SEQ ID NO: 9194548 - DNA, 22 bp, Homo sapiens
ttcattagagattataaaatga

SEQ ID NO: 9194549 - DNA, 22 bp, Homo sapiens
ttcatgtttgcctatttgactt

SEQ ID NO: 9194550 - DNA, 22 bp, Homo sapiens
ttccagatgtttaagttctgct

SEQ ID NO: 9194551 - DNA, 22 bp, Homo sapiens
ttccagatatttttatgtggaa

SEQ ID NO: 9194552 - DNA, 22 bp, Homo sapiens
ttccagcagcgtgggagaagta

SEQ ID NO: 9194553 - DNA, 22 bp, Homo sapiens
ttccagcaggcagacaggagat

SEQ ID NO: 9194554 - DNA, 22 bp, Homo sapiens
ttccagccatggtttccctatg

SEQ ID NO: 9194555 - DNA, 22 bp, Homo sapiens
ttccagcccgcgacttgttcag

SEQ ID NO: 9194556 - DNA, 22 bp, Homo sapiens
ttccagaggtagcaatgacttg

SEQ ID NO: 9194557 - DNA, 22 bp, Homo sapiens
ttccagaggggaggtggcagcc

SEQ ID NO: 9194558 - DNA, 22 bp, Homo sapiens
ttccagagttgggggagtggtt

SEQ ID NO: 9194559 - DNA, 22 bp, Homo sapiens
ttccagagtctggttccatggt

SEQ ID NO: 9194560 - DNA, 22 bp, Homo sapiens
ttccagagtccatgttggctca

SEQ ID NO: 9194561 - DNA, 22 bp, Homo sapiens
ttccagaggttctcagccctgt

SEQ ID NO: 9194562 - DNA, 23 bp, Homo sapiens
ttccagagtccacatctgccacc

SEQ ID NO: 9194563 - DNA, 22 bp, Homo sapiens
ttccagctaactcacatccctt

SEQ ID NO: 9194564 - DNA, 22 bp, Homo sapiens
ttccagctaactcacatccctt

SEQ ID NO: 9194565 - DNA, 22 bp, Homo sapiens
tgtggaaagtggtctaagcaca

SEQ ID NO: 9194566 - DNA, 22 bp, Homo sapiens
tgtggaagccggtgggaagcag

SEQ ID NO: 9194567 - DNA, 22 bp, Homo sapiens
tgtggccttgcagcctggaggt

SEQ ID NO: 9194568 - DNA, 19 bp, Homo sapiens
tgtggctgagcactcctta

SEQ ID NO: 9194569 - DNA, 19 bp, Homo sapiens
tgtggctgagcactcctta

SEQ ID NO: 9194570 - DNA, 22 bp, Homo sapiens
tgtggctgatcaaagcgctcag

SEQ ID NO: 9194571 - DNA, 23 bp, Homo sapiens
tgtggctgagaaattgacaactt

SEQ ID NO: 9194572 - DNA, 22 bp, Homo sapiens
tgtggctgactcctggtcccca

SEQ ID NO: 9194573 - DNA, 22 bp, Homo sapiens
tgtggctctcctcctgctgccc

SEQ ID NO: 9194574 - DNA, 22 bp, Homo sapiens
tgtggctctcctcctgctgccc

SEQ ID NO: 9194575 - DNA, 21 bp, Homo sapiens
tgtggctgacaccctttggga

SEQ ID NO: 9194576 - DNA, 22 bp, Homo sapiens
tgtggctctgccccctggtaag

SEQ ID NO: 9194577 - DNA, 22 bp, Homo sapiens
tgtggctcggccagctgctgaa

SEQ ID NO: 9194578 - DNA, 22 bp, Homo sapiens
tgtgggaatcagccaggggggc

SEQ ID NO: 9194579 - DNA, 22 bp, Homo sapiens
tgtgggagaaggaagcaagctg

SEQ ID NO: 9194580 - DNA, 22 bp, Homo sapiens
tgtgggaggaacacagccagaa

SEQ ID NO: 9194581 - DNA, 22 bp, Homo sapiens
tgtgggaggaacacagccagaa

SEQ ID NO: 9194582 - DNA, 22 bp, Homo sapiens
tgtgggaggaacacagccagaa

SEQ ID NO: 9194583 - DNA, 22 bp, Homo sapiens
tgtgggaggaacacagccagaa

SEQ ID NO: 9194584 - DNA, 22 bp, Homo sapiens
tgtgggaggaattagaatggga

SEQ ID NO: 9194585 - DNA, 22 bp, Homo sapiens
tgtggctgccaccctgaagccg

SEQ ID NO: 9194586 - DNA, 22 bp, Homo sapiens
tgtggctgccaccctgaagccg

SEQ ID NO: 9194587 - DNA, 22 bp, Homo sapiens
tgtgggaagatgttgcaggaga

SEQ ID NO: 9194588 - DNA, 22 bp, Homo sapiens
tgtggctgcaaaggaaggctgc

SEQ ID NO: 9194589 - DNA, 22 bp, Homo sapiens
tgtggctgcaaaggaaggctgc

SEQ ID NO: 9194590 - DNA, 22 bp, Homo sapiens
tgtggctgcaaaggaaggctgc

SEQ ID NO: 9194591 - DNA, 22 bp, Homo sapiens
tgtggctgcagacactggagcc

SEQ ID NO: 9194592 - DNA, 22 bp, Homo sapiens
tgtggctgcagacactggagcc

SEQ ID NO: 9194593 - DNA, 22 bp, Homo sapiens
tgtggctgcaggcgatggagga

SEQ ID NO: 9194594 - DNA, 22 bp, Homo sapiens
tgtggctgcaggcgatggagga

SEQ ID NO: 9194595 - DNA, 22 bp, Homo sapiens
tgtggctgcaggcgatggagga

SEQ ID NO: 9194596 - DNA, 23 bp, Homo sapiens
tgtgtacatacatatgtacacac

SEQ ID NO: 9194597 - DNA, 22 bp, Homo sapiens
tgtgtacattgccttttaaagg

SEQ ID NO: 9194598 - DNA, 22 bp, Homo sapiens
tgtgtacaggccttgctagact

SEQ ID NO: 9194599 - DNA, 22 bp, Homo sapiens
tgtgtacaggaactgatcagat

SEQ ID NO: 9194600 - DNA, 22 bp, Homo sapiens
tgtgtacaggacagaaaggagg

SEQ ID NO: 9194601 - DNA, 22 bp, Homo sapiens
tgtgtacacacagatatataca

SEQ ID NO: 9194602 - DNA, 22 bp, Homo sapiens
tgtgtacacagatagtaatggc

SEQ ID NO: 9194603 - DNA, 22 bp, Homo sapiens
tgtgtacacatgacaggcaccc

SEQ ID NO: 9194604 - DNA, 22 bp, Homo sapiens
tgtgtacacaatgattgcagag

SEQ ID NO: 9194605 - DNA, 23 bp, Homo sapiens
tgtgtacacaatagatgaggttt

SEQ ID NO: 9194606 - DNA, 22 bp, Homo sapiens
tgtgtacacaagtatatataca

SEQ ID NO: 9194607 - DNA, 22 bp, Homo sapiens
tgtgtacaaatttagccagcag

SEQ ID NO: 9194608 - DNA, 22 bp, Homo sapiens
tgtgtacaaactaacaacatat

SEQ ID NO: 9194609 - DNA, 22 bp, Homo sapiens
tgtgtacaagcctgagtacaga

SEQ ID NO: 9194610 - DNA, 22 bp, Homo sapiens
tgtggggaagagtatgacttgg

SEQ ID NO: 9194611 - DNA, 22 bp, Homo sapiens
tgtggggacccatgccatgggc

SEQ ID NO: 9194612 - DNA, 22 bp, Homo sapiens
tgtggggactgagtggaggctt

SEQ ID NO: 9194613 - DNA, 22 bp, Homo sapiens
tgtggggactgagtggaggctt

SEQ ID NO: 9194614 - DNA, 22 bp, Homo sapiens
tgtggggacctggctgccaccc

SEQ ID NO: 9194615 - DNA, 22 bp, Homo sapiens
tgtgggcactaatgacatgcag

SEQ ID NO: 9194616 - DNA, 22 bp, Homo sapiens
tgtgggcactaatgacatgcag

SEQ ID NO: 9194617 - DNA, 22 bp, Homo sapiens
tgtgggaggtctggaaggctcc

SEQ ID NO: 9194618 - DNA, 22 bp, Homo sapiens
tgtgggaggtctggaaggctcc

SEQ ID NO: 9194619 - DNA, 22 bp, Homo sapiens
tgtgggaggattcagaattggg

SEQ ID NO: 9194620 - DNA, 22 bp, Homo sapiens
tgtgggaggaattagaatggga

SEQ ID NO: 9194621 - DNA, 20 bp, Homo sapiens
tgtgggcccttggctggcaa

SEQ ID NO: 9194622 - DNA, 22 bp, Homo sapiens
tgtgggcctgggaaggtgacac

SEQ ID NO: 9194623 - DNA, 22 bp, Homo sapiens
tgtgggcctcagcaggactcca

SEQ ID NO: 9194624 - DNA, 22 bp, Homo sapiens
tgtgggccaggaggcctcagtg

SEQ ID NO: 9194625 - DNA, 22 bp, Homo sapiens
tgtgggccctaggcaccttgtc

SEQ ID NO: 9194626 - DNA, 22 bp, Homo sapiens
tgtgggcccagattctgaggct

SEQ ID NO: 9194627 - DNA, 20 bp, Homo sapiens
tgtgggcctgtgaagcggcg

SEQ ID NO: 9194628 - DNA, 20 bp, Homo sapiens
tgtgggccttcggcgtgctc

SEQ ID NO: 9194629 - DNA, 23 bp, Homo sapiens
tgtgggcgcattgtaagggtagc

SEQ ID NO: 9194630 - DNA, 23 bp, Homo sapiens
tgtgggcgcattgtaagggtagc

SEQ ID NO: 9194631 - DNA, 22 bp, Homo sapiens
tgtgtgtgtgcgcgcacgcata

SEQ ID NO: 9194632 - DNA, 22 bp, Homo sapiens
tgtgtgtgttcctcctcagcta

SEQ ID NO: 9194633 - DNA, 21 bp, Homo sapiens
tgtgtgtgcaggcacacacac

SEQ ID NO: 9194634 - DNA, 22 bp, Homo sapiens
tgtgtgtgcaggagagcaggtg

SEQ ID NO: 9194635 - DNA, 22 bp, Homo sapiens
tgtgtgtgggcggaacggcccc

SEQ ID NO: 9194636 - DNA, 22 bp, Homo sapiens
tgtgtgtggggaggcagcagat

SEQ ID NO: 9194637 - DNA, 22 bp, Homo sapiens
tgtgtgtgggcggaacggcccc

SEQ ID NO: 9194638 - DNA, 22 bp, Homo sapiens
tgttaaaaatgcagattcctat

SEQ ID NO: 9194639 - DNA, 19 bp, Homo sapiens
tgtgtgtttatatatgtat

SEQ ID NO: 9194640 - DNA, 22 bp, Homo sapiens
tgttaaagttatatgccgtcct

SEQ ID NO: 9194641 - DNA, 22 bp, Homo sapiens
tgttaaaaattcagctctagat

SEQ ID NO: 9194642 - DNA, 22 bp, Homo sapiens
tgttaaaaccacaggtgaggac

SEQ ID NO: 9194643 - DNA, 22 bp, Homo sapiens
tgtgtgtgtttctgctcataca

SEQ ID NO: 9194644 - DNA, 22 bp, Homo sapiens
tgtgtgtgactcatactagaac

SEQ ID NO: 9194645 - DNA, 21 bp, Homo sapiens
tgtgtgggcatatctgctgca

SEQ ID NO: 9194646 - DNA, 22 bp, Homo sapiens
tgtgtggcaagctgtatgctag

SEQ ID NO: 9194647 - DNA, 22 bp, Homo sapiens
tgtgtggattcatctcaaagag

SEQ ID NO: 9194648 - DNA, 22 bp, Homo sapiens
tgtgtgggagcacgggctgttg

SEQ ID NO: 9194649 - DNA, 22 bp, Homo sapiens
tgtgtggattcatctcaaagag

SEQ ID NO: 9194650 - DNA, 22 bp, Homo sapiens
tgtgtggattcatctcaaagag

SEQ ID NO: 9194651 - DNA, 22 bp, Homo sapiens
tgtgtggatgcagcgtgggtct

SEQ ID NO: 9194652 - DNA, 19 bp, Homo sapiens
tgtgtgctgactgccagag

SEQ ID NO: 9194653 - DNA, 22 bp, Homo sapiens
tgtgtgctaatgtatgctctaa

SEQ ID NO: 9194654 - DNA, 22 bp, Homo sapiens
tgtgtgcctgagccgtgcctgg

SEQ ID NO: 9194655 - DNA, 22 bp, Homo sapiens
tgtgtgcctgagccgtgcctgg

SEQ ID NO: 9194656 - DNA, 22 bp, Homo sapiens
tgtgtgccagcctacgaggagc

SEQ ID NO: 9194657 - DNA, 19 bp, Homo sapiens
tgtgtgccctcaccacata

SEQ ID NO: 9194658 - DNA, 22 bp, Homo sapiens
tgtgtgccccagatgagtagct

SEQ ID NO: 9194659 - DNA, 22 bp, Homo sapiens
tgtgtgccagggcatgcacagg

SEQ ID NO: 9194660 - DNA, 19 bp, Homo sapiens
tgtgtgccctcaccacata

SEQ ID NO: 9194661 - DNA, 22 bp, Homo sapiens
tgtgtgccagatacaagcactg

SEQ ID NO: 9194662 - DNA, 22 bp, Homo sapiens
tgtgtgcattcacatgcatgcc

SEQ ID NO: 9194663 - DNA, 22 bp, Homo sapiens
tgtgtcagaagtacttttggaa

SEQ ID NO: 9194664 - DNA, 19 bp, Homo sapiens
tgttgtctaccatgaagtc

SEQ ID NO: 9194665 - DNA, 22 bp, Homo sapiens
tgttgttttctcatggagaata

SEQ ID NO: 9194666 - DNA, 23 bp, Homo sapiens
tgttgaagtaactgttacataga

SEQ ID NO: 9194667 - DNA, 22 bp, Homo sapiens
tgttcttttctctaaactgata

SEQ ID NO: 9194668 - DNA, 22 bp, Homo sapiens
tgttgagtatatacctacaagt

SEQ ID NO: 9194669 - DNA, 22 bp, Homo sapiens
tgttgtaatcattttatgaaaa

SEQ ID NO: 9194670 - DNA, 22 bp, Homo sapiens
tgttggcttgaccttcgctgtt

SEQ ID NO: 9194671 - DNA, 22 bp, Homo sapiens
tgtttattcatggctaatgaaa

SEQ ID NO: 9194672 - DNA, 22 bp, Homo sapiens
tgtttattcatggctaatgaaa

SEQ ID NO: 9194673 - DNA, 22 bp, Homo sapiens
tgtttattacagttcttggaat

SEQ ID NO: 9194674 - DNA, 22 bp, Homo sapiens
tgtttactgcattctatttgct

SEQ ID NO: 9194675 - DNA, 21 bp, Homo sapiens
tgtttatggaaaagagacaaa

SEQ ID NO: 9194676 - DNA, 22 bp, Homo sapiens
tgtttatagggtctgtcacttg

SEQ ID NO: 9194677 - DNA, 22 bp, Homo sapiens
tgtttattttcaggatggattg

SEQ ID NO: 9194678 - DNA, 22 bp, Homo sapiens
tgtttattttcaggatggattg

SEQ ID NO: 9194679 - DNA, 22 bp, Homo sapiens
tgtttattgctgcaattgtgcc

SEQ ID NO: 9194680 - DNA, 22 bp, Homo sapiens
tgtttattgcagtgctgggctg

SEQ ID NO: 9194681 - DNA, 22 bp, Homo sapiens
tgtttattgcagtgctgggctg

SEQ ID NO: 9194682 - DNA, 18 bp, Homo sapiens
tgtttattctcctgacag

SEQ ID NO: 9194683 - DNA, 18 bp, Homo sapiens
tgtttattctcctgacag

SEQ ID NO: 9194684 - DNA, 22 bp, Homo sapiens
tgtttattgagtgcctactata

SEQ ID NO: 9194685 - DNA, 18 bp, Homo sapiens
tgttaaatgaagatttgc

SEQ ID NO: 9194686 - DNA, 22 bp, Homo sapiens
tgttaacagccagatttggtga

SEQ ID NO: 9194687 - DNA, 22 bp, Homo sapiens
tgttactttgattggtattcta

SEQ ID NO: 9194688 - DNA, 22 bp, Homo sapiens
tgttacttatctcacgtgatgc

SEQ ID NO: 9194689 - DNA, 22 bp, Homo sapiens
tgttacttcttatttcttacat

SEQ ID NO: 9194690 - DNA, 22 bp, Homo sapiens
tgttacttcttggtaaaggaga

SEQ ID NO: 9194691 - DNA, 22 bp, Homo sapiens
tgttactgtggttaccagaagc

SEQ ID NO: 9194692 - DNA, 22 bp, Homo sapiens
tgttactattagtttgagcata

SEQ ID NO: 9194693 - DNA, 22 bp, Homo sapiens
tgttacagtgactaatgtttta

SEQ ID NO: 9194694 - DNA, 22 bp, Homo sapiens
tgttaagaagaggcagtactta

SEQ ID NO: 9194695 - DNA, 22 bp, Homo sapiens
tgttcttaacttttgtgtatat

SEQ ID NO: 9194696 - DNA, 17 bp, Homo sapiens
tgttctgttggaaagca

SEQ ID NO: 9194697 - DNA, 22 bp, Homo sapiens
tgttctgttttatggtagggaa

SEQ ID NO: 9194698 - DNA, 22 bp, Homo sapiens
tgttagtattggcaaatttgtt

SEQ ID NO: 9194699 - DNA, 22 bp, Homo sapiens
tgttagcatagctcagaaggag

SEQ ID NO: 9194700 - DNA, 22 bp, Homo sapiens
tgttagcagagcagctgacaga

SEQ ID NO: 9194701 - DNA, 22 bp, Homo sapiens
tgttagaagttaatcactaatt

SEQ ID NO: 9194702 - DNA, 22 bp, Homo sapiens
tgttagcagagcagctgacaga

SEQ ID NO: 9194703 - DNA, 22 bp, Homo sapiens
tgttagcaaggataattatgat

SEQ ID NO: 9194704 - DNA, 22 bp, Homo sapiens
tgttagcaaggataattatgat

SEQ ID NO: 9194705 - DNA, 22 bp, Homo sapiens
tgttctttagcagaccatgttg

SEQ ID NO: 9194706 - DNA, 22 bp, Homo sapiens
tgttcttgagcctttagaccta

SEQ ID NO: 9194707 - DNA, 22 bp, Homo sapiens
tgttctttgctgttgatgtaga

SEQ ID NO: 9194708 - DNA, 22 bp, Homo sapiens
tgttctttgccagtgatttaat

SEQ ID NO: 9194709 - DNA, 22 bp, Homo sapiens
tgttctttgccagtgatttaat

SEQ ID NO: 9194710 - DNA, 22 bp, Homo sapiens
tgttctttggcttcacagctct

SEQ ID NO: 9194711 - DNA, 22 bp, Homo sapiens
tgttctttggcttcctttccgt

SEQ ID NO: 9194712 - DNA, 22 bp, Homo sapiens
ttaaaatgcagattctgattca

SEQ ID NO: 9194713 - DNA, 22 bp, Homo sapiens
ttaaaatgcagattctgattca

SEQ ID NO: 9194714 - DNA, 22 bp, Homo sapiens
ttaaaagagacttcctttgttt

SEQ ID NO: 9194715 - DNA, 22 bp, Homo sapiens
ttaaaatgcagattatgactca

SEQ ID NO: 9194716 - DNA, 22 bp, Homo sapiens
ttaaaacagcgtgaatctggca

SEQ ID NO: 9194717 - DNA, 22 bp, Homo sapiens
ttaaaacgtaaatgtccccagc

SEQ ID NO: 9194718 - DNA, 22 bp, Homo sapiens
ttaaaaatatgtagggcccgat

SEQ ID NO: 9194719 - DNA, 20 bp, Homo sapiens
ttaaaaagagtcacaggaga

SEQ ID NO: 9194720 - DNA, 22 bp, Homo sapiens
tgttttttccttatgcaatctg

SEQ ID NO: 9194721 - DNA, 22 bp, Homo sapiens
tgtttttttatatacctgaagt

SEQ ID NO: 9194722 - DNA, 17 bp, Homo sapiens
tgttttttccctgttct

SEQ ID NO: 9194723 - DNA, 22 bp, Homo sapiens
tgttttttccttatgcaatctg

SEQ ID NO: 9194724 - DNA, 22 bp, Homo sapiens
ttaaaatttccccaccatgtat

SEQ ID NO: 9194725 - DNA, 22 bp, Homo sapiens
ttaaaatttccccaccatgtat

SEQ ID NO: 9194726 - DNA, 22 bp, Homo sapiens
ttaaaatttccccaccatgtat

SEQ ID NO: 9194727 - DNA, 22 bp, Homo sapiens
ttaaaattatggcccatttgga

SEQ ID NO: 9194728 - DNA, 22 bp, Homo sapiens
ttaaaattatggcccatttgga

SEQ ID NO: 9194729 - DNA, 22 bp, Homo sapiens
ttaaaccactttgttgcaagta

SEQ ID NO: 9194730 - DNA, 22 bp, Homo sapiens
ttaaaccatagtttaacataag

SEQ ID NO: 9194731 - DNA, 22 bp, Homo sapiens
ttaaacagacagtaaatgaaac

SEQ ID NO: 9194732 - DNA, 22 bp, Homo sapiens
tgtttttccatgtgcagaacaa

SEQ ID NO: 9194733 - DNA, 22 bp, Homo sapiens
tgtttttgtctccttgtctgct

SEQ ID NO: 9194734 - DNA, 22 bp, Homo sapiens
tgttttatgagccatataacct

SEQ ID NO: 9194735 - DNA, 22 bp, Homo sapiens
tgttttaatctcccattgctct

SEQ ID NO: 9194736 - DNA, 22 bp, Homo sapiens
tgttttatcaagatggcatgtc

SEQ ID NO: 9194737 - DNA, 22 bp, Homo sapiens
tgttttaagagcgcactttata

SEQ ID NO: 9194738 - DNA, 22 bp, Homo sapiens
tgttttaagggtcaactgtcac

SEQ ID NO: 9194739 - DNA, 22 bp, Homo sapiens
tgttttaagggtcaactgtcac

SEQ ID NO: 9194740 - DNA, 22 bp, Homo sapiens
tgtttcaaaataacaagagggt

SEQ ID NO: 9194741 - DNA, 22 bp, Homo sapiens
tgtttcaaaacagtgataattt

SEQ ID NO: 9194742 - DNA, 18 bp, Homo sapiens
tgtttatttttctcttac

SEQ ID NO: 9194743 - DNA, 18 bp, Homo sapiens
tgtttatttttctcttac

SEQ ID NO: 9194744 - DNA, 22 bp, Homo sapiens
tgtttcaaagaaagaaaatata

SEQ ID NO: 9194745 - DNA, 22 bp, Homo sapiens
tgtttcaaaggttatacagtca

SEQ ID NO: 9194746 - DNA, 22 bp, Homo sapiens
tgtttcaaaggttatacagtca

SEQ ID NO: 9194747 - DNA, 22 bp, Homo sapiens
tgtttgcattaattagaaggta

SEQ ID NO: 9194748 - DNA, 22 bp, Homo sapiens
tgtttcaaaggttatacagtca

SEQ ID NO: 9194749 - DNA, 22 bp, Homo sapiens
tgtttgctagggttggtattta

SEQ ID NO: 9194750 - DNA, 22 bp, Homo sapiens
tgtttgctatatcctacttcat

SEQ ID NO: 9194751 - DNA, 22 bp, Homo sapiens
tgtttgcattgttaattcagtc

SEQ ID NO: 9194752 - DNA, 22 bp, Homo sapiens
tgtttgctagggttggtattta

SEQ ID NO: 9194753 - DNA, 22 bp, Homo sapiens
tgtttgctctgactatcttgcg

SEQ ID NO: 9194754 - DNA, 22 bp, Homo sapiens
tgtttgctctgactatcttgcg

SEQ ID NO: 9194755 - DNA, 22 bp, Homo sapiens
tgtttgtgctgcctggtgggca

SEQ ID NO: 9194756 - DNA, 20 bp, Homo sapiens
tgtttgtgtggggccttggc

SEQ ID NO: 9194757 - DNA, 22 bp, Homo sapiens
tgtttggagaaaggctgtgaac

SEQ ID NO: 9194758 - DNA, 22 bp, Homo sapiens
tgtttgcttacttgtatgctgc

SEQ ID NO: 9194759 - DNA, 22 bp, Homo sapiens
tgtttgtcatcattgtgagaga

SEQ ID NO: 9194760 - DNA, 22 bp, Homo sapiens
tgtgaagtccagagaagtcagg

SEQ ID NO: 9194761 - DNA, 22 bp, Homo sapiens
tgtgaatggacaattaaatcta

SEQ ID NO: 9194762 - DNA, 23 bp, Homo sapiens
tgtgaattgaggacatcaaaagc

SEQ ID NO: 9194763 - DNA, 22 bp, Homo sapiens
tgtgaaatgctattgtgacaaa

SEQ ID NO: 9194764 - DNA, 22 bp, Homo sapiens
tgtgaaatgaagataattcttg

SEQ ID NO: 9194765 - DNA, 22 bp, Homo sapiens
tgtgaaatgagtatatttgaat

SEQ ID NO: 9194766 - DNA, 22 bp, Homo sapiens
tgtgaaatgagtatatttgaat

SEQ ID NO: 9194767 - DNA, 22 bp, Homo sapiens
tgtgaaatgagtatatttgaat

SEQ ID NO: 9194768 - DNA, 22 bp, Homo sapiens
tgtgaaatgtgtgtataattaa

SEQ ID NO: 9194769 - DNA, 22 bp, Homo sapiens
tgtgaaatgtgtgtataattaa

SEQ ID NO: 9194770 - DNA, 22 bp, Homo sapiens
tgtgaaatgtggatgttaatag

SEQ ID NO: 9194771 - DNA, 22 bp, Homo sapiens
tgtgaaattcttgaaatgcaca

SEQ ID NO: 9194772 - DNA, 22 bp, Homo sapiens
tgtgaaattgagaaactttcac

SEQ ID NO: 9194773 - DNA, 22 bp, Homo sapiens
tgtgaaattgagaaactttcac

SEQ ID NO: 9194774 - DNA, 18 bp, Homo sapiens
tgtgaacacatttttctg

SEQ ID NO: 9194775 - DNA, 23 bp, Homo sapiens
tgtgaaatttgaggtcagtgctt

SEQ ID NO: 9194776 - DNA, 20 bp, Homo sapiens
tgtgaaagcagtagaatgac

SEQ ID NO: 9194777 - DNA, 20 bp, Homo sapiens
tgtgaaagcagtagaatgac

SEQ ID NO: 9194778 - DNA, 22 bp, Homo sapiens
tgtgaaagagtcttatagtttc

SEQ ID NO: 9194779 - DNA, 22 bp, Homo sapiens
tgtgaaaggagccatagacagt

SEQ ID NO: 9194780 - DNA, 22 bp, Homo sapiens
tgtgaaaggaaggcatgaaaag

SEQ ID NO: 9194781 - DNA, 19 bp, Homo sapiens
tgtgaaagctagtgttctt

SEQ ID NO: 9194782 - DNA, 22 bp, Homo sapiens
tgtgaaatattggcaatttcat

SEQ ID NO: 9194783 - DNA, 22 bp, Homo sapiens
tgtgaaatcacaggctatttag

SEQ ID NO: 9194784 - DNA, 22 bp, Homo sapiens
tgtgaaatatttatatactcaa

SEQ ID NO: 9194785 - DNA, 22 bp, Homo sapiens
tgtgaaatcaattagctgcaga

SEQ ID NO: 9194786 - DNA, 22 bp, Homo sapiens
tgtgatttcatctgaggccagg

SEQ ID NO: 9194787 - DNA, 22 bp, Homo sapiens
tgtgatttcactggtgacatgt

SEQ ID NO: 9194788 - DNA, 22 bp, Homo sapiens
tgtgcaaaataataaatcactg

SEQ ID NO: 9194789 - DNA, 18 bp, Homo sapiens
tgtgatttggctggaaat

SEQ ID NO: 9194790 - DNA, 22 bp, Homo sapiens
tgtgattatattgtagtacatt

SEQ ID NO: 9194791 - DNA, 22 bp, Homo sapiens
tgtgattatttgattaacatgt

SEQ ID NO: 9194792 - DNA, 22 bp, Homo sapiens
tgtgatttattgaaaagagctt

SEQ ID NO: 9194793 - DNA, 22 bp, Homo sapiens
tgtgatttatgcatggggaagt

SEQ ID NO: 9194794 - DNA, 19 bp, Homo sapiens
tgtgataagcagaattcca

SEQ ID NO: 9194795 - DNA, 21 bp, Homo sapiens
tgtgataatactatatgctct

SEQ ID NO: 9194796 - DNA, 19 bp, Homo sapiens
tgtgatagttgaacctgcc

SEQ ID NO: 9194797 - DNA, 22 bp, Homo sapiens
tgtgatagatatgcacatagct

SEQ ID NO: 9194798 - DNA, 22 bp, Homo sapiens
tgtgatagaaagtatcacaagg

SEQ ID NO: 9194799 - DNA, 22 bp, Homo sapiens
tgtgagttcttattgctcatct

SEQ ID NO: 9194800 - DNA, 22 bp, Homo sapiens
tgtgagaggagaaatgcattaa

SEQ ID NO: 9194801 - DNA, 22 bp, Homo sapiens
tgtgagagctgcttcagccagg

SEQ ID NO: 9194802 - DNA, 22 bp, Homo sapiens
tgtgagattttatttgatatgc

SEQ ID NO: 9194803 - DNA, 22 bp, Homo sapiens
tgtgagagaagtgtgtgctccc

SEQ ID NO: 9194804 - DNA, 22 bp, Homo sapiens
tgtgagagagtgcatttgcata

SEQ ID NO: 9194805 - DNA, 22 bp, Homo sapiens
tgtgagagctccatcctcatga

SEQ ID NO: 9194806 - DNA, 22 bp, Homo sapiens
tgtgagagcagaagacacatag

SEQ ID NO: 9194807 - DNA, 22 bp, Homo sapiens
tgtgagacacactgctgcttca

SEQ ID NO: 9194808 - DNA, 22 bp, Homo sapiens
tgtgagacaggatttagagcag

SEQ ID NO: 9194809 - DNA, 22 bp, Homo sapiens
tgtgagaattcctgatcacagg

SEQ ID NO: 9194810 - DNA, 22 bp, Homo sapiens
tgtgagaagggtgaggctttta

SEQ ID NO: 9194811 - DNA, 22 bp, Homo sapiens
tgtgacctcatcttaactggaa

SEQ ID NO: 9194812 - DNA, 22 bp, Homo sapiens
tgtgctgacaagatcagaaggt

SEQ ID NO: 9194813 - DNA, 22 bp, Homo sapiens
tgtgctgacaattcacagagaa

SEQ ID NO: 9194814 - DNA, 22 bp, Homo sapiens
tgtgctgagcaaatccatctgt

SEQ ID NO: 9194815 - DNA, 22 bp, Homo sapiens
tgtgctgagtgatcccattcct

SEQ ID NO: 9194816 - DNA, 23 bp, Homo sapiens
tgtgctggcatctcaggctttgg

SEQ ID NO: 9194817 - DNA, 22 bp, Homo sapiens
tgtgccttcctctgagcttgtc

SEQ ID NO: 9194818 - DNA, 22 bp, Homo sapiens
tgtgcctttaaggggagctgag

SEQ ID NO: 9194819 - DNA, 22 bp, Homo sapiens
tgtgcctggatctctgtgacaa

SEQ ID NO: 9194820 - DNA, 22 bp, Homo sapiens
tgtgcctggcattctgggcttc

SEQ ID NO: 9194821 - DNA, 22 bp, Homo sapiens
tgtgcctggcattctgggcttc

SEQ ID NO: 9194822 - DNA, 22 bp, Homo sapiens
tgtgcctggcccagtggtgtca

SEQ ID NO: 9194823 - DNA, 22 bp, Homo sapiens
tgtgcctggagtccctgaggag

SEQ ID NO: 9194824 - DNA, 22 bp, Homo sapiens
tgtgcctggagtccctgaggag

SEQ ID NO: 9194825 - DNA, 22 bp, Homo sapiens
tgtgcccattccacttgagtac

SEQ ID NO: 9194826 - DNA, 19 bp, Homo sapiens
tgtgccccctccagcctgc

SEQ ID NO: 9194827 - DNA, 18 bp, Homo sapiens
tgtgcctctgcaggacgt

SEQ ID NO: 9194828 - DNA, 19 bp, Homo sapiens
tgtgcctcctcgtctccta

SEQ ID NO: 9194829 - DNA, 22 bp, Homo sapiens
tgtgcagttttaagtggtctaa

SEQ ID NO: 9194830 - DNA, 22 bp, Homo sapiens
tgtgcagtttctatgttgtcca

SEQ ID NO: 9194831 - DNA, 22 bp, Homo sapiens
tgtgcatattactacctactcc

SEQ ID NO: 9194832 - DNA, 22 bp, Homo sapiens
tgtgcatggcatcattgcagcc

SEQ ID NO: 9194833 - DNA, 20 bp, Homo sapiens
tgtgccaaaactgtttgctt

SEQ ID NO: 9194834 - DNA, 22 bp, Homo sapiens
tgtgcagagcccacaggcagct

SEQ ID NO: 9194835 - DNA, 22 bp, Homo sapiens
tgtgcagctctagagccaagcc

SEQ ID NO: 9194836 - DNA, 22 bp, Homo sapiens
tgtgcagggaagggcatgctat

SEQ ID NO: 9194837 - DNA, 22 bp, Homo sapiens
tgtgcagtttctatgttgtcca

SEQ ID NO: 9194838 - DNA, 22 bp, Homo sapiens
tgtgcagtggcctcggcacgca

SEQ ID NO: 9194839 - DNA, 21 bp, Homo sapiens
tgtgcagtccaatgtgctagc

SEQ ID NO: 9194840 - DNA, 22 bp, Homo sapiens
tgtgcacattctaggactagta

SEQ ID NO: 9194841 - DNA, 20 bp, Homo sapiens
tgtgcacctgctagggagca

SEQ ID NO: 9194842 - DNA, 22 bp, Homo sapiens
tgtgcacattctaggactagta

SEQ ID NO: 9194843 - DNA, 22 bp, Homo sapiens
tgtcttttataactgacatata

SEQ ID NO: 9194844 - DNA, 22 bp, Homo sapiens
tgtcttttacctaatgagctgg

SEQ ID NO: 9194845 - DNA, 22 bp, Homo sapiens
tgtcttttacctaatgagctgg

SEQ ID NO: 9194846 - DNA, 22 bp, Homo sapiens
tgtcttttgccaaagatcagtt

SEQ ID NO: 9194847 - DNA, 22 bp, Homo sapiens
tgtcttttctactgtaagcata

SEQ ID NO: 9194848 - DNA, 22 bp, Homo sapiens
tgtctttaattctacatatctc

SEQ ID NO: 9194849 - DNA, 22 bp, Homo sapiens
tgtctttaattctacatatctc

SEQ ID NO: 9194850 - DNA, 19 bp, Homo sapiens
tgtctttggtctgagtttc

SEQ ID NO: 9194851 - DNA, 22 bp, Homo sapiens
tgtcttttacctaatgagctgg

SEQ ID NO: 9194852 - DNA, 22 bp, Homo sapiens
tgtctttgttattgtggacagg

SEQ ID NO: 9194853 - DNA, 22 bp, Homo sapiens
tgtctttttactatgttcaatc

SEQ ID NO: 9194854 - DNA, 22 bp, Homo sapiens
tgtgaaaaaagttctagaagga

SEQ ID NO: 9194855 - DNA, 22 bp, Homo sapiens
tgtcttttggagcatctttctt

SEQ ID NO: 9194856 - DNA, 22 bp, Homo sapiens
tgtcttttggagcatctttctt

SEQ ID NO: 9194857 - DNA, 22 bp, Homo sapiens
tgtgaaaagggctttgtacaaa

SEQ ID NO: 9194858 - DNA, 22 bp, Homo sapiens
tgtgaaaagggctttgtacaaa

SEQ ID NO: 9194859 - DNA, 22 bp, Homo sapiens
tgtgaaaagggctttgtacaaa

SEQ ID NO: 9194860 - DNA, 22 bp, Homo sapiens
tgtgaaaagggctttgtacaaa

SEQ ID NO: 9194861 - DNA, 22 bp, Homo sapiens
tgtgaaaagcaggctactttct

SEQ ID NO: 9194862 - DNA, 22 bp, Homo sapiens
tgtgaaaagcaggctactttct

SEQ ID NO: 9194863 - DNA, 22 bp, Homo sapiens
tgtgaaaagcgtgtgttctagg

SEQ ID NO: 9194864 - DNA, 22 bp, Homo sapiens
tgtctttaagcaaacagtgttt

SEQ ID NO: 9194865 - DNA, 22 bp, Homo sapiens
tgtcttcttcataaggagagtg

SEQ ID NO: 9194866 - DNA, 22 bp, Homo sapiens
tgtcttggattatctgtgcaac

SEQ ID NO: 9194867 - DNA, 22 bp, Homo sapiens
tgtcttgtctgtgagggcattg

SEQ ID NO: 9194868 - DNA, 22 bp, Homo sapiens
tgtcttctgtattcaagtctat

SEQ ID NO: 9194869 - DNA, 17 bp, Homo sapiens
tgtcttctgaagagagc

SEQ ID NO: 9194870 - DNA, 22 bp, Homo sapiens
tgtcttctaccttgacagcatt

SEQ ID NO: 9194871 - DNA, 20 bp, Homo sapiens
tgtcttcattatggtgccct

SEQ ID NO: 9194872 - DNA, 22 bp, Homo sapiens
tgtcttcattccccatgaagtc

SEQ ID NO: 9194873 - DNA, 22 bp, Homo sapiens
tgtcttcgctacaatgaaaagg

SEQ ID NO: 9194874 - DNA, 23 bp, Homo sapiens
tgtcttcgactcctgcgtgcttc

SEQ ID NO: 9194875 - DNA, 22 bp, Homo sapiens
tgtcttcagtgtgttaccatgg

SEQ ID NO: 9194876 - DNA, 22 bp, Homo sapiens
tgtcttcagtgtgttaccatgg

SEQ ID NO: 9194877 - DNA, 22 bp, Homo sapiens
tgtcttcagtaaaatacactat

SEQ ID NO: 9194878 - DNA, 22 bp, Homo sapiens
tgtcttaagtagattacagcct

SEQ ID NO: 9194879 - DNA, 22 bp, Homo sapiens
tgtctgttattggtgtataaga

SEQ ID NO: 9194880 - DNA, 22 bp, Homo sapiens
tgtcttaatttggatgatgttt

SEQ ID NO: 9194881 - DNA, 22 bp, Homo sapiens
tgtcttaatttccctttgtcat

SEQ ID NO: 9194882 - DNA, 22 bp, Homo sapiens
tgtcttaatagtatccaggttc

SEQ ID NO: 9194883 - DNA, 22 bp, Homo sapiens
tgtctgtggcaattgtgggtaa

SEQ ID NO: 9194884 - DNA, 22 bp, Homo sapiens
tgtctgtggcaattgtgggtaa

SEQ ID NO: 9194885 - DNA, 17 bp, Homo sapiens
tgtcttatctgtcctgt

SEQ ID NO: 9194886 - DNA, 17 bp, Homo sapiens
tgtcttatctgtcctgt

SEQ ID NO: 9194887 - DNA, 22 bp, Homo sapiens
tgtcttatgctgcatagactat

SEQ ID NO: 9194888 - DNA, 22 bp, Homo sapiens
tgtcttatgctgcatagactat

SEQ ID NO: 9194889 - DNA, 22 bp, Homo sapiens
tgtcttatggtcttgggcttcc

SEQ ID NO: 9194890 - DNA, 22 bp, Homo sapiens
tgtcttattttgaagtgttcac

SEQ ID NO: 9194891 - DNA, 22 bp, Homo sapiens
tgtcttattttgaagtgttcac

SEQ ID NO: 9194892 - DNA, 22 bp, Homo sapiens
tgtcttatgtagatactgagaa

SEQ ID NO: 9194893 - DNA, 22 bp, Homo sapiens
tgtcttattccttctgttcagc

SEQ ID NO: 9194894 - DNA, 20 bp, Homo sapiens
tgtcttattccagtgtttac

SEQ ID NO: 9194895 - DNA, 20 bp, Homo sapiens
tgtcttattccagtgtttac

SEQ ID NO: 9194896 - DNA, 22 bp, Homo sapiens
tgtcttcacatgataagccatt

SEQ ID NO: 9194897 - DNA, 22 bp, Homo sapiens
tgtcttcactcaagtctcttgg

SEQ ID NO: 9194898 - DNA, 22 bp, Homo sapiens
tgtcttcagcaaatgcctttct

SEQ ID NO: 9194899 - DNA, 22 bp, Homo sapiens
tgtcttcagcagtcatctgggg

SEQ ID NO: 9194900 - DNA, 22 bp, Homo sapiens
tgtcttcagataggcattcttc

SEQ ID NO: 9194901 - DNA, 22 bp, Homo sapiens
tgtctgtgacctcttaggcaag

SEQ ID NO: 9194902 - DNA, 22 bp, Homo sapiens
tgtctgtgacctctttggagcc

SEQ ID NO: 9194903 - DNA, 22 bp, Homo sapiens
tgtctggggaactgtgcatcca

SEQ ID NO: 9194904 - DNA, 22 bp, Homo sapiens
tgtctgggatgttggcagccac

SEQ ID NO: 9194905 - DNA, 22 bp, Homo sapiens
tgtctgggatgtaattcctgcc

SEQ ID NO: 9194906 - DNA, 22 bp, Homo sapiens
tgtctggattgctgagccccag

SEQ ID NO: 9194907 - DNA, 23 bp, Homo sapiens
tgtctggattcgactgtggttgg

SEQ ID NO: 9194908 - DNA, 20 bp, Homo sapiens
tgtctggatgtttaagcaga

SEQ ID NO: 9194909 - DNA, 22 bp, Homo sapiens
tgtctggatgtctggagcatcg

SEQ ID NO: 9194910 - DNA, 22 bp, Homo sapiens
tgtctggatggtggagattgag

SEQ ID NO: 9194911 - DNA, 22 bp, Homo sapiens
tgtctggctcattttctgcagt

SEQ ID NO: 9194912 - DNA, 22 bp, Homo sapiens
tgtctgggagggacagggctac

SEQ ID NO: 9194913 - DNA, 22 bp, Homo sapiens
tgtctgggagactgatcacccg

SEQ ID NO: 9194914 - DNA, 22 bp, Homo sapiens
tgtctgggagggacagggctac

SEQ ID NO: 9194915 - DNA, 22 bp, Homo sapiens
tgtctggaagtaccagggaagc

SEQ ID NO: 9194916 - DNA, 22 bp, Homo sapiens
tgtctggaagggctatgtgacc

SEQ ID NO: 9194917 - DNA, 19 bp, Homo sapiens
tgtctggaagagctgcagg

SEQ ID NO: 9194918 - DNA, 22 bp, Homo sapiens
tgtctggacagagattctcaat

SEQ ID NO: 9194919 - DNA, 22 bp, Homo sapiens
tgtctggaatttctattttgtc

SEQ ID NO: 9194920 - DNA, 22 bp, Homo sapiens
tgtctggagggctggctccctg

SEQ ID NO: 9194921 - DNA, 22 bp, Homo sapiens
tgtctggaggggatgttatggt

SEQ ID NO: 9194922 - DNA, 22 bp, Homo sapiens
tgtctggaggtcaggtcctggg

SEQ ID NO: 9194923 - DNA, 22 bp, Homo sapiens
tgtctggatcagtgggtgcttg

SEQ ID NO: 9194924 - DNA, 23 bp, Homo sapiens
tgtctggagttttgcactgttgc

SEQ ID NO: 9194925 - DNA, 22 bp, Homo sapiens
tgtctggatagagcctaggccc

SEQ ID NO: 9194926 - DNA, 23 bp, Homo sapiens
tgtctggagcctgagcaggtgct

SEQ ID NO: 9194927 - DNA, 23 bp, Homo sapiens
tgtctggagcctgagcaggtgct

SEQ ID NO: 9194928 - DNA, 22 bp, Homo sapiens
tgtctggactgctcacagtacc

SEQ ID NO: 9194929 - DNA, 23 bp, Homo sapiens
tgtctggagagggcttgctctcc

SEQ ID NO: 9194930 - DNA, 22 bp, Homo sapiens
tgtctggacattgacaatcatg

SEQ ID NO: 9194931 - DNA, 22 bp, Homo sapiens
tgtctgatgatagtgtctctcc

SEQ ID NO: 9194932 - DNA, 21 bp, Homo sapiens
tgtctgatgtattttttgcct

SEQ ID NO: 9194933 - DNA, 22 bp, Homo sapiens
tgtctgctaaattactattaca

SEQ ID NO: 9194934 - DNA, 22 bp, Homo sapiens
tgtctgaattttggaatcaagt

SEQ ID NO: 9194935 - DNA, 22 bp, Homo sapiens
tgtctgaattccacatcgttct

SEQ ID NO: 9194936 - DNA, 18 bp, Homo sapiens
tgtctgagagctgggcgc

SEQ ID NO: 9194937 - DNA, 22 bp, Homo sapiens
tgtctgaaggcctgacctacat

SEQ ID NO: 9194938 - DNA, 22 bp, Homo sapiens
tgtctgaaggcaggtggagaac

SEQ ID NO: 9194939 - DNA, 22 bp, Homo sapiens
tgtctgaatcgcttcctagagg

SEQ ID NO: 9194940 - DNA, 22 bp, Homo sapiens
tgtctgaatctcggtttcctca

SEQ ID NO: 9194941 - DNA, 22 bp, Homo sapiens
tgtctgaattcaagaaattcaa

SEQ ID NO: 9194942 - DNA, 22 bp, Homo sapiens
tgtctgaaccctggccctgcct

SEQ ID NO: 9194943 - DNA, 22 bp, Homo sapiens
tgtctgaacgaagtaggtccac

SEQ ID NO: 9194944 - DNA, 18 bp, Homo sapiens
tgtctgaagccacttttt

SEQ ID NO: 9194945 - DNA, 22 bp, Homo sapiens
tgtctgaactgcactgaaagac

SEQ ID NO: 9194946 - DNA, 22 bp, Homo sapiens
tgtctgaactgcatttgctcct

SEQ ID NO: 9194947 - DNA, 22 bp, Homo sapiens
tgtctgaagcactgggcgttgc

SEQ ID NO: 9194948 - DNA, 22 bp, Homo sapiens
tgtctgaagcagccagtgctgt

SEQ ID NO: 9194949 - DNA, 22 bp, Homo sapiens
tgtctgaaaggctttttctcac

SEQ ID NO: 9194950 - DNA, 22 bp, Homo sapiens
tgtctgaacaaactctgcctcc

SEQ ID NO: 9194951 - DNA, 22 bp, Homo sapiens
tgtctgaaacttggtcctatgc

SEQ ID NO: 9194952 - DNA, 22 bp, Homo sapiens
tgtctgaaagaggacgagctgg

SEQ ID NO: 9194953 - DNA, 22 bp, Homo sapiens
tgtctgaaacttatgatatact

SEQ ID NO: 9194954 - DNA, 20 bp, Homo sapiens
tgtctgaaaaggaagctatc

SEQ ID NO: 9194955 - DNA, 22 bp, Homo sapiens
tgtctctttgggttcctcttgg

SEQ ID NO: 9194956 - DNA, 22 bp, Homo sapiens
tgtctcttttcaagctaccctt

SEQ ID NO: 9194957 - DNA, 22 bp, Homo sapiens
tgtctcttttcaagctaccctt

SEQ ID NO: 9194958 - DNA, 22 bp, Homo sapiens
tgtctcttgttaatgattacta

SEQ ID NO: 9194959 - DNA, 22 bp, Homo sapiens
tgtctcttggctctatcactta

SEQ ID NO: 9194960 - DNA, 22 bp, Homo sapiens
tgtctctgctttccttgcaggg

SEQ ID NO: 9194961 - DNA, 22 bp, Homo sapiens
tgtctctgctgcaccttctggg

SEQ ID NO: 9194962 - DNA, 19 bp, Homo sapiens
tgtctctgaaagatgagct

SEQ ID NO: 9194963 - DNA, 22 bp, Homo sapiens
tgtctctctagctcttggtttg

SEQ ID NO: 9194964 - DNA, 22 bp, Homo sapiens
tgtctctctagctcttggtttg

SEQ ID NO: 9194965 - DNA, 22 bp, Homo sapiens
tgtctctctgcccccattgctc

SEQ ID NO: 9194966 - DNA, 22 bp, Homo sapiens
tgtctctctgcccccattgctc

SEQ ID NO: 9194967 - DNA, 22 bp, Homo sapiens
tgtctctgaaatatgtggctcc

SEQ ID NO: 9194968 - DNA, 22 bp, Homo sapiens
tgtctatacctgatacagagtt

SEQ ID NO: 9194969 - DNA, 22 bp, Homo sapiens
tgtctataagagttgtttattt

SEQ ID NO: 9194970 - DNA, 22 bp, Homo sapiens
tgtctataagagttgtttattt

SEQ ID NO: 9194971 - DNA, 22 bp, Homo sapiens
tgtctatagcctgatttgttgg

SEQ ID NO: 9194972 - DNA, 22 bp, Homo sapiens
tgtctccaggggcaggccagcc

SEQ ID NO: 9194973 - DNA, 22 bp, Homo sapiens
tgtctccagaaagcaccaggag

SEQ ID NO: 9194974 - DNA, 23 bp, Homo sapiens
tgtcctttttgaggcctcctcct

SEQ ID NO: 9194975 - DNA, 22 bp, Homo sapiens
tgtctacaaacgtgtacacatt

SEQ ID NO: 9194976 - DNA, 22 bp, Homo sapiens
tgtctagaggccaacaggaaag

SEQ ID NO: 9194977 - DNA, 22 bp, Homo sapiens
tgtctacttgggctctacagca

SEQ ID NO: 9194978 - DNA, 19 bp, Homo sapiens
tgtctcctcatgcaagtgt

SEQ ID NO: 9194979 - DNA, 22 bp, Homo sapiens
tgtctcctcaactcatgctcga

SEQ ID NO: 9194980 - DNA, 22 bp, Homo sapiens
tgtctcctatttcctgctaagg

SEQ ID NO: 9194981 - DNA, 22 bp, Homo sapiens
tgtctcctactgcctgtggatc

SEQ ID NO: 9194982 - DNA, 22 bp, Homo sapiens
tgtctcctactgcctgtggatc

SEQ ID NO: 9194983 - DNA, 22 bp, Homo sapiens
tgtctcctactgcctgtggatc

SEQ ID NO: 9194984 - DNA, 22 bp, Homo sapiens
tgtctcccaggtgtgcccagtg

SEQ ID NO: 9194985 - DNA, 22 bp, Homo sapiens
tgtctcctaatgtctgtttcct

SEQ ID NO: 9194986 - DNA, 21 bp, Homo sapiens
tgtctcctgttggcacatggc

SEQ ID NO: 9194987 - DNA, 21 bp, Homo sapiens
tgtctcctgttggcacatggc

SEQ ID NO: 9194988 - DNA, 22 bp, Homo sapiens
tgtctcctgggccctggccctg

SEQ ID NO: 9194989 - DNA, 22 bp, Homo sapiens
tgtctcctctgtcctgtcagga

SEQ ID NO: 9194990 - DNA, 22 bp, Homo sapiens
tgtctccttgcttttccctgta

SEQ ID NO: 9194991 - DNA, 20 bp, Homo sapiens
tgtctctcagtgtcagtgca

SEQ ID NO: 9194992 - DNA, 22 bp, Homo sapiens
tgtctctcatttagttttgcac

SEQ ID NO: 9194993 - DNA, 22 bp, Homo sapiens
tgtctctcatttagttttgcac

SEQ ID NO: 9194994 - DNA, 20 bp, Homo sapiens
tgtctctcagtgtcagtgca

SEQ ID NO: 9194995 - DNA, 20 bp, Homo sapiens
tgtctctcggttttgtgact

SEQ ID NO: 9194996 - DNA, 18 bp, Homo sapiens
tgtctctcctttctgtgt

SEQ ID NO: 9194997 - DNA, 22 bp, Homo sapiens
tgtctctccacacagccagtgc

SEQ ID NO: 9194998 - DNA, 22 bp, Homo sapiens
tgtctctccacacagccagtgc

SEQ ID NO: 9194999 - DNA, 22 bp, Homo sapiens
tgtctctcctgatgatctggtg

SEQ ID NO: 9195000 - DNA, 22 bp, Homo sapiens
tgtctctcctgatgatctggtg

SEQ ID NO: 9195001 - DNA, 22 bp, Homo sapiens
ttccaggaaaacagttggaagt

SEQ ID NO: 9195002 - DNA, 22 bp, Homo sapiens
aagcaagacagaagttactgcc

SEQ ID NO: 9195003 - DNA, 22 bp, Homo sapiens
acaaagtaggtcatcaaagctc

SEQ ID NO: 9195004 - DNA, 22 bp, Homo sapiens
aatcagaatcagttgacacagc

SEQ ID NO: 9195005 - DNA, 22 bp, Homo sapiens
aatgattgcaaacattgagaac

SEQ ID NO: 9195006 - DNA, 22 bp, Homo sapiens
aagccaagagttaactatttgt

SEQ ID NO: 9195007 - DNA, 22 bp, Homo sapiens
aaggctatgatctttttcatga

SEQ ID NO: 9195008 - DNA, 22 bp, Homo sapiens
accatgttggccaagctggtct

SEQ ID NO: 9195009 - DNA, 22 bp, Homo sapiens
acttggcaggtcaggggatatt

SEQ ID NO: 9195010 - DNA, 22 bp, Homo sapiens
atcagcaagcatttattgagtg

SEQ ID NO: 9195011 - DNA, 22 bp, Homo sapiens
agtctgggtgtgaatgaacttg

SEQ ID NO: 9195012 - DNA, 22 bp, Homo sapiens
agtctgggagaaggtgagatta

SEQ ID NO: 9195013 - DNA, 22 bp, Homo sapiens
agtctgggaactgggaacgttt

SEQ ID NO: 9195014 - DNA, 22 bp, Homo sapiens
actgatgtgacagctgagcaga

SEQ ID NO: 9195015 - DNA, 22 bp, Homo sapiens
actgatgttaaccctctcttct

SEQ ID NO: 9195016 - DNA, 22 bp, Homo sapiens
actgatgtgatttcaaattcca

SEQ ID NO: 9195017 - DNA, 22 bp, Homo sapiens
actgatgttcagccatgttctg

SEQ ID NO: 9195018 - DNA, 22 bp, Homo sapiens
atggaaatcgatgtctaagtta

SEQ ID NO: 9195019 - DNA, 22 bp, Homo sapiens
atggaaatatctttagagctta

SEQ ID NO: 9195020 - DNA, 22 bp, Homo sapiens
caaatgatagagccgattatca

SEQ ID NO: 9195021 - DNA, 21 bp, Homo sapiens
atggaaattggcaaatgctac

SEQ ID NO: 9195022 - DNA, 22 bp, Homo sapiens
atggaaaaggctgatttcatta

SEQ ID NO: 9195023 - DNA, 22 bp, Homo sapiens
cttggcatgttcatctgcttgg

SEQ ID NO: 9195024 - DNA, 22 bp, Homo sapiens
cttggcattgtgttgatagaag

SEQ ID NO: 9195025 - DNA, 22 bp, Homo sapiens
attctgtgtgtactgagatggg

SEQ ID NO: 9195026 - DNA, 22 bp, Homo sapiens
gcttggcatttgctgggagctg

SEQ ID NO: 9195027 - DNA, 22 bp, Homo sapiens
cagaggtttgatcgagtaggtc

SEQ ID NO: 9195028 - DNA, 22 bp, Homo sapiens
gtagggatggaagccatgaaat

SEQ ID NO: 9195029 - DNA, 22 bp, Homo sapiens
aggcattttgttcaagatgaca

SEQ ID NO: 9195030 - DNA, 22 bp, Homo sapiens
agttggcactgagctgtgattg

SEQ ID NO: 9195031 - DNA, 22 bp, Homo sapiens
cagtgattcagactcatcattt

SEQ ID NO: 9195032 - DNA, 22 bp, Homo sapiens
tccctgctgcactcacacctac

SEQ ID NO: 9195033 - DNA, 22 bp, Homo sapiens
caggaaaatgtcaatggaaagc

SEQ ID NO: 9195034 - DNA, 22 bp, Homo sapiens
gttggcagaaagctttcgatcg

SEQ ID NO: 9195035 - DNA, 22 bp, Homo sapiens
gttttcttcctgcaattggcat

SEQ ID NO: 9195036 - DNA, 22 bp, Homo sapiens
taacaaagtaccatagactgga

SEQ ID NO: 9195037 - DNA, 19 bp, Homo sapiens
taacaaagtctgaagtcag

SEQ ID NO: 9195038 - DNA, 22 bp, Homo sapiens
caggagatgacagggaagaacc

SEQ ID NO: 9195039 - DNA, 22 bp, Homo sapiens
ttgtttcagctgtatgctatgt

SEQ ID NO: 9195040 - DNA, 22 bp, Homo sapiens
ttgtttcatgagtgtaaaggga

SEQ ID NO: 9195041 - DNA, 22 bp, Homo sapiens
ttgtttcatggggatgtttatt

SEQ ID NO: 9195042 - DNA, 22 bp, Homo sapiens
tttgtgaataggttggcttcca

SEQ ID NO: 9195043 - DNA, 22 bp, Homo sapiens
tggtaggagggaaatgcgggtt

SEQ ID NO: 9195044 - DNA, 22 bp, Homo sapiens
tggtaggatagtgacttatatg

SEQ ID NO: 9195045 - DNA, 21 bp, Homo sapiens
tggtaggatccaggaatctgc

SEQ ID NO: 9195046 - DNA, 22 bp, Homo sapiens
tgtaggattttcaccagacctt

SEQ ID NO: 9195047 - DNA, 16 bp, Homo sapiens
tgtaggataaccatac

SEQ ID NO: 9195048 - DNA, 22 bp, Homo sapiens
tgtaggatgtaaggcaggcatc

SEQ ID NO: 9195049 - DNA, 22 bp, Homo sapiens
cttctttccttcctccagtggc

SEQ ID NO: 9195050 - DNA, 22 bp, Homo sapiens
gatcagaattcttgtgtgtttc

SEQ ID NO: 9195051 - DNA, 18 bp, Homo sapiens
gatggaaagtgtatgagt

SEQ ID NO: 9195052 - DNA, 22 bp, Homo sapiens
gggccatgagaggttcatcaac

SEQ ID NO: 9195053 - DNA, 18 bp, Homo sapiens
ggaagaaaaggaactcag

SEQ ID NO: 9195054 - DNA, 20 bp, Homo sapiens
ggaaaaatgcatgctcaaga

SEQ ID NO: 9195055 - DNA, 22 bp, Homo sapiens
gttgttttgctgtctgtcttag

SEQ ID NO: 9195056 - DNA, 22 bp, Homo sapiens
gtttttctttgtgtgaagacaa

SEQ ID NO: 9195057 - DNA, 22 bp, Homo sapiens
gtctgggattggggtaaagaag

SEQ ID NO: 9195058 - DNA, 22 bp, Homo sapiens
gtcaggatcaaattgaagttat

SEQ ID NO: 9195059 - DNA, 22 bp, Homo sapiens
tgtgccttatgaattctttctg

SEQ ID NO: 9195060 - DNA, 22 bp, Homo sapiens
tgtgatgctggagtgcgaatat

SEQ ID NO: 9195061 - DNA, 22 bp, Homo sapiens
tgtttgcttacttgtatgctgc

SEQ ID NO: 9195062 - DNA, 22 bp, Homo sapiens
tgtttgctatatcctacttcat

SEQ ID NO: 9195063 - DNA, 22 bp, Homo sapiens
tgttcttgggaatcttacagtt

SEQ ID NO: 9195064 - DNA, 22 bp, Homo sapiens
tgttctttcagttagacacagt

SEQ ID NO: 9195065 - DNA, 22 bp, Homo sapiens
tgttgactcaacactgtgggca

SEQ ID NO: 9195066 - DNA, 18 bp, Homo sapiens
tgggatggagagtaactg

SEQ ID NO: 9195067 - DNA, 22 bp, Homo sapiens
tgggtaggggacgtggaagaaa

SEQ ID NO: 9195068 - DNA, 22 bp, Homo sapiens
tgggtaggccaggaagcagtgt

SEQ ID NO: 9195069 - DNA, 22 bp, Homo sapiens
tgggtaggaccagaaatgcact

SEQ ID NO: 9195070 - DNA, 22 bp, Homo sapiens
tgtcacatgtttaatgtggact

SEQ ID NO: 9195071 - DNA, 22 bp, Homo sapiens
tgtacaatctgatgatgtatgg

SEQ ID NO: 9195072 - DNA, 22 bp, Homo sapiens
tgtacaatcttggtccctttat

SEQ ID NO: 9195073 - DNA, 22 bp, Homo sapiens
tgtacaatgtggccagtgttaa

SEQ ID NO: 9195074 - DNA, 22 bp, Homo sapiens
tggaaatacaagaagtatgtca

SEQ ID NO: 9195075 - DNA, 22 bp, Homo sapiens
tggattgataagagacaagtga

SEQ ID NO: 9195076 - DNA, 21 bp, Homo sapiens
tggattgaggtgacagtgtgc

SEQ ID NO: 9195077 - DNA, 21 bp, Homo sapiens
tgacatttggattcatagtaa

SEQ ID NO: 9195078 - DNA, 22 bp, Homo sapiens
tgaagcaggaaacttcttgttt

SEQ ID NO: 9195079 - DNA, 20 bp, Homo sapiens
tgaagcagccttgattctgt

SEQ ID NO: 9195080 - DNA, 22 bp, Homo sapiens
tgagaaacatatgagagatttg

SEQ ID NO: 9195081 - DNA, 18 bp, Homo sapiens
tgagaactaggcattgca

SEQ ID NO: 9195082 - DNA, 22 bp, Homo sapiens
tgcaaactattggtagagatgg

SEQ ID NO: 9195083 - DNA, 22 bp, Homo sapiens
tgattctgtaaacatgtcttta

SEQ ID NO: 9195084 - DNA, 21 bp, Homo sapiens
tgattctgttttatcatcagc

SEQ ID NO: 9195085 - DNA, 21 bp, Homo sapiens
tgattctgcatttctaacagg

SEQ ID NO: 9195086 - DNA, 22 bp, Homo sapiens
tctgaaagtatctggatctttt

SEQ ID NO: 9195087 - DNA, 22 bp, Homo sapiens
tctagggaggcaatagcaatgt

SEQ ID NO: 9195088 - DNA, 22 bp, Homo sapiens
tctttacaatctaagcatagtt

SEQ ID NO: 9195089 - DNA, 22 bp, Homo sapiens
tctttacatcacaattgtatgg

SEQ ID NO: 9195090 - DNA, 22 bp, Homo sapiens
tctgggattttatagacatgct

SEQ ID NO: 9195091 - DNA, 22 bp, Homo sapiens
tctgggatttttgacactgaag

SEQ ID NO: 9195092 - DNA, 22 bp, Homo sapiens
tctgggatgcaaacagaatctg

SEQ ID NO: 9195093 - DNA, 22 bp, Homo sapiens
tctgagaataaaaattgcattt

SEQ ID NO: 9195094 - DNA, 22 bp, Homo sapiens
tctgagaacataaattgacttc

SEQ ID NO: 9195095 - DNA, 22 bp, Homo sapiens
tctgagaacatgctttgatcat

SEQ ID NO: 9195096 - DNA, 22 bp, Homo sapiens
aagtttggtccttctaagaaga

SEQ ID NO: 9195097 - DNA, 22 bp, Homo sapiens
agaggttgggtctgaggtgaga

SEQ ID NO: 9195098 - DNA, 21 bp, Homo sapiens
agagtctgcatttctgacaag

SEQ ID NO: 9195099 - DNA, 22 bp, Homo sapiens
aacaaatgtgttttgtaattaa

SEQ ID NO: 9195100 - DNA, 22 bp, Homo sapiens
agcaggttaccattgatttcct

SEQ ID NO: 9195101 - DNA, 22 bp, Homo sapiens
agatattctgcctaacaggttt

SEQ ID NO: 9195102 - DNA, 22 bp, Homo sapiens
agatgattatgatagcactgtt

SEQ ID NO: 9195103 - DNA, 22 bp, Homo sapiens
caaagcaaggctcagtttgaac

SEQ ID NO: 9195104 - DNA, 22 bp, Homo sapiens
agagattgctagctggctttaa

SEQ ID NO: 9195105 - DNA, 22 bp, Homo sapiens
agagattggggatgaatctttc

SEQ ID NO: 9195106 - DNA, 22 bp, Homo sapiens
atgaagcagttaaggtgcatga

SEQ ID NO: 9195107 - DNA, 23 bp, Homo sapiens
atcagtcttggtagctgtgccca

SEQ ID NO: 9195108 - DNA, 22 bp, Homo sapiens
atcagcaatctcgtgtattagg

SEQ ID NO: 9195109 - DNA, 22 bp, Homo sapiens
aggtaggaaagtctccttgtat

SEQ ID NO: 9195110 - DNA, 22 bp, Homo sapiens
aggtaggagttgatggatgttc

SEQ ID NO: 9195111 - DNA, 22 bp, Homo sapiens
aggaaaaacctgttaatggtag

SEQ ID NO: 9195112 - DNA, 21 bp, Homo sapiens
aggattttgttgaagtttctg

SEQ ID NO: 9195113 - DNA, 22 bp, Homo sapiens
agggttttcatttctgagcatt

SEQ ID NO: 9195114 - DNA, 22 bp, Homo sapiens
agtaggatgctttatatgaaag

SEQ ID NO: 9195115 - DNA, 22 bp, Homo sapiens
agtaggataagagcctgtccaa

SEQ ID NO: 9195116 - DNA, 22 bp, Homo sapiens
attggcagttggctgtggttca

SEQ ID NO: 9195117 - DNA, 22 bp, Homo sapiens
cttgagaagagatttatatttg

SEQ ID NO: 9195118 - DNA, 22 bp, Homo sapiens
gagcttggtgttatttctgtgg

SEQ ID NO: 9195119 - DNA, 22 bp, Homo sapiens
gaggttggggctgcagtgagct

SEQ ID NO: 9195120 - DNA, 22 bp, Homo sapiens
ggataggaattgagatgctatt

SEQ ID NO: 9195121 - DNA, 21 bp, Homo sapiens
ggagtttttctggaagggact

SEQ ID NO: 9195122 - DNA, 20 bp, Homo sapiens
catttcattgtgtcttcact

SEQ ID NO: 9195123 - DNA, 22 bp, Homo sapiens
tcaggaggccggcaggatttga

SEQ ID NO: 9195124 - DNA, 22 bp, Homo sapiens
tggtaggaatgattacgacttt

SEQ ID NO: 9195125 - DNA, 22 bp, Homo sapiens
tggtaggagatatggtctccga

SEQ ID NO: 9195126 - DNA, 22 bp, Homo sapiens
tgggatagaaatttagaacaag

SEQ ID NO: 9195127 - DNA, 22 bp, Homo sapiens
tctgttctattggtctatgtgt

SEQ ID NO: 9195128 - DNA, 22 bp, Homo sapiens
ctgaagtcatacactgttctga

SEQ ID NO: 9195129 - DNA, 22 bp, Homo sapiens
ttcttcatgctgttgctgcttg

SEQ ID NO: 9195130 - DNA, 22 bp, Homo sapiens
ttccactgattttggttgacct

SEQ ID NO: 9195131 - DNA, 22 bp, Homo sapiens
tagatgattttcagtcaaagca

SEQ ID NO: 9195132 - DNA, 22 bp, Homo sapiens
gttttatttccatgagagaccg

SEQ ID NO: 9195133 - DNA, 21 bp, Homo sapiens
taacaaagacttctggtcagg

SEQ ID NO: 9195134 - DNA, 22 bp, Homo sapiens
taccttgggttgagttcattct

SEQ ID NO: 9195135 - DNA, 22 bp, Homo sapiens
taccttgggctattatctttga

SEQ ID NO: 9195136 - DNA, 22 bp, Homo sapiens
taccttggggttttgttgctct

SEQ ID NO: 9195137 - DNA, 22 bp, Homo sapiens
tcagggttgtggtggaattcag

SEQ ID NO: 9195138 - DNA, 22 bp, Homo sapiens
tcagggttgtgaaggaaagggg

SEQ ID NO: 9195139 - DNA, 22 bp, Homo sapiens
ggtgggatgcctctggagaagt

SEQ ID NO: 9195140 - DNA, 22 bp, Homo sapiens
ggtaggagtgaagacttaagat

SEQ ID NO: 9195141 - DNA, 22 bp, Homo sapiens
ttgcatttgagaaagttctcct

SEQ ID NO: 9195142 - DNA, 22 bp, Homo sapiens
tttagcattaagcttttcaaat

SEQ ID NO: 9195143 - DNA, 21 bp, Homo sapiens
ttgttcttccagaagcaaagt

SEQ ID NO: 9195144 - DNA, 22 bp, Homo sapiens
ttgaaaacagcgtagattcaca

SEQ ID NO: 9195145 - DNA, 22 bp, Homo sapiens
ttctcttcatctcagtaaatgt

SEQ ID NO: 9195146 - DNA, 22 bp, Homo sapiens
agagtttggagagggtgaggca

SEQ ID NO: 9195147 - DNA, 22 bp, Homo sapiens
agagtttgaagttatctttgac

SEQ ID NO: 9195148 - DNA, 22 bp, Homo sapiens
agagtttggaggtgttcctgga

SEQ ID NO: 9195149 - DNA, 22 bp, Homo sapiens
agagtttgtatttttcagtgaa

SEQ ID NO: 9195150 - DNA, 22 bp, Homo sapiens
agagtttggtgaagcaatttga

SEQ ID NO: 9195151 - DNA, 22 bp, Homo sapiens
agagtttgtgggcttttcctcc

SEQ ID NO: 9195152 - DNA, 22 bp, Homo sapiens
agagtttgttgaatttacttgg

SEQ ID NO: 9195153 - DNA, 22 bp, Homo sapiens
atgtgtacacacatatatgtat

SEQ ID NO: 9195154 - DNA, 22 bp, Homo sapiens
atgcacctgaactccatcagct

SEQ ID NO: 9195155 - DNA, 22 bp, Homo sapiens
agtcaaagctacaggcatttga

SEQ ID NO: 9195156 - DNA, 22 bp, Homo sapiens
aagtttcatgacttggttatta

SEQ ID NO: 9195157 - DNA, 22 bp, Homo sapiens
aagtttcatgtggaggtagact

SEQ ID NO: 9195158 - DNA, 22 bp, Homo sapiens
aagtttcaaatgttgattatgc

SEQ ID NO: 9195159 - DNA, 22 bp, Homo sapiens
aataagaatttacttgtcaaga

SEQ ID NO: 9195160 - DNA, 22 bp, Homo sapiens
acaaagctagagaagagaattg

SEQ ID NO: 9195161 - DNA, 22 bp, Homo sapiens
aacaaatgacctgatttcttcc

SEQ ID NO: 9195162 - DNA, 22 bp, Homo sapiens
aaagtgtactatgtcatgaaca

SEQ ID NO: 9195163 - DNA, 18 bp, Homo sapiens
gattctgattctggaggc

SEQ ID NO: 9195164 - DNA, 22 bp, Homo sapiens
gattctgaaattaacagactgg

SEQ ID NO: 9195165 - DNA, 22 bp, Homo sapiens
gaggttggcgccctgcctggcc

SEQ ID NO: 9195166 - DNA, 22 bp, Homo sapiens
gaggttgggatgagggatacag

SEQ ID NO: 9195167 - DNA, 22 bp, Homo sapiens
atgatgtccctaggcaggtagt

SEQ ID NO: 9195168 - DNA, 22 bp, Homo sapiens
atgatgtctggaggcatgctgt

SEQ ID NO: 9195169 - DNA, 22 bp, Homo sapiens
atgctaatgagctaaggagtcc

SEQ ID NO: 9195170 - DNA, 22 bp, Homo sapiens
gggtaggaaatccagaggtggc

SEQ ID NO: 9195171 - DNA, 22 bp, Homo sapiens
caatagatgtttttgcttacca

SEQ ID NO: 9195172 - DNA, 22 bp, Homo sapiens
atccttggatgtgtctttttgt

SEQ ID NO: 9195173 - DNA, 22 bp, Homo sapiens
aggttggctgctcttttcctaa

SEQ ID NO: 9195174 - DNA, 22 bp, Homo sapiens
aggatttgaacctaggcaatca

SEQ ID NO: 9195175 - DNA, 22 bp, Homo sapiens
tcaggaaagagtaatgtataca

SEQ ID NO: 9195176 - DNA, 22 bp, Homo sapiens
tgggtaggtgtggcctgaatgt

SEQ ID NO: 9195177 - DNA, 22 bp, Homo sapiens
tgaaagcaggcgggctacttta

SEQ ID NO: 9195178 - DNA, 22 bp, Homo sapiens
cccagagaatctttcagaaagg

SEQ ID NO: 9195179 - DNA, 22 bp, Homo sapiens
ttttgctttaagatggagagga

SEQ ID NO: 9195180 - DNA, 22 bp, Homo sapiens
tttcatgttggatactgtttca

SEQ ID NO: 9195181 - DNA, 22 bp, Homo sapiens
tttccactcctattgcatctca

SEQ ID NO: 9195182 - DNA, 22 bp, Homo sapiens
tttgacttctatctagtaagaa

SEQ ID NO: 9195183 - DNA, 22 bp, Homo sapiens
ctgggatgggaactgagaatca

SEQ ID NO: 9195184 - DNA, 22 bp, Homo sapiens
gaaactagatgtattagagatt

SEQ ID NO: 9195185 - DNA, 22 bp, Homo sapiens
ctttttcccaggtggagagagg

SEQ ID NO: 9195186 - DNA, 22 bp, Homo sapiens
gaattaattgtgtggtttgaat

SEQ ID NO: 9195187 - DNA, 22 bp, Homo sapiens
tatgtcaaaaaagattatgttt

SEQ ID NO: 9195188 - DNA, 22 bp, Homo sapiens
tatgtcaaagttaagaaatagg

SEQ ID NO: 9195189 - DNA, 22 bp, Homo sapiens
tatggaaagggagtttaatttg

SEQ ID NO: 9195190 - DNA, 22 bp, Homo sapiens
ggttaggatcagatcctggagg

SEQ ID NO: 9195191 - DNA, 22 bp, Homo sapiens
gtgaggatgcagatgagggcct

SEQ ID NO: 9195192 - DNA, 22 bp, Homo sapiens
ggaaaaatgacacatatctcaa

SEQ ID NO: 9195193 - DNA, 22 bp, Homo sapiens
ggaaaaatagagtatactttaa

SEQ ID NO: 9195194 - DNA, 22 bp, Homo sapiens
gcttggcagggcctgctggagc

SEQ ID NO: 9195195 - DNA, 22 bp, Homo sapiens
ttctctgagtacgtttcagtgt

SEQ ID NO: 9195196 - DNA, 23 bp, Homo sapiens
ttccagtgagactgagaggtctt

SEQ ID NO: 9195197 - DNA, 22 bp, Homo sapiens
ttccagtgactaagcttctgct

SEQ ID NO: 9195198 - DNA, 22 bp, Homo sapiens
ttccagtgaccatagagtatgg

SEQ ID NO: 9195199 - DNA, 22 bp, Homo sapiens
ttcatttaatttgtgtattaac

SEQ ID NO: 9195200 - DNA, 22 bp, Homo sapiens
tttcacaattttaaggagcaaa

SEQ ID NO: 9195201 - DNA, 22 bp, Homo sapiens
ttggcagggctgcttgtctagg

SEQ ID NO: 9195202 - DNA, 22 bp, Homo sapiens
agagatttctactgcactcttt

SEQ ID NO: 9195203 - DNA, 20 bp, Homo sapiens
agaggatttatgtggatgtg

SEQ ID NO: 9195204 - DNA, 22 bp, Homo sapiens
agaggattttaaaagcatatgt

SEQ ID NO: 9195205 - DNA, 22 bp, Homo sapiens
acaatagaaggaaactgacata

SEQ ID NO: 9195206 - DNA, 22 bp, Homo sapiens
agcaaagtccagtctgtgtaca

SEQ ID NO: 9195207 - DNA, 22 bp, Homo sapiens
agcaaagtagctgctgttctta

SEQ ID NO: 9195208 - DNA, 22 bp, Homo sapiens
aagcaggtaaatatgtttccct

SEQ ID NO: 9195209 - DNA, 22 bp, Homo sapiens
acaaatgaatcatacataatgt

SEQ ID NO: 9195210 - DNA, 22 bp, Homo sapiens
aaatcagacttgaattttcatc

SEQ ID NO: 9195211 - DNA, 22 bp, Homo sapiens
atgctgatctgtaataagattt

SEQ ID NO: 9195212 - DNA, 22 bp, Homo sapiens
atgagaaagagttgtatctaga

SEQ ID NO: 9195213 - DNA, 22 bp, Homo sapiens
atgattctggtgagaatgagga

SEQ ID NO: 9195214 - DNA, 22 bp, Homo sapiens
atgattcttttggatagatgat

SEQ ID NO: 9195215 - DNA, 21 bp, Homo sapiens
atgattctgcaaatgagtagt

SEQ ID NO: 9195216 - DNA, 22 bp, Homo sapiens
atgattctaggcattgaagata

SEQ ID NO: 9195217 - DNA, 22 bp, Homo sapiens
agagactgcaatgagtggtagg

SEQ ID NO: 9195218 - DNA, 22 bp, Homo sapiens
agaaagagctcgggattaacag

SEQ ID NO: 9195219 - DNA, 22 bp, Homo sapiens
atttttccaattaggataaaga

SEQ ID NO: 9195220 - DNA, 22 bp, Homo sapiens
attaggcattatggggataagg

SEQ ID NO: 9195221 - DNA, 22 bp, Homo sapiens
gagagattaccacgcttcctga

SEQ ID NO: 9195222 - DNA, 22 bp, Homo sapiens
atgtctaaaagataaagtttaa

SEQ ID NO: 9195223 - DNA, 22 bp, Homo sapiens
atgatgctgttattatctatac

SEQ ID NO: 9195224 - DNA, 22 bp, Homo sapiens
atgatgctgtttatcatatact

SEQ ID NO: 9195225 - DNA, 22 bp, Homo sapiens
aggtaggatgggtggagatgat

SEQ ID NO: 9195226 - DNA, 20 bp, Homo sapiens
aggtaggatcggtgtcataa

SEQ ID NO: 9195227 - DNA, 22 bp, Homo sapiens
aggtaggatagataggaagacc

SEQ ID NO: 9195228 - DNA, 22 bp, Homo sapiens
ctaggtgatccactgctctctt

SEQ ID NO: 9195229 - DNA, 22 bp, Homo sapiens
aggatttgcactggtgtttgag

SEQ ID NO: 9195230 - DNA, 22 bp, Homo sapiens
tcctttcaccaaaaagtgttgt

SEQ ID NO: 9195231 - DNA, 22 bp, Homo sapiens
taatgtataacaaatactcatc

SEQ ID NO: 9195232 - DNA, 22 bp, Homo sapiens
tacatgtttggtaaatgatggc

SEQ ID NO: 9195233 - DNA, 22 bp, Homo sapiens
tttcaatgtatgtctttctgag

SEQ ID NO: 9195234 - DNA, 22 bp, Homo sapiens
ttggtcagcactgatgtttcag

SEQ ID NO: 9195235 - DNA, 22 bp, Homo sapiens
cgtaggatactcagtgctcatt

SEQ ID NO: 9195236 - DNA, 22 bp, Homo sapiens
gaaccatgagaaattgctattt

SEQ ID NO: 9195237 - DNA, 22 bp, Homo sapiens
ctttcacagctgtgcttatgat

SEQ ID NO: 9195238 - DNA, 22 bp, Homo sapiens
ctttcacataattgaccttgaa

SEQ ID NO: 9195239 - DNA, 22 bp, Homo sapiens
ctttcacagtcctgactgagcg

SEQ ID NO: 9195240 - DNA, 18 bp, Homo sapiens
ctttcagatggatatgct

SEQ ID NO: 9195241 - DNA, 22 bp, Homo sapiens
gaggaggaaaccctgttcctct

SEQ ID NO: 9195242 - DNA, 21 bp, Homo sapiens
ctgttcactgtgctgtgcaaa

SEQ ID NO: 9195243 - DNA, 22 bp, Homo sapiens
gggtaggatggtagaagggacc

SEQ ID NO: 9195244 - DNA, 22 bp, Homo sapiens
gggtaggagaggtgtctgtgtg

SEQ ID NO: 9195245 - DNA, 21 bp, Homo sapiens
gttttctttgatagagggaag

SEQ ID NO: 9195246 - DNA, 22 bp, Homo sapiens
taaaatttgtccctgagtgttg

SEQ ID NO: 9195247 - DNA, 22 bp, Homo sapiens
gttttgttttgagtcaactcca

SEQ ID NO: 9195248 - DNA, 22 bp, Homo sapiens
taatgtttccagtctatgatgg

SEQ ID NO: 9195249 - DNA, 22 bp, Homo sapiens
taggatctcaccatagaaggaa

SEQ ID NO: 9195250 - DNA, 22 bp, Homo sapiens
taggattccagaacagtgctgc

SEQ ID NO: 9195251 - DNA, 22 bp, Homo sapiens
taggatgtgccaggaaagaaag

SEQ ID NO: 9195252 - DNA, 22 bp, Homo sapiens
tatccttgtactatagtattta

SEQ ID NO: 9195253 - DNA, 22 bp, Homo sapiens
tcactttagaggaaacattgag

SEQ ID NO: 9195254 - DNA, 22 bp, Homo sapiens
ttcaacatcttggagctggaac

SEQ ID NO: 9195255 - DNA, 22 bp, Homo sapiens
ttgattcttctgaatttgcaga

SEQ ID NO: 9195256 - DNA, 22 bp, Homo sapiens
ttgattctatgaggtaagctat

SEQ ID NO: 9195257 - DNA, 22 bp, Homo sapiens
ttctttcactcaagaaggatct

SEQ ID NO: 9195258 - DNA, 22 bp, Homo sapiens
ttctttcagaacacaagtgatt

SEQ ID NO: 9195259 - DNA, 22 bp, Homo sapiens
tgtttcagtccctgtgttcaat

SEQ ID NO: 9195260 - DNA, 22 bp, Homo sapiens
tgtgttttaaatggaaatttga

SEQ ID NO: 9195261 - DNA, 22 bp, Homo sapiens
ttaaatgaacgagatatgcaac

SEQ ID NO: 9195262 - DNA, 22 bp, Homo sapiens
ttaaatgaggctgatgtagatt

SEQ ID NO: 9195263 - DNA, 22 bp, Homo sapiens
ttttgcatctggtgaagaccag

SEQ ID NO: 9195264 - DNA, 23 bp, Homo sapiens
tttcttctcgaagagggagctta

SEQ ID NO: 9195265 - DNA, 21 bp, Homo sapiens
tttctgtctctgccactagtt

SEQ ID NO: 9195266 - DNA, 22 bp, Homo sapiens
catgagactgccttttcaaacc

SEQ ID NO: 9195267 - DNA, 22 bp, Homo sapiens
catctctccacggcagctctcg

SEQ ID NO: 9195268 - DNA, 22 bp, Homo sapiens
catccaaagcaaatatcttaaa

SEQ ID NO: 9195269 - DNA, 22 bp, Homo sapiens
catctcctttggtctacttcca

SEQ ID NO: 9195270 - DNA, 19 bp, Homo sapiens
catctcccacagccacaca

SEQ ID NO: 9195271 - DNA, 20 bp, Homo sapiens
catctcctgcctccatgttc

SEQ ID NO: 9195272 - DNA, 22 bp, Homo sapiens
cagtatttgttccctatcaatg

SEQ ID NO: 9195273 - DNA, 19 bp, Homo sapiens
cattcctttgtctgccaaa

SEQ ID NO: 9195274 - DNA, 22 bp, Homo sapiens
cattgctgtagtccagatgagg

SEQ ID NO: 9195275 - DNA, 22 bp, Homo sapiens
cattgctgttatgcataattcc

SEQ ID NO: 9195276 - DNA, 22 bp, Homo sapiens
catttcaaacagttacagctgc

SEQ ID NO: 9195277 - DNA, 22 bp, Homo sapiens
catttcaatacagtttgtaaat

SEQ ID NO: 9195278 - DNA, 22 bp, Homo sapiens
catttcacagtaaagtgatttc

SEQ ID NO: 9195279 - DNA, 22 bp, Homo sapiens
ccacagtttcttcatctataaa

SEQ ID NO: 9195280 - DNA, 22 bp, Homo sapiens
ccactaccacggcatgcctccc

SEQ ID NO: 9195281 - DNA, 22 bp, Homo sapiens
aggaagtgaaagggaaggagtt

SEQ ID NO: 9195282 - DNA, 22 bp, Homo sapiens
aggaagtgtcagggataacgat

SEQ ID NO: 9195283 - DNA, 22 bp, Homo sapiens
cagtatgtttgggagacatgac

SEQ ID NO: 9195284 - DNA, 22 bp, Homo sapiens
cagtatttgttacagcattagc

SEQ ID NO: 9195285 - DNA, 22 bp, Homo sapiens
cagtatttggaatatagctaag

SEQ ID NO: 9195286 - DNA, 22 bp, Homo sapiens
cagtatttcctcttcttaactt

SEQ ID NO: 9195287 - DNA, 22 bp, Homo sapiens
cagtaaatagtggagatgtggg

SEQ ID NO: 9195288 - DNA, 22 bp, Homo sapiens
cagtaaatataggaacgtggaa

SEQ ID NO: 9195289 - DNA, 22 bp, Homo sapiens
cagtaaatacatatcagagaag

SEQ ID NO: 9195290 - DNA, 22 bp, Homo sapiens
cagtaaatcctagagccctcat

SEQ ID NO: 9195291 - DNA, 22 bp, Homo sapiens
cagtaaatctctatctgccatt

SEQ ID NO: 9195292 - DNA, 22 bp, Homo sapiens
cagtaaatgagaagctagtaat

SEQ ID NO: 9195293 - DNA, 22 bp, Homo sapiens
cagtaaatgcagatatagatac

SEQ ID NO: 9195294 - DNA, 22 bp, Homo sapiens
cagtaaatgatgatagtgcctt

SEQ ID NO: 9195295 - DNA, 22 bp, Homo sapiens
cagtaaatggtacgtatatttt

SEQ ID NO: 9195296 - DNA, 22 bp, Homo sapiens
cagtaaatgtgatttttcttgt

SEQ ID NO: 9195297 - DNA, 22 bp, Homo sapiens
cagtaaatgtcctcgcagggaa

SEQ ID NO: 9195298 - DNA, 22 bp, Homo sapiens
cagtaaattatctcatctctgt

SEQ ID NO: 9195299 - DNA, 22 bp, Homo sapiens
cagtaaattttatttgtgggtg

SEQ ID NO: 9195300 - DNA, 22 bp, Homo sapiens
cagtaaatttgagggatctaat

SEQ ID NO: 9195301 - DNA, 22 bp, Homo sapiens
aggaagaaacctactagagttt

SEQ ID NO: 9195302 - DNA, 22 bp, Homo sapiens
caggatggagggagggctgtta

SEQ ID NO: 9195303 - DNA, 22 bp, Homo sapiens
caggatggccccggggctgtgc

SEQ ID NO: 9195304 - DNA, 22 bp, Homo sapiens
caggatggcagagaaaagggtg

SEQ ID NO: 9195305 - DNA, 22 bp, Homo sapiens
caggatggtcagatgcattgtc

SEQ ID NO: 9195306 - DNA, 22 bp, Homo sapiens
caggatgggatgtagtgggccc

SEQ ID NO: 9195307 - DNA, 22 bp, Homo sapiens
cagctgttcattgttgccaccc

SEQ ID NO: 9195308 - DNA, 22 bp, Homo sapiens
cagctgttgtcacctcacatcc

SEQ ID NO: 9195309 - DNA, 22 bp, Homo sapiens
agcttccttgaattctgtagaa

SEQ ID NO: 9195310 - DNA, 22 bp, Homo sapiens
agcttcctgtcttctgcacaaa

SEQ ID NO: 9195311 - DNA, 22 bp, Homo sapiens
agcttcctgactggtgctctta

SEQ ID NO: 9195312 - DNA, 22 bp, Homo sapiens
agcttcctacaaccatctcaga

SEQ ID NO: 9195313 - DNA, 23 bp, Homo sapiens
agcttcctagtgacctggagtct

SEQ ID NO: 9195314 - DNA, 21 bp, Homo sapiens
agggaaaaggctgagtgaggg

SEQ ID NO: 9195315 - DNA, 22 bp, Homo sapiens
cctccttctggggccttctgct

SEQ ID NO: 9195316 - DNA, 22 bp, Homo sapiens
cccactctccatgaggttccca

SEQ ID NO: 9195317 - DNA, 22 bp, Homo sapiens
aggctgccatagggaactgcat

SEQ ID NO: 9195318 - DNA, 21 bp, Homo sapiens
aggctgcatgcatgagtgtgg

SEQ ID NO: 9195319 - DNA, 22 bp, Homo sapiens
ccagtgtgattgttgcaagaat

SEQ ID NO: 9195320 - DNA, 22 bp, Homo sapiens
ccaggttcaaatagctgtgtga

SEQ ID NO: 9195321 - DNA, 22 bp, Homo sapiens
ccagtaattagactttcaggca

SEQ ID NO: 9195322 - DNA, 22 bp, Homo sapiens
ccagtaatggaaatagcagttc

SEQ ID NO: 9195323 - DNA, 22 bp, Homo sapiens
aggctctgggaagcagtgagtt

SEQ ID NO: 9195324 - DNA, 22 bp, Homo sapiens
aggcaggtagaaggatctttat

SEQ ID NO: 9195325 - DNA, 22 bp, Homo sapiens
aggcaggtcccctggaaggcac

SEQ ID NO: 9195326 - DNA, 18 bp, Homo sapiens
ccagccctgcagcacctg

SEQ ID NO: 9195327 - DNA, 17 bp, Homo sapiens
ccagccctcgcgctttt

SEQ ID NO: 9195328 - DNA, 22 bp, Homo sapiens
ccagccctcggtagtcccatag

SEQ ID NO: 9195329 - DNA, 22 bp, Homo sapiens
ccagctcccattcttcacctgt

SEQ ID NO: 9195330 - DNA, 22 bp, Homo sapiens
aggctcagaggtgagcatctgc

SEQ ID NO: 9195331 - DNA, 22 bp, Homo sapiens
ctaccactggctctgtgacttt

SEQ ID NO: 9195332 - DNA, 22 bp, Homo sapiens
agtatgttgacttattcttgga

SEQ ID NO: 9195333 - DNA, 22 bp, Homo sapiens
agtatttcctggcttatctgct

SEQ ID NO: 9195334 - DNA, 22 bp, Homo sapiens
agtacagggagtttgttgtgtt

SEQ ID NO: 9195335 - DNA, 22 bp, Homo sapiens
aggtccctcagaggcctcaccg

SEQ ID NO: 9195336 - DNA, 22 bp, Homo sapiens
ctcctgcccacgtgctacttct

SEQ ID NO: 9195337 - DNA, 22 bp, Homo sapiens
ctccctccctacgtgagctcac

SEQ ID NO: 9195338 - DNA, 22 bp, Homo sapiens
ctccctcatatacccagcgaga

SEQ ID NO: 9195339 - DNA, 22 bp, Homo sapiens
ctcatgtcaggggtgtcaatgt

SEQ ID NO: 9195340 - DNA, 22 bp, Homo sapiens
ctcattctttcacagtctgtgg

SEQ ID NO: 9195341 - DNA, 22 bp, Homo sapiens
ctcattgcagctgcattactgt

SEQ ID NO: 9195342 - DNA, 22 bp, Homo sapiens
agtcctcccttggggccacctt

SEQ ID NO: 9195343 - DNA, 22 bp, Homo sapiens
ctccagctttagctctccaggg

SEQ ID NO: 9195344 - DNA, 22 bp, Homo sapiens
ctccagcttctgcccagagact

SEQ ID NO: 9195345 - DNA, 22 bp, Homo sapiens
ctccagctttttcccagttggc

SEQ ID NO: 9195346 - DNA, 22 bp, Homo sapiens
ctccagctgccaccagatgttt

SEQ ID NO: 9195347 - DNA, 22 bp, Homo sapiens
ctccagcttccctcagctgtgg

SEQ ID NO: 9195348 - DNA, 22 bp, Homo sapiens
ctccagctcgcgagctctgctc

SEQ ID NO: 9195349 - DNA, 22 bp, Homo sapiens
agttaagagtgtgaaaatgtta

SEQ ID NO: 9195350 - DNA, 22 bp, Homo sapiens
ctgaatgatataagatctttct

SEQ ID NO: 9195351 - DNA, 22 bp, Homo sapiens
ctgaatgaatggtttgtcttat

SEQ ID NO: 9195352 - DNA, 22 bp, Homo sapiens
ctgaatgagtggatttttcatt

SEQ ID NO: 9195353 - DNA, 22 bp, Homo sapiens
ctctcagcaggaaagcatgcaa

SEQ ID NO: 9195354 - DNA, 22 bp, Homo sapiens
ctctcatgtagtatctgtatgg

SEQ ID NO: 9195355 - DNA, 22 bp, Homo sapiens
cttcttcaacctgaaagtttca

SEQ ID NO: 9195356 - DNA, 22 bp, Homo sapiens
atctgacatctactagaacaga

SEQ ID NO: 9195357 - DNA, 22 bp, Homo sapiens
atctgattcattgaaatgggtg

SEQ ID NO: 9195358 - DNA, 22 bp, Homo sapiens
atctgaagctatctgcacttca

SEQ ID NO: 9195359 - DNA, 22 bp, Homo sapiens
atctgaagggaagtggaaggca

SEQ ID NO: 9195360 - DNA, 22 bp, Homo sapiens
atctgaataaatttcttttagt

SEQ ID NO: 9195361 - DNA, 22 bp, Homo sapiens
atctgaagaatgaatggaatta

SEQ ID NO: 9195362 - DNA, 22 bp, Homo sapiens
atcagaatgattagtaaccaat

SEQ ID NO: 9195363 - DNA, 22 bp, Homo sapiens
atcagaatcttctgaacagtgg

SEQ ID NO: 9195364 - DNA, 22 bp, Homo sapiens
atcctgaaaacttacgaagtgg

SEQ ID NO: 9195365 - DNA, 22 bp, Homo sapiens
atatgctaattagagggcatta

SEQ ID NO: 9195366 - DNA, 22 bp, Homo sapiens
atattatagacagagtcttctg

SEQ ID NO: 9195367 - DNA, 22 bp, Homo sapiens
ctgggctcttcccagatccaga

SEQ ID NO: 9195368 - DNA, 22 bp, Homo sapiens
atcagaatactatcaacagtga

SEQ ID NO: 9195369 - DNA, 21 bp, Homo sapiens
atcagaatctctagatttgga

SEQ ID NO: 9195370 - DNA, 22 bp, Homo sapiens
atcagaataattagatttcaga

SEQ ID NO: 9195371 - DNA, 22 bp, Homo sapiens
atcactttggtaccaattcagc

SEQ ID NO: 9195372 - DNA, 22 bp, Homo sapiens
atcaacatgaatttctctgaag

SEQ ID NO: 9195373 - DNA, 22 bp, Homo sapiens
atcaaagtaggcatatgttttt

SEQ ID NO: 9195374 - DNA, 22 bp, Homo sapiens
atcaaaatggaagaatttggct

SEQ ID NO: 9195375 - DNA, 22 bp, Homo sapiens
atatttactgctgtggtgaagg

SEQ ID NO: 9195376 - DNA, 22 bp, Homo sapiens
atagcacatcactccagtgagt

SEQ ID NO: 9195377 - DNA, 22 bp, Homo sapiens
atagcaatgatcaagacagaca

SEQ ID NO: 9195378 - DNA, 22 bp, Homo sapiens
atagcaatcagtgtatttgaaa

SEQ ID NO: 9195379 - DNA, 22 bp, Homo sapiens
atagatttgaatttaagacttg

SEQ ID NO: 9195380 - DNA, 22 bp, Homo sapiens
atagatttgaatttaagacttg

SEQ ID NO: 9195381 - DNA, 22 bp, Homo sapiens
atactatattaccttctcaact

SEQ ID NO: 9195382 - DNA, 22 bp, Homo sapiens
atactaaagtatagaacttagt

SEQ ID NO: 9195383 - DNA, 22 bp, Homo sapiens
ctggaatgcctccctgtcagag

SEQ ID NO: 9195384 - DNA, 22 bp, Homo sapiens
ctggagaattctatgaaatatt

SEQ ID NO: 9195385 - DNA, 22 bp, Homo sapiens
ctggagaagaggtagtatgtag

SEQ ID NO: 9195386 - DNA, 22 bp, Homo sapiens
ataccaaagcacatactgtttg

SEQ ID NO: 9195387 - DNA, 22 bp, Homo sapiens
ataccataggaaaggatcagcc

SEQ ID NO: 9195388 - DNA, 22 bp, Homo sapiens
ataccctagagttggacagaat

SEQ ID NO: 9195389 - DNA, 22 bp, Homo sapiens
agttatttactcctttgtctct

SEQ ID NO: 9195390 - DNA, 22 bp, Homo sapiens
ctgcaaatcaagttcttataat

SEQ ID NO: 9195391 - DNA, 22 bp, Homo sapiens
agttatttaaaatgattgtcct

SEQ ID NO: 9195392 - DNA, 22 bp, Homo sapiens
ctgcctctcaggtccctgagat

SEQ ID NO: 9195393 - DNA, 22 bp, Homo sapiens
ataaattatgaatggccctttt

SEQ ID NO: 9195394 - DNA, 22 bp, Homo sapiens
ctgctgaggtccttgctcagac

SEQ ID NO: 9195395 - DNA, 22 bp, Homo sapiens
atacaacagaaaatgattattc

SEQ ID NO: 9195396 - DNA, 22 bp, Homo sapiens
atgatcagggcagaagcagaag

SEQ ID NO: 9195397 - DNA, 22 bp, Homo sapiens
atgatcagcagttttcagtgtt

SEQ ID NO: 9195398 - DNA, 20 bp, Homo sapiens
gaaacattggcagcaactga

SEQ ID NO: 9195399 - DNA, 22 bp, Homo sapiens
ctttcccttagccccattctat

SEQ ID NO: 9195400 - DNA, 22 bp, Homo sapiens
atctggagaatgtttgtctccg

SEQ ID NO: 9195401 - DNA, 22 bp, Homo sapiens
atctggagagatcttcacaaaa

SEQ ID NO: 9195402 - DNA, 22 bp, Homo sapiens
atctggagatgggtctgtcacc

SEQ ID NO: 9195403 - DNA, 22 bp, Homo sapiens
atctggagcagggccacaaggc

SEQ ID NO: 9195404 - DNA, 22 bp, Homo sapiens
atctggagtttcagttttctgg

SEQ ID NO: 9195405 - DNA, 22 bp, Homo sapiens
ctttcttcaacctcattctgca

SEQ ID NO: 9195406 - DNA, 22 bp, Homo sapiens
atgaaacaaacctctatggagt

SEQ ID NO: 9195407 - DNA, 22 bp, Homo sapiens
atgaaacaagggtattttctct

SEQ ID NO: 9195408 - DNA, 22 bp, Homo sapiens
atgaacatcggaaatgagactg

SEQ ID NO: 9195409 - DNA, 22 bp, Homo sapiens
atgaacagtacaaagcacagac

SEQ ID NO: 9195410 - DNA, 22 bp, Homo sapiens
atgaacagtatgcaacatgatt

SEQ ID NO: 9195411 - DNA, 20 bp, Homo sapiens
atgctcgttgggtttcttcc

SEQ ID NO: 9195412 - DNA, 22 bp, Homo sapiens
gaccttgtgatccacccgcttt

SEQ ID NO: 9195413 - DNA, 22 bp, Homo sapiens
gactgggagggttcagctgggt

SEQ ID NO: 9195414 - DNA, 22 bp, Homo sapiens
gaaggctgtaggcaaagtagga

SEQ ID NO: 9195415 - DNA, 22 bp, Homo sapiens
gaaggctgctgggaagtgtggt

SEQ ID NO: 9195416 - DNA, 22 bp, Homo sapiens
gaaggctggctttctgagagca

SEQ ID NO: 9195417 - DNA, 22 bp, Homo sapiens
gaataattgtgatgcttgaagt

SEQ ID NO: 9195418 - DNA, 22 bp, Homo sapiens
atgtcctggagcagaggcaagg

SEQ ID NO: 9195419 - DNA, 22 bp, Homo sapiens
atgtcctggcccgaggatggag

SEQ ID NO: 9195420 - DNA, 22 bp, Homo sapiens
atgtagctgcagatgataatgc

SEQ ID NO: 9195421 - DNA, 19 bp, Homo sapiens
atgtctctgtagcacatac

SEQ ID NO: 9195422 - DNA, 20 bp, Homo sapiens
atgtgaaagatcagttgtct

SEQ ID NO: 9195423 - DNA, 22 bp, Homo sapiens
atgtgtctggttattgacatgc

SEQ ID NO: 9195424 - DNA, 22 bp, Homo sapiens
atgttgaactaggatctcttga

SEQ ID NO: 9195425 - DNA, 22 bp, Homo sapiens
gatatcattgagcccaggagtt

SEQ ID NO: 9195426 - DNA, 22 bp, Homo sapiens
atgtttaaaggagtcagagact

SEQ ID NO: 9195427 - DNA, 22 bp, Homo sapiens
atgtttaaatttatagacagtg

SEQ ID NO: 9195428 - DNA, 22 bp, Homo sapiens
atgttgtgtttgactgttaccc

SEQ ID NO: 9195429 - DNA, 20 bp, Homo sapiens
gagttccccatttctcctgg

SEQ ID NO: 9195430 - DNA, 22 bp, Homo sapiens
gagatgggcgagaaggtggact

SEQ ID NO: 9195431 - DNA, 22 bp, Homo sapiens
atggagggtggtaagacagaga

SEQ ID NO: 9195432 - DNA, 17 bp, Homo sapiens
gagatgggtggatcacc

SEQ ID NO: 9195433 - DNA, 22 bp, Homo sapiens
gagatggggaataggagcaagc

SEQ ID NO: 9195434 - DNA, 22 bp, Homo sapiens
atggttatgcaaacatgatgca

SEQ ID NO: 9195435 - DNA, 22 bp, Homo sapiens
gaggaagggactttattatctg

SEQ ID NO: 9195436 - DNA, 22 bp, Homo sapiens
atgggagaaacatcatgaggca

SEQ ID NO: 9195437 - DNA, 22 bp, Homo sapiens
attcaactatgtatagtcttct

SEQ ID NO: 9195438 - DNA, 22 bp, Homo sapiens
gatatttaactctcacaggtcc

SEQ ID NO: 9195439 - DNA, 22 bp, Homo sapiens
attcacaatagcagcttgcatg

SEQ ID NO: 9195440 - DNA, 22 bp, Homo sapiens
attcaaggttggctcaggaatt

SEQ ID NO: 9195441 - DNA, 22 bp, Homo sapiens
attcacatgtgcttcttatcac

SEQ ID NO: 9195442 - DNA, 22 bp, Homo sapiens
attccttctttgagaataagca

SEQ ID NO: 9195443 - DNA, 22 bp, Homo sapiens
attctttagccagcaggtatat

SEQ ID NO: 9195444 - DNA, 22 bp, Homo sapiens
attgtataacagcatgtatttt

SEQ ID NO: 9195445 - DNA, 23 bp, Homo sapiens
gcattctgatggttctctgtgat

SEQ ID NO: 9195446 - DNA, 22 bp, Homo sapiens
gcattctgtgctacagccattc

SEQ ID NO: 9195447 - DNA, 22 bp, Homo sapiens
atttttcagcttcattgaggca

SEQ ID NO: 9195448 - DNA, 22 bp, Homo sapiens
atttttcaactttggaaatggc

SEQ ID NO: 9195449 - DNA, 22 bp, Homo sapiens
attttactttgtgaatattgac

SEQ ID NO: 9195450 - DNA, 22 bp, Homo sapiens
attttacttcatttgaaatgcc

SEQ ID NO: 9195451 - DNA, 22 bp, Homo sapiens
caaacattcaagtacaagtctt

SEQ ID NO: 9195452 - DNA, 22 bp, Homo sapiens
caaaatgatgtgattttattgt

SEQ ID NO: 9195453 - DNA, 22 bp, Homo sapiens
caaatactttatatacttcaaa

SEQ ID NO: 9195454 - DNA, 22 bp, Homo sapiens
caaaggaaatactaatctggaa

SEQ ID NO: 9195455 - DNA, 22 bp, Homo sapiens
caaatggatacaggcaaacatt

SEQ ID NO: 9195456 - DNA, 22 bp, Homo sapiens
caaatggagaattagcagtttg

SEQ ID NO: 9195457 - DNA, 22 bp, Homo sapiens
atttccagtgcactgaatagaa

SEQ ID NO: 9195458 - DNA, 22 bp, Homo sapiens
atttccattttcagccattact

SEQ ID NO: 9195459 - DNA, 22 bp, Homo sapiens
atttccattatcatgacaaatt

SEQ ID NO: 9195460 - DNA, 22 bp, Homo sapiens
atttccatgtccaaaaattagt

SEQ ID NO: 9195461 - DNA, 22 bp, Homo sapiens
atttccatgtcggtattttata

SEQ ID NO: 9195462 - DNA, 22 bp, Homo sapiens
atttccatgaagtttagttata

SEQ ID NO: 9195463 - DNA, 22 bp, Homo sapiens
atttccatgaaggcagatttta

SEQ ID NO: 9195464 - DNA, 22 bp, Homo sapiens
atttccatgaattcccactcat

SEQ ID NO: 9195465 - DNA, 22 bp, Homo sapiens
atttccatgccttagcttaagg

SEQ ID NO: 9195466 - DNA, 22 bp, Homo sapiens
atttccatacacccatttctga

SEQ ID NO: 9195467 - DNA, 22 bp, Homo sapiens
atttccatagagcgtctcacag

SEQ ID NO: 9195468 - DNA, 22 bp, Homo sapiens
atttccatcatcattaggccta

SEQ ID NO: 9195469 - DNA, 17 bp, Homo sapiens
gcccccagaaatctcag

SEQ ID NO: 9195470 - DNA, 22 bp, Homo sapiens
atttctgtgcagtaaatggtga

SEQ ID NO: 9195471 - DNA, 22 bp, Homo sapiens
atttggaagcatttccaaagca

SEQ ID NO: 9195472 - DNA, 22 bp, Homo sapiens
gcctcacagactgactgaaagc

SEQ ID NO: 9195473 - DNA, 22 bp, Homo sapiens
cagagggtcaccaggaagtgca

SEQ ID NO: 9195474 - DNA, 22 bp, Homo sapiens
ggtctgccacaagatttttgag

SEQ ID NO: 9195475 - DNA, 22 bp, Homo sapiens
ggtctgcccactactctccatt

SEQ ID NO: 9195476 - DNA, 22 bp, Homo sapiens
cagcaaaggtagaagcacagga

SEQ ID NO: 9195477 - DNA, 22 bp, Homo sapiens
cagcaaggactgggcatgtgaa

SEQ ID NO: 9195478 - DNA, 22 bp, Homo sapiens
cagcacagtgaccagacccact

SEQ ID NO: 9195479 - DNA, 22 bp, Homo sapiens
cagcacatctgattatatgact

SEQ ID NO: 9195480 - DNA, 22 bp, Homo sapiens
cagcacatctccaagaatttct

SEQ ID NO: 9195481 - DNA, 22 bp, Homo sapiens
cagcacatagtaggtattcact

SEQ ID NO: 9195482 - DNA, 22 bp, Homo sapiens
gtgctgtgcgctttttctgtat

SEQ ID NO: 9195483 - DNA, 22 bp, Homo sapiens
cagccttcaaggcttagctcag

SEQ ID NO: 9195484 - DNA, 20 bp, Homo sapiens
cagcctccactcactcagct

SEQ ID NO: 9195485 - DNA, 22 bp, Homo sapiens
gtcataatataaaaactgactt

SEQ ID NO: 9195486 - DNA, 22 bp, Homo sapiens
gtctggagccccagtcaatgag

SEQ ID NO: 9195487 - DNA, 22 bp, Homo sapiens
cagccccatggtgtgctccagc

SEQ ID NO: 9195488 - DNA, 22 bp, Homo sapiens
cagccctcaggtcctcagcagc

SEQ ID NO: 9195489 - DNA, 22 bp, Homo sapiens
caagggtggtattgggagcata

SEQ ID NO: 9195490 - DNA, 21 bp, Homo sapiens
gctttctgtggactctgcacc

SEQ ID NO: 9195491 - DNA, 22 bp, Homo sapiens
gctttcttcatactcaagcatc

SEQ ID NO: 9195492 - DNA, 22 bp, Homo sapiens
caagtatttcctgatggcctgt

SEQ ID NO: 9195493 - DNA, 22 bp, Homo sapiens
caagtagagttcacttgtcttt

SEQ ID NO: 9195494 - DNA, 20 bp, Homo sapiens
cacaggcttacagtttagat

SEQ ID NO: 9195495 - DNA, 22 bp, Homo sapiens
cacaggaatcgtcacttagcgc

SEQ ID NO: 9195496 - DNA, 22 bp, Homo sapiens
ggactgggattctggatctgct

SEQ ID NO: 9195497 - DNA, 20 bp, Homo sapiens
cacagactgtatgggcacca

SEQ ID NO: 9195498 - DNA, 22 bp, Homo sapiens
cacagaattaagggagaaatat

SEQ ID NO: 9195499 - DNA, 22 bp, Homo sapiens
cacacagcaacaagaatagcca

SEQ ID NO: 9195500 - DNA, 22 bp, Homo sapiens
ggaaggggagctggaaagggta

SEQ ID NO: 9195501 - DNA, 22 bp, Homo sapiens
cacagaagaatcatgctgtgtt

SEQ ID NO: 9195502 - DNA, 22 bp, Homo sapiens
cacgcatgtggatcagatgaag

SEQ ID NO: 9195503 - DNA, 22 bp, Homo sapiens
cacattcttgagttacagtcta

SEQ ID NO: 9195504 - DNA, 22 bp, Homo sapiens
cacattctgtgaagctgatttt

SEQ ID NO: 9195505 - DNA, 22 bp, Homo sapiens
cacattctttcacagttctgaa

SEQ ID NO: 9195506 - DNA, 22 bp, Homo sapiens
cacattcttggtcaccttgtgg

SEQ ID NO: 9195507 - DNA, 22 bp, Homo sapiens
cacatttagaggttagcatggt

SEQ ID NO: 9195508 - DNA, 22 bp, Homo sapiens
ggctccaggtgcatgccaggct

SEQ ID NO: 9195509 - DNA, 22 bp, Homo sapiens
ggctccaggtttaagggtatgt

SEQ ID NO: 9195510 - DNA, 22 bp, Homo sapiens
cagaaaacctgactctagaact

SEQ ID NO: 9195511 - DNA, 22 bp, Homo sapiens
cagaaataaacttctcacatcg

SEQ ID NO: 9195512 - DNA, 22 bp, Homo sapiens
atcctgaagcatgaatgtcaaa

SEQ ID NO: 9195513 - DNA, 22 bp, Homo sapiens
agaagctaattcatgtcttatg

SEQ ID NO: 9195514 - DNA, 22 bp, Homo sapiens
agaagccaaatgccagtgacct

SEQ ID NO: 9195515 - DNA, 22 bp, Homo sapiens
agaagccaaaggggccagatat

SEQ ID NO: 9195516 - DNA, 22 bp, Homo sapiens
atagctgttgccaatttccatg

SEQ ID NO: 9195517 - DNA, 22 bp, Homo sapiens
ataggaatgtgatttataaatg

SEQ ID NO: 9195518 - DNA, 22 bp, Homo sapiens
atacactgctgccacacagctg

SEQ ID NO: 9195519 - DNA, 22 bp, Homo sapiens
atactgttggcagcagaccaga

SEQ ID NO: 9195520 - DNA, 22 bp, Homo sapiens
ataaattttcttgctgtactta

SEQ ID NO: 9195521 - DNA, 22 bp, Homo sapiens
ataaatttataattgtttcctg

SEQ ID NO: 9195522 - DNA, 20 bp, Homo sapiens
agttcacaggccaaatttct

SEQ ID NO: 9195523 - DNA, 22 bp, Homo sapiens
agttcagtagtccttcattgta

SEQ ID NO: 9195524 - DNA, 22 bp, Homo sapiens
ataaggacacccttctctttac

SEQ ID NO: 9195525 - DNA, 22 bp, Homo sapiens
ataaggacttgaattagacatt

SEQ ID NO: 9195526 - DNA, 22 bp, Homo sapiens
ataaggcatatagtcacttttt

SEQ ID NO: 9195527 - DNA, 22 bp, Homo sapiens
atacaagttgtgataatgtaaa

SEQ ID NO: 9195528 - DNA, 21 bp, Homo sapiens
aggttcctgagtcatgcctta

SEQ ID NO: 9195529 - DNA, 22 bp, Homo sapiens
agtcctggtgacactcctcttc

SEQ ID NO: 9195530 - DNA, 22 bp, Homo sapiens
actctgtaattctatatgcagt

SEQ ID NO: 9195531 - DNA, 21 bp, Homo sapiens
agtaagggaggaaagaaattg

SEQ ID NO: 9195532 - DNA, 22 bp, Homo sapiens
agtaagtgcagaaaagatgtgg

SEQ ID NO: 9195533 - DNA, 22 bp, Homo sapiens
agtcagtcacaaaggaccacat

SEQ ID NO: 9195534 - DNA, 22 bp, Homo sapiens
agtgggaggaagtggtgatatt

SEQ ID NO: 9195535 - DNA, 22 bp, Homo sapiens
agtgattttatcaatttactca

SEQ ID NO: 9195536 - DNA, 22 bp, Homo sapiens
agtcctttgctgaactgtcaca

SEQ ID NO: 9195537 - DNA, 22 bp, Homo sapiens
agtgaattagcctatttgtaaa

SEQ ID NO: 9195538 - DNA, 22 bp, Homo sapiens
agtgaggataccaatgtgtaga

SEQ ID NO: 9195539 - DNA, 17 bp, Homo sapiens
agtgaggagattggaag

SEQ ID NO: 9195540 - DNA, 19 bp, Homo sapiens
agttatttctaaatttacc

SEQ ID NO: 9195541 - DNA, 22 bp, Homo sapiens
acagtgaaaagaatattagaat

SEQ ID NO: 9195542 - DNA, 22 bp, Homo sapiens
acatctctgggtcctccatgca

SEQ ID NO: 9195543 - DNA, 22 bp, Homo sapiens
acatctgttgattgatgttaca

SEQ ID NO: 9195544 - DNA, 22 bp, Homo sapiens
acatctgtaatctagtcaaccc

SEQ ID NO: 9195545 - DNA, 21 bp, Homo sapiens
acaggctcacgatccatttct

SEQ ID NO: 9195546 - DNA, 22 bp, Homo sapiens
aggaaataagggacaagacaaa

SEQ ID NO: 9195547 - DNA, 22 bp, Homo sapiens
aggaaataggaccagacaaagc

SEQ ID NO: 9195548 - DNA, 22 bp, Homo sapiens
acaggacatggcttctgtgacg

SEQ ID NO: 9195549 - DNA, 22 bp, Homo sapiens
acagcatgtctagttaaatact

SEQ ID NO: 9195550 - DNA, 22 bp, Homo sapiens
acagcatggataacaaggcact

SEQ ID NO: 9195551 - DNA, 22 bp, Homo sapiens
acagcatgagagatgaacattc

SEQ ID NO: 9195552 - DNA, 22 bp, Homo sapiens
acagcatgagagtagcaaaagg

SEQ ID NO: 9195553 - DNA, 21 bp, Homo sapiens
acagcatgtttgtgtgtttgc

SEQ ID NO: 9195554 - DNA, 22 bp, Homo sapiens
acagcattgagagctaaattta

SEQ ID NO: 9195555 - DNA, 22 bp, Homo sapiens
acaggacaaggggaagaagata

SEQ ID NO: 9195556 - DNA, 22 bp, Homo sapiens
acaggaataaaaggaataagga

SEQ ID NO: 9195557 - DNA, 22 bp, Homo sapiens
acaggaagtgggaagaaacagg

SEQ ID NO: 9195558 - DNA, 22 bp, Homo sapiens
acctcatctggtttgtaaggca

SEQ ID NO: 9195559 - DNA, 22 bp, Homo sapiens
agggcaagggttgaagataaga

SEQ ID NO: 9195560 - DNA, 22 bp, Homo sapiens
accagagaatgtgcatctctaa

SEQ ID NO: 9195561 - DNA, 22 bp, Homo sapiens
accagagatggggcttctctgt

SEQ ID NO: 9195562 - DNA, 22 bp, Homo sapiens
acatgtatgtgtgcaaacacat

SEQ ID NO: 9195563 - DNA, 22 bp, Homo sapiens
acatgtgcagacagcaagcagg

SEQ ID NO: 9195564 - DNA, 20 bp, Homo sapiens
aggctcagctgagctcttgg

SEQ ID NO: 9195565 - DNA, 22 bp, Homo sapiens
aggctctcaccctctgaccaga

SEQ ID NO: 9195566 - DNA, 22 bp, Homo sapiens
aggctgggaaacctgaagttgt

SEQ ID NO: 9195567 - DNA, 22 bp, Homo sapiens
aggctgggaaatgtagtcttcc

SEQ ID NO: 9195568 - DNA, 22 bp, Homo sapiens
aggctgggaaatgtattccagc

SEQ ID NO: 9195569 - DNA, 22 bp, Homo sapiens
aggctgcagaacagtcaggtgc

SEQ ID NO: 9195570 - DNA, 22 bp, Homo sapiens
atgtatacgtgcaagtcacagg

SEQ ID NO: 9195571 - DNA, 21 bp, Homo sapiens
atgttcactgggtcaattaga

SEQ ID NO: 9195572 - DNA, 22 bp, Homo sapiens
atgtgcatgtgcacacatgcgt

SEQ ID NO: 9195573 - DNA, 22 bp, Homo sapiens
atgatttaaagtcattgtgaac

SEQ ID NO: 9195574 - DNA, 22 bp, Homo sapiens
atgcaaatgtcaccacttctaa

SEQ ID NO: 9195575 - DNA, 22 bp, Homo sapiens
atgcaaattaacatatagtaga

SEQ ID NO: 9195576 - DNA, 22 bp, Homo sapiens
atgctaaactatgatcattttc

SEQ ID NO: 9195577 - DNA, 18 bp, Homo sapiens
atgcttctgatagaagca

SEQ ID NO: 9195578 - DNA, 22 bp, Homo sapiens
atgcttctcagctcaaggcaaa

SEQ ID NO: 9195579 - DNA, 22 bp, Homo sapiens
atgccatctcttcattttatag

SEQ ID NO: 9195580 - DNA, 22 bp, Homo sapiens
atgccatcctaattacgttgaa

SEQ ID NO: 9195581 - DNA, 22 bp, Homo sapiens
atgccatctgaaatctgtcata

SEQ ID NO: 9195582 - DNA, 22 bp, Homo sapiens
caaacattgctaccagaggttt

SEQ ID NO: 9195583 - DNA, 22 bp, Homo sapiens
agattctaccagagctagtttg

SEQ ID NO: 9195584 - DNA, 22 bp, Homo sapiens
agatgtttgtgttatctccatt

SEQ ID NO: 9195585 - DNA, 22 bp, Homo sapiens
agatttaaagcagtattcgcaa

SEQ ID NO: 9195586 - DNA, 22 bp, Homo sapiens
agatttaaatttgctacaattc

SEQ ID NO: 9195587 - DNA, 23 bp, Homo sapiens
agatttaatgttatattctgggc

SEQ ID NO: 9195588 - DNA, 22 bp, Homo sapiens
agatttatgtggtcacactcag

SEQ ID NO: 9195589 - DNA, 22 bp, Homo sapiens
atttgaaccactcagaactcat

SEQ ID NO: 9195590 - DNA, 22 bp, Homo sapiens
atttgaaatctgggttactctg

SEQ ID NO: 9195591 - DNA, 22 bp, Homo sapiens
atttgaaatcccttctactgta

SEQ ID NO: 9195592 - DNA, 20 bp, Homo sapiens
attctaaagctctgctcttt

SEQ ID NO: 9195593 - DNA, 22 bp, Homo sapiens
attctaaatgtaatttagaatt

SEQ ID NO: 9195594 - DNA, 22 bp, Homo sapiens
attctaaatcagagagctctgt

SEQ ID NO: 9195595 - DNA, 22 bp, Homo sapiens
attctccagtagtcattctatc

SEQ ID NO: 9195596 - DNA, 22 bp, Homo sapiens
agagcttgtaattgagtcaggt

SEQ ID NO: 9195597 - DNA, 22 bp, Homo sapiens
attgaaaatataattctaggag

SEQ ID NO: 9195598 - DNA, 22 bp, Homo sapiens
attgtataacagcatgtatttt

SEQ ID NO: 9195599 - DNA, 19 bp, Homo sapiens
cagctggaatcatctgagg

SEQ ID NO: 9195600 - DNA, 22 bp, Homo sapiens
cagcctctgacaccacagtcgt

SEQ ID NO: 9195601 - DNA, 22 bp, Homo sapiens
cagcatcaccaacttgagcaat

SEQ ID NO: 9195602 - DNA, 22 bp, Homo sapiens
cagcctctaagcacagcctctc

SEQ ID NO: 9195603 - DNA, 22 bp, Homo sapiens
cagcctcctgggacactcaccg

SEQ ID NO: 9195604 - DNA, 19 bp, Homo sapiens
cagcccagggtgctaccaa

SEQ ID NO: 9195605 - DNA, 22 bp, Homo sapiens
cagatgaactctatcctgtggc

SEQ ID NO: 9195606 - DNA, 22 bp, Homo sapiens
cagatgaactaggctgcacttg

SEQ ID NO: 9195607 - DNA, 22 bp, Homo sapiens
cagatattaggagctcaataat

SEQ ID NO: 9195608 - DNA, 22 bp, Homo sapiens
cagatcaagctgtatggtcaga

SEQ ID NO: 9195609 - DNA, 22 bp, Homo sapiens
cagatcctgccaggctgagttg

SEQ ID NO: 9195610 - DNA, 22 bp, Homo sapiens
cacaggctccggccttgcagcc

SEQ ID NO: 9195611 - DNA, 23 bp, Homo sapiens
cacatggaggaccgttcttataa

SEQ ID NO: 9195612 - DNA, 23 bp, Homo sapiens
cacatggattaaatgagaccaca

SEQ ID NO: 9195613 - DNA, 22 bp, Homo sapiens
cacatgaagacctaattggatt

SEQ ID NO: 9195614 - DNA, 22 bp, Homo sapiens
cacatttaagcagatgtggacc

SEQ ID NO: 9195615 - DNA, 22 bp, Homo sapiens
agcatttagttagtaaatgttt

SEQ ID NO: 9195616 - DNA, 22 bp, Homo sapiens
agcatttatttcttagaaattg

SEQ ID NO: 9195617 - DNA, 22 bp, Homo sapiens
cactgcaacctctgccacctgg

SEQ ID NO: 9195618 - DNA, 22 bp, Homo sapiens
cactgcacaatgtagcaaagaa

SEQ ID NO: 9195619 - DNA, 22 bp, Homo sapiens
cactgcaagctctgccacctgg

SEQ ID NO: 9195620 - DNA, 22 bp, Homo sapiens
cactgcacaggtgagatgtggg

SEQ ID NO: 9195621 - DNA, 22 bp, Homo sapiens
cagaaactttctttactgagca

SEQ ID NO: 9195622 - DNA, 22 bp, Homo sapiens
cacagaacatccttagctcatg

SEQ ID NO: 9195623 - DNA, 22 bp, Homo sapiens
cacaggaagaggtatacaattc

SEQ ID NO: 9195624 - DNA, 22 bp, Homo sapiens
cacaggaacaaagaagacaatt

SEQ ID NO: 9195625 - DNA, 22 bp, Homo sapiens
caattcaacctaagtgcatcca

SEQ ID NO: 9195626 - DNA, 22 bp, Homo sapiens
caaggaagttttaggagaggaa

SEQ ID NO: 9195627 - DNA, 22 bp, Homo sapiens
caaggaaggagagatgatgggt

SEQ ID NO: 9195628 - DNA, 20 bp, Homo sapiens
agcaattgtgaacttattca

SEQ ID NO: 9195629 - DNA, 22 bp, Homo sapiens
agcaattggaatttagacaaga

SEQ ID NO: 9195630 - DNA, 22 bp, Homo sapiens
caatgtttttccttccttaata

SEQ ID NO: 9195631 - DNA, 22 bp, Homo sapiens
aaatcagacttgaattttcatc

SEQ ID NO: 9195632 - DNA, 22 bp, Homo sapiens
aaatcagagaatatatttagaa

SEQ ID NO: 9195633 - DNA, 22 bp, Homo sapiens
aaatcagagtctgattttaagg

SEQ ID NO: 9195634 - DNA, 19 bp, Homo sapiens
aaatcagaatctgcatttt

SEQ ID NO: 9195635 - DNA, 22 bp, Homo sapiens
aaatcactgttattgatcttaa

SEQ ID NO: 9195636 - DNA, 21 bp, Homo sapiens
aaatcactgtccaatcttggt

SEQ ID NO: 9195637 - DNA, 22 bp, Homo sapiens
aaatcaaaagacatgtgtttta

SEQ ID NO: 9195638 - DNA, 22 bp, Homo sapiens
aaatgcaattgtatgtactcca

SEQ ID NO: 9195639 - DNA, 22 bp, Homo sapiens
aaatgcaagttcatattttgtt

SEQ ID NO: 9195640 - DNA, 22 bp, Homo sapiens
aaatgccagcacacgtctgtgg

SEQ ID NO: 9195641 - DNA, 22 bp, Homo sapiens
aagaagtggttggaagaagcat

SEQ ID NO: 9195642 - DNA, 22 bp, Homo sapiens
aagaaggtgtggaaagatgctc

SEQ ID NO: 9195643 - DNA, 22 bp, Homo sapiens
aaatacagattcttgtgtctat

SEQ ID NO: 9195644 - DNA, 19 bp, Homo sapiens
aaatacagcagctgtttcc

SEQ ID NO: 9195645 - DNA, 22 bp, Homo sapiens
aaatacataaaggttgtaccag

SEQ ID NO: 9195646 - DNA, 22 bp, Homo sapiens
aagagtttctgggtcaaggatt

SEQ ID NO: 9195647 - DNA, 22 bp, Homo sapiens
aacttccttctagttcatatgt

SEQ ID NO: 9195648 - DNA, 22 bp, Homo sapiens
aacttcctgacttctaatgagt

SEQ ID NO: 9195649 - DNA, 22 bp, Homo sapiens
aacttctgccaaacagctgtta

SEQ ID NO: 9195650 - DNA, 22 bp, Homo sapiens
aacttctgggctgtccaaaact

SEQ ID NO: 9195651 - DNA, 22 bp, Homo sapiens
aacttctggatgtttcaaatgt

SEQ ID NO: 9195652 - DNA, 22 bp, Homo sapiens
aacttctgcagaaaagtgcatg

SEQ ID NO: 9195653 - DNA, 22 bp, Homo sapiens
aacatgcaaagctatgatgtat

SEQ ID NO: 9195654 - DNA, 22 bp, Homo sapiens
aacatgatgacaaaggtatatt

SEQ ID NO: 9195655 - DNA, 22 bp, Homo sapiens
aaattccattttgtgactattc

SEQ ID NO: 9195656 - DNA, 22 bp, Homo sapiens
aaattccattatgataatttcg

SEQ ID NO: 9195657 - DNA, 22 bp, Homo sapiens
aaattcagcatcctgcactgga

SEQ ID NO: 9195658 - DNA, 22 bp, Homo sapiens
aaattcagtgttcttcccgtaa

SEQ ID NO: 9195659 - DNA, 22 bp, Homo sapiens
aaattcagatggctttcttttc

SEQ ID NO: 9195660 - DNA, 21 bp, Homo sapiens
aaagcatcacgaacatttggg

SEQ ID NO: 9195661 - DNA, 22 bp, Homo sapiens
aaagcatcagatctgacacttc

SEQ ID NO: 9195662 - DNA, 22 bp, Homo sapiens
aaaggaagtgccactcttcttc

SEQ ID NO: 9195663 - DNA, 22 bp, Homo sapiens
aaaggagaaaacatacaggact

SEQ ID NO: 9195664 - DNA, 22 bp, Homo sapiens
aaagttcattgatgactgaggt

SEQ ID NO: 9195665 - DNA, 22 bp, Homo sapiens
aaagtacaaggaaaggatctga

SEQ ID NO: 9195666 - DNA, 22 bp, Homo sapiens
aaagacagacggaaacctgagg

SEQ ID NO: 9195667 - DNA, 22 bp, Homo sapiens
aaacttattttatcacagttca

SEQ ID NO: 9195668 - DNA, 22 bp, Homo sapiens
aaatccagtttgtcatttccca

SEQ ID NO: 9195669 - DNA, 22 bp, Homo sapiens
aaatacagatagatttaaccca

SEQ ID NO: 9195670 - DNA, 21 bp, Homo sapiens
aaatacagaaacttgttttca

SEQ ID NO: 9195671 - DNA, 22 bp, Homo sapiens
aaaagattgttagggagaatgt

SEQ ID NO: 9195672 - DNA, 22 bp, Homo sapiens
aaaacagttataaacagagtca

SEQ ID NO: 9195673 - DNA, 22 bp, Homo sapiens
aaaacactgcctgcttgactga

SEQ ID NO: 9195674 - DNA, 22 bp, Homo sapiens
aaaacactgcaaagctgattgg

SEQ ID NO: 9195675 - DNA, 21 bp, Homo sapiens
aaaatgtgagcgtgatgctta

SEQ ID NO: 9195676 - DNA, 22 bp, Homo sapiens
aaaataacttctactatttgca

SEQ ID NO: 9195677 - DNA, 22 bp, Homo sapiens
aaaatacacatactaggggaaa

SEQ ID NO: 9195678 - DNA, 22 bp, Homo sapiens
aaaatgagatacagtttgaaag

SEQ ID NO: 9195679 - DNA, 22 bp, Homo sapiens
acaaatgaatcatacataatgt

SEQ ID NO: 9195680 - DNA, 22 bp, Homo sapiens
acaaatgactatttggtacagg

SEQ ID NO: 9195681 - DNA, 23 bp, Homo sapiens
aagaatctcagaattagaaatac

SEQ ID NO: 9195682 - DNA, 22 bp, Homo sapiens
aagaatctccatctgattcact

SEQ ID NO: 9195683 - DNA, 22 bp, Homo sapiens
aagaatcattgtaaagttctgt

SEQ ID NO: 9195684 - DNA, 22 bp, Homo sapiens
aagaacattgatattgtctatg

SEQ ID NO: 9195685 - DNA, 22 bp, Homo sapiens
aagaacttttggcaagtgttat

SEQ ID NO: 9195686 - DNA, 22 bp, Homo sapiens
acaatatagtccatgagcatgc

SEQ ID NO: 9195687 - DNA, 22 bp, Homo sapiens
acaaatttgtgtagttatggca

SEQ ID NO: 9195688 - DNA, 22 bp, Homo sapiens
acaaatttgaatcctgacttct

SEQ ID NO: 9195689 - DNA, 22 bp, Homo sapiens
acaaatttggtgagagtaaata

SEQ ID NO: 9195690 - DNA, 22 bp, Homo sapiens
acaaatttcataggcaaatttt

SEQ ID NO: 9195691 - DNA, 22 bp, Homo sapiens
acacagagccaaaccatatcac

SEQ ID NO: 9195692 - DNA, 22 bp, Homo sapiens
acacagagccagggaatacagt

SEQ ID NO: 9195693 - DNA, 22 bp, Homo sapiens
acacagcaacttgcagtatgga

SEQ ID NO: 9195694 - DNA, 22 bp, Homo sapiens
acacagcaacttgcagtatgga

SEQ ID NO: 9195695 - DNA, 22 bp, Homo sapiens
acacagcaaggtctgactttgg

SEQ ID NO: 9195696 - DNA, 20 bp, Homo sapiens
acacagactcagcttggatg

SEQ ID NO: 9195697 - DNA, 22 bp, Homo sapiens
aagccaggttccatggaggagc

SEQ ID NO: 9195698 - DNA, 22 bp, Homo sapiens
acagacatttaataaatgctga

SEQ ID NO: 9195699 - DNA, 22 bp, Homo sapiens
acagacatttaataaatgctga

SEQ ID NO: 9195700 - DNA, 23 bp, Homo sapiens
acagaaatcatttgtaaggtacc

SEQ ID NO: 9195701 - DNA, 22 bp, Homo sapiens
acactttaagcatttcacactg

SEQ ID NO: 9195702 - DNA, 22 bp, Homo sapiens
aaatggactgtgatatttacat

SEQ ID NO: 9195703 - DNA, 22 bp, Homo sapiens
aagtaatataattgttgttgtt

SEQ ID NO: 9195704 - DNA, 22 bp, Homo sapiens
aagtaaggcagtgaatgagatt

SEQ ID NO: 9195705 - DNA, 22 bp, Homo sapiens
aatgctgtcttttctacttcat

SEQ ID NO: 9195706 - DNA, 22 bp, Homo sapiens
aactttaaggctataaattatg

SEQ ID NO: 9195707 - DNA, 22 bp, Homo sapiens
aatgtaaagttgggcacaaatg

SEQ ID NO: 9195708 - DNA, 22 bp, Homo sapiens
aatctctctggggttcagtcct

SEQ ID NO: 9195709 - DNA, 22 bp, Homo sapiens
aatctctttggctcaaggatcc

SEQ ID NO: 9195710 - DNA, 22 bp, Homo sapiens
aataatgagcttgtctaattgt

SEQ ID NO: 9195711 - DNA, 22 bp, Homo sapiens
aatacagatgagcttctgcctc

SEQ ID NO: 9195712 - DNA, 19 bp, Homo sapiens
aatacagtgttatagaatt

SEQ ID NO: 9195713 - DNA, 22 bp, Homo sapiens
aatatttatgacaggaagtagc

SEQ ID NO: 9195714 - DNA, 19 bp, Homo sapiens
acaatagaaaagtcttttg

SEQ ID NO: 9195715 - DNA, 22 bp, Homo sapiens
agcacacagtattagccattgt

SEQ ID NO: 9195716 - DNA, 22 bp, Homo sapiens
agcacacaggccacctccactt

SEQ ID NO: 9195717 - DNA, 22 bp, Homo sapiens
agcacacagtattagccattgt

SEQ ID NO: 9195718 - DNA, 22 bp, Homo sapiens
agcacacaggacttgattcatg

SEQ ID NO: 9195719 - DNA, 22 bp, Homo sapiens
agcacacaggacttgattcatg

SEQ ID NO: 9195720 - DNA, 22 bp, Homo sapiens
agcacacatcacttctgctcat

SEQ ID NO: 9195721 - DNA, 22 bp, Homo sapiens
agcacacagtcttccttcctcc

SEQ ID NO: 9195722 - DNA, 22 bp, Homo sapiens
acaaagtgctgacattacaggc

SEQ ID NO: 9195723 - DNA, 22 bp, Homo sapiens
aatttctccagacagctgtgca

SEQ ID NO: 9195724 - DNA, 22 bp, Homo sapiens
aatttgacagcaatagaagatt

SEQ ID NO: 9195725 - DNA, 22 bp, Homo sapiens
aatttgatgagtttgtaagtct

SEQ ID NO: 9195726 - DNA, 22 bp, Homo sapiens
agagtgggttataggcagactt

SEQ ID NO: 9195727 - DNA, 20 bp, Homo sapiens
agagtgggtgtcacaggctg

SEQ ID NO: 9195728 - DNA, 18 bp, Homo sapiens
aatttccatatgaattgc

SEQ ID NO: 9195729 - DNA, 22 bp, Homo sapiens
agagctgcgtctattcacaatc

SEQ ID NO: 9195730 - DNA, 22 bp, Homo sapiens
aattaattttgttcattcagtc

SEQ ID NO: 9195731 - DNA, 21 bp, Homo sapiens
aattacagatggaattacaga

SEQ ID NO: 9195732 - DNA, 22 bp, Homo sapiens
agagatctgtggattcattgtc

SEQ ID NO: 9195733 - DNA, 22 bp, Homo sapiens
aatgtgtagcatttaatgcagt

SEQ ID NO: 9195734 - DNA, 22 bp, Homo sapiens
agctgagattatgctcttctca

SEQ ID NO: 9195735 - DNA, 22 bp, Homo sapiens
acagaaggacttgagaaagaca

SEQ ID NO: 9195736 - DNA, 22 bp, Homo sapiens
acagaacttccagggaacatac

SEQ ID NO: 9195737 - DNA, 22 bp, Homo sapiens
acagaactttctgatcctgagc

SEQ ID NO: 9195738 - DNA, 22 bp, Homo sapiens
agctaaatgttgcttaaaattt

SEQ ID NO: 9195739 - DNA, 22 bp, Homo sapiens
acacatcatgccaagtttcacc

SEQ ID NO: 9195740 - DNA, 22 bp, Homo sapiens
acacatcagaaatatgaatgag

SEQ ID NO: 9195741 - DNA, 18 bp, Homo sapiens
acacagtggatgcctggt

SEQ ID NO: 9195742 - DNA, 22 bp, Homo sapiens
acacaagattgtgtattgaatt

SEQ ID NO: 9195743 - DNA, 22 bp, Homo sapiens
aagtatatttagctgagcttgt

SEQ ID NO: 9195744 - DNA, 22 bp, Homo sapiens
acatttcagatgtaatgtgatg

SEQ ID NO: 9195745 - DNA, 22 bp, Homo sapiens
acatttcagattcatgaagtga

SEQ ID NO: 9195746 - DNA, 22 bp, Homo sapiens
acatttcagtaagtgttaattt

SEQ ID NO: 9195747 - DNA, 22 bp, Homo sapiens
aaggaaggtactcagtgattct

SEQ ID NO: 9195748 - DNA, 22 bp, Homo sapiens
aaggaagggaaatagtgatgtc

SEQ ID NO: 9195749 - DNA, 22 bp, Homo sapiens
aaggaaggaattgatcatgcgc

SEQ ID NO: 9195750 - DNA, 22 bp, Homo sapiens
aaggaattccctttctgacaga

SEQ ID NO: 9195751 - DNA, 22 bp, Homo sapiens
aaggaaggttcatagtcaaaga

SEQ ID NO: 9195752 - DNA, 22 bp, Homo sapiens
aaggacaatgaagacagccaca

SEQ ID NO: 9195753 - DNA, 22 bp, Homo sapiens
aaggatttttggaatgagatgg

SEQ ID NO: 9195754 - DNA, 23 bp, Homo sapiens
aaggatctctgagatcatggctt

SEQ ID NO: 9195755 - DNA, 22 bp, Homo sapiens
acatgcatggacatgtatatat

SEQ ID NO: 9195756 - DNA, 22 bp, Homo sapiens
acatgaagtggtcagatcaaac

SEQ ID NO: 9195757 - DNA, 22 bp, Homo sapiens
acatgaacactgcttgccacat

SEQ ID NO: 9195758 - DNA, 22 bp, Homo sapiens
aaggccagagcgtgtcctgcct

SEQ ID NO: 9195759 - DNA, 22 bp, Homo sapiens
aaggcaatttggaagaggcaga

SEQ ID NO: 9195760 - DNA, 22 bp, Homo sapiens
aatagcagtttttcactgatat

SEQ ID NO: 9195761 - DNA, 22 bp, Homo sapiens
aatagcacacttgtgagcatta

SEQ ID NO: 9195762 - DNA, 22 bp, Homo sapiens
aagtgttatgagtcaaggagct

SEQ ID NO: 9195763 - DNA, 22 bp, Homo sapiens
aagtgtctgcaaaatgacagag

SEQ ID NO: 9195764 - DNA, 22 bp, Homo sapiens
actgcatgataataatagcaga

SEQ ID NO: 9195765 - DNA, 22 bp, Homo sapiens
actgcatgtaaggcaatatgtt

SEQ ID NO: 9195766 - DNA, 18 bp, Homo sapiens
actctttctgcccacagg

SEQ ID NO: 9195767 - DNA, 23 bp, Homo sapiens
aatgccatattggatttcttcag

SEQ ID NO: 9195768 - DNA, 22 bp, Homo sapiens
agaaggaaacagctgtgctttg

SEQ ID NO: 9195769 - DNA, 22 bp, Homo sapiens
agaaggaaaacctgtcttatgt

SEQ ID NO: 9195770 - DNA, 22 bp, Homo sapiens
agaaggaaggctgagtgctgat

SEQ ID NO: 9195771 - DNA, 22 bp, Homo sapiens
agaaggaagccaggagggtgca

SEQ ID NO: 9195772 - DNA, 21 bp, Homo sapiens
agaactgattaaataagcagt

SEQ ID NO: 9195773 - DNA, 22 bp, Homo sapiens
agaacttaattcagtgacttaa

SEQ ID NO: 9195774 - DNA, 22 bp, Homo sapiens
aatgaagaaatggacatcttta

SEQ ID NO: 9195775 - DNA, 22 bp, Homo sapiens
acttttatcaaggaagtgatct

SEQ ID NO: 9195776 - DNA, 22 bp, Homo sapiens
tcactttggaagatagcacatc

SEQ ID NO: 9195777 - DNA, 22 bp, Homo sapiens
tcacttcttcccttgcacatat

SEQ ID NO: 9195778 - DNA, 22 bp, Homo sapiens
tcaccagatctctctgtaatgg

SEQ ID NO: 9195779 - DNA, 23 bp, Homo sapiens
tcaccagaaggggtcaataaaga

SEQ ID NO: 9195780 - DNA, 22 bp, Homo sapiens
tcagacatcgtaattacacaat

SEQ ID NO: 9195781 - DNA, 22 bp, Homo sapiens
tcagaaaagagaaaatcttata

SEQ ID NO: 9195782 - DNA, 22 bp, Homo sapiens
tcacaagatggctgctgcagcc

SEQ ID NO: 9195783 - DNA, 22 bp, Homo sapiens
tcacaaatagctatattaagga

SEQ ID NO: 9195784 - DNA, 22 bp, Homo sapiens
tcacaaaaggccatgtggcttc

SEQ ID NO: 9195785 - DNA, 20 bp, Homo sapiens
tcacacatggtaagctatga

SEQ ID NO: 9195786 - DNA, 22 bp, Homo sapiens
tcacaggctctccaccatgagg

SEQ ID NO: 9195787 - DNA, 22 bp, Homo sapiens
tcacaggctctagggattaaga

SEQ ID NO: 9195788 - DNA, 22 bp, Homo sapiens
tcacagaagttgaatttgcatg

SEQ ID NO: 9195789 - DNA, 22 bp, Homo sapiens
tcacagaataaattgagaagac

SEQ ID NO: 9195790 - DNA, 22 bp, Homo sapiens
tcaagaatttttaatgtgactg

SEQ ID NO: 9195791 - DNA, 22 bp, Homo sapiens
tatttcttcgggattcaagcta

SEQ ID NO: 9195792 - DNA, 22 bp, Homo sapiens
tcaagtatgacatcaagtttct

SEQ ID NO: 9195793 - DNA, 22 bp, Homo sapiens
tcaatttcccctattgatagac

SEQ ID NO: 9195794 - DNA, 22 bp, Homo sapiens
tcaatttcttggtttgataata

SEQ ID NO: 9195795 - DNA, 22 bp, Homo sapiens
tcagtgatttctggggtgaggg

SEQ ID NO: 9195796 - DNA, 22 bp, Homo sapiens
tcagtctctctatctgtaaaat

SEQ ID NO: 9195797 - DNA, 21 bp, Homo sapiens
tcagtaaaaaaactacctaga

SEQ ID NO: 9195798 - DNA, 22 bp, Homo sapiens
tcatggaaacagcaatgctaat

SEQ ID NO: 9195799 - DNA, 19 bp, Homo sapiens
tcatggaagaaatgtgata

SEQ ID NO: 9195800 - DNA, 20 bp, Homo sapiens
tcatggaatctcactctagt

SEQ ID NO: 9195801 - DNA, 22 bp, Homo sapiens
tcattatttgctttagttatgt

SEQ ID NO: 9195802 - DNA, 21 bp, Homo sapiens
tcatatttctcttgctattgt

SEQ ID NO: 9195803 - DNA, 22 bp, Homo sapiens
tcatgccaatttctgcatggct

SEQ ID NO: 9195804 - DNA, 22 bp, Homo sapiens
tcatgctctggtttagctgttt

SEQ ID NO: 9195805 - DNA, 22 bp, Homo sapiens
tcatatttaggcctttaattca

SEQ ID NO: 9195806 - DNA, 22 bp, Homo sapiens
tcatatttaggcctttaattca

SEQ ID NO: 9195807 - DNA, 22 bp, Homo sapiens
tcaggctgaggtcatctgcatc

SEQ ID NO: 9195808 - DNA, 22 bp, Homo sapiens
tcaggctgggctcctctcccca

SEQ ID NO: 9195809 - DNA, 22 bp, Homo sapiens
tcaggaagaaagaagggagtgt

SEQ ID NO: 9195810 - DNA, 22 bp, Homo sapiens
tcagcagaaaggcactagatga

SEQ ID NO: 9195811 - DNA, 22 bp, Homo sapiens
tcccagtgagatgaaacaggta

SEQ ID NO: 9195812 - DNA, 22 bp, Homo sapiens
tcccagtggtgggtgcacattt

SEQ ID NO: 9195813 - DNA, 19 bp, Homo sapiens
tcccagtggggagaggtgt

SEQ ID NO: 9195814 - DNA, 22 bp, Homo sapiens
tccccaatttgagtcacctctg

SEQ ID NO: 9195815 - DNA, 22 bp, Homo sapiens
tccatgcagagaactgaagtac

SEQ ID NO: 9195816 - DNA, 22 bp, Homo sapiens
tccatgcaaacagtggctagct

SEQ ID NO: 9195817 - DNA, 22 bp, Homo sapiens
tccatctcacctgcactctgcg

SEQ ID NO: 9195818 - DNA, 20 bp, Homo sapiens
tccatcttgggcagaagcag

SEQ ID NO: 9195819 - DNA, 22 bp, Homo sapiens
tccatgcagagtccaggcctca

SEQ ID NO: 9195820 - DNA, 22 bp, Homo sapiens
tccatgcagaggagctggtggc

SEQ ID NO: 9195821 - DNA, 21 bp, Homo sapiens
tccagctcctgccactcctta

SEQ ID NO: 9195822 - DNA, 22 bp, Homo sapiens
tccagcatgaaggggcttttat

SEQ ID NO: 9195823 - DNA, 22 bp, Homo sapiens
tccagcatatatagagaatgag

SEQ ID NO: 9195824 - DNA, 22 bp, Homo sapiens
tccagcatttttcaatagaatt

SEQ ID NO: 9195825 - DNA, 22 bp, Homo sapiens
tccagagatctctcttccctgt

SEQ ID NO: 9195826 - DNA, 22 bp, Homo sapiens
tccagaatactctgaaatcatt

SEQ ID NO: 9195827 - DNA, 22 bp, Homo sapiens
tccagaatactctgaaatcatt

SEQ ID NO: 9195828 - DNA, 22 bp, Homo sapiens
tcattgaatgctctgcaggttg

SEQ ID NO: 9195829 - DNA, 22 bp, Homo sapiens
tatgacagtttcgtaggggttg

SEQ ID NO: 9195830 - DNA, 22 bp, Homo sapiens
tataaattaatgtgcccatgag

SEQ ID NO: 9195831 - DNA, 22 bp, Homo sapiens
taggtctgtaccctgtccttct

SEQ ID NO: 9195832 - DNA, 22 bp, Homo sapiens
taggtctcctggcctagagatt

SEQ ID NO: 9195833 - DNA, 22 bp, Homo sapiens
tatacaatggctgaatcatcca

SEQ ID NO: 9195834 - DNA, 22 bp, Homo sapiens
tattctcagtgctataagtaga

SEQ ID NO: 9195835 - DNA, 22 bp, Homo sapiens
tatttatattctgccttctgct

SEQ ID NO: 9195836 - DNA, 22 bp, Homo sapiens
tatttataccaggtgatcggag

SEQ ID NO: 9195837 - DNA, 22 bp, Homo sapiens
tatttataatctgccaaagaga

SEQ ID NO: 9195838 - DNA, 22 bp, Homo sapiens
tagaaagtactaaatttaactg

SEQ ID NO: 9195839 - DNA, 22 bp, Homo sapiens
tagaaacatgttctgttctgtt

SEQ ID NO: 9195840 - DNA, 22 bp, Homo sapiens
taatagcattatcatcaaaact

SEQ ID NO: 9195841 - DNA, 22 bp, Homo sapiens
taattatagccgctattttgct

SEQ ID NO: 9195842 - DNA, 22 bp, Homo sapiens
taattatagccgctattttgct

SEQ ID NO: 9195843 - DNA, 22 bp, Homo sapiens
taataagtctgttgtttaattg

SEQ ID NO: 9195844 - DNA, 22 bp, Homo sapiens
taatacatcattcatctaagga

SEQ ID NO: 9195845 - DNA, 22 bp, Homo sapiens
taaggcagtagtgtctgtaggg

SEQ ID NO: 9195846 - DNA, 22 bp, Homo sapiens
taaggcaagaaactcctgtgta

SEQ ID NO: 9195847 - DNA, 22 bp, Homo sapiens
taaggcaagtttttagtggaca

SEQ ID NO: 9195848 - DNA, 22 bp, Homo sapiens
taaggctgggaattgctgagct

SEQ ID NO: 9195849 - DNA, 23 bp, Homo sapiens
tacagaaggagtagtcactaaga

SEQ ID NO: 9195850 - DNA, 22 bp, Homo sapiens
tacagtaagatgaaatagcaat

SEQ ID NO: 9195851 - DNA, 22 bp, Homo sapiens
tacagtaatctggacatgattt

SEQ ID NO: 9195852 - DNA, 22 bp, Homo sapiens
tacatacattacctcatttagt

SEQ ID NO: 9195853 - DNA, 22 bp, Homo sapiens
tacatttgcctccaccaaaggt

SEQ ID NO: 9195854 - DNA, 22 bp, Homo sapiens
tacattctggaaaggcacagac

SEQ ID NO: 9195855 - DNA, 22 bp, Homo sapiens
tacattctgaaataaatggttt

SEQ ID NO: 9195856 - DNA, 22 bp, Homo sapiens
gtttttattgtgtaaatgtggg

SEQ ID NO: 9195857 - DNA, 22 bp, Homo sapiens
taaaagttttagttgtacataa

SEQ ID NO: 9195858 - DNA, 22 bp, Homo sapiens
taaagggtaggttttactgtaa

SEQ ID NO: 9195859 - DNA, 22 bp, Homo sapiens
taaacactgccttggtgggtca

SEQ ID NO: 9195860 - DNA, 22 bp, Homo sapiens
taaacactcacttcatagccat

SEQ ID NO: 9195861 - DNA, 22 bp, Homo sapiens
taaattactcaatgcacataaa

SEQ ID NO: 9195862 - DNA, 20 bp, Homo sapiens
taaattagccttgaagatta

SEQ ID NO: 9195863 - DNA, 22 bp, Homo sapiens
taaattatgtcacatgactctg

SEQ ID NO: 9195864 - DNA, 22 bp, Homo sapiens
taaattcagtgagtaatttctg

SEQ ID NO: 9195865 - DNA, 22 bp, Homo sapiens
taaatttttgttaacagcctct

SEQ ID NO: 9195866 - DNA, 22 bp, Homo sapiens
taacctggggcggtttcccaat

SEQ ID NO: 9195867 - DNA, 22 bp, Homo sapiens
taactccattttacagagtagg

SEQ ID NO: 9195868 - DNA, 22 bp, Homo sapiens
gttaagaattcgttctcatgtt

SEQ ID NO: 9195869 - DNA, 22 bp, Homo sapiens
gttaagaatgcattatgcatat

SEQ ID NO: 9195870 - DNA, 22 bp, Homo sapiens
gttaagaatcaagacttatctt

SEQ ID NO: 9195871 - DNA, 22 bp, Homo sapiens
gttaagaagctagagatgaaca

SEQ ID NO: 9195872 - DNA, 22 bp, Homo sapiens
gttaaccatgatgttttaaaag

SEQ ID NO: 9195873 - DNA, 22 bp, Homo sapiens
gttcagatttgactggtttctc

SEQ ID NO: 9195874 - DNA, 22 bp, Homo sapiens
gttgccttcactggtcttggca

SEQ ID NO: 9195875 - DNA, 22 bp, Homo sapiens
gttgtaaatacagtactgaaac

SEQ ID NO: 9195876 - DNA, 22 bp, Homo sapiens
gggtggcactgataatgagacg

SEQ ID NO: 9195877 - DNA, 19 bp, Homo sapiens
ggtctcagtgcagctgcag

SEQ ID NO: 9195878 - DNA, 22 bp, Homo sapiens
ggtctctttgcttcagctacag

SEQ ID NO: 9195879 - DNA, 23 bp, Homo sapiens
gtatttcagcattctcagttaaa

SEQ ID NO: 9195880 - DNA, 22 bp, Homo sapiens
gtcattttgctgcatatttaga

SEQ ID NO: 9195881 - DNA, 22 bp, Homo sapiens
gtacatttctcccaacactaaa

SEQ ID NO: 9195882 - DNA, 22 bp, Homo sapiens
gtagaattacctctctatgtcc

SEQ ID NO: 9195883 - DNA, 22 bp, Homo sapiens
gtatttaattccattaagttag

SEQ ID NO: 9195884 - DNA, 22 bp, Homo sapiens
gtctgctgtgccttggggaaaa

SEQ ID NO: 9195885 - DNA, 22 bp, Homo sapiens
gtctgctgttcagagatgttgc

SEQ ID NO: 9195886 - DNA, 22 bp, Homo sapiens
gtctgctgacagagcatggacc

SEQ ID NO: 9195887 - DNA, 22 bp, Homo sapiens
gtgaaggactgaatgaaaatgt

SEQ ID NO: 9195888 - DNA, 22 bp, Homo sapiens
gtgaaaataaggctggttcttg

SEQ ID NO: 9195889 - DNA, 22 bp, Homo sapiens
ggcaaagttttcatctcataac

SEQ ID NO: 9195890 - DNA, 22 bp, Homo sapiens
ggcaaagagacatgcatcgggg

SEQ ID NO: 9195891 - DNA, 22 bp, Homo sapiens
ggcagtgaacagaaatgcagaa

SEQ ID NO: 9195892 - DNA, 22 bp, Homo sapiens
ggctgggctgcggctgtacctg

SEQ ID NO: 9195893 - DNA, 22 bp, Homo sapiens
ggctgggctgctgggtcagagc

SEQ ID NO: 9195894 - DNA, 22 bp, Homo sapiens
ggctgggcctctccctcagctg

SEQ ID NO: 9195895 - DNA, 22 bp, Homo sapiens
ggctgggccgcggctacccaga

SEQ ID NO: 9195896 - DNA, 19 bp, Homo sapiens
ggctgggccctgtttctcc

SEQ ID NO: 9195897 - DNA, 22 bp, Homo sapiens
ggctgggctccgggagcatgcg

SEQ ID NO: 9195898 - DNA, 22 bp, Homo sapiens
ggctgggctcgctgattggctg

SEQ ID NO: 9195899 - DNA, 22 bp, Homo sapiens
ggctgggcatccatccatgaga

SEQ ID NO: 9195900 - DNA, 22 bp, Homo sapiens
ggctgggccagggcctgtggac

SEQ ID NO: 9195901 - DNA, 22 bp, Homo sapiens
ggctgggcaaacaagactcttc

SEQ ID NO: 9195902 - DNA, 21 bp, Homo sapiens
ggctgggcaggacccacccct

SEQ ID NO: 9195903 - DNA, 22 bp, Homo sapiens
ggctgggcaggtctgcacaggg

SEQ ID NO: 9195904 - DNA, 22 bp, Homo sapiens
ggctgggcagcagctgttaagc

SEQ ID NO: 9195905 - DNA, 22 bp, Homo sapiens
ggctccaggagatgctgggcag

SEQ ID NO: 9195906 - DNA, 22 bp, Homo sapiens
ggctccagaaatcatagagcag

SEQ ID NO: 9195907 - DNA, 22 bp, Homo sapiens
ggctcttgaaatgtggctggcg

SEQ ID NO: 9195908 - DNA, 22 bp, Homo sapiens
ggctcttgggagctcagagttg

SEQ ID NO: 9195909 - DNA, 19 bp, Homo sapiens
gggcaaagtgatcgtcctg

SEQ ID NO: 9195910 - DNA, 22 bp, Homo sapiens
gggatggggtcgggaccctgct

SEQ ID NO: 9195911 - DNA, 22 bp, Homo sapiens
gggcaagaagctggaagcattc

SEQ ID NO: 9195912 - DNA, 22 bp, Homo sapiens
gggcaaagtggtggaggcagtt

SEQ ID NO: 9195913 - DNA, 22 bp, Homo sapiens
gggaatgtaatcatggaatgct

SEQ ID NO: 9195914 - DNA, 22 bp, Homo sapiens
gggaatgtgaaacagtaaggga

SEQ ID NO: 9195915 - DNA, 17 bp, Homo sapiens
gcttgccttgtcttcct

SEQ ID NO: 9195916 - DNA, 21 bp, Homo sapiens
gcttgcttggagtttaggagt

SEQ ID NO: 9195917 - DNA, 22 bp, Homo sapiens
gcttgctttgtaaatatctgtg

SEQ ID NO: 9195918 - DNA, 22 bp, Homo sapiens
ggagacagtatggcttgtagct

SEQ ID NO: 9195919 - DNA, 22 bp, Homo sapiens
gctgcctcaggcacctcctggc

SEQ ID NO: 9195920 - DNA, 22 bp, Homo sapiens
gctgcctccaatctgtgccccg

SEQ ID NO: 9195921 - DNA, 22 bp, Homo sapiens
gctgcccagtgtgctcatgcag

SEQ ID NO: 9195922 - DNA, 22 bp, Homo sapiens
gctgctacaacagaataccata

SEQ ID NO: 9195923 - DNA, 22 bp, Homo sapiens
gcgtctcaaggcccccaggcca

SEQ ID NO: 9195924 - DNA, 22 bp, Homo sapiens
gcgtctcaaggcccccaggcca

SEQ ID NO: 9195925 - DNA, 22 bp, Homo sapiens
gcctttggctctgtctgacctg

SEQ ID NO: 9195926 - DNA, 21 bp, Homo sapiens
gcctttggtttcttgtcctgc

SEQ ID NO: 9195927 - DNA, 22 bp, Homo sapiens
gctcccagaaccaaggctgggg

SEQ ID NO: 9195928 - DNA, 22 bp, Homo sapiens
gctcagcactttctccaaccac

SEQ ID NO: 9195929 - DNA, 22 bp, Homo sapiens
gctactgattgaccttggagag

SEQ ID NO: 9195930 - DNA, 22 bp, Homo sapiens
gcacagaacagagaaatagcca

SEQ ID NO: 9195931 - DNA, 22 bp, Homo sapiens
gcacacatgcatgtgtgcatcc

SEQ ID NO: 9195932 - DNA, 22 bp, Homo sapiens
gcacacatatatatgagcatgt

SEQ ID NO: 9195933 - DNA, 20 bp, Homo sapiens
gcacacatagaaatgcatat

SEQ ID NO: 9195934 - DNA, 22 bp, Homo sapiens
gcagagattgtaatgatacctg

SEQ ID NO: 9195935 - DNA, 22 bp, Homo sapiens
gcagactgtacactggactttg

SEQ ID NO: 9195936 - DNA, 22 bp, Homo sapiens
gcagcctccgcactgcgagtcc

SEQ ID NO: 9195937 - DNA, 22 bp, Homo sapiens
gcagcctcagggcactcagatg

SEQ ID NO: 9195938 - DNA, 22 bp, Homo sapiens
gcagcctctgatgatggccgta

SEQ ID NO: 9195939 - DNA, 22 bp, Homo sapiens
gcagcctcaaactccccagctc

SEQ ID NO: 9195940 - DNA, 20 bp, Homo sapiens
gcagcctcaacaggcacagc

SEQ ID NO: 9195941 - DNA, 22 bp, Homo sapiens
gcagtgggagcttaggcagtgc

SEQ ID NO: 9195942 - DNA, 22 bp, Homo sapiens
gcatgcagaaaatgaacaacga

SEQ ID NO: 9195943 - DNA, 22 bp, Homo sapiens
gcatgcagggagggtctggctg

SEQ ID NO: 9195944 - DNA, 22 bp, Homo sapiens
gcatgcaggataggttgagctc

SEQ ID NO: 9195945 - DNA, 22 bp, Homo sapiens
gcatgcaggagagaaagacggc

SEQ ID NO: 9195946 - DNA, 22 bp, Homo sapiens
gcatgcagacagtctgagacca

SEQ ID NO: 9195947 - DNA, 19 bp, Homo sapiens
gcatgcagagtaagaaggt

SEQ ID NO: 9195948 - DNA, 22 bp, Homo sapiens
gcatgcagagtccctctgcatt

SEQ ID NO: 9195949 - DNA, 22 bp, Homo sapiens
gcatgcagtaaaattcagcaac

SEQ ID NO: 9195950 - DNA, 22 bp, Homo sapiens
gcatgcagtaaaattcagcaac

SEQ ID NO: 9195951 - DNA, 22 bp, Homo sapiens
gcatgcagtcaaccagtaaggg

SEQ ID NO: 9195952 - DNA, 22 bp, Homo sapiens
gcatgcagtgcaattcaatgta

SEQ ID NO: 9195953 - DNA, 22 bp, Homo sapiens
gccccagcctcccgagtagctg

SEQ ID NO: 9195954 - DNA, 22 bp, Homo sapiens
ctgttgagtaatttatatcagg

SEQ ID NO: 9195955 - DNA, 22 bp, Homo sapiens
ctgttgcatcatggctcttaat

SEQ ID NO: 9195956 - DNA, 22 bp, Homo sapiens
ctgtgtctaatcttatacatca

SEQ ID NO: 9195957 - DNA, 21 bp, Homo sapiens
ctgtcctggtctagaggcaca

SEQ ID NO: 9195958 - DNA, 22 bp, Homo sapiens
ctgtcctgaagttttcatgaga

SEQ ID NO: 9195959 - DNA, 22 bp, Homo sapiens
cttgcacatttcacacaatagg

SEQ ID NO: 9195960 - DNA, 22 bp, Homo sapiens
cttcctgcatggagtctgaatg

SEQ ID NO: 9195961 - DNA, 22 bp, Homo sapiens
cttcctgcaacacctgtgttgc

SEQ ID NO: 9195962 - DNA, 22 bp, Homo sapiens
cttcctgcccacttcctgctgg

SEQ ID NO: 9195963 - DNA, 22 bp, Homo sapiens
cttgtagaattgaaatggtctc

SEQ ID NO: 9195964 - DNA, 22 bp, Homo sapiens
cttgcatgcatttgaagatcat

SEQ ID NO: 9195965 - DNA, 22 bp, Homo sapiens
cttccctttctggtgacttctc

SEQ ID NO: 9195966 - DNA, 22 bp, Homo sapiens
cttccctttttatgtcttcagc

SEQ ID NO: 9195967 - DNA, 22 bp, Homo sapiens
cttcctctgaggcttctgagtc

SEQ ID NO: 9195968 - DNA, 22 bp, Homo sapiens
cttcctgaaagtagtaggttga

SEQ ID NO: 9195969 - DNA, 22 bp, Homo sapiens
cttcctctgcctcccgtgctca

SEQ ID NO: 9195970 - DNA, 19 bp, Homo sapiens
ctgggccagagctgtcctc

SEQ ID NO: 9195971 - DNA, 22 bp, Homo sapiens
ctgggaggcagaggttgcagtg

SEQ ID NO: 9195972 - DNA, 21 bp, Homo sapiens
ctgccacctgctccatcagca

SEQ ID NO: 9195973 - DNA, 22 bp, Homo sapiens
ctgccaccatgccccagcagag

SEQ ID NO: 9195974 - DNA, 22 bp, Homo sapiens
ctgccagcactgcctcctgagg

SEQ ID NO: 9195975 - DNA, 22 bp, Homo sapiens
gaggcaatgggctatagcattg

SEQ ID NO: 9195976 - DNA, 22 bp, Homo sapiens
gagcctcctcctggtgtgccga

SEQ ID NO: 9195977 - DNA, 21 bp, Homo sapiens
gagcttgcaagcattatggga

SEQ ID NO: 9195978 - DNA, 22 bp, Homo sapiens
gagcttgcctagttttttaaac

SEQ ID NO: 9195979 - DNA, 22 bp, Homo sapiens
gagatggaaaactgctggtagt

SEQ ID NO: 9195980 - DNA, 22 bp, Homo sapiens
gagatggagtctttttctgtca

SEQ ID NO: 9195981 - DNA, 22 bp, Homo sapiens
gacctcatgatccacctgcctt

SEQ ID NO: 9195982 - DNA, 22 bp, Homo sapiens
ctttcacagcttgaaaagtatt

SEQ ID NO: 9195983 - DNA, 22 bp, Homo sapiens
ctttcacagcacaagcctgcct

SEQ ID NO: 9195984 - DNA, 22 bp, Homo sapiens
ctttcacacacatacatttgga

SEQ ID NO: 9195985 - DNA, 22 bp, Homo sapiens
ctttcatagttaaaatagtttg

SEQ ID NO: 9195986 - DNA, 22 bp, Homo sapiens
gaaatcaggatgatgttccaga

SEQ ID NO: 9195987 - DNA, 22 bp, Homo sapiens
gaaatgcagattctgattctgt

SEQ ID NO: 9195988 - DNA, 22 bp, Homo sapiens
gaagccagcagtggagaaagga

SEQ ID NO: 9195989 - DNA, 22 bp, Homo sapiens
gacagggaaacattgaagtgtc

SEQ ID NO: 9195990 - DNA, 22 bp, Homo sapiens
gacacagaccaccaggccctgg

SEQ ID NO: 9195991 - DNA, 20 bp, Homo sapiens
gacaacatgcagaaagtata

SEQ ID NO: 9195992 - DNA, 22 bp, Homo sapiens
gaaggaagattctgttggaatc

SEQ ID NO: 9195993 - DNA, 22 bp, Homo sapiens
ttcatgaatgttccatgtgagt

SEQ ID NO: 9195994 - DNA, 22 bp, Homo sapiens
ttcacagaattgtcttgactgg

SEQ ID NO: 9195995 - DNA, 22 bp, Homo sapiens
ttcagatgtggctttgtcaggc

SEQ ID NO: 9195996 - DNA, 22 bp, Homo sapiens
ttaggaagtttcagaaaatgca

SEQ ID NO: 9195997 - DNA, 22 bp, Homo sapiens
ttaggcctttgattggggtgct

SEQ ID NO: 9195998 - DNA, 19 bp, Homo sapiens
ttcacaattatgaaattag

SEQ ID NO: 9195999 - DNA, 22 bp, Homo sapiens
ctagatttctagttcattatcc

SEQ ID NO: 9196000 - DNA, 22 bp, Homo sapiens
ctcacagagctcatactgggag

SEQ ID NO: 9196001 - DNA, 22 bp, Homo sapiens
ctcacagcagccagtctgcctt

SEQ ID NO: 9196002 - DNA, 22 bp, Homo sapiens
ctatttttctgtaccctaattt

SEQ ID NO: 9196003 - DNA, 22 bp, Homo sapiens
ctcaaaatccataaaatcaggt

SEQ ID NO: 9196004 - DNA, 22 bp, Homo sapiens
ctcaaaatccataaaatcaggt

SEQ ID NO: 9196005 - DNA, 22 bp, Homo sapiens
ctcaaaatggttaattttaata

SEQ ID NO: 9196006 - DNA, 22 bp, Homo sapiens
ctacttctgtggctctaagaga

SEQ ID NO: 9196007 - DNA, 22 bp, Homo sapiens
ctaccttcaagttcctccctct

SEQ ID NO: 9196008 - DNA, 22 bp, Homo sapiens
ttccaggaccaggaagagggga

SEQ ID NO: 9196009 - DNA, 22 bp, Homo sapiens
ttccaggagccacacaggggcg

SEQ ID NO: 9196010 - DNA, 22 bp, Homo sapiens
cctgggagtgtgccatctctgt

SEQ ID NO: 9196011 - DNA, 20 bp, Homo sapiens
tgtgtataaatatatgtttc

SEQ ID NO: 9196012 - DNA, 22 bp, Homo sapiens
tgtgtatatatgtgcacatgta

SEQ ID NO: 9196013 - DNA, 22 bp, Homo sapiens
tgtgtataggttgtgctaatag

SEQ ID NO: 9196014 - DNA, 22 bp, Homo sapiens
tgtgtatagatgcatgcatata

SEQ ID NO: 9196015 - DNA, 22 bp, Homo sapiens
tgtgtatacatacatacacacg

SEQ ID NO: 9196016 - DNA, 22 bp, Homo sapiens
tgtgtatgtgtatacactatat

SEQ ID NO: 9196017 - DNA, 23 bp, Homo sapiens
tgtgtatgtatctatgcataggt

SEQ ID NO: 9196018 - DNA, 22 bp, Homo sapiens
tgttacaggaaatagaattacc

SEQ ID NO: 9196019 - DNA, 22 bp, Homo sapiens
ccttcctggagcccatgcagat

SEQ ID NO: 9196020 - DNA, 17 bp, Homo sapiens
ccttcctcatctccttc

SEQ ID NO: 9196021 - DNA, 19 bp, Homo sapiens
ccttccccttcagcctctg

SEQ ID NO: 9196022 - DNA, 22 bp, Homo sapiens
ttagaatttctgctcactttga

SEQ ID NO: 9196023 - DNA, 22 bp, Homo sapiens
ccttccttcaagcacacatcta

SEQ ID NO: 9196024 - DNA, 22 bp, Homo sapiens
ccttccttgagaagcaattcct

SEQ ID NO: 9196025 - DNA, 22 bp, Homo sapiens
ccttccttgtctacaaaagctc

SEQ ID NO: 9196026 - DNA, 22 bp, Homo sapiens
ccttcctttcagggctatgcct

SEQ ID NO: 9196027 - DNA, 22 bp, Homo sapiens
ccttcctttgcaggtcaggtca

SEQ ID NO: 9196028 - DNA, 22 bp, Homo sapiens
ccttcctttgcatcatttctag

SEQ ID NO: 9196029 - DNA, 22 bp, Homo sapiens
ccttccttttactgtctccgga

SEQ ID NO: 9196030 - DNA, 22 bp, Homo sapiens
cctgtctgtttgcccattcttg

SEQ ID NO: 9196031 - DNA, 22 bp, Homo sapiens
cctgtctgttctgactggtcag

SEQ ID NO: 9196032 - DNA, 23 bp, Homo sapiens
cctgtctgtgctgggtggacaca

SEQ ID NO: 9196033 - DNA, 22 bp, Homo sapiens
cctgtctggaacatggcctgtt

SEQ ID NO: 9196034 - DNA, 18 bp, Homo sapiens
cctgtctggggtccccac

SEQ ID NO: 9196035 - DNA, 22 bp, Homo sapiens
cctgtctggggactccctgggt

SEQ ID NO: 9196036 - DNA, 22 bp, Homo sapiens
cctgtctgtattattcaccact

SEQ ID NO: 9196037 - DNA, 22 bp, Homo sapiens
cctgtctgtatcggttcagagt

SEQ ID NO: 9196038 - DNA, 22 bp, Homo sapiens
cctgtctgtcctctcatgagcc

SEQ ID NO: 9196039 - DNA, 22 bp, Homo sapiens
cctgtctgcatgagtgagcata

SEQ ID NO: 9196040 - DNA, 22 bp, Homo sapiens
cctgtctgcagatatctcaggt

SEQ ID NO: 9196041 - DNA, 22 bp, Homo sapiens
cctgtctgcatgatccctgcca

SEQ ID NO: 9196042 - DNA, 22 bp, Homo sapiens
cctgtctgcggaggagtggaag

SEQ ID NO: 9196043 - DNA, 22 bp, Homo sapiens
cctgtctgaggaggtgctcttt

SEQ ID NO: 9196044 - DNA, 20 bp, Homo sapiens
cctgtctgcaatggaggtca

SEQ ID NO: 9196045 - DNA, 22 bp, Homo sapiens
ctccaccacacatctgtccacc

SEQ ID NO: 9196046 - DNA, 22 bp, Homo sapiens
ttgtacaacgttttaaatttga

SEQ ID NO: 9196047 - DNA, 22 bp, Homo sapiens
ctccagatgtatactttccaag

SEQ ID NO: 9196048 - DNA, 19 bp, Homo sapiens
ctccaagttaagagggagg

SEQ ID NO: 9196049 - DNA, 20 bp, Homo sapiens
ctccaaattcctgaggataa

SEQ ID NO: 9196050 - DNA, 22 bp, Homo sapiens
ctccaaatataatcacattgga

SEQ ID NO: 9196051 - DNA, 19 bp, Homo sapiens
ctccaaatacttttccctt

SEQ ID NO: 9196052 - DNA, 22 bp, Homo sapiens
ctccaaatacagtcatcttggg

SEQ ID NO: 9196053 - DNA, 22 bp, Homo sapiens
ctccagccagagtgcctctgtt

SEQ ID NO: 9196054 - DNA, 20 bp, Homo sapiens
ctccagcccctgccctggtc

SEQ ID NO: 9196055 - DNA, 22 bp, Homo sapiens
tttaatatccagtggatacaaa

SEQ ID NO: 9196056 - DNA, 22 bp, Homo sapiens
tttaacagatgctatgtctacc

SEQ ID NO: 9196057 - DNA, 22 bp, Homo sapiens
tttcaattgactttggaagaaa

SEQ ID NO: 9196058 - DNA, 21 bp, Homo sapiens
tttcacaaaagtatgtgacaa

SEQ ID NO: 9196059 - DNA, 22 bp, Homo sapiens
tttcacaaatgtctttaacttg

SEQ ID NO: 9196060 - DNA, 22 bp, Homo sapiens
tttcacaaagcatagcacttta

SEQ ID NO: 9196061 - DNA, 22 bp, Homo sapiens
tttcacaaactgaggagacaat

SEQ ID NO: 9196062 - DNA, 22 bp, Homo sapiens
tttcacataaatattatgccta

SEQ ID NO: 9196063 - DNA, 22 bp, Homo sapiens
tttcacatagaaagtgatttac

SEQ ID NO: 9196064 - DNA, 22 bp, Homo sapiens
tttcacagttagcatgaggact

SEQ ID NO: 9196065 - DNA, 22 bp, Homo sapiens
tttcacagtcaatttggagtca

SEQ ID NO: 9196066 - DNA, 22 bp, Homo sapiens
tttcacagtcaatttggagtca

SEQ ID NO: 9196067 - DNA, 22 bp, Homo sapiens
tttcctaggctctagagttcta

SEQ ID NO: 9196068 - DNA, 22 bp, Homo sapiens
ctctctgatgtcaggtcgctga

SEQ ID NO: 9196069 - DNA, 17 bp, Homo sapiens
ctctccttcctctgagg

SEQ ID NO: 9196070 - DNA, 22 bp, Homo sapiens
ctctccaggttagagcacttat

SEQ ID NO: 9196071 - DNA, 22 bp, Homo sapiens
tttcctcacttcatgagagttt

SEQ ID NO: 9196072 - DNA, 22 bp, Homo sapiens
tttatttaaagtcgtgtgttaa

SEQ ID NO: 9196073 - DNA, 22 bp, Homo sapiens
ctcctccagtgggtccctcagg

SEQ ID NO: 9196074 - DNA, 22 bp, Homo sapiens
ctcctccacagagtccttgcca

SEQ ID NO: 9196075 - DNA, 22 bp, Homo sapiens
tttaggcattgggtgctcaagt

SEQ ID NO: 9196076 - DNA, 22 bp, Homo sapiens
tttaggtgtgtttggattgaga

SEQ ID NO: 9196077 - DNA, 22 bp, Homo sapiens
ctccctcacaaagcattctctt

SEQ ID NO: 9196078 - DNA, 22 bp, Homo sapiens
ctccccattgtgacctcatcca

SEQ ID NO: 9196079 - DNA, 18 bp, Homo sapiens
ctgcacttcagcttgggc

SEQ ID NO: 9196080 - DNA, 22 bp, Homo sapiens
ctgactccaaagtttgggctct

SEQ ID NO: 9196081 - DNA, 22 bp, Homo sapiens
ctgactccctccccaaagctgg

SEQ ID NO: 9196082 - DNA, 22 bp, Homo sapiens
ctgactcccaagctagtgctct

SEQ ID NO: 9196083 - DNA, 22 bp, Homo sapiens
ctgactccttaccatatgcttt

SEQ ID NO: 9196084 - DNA, 18 bp, Homo sapiens
ctgactcctttgctgcca

SEQ ID NO: 9196085 - DNA, 22 bp, Homo sapiens
ctctttctcgccgcccgcagtc

SEQ ID NO: 9196086 - DNA, 22 bp, Homo sapiens
ctctttctcattgtcagcagaa

SEQ ID NO: 9196087 - DNA, 22 bp, Homo sapiens
ctcttccatattactcagggta

SEQ ID NO: 9196088 - DNA, 22 bp, Homo sapiens
ctcttagtttatctttgacaaa

SEQ ID NO: 9196089 - DNA, 22 bp, Homo sapiens
ctcttagtttgtaaaaataatt

SEQ ID NO: 9196090 - DNA, 22 bp, Homo sapiens
ctcttagttttttcctcatgaa

SEQ ID NO: 9196091 - DNA, 22 bp, Homo sapiens
ttttaatactgctattgtagga

SEQ ID NO: 9196092 - DNA, 22 bp, Homo sapiens
tacattgtgttaaaacagaaga

SEQ ID NO: 9196093 - DNA, 22 bp, Homo sapiens
tagattccattggcccagagaa

SEQ ID NO: 9196094 - DNA, 22 bp, Homo sapiens
caggctggagttcagtggtgtg

SEQ ID NO: 9196095 - DNA, 22 bp, Homo sapiens
caggctgccgaggctgcagaat

SEQ ID NO: 9196096 - DNA, 22 bp, Homo sapiens
caggctgggaacgccacccgct

SEQ ID NO: 9196097 - DNA, 22 bp, Homo sapiens
caggctgggactgacccctgct

SEQ ID NO: 9196098 - DNA, 22 bp, Homo sapiens
caggctggcaatgcgtcaagca

SEQ ID NO: 9196099 - DNA, 22 bp, Homo sapiens
taatccaaaactgaatctgtgg

SEQ ID NO: 9196100 - DNA, 22 bp, Homo sapiens
taatcagaagttacattagggt

SEQ ID NO: 9196101 - DNA, 22 bp, Homo sapiens
taatcacaattcagatgtctta

SEQ ID NO: 9196102 - DNA, 22 bp, Homo sapiens
caggcagatgctgacaagagtt

SEQ ID NO: 9196103 - DNA, 22 bp, Homo sapiens
caggcagatttgctgccctcca

SEQ ID NO: 9196104 - DNA, 22 bp, Homo sapiens
taatacagaagtgtattaaaat

SEQ ID NO: 9196105 - DNA, 22 bp, Homo sapiens
gtgcttccccaagccacagcct

SEQ ID NO: 9196106 - DNA, 22 bp, Homo sapiens
gtgcttcctgtattgattccat

SEQ ID NO: 9196107 - DNA, 22 bp, Homo sapiens
cagctatttatctttcatgata

SEQ ID NO: 9196108 - DNA, 22 bp, Homo sapiens
cagctattgttctgtataatga

SEQ ID NO: 9196109 - DNA, 22 bp, Homo sapiens
taagtattggcctatagctaga

SEQ ID NO: 9196110 - DNA, 22 bp, Homo sapiens
taggctgggcctgccttccagg

SEQ ID NO: 9196111 - DNA, 22 bp, Homo sapiens
tagatttgaatgatgtaaagag

SEQ ID NO: 9196112 - DNA, 22 bp, Homo sapiens
tagatttaagaccctgaatttg

SEQ ID NO: 9196113 - DNA, 22 bp, Homo sapiens
tagcttgcctctggctgcacgg

SEQ ID NO: 9196114 - DNA, 22 bp, Homo sapiens
cagtatttttaagctgctttgt

SEQ ID NO: 9196115 - DNA, 21 bp, Homo sapiens
cagtattttaagcagtgagtt

SEQ ID NO: 9196116 - DNA, 22 bp, Homo sapiens
tattttaaagactgccagccta

SEQ ID NO: 9196117 - DNA, 22 bp, Homo sapiens
tatttgaagattcttctgatgt

SEQ ID NO: 9196118 - DNA, 22 bp, Homo sapiens
tattttaaagtgaagggtcttg

SEQ ID NO: 9196119 - DNA, 22 bp, Homo sapiens
tcaatagataaagctacataaa

SEQ ID NO: 9196120 - DNA, 18 bp, Homo sapiens
tcaagccattctcctgcc

SEQ ID NO: 9196121 - DNA, 22 bp, Homo sapiens
tccttcctccatggtcttggtt

SEQ ID NO: 9196122 - DNA, 22 bp, Homo sapiens
tccttcctcggggacccagatc

SEQ ID NO: 9196123 - DNA, 22 bp, Homo sapiens
tccttcctgcaggccaagtcct

SEQ ID NO: 9196124 - DNA, 22 bp, Homo sapiens
tccttcctgctctaacattcag

SEQ ID NO: 9196125 - DNA, 22 bp, Homo sapiens
tctaagccaggactgagagacg

SEQ ID NO: 9196126 - DNA, 22 bp, Homo sapiens
ccagagaaccatctgcttgagg

SEQ ID NO: 9196127 - DNA, 22 bp, Homo sapiens
ccagagaatccggagagtccat

SEQ ID NO: 9196128 - DNA, 22 bp, Homo sapiens
ccaaggcttcccagagatgctc

SEQ ID NO: 9196129 - DNA, 22 bp, Homo sapiens
ccaaggctgtcattcagtagct

SEQ ID NO: 9196130 - DNA, 22 bp, Homo sapiens
tcctgggcttaagtgatcctcc

SEQ ID NO: 9196131 - DNA, 22 bp, Homo sapiens
cattcttctggatagttagttg

SEQ ID NO: 9196132 - DNA, 22 bp, Homo sapiens
cattacatctttgatgcagtat

SEQ ID NO: 9196133 - DNA, 22 bp, Homo sapiens
tccctcctgcatgaggctcggc

SEQ ID NO: 9196134 - DNA, 22 bp, Homo sapiens
catgcatgccgggctgacagag

SEQ ID NO: 9196135 - DNA, 22 bp, Homo sapiens
catgcatgccgggctgacagag

SEQ ID NO: 9196136 - DNA, 22 bp, Homo sapiens
catgaaggaccatttcacggtc

SEQ ID NO: 9196137 - DNA, 22 bp, Homo sapiens
catgaaggaataattgtttaga

SEQ ID NO: 9196138 - DNA, 22 bp, Homo sapiens
catgaatttatattattagtga

SEQ ID NO: 9196139 - DNA, 22 bp, Homo sapiens
catgcatgtttactacagtgac

SEQ ID NO: 9196140 - DNA, 22 bp, Homo sapiens
catgcatgtttactacagtgac

SEQ ID NO: 9196141 - DNA, 22 bp, Homo sapiens
tccaggagaaggccatccagcg

SEQ ID NO: 9196142 - DNA, 22 bp, Homo sapiens
tcagtccagctcctcatttccc

SEQ ID NO: 9196143 - DNA, 22 bp, Homo sapiens
catctgaagagctttgcaagag

SEQ ID NO: 9196144 - DNA, 22 bp, Homo sapiens
catctgaataaagacttgcaga

SEQ ID NO: 9196145 - DNA, 19 bp, Homo sapiens
catctgtaaggacagaaac

SEQ ID NO: 9196146 - DNA, 22 bp, Homo sapiens
catgaacatttgtttacatctg

SEQ ID NO: 9196147 - DNA, 22 bp, Homo sapiens
catgaaaataacattgttgtga

SEQ ID NO: 9196148 - DNA, 22 bp, Homo sapiens
tcaatcaatgtgtcagttccca

SEQ ID NO: 9196149 - DNA, 22 bp, Homo sapiens
cagttgcctactacatggcagg

SEQ ID NO: 9196150 - DNA, 22 bp, Homo sapiens
tcagatatgaattcatatctct

SEQ ID NO: 9196151 - DNA, 22 bp, Homo sapiens
tcagatgagtgctttcagctgc

SEQ ID NO: 9196152 - DNA, 22 bp, Homo sapiens
cagtttgtgctaggcactattt

SEQ ID NO: 9196153 - DNA, 18 bp, Homo sapiens
cataattttctttcttta

SEQ ID NO: 9196154 - DNA, 22 bp, Homo sapiens
catagaacagctcctagcacat

SEQ ID NO: 9196155 - DNA, 22 bp, Homo sapiens
tcaggctgtatatcttgcactc

SEQ ID NO: 9196156 - DNA, 22 bp, Homo sapiens
cccaggctagaaaggccaacaa

SEQ ID NO: 9196157 - DNA, 23 bp, Homo sapiens
cccaggctacaaattatgctctg

SEQ ID NO: 9196158 - DNA, 22 bp, Homo sapiens
tgccttcaagacccatcctcca

SEQ ID NO: 9196159 - DNA, 22 bp, Homo sapiens
cccaggctgggaacgattctag

SEQ ID NO: 9196160 - DNA, 22 bp, Homo sapiens
ccccacaactcatgttgaaact

SEQ ID NO: 9196161 - DNA, 22 bp, Homo sapiens
tgctggagcccaggcggccttt

SEQ ID NO: 9196162 - DNA, 22 bp, Homo sapiens
ccctgaccaccagctccatttg

SEQ ID NO: 9196163 - DNA, 22 bp, Homo sapiens
tggaatggaaacaaactgagga

SEQ ID NO: 9196164 - DNA, 22 bp, Homo sapiens
tggaatgtaaactctgtgaggg

SEQ ID NO: 9196165 - DNA, 22 bp, Homo sapiens
tggaatgtcataccataaaaga

SEQ ID NO: 9196166 - DNA, 22 bp, Homo sapiens
tgctgtgttactgagatccggc

SEQ ID NO: 9196167 - DNA, 22 bp, Homo sapiens
tgctgtgttcaccaatatgtgt

SEQ ID NO: 9196168 - DNA, 22 bp, Homo sapiens
tgctgtgttctcctgactcacc

SEQ ID NO: 9196169 - DNA, 22 bp, Homo sapiens
tgctgtgtggatgtgaagaatc

SEQ ID NO: 9196170 - DNA, 22 bp, Homo sapiens
tgctgtgtctttctgtgaaaag

SEQ ID NO: 9196171 - DNA, 22 bp, Homo sapiens
cctctgtggccctgactctctt

SEQ ID NO: 9196172 - DNA, 22 bp, Homo sapiens
cctcttcctcaccatctacaac

SEQ ID NO: 9196173 - DNA, 21 bp, Homo sapiens
cctgagcctgtttatccagaa

SEQ ID NO: 9196174 - DNA, 17 bp, Homo sapiens
cctcttcctctcagctg

SEQ ID NO: 9196175 - DNA, 22 bp, Homo sapiens
cccttcctcccaggcttctgtg

SEQ ID NO: 9196176 - DNA, 22 bp, Homo sapiens
cccttcctcaaggagctgtgtt

SEQ ID NO: 9196177 - DNA, 22 bp, Homo sapiens
cccttccttgattttaactgga

SEQ ID NO: 9196178 - DNA, 22 bp, Homo sapiens
cccttcctcctcgcctgtcaga

SEQ ID NO: 9196179 - DNA, 22 bp, Homo sapiens
ccctgcagccttgcatgccttc

SEQ ID NO: 9196180 - DNA, 22 bp, Homo sapiens
cctcatgttgctcgcatctgca

SEQ ID NO: 9196181 - DNA, 22 bp, Homo sapiens
cctcagtgagtgtttccttctt

SEQ ID NO: 9196182 - DNA, 22 bp, Homo sapiens
cctcagttttctcatctgtaaa

SEQ ID NO: 9196183 - DNA, 22 bp, Homo sapiens
cctcagctgtcttttccgaggt

SEQ ID NO: 9196184 - DNA, 17 bp, Homo sapiens
cctcagcttctttcctc

SEQ ID NO: 9196185 - DNA, 22 bp, Homo sapiens
ccaggacactgcttcacagcag

SEQ ID NO: 9196186 - DNA, 22 bp, Homo sapiens
tctgggagcctgaaagtgaatg

SEQ ID NO: 9196187 - DNA, 22 bp, Homo sapiens
ccagctctgcatgtttcccttg

SEQ ID NO: 9196188 - DNA, 22 bp, Homo sapiens
ccagctctgattttgacctcca

SEQ ID NO: 9196189 - DNA, 22 bp, Homo sapiens
tcttcagacttccggaaacgtg

SEQ ID NO: 9196190 - DNA, 22 bp, Homo sapiens
tcttccagtctgtaggactagg

SEQ ID NO: 9196191 - DNA, 22 bp, Homo sapiens
tcttcacgccaagtgcccctca

SEQ ID NO: 9196192 - DNA, 22 bp, Homo sapiens
tgagaatgaatcttttgctttc

SEQ ID NO: 9196193 - DNA, 22 bp, Homo sapiens
tgagaataacagcctgtgttcc

SEQ ID NO: 9196194 - DNA, 19 bp, Homo sapiens
tgacaatgggcacctgtgt

SEQ ID NO: 9196195 - DNA, 22 bp, Homo sapiens
tgacaatagcgatttatcttgc

SEQ ID NO: 9196196 - DNA, 22 bp, Homo sapiens
ccagtcctgggagcttgcactg

SEQ ID NO: 9196197 - DNA, 22 bp, Homo sapiens
ccagtctcgttgaggcgcttgt

SEQ ID NO: 9196198 - DNA, 22 bp, Homo sapiens
ccagtctcctaagagcccctga

SEQ ID NO: 9196199 - DNA, 20 bp, Homo sapiens
ccagtctctggccagcatca

SEQ ID NO: 9196200 - DNA, 22 bp, Homo sapiens
ccagtctcttccctcctgccag

SEQ ID NO: 9196201 - DNA, 23 bp, Homo sapiens
ccagtctcacgtatacaggattt

SEQ ID NO: 9196202 - DNA, 22 bp, Homo sapiens
ccagtctcagttcacgttggta

SEQ ID NO: 9196203 - DNA, 19 bp, Homo sapiens
ccagtctccttgcagcatc

SEQ ID NO: 9196204 - DNA, 20 bp, Homo sapiens
ccagtccctgagcaccaggg

SEQ ID NO: 9196205 - DNA, 22 bp, Homo sapiens
ccatgcatataatagtgcctgg

SEQ ID NO: 9196206 - DNA, 22 bp, Homo sapiens
ccatgctgaccctgtgcaggca

SEQ ID NO: 9196207 - DNA, 22 bp, Homo sapiens
ccatgctgtgacacagtagtta

SEQ ID NO: 9196208 - DNA, 22 bp, Homo sapiens
ccatgcccttgtcatctccagg

SEQ ID NO: 9196209 - DNA, 22 bp, Homo sapiens
tgcacacattctatggggctga

SEQ ID NO: 9196210 - DNA, 22 bp, Homo sapiens
tgcacacattaaggatacacag

SEQ ID NO: 9196211 - DNA, 22 bp, Homo sapiens
tgcacacatgtttacaagcatc

SEQ ID NO: 9196212 - DNA, 22 bp, Homo sapiens
tgcacacatgtatgtatatgtg

SEQ ID NO: 9196213 - DNA, 22 bp, Homo sapiens
tgcacacatatgagcatgtgtg

SEQ ID NO: 9196214 - DNA, 22 bp, Homo sapiens
tgcaaatattccatgctgttca

SEQ ID NO: 9196215 - DNA, 22 bp, Homo sapiens
ccattctgagtcttatgtcttt

SEQ ID NO: 9196216 - DNA, 22 bp, Homo sapiens
ccattctgacttcattgcctca

SEQ ID NO: 9196217 - DNA, 22 bp, Homo sapiens
ccattctgacacctaattctgt

SEQ ID NO: 9196218 - DNA, 22 bp, Homo sapiens
ccattctgaagtgcaggctaag

SEQ ID NO: 9196219 - DNA, 22 bp, Homo sapiens
ccattctgaacaattcttgtct

SEQ ID NO: 9196220 - DNA, 22 bp, Homo sapiens
ccattctgtccagaggaggaag

SEQ ID NO: 9196221 - DNA, 23 bp, Homo sapiens
tgattttaaaaagtaagttatca

SEQ ID NO: 9196222 - DNA, 20 bp, Homo sapiens
tttctgtgcccaggtctgtt

SEQ ID NO: 9196223 - DNA, 22 bp, Homo sapiens
tttctgtaggggatatctttga

SEQ ID NO: 9196224 - DNA, 22 bp, Homo sapiens
tttctgtatttaaaagatctgg

SEQ ID NO: 9196225 - DNA, 22 bp, Homo sapiens
tttcttcatagaccttgtcttg

SEQ ID NO: 9196226 - DNA, 22 bp, Homo sapiens
tttcttcagagagagctttccc

SEQ ID NO: 9196227 - DNA, 22 bp, Homo sapiens
tttcttctaagatttcaaacta

SEQ ID NO: 9196228 - DNA, 21 bp, Homo sapiens
tttcttcccttggcttctgag

SEQ ID NO: 9196229 - DNA, 22 bp, Homo sapiens
tttctgacttttatatgcatat

SEQ ID NO: 9196230 - DNA, 20 bp, Homo sapiens
tttctgtagctcagtattca

SEQ ID NO: 9196231 - DNA, 22 bp, Homo sapiens
tttctgtagggatttcacagtt

SEQ ID NO: 9196232 - DNA, 22 bp, Homo sapiens
tttctgtacacccactattcat

SEQ ID NO: 9196233 - DNA, 22 bp, Homo sapiens
tttctcttgcgatatgctacac

SEQ ID NO: 9196234 - DNA, 22 bp, Homo sapiens
tttctcagtgtagcttttcaag

SEQ ID NO: 9196235 - DNA, 22 bp, Homo sapiens
tttctcagggaggagtcaagcc

SEQ ID NO: 9196236 - DNA, 22 bp, Homo sapiens
tttctactttggaatgcactga

SEQ ID NO: 9196237 - DNA, 22 bp, Homo sapiens
tttctcatttagagtggcaggg

SEQ ID NO: 9196238 - DNA, 22 bp, Homo sapiens
tttctaatgttctcagggattg

SEQ ID NO: 9196239 - DNA, 22 bp, Homo sapiens
tttccttcatcatctgagagct

SEQ ID NO: 9196240 - DNA, 22 bp, Homo sapiens
tttccttccaaatgcccgggag

SEQ ID NO: 9196241 - DNA, 22 bp, Homo sapiens
tttccttccatgttgggcaaaa

SEQ ID NO: 9196242 - DNA, 22 bp, Homo sapiens
tttccttccaggttcctaaggc

SEQ ID NO: 9196243 - DNA, 22 bp, Homo sapiens
tttccttcctaaggtgaagcaa

SEQ ID NO: 9196244 - DNA, 22 bp, Homo sapiens
tttccttccctggatgagaagt

SEQ ID NO: 9196245 - DNA, 22 bp, Homo sapiens
tttccttccttgctagcctgag

SEQ ID NO: 9196246 - DNA, 22 bp, Homo sapiens
tttccttctcagggagcttcaa

SEQ ID NO: 9196247 - DNA, 22 bp, Homo sapiens
tttcaaagacagccatatttgt

SEQ ID NO: 9196248 - DNA, 22 bp, Homo sapiens
tttcaaagaccattaactatca

SEQ ID NO: 9196249 - DNA, 22 bp, Homo sapiens
tttcaaagagttgtaaattact

SEQ ID NO: 9196250 - DNA, 22 bp, Homo sapiens
tttcagatcattttttaagtac

SEQ ID NO: 9196251 - DNA, 22 bp, Homo sapiens
tttcattgtcatctatcttaga

SEQ ID NO: 9196252 - DNA, 22 bp, Homo sapiens
ttggtttgttcaccatcaagca

SEQ ID NO: 9196253 - DNA, 22 bp, Homo sapiens
ttggttcagtaggcatgcctgg

SEQ ID NO: 9196254 - DNA, 23 bp, Homo sapiens
ttgtaaaacagtgtgacggttcc

SEQ ID NO: 9196255 - DNA, 22 bp, Homo sapiens
ttgtccttcttcattcagtccc

SEQ ID NO: 9196256 - DNA, 22 bp, Homo sapiens
ttgtctctgtgtggcttcccta

SEQ ID NO: 9196257 - DNA, 22 bp, Homo sapiens
ttgcaaattcgtcactgttaaa

SEQ ID NO: 9196258 - DNA, 23 bp, Homo sapiens
ttgcaaatttcagttagttcatg

SEQ ID NO: 9196259 - DNA, 22 bp, Homo sapiens
ttgtgttttcttatggcataaa

SEQ ID NO: 9196260 - DNA, 22 bp, Homo sapiens
ttgtttaaagaacttctgactt

SEQ ID NO: 9196261 - DNA, 22 bp, Homo sapiens
ttgtttcattttggctaaactg

SEQ ID NO: 9196262 - DNA, 22 bp, Homo sapiens
ttgtgtttctggccaagatgga

SEQ ID NO: 9196263 - DNA, 22 bp, Homo sapiens
ttgtgtttctgtgatatgtaaa

SEQ ID NO: 9196264 - DNA, 22 bp, Homo sapiens
ttgtttgaataacagacaaatt

SEQ ID NO: 9196265 - DNA, 22 bp, Homo sapiens
ttgttttattctgcaatttccc

SEQ ID NO: 9196266 - DNA, 22 bp, Homo sapiens
tttattaagatgcgaatgctga

SEQ ID NO: 9196267 - DNA, 23 bp, Homo sapiens
tttatagcagcatgatttataat

SEQ ID NO: 9196268 - DNA, 23 bp, Homo sapiens
tttatagcagcatgatttatagt

SEQ ID NO: 9196269 - DNA, 22 bp, Homo sapiens
tttagttttgatgaaaatgcca

SEQ ID NO: 9196270 - DNA, 22 bp, Homo sapiens
tttatagatgtctgtattataa

SEQ ID NO: 9196271 - DNA, 22 bp, Homo sapiens
tttactaacaccatacatgctg

SEQ ID NO: 9196272 - DNA, 22 bp, Homo sapiens
tttacaaggcagaactgattaa

SEQ ID NO: 9196273 - DNA, 22 bp, Homo sapiens
tttactttctcaagtatatagg

SEQ ID NO: 9196274 - DNA, 22 bp, Homo sapiens
tttactgtgtaaggggaatgtt

SEQ ID NO: 9196275 - DNA, 22 bp, Homo sapiens
tttactgtctcagagagacaaa

SEQ ID NO: 9196276 - DNA, 22 bp, Homo sapiens
tttactgtttacagctaatgca

SEQ ID NO: 9196277 - DNA, 22 bp, Homo sapiens
tttaaaatcagatgggagttgg

SEQ ID NO: 9196278 - DNA, 22 bp, Homo sapiens
ttttggcaaagagatagcatga

SEQ ID NO: 9196279 - DNA, 21 bp, Homo sapiens
ttttggcaaggtgcatgtttc

SEQ ID NO: 9196280 - DNA, 23 bp, Homo sapiens
ttttgacaggaggaaggtgttga

SEQ ID NO: 9196281 - DNA, 22 bp, Homo sapiens
ttttgaagaagatgggaattta

SEQ ID NO: 9196282 - DNA, 22 bp, Homo sapiens
tttttgaaggctgatgtgatta

SEQ ID NO: 9196283 - DNA, 22 bp, Homo sapiens
tttgattttcagcaatagtggc

SEQ ID NO: 9196284 - DNA, 22 bp, Homo sapiens
tttgcagtcaaatttgctaaat

SEQ ID NO: 9196285 - DNA, 22 bp, Homo sapiens
tttgtagagaatgttaagcact

SEQ ID NO: 9196286 - DNA, 22 bp, Homo sapiens
tttgtttctgcaatacctatag

SEQ ID NO: 9196287 - DNA, 22 bp, Homo sapiens
ttttataaagagagtcagttgg

SEQ ID NO: 9196288 - DNA, 22 bp, Homo sapiens
ttttatagctgaatagtattcc

SEQ ID NO: 9196289 - DNA, 22 bp, Homo sapiens
ttaaatgatgcatatcatttag

SEQ ID NO: 9196290 - DNA, 22 bp, Homo sapiens
ttaaatgaacgagatatgcaac

SEQ ID NO: 9196291 - DNA, 22 bp, Homo sapiens
ttaaattaggactctagttctg

SEQ ID NO: 9196292 - DNA, 22 bp, Homo sapiens
ttaaattagtcaagcttctctg

SEQ ID NO: 9196293 - DNA, 22 bp, Homo sapiens
ttaacaaagtaacgggaaaaga

SEQ ID NO: 9196294 - DNA, 22 bp, Homo sapiens
ttaaagcatcctgtcagtctgt

SEQ ID NO: 9196295 - DNA, 22 bp, Homo sapiens
ttaataaagtatgaattggaaa

SEQ ID NO: 9196296 - DNA, 22 bp, Homo sapiens
ttaagtaagaccttatgtcttg

SEQ ID NO: 9196297 - DNA, 22 bp, Homo sapiens
ttaaggaaggtgaatttcttgg

SEQ ID NO: 9196298 - DNA, 22 bp, Homo sapiens
ttaagaatgtgccttttggttg

SEQ ID NO: 9196299 - DNA, 22 bp, Homo sapiens
ttaacattaaaagcagcatttt

SEQ ID NO: 9196300 - DNA, 22 bp, Homo sapiens
ttaacatgtcttgacttcatct

SEQ ID NO: 9196301 - DNA, 22 bp, Homo sapiens
ttaaccaggtcctttgaaaaca

SEQ ID NO: 9196302 - DNA, 22 bp, Homo sapiens
ttacaggattctttggatatgc

SEQ ID NO: 9196303 - DNA, 22 bp, Homo sapiens
ttacatcagcaagagtgtatgt

SEQ ID NO: 9196304 - DNA, 22 bp, Homo sapiens
ttactgtagcttgacatatgtc

SEQ ID NO: 9196305 - DNA, 22 bp, Homo sapiens
ttaccaaatcccgtgcacattc

SEQ ID NO: 9196306 - DNA, 22 bp, Homo sapiens
ttactgttggttggtaagagtt

SEQ ID NO: 9196307 - DNA, 20 bp, Homo sapiens
ttagaagggccagatgaagg

SEQ ID NO: 9196308 - DNA, 22 bp, Homo sapiens
ttagagagaaccatcaggatct

SEQ ID NO: 9196309 - DNA, 22 bp, Homo sapiens
tgtgtttagagagcacattcag

SEQ ID NO: 9196310 - DNA, 22 bp, Homo sapiens
tgttatttatttcacctccaga

SEQ ID NO: 9196311 - DNA, 22 bp, Homo sapiens
tgttcacaagatgtctgtggct

SEQ ID NO: 9196312 - DNA, 22 bp, Homo sapiens
tgttcaaatcttttgcttattt

SEQ ID NO: 9196313 - DNA, 22 bp, Homo sapiens
tgtttcatgaaacatgtttagg

SEQ ID NO: 9196314 - DNA, 22 bp, Homo sapiens
tgtttcatgtggacatagttgt

SEQ ID NO: 9196315 - DNA, 22 bp, Homo sapiens
tgtttccaaagtcttttcttaa

SEQ ID NO: 9196316 - DNA, 22 bp, Homo sapiens
tgtttactagccaacatggaga

SEQ ID NO: 9196317 - DNA, 22 bp, Homo sapiens
tgttttcacaatgatgtcagat

SEQ ID NO: 9196318 - DNA, 22 bp, Homo sapiens
tgttttcaagtcaaggccaaat

SEQ ID NO: 9196319 - DNA, 22 bp, Homo sapiens
tgtttaatctataaaatggaga

SEQ ID NO: 9196320 - DNA, 22 bp, Homo sapiens
tgtttaatcttcaggacagtct

SEQ ID NO: 9196321 - DNA, 22 bp, Homo sapiens
tgtgtgaacatgttttcatttc

SEQ ID NO: 9196322 - DNA, 22 bp, Homo sapiens
tgtgtgaatggattattctatt

SEQ ID NO: 9196323 - DNA, 22 bp, Homo sapiens
tgtgtgaaggagccactgttca

SEQ ID NO: 9196324 - DNA, 22 bp, Homo sapiens
tgtgtgaagtgattttaagtct

SEQ ID NO: 9196325 - DNA, 22 bp, Homo sapiens
tgtgtgaagggaagatagaggt

SEQ ID NO: 9196326 - DNA, 22 bp, Homo sapiens
tgtgtgaatagcagtggctggt

SEQ ID NO: 9196327 - DNA, 22 bp, Homo sapiens
tgtgtgaatctattgaatatat

SEQ ID NO: 9196328 - DNA, 22 bp, Homo sapiens
tgtgtgaactctctgatgtaca

SEQ ID NO: 9196329 - DNA, 22 bp, Homo sapiens
tgtgtgaagcacatgttcaagg

SEQ ID NO: 9196330 - DNA, 20 bp, Homo sapiens
tgtgtgaacacggactctgt

SEQ ID NO: 9196331 - DNA, 22 bp, Homo sapiens
tgtgtgaagcactctgggtgat

SEQ ID NO: 9196332 - DNA, 22 bp, Homo sapiens
tgtgtgaaggaatatatactca

SEQ ID NO: 9196333 - DNA, 22 bp, Homo sapiens
tgtgtgcaagtgacattagaaa

SEQ ID NO: 9196334 - DNA, 20 bp, Homo sapiens
tgtgtgaattagggcatgtt

SEQ ID NO: 9196335 - DNA, 22 bp, Homo sapiens
tgtgtgaattacgcgtgtcctg

SEQ ID NO: 9196336 - DNA, 22 bp, Homo sapiens
tgtgtgaattctgagcagttta

SEQ ID NO: 9196337 - DNA, 20 bp, Homo sapiens
tgtgtgaatttcagagccgc

SEQ ID NO: 9196338 - DNA, 22 bp, Homo sapiens
tgtggtggggtctggtattcca

SEQ ID NO: 9196339 - DNA, 22 bp, Homo sapiens
tgtgtaaatggactgtgaatta

SEQ ID NO: 9196340 - DNA, 22 bp, Homo sapiens
tgtggacagagcagaaggtcat

SEQ ID NO: 9196341 - DNA, 22 bp, Homo sapiens
tccccctcattacctcattcaa

SEQ ID NO: 9196342 - DNA, 21 bp, Homo sapiens
tccccagtgccctctctaaga

SEQ ID NO: 9196343 - DNA, 22 bp, Homo sapiens
tgtggagtggtctgaaggctcc

SEQ ID NO: 9196344 - DNA, 22 bp, Homo sapiens
tgtggcacttctctccttgtaa

SEQ ID NO: 9196345 - DNA, 22 bp, Homo sapiens
tgtggcacatacacaggagggc

SEQ ID NO: 9196346 - DNA, 22 bp, Homo sapiens
tgtggcacagaagaaagagagg

SEQ ID NO: 9196347 - DNA, 19 bp, Homo sapiens
ttctttccacatcttctct

SEQ ID NO: 9196348 - DNA, 22 bp, Homo sapiens
ttctttattgagacttcattgt

SEQ ID NO: 9196349 - DNA, 22 bp, Homo sapiens
ttctttatgttaatgaatctat

SEQ ID NO: 9196350 - DNA, 22 bp, Homo sapiens
ttctttcctcccagcctttgga

SEQ ID NO: 9196351 - DNA, 22 bp, Homo sapiens
ttgagatggagtctcactctgt

SEQ ID NO: 9196352 - DNA, 22 bp, Homo sapiens
ttgagatggagcttcactcttg

SEQ ID NO: 9196353 - DNA, 22 bp, Homo sapiens
ttgattctggtgactgatggaa

SEQ ID NO: 9196354 - DNA, 20 bp, Homo sapiens
ttgattcaagggctgatgga

SEQ ID NO: 9196355 - DNA, 21 bp, Homo sapiens
ttgattttaggaagtttgtca

SEQ ID NO: 9196356 - DNA, 22 bp, Homo sapiens
ttgattttaaaatagtgacact

SEQ ID NO: 9196357 - DNA, 22 bp, Homo sapiens
ttgcaaagtgtcatgcaaagta

SEQ ID NO: 9196358 - DNA, 22 bp, Homo sapiens
ttgcaaataaacaagtatacat

SEQ ID NO: 9196359 - DNA, 22 bp, Homo sapiens
ttgatttgtaggaatggagacc

SEQ ID NO: 9196360 - DNA, 22 bp, Homo sapiens
ttgcaaatgtgaataattacac

SEQ ID NO: 9196361 - DNA, 20 bp, Homo sapiens
ttgcaaatatctattgattg

SEQ ID NO: 9196362 - DNA, 19 bp, Homo sapiens
ttctggtctggaatcaagg

SEQ ID NO: 9196363 - DNA, 22 bp, Homo sapiens
ttctggtcaatggcctgtaagt

SEQ ID NO: 9196364 - DNA, 20 bp, Homo sapiens
ttctatacatatcactgaaa

SEQ ID NO: 9196365 - DNA, 20 bp, Homo sapiens
ttctatacatatcactgaaa

SEQ ID NO: 9196366 - DNA, 22 bp, Homo sapiens
ttctgaagggctaagtgtctat

SEQ ID NO: 9196367 - DNA, 22 bp, Homo sapiens
ttctgctgtttgtagtaatgta

SEQ ID NO: 9196368 - DNA, 22 bp, Homo sapiens
ttctgctgtagttgcatctgtt

SEQ ID NO: 9196369 - DNA, 22 bp, Homo sapiens
ttctgctggtgttttgtgaggc

SEQ ID NO: 9196370 - DNA, 22 bp, Homo sapiens
ttctgctgcctactcctgggga

SEQ ID NO: 9196371 - DNA, 22 bp, Homo sapiens
ttctgctgaaaacagccatgta

SEQ ID NO: 9196372 - DNA, 22 bp, Homo sapiens
ttcaacaattaagtatcagcct

SEQ ID NO: 9196373 - DNA, 22 bp, Homo sapiens
ttcaacaagtcttttttcactg

SEQ ID NO: 9196374 - DNA, 22 bp, Homo sapiens
ttcacaaagctggagcatttcc

SEQ ID NO: 9196375 - DNA, 22 bp, Homo sapiens
ttcacaaagctggttccttctg

SEQ ID NO: 9196376 - DNA, 22 bp, Homo sapiens
ttcacaagtcattagctgcata
